United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 91

SEQ ID NO: 3242753 - RNA, 20 nt, Mycobacterium tuberculosis H37Rv
auuggaugccauaggacagg

SEQ ID NO: 3242754 - RNA, 14 nt, Mycobacterium tuberculosis H37Rv
auuggcgaucagca

SEQ ID NO: 3242755 - RNA, 18 nt, Mycobacterium tuberculosis H37Rv
auuggcgaucagcagccg

SEQ ID NO: 3242756 - RNA, 14 nt, Mycobacterium tuberculosis H37Rv
auuggcgccgucac

SEQ ID NO: 3242757 - RNA, 21 nt, Mycobacterium tuberculosis H37Rv
auuggcgccgucaccgaucga

SEQ ID NO: 3242758 - RNA, 18 nt, Mycobacterium tuberculosis H37Rv
auuggcgucagcagcaac

SEQ ID NO: 3242759 - RNA, 14 nt, Mycobacterium tuberculosis H37Rv
auuggcucgagcaa

SEQ ID NO: 3242760 - RNA, 20 nt, Mycobacterium tuberculosis H37Rv
auugggcgauuuugcgucug

SEQ ID NO: 3242761 - RNA, 22 nt, Mycobacterium tuberculosis H37Rv
auugggcgauuuugcgucugcu

SEQ ID NO: 3242762 - RNA, 20 nt, Mycobacterium tuberculosis H37Rv
auugggcgcuuaugcgucug

SEQ ID NO: 3242763 - RNA, 17 nt, Mycobacterium tuberculosis H37Rv
auuggucaccugcugca

SEQ ID NO: 3242764 - RNA, 15 nt, Mycobacterium tuberculosis H37Rv
auuggucgcucgcgg

SEQ ID NO: 3242765 - RNA, 18 nt, Mycobacterium tuberculosis H37Rv
auuggugggccagcagca

SEQ ID NO: 3242766 - RNA, 19 nt, Mycobacterium tuberculosis H37Rv
auuggugggccagcagcaa

SEQ ID NO: 3242767 - RNA, 13 nt, Mycobacterium tuberculosis H37Rv
auugguguagcca

SEQ ID NO: 3242768 - RNA, 13 nt, Mycobacterium tuberculosis H37Rv
auugguugaggag

SEQ ID NO: 3242769 - RNA, 16 nt, Mycobacterium tuberculosis H37Rv
auugucaacgaauggu

SEQ ID NO: 3242770 - RNA, 16 nt, Mycobacterium tuberculosis H37Rv
auugucgaucaccugc

SEQ ID NO: 3242771 - RNA, 17 nt, Mycobacterium tuberculosis H37Rv
auugucggcgaaaugaa

SEQ ID NO: 3242772 - RNA, 18 nt, Mycobacterium tuberculosis H37Rv
auugucggcgaaaugaag

SEQ ID NO: 3242773 - RNA, 21 nt, Mycobacterium tuberculosis H37Rv
auugugcggccccgucgccga

SEQ ID NO: 3242774 - RNA, 14 nt, Mycobacterium tuberculosis H37Rv
auugugugcagcag

SEQ ID NO: 3242775 - RNA, 16 nt, Mycobacterium tuberculosis H37Rv
auugugugcagcagca

SEQ ID NO: 3242776 - RNA, 16 nt, Mycobacterium tuberculosis H37Rv
auuucaccgaagccau

SEQ ID NO: 3242777 - RNA, 22 nt, Mycobacterium tuberculosis H37Rv
auuucagccuuguugccgccgg

SEQ ID NO: 3242778 - RNA, 16 nt, Mycobacterium tuberculosis H37Rv
auuuccacauccaacg

SEQ ID NO: 3242779 - RNA, 17 nt, Mycobacterium tuberculosis H37Rv
auuucgaucacaucguu

SEQ ID NO: 3242780 - RNA, 17 nt, Mycobacterium tuberculosis H37Rv
caacaccagaugcaccu

SEQ ID NO: 3242781 - RNA, 15 nt, Mycobacterium tuberculosis H37Rv
caacaccagccgguc

SEQ ID NO: 3242782 - RNA, 21 nt, Mycobacterium tuberculosis H37Rv
caacaccaggucauugccggc

SEQ ID NO: 3242783 - RNA, 18 nt, Mycobacterium tuberculosis H37Rv
caacaccccccccaccca

SEQ ID NO: 3242784 - RNA, 17 nt, Mycobacterium tuberculosis H37Rv
caacacccgcccgggcg

SEQ ID NO: 3242785 - RNA, 18 nt, Mycobacterium tuberculosis H37Rv
caacaccgaguuccucug

SEQ ID NO: 3242786 - RNA, 16 nt, Mycobacterium tuberculosis H37Rv
caacaccgccagcaug

SEQ ID NO: 3242787 - RNA, 17 nt, Mycobacterium tuberculosis H37Rv
caacaccgcgccgacga

SEQ ID NO: 3242788 - RNA, 14 nt, Mycobacterium tuberculosis H37Rv
caacaccgcggccg

SEQ ID NO: 3242789 - RNA, 15 nt, Mycobacterium tuberculosis H37Rv
caacaccgcggcgcu

SEQ ID NO: 3242790 - RNA, 20 nt, Mycobacterium tuberculosis H37Rv
caacaccgcgucaacgcugu

SEQ ID NO: 3242791 - RNA, 14 nt, Mycobacterium tuberculosis H37Rv
caacaccggcgugg

SEQ ID NO: 3242792 - RNA, 20 nt, Mycobacterium tuberculosis H37Rv
caacaccgucggcagcagcg

SEQ ID NO: 3242793 - RNA, 15 nt, Mycobacterium tuberculosis H37Rv
caacaccucgucggc

SEQ ID NO: 3242794 - RNA, 13 nt, Mycobacterium tuberculosis H37Rv
caacacgucgagc

SEQ ID NO: 3242795 - RNA, 19 nt, Mycobacterium tuberculosis H37Rv
caacacugaguucggugcu

SEQ ID NO: 3242796 - RNA, 21 nt, Mycobacterium tuberculosis H37Rv
caacacuuccgggcggugaag

SEQ ID NO: 3242797 - RNA, 15 nt, Mycobacterium tuberculosis H37Rv
caacagaugccaccc

SEQ ID NO: 3242798 - RNA, 18 nt, Mycobacterium tuberculosis H37Rv
caacagaugccacccaga

SEQ ID NO: 3242799 - RNA, 17 nt, Mycobacterium tuberculosis H37Rv
caacagcaacggcagcg

SEQ ID NO: 3242800 - RNA, 12 nt, Mycobacterium tuberculosis H37Rv
caacagcaccag

SEQ ID NO: 3242801 - RNA, 23 nt, Mycobacterium tuberculosis H37Rv
caacagcacccgggccacgucga

SEQ ID NO: 3242802 - RNA, 17 nt, Mycobacterium tuberculosis H37Rv
caacagcacguacugcu

SEQ ID NO: 3242803 - RNA, 12 nt, Mycobacterium tuberculosis H37Rv
caacagccagcu

SEQ ID NO: 3242804 - RNA, 14 nt, Mycobacterium tuberculosis H37Rv
caacagccgcagcc

SEQ ID NO: 3242805 - RNA, 19 nt, Mycobacterium tuberculosis H37Rv
caacagccgcagccagguc

SEQ ID NO: 3242806 - RNA, 14 nt, Mycobacterium tuberculosis H37Rv
caacagccgcucgc

SEQ ID NO: 3242807 - RNA, 21 nt, Mycobacterium tuberculosis H37Rv
caacagcgcgguguucgcggc

SEQ ID NO: 3242808 - RNA, 14 nt, Mycobacterium tuberculosis H37Rv
caacagcgcuccag

SEQ ID NO: 3242809 - RNA, 12 nt, Mycobacterium tuberculosis H37Rv
caacagcggcaa

SEQ ID NO: 3242810 - RNA, 20 nt, Mycobacterium tuberculosis H37Rv
caacagcggggugugcgguu

SEQ ID NO: 3242811 - RNA, 16 nt, Mycobacterium tuberculosis H37Rv
caacagcguggagcgc

SEQ ID NO: 3242812 - RNA, 20 nt, Mycobacterium tuberculosis H37Rv
caacagcugggucaugccgu

SEQ ID NO: 3242813 - RNA, 16 nt, Mycobacterium tuberculosis H37Rv
caacagcuuggagauc

SEQ ID NO: 3242814 - RNA, 13 nt, Mycobacterium tuberculosis H37Rv
caacaggccaacu

SEQ ID NO: 3242815 - RNA, 22 nt, Mycobacterium tuberculosis H37Rv
caacaggccaacuuggcggcca

SEQ ID NO: 3242816 - RNA, 17 nt, Mycobacterium tuberculosis H37Rv
caacaggccggcucgcu

SEQ ID NO: 3242817 - RNA, 14 nt, Mycobacterium tuberculosis H37Rv
caacaggccgucga

SEQ ID NO: 3242818 - RNA, 14 nt, Mycobacterium tuberculosis H37Rv
caacagggccagga

SEQ ID NO: 3242819 - RNA, 12 nt, Mycobacterium tuberculosis H37Rv
caacaggguggg

SEQ ID NO: 3242820 - RNA, 16 nt, Mycobacterium tuberculosis H37Rv
caacagguccaccggc

SEQ ID NO: 3242821 - RNA, 22 nt, Mycobacterium tuberculosis H37Rv
caacauccgguggugcucgucg

SEQ ID NO: 3242822 - RNA, 17 nt, Mycobacterium tuberculosis H37Rv
caacaucuugccgucgg

SEQ ID NO: 3242823 - RNA, 14 nt, Mycobacterium tuberculosis H37Rv
caacaugcuggaga

SEQ ID NO: 3242824 - RNA, 15 nt, Mycobacterium tuberculosis H37Rv
caacaugcuggagaa

SEQ ID NO: 3242825 - RNA, 18 nt, Mycobacterium tuberculosis H37Rv
caacauguugucgucgcc

SEQ ID NO: 3242826 - RNA, 21 nt, Mycobacterium tuberculosis H37Rv
caacauguugucgucgccgcc

SEQ ID NO: 3242827 - RNA, 22 nt, Mycobacterium tuberculosis H37Rv
caacauuggugagguggucagc

SEQ ID NO: 3242828 - RNA, 21 nt, Mycobacterium tuberculosis H37Rv
caaccaaagcgacgagcagca

SEQ ID NO: 3242829 - RNA, 14 nt, Mycobacterium tuberculosis H37Rv
caaccacaucaccg

SEQ ID NO: 3242830 - RNA, 15 nt, Mycobacterium tuberculosis H37Rv
caaccaccggccgcg

SEQ ID NO: 3242831 - RNA, 19 nt, Mycobacterium tuberculosis H37Rv
caaccaccucgccaacauc

SEQ ID NO: 3242832 - RNA, 11 nt, Mycobacterium tuberculosis H37Rv
caaccagcaga

SEQ ID NO: 3242833 - RNA, 12 nt, Mycobacterium tuberculosis H37Rv
caaccagcagca

SEQ ID NO: 3242834 - RNA, 15 nt, Mycobacterium tuberculosis H37Rv
caaccagcagcaggu

SEQ ID NO: 3242835 - RNA, 13 nt, Mycobacterium tuberculosis H37Rv
caaccagcauggc

SEQ ID NO: 3242836 - RNA, 16 nt, Mycobacterium tuberculosis H37Rv
caaccagcgagcccag

SEQ ID NO: 3242837 - RNA, 13 nt, Mycobacterium tuberculosis H37Rv
caaccagcggcac

SEQ ID NO: 3242838 - RNA, 19 nt, Mycobacterium tuberculosis H37Rv
caaccaggaugguugcgac

SEQ ID NO: 3242839 - RNA, 18 nt, Mycobacterium tuberculosis H37Rv
caaccaggugagcgacgc

SEQ ID NO: 3242840 - RNA, 17 nt, Mycobacterium tuberculosis H37Rv
caaccagugcagcucga

SEQ ID NO: 3242841 - RNA, 17 nt, Mycobacterium tuberculosis H37Rv
caaccaucgcgaucuga

SEQ ID NO: 3242842 - RNA, 23 nt, Mycobacterium tuberculosis H37Rv
caaccaugcgguuagcagccgcu

SEQ ID NO: 3242843 - RNA, 19 nt, Mycobacterium tuberculosis H37Rv
caaccauguuaacgcgcgu

SEQ ID NO: 3242844 - RNA, 19 nt, Mycobacterium tuberculosis H37Rv
caaccauuagcgccaagcc

SEQ ID NO: 3242845 - RNA, 21 nt, Mycobacterium tuberculosis H37Rv
caacccaccccccagcgccgc

SEQ ID NO: 3242846 - RNA, 18 nt, Mycobacterium tuberculosis H37Rv
caaccccagcgacaugcc

SEQ ID NO: 3242847 - RNA, 13 nt, Mycobacterium tuberculosis H37Rv
caaccccgagcgg

SEQ ID NO: 3242848 - RNA, 13 nt, Mycobacterium tuberculosis H37Rv
caaccccgccggc

SEQ ID NO: 3242849 - RNA, 23 nt, Mycobacterium tuberculosis H37Rv
caaccccggaccgcggccaccgc

SEQ ID NO: 3242850 - RNA, 14 nt, Mycobacterium tuberculosis H37Rv
caacccgcaccccg

SEQ ID NO: 3242851 - RNA, 21 nt, Mycobacterium tuberculosis H37Rv
caacccgccguugccaccggu

SEQ ID NO: 3242852 - RNA, 23 nt, Mycobacterium tuberculosis H37Rv
caacccgccguugccaccggugc

SEQ ID NO: 3242853 - RNA, 12 nt, Mycobacterium tuberculosis H37Rv
caacccgcucgg

SEQ ID NO: 3242854 - RNA, 21 nt, Mycobacterium tuberculosis H37Rv
caacccggacgaacgccgucg

SEQ ID NO: 3242855 - RNA, 23 nt, Mycobacterium tuberculosis H37Rv
caacccggcgggcccgccggccc

SEQ ID NO: 3242856 - RNA, 21 nt, Mycobacterium tuberculosis H37Rv
caacccgggccgccagggccc

SEQ ID NO: 3242857 - RNA, 17 nt, Mycobacterium tuberculosis H37Rv
caacccggucggcagcu

SEQ ID NO: 3242858 - RNA, 19 nt, Mycobacterium tuberculosis H37Rv
caacccggucggcagcugg

SEQ ID NO: 3242859 - RNA, 13 nt, Mycobacterium tuberculosis H37Rv
caacccggugaug

SEQ ID NO: 3242860 - RNA, 19 nt, Mycobacterium tuberculosis H37Rv
caacccgucgagccgugcc

SEQ ID NO: 3242861 - RNA, 23 nt, Mycobacterium tuberculosis H37Rv
caacccgugcgacuucgagauug

SEQ ID NO: 3242862 - RNA, 19 nt, Mycobacterium tuberculosis H37Rv
caacccguuguggccgccu

SEQ ID NO: 3242863 - RNA, 17 nt, Mycobacterium tuberculosis H37Rv
caacccuaaaccagcca

SEQ ID NO: 3242864 - RNA, 20 nt, Mycobacterium tuberculosis H37Rv
caacccuagggcggugccgc

SEQ ID NO: 3242865 - RNA, 17 nt, Mycobacterium tuberculosis H37Rv
caacccugcggcgucgu

SEQ ID NO: 3242866 - RNA, 15 nt, Mycobacterium tuberculosis H37Rv
caacccugcggugca

SEQ ID NO: 3242867 - RNA, 20 nt, Mycobacterium tuberculosis H37Rv
caaccgaauccaucgagacc

SEQ ID NO: 3242868 - RNA, 20 nt, Mycobacterium tuberculosis H37Rv
caaccgaauugaacugagga

SEQ ID NO: 3242869 - RNA, 18 nt, Mycobacterium tuberculosis H37Rv
caaccgaucggucguccg

SEQ ID NO: 3242870 - RNA, 17 nt, Mycobacterium tuberculosis H37Rv
caaccgcaccagguguc

SEQ ID NO: 3242871 - RNA, 13 nt, Mycobacterium tuberculosis H37Rv
caaccgcaccgca

SEQ ID NO: 3242872 - RNA, 21 nt, Mycobacterium tuberculosis H37Rv
caaccgccaucgucgaagacc

SEQ ID NO: 3242873 - RNA, 22 nt, Mycobacterium tuberculosis H37Rv
caaccgccaucgucgaagaccu

SEQ ID NO: 3242874 - RNA, 15 nt, Mycobacterium tuberculosis H37Rv
caaccgcccgaucag

SEQ ID NO: 3242875 - RNA, 15 nt, Mycobacterium tuberculosis H37Rv
caaccgcgcccuagc

SEQ ID NO: 3242876 - RNA, 17 nt, Mycobacterium tuberculosis H37Rv
caacgcugcagcagguc

SEQ ID NO: 3242877 - RNA, 22 nt, Mycobacterium tuberculosis H37Rv
caacgcugcagcaggucgaugc

SEQ ID NO: 3242878 - RNA, 13 nt, Mycobacterium tuberculosis H37Rv
caacgcugggcgg

SEQ ID NO: 3242879 - RNA, 18 nt, Mycobacterium tuberculosis H37Rv
caacgcuucugccugcgc

SEQ ID NO: 3242880 - RNA, 11 nt, Mycobacterium tuberculosis H37Rv
caacggaaucu

SEQ ID NO: 3242881 - RNA, 20 nt, Mycobacterium tuberculosis H37Rv
caacggaaucucuucggcgg

SEQ ID NO: 3242882 - RNA, 22 nt, Mycobacterium tuberculosis H37Rv
caacggacgggaucgcccaggc

SEQ ID NO: 3242883 - RNA, 15 nt, Mycobacterium tuberculosis H37Rv
caacggcacccugcg

SEQ ID NO: 3242884 - RNA, 20 nt, Mycobacterium tuberculosis H37Rv
caacggcacccugcggcacc

SEQ ID NO: 3242885 - RNA, 23 nt, Mycobacterium tuberculosis H37Rv
caacggcaccucgacgucgagca

SEQ ID NO: 3242886 - RNA, 13 nt, Mycobacterium tuberculosis H37Rv
caacggcagcccg

SEQ ID NO: 3242887 - RNA, 18 nt, Mycobacterium tuberculosis H37Rv
caacggcagcgccaccga

SEQ ID NO: 3242888 - RNA, 19 nt, Mycobacterium tuberculosis H37Rv
caacggcaucccggccgcu

SEQ ID NO: 3242889 - RNA, 16 nt, Mycobacterium tuberculosis H37Rv
caacggcgcgccgacc

SEQ ID NO: 3242890 - RNA, 16 nt, Mycobacterium tuberculosis H37Rv
caacggcgcggcaagg

SEQ ID NO: 3242891 - RNA, 19 nt, Mycobacterium tuberculosis H37Rv
caacggcggcgccguucgu

SEQ ID NO: 3242892 - RNA, 20 nt, Mycobacterium tuberculosis H37Rv
caacggcguaaucgggaagu

SEQ ID NO: 3242893 - RNA, 20 nt, Mycobacterium tuberculosis H37Rv
caacggcguuggcgccguua

SEQ ID NO: 3242894 - RNA, 23 nt, Mycobacterium tuberculosis H37Rv
caacgggauccgcgcgcuggacc

SEQ ID NO: 3242895 - RNA, 22 nt, Mycobacterium tuberculosis H37Rv
caacgggccgcaucgucgccgc

SEQ ID NO: 3242896 - RNA, 19 nt, Mycobacterium tuberculosis H37Rv
caacgggccuucagcucac

SEQ ID NO: 3242897 - RNA, 20 nt, Mycobacterium tuberculosis H37Rv
caacgggccuucagcucacc

SEQ ID NO: 3242898 - RNA, 15 nt, Mycobacterium tuberculosis H37Rv
caacgggcgaacuug

SEQ ID NO: 3242899 - RNA, 19 nt, Mycobacterium tuberculosis H37Rv
caacggggcagucaacucc

SEQ ID NO: 3242900 - RNA, 22 nt, Mycobacterium tuberculosis H37Rv
caacggggcagucaacucccga

SEQ ID NO: 3242901 - RNA, 20 nt, Mycobacterium tuberculosis H37Rv
caacggguacacccgcucgc

SEQ ID NO: 3242902 - RNA, 19 nt, Mycobacterium tuberculosis H37Rv
caacgguaguugcgcggca

SEQ ID NO: 3242903 - RNA, 21 nt, Mycobacterium tuberculosis H37Rv
caacggucaaucccggccagg

SEQ ID NO: 3242904 - RNA, 15 nt, Mycobacterium tuberculosis H37Rv
caacggucucaacgc

SEQ ID NO: 3242905 - RNA, 16 nt, Mycobacterium tuberculosis H37Rv
caacggugcucuucga

SEQ ID NO: 3242906 - RNA, 16 nt, Mycobacterium tuberculosis H37Rv
caacguagccagcagc

SEQ ID NO: 3242907 - RNA, 21 nt, Mycobacterium tuberculosis H37Rv
caacgucgagauccucgucga

SEQ ID NO: 3242908 - RNA, 16 nt, Mycobacterium tuberculosis H37Rv
caacgucggcaccggu

SEQ ID NO: 3242909 - RNA, 16 nt, Mycobacterium tuberculosis H37Rv
caacgucgugaucgca

SEQ ID NO: 3242910 - RNA, 23 nt, Mycobacterium tuberculosis H37Rv
caacgucucuagauauggaccgc

SEQ ID NO: 3242911 - RNA, 21 nt, Mycobacterium tuberculosis H37Rv
caacgucuugcuggucgaugg

SEQ ID NO: 3242912 - RNA, 18 nt, Mycobacterium tuberculosis H37Rv
caacgugaugcguucggc

SEQ ID NO: 3242913 - RNA, 19 nt, Mycobacterium tuberculosis H37Rv
caacguggugucucggcug

SEQ ID NO: 3242914 - RNA, 15 nt, Mycobacterium tuberculosis H37Rv
caacgugucccaagc

SEQ ID NO: 3242915 - RNA, 21 nt, Mycobacterium tuberculosis H37Rv
caacguucaacgacggcaagc

SEQ ID NO: 3242916 - RNA, 13 nt, Mycobacterium tuberculosis H37Rv
caacguucggcac

SEQ ID NO: 3242917 - RNA, 15 nt, Mycobacterium tuberculosis H37Rv
caacguucggcacaa

SEQ ID NO: 3242918 - RNA, 21 nt, Mycobacterium tuberculosis H37Rv
caacguucggcacaaccaacg

SEQ ID NO: 3242919 - RNA, 19 nt, Mycobacterium tuberculosis H37Rv
caacguugcgccagcggug

SEQ ID NO: 3242920 - RNA, 16 nt, Mycobacterium tuberculosis H37Rv
caacguuguagcccaa

SEQ ID NO: 3242921 - RNA, 20 nt, Mycobacterium tuberculosis H37Rv
caacuaccuguugacacaac

SEQ ID NO: 3242922 - RNA, 20 nt, Mycobacterium tuberculosis H37Rv
caacuaucgucgugucgccg

SEQ ID NO: 3242923 - RNA, 22 nt, Mycobacterium tuberculosis H37Rv
caacuaucgucgugucgccgcc

SEQ ID NO: 3242924 - RNA, 13 nt, Mycobacterium tuberculosis H37Rv
caacucaggccgg

SEQ ID NO: 3242925 - RNA, 14 nt, Mycobacterium tuberculosis H37Rv
caacuccacgcgga

SEQ ID NO: 3242926 - RNA, 14 nt, Mycobacterium tuberculosis H37Rv
caacucccagcacg

SEQ ID NO: 3242927 - RNA, 21 nt, Mycobacterium tuberculosis H37Rv
caacuccggucaacacccgcc

SEQ ID NO: 3242928 - RNA, 12 nt, Mycobacterium tuberculosis H37Rv
caacuccucagc

SEQ ID NO: 3242929 - RNA, 20 nt, Mycobacterium tuberculosis H37Rv
caacuccucagccgccuguc

SEQ ID NO: 3242930 - RNA, 22 nt, Mycobacterium tuberculosis H37Rv
caacuccugcagcccgggcagc

SEQ ID NO: 3242931 - RNA, 23 nt, Mycobacterium tuberculosis H37Rv
caacucgccacggucgccgacca

SEQ ID NO: 3242932 - RNA, 11 nt, Mycobacterium tuberculosis H37Rv
caacucggcag

SEQ ID NO: 3242933 - RNA, 12 nt, Mycobacterium tuberculosis H37Rv
caacucggccac

SEQ ID NO: 3242934 - RNA, 23 nt, Mycobacterium tuberculosis H37Rv
caacucggccacggcgucggcca

SEQ ID NO: 3242935 - RNA, 14 nt, Mycobacterium tuberculosis H37Rv
caacucggccagcu

SEQ ID NO: 3242936 - RNA, 17 nt, Mycobacterium tuberculosis H37Rv
caacucgggcagcgcgg

SEQ ID NO: 3242937 - RNA, 23 nt, Mycobacterium tuberculosis H37Rv
caacucggugacguuggcaggca

SEQ ID NO: 3242938 - RNA, 17 nt, Mycobacterium tuberculosis H37Rv
caacucguccaacugaa

SEQ ID NO: 3242939 - RNA, 19 nt, Mycobacterium tuberculosis H37Rv
caacucuucagcaagccaa

SEQ ID NO: 3242940 - RNA, 17 nt, Mycobacterium tuberculosis H37Rv
caacugcagauaggacc

SEQ ID NO: 3242941 - RNA, 20 nt, Mycobacterium tuberculosis H37Rv
caacugcagauaggacccag

SEQ ID NO: 3242942 - RNA, 20 nt, Mycobacterium tuberculosis H37Rv
caacugcagcauggcccugg

SEQ ID NO: 3242943 - RNA, 14 nt, Mycobacterium tuberculosis H37Rv
caacugcaucacca

SEQ ID NO: 3242944 - RNA, 15 nt, Mycobacterium tuberculosis H37Rv
caacugcccgaugau

SEQ ID NO: 3242945 - RNA, 17 nt, Mycobacterium tuberculosis H37Rv
caacugccgagcagacg

SEQ ID NO: 3242946 - RNA, 19 nt, Mycobacterium tuberculosis H37Rv
caacugcgaaacgccaccg

SEQ ID NO: 3242947 - RNA, 23 nt, Mycobacterium tuberculosis H37Rv
caacugcgccguucgcucccccg

SEQ ID NO: 3242948 - RNA, 15 nt, Mycobacterium tuberculosis H37Rv
caacugcggcagguc

SEQ ID NO: 3242949 - RNA, 13 nt, Mycobacterium tuberculosis H37Rv
caacugcucgacg

SEQ ID NO: 3242950 - RNA, 14 nt, Mycobacterium tuberculosis H37Rv
caacugcucgacga

SEQ ID NO: 3242951 - RNA, 21 nt, Mycobacterium tuberculosis H37Rv
caacugggccgagcgcgccgu

SEQ ID NO: 3242952 - RNA, 13 nt, Mycobacterium tuberculosis H37Rv
caacuggucgcca

SEQ ID NO: 3242953 - RNA, 15 nt, Mycobacterium tuberculosis H37Rv
caacuggugggccau

SEQ ID NO: 3242954 - RNA, 17 nt, Mycobacterium tuberculosis H37Rv
caacuucaacuggauca

SEQ ID NO: 3242955 - RNA, 12 nt, Mycobacterium tuberculosis H37Rv
caacuucaccac

SEQ ID NO: 3242956 - RNA, 20 nt, Mycobacterium tuberculosis H37Rv
caacuuccgcagcgccaccc

SEQ ID NO: 3242957 - RNA, 20 nt, Mycobacterium tuberculosis H37Rv
caacuucuuuagcguguggc

SEQ ID NO: 3242958 - RNA, 19 nt, Mycobacterium tuberculosis H37Rv
caacuuggcggccagccgc

SEQ ID NO: 3242959 - RNA, 21 nt, Mycobacterium tuberculosis H37Rv
caagaaagacgcuguccaggu

SEQ ID NO: 3242960 - RNA, 17 nt, Mycobacterium tuberculosis H37Rv
caagaaguugacaccag

SEQ ID NO: 3242961 - RNA, 17 nt, Mycobacterium tuberculosis H37Rv
caagaaucaccggcaau

SEQ ID NO: 3242962 - RNA, 19 nt, Mycobacterium tuberculosis H37Rv
caagacaugcugauggauc

SEQ ID NO: 3242963 - RNA, 14 nt, Mycobacterium tuberculosis H37Rv
caagaccgcggcgu

SEQ ID NO: 3242964 - RNA, 13 nt, Mycobacterium tuberculosis H37Rv
caagaccggcggg

SEQ ID NO: 3242965 - RNA, 16 nt, Mycobacterium tuberculosis H37Rv
caagacgaacagcacg

SEQ ID NO: 3242966 - RNA, 13 nt, Mycobacterium tuberculosis H37Rv
caagacgccaccc

SEQ ID NO: 3242967 - RNA, 15 nt, Mycobacterium tuberculosis H37Rv
caagacggcgggccc

SEQ ID NO: 3242968 - RNA, 17 nt, Mycobacterium tuberculosis H37Rv
caagacgucggcguggu

SEQ ID NO: 3242969 - RNA, 15 nt, Mycobacterium tuberculosis H37Rv
caagagccgcagcca

SEQ ID NO: 3242970 - RNA, 22 nt, Mycobacterium tuberculosis H37Rv
caagagugcucagcgcgcgccg

SEQ ID NO: 3242971 - RNA, 20 nt, Mycobacterium tuberculosis H37Rv
caagaguugccggaucgacg

SEQ ID NO: 3242972 - RNA, 19 nt, Mycobacterium tuberculosis H37Rv
caaguacgcgucggugacc

SEQ ID NO: 3242973 - RNA, 14 nt, Mycobacterium tuberculosis H37Rv
caaguacgcuccga

SEQ ID NO: 3242974 - RNA, 20 nt, Mycobacterium tuberculosis H37Rv
caaguagccgucgucgucga

SEQ ID NO: 3242975 - RNA, 16 nt, Mycobacterium tuberculosis H37Rv
caagucaccauagcuc

SEQ ID NO: 3242976 - RNA, 20 nt, Mycobacterium tuberculosis H37Rv
caagucaccauagcucaggg

SEQ ID NO: 3242977 - RNA, 16 nt, Mycobacterium tuberculosis H37Rv
caaguccaacgacugu

SEQ ID NO: 3242978 - RNA, 13 nt, Mycobacterium tuberculosis H37Rv
caaguccagcagc

SEQ ID NO: 3242979 - RNA, 14 nt, Mycobacterium tuberculosis H37Rv
caaguccagcagcg

SEQ ID NO: 3242980 - RNA, 16 nt, Mycobacterium tuberculosis H37Rv
caagucccucggcggc

SEQ ID NO: 3242981 - RNA, 15 nt, Mycobacterium tuberculosis H37Rv
caaguccgcccgccg

SEQ ID NO: 3242982 - RNA, 15 nt, Mycobacterium tuberculosis H37Rv
caaguccuucacugc

SEQ ID NO: 3242983 - RNA, 14 nt, Mycobacterium tuberculosis H37Rv
caagucgacacgcc

SEQ ID NO: 3242984 - RNA, 11 nt, Mycobacterium tuberculosis H37Rv
caagucgacgc

SEQ ID NO: 3242985 - RNA, 21 nt, Mycobacterium tuberculosis H37Rv
caagucgauguacaccgugcg

SEQ ID NO: 3242986 - RNA, 20 nt, Mycobacterium tuberculosis H37Rv
caagucgccgaggcaaccga

SEQ ID NO: 3242987 - RNA, 18 nt, Mycobacterium tuberculosis H37Rv
caagucugcccgacugcc

SEQ ID NO: 3242988 - RNA, 12 nt, Mycobacterium tuberculosis H37Rv
caagucugugcu

SEQ ID NO: 3242989 - RNA, 16 nt, Mycobacterium tuberculosis H37Rv
caagucugugcucacg

SEQ ID NO: 3242990 - RNA, 23 nt, Mycobacterium tuberculosis H37Rv
caagugccggcgcggagugccca

SEQ ID NO: 3242991 - RNA, 18 nt, Mycobacterium tuberculosis H37Rv
caagugcuggccgaagaa

SEQ ID NO: 3242992 - RNA, 19 nt, Mycobacterium tuberculosis H37Rv
caaguggccagcgccaacu

SEQ ID NO: 3242993 - RNA, 13 nt, Mycobacterium tuberculosis H37Rv
caaguggcgcucg

SEQ ID NO: 3242994 - RNA, 15 nt, Mycobacterium tuberculosis H37Rv
caagugggugagaaa

SEQ ID NO: 3242995 - RNA, 14 nt, Mycobacterium tuberculosis H37Rv
caagugguccaagu

SEQ ID NO: 3242996 - RNA, 23 nt, Mycobacterium tuberculosis H37Rv
caaguggugguaggccgggagga

SEQ ID NO: 3242997 - RNA, 15 nt, Mycobacterium tuberculosis H37Rv
caagugucgccgcuc

SEQ ID NO: 3242998 - RNA, 21 nt, Mycobacterium tuberculosis H37Rv
caagugucuccggcaacagca

SEQ ID NO: 3242999 - RNA, 16 nt, Mycobacterium tuberculosis H37Rv
caaguucgccagcaac

SEQ ID NO: 3243000 - RNA, 21 nt, Mycobacterium tuberculosis H37Rv
caaguucgccagcaacgucgg

SEQ ID NO: 3243001 - RNA, 20 nt, Mycobacterium tuberculosis H37Rv
caaguugggcguucaggugu

SEQ ID NO: 3243002 - RNA, 17 nt, Mycobacterium tuberculosis H37Rv
caaguugguucaccgcg

SEQ ID NO: 3243003 - RNA, 23 nt, Mycobacterium tuberculosis H37Rv
caauacacguugccgaucccggc

SEQ ID NO: 3243004 - RNA, 20 nt, Mycobacterium tuberculosis H37Rv
caauaccgccagcgccaccg

SEQ ID NO: 3243005 - RNA, 19 nt, Mycobacterium tuberculosis H37Rv
caauacggucagcagacug

SEQ ID NO: 3243006 - RNA, 22 nt, Mycobacterium tuberculosis H37Rv
caauacgugauguagcugcagg

SEQ ID NO: 3243007 - RNA, 12 nt, Mycobacterium tuberculosis H37Rv
caauagaccgca

SEQ ID NO: 3243008 - RNA, 22 nt, Mycobacterium tuberculosis H37Rv
caauagcaacucgaucgccuga

SEQ ID NO: 3243009 - RNA, 15 nt, Mycobacterium tuberculosis H37Rv
caauaggcuccagcg

SEQ ID NO: 3243010 - RNA, 22 nt, Mycobacterium tuberculosis H37Rv
caauaggcuccagcgcgcgccg

SEQ ID NO: 3243011 - RNA, 18 nt, Mycobacterium tuberculosis H37Rv
caauauccuccagcaggu

SEQ ID NO: 3243012 - RNA, 18 nt, Mycobacterium tuberculosis H37Rv
caaucacauagccgguca

SEQ ID NO: 3243013 - RNA, 21 nt, Mycobacterium tuberculosis H37Rv
caaucacauagccggucagua

SEQ ID NO: 3243014 - RNA, 12 nt, Mycobacterium tuberculosis H37Rv
caaucaccaccg

SEQ ID NO: 3243015 - RNA, 13 nt, Mycobacterium tuberculosis H37Rv
caaucacccagcc

SEQ ID NO: 3243016 - RNA, 17 nt, Mycobacterium tuberculosis H37Rv
caaucagcccgacaccg

SEQ ID NO: 3243017 - RNA, 19 nt, Mycobacterium tuberculosis H37Rv
caaucagcccgacaccguc

SEQ ID NO: 3243018 - RNA, 14 nt, Mycobacterium tuberculosis H37Rv
caaucagugcagcg

SEQ ID NO: 3243019 - RNA, 17 nt, Mycobacterium tuberculosis H37Rv
caaucaugucagcgcug

SEQ ID NO: 3243020 - RNA, 15 nt, Mycobacterium tuberculosis H37Rv
caaucauguucaucu

SEQ ID NO: 3243021 - RNA, 17 nt, Mycobacterium tuberculosis H37Rv
caauccacgcacucguc

SEQ ID NO: 3243022 - RNA, 19 nt, Mycobacterium tuberculosis H37Rv
caauccacgcacucgucgg

SEQ ID NO: 3243023 - RNA, 20 nt, Mycobacterium tuberculosis H37Rv
caauccaggccaccccgacc

SEQ ID NO: 3243024 - RNA, 17 nt, Mycobacterium tuberculosis H37Rv
caaucccggccaggggc

SEQ ID NO: 3243025 - RNA, 13 nt, Mycobacterium tuberculosis H37Rv
caaucccuccgcc

SEQ ID NO: 3243026 - RNA, 18 nt, Mycobacterium tuberculosis H37Rv
caauccgcaaaacgagcu

SEQ ID NO: 3243027 - RNA, 22 nt, Mycobacterium tuberculosis H37Rv
caauccgcaaaacgagcuucca

SEQ ID NO: 3243028 - RNA, 17 nt, Mycobacterium tuberculosis H37Rv
caauccgcacagcgacg

SEQ ID NO: 3243029 - RNA, 23 nt, Mycobacterium tuberculosis H37Rv
caauccgcccuugccgccuuggc

SEQ ID NO: 3243030 - RNA, 19 nt, Mycobacterium tuberculosis H37Rv
caauccggcgccagcagug

SEQ ID NO: 3243031 - RNA, 16 nt, Mycobacterium tuberculosis H37Rv
caauccggcugcggua

SEQ ID NO: 3243032 - RNA, 15 nt, Mycobacterium tuberculosis H37Rv
caauccugguguucg

SEQ ID NO: 3243033 - RNA, 20 nt, Mycobacterium tuberculosis H37Rv
caaucgagaacgcccgcugc

SEQ ID NO: 3243034 - RNA, 19 nt, Mycobacterium tuberculosis H37Rv
caaucgaguagcugaccga

SEQ ID NO: 3243035 - RNA, 21 nt, Mycobacterium tuberculosis H37Rv
caaucgcaaugaccugcagcg

SEQ ID NO: 3243036 - RNA, 22 nt, Mycobacterium tuberculosis H37Rv
caaucgcaaugaccugcagcgc

SEQ ID NO: 3243037 - RNA, 23 nt, Mycobacterium tuberculosis H37Rv
caaucgcaaugaccugcagcgca

SEQ ID NO: 3243038 - RNA, 18 nt, Mycobacterium tuberculosis H37Rv
caaucggauagccgugcu

SEQ ID NO: 3243039 - RNA, 17 nt, Mycobacterium tuberculosis H37Rv
caaucggcggcacccgg

SEQ ID NO: 3243040 - RNA, 16 nt, Mycobacterium tuberculosis H37Rv
caaucgggaucgcugc

SEQ ID NO: 3243041 - RNA, 23 nt, Mycobacterium tuberculosis H37Rv
caaucgguggucguaggugacga

SEQ ID NO: 3243042 - RNA, 21 nt, Mycobacterium tuberculosis H37Rv
caaucguccacccgagcucuu

SEQ ID NO: 3243043 - RNA, 13 nt, Mycobacterium tuberculosis H37Rv
caaucgucggcca

SEQ ID NO: 3243044 - RNA, 16 nt, Mycobacterium tuberculosis H37Rv
caaucgucggccagca

SEQ ID NO: 3243045 - RNA, 14 nt, Mycobacterium tuberculosis H37Rv
caaucguuggccau

SEQ ID NO: 3243046 - RNA, 17 nt, Mycobacterium tuberculosis H37Rv
caaucucccauacgccg

SEQ ID NO: 3243047 - RNA, 13 nt, Mycobacterium tuberculosis H37Rv
caaucuccuccgc

SEQ ID NO: 3243048 - RNA, 12 nt, Mycobacterium tuberculosis H37Rv
caaucucggccg

SEQ ID NO: 3243049 - RNA, 14 nt, Mycobacterium tuberculosis H37Rv
caaucucggcguug

SEQ ID NO: 3243050 - RNA, 19 nt, Mycobacterium tuberculosis H37Rv
caaucucggcguugccgcc

SEQ ID NO: 3243051 - RNA, 14 nt, Mycobacterium tuberculosis H37Rv
caaucugcacgcgc

SEQ ID NO: 3243052 - RNA, 14 nt, Mycobacterium tuberculosis H37Rv
caaucugcgggccg

SEQ ID NO: 3243053 - RNA, 12 nt, Mycobacterium tuberculosis H37Rv
caaugacaccgg

SEQ ID NO: 3243054 - RNA, 17 nt, Mycobacterium tuberculosis H37Rv
caaugaccgccagcagc

SEQ ID NO: 3243055 - RNA, 16 nt, Mycobacterium tuberculosis H37Rv
caaugaccugcagcgc

SEQ ID NO: 3243056 - RNA, 17 nt, Mycobacterium tuberculosis H37Rv
caaugaccugcagcgca

SEQ ID NO: 3243057 - RNA, 20 nt, Mycobacterium tuberculosis H37Rv
caaugacucggccgcaccag

SEQ ID NO: 3243058 - RNA, 20 nt, Mycobacterium tuberculosis H37Rv
caaugcacaccgggcaccag

SEQ ID NO: 3243059 - RNA, 15 nt, Mycobacterium tuberculosis H37Rv
caaugcccgcaccgc

SEQ ID NO: 3243060 - RNA, 21 nt, Mycobacterium tuberculosis H37Rv
caaugcccuuggccagcaggg

SEQ ID NO: 3243061 - RNA, 22 nt, Mycobacterium tuberculosis H37Rv
caaugccggaucgggaccggga

SEQ ID NO: 3243062 - RNA, 14 nt, Mycobacterium tuberculosis H37Rv
caaugccggccgcg

SEQ ID NO: 3243063 - RNA, 14 nt, Mycobacterium tuberculosis H37Rv
caaugcgcgacggu

SEQ ID NO: 3243064 - RNA, 20 nt, Mycobacterium tuberculosis H37Rv
caaugcgucgaugcgcugcu

SEQ ID NO: 3243065 - RNA, 20 nt, Mycobacterium tuberculosis H37Rv
caaugcguugacgucgagca

SEQ ID NO: 3243066 - RNA, 23 nt, Mycobacterium tuberculosis H37Rv
caaugcguugacgucgagcagcg

SEQ ID NO: 3243067 - RNA, 16 nt, Mycobacterium tuberculosis H37Rv
caaugcuggcagcggc

SEQ ID NO: 3243068 - RNA, 15 nt, Mycobacterium tuberculosis H37Rv
cacagaccgaacagc

SEQ ID NO: 3243069 - RNA, 20 nt, Mycobacterium tuberculosis H37Rv
cacagaccgaacagcaccga

SEQ ID NO: 3243070 - RNA, 16 nt, Mycobacterium tuberculosis H37Rv
cacagcaacgcccaac

SEQ ID NO: 3243071 - RNA, 19 nt, Mycobacterium tuberculosis H37Rv
cacagcaacgugugcacca

SEQ ID NO: 3243072 - RNA, 12 nt, Mycobacterium tuberculosis H37Rv
cacagcaccacg

SEQ ID NO: 3243073 - RNA, 20 nt, Mycobacterium tuberculosis H37Rv
cacagcaccguccucgguca

SEQ ID NO: 3243074 - RNA, 12 nt, Mycobacterium tuberculosis H37Rv
cacagcaggcuc

SEQ ID NO: 3243075 - RNA, 14 nt, Mycobacterium tuberculosis H37Rv
cacagcaggcucga

SEQ ID NO: 3243076 - RNA, 13 nt, Mycobacterium tuberculosis H37Rv
cacagccaccagc

SEQ ID NO: 3243077 - RNA, 15 nt, Mycobacterium tuberculosis H37Rv
cacagccaguaaaaa

SEQ ID NO: 3243078 - RNA, 14 nt, Mycobacterium tuberculosis H37Rv
cacagccccagggu

SEQ ID NO: 3243079 - RNA, 15 nt, Mycobacterium tuberculosis H37Rv
cacagccccagggug

SEQ ID NO: 3243080 - RNA, 16 nt, Mycobacterium tuberculosis H37Rv
cacagccccagggugc

SEQ ID NO: 3243081 - RNA, 15 nt, Mycobacterium tuberculosis H37Rv
cacagcccgaugccg

SEQ ID NO: 3243082 - RNA, 19 nt, Mycobacterium tuberculosis H37Rv
cacagcccgaugccgugcc

SEQ ID NO: 3243083 - RNA, 22 nt, Mycobacterium tuberculosis H37Rv
cacagcccggcgacgacccggg

SEQ ID NO: 3243084 - RNA, 14 nt, Mycobacterium tuberculosis H37Rv
cacagccgaccucg

SEQ ID NO: 3243085 - RNA, 14 nt, Mycobacterium tuberculosis H37Rv
cacagccggcggcu

SEQ ID NO: 3243086 - RNA, 22 nt, Mycobacterium tuberculosis H37Rv
cacagccggguuuggugcagcc

SEQ ID NO: 3243087 - RNA, 14 nt, Mycobacterium tuberculosis H37Rv
cacagcgaacagac

SEQ ID NO: 3243088 - RNA, 18 nt, Mycobacterium tuberculosis H37Rv
cacagcgaccaucgccga

SEQ ID NO: 3243089 - RNA, 13 nt, Mycobacterium tuberculosis H37Rv
cacagcgcagccu

SEQ ID NO: 3243090 - RNA, 14 nt, Mycobacterium tuberculosis H37Rv
cacagcgccgcguu

SEQ ID NO: 3243091 - RNA, 13 nt, Mycobacterium tuberculosis H37Rv
cacagcggagacg

SEQ ID NO: 3243092 - RNA, 17 nt, Mycobacterium tuberculosis H37Rv
cacagcggagacgaucg

SEQ ID NO: 3243093 - RNA, 12 nt, Mycobacterium tuberculosis H37Rv
cacagcggccau

SEQ ID NO: 3243094 - RNA, 16 nt, Mycobacterium tuberculosis H37Rv
cacagcggcgauuggc

SEQ ID NO: 3243095 - RNA, 13 nt, Mycobacterium tuberculosis H37Rv
cacagcguaugca

SEQ ID NO: 3243096 - RNA, 19 nt, Mycobacterium tuberculosis H37Rv
cacaggacaauggacacca

SEQ ID NO: 3243097 - RNA, 21 nt, Mycobacterium tuberculosis H37Rv
cacaggacuuguccaucacau

SEQ ID NO: 3243098 - RNA, 18 nt, Mycobacterium tuberculosis H37Rv
cacaggauccguggccaa

SEQ ID NO: 3243099 - RNA, 16 nt, Mycobacterium tuberculosis H37Rv
cacaggauuggccgcu

SEQ ID NO: 3243100 - RNA, 21 nt, Mycobacterium tuberculosis H37Rv
cacaggcauuuucacugugcc

SEQ ID NO: 3243101 - RNA, 16 nt, Mycobacterium tuberculosis H37Rv
cacaggcgcgaucgcu

SEQ ID NO: 3243102 - RNA, 13 nt, Mycobacterium tuberculosis H37Rv
cacaggcggcgcu

SEQ ID NO: 3243103 - RNA, 17 nt, Mycobacterium tuberculosis H37Rv
cacaggcuuuuccggcg

SEQ ID NO: 3243104 - RNA, 21 nt, Mycobacterium tuberculosis H37Rv
cacaggggcagcgcggccacc

SEQ ID NO: 3243105 - RNA, 22 nt, Mycobacterium tuberculosis H37Rv
cacaggggcagcgcggccaccc

SEQ ID NO: 3243106 - RNA, 15 nt, Mycobacterium tuberculosis H37Rv
cacagguccugcgcc

SEQ ID NO: 3243107 - RNA, 15 nt, Mycobacterium tuberculosis H37Rv
cacagguuugcgccg

SEQ ID NO: 3243108 - RNA, 14 nt, Mycobacterium tuberculosis H37Rv
cacagucgccggcc

SEQ ID NO: 3243109 - RNA, 15 nt, Mycobacterium tuberculosis H37Rv
cacagucgccggccg

SEQ ID NO: 3243110 - RNA, 13 nt, Mycobacterium tuberculosis H37Rv
cacagucgcucgc

SEQ ID NO: 3243111 - RNA, 14 nt, Mycobacterium tuberculosis H37Rv
cacagucgcucgcu

SEQ ID NO: 3243112 - RNA, 17 nt, Mycobacterium tuberculosis H37Rv
cacagucggugcagcgc

SEQ ID NO: 3243113 - RNA, 15 nt, Mycobacterium tuberculosis H37Rv
cacagucgugagcca

SEQ ID NO: 3243114 - RNA, 17 nt, Mycobacterium tuberculosis H37Rv
cacagugcggccccgac

SEQ ID NO: 3243115 - RNA, 21 nt, Mycobacterium tuberculosis H37Rv
cacauacagcaggccgcgcuc

SEQ ID NO: 3243116 - RNA, 22 nt, Mycobacterium tuberculosis H37Rv
cacaucaccaaaaacccgguga

SEQ ID NO: 3243117 - RNA, 13 nt, Mycobacterium tuberculosis H37Rv
cacaucaccggcg

SEQ ID NO: 3243118 - RNA, 20 nt, Mycobacterium tuberculosis H37Rv
cacauccacgcacucacuac

SEQ ID NO: 3243119 - RNA, 23 nt, Mycobacterium tuberculosis H37Rv
cacauccaguaaccguccgcgga

SEQ ID NO: 3243120 - RNA, 19 nt, Mycobacterium tuberculosis H37Rv
cacauccgcuugcggggcc

SEQ ID NO: 3243121 - RNA, 15 nt, Mycobacterium tuberculosis H37Rv
cacauccggucagau

SEQ ID NO: 3243122 - RNA, 21 nt, Mycobacterium tuberculosis H37Rv
cacauccuggcggcugcagcc

SEQ ID NO: 3243123 - RNA, 20 nt, Mycobacterium tuberculosis H37Rv
cacaucggugccacguucgc

SEQ ID NO: 3243124 - RNA, 17 nt, Mycobacterium tuberculosis H37Rv
cacaugaacgaccaccg

SEQ ID NO: 3243125 - RNA, 16 nt, Mycobacterium tuberculosis H37Rv
cacaugacgaucgcgg

SEQ ID NO: 3243126 - RNA, 15 nt, Mycobacterium tuberculosis H37Rv
cacaugaucgagcag

SEQ ID NO: 3243127 - RNA, 15 nt, Mycobacterium tuberculosis H37Rv
cacaugccacagcgg

SEQ ID NO: 3243128 - RNA, 16 nt, Mycobacterium tuberculosis H37Rv
cacaugccacagcggc

SEQ ID NO: 3243129 - RNA, 20 nt, Mycobacterium tuberculosis H37Rv
cacaugcccggacgauggcg

SEQ ID NO: 3243130 - RNA, 13 nt, Mycobacterium tuberculosis H37Rv
cacaugcucaggg

SEQ ID NO: 3243131 - RNA, 17 nt, Mycobacterium tuberculosis H37Rv
cacaugcucagucgcuc

SEQ ID NO: 3243132 - RNA, 17 nt, Mycobacterium tuberculosis H37Rv
cacauggaacucacccu

SEQ ID NO: 3243133 - RNA, 19 nt, Mycobacterium tuberculosis H37Rv
cacaugguacggacgcugc

SEQ ID NO: 3243134 - RNA, 13 nt, Mycobacterium tuberculosis H37Rv
cacauucagcgcc

SEQ ID NO: 3243135 - RNA, 19 nt, Mycobacterium tuberculosis H37Rv
cacauuggcgaucagcagc

SEQ ID NO: 3243136 - RNA, 22 nt, Mycobacterium tuberculosis H37Rv
cacauuggcgaucagcagccgc

SEQ ID NO: 3243137 - RNA, 18 nt, Mycobacterium tuberculosis H37Rv
cacauuuuuguuguuauu

SEQ ID NO: 3243138 - RNA, 15 nt, Mycobacterium tuberculosis H37Rv
caccaacaccagcgc

SEQ ID NO: 3243139 - RNA, 15 nt, Mycobacterium tuberculosis H37Rv
caccaacacccgggc

SEQ ID NO: 3243140 - RNA, 17 nt, Mycobacterium tuberculosis H37Rv
caccaacacccgggccu

SEQ ID NO: 3243141 - RNA, 15 nt, Mycobacterium tuberculosis H37Rv
caccaaccagugcag

SEQ ID NO: 3243142 - RNA, 17 nt, Mycobacterium tuberculosis H37Rv
caccaacccacccccca

SEQ ID NO: 3243143 - RNA, 13 nt, Mycobacterium tuberculosis H37Rv
caccaaccgcccg

SEQ ID NO: 3243144 - RNA, 17 nt, Mycobacterium tuberculosis H37Rv
caccaaccgcccgauca

SEQ ID NO: 3243145 - RNA, 15 nt, Mycobacterium tuberculosis H37Rv
caccaacgaacuggg

SEQ ID NO: 3243146 - RNA, 15 nt, Mycobacterium tuberculosis H37Rv
caccaacgagucagu

SEQ ID NO: 3243147 - RNA, 15 nt, Mycobacterium tuberculosis H37Rv
caccaacgccaccgu

SEQ ID NO: 3243148 - RNA, 23 nt, Mycobacterium tuberculosis H37Rv
caccaacgcgaucaggcgcucga

SEQ ID NO: 3243149 - RNA, 13 nt, Mycobacterium tuberculosis H37Rv
caccaacucgacg

SEQ ID NO: 3243150 - RNA, 15 nt, Mycobacterium tuberculosis H37Rv
caccaagacaccggc

SEQ ID NO: 3243151 - RNA, 13 nt, Mycobacterium tuberculosis H37Rv
caccaagacgcca

SEQ ID NO: 3243152 - RNA, 22 nt, Mycobacterium tuberculosis H37Rv
caccaagcucggccagcacgcc

SEQ ID NO: 3243153 - RNA, 20 nt, Mycobacterium tuberculosis H37Rv
caccaaggccgccugcaaca

SEQ ID NO: 3243154 - RNA, 23 nt, Mycobacterium tuberculosis H37Rv
caccaaggccgugaugccacggc

SEQ ID NO: 3243155 - RNA, 19 nt, Mycobacterium tuberculosis H37Rv
caccaaggucuucaggccg

SEQ ID NO: 3243156 - RNA, 23 nt, Mycobacterium tuberculosis H37Rv
caccaaggucuucaggccgcgca

SEQ ID NO: 3243157 - RNA, 20 nt, Mycobacterium tuberculosis H37Rv
caccaauaccgcacccgcuc

SEQ ID NO: 3243158 - RNA, 14 nt, Mycobacterium tuberculosis H37Rv
caccacaacgccag

SEQ ID NO: 3243159 - RNA, 18 nt, Mycobacterium tuberculosis H37Rv
caccacaauccacgcacu

SEQ ID NO: 3243160 - RNA, 14 nt, Mycobacterium tuberculosis H37Rv
caccacacagccgc

SEQ ID NO: 3243161 - RNA, 17 nt, Mycobacterium tuberculosis H37Rv
caccacaccggagccga

SEQ ID NO: 3243162 - RNA, 21 nt, Mycobacterium tuberculosis H37Rv
caccacagacgacgucggcgu

SEQ ID NO: 3243163 - RNA, 22 nt, Mycobacterium tuberculosis H37Rv
caccacaucggugccacguucg

SEQ ID NO: 3243164 - RNA, 15 nt, Mycobacterium tuberculosis H37Rv
caccacaugggagcc

SEQ ID NO: 3243165 - RNA, 16 nt, Mycobacterium tuberculosis H37Rv
caccagcaccgccgcu

SEQ ID NO: 3243166 - RNA, 14 nt, Mycobacterium tuberculosis H37Rv
caccagcagcacca

SEQ ID NO: 3243167 - RNA, 13 nt, Mycobacterium tuberculosis H37Rv
caccagcaggcgg

SEQ ID NO: 3243168 - RNA, 17 nt, Mycobacterium tuberculosis H37Rv
caccagccaaaucagcc

SEQ ID NO: 3243169 - RNA, 19 nt, Mycobacterium tuberculosis H37Rv
caccagccaccgcgcguca

SEQ ID NO: 3243170 - RNA, 15 nt, Mycobacterium tuberculosis H37Rv
caccagccagccugc

SEQ ID NO: 3243171 - RNA, 14 nt, Mycobacterium tuberculosis H37Rv
caccagccccaacc

SEQ ID NO: 3243172 - RNA, 15 nt, Mycobacterium tuberculosis H37Rv
caccagcccggcggc

SEQ ID NO: 3243173 - RNA, 23 nt, Mycobacterium tuberculosis H37Rv
caccagcccggcggcggucacca

SEQ ID NO: 3243174 - RNA, 23 nt, Mycobacterium tuberculosis H37Rv
caccagccgggcaaggcccgguc

SEQ ID NO: 3243175 - RNA, 20 nt, Mycobacterium tuberculosis H37Rv
caccagccgguagccgggca

SEQ ID NO: 3243176 - RNA, 15 nt, Mycobacterium tuberculosis H37Rv
caccagccggugagc

SEQ ID NO: 3243177 - RNA, 20 nt, Mycobacterium tuberculosis H37Rv
caccagccggugagcgagcg

SEQ ID NO: 3243178 - RNA, 14 nt, Mycobacterium tuberculosis H37Rv
caccagccgucagc

SEQ ID NO: 3243179 - RNA, 15 nt, Mycobacterium tuberculosis H37Rv
caccagccgucagcg

SEQ ID NO: 3243180 - RNA, 18 nt, Mycobacterium tuberculosis H37Rv
caccagccgucagcgcgg

SEQ ID NO: 3243181 - RNA, 14 nt, Mycobacterium tuberculosis H37Rv
caccagcgacgcca

SEQ ID NO: 3243182 - RNA, 16 nt, Mycobacterium tuberculosis H37Rv
caccagcgaggccagc

SEQ ID NO: 3243183 - RNA, 12 nt, Mycobacterium tuberculosis H37Rv
caccagcgcagc

SEQ ID NO: 3243184 - RNA, 15 nt, Mycobacterium tuberculosis H37Rv
caccagcgcagcauu

SEQ ID NO: 3243185 - RNA, 19 nt, Mycobacterium tuberculosis H37Rv
caccagcgcagcauugacc

SEQ ID NO: 3243186 - RNA, 21 nt, Mycobacterium tuberculosis H37Rv
caccagcgcagcauugaccaa

SEQ ID NO: 3243187 - RNA, 13 nt, Mycobacterium tuberculosis H37Rv
caccagcgcagcc

SEQ ID NO: 3243188 - RNA, 20 nt, Mycobacterium tuberculosis H37Rv
caccagcgcagccgaucguc

SEQ ID NO: 3243189 - RNA, 15 nt, Mycobacterium tuberculosis H37Rv
caccagcgcaucggc

SEQ ID NO: 3243190 - RNA, 17 nt, Mycobacterium tuberculosis H37Rv
caccagcgcccggcccg

SEQ ID NO: 3243191 - RNA, 20 nt, Mycobacterium tuberculosis H37Rv
caccagcgcccggcccgcca

SEQ ID NO: 3243192 - RNA, 23 nt, Mycobacterium tuberculosis H37Rv
caccagcgcccggcccgccaccc

SEQ ID NO: 3243193 - RNA, 17 nt, Mycobacterium tuberculosis H37Rv
caccagcgcccgucgcu

SEQ ID NO: 3243194 - RNA, 17 nt, Mycobacterium tuberculosis H37Rv
caccagcgccuugacgc

SEQ ID NO: 3243195 - RNA, 17 nt, Mycobacterium tuberculosis H37Rv
caccagcgcgagcccga

SEQ ID NO: 3243196 - RNA, 21 nt, Mycobacterium tuberculosis H37Rv
caccagcgcgagcccgaacca

SEQ ID NO: 3243197 - RNA, 13 nt, Mycobacterium tuberculosis H37Rv
caccagcgcgccg

SEQ ID NO: 3243198 - RNA, 16 nt, Mycobacterium tuberculosis H37Rv
caccagcgcuccagca

SEQ ID NO: 3243199 - RNA, 19 nt, Mycobacterium tuberculosis H37Rv
caccagcgcuccagcaccc

SEQ ID NO: 3243200 - RNA, 20 nt, Mycobacterium tuberculosis H37Rv
caccagcggcaccgcggcca

SEQ ID NO: 3243201 - RNA, 23 nt, Mycobacterium tuberculosis H37Rv
caccagcggcauauggauguugg

SEQ ID NO: 3243202 - RNA, 16 nt, Mycobacterium tuberculosis H37Rv
caccagcggcggcccu

SEQ ID NO: 3243203 - RNA, 20 nt, Mycobacterium tuberculosis H37Rv
caccagcggcugaccgggca

SEQ ID NO: 3243204 - RNA, 14 nt, Mycobacterium tuberculosis H37Rv
caccagcggucagc

SEQ ID NO: 3243205 - RNA, 20 nt, Mycobacterium tuberculosis H37Rv
caccagcggucagccggcca

SEQ ID NO: 3243206 - RNA, 14 nt, Mycobacterium tuberculosis H37Rv
caccagcgucgcgg

SEQ ID NO: 3243207 - RNA, 17 nt, Mycobacterium tuberculosis H37Rv
caccagcgucgcggcca

SEQ ID NO: 3243208 - RNA, 16 nt, Mycobacterium tuberculosis H37Rv
caccagcucacccgga

SEQ ID NO: 3243209 - RNA, 20 nt, Mycobacterium tuberculosis H37Rv
caccagcucacccggagcac

SEQ ID NO: 3243210 - RNA, 21 nt, Mycobacterium tuberculosis H37Rv
caccagcucacccggagcacc

SEQ ID NO: 3243211 - RNA, 16 nt, Mycobacterium tuberculosis H37Rv
caccagcugcucgucg

SEQ ID NO: 3243212 - RNA, 17 nt, Mycobacterium tuberculosis H37Rv
caccagcuggaacggca

SEQ ID NO: 3243213 - RNA, 13 nt, Mycobacterium tuberculosis H37Rv
caccagcuggaag

SEQ ID NO: 3243214 - RNA, 15 nt, Mycobacterium tuberculosis H37Rv
caccagggccaccgc

SEQ ID NO: 3243215 - RNA, 22 nt, Mycobacterium tuberculosis H37Rv
caccagggccuccacccgccac

SEQ ID NO: 3243216 - RNA, 17 nt, Mycobacterium tuberculosis H37Rv
caccaggggaccgcggc

SEQ ID NO: 3243217 - RNA, 16 nt, Mycobacterium tuberculosis H37Rv
caccaggggcgcguca

SEQ ID NO: 3243218 - RNA, 22 nt, Mycobacterium tuberculosis H37Rv
caccaggggcgcgucauggcga

SEQ ID NO: 3243219 - RNA, 21 nt, Mycobacterium tuberculosis H37Rv
caccagggggcgagagcgcgg

SEQ ID NO: 3243220 - RNA, 17 nt, Mycobacterium tuberculosis H37Rv
caccagggugccgggca

SEQ ID NO: 3243221 - RNA, 17 nt, Mycobacterium tuberculosis H37Rv
caccaggguguauggcc

SEQ ID NO: 3243222 - RNA, 23 nt, Mycobacterium tuberculosis H37Rv
caccagguacgcgaucagcgcgc

SEQ ID NO: 3243223 - RNA, 16 nt, Mycobacterium tuberculosis H37Rv
caccaggucauugccg

SEQ ID NO: 3243224 - RNA, 20 nt, Mycobacterium tuberculosis H37Rv
caccaggucggccuucagcg

SEQ ID NO: 3243225 - RNA, 17 nt, Mycobacterium tuberculosis H37Rv
caccagguguccccgcc

SEQ ID NO: 3243226 - RNA, 23 nt, Mycobacterium tuberculosis H37Rv
caccagguugcaaccuugggcgc

SEQ ID NO: 3243227 - RNA, 15 nt, Mycobacterium tuberculosis H37Rv
caccagucacgccca

SEQ ID NO: 3243228 - RNA, 19 nt, Mycobacterium tuberculosis H37Rv
caccagucacgcccaccac

SEQ ID NO: 3243229 - RNA, 14 nt, Mycobacterium tuberculosis H37Rv
caccaguccagcgg

SEQ ID NO: 3243230 - RNA, 15 nt, Mycobacterium tuberculosis H37Rv
caccaguccagcggg

SEQ ID NO: 3243231 - RNA, 17 nt, Mycobacterium tuberculosis H37Rv
caccaguccagcgggca

SEQ ID NO: 3243232 - RNA, 15 nt, Mycobacterium tuberculosis H37Rv
caccagucgcgcagc

SEQ ID NO: 3243233 - RNA, 14 nt, Mycobacterium tuberculosis H37Rv
caccagugccccgc

SEQ ID NO: 3243234 - RNA, 15 nt, Mycobacterium tuberculosis H37Rv
caccagugccccgcc

SEQ ID NO: 3243235 - RNA, 20 nt, Mycobacterium tuberculosis H37Rv
caccagugccccgccgagcg

SEQ ID NO: 3243236 - RNA, 19 nt, Mycobacterium tuberculosis H37Rv
caccagugcgggguccagc

SEQ ID NO: 3243237 - RNA, 15 nt, Mycobacterium tuberculosis H37Rv
caccaguggcgccca

SEQ ID NO: 3243238 - RNA, 19 nt, Mycobacterium tuberculosis H37Rv
caccaguguggcgaugacc

SEQ ID NO: 3243239 - RNA, 22 nt, Mycobacterium tuberculosis H37Rv
caccaguuugugccgccgcggc

SEQ ID NO: 3243240 - RNA, 16 nt, Mycobacterium tuberculosis H37Rv
caccauaauggucguc

SEQ ID NO: 3243241 - RNA, 20 nt, Mycobacterium tuberculosis H37Rv
caccauaauggucgucgcga

SEQ ID NO: 3243242 - RNA, 23 nt, Mycobacterium tuberculosis H37Rv
caccaucaacauugugcucgccg

SEQ ID NO: 3243243 - RNA, 24 nt, Mycobacterium tuberculosis H37Rv
caccaucaaggacucggacgcgcc

SEQ ID NO: 3243244 - RNA, 12 nt, Mycobacterium tuberculosis H37Rv
caccaucaucac

SEQ ID NO: 3243245 - RNA, 14 nt, Mycobacterium tuberculosis H37Rv
caccaucaucaccu

SEQ ID NO: 3243246 - RNA, 14 nt, Mycobacterium tuberculosis H37Rv
caccauccccggca

SEQ ID NO: 3243247 - RNA, 14 nt, Mycobacterium tuberculosis H37Rv
caccauccgguccc

SEQ ID NO: 3243248 - RNA, 19 nt, Mycobacterium tuberculosis H37Rv
caccaucgccgccgcgcgu

SEQ ID NO: 3243249 - RNA, 23 nt, Mycobacterium tuberculosis H37Rv
caccaucgccgccguugccgccg

SEQ ID NO: 3243250 - RNA, 19 nt, Mycobacterium tuberculosis H37Rv
caccaucgcggccgcuggg

SEQ ID NO: 3243251 - RNA, 19 nt, Mycobacterium tuberculosis H37Rv
caccaucggggaaggggcu

SEQ ID NO: 3243252 - RNA, 21 nt, Mycobacterium tuberculosis H37Rv
caccaucguugccggugccgc

SEQ ID NO: 3243253 - RNA, 23 nt, Mycobacterium tuberculosis H37Rv
caccaucguugccggugccgccg

SEQ ID NO: 3243254 - RNA, 16 nt, Mycobacterium tuberculosis H37Rv
caccaucuccgccguc

SEQ ID NO: 3243255 - RNA, 17 nt, Mycobacterium tuberculosis H37Rv
caccaucuccgccgucg

SEQ ID NO: 3243256 - RNA, 21 nt, Mycobacterium tuberculosis H37Rv
caccaucuccgccgucgccac

SEQ ID NO: 3243257 - RNA, 17 nt, Mycobacterium tuberculosis H37Rv
caccaugaucaggcccc

SEQ ID NO: 3243258 - RNA, 22 nt, Mycobacterium tuberculosis H37Rv
caccaugaucaggccccacacg

SEQ ID NO: 3243259 - RNA, 20 nt, Mycobacterium tuberculosis H37Rv
caccaugauugccaggaccg

SEQ ID NO: 3243260 - RNA, 21 nt, Mycobacterium tuberculosis H37Rv
caccaugcucggaaacagcga

SEQ ID NO: 3243261 - RNA, 19 nt, Mycobacterium tuberculosis H37Rv
cacccgaauuugucggcga

SEQ ID NO: 3243262 - RNA, 15 nt, Mycobacterium tuberculosis H37Rv
cacccgacucgucgg

SEQ ID NO: 3243263 - RNA, 14 nt, Mycobacterium tuberculosis H37Rv
cacccgagggccug

SEQ ID NO: 3243264 - RNA, 18 nt, Mycobacterium tuberculosis H37Rv
cacccgaucgacgacuug

SEQ ID NO: 3243265 - RNA, 18 nt, Mycobacterium tuberculosis H37Rv
cacccgaucgacggucgu

SEQ ID NO: 3243266 - RNA, 15 nt, Mycobacterium tuberculosis H37Rv
cacccgaugugcccg

SEQ ID NO: 3243267 - RNA, 12 nt, Mycobacterium tuberculosis H37Rv
cacccgauuggc

SEQ ID NO: 3243268 - RNA, 22 nt, Mycobacterium tuberculosis H37Rv
cacccgcaaugcgcgcgauggc

SEQ ID NO: 3243269 - RNA, 13 nt, Mycobacterium tuberculosis H37Rv
cacccgcaccacc

SEQ ID NO: 3243270 - RNA, 14 nt, Mycobacterium tuberculosis H37Rv
cacccgcaccaccg

SEQ ID NO: 3243271 - RNA, 19 nt, Mycobacterium tuberculosis H37Rv
cacccgcaccaccggcccc

SEQ ID NO: 3243272 - RNA, 22 nt, Mycobacterium tuberculosis H37Rv
cacccgcaccaccggccccacc

SEQ ID NO: 3243273 - RNA, 14 nt, Mycobacterium tuberculosis H37Rv
cacccgcaccgccg

SEQ ID NO: 3243274 - RNA, 14 nt, Mycobacterium tuberculosis H37Rv
cacccgcaccgcgg

SEQ ID NO: 3243275 - RNA, 18 nt, Mycobacterium tuberculosis H37Rv
cacccgcaccucaccggg

SEQ ID NO: 3243276 - RNA, 20 nt, Mycobacterium tuberculosis H37Rv
cacccgcaccucaccggguu

SEQ ID NO: 3243277 - RNA, 13 nt, Mycobacterium tuberculosis H37Rv
cacccgcacucca

SEQ ID NO: 3243278 - RNA, 23 nt, Mycobacterium tuberculosis H37Rv
cacccgcaggucgaucugcgcca

SEQ ID NO: 3243279 - RNA, 14 nt, Mycobacterium tuberculosis H37Rv
cacccgcaggucgc

SEQ ID NO: 3243280 - RNA, 20 nt, Mycobacterium tuberculosis H37Rv
cacccgcaggucgcaccaca

SEQ ID NO: 3243281 - RNA, 12 nt, Mycobacterium tuberculosis H37Rv
cacccgcaucgg

SEQ ID NO: 3243282 - RNA, 19 nt, Mycobacterium tuberculosis H37Rv
cacccgcaucggcacgcca

SEQ ID NO: 3243283 - RNA, 14 nt, Mycobacterium tuberculosis H37Rv
cacccgccaggccg

SEQ ID NO: 3243284 - RNA, 15 nt, Mycobacterium tuberculosis H37Rv
cacccgccaggccgc

SEQ ID NO: 3243285 - RNA, 12 nt, Mycobacterium tuberculosis H37Rv
cacccgcccgag

SEQ ID NO: 3243286 - RNA, 13 nt, Mycobacterium tuberculosis H37Rv
cacccgccgcagc

SEQ ID NO: 3243287 - RNA, 13 nt, Mycobacterium tuberculosis H37Rv
cacccgccggccg

SEQ ID NO: 3243288 - RNA, 13 nt, Mycobacterium tuberculosis H37Rv
cacccgcgccgcc

SEQ ID NO: 3243289 - RNA, 14 nt, Mycobacterium tuberculosis H37Rv
cacccgcgccgccc

SEQ ID NO: 3243290 - RNA, 23 nt, Mycobacterium tuberculosis H37Rv
cacccgcggcgccguugccgccg

SEQ ID NO: 3243291 - RNA, 15 nt, Mycobacterium tuberculosis H37Rv
cacccgcggugacgc

SEQ ID NO: 3243292 - RNA, 23 nt, Mycobacterium tuberculosis H37Rv
cacccgcgucgagugccgccacc

SEQ ID NO: 3243293 - RNA, 17 nt, Mycobacterium tuberculosis H37Rv
cacccgcucggccguca

SEQ ID NO: 3243294 - RNA, 17 nt, Mycobacterium tuberculosis H37Rv
cacccgcucggcgcgcg

SEQ ID NO: 3243295 - RNA, 18 nt, Mycobacterium tuberculosis H37Rv
cacccgcuggcgguaagc

SEQ ID NO: 3243296 - RNA, 16 nt, Mycobacterium tuberculosis H37Rv
cacccgcuggucgagc

SEQ ID NO: 3243297 - RNA, 15 nt, Mycobacterium tuberculosis H37Rv
cacccggcagagcac

SEQ ID NO: 3243298 - RNA, 22 nt, Mycobacterium tuberculosis H37Rv
cacccggcccaaggaacggcgu

SEQ ID NO: 3243299 - RNA, 13 nt, Mycobacterium tuberculosis H37Rv
cacccggccguug

SEQ ID NO: 3243300 - RNA, 19 nt, Mycobacterium tuberculosis H37Rv
cacccggcuucgccgcgcu

SEQ ID NO: 3243301 - RNA, 21 nt, Mycobacterium tuberculosis H37Rv
cacccgggacguuguccaccg

SEQ ID NO: 3243302 - RNA, 23 nt, Mycobacterium tuberculosis H37Rv
cacccgggacguuguccaccgcc

SEQ ID NO: 3243303 - RNA, 20 nt, Mycobacterium tuberculosis H37Rv
cacccgggcagccugcugca

SEQ ID NO: 3243304 - RNA, 20 nt, Mycobacterium tuberculosis H37Rv
cacccgggccaccccgagcu

SEQ ID NO: 3243305 - RNA, 15 nt, Mycobacterium tuberculosis H37Rv
cacccgggccaucgc

SEQ ID NO: 3243306 - RNA, 18 nt, Mycobacterium tuberculosis H37Rv
cacccgggccucggcgcc

SEQ ID NO: 3243307 - RNA, 21 nt, Mycobacterium tuberculosis H37Rv
cacccgggccucggcgccguc

SEQ ID NO: 3243308 - RNA, 13 nt, Mycobacterium tuberculosis H37Rv
cacccgggcgugg

SEQ ID NO: 3243309 - RNA, 18 nt, Mycobacterium tuberculosis H37Rv
cacccggggugcccggcc

SEQ ID NO: 3243310 - RNA, 20 nt, Mycobacterium tuberculosis H37Rv
cacccggggugcccggccgc

SEQ ID NO: 3243311 - RNA, 21 nt, Mycobacterium tuberculosis H37Rv
cacccggggugcccggccgcc

SEQ ID NO: 3243312 - RNA, 19 nt, Mycobacterium tuberculosis H37Rv
cacccggguggcacgcacg

SEQ ID NO: 3243313 - RNA, 17 nt, Mycobacterium tuberculosis H37Rv
cacccgguagacgucgu

SEQ ID NO: 3243314 - RNA, 18 nt, Mycobacterium tuberculosis H37Rv
cacccggucaucggccgu

SEQ ID NO: 3243315 - RNA, 15 nt, Mycobacterium tuberculosis H37Rv
cacccgguccggccc

SEQ ID NO: 3243316 - RNA, 19 nt, Mycobacterium tuberculosis H37Rv
cacccggugagaagaagcc

SEQ ID NO: 3243317 - RNA, 14 nt, Mycobacterium tuberculosis H37Rv
cacccggugccgca

SEQ ID NO: 3243318 - RNA, 18 nt, Mycobacterium tuberculosis H37Rv
cacccggugccgcagcag

SEQ ID NO: 3243319 - RNA, 15 nt, Mycobacterium tuberculosis H37Rv
cacccgguugugcgc

SEQ ID NO: 3243320 - RNA, 16 nt, Mycobacterium tuberculosis H37Rv
cacccgugccgccgau

SEQ ID NO: 3243321 - RNA, 17 nt, Mycobacterium tuberculosis H37Rv
cacccgugccgccgaug

SEQ ID NO: 3243322 - RNA, 20 nt, Mycobacterium tuberculosis H37Rv
cacccgugccgccgaugccg

SEQ ID NO: 3243323 - RNA, 18 nt, Mycobacterium tuberculosis H37Rv
cacccguguucgccacac

SEQ ID NO: 3243324 - RNA, 19 nt, Mycobacterium tuberculosis H37Rv
cacccguguugagggugcc

SEQ ID NO: 3243325 - RNA, 20 nt, Mycobacterium tuberculosis H37Rv
cacccguucgugagcggcca

SEQ ID NO: 3243326 - RNA, 20 nt, Mycobacterium tuberculosis H37Rv
cacccguugaucgcggacac

SEQ ID NO: 3243327 - RNA, 16 nt, Mycobacterium tuberculosis H37Rv
cacccguugcgacacc

SEQ ID NO: 3243328 - RNA, 16 nt, Mycobacterium tuberculosis H37Rv
cacccuaaucguuccg

SEQ ID NO: 3243329 - RNA, 21 nt, Mycobacterium tuberculosis H37Rv
cacccuauuggucggucgcgc

SEQ ID NO: 3243330 - RNA, 15 nt, Mycobacterium tuberculosis H37Rv
cacccuccgccgguc

SEQ ID NO: 3243331 - RNA, 12 nt, Mycobacterium tuberculosis H37Rv
cacccucgggca

SEQ ID NO: 3243332 - RNA, 18 nt, Mycobacterium tuberculosis H37Rv
cacccugaugugagucca

SEQ ID NO: 3243333 - RNA, 22 nt, Mycobacterium tuberculosis H37Rv
cacccugggcaaacugggcacc

SEQ ID NO: 3243334 - RNA, 13 nt, Mycobacterium tuberculosis H37Rv
cacccugucgcgc

SEQ ID NO: 3243335 - RNA, 17 nt, Mycobacterium tuberculosis H37Rv
cacccuguuccagcggg

SEQ ID NO: 3243336 - RNA, 14 nt, Mycobacterium tuberculosis H37Rv
cacccuugccgccg

SEQ ID NO: 3243337 - RNA, 14 nt, Mycobacterium tuberculosis H37Rv
caccgaaaaguccg

SEQ ID NO: 3243338 - RNA, 21 nt, Mycobacterium tuberculosis H37Rv
caccgaaacgcgcggaucguc

SEQ ID NO: 3243339 - RNA, 15 nt, Mycobacterium tuberculosis H37Rv
caccgaacacggcgu

SEQ ID NO: 3243340 - RNA, 18 nt, Mycobacterium tuberculosis H37Rv
caccgaacagucgcagcc

SEQ ID NO: 3243341 - RNA, 17 nt, Mycobacterium tuberculosis H37Rv
caccgaacccgccaccg

SEQ ID NO: 3243342 - RNA, 14 nt, Mycobacterium tuberculosis H37Rv
caccgaaccgccgc

SEQ ID NO: 3243343 - RNA, 20 nt, Mycobacterium tuberculosis H37Rv
caccgaaccgccgcugccgc

SEQ ID NO: 3243344 - RNA, 15 nt, Mycobacterium tuberculosis H37Rv
caccgaacgcaccga

SEQ ID NO: 3243345 - RNA, 13 nt, Mycobacterium tuberculosis H37Rv
caccgaacgcggc

SEQ ID NO: 3243346 - RNA, 16 nt, Mycobacterium tuberculosis H37Rv
caccgaacgcggccac

SEQ ID NO: 3243347 - RNA, 17 nt, Mycobacterium tuberculosis H37Rv
caccgaacgcggccacc

SEQ ID NO: 3243348 - RNA, 22 nt, Mycobacterium tuberculosis H37Rv
caccgaacgcggccaccgaccg

SEQ ID NO: 3243349 - RNA, 16 nt, Mycobacterium tuberculosis H37Rv
caccgaacuugcggac

SEQ ID NO: 3243350 - RNA, 21 nt, Mycobacterium tuberculosis H37Rv
caccgaauaccgccgcgcagc

SEQ ID NO: 3243351 - RNA, 20 nt, Mycobacterium tuberculosis H37Rv
caccgaaugcacgacggugu

SEQ ID NO: 3243352 - RNA, 21 nt, Mycobacterium tuberculosis H37Rv
caccgacaauucaacacacgg

SEQ ID NO: 3243353 - RNA, 12 nt, Mycobacterium tuberculosis H37Rv
caccgacaccgg

SEQ ID NO: 3243354 - RNA, 13 nt, Mycobacterium tuberculosis H37Rv
caccgacaccggc

SEQ ID NO: 3243355 - RNA, 14 nt, Mycobacterium tuberculosis H37Rv
caccgacaccggcc

SEQ ID NO: 3243356 - RNA, 15 nt, Mycobacterium tuberculosis H37Rv
caccgacaccggccg

SEQ ID NO: 3243357 - RNA, 12 nt, Mycobacterium tuberculosis H37Rv
caccgacaccgu

SEQ ID NO: 3243358 - RNA, 19 nt, Mycobacterium tuberculosis H37Rv
caccgccgcgaccgccucg

SEQ ID NO: 3243359 - RNA, 19 nt, Mycobacterium tuberculosis H37Rv
caccgccgcgccggcggcc

SEQ ID NO: 3243360 - RNA, 20 nt, Mycobacterium tuberculosis H37Rv
caccgccgcgccggcggcca

SEQ ID NO: 3243361 - RNA, 15 nt, Mycobacterium tuberculosis H37Rv
caccgccgcggccgc

SEQ ID NO: 3243362 - RNA, 23 nt, Mycobacterium tuberculosis H37Rv
caccgccgcggccgccguccccg

SEQ ID NO: 3243363 - RNA, 19 nt, Mycobacterium tuberculosis H37Rv
caccgccgcuaccgcccgc

SEQ ID NO: 3243364 - RNA, 14 nt, Mycobacterium tuberculosis H37Rv
caccgccgcugcca

SEQ ID NO: 3243365 - RNA, 15 nt, Mycobacterium tuberculosis H37Rv
caccgccggcaccgc

SEQ ID NO: 3243366 - RNA, 19 nt, Mycobacterium tuberculosis H37Rv
caccgccggcagcaucggc

SEQ ID NO: 3243367 - RNA, 13 nt, Mycobacterium tuberculosis H37Rv
caccgccggcgcc

SEQ ID NO: 3243368 - RNA, 15 nt, Mycobacterium tuberculosis H37Rv
caccgccggcgcccc

SEQ ID NO: 3243369 - RNA, 20 nt, Mycobacterium tuberculosis H37Rv
caccgccggcgccgccgucg

SEQ ID NO: 3243370 - RNA, 20 nt, Mycobacterium tuberculosis H37Rv
caccgccggcuccgccguug

SEQ ID NO: 3243371 - RNA, 19 nt, Mycobacterium tuberculosis H37Rv
caccgccgggaugccggcc

SEQ ID NO: 3243372 - RNA, 21 nt, Mycobacterium tuberculosis H37Rv
caccgccgggaugccggcccc

SEQ ID NO: 3243373 - RNA, 16 nt, Mycobacterium tuberculosis H37Rv
caccgccggggugugc

SEQ ID NO: 3243374 - RNA, 21 nt, Mycobacterium tuberculosis H37Rv
caccgccggugccgccaucgc

SEQ ID NO: 3243375 - RNA, 15 nt, Mycobacterium tuberculosis H37Rv
caccgccgguggcgc

SEQ ID NO: 3243376 - RNA, 19 nt, Mycobacterium tuberculosis H37Rv
caccgccgucaccgccauu

SEQ ID NO: 3243377 - RNA, 15 nt, Mycobacterium tuberculosis H37Rv
caccgccguugccgc

SEQ ID NO: 3243378 - RNA, 19 nt, Mycobacterium tuberculosis H37Rv
caccgccguugccgccggc

SEQ ID NO: 3243379 - RNA, 23 nt, Mycobacterium tuberculosis H37Rv
caccgccguugccgccggcgccg

SEQ ID NO: 3243380 - RNA, 15 nt, Mycobacterium tuberculosis H37Rv
caccgccugcgccgc

SEQ ID NO: 3243381 - RNA, 16 nt, Mycobacterium tuberculosis H37Rv
caccgccugcgccgcc

SEQ ID NO: 3243382 - RNA, 17 nt, Mycobacterium tuberculosis H37Rv
caccgccugcgccgccc

SEQ ID NO: 3243383 - RNA, 18 nt, Mycobacterium tuberculosis H37Rv
caccgccugcgccgcccg

SEQ ID NO: 3243384 - RNA, 22 nt, Mycobacterium tuberculosis H37Rv
caccgccuggaucagcgcguug

SEQ ID NO: 3243385 - RNA, 18 nt, Mycobacterium tuberculosis H37Rv
caccgccugugccgccgg

SEQ ID NO: 3243386 - RNA, 21 nt, Mycobacterium tuberculosis H37Rv
caccgccuuugccgccggcac

SEQ ID NO: 3243387 - RNA, 17 nt, Mycobacterium tuberculosis H37Rv
caccgcgacaccccgga

SEQ ID NO: 3243388 - RNA, 14 nt, Mycobacterium tuberculosis H37Rv
caccgcgaccucgc

SEQ ID NO: 3243389 - RNA, 20 nt, Mycobacterium tuberculosis H37Rv
caccgcgaccucgcggcgcu

SEQ ID NO: 3243390 - RNA, 14 nt, Mycobacterium tuberculosis H37Rv
caccgcgacgacga

SEQ ID NO: 3243391 - RNA, 12 nt, Mycobacterium tuberculosis H37Rv
caccgcgcauca

SEQ ID NO: 3243392 - RNA, 17 nt, Mycobacterium tuberculosis H37Rv
caccgcgcaucaucgcc

SEQ ID NO: 3243393 - RNA, 14 nt, Mycobacterium tuberculosis H37Rv
caccgcgccgacga

SEQ ID NO: 3243394 - RNA, 19 nt, Mycobacterium tuberculosis H37Rv
caccgcgccgagcagacgc

SEQ ID NO: 3243395 - RNA, 15 nt, Mycobacterium tuberculosis H37Rv
caccgcgccggcgga

SEQ ID NO: 3243396 - RNA, 13 nt, Mycobacterium tuberculosis H37Rv
caccgcgccgucg

SEQ ID NO: 3243397 - RNA, 17 nt, Mycobacterium tuberculosis H37Rv
caccgcgccgucgucgc

SEQ ID NO: 3243398 - RNA, 16 nt, Mycobacterium tuberculosis H37Rv
caccgcgcgcuccaga

SEQ ID NO: 3243399 - RNA, 17 nt, Mycobacterium tuberculosis H37Rv
caccgcgcgcuccagau

SEQ ID NO: 3243400 - RNA, 22 nt, Mycobacterium tuberculosis H37Rv
caccgcgcggcgcagcaccguc

SEQ ID NO: 3243401 - RNA, 14 nt, Mycobacterium tuberculosis H37Rv
caccgcgcucucgg

SEQ ID NO: 3243402 - RNA, 17 nt, Mycobacterium tuberculosis H37Rv
caccgcgcucucgguca

SEQ ID NO: 3243403 - RNA, 15 nt, Mycobacterium tuberculosis H37Rv
caccgcggaaggcca

SEQ ID NO: 3243404 - RNA, 18 nt, Mycobacterium tuberculosis H37Rv
caccgcggaaggccagcu

SEQ ID NO: 3243405 - RNA, 14 nt, Mycobacterium tuberculosis H37Rv
caccgcggacccgc

SEQ ID NO: 3243406 - RNA, 15 nt, Mycobacterium tuberculosis H37Rv
caccgcggacccgca

SEQ ID NO: 3243407 - RNA, 22 nt, Mycobacterium tuberculosis H37Rv
caccgcggacccgcagcugcgg

SEQ ID NO: 3243408 - RNA, 22 nt, Mycobacterium tuberculosis H37Rv
caccgcggauaggccgcgcggc

SEQ ID NO: 3243409 - RNA, 13 nt, Mycobacterium tuberculosis H37Rv
caccgcggcaugu

SEQ ID NO: 3243410 - RNA, 12 nt, Mycobacterium tuberculosis H37Rv
caccgcggccga

SEQ ID NO: 3243411 - RNA, 16 nt, Mycobacterium tuberculosis H37Rv
caccgcggccgaggga

SEQ ID NO: 3243412 - RNA, 13 nt, Mycobacterium tuberculosis H37Rv
caccgcggccgcg

SEQ ID NO: 3243413 - RNA, 19 nt, Mycobacterium tuberculosis H37Rv
caccgcggccgcggucgau

SEQ ID NO: 3243414 - RNA, 22 nt, Mycobacterium tuberculosis H37Rv
caccgcggcgcugaugccgucu

SEQ ID NO: 3243415 - RNA, 15 nt, Mycobacterium tuberculosis H37Rv
caccgcggcggcgcg

SEQ ID NO: 3243416 - RNA, 16 nt, Mycobacterium tuberculosis H37Rv
caccgcggcggcggcc

SEQ ID NO: 3243417 - RNA, 17 nt, Mycobacterium tuberculosis H37Rv
caccgcggcggcggcca

SEQ ID NO: 3243418 - RNA, 18 nt, Mycobacterium tuberculosis H37Rv
caccgcggcggcggccau

SEQ ID NO: 3243419 - RNA, 15 nt, Mycobacterium tuberculosis H37Rv
caccgcggcgucgcc

SEQ ID NO: 3243420 - RNA, 23 nt, Mycobacterium tuberculosis H37Rv
caccgcgggaucgguggcggcac

SEQ ID NO: 3243421 - RNA, 16 nt, Mycobacterium tuberculosis H37Rv
caccgcgguacgccgg

SEQ ID NO: 3243422 - RNA, 17 nt, Mycobacterium tuberculosis H37Rv
caccgcgguacgccggu

SEQ ID NO: 3243423 - RNA, 19 nt, Mycobacterium tuberculosis H37Rv
caccgcgguagccgagcuu

SEQ ID NO: 3243424 - RNA, 20 nt, Mycobacterium tuberculosis H37Rv
caccgcgguagccgagcuug

SEQ ID NO: 3243425 - RNA, 15 nt, Mycobacterium tuberculosis H37Rv
caccgcggucaccga

SEQ ID NO: 3243426 - RNA, 20 nt, Mycobacterium tuberculosis H37Rv
caccgcgguggcggcgagca

SEQ ID NO: 3243427 - RNA, 22 nt, Mycobacterium tuberculosis H37Rv
caccgcguaauucgacuucggg

SEQ ID NO: 3243428 - RNA, 21 nt, Mycobacterium tuberculosis H37Rv
caccgcguccaggugcgccgu

SEQ ID NO: 3243429 - RNA, 15 nt, Mycobacterium tuberculosis H37Rv
caccgcgucggccga

SEQ ID NO: 3243430 - RNA, 13 nt, Mycobacterium tuberculosis H37Rv
caccgcgucgggc

SEQ ID NO: 3243431 - RNA, 17 nt, Mycobacterium tuberculosis H37Rv
caccgcgucgggccgca

SEQ ID NO: 3243432 - RNA, 17 nt, Mycobacterium tuberculosis H37Rv
caccgcguucugguugu

SEQ ID NO: 3243433 - RNA, 19 nt, Mycobacterium tuberculosis H37Rv
caccgcguugaugaccagg

SEQ ID NO: 3243434 - RNA, 16 nt, Mycobacterium tuberculosis H37Rv
caccgcguuggccaca

SEQ ID NO: 3243435 - RNA, 13 nt, Mycobacterium tuberculosis H37Rv
caccgcucgccac

SEQ ID NO: 3243436 - RNA, 14 nt, Mycobacterium tuberculosis H37Rv
caccgcugccggca

SEQ ID NO: 3243437 - RNA, 18 nt, Mycobacterium tuberculosis H37Rv
caccgcugcggcaccacc

SEQ ID NO: 3243438 - RNA, 22 nt, Mycobacterium tuberculosis H37Rv
caccgcugcggcaccacccggc

SEQ ID NO: 3243439 - RNA, 17 nt, Mycobacterium tuberculosis H37Rv
caccgcugcggccagcg

SEQ ID NO: 3243440 - RNA, 19 nt, Mycobacterium tuberculosis H37Rv
caccgcuguguucagcgca

SEQ ID NO: 3243441 - RNA, 19 nt, Mycobacterium tuberculosis H37Rv
caccgcuguucuuggugac

SEQ ID NO: 3243442 - RNA, 15 nt, Mycobacterium tuberculosis H37Rv
caccgcuucaggcgc

SEQ ID NO: 3243443 - RNA, 19 nt, Mycobacterium tuberculosis H37Rv
caccgcuucaggcgccacu

SEQ ID NO: 3243444 - RNA, 17 nt, Mycobacterium tuberculosis H37Rv
caccgcuugaccccugg

SEQ ID NO: 3243445 - RNA, 22 nt, Mycobacterium tuberculosis H37Rv
caccggaaccaccaguaccacc

SEQ ID NO: 3243446 - RNA, 20 nt, Mycobacterium tuberculosis H37Rv
caccggaacccccagcugca

SEQ ID NO: 3243447 - RNA, 15 nt, Mycobacterium tuberculosis H37Rv
caccggaauacagcc

SEQ ID NO: 3243448 - RNA, 19 nt, Mycobacterium tuberculosis H37Rv
caccggaauccgggccgcc

SEQ ID NO: 3243449 - RNA, 23 nt, Mycobacterium tuberculosis H37Rv
caccggaauuugcgucgugggga

SEQ ID NO: 3243450 - RNA, 15 nt, Mycobacterium tuberculosis H37Rv
caccggaccgaccac

SEQ ID NO: 3243451 - RNA, 13 nt, Mycobacterium tuberculosis H37Rv
caccggacugcgc

SEQ ID NO: 3243452 - RNA, 23 nt, Mycobacterium tuberculosis H37Rv
caccggacugcgccgggugaggc

SEQ ID NO: 3243453 - RNA, 21 nt, Mycobacterium tuberculosis H37Rv
caccggagaacgggucgacgu

SEQ ID NO: 3243454 - RNA, 16 nt, Mycobacterium tuberculosis H37Rv
caccgucaacgacugg

SEQ ID NO: 3243455 - RNA, 17 nt, Mycobacterium tuberculosis H37Rv
caccgucacgccaccgc

SEQ ID NO: 3243456 - RNA, 15 nt, Mycobacterium tuberculosis H37Rv
caccgucaguucggu

SEQ ID NO: 3243457 - RNA, 15 nt, Mycobacterium tuberculosis H37Rv
caccguccagcagcu

SEQ ID NO: 3243458 - RNA, 20 nt, Mycobacterium tuberculosis H37Rv
caccgucccugugucgccgu

SEQ ID NO: 3243459 - RNA, 22 nt, Mycobacterium tuberculosis H37Rv
caccgucccugugucgccgucg

SEQ ID NO: 3243460 - RNA, 16 nt, Mycobacterium tuberculosis H37Rv
caccguccgucggcgc

SEQ ID NO: 3243461 - RNA, 14 nt, Mycobacterium tuberculosis H37Rv
caccgucgacgaca

SEQ ID NO: 3243462 - RNA, 12 nt, Mycobacterium tuberculosis H37Rv
caccgucgagcc

SEQ ID NO: 3243463 - RNA, 15 nt, Mycobacterium tuberculosis H37Rv
caccgucgagccgga

SEQ ID NO: 3243464 - RNA, 17 nt, Mycobacterium tuberculosis H37Rv
caccgucgagucgacgg

SEQ ID NO: 3243465 - RNA, 17 nt, Mycobacterium tuberculosis H37Rv
caccgucgcaccagcga

SEQ ID NO: 3243466 - RNA, 14 nt, Mycobacterium tuberculosis H37Rv
caccgucgcaccca

SEQ ID NO: 3243467 - RNA, 17 nt, Mycobacterium tuberculosis H37Rv
caccgucgccgccgguc

SEQ ID NO: 3243468 - RNA, 14 nt, Mycobacterium tuberculosis H37Rv
caccgucgcggcgg

SEQ ID NO: 3243469 - RNA, 17 nt, Mycobacterium tuberculosis H37Rv
caccgucgcggcggcac

SEQ ID NO: 3243470 - RNA, 22 nt, Mycobacterium tuberculosis H37Rv
caccgucgcggcggcacuacgc

SEQ ID NO: 3243471 - RNA, 21 nt, Mycobacterium tuberculosis H37Rv
caccgucgcuaugcgccgcau

SEQ ID NO: 3243472 - RNA, 18 nt, Mycobacterium tuberculosis H37Rv
caccgucgcugcccgcgc

SEQ ID NO: 3243473 - RNA, 23 nt, Mycobacterium tuberculosis H37Rv
caccgucgcugcccgcgcggcca

SEQ ID NO: 3243474 - RNA, 21 nt, Mycobacterium tuberculosis H37Rv
caccgucggaacugaccacgu

SEQ ID NO: 3243475 - RNA, 12 nt, Mycobacterium tuberculosis H37Rv
caccgucggcac

SEQ ID NO: 3243476 - RNA, 17 nt, Mycobacterium tuberculosis H37Rv
caccgucggcaccagca

SEQ ID NO: 3243477 - RNA, 14 nt, Mycobacterium tuberculosis H37Rv
caccgucggcagca

SEQ ID NO: 3243478 - RNA, 18 nt, Mycobacterium tuberculosis H37Rv
caccgucggcagcagcgg

SEQ ID NO: 3243479 - RNA, 13 nt, Mycobacterium tuberculosis H37Rv
caccgucgggccc

SEQ ID NO: 3243480 - RNA, 17 nt, Mycobacterium tuberculosis H37Rv
caccgucgggcccagcc

SEQ ID NO: 3243481 - RNA, 18 nt, Mycobacterium tuberculosis H37Rv
caccgucguacucggcgg

SEQ ID NO: 3243482 - RNA, 21 nt, Mycobacterium tuberculosis H37Rv
caccgucguacucggcggcca

SEQ ID NO: 3243483 - RNA, 22 nt, Mycobacterium tuberculosis H37Rv
caccgucgucguuucgccagcc

SEQ ID NO: 3243484 - RNA, 16 nt, Mycobacterium tuberculosis H37Rv
caccgucucgcaccgc

SEQ ID NO: 3243485 - RNA, 14 nt, Mycobacterium tuberculosis H37Rv
caccgucugcggac

SEQ ID NO: 3243486 - RNA, 18 nt, Mycobacterium tuberculosis H37Rv
caccgucugcuggccggg

SEQ ID NO: 3243487 - RNA, 19 nt, Mycobacterium tuberculosis H37Rv
caccgucugcuggccgggu

SEQ ID NO: 3243488 - RNA, 16 nt, Mycobacterium tuberculosis H37Rv
caccgugacagcggca

SEQ ID NO: 3243489 - RNA, 23 nt, Mycobacterium tuberculosis H37Rv
caccgugacagcggcauugccag

SEQ ID NO: 3243490 - RNA, 14 nt, Mycobacterium tuberculosis H37Rv
caccgugaccagcc

SEQ ID NO: 3243491 - RNA, 14 nt, Mycobacterium tuberculosis H37Rv
caccgugaccgccg

SEQ ID NO: 3243492 - RNA, 17 nt, Mycobacterium tuberculosis H37Rv
caccgugaccgccgcgc

SEQ ID NO: 3243493 - RNA, 14 nt, Mycobacterium tuberculosis H37Rv
caccgugcaccagc

SEQ ID NO: 3243494 - RNA, 19 nt, Mycobacterium tuberculosis H37Rv
caccgugcaccagcucacc

SEQ ID NO: 3243495 - RNA, 16 nt, Mycobacterium tuberculosis H37Rv
caccgugcccugggug

SEQ ID NO: 3243496 - RNA, 17 nt, Mycobacterium tuberculosis H37Rv
caccgugccgacgcccc

SEQ ID NO: 3243497 - RNA, 15 nt, Mycobacterium tuberculosis H37Rv
caccgugcgccgaau

SEQ ID NO: 3243498 - RNA, 16 nt, Mycobacterium tuberculosis H37Rv
caccgugcggaucgcg

SEQ ID NO: 3243499 - RNA, 13 nt, Mycobacterium tuberculosis H37Rv
caccgugcggucg

SEQ ID NO: 3243500 - RNA, 23 nt, Mycobacterium tuberculosis H37Rv
caccguggaagauguugccgccg

SEQ ID NO: 3243501 - RNA, 15 nt, Mycobacterium tuberculosis H37Rv
caccguggaucggca

SEQ ID NO: 3243502 - RNA, 13 nt, Mycobacterium tuberculosis H37Rv
caccguggccucg

SEQ ID NO: 3243503 - RNA, 18 nt, Mycobacterium tuberculosis H37Rv
caccguggcggaucgcga

SEQ ID NO: 3243504 - RNA, 13 nt, Mycobacterium tuberculosis H37Rv
caccgugguggac

SEQ ID NO: 3243505 - RNA, 21 nt, Mycobacterium tuberculosis H37Rv
caccgugguggcguaucgggc

SEQ ID NO: 3243506 - RNA, 14 nt, Mycobacterium tuberculosis H37Rv
caccgugucgccgg

SEQ ID NO: 3243507 - RNA, 20 nt, Mycobacterium tuberculosis H37Rv
caccgugugcacgcgauggc

SEQ ID NO: 3243508 - RNA, 14 nt, Mycobacterium tuberculosis H37Rv
caccguuaccgccg

SEQ ID NO: 3243509 - RNA, 15 nt, Mycobacterium tuberculosis H37Rv
caccguuaccgccgu

SEQ ID NO: 3243510 - RNA, 17 nt, Mycobacterium tuberculosis H37Rv
caccguuaccgccgucg

SEQ ID NO: 3243511 - RNA, 18 nt, Mycobacterium tuberculosis H37Rv
caccguuaccgccgucgc

SEQ ID NO: 3243512 - RNA, 14 nt, Mycobacterium tuberculosis H37Rv
caccguugccgaac

SEQ ID NO: 3243513 - RNA, 15 nt, Mycobacterium tuberculosis H37Rv
caccguugccgccgu

SEQ ID NO: 3243514 - RNA, 16 nt, Mycobacterium tuberculosis H37Rv
caccguugccgccguc

SEQ ID NO: 3243515 - RNA, 19 nt, Mycobacterium tuberculosis H37Rv
caccguugcguuggcgcca

SEQ ID NO: 3243516 - RNA, 22 nt, Mycobacterium tuberculosis H37Rv
caccguugcguuggcgccacca

SEQ ID NO: 3243517 - RNA, 17 nt, Mycobacterium tuberculosis H37Rv
caccguuggccgcgcuc

SEQ ID NO: 3243518 - RNA, 17 nt, Mycobacterium tuberculosis H37Rv
caccguuugagcggcca

SEQ ID NO: 3243519 - RNA, 18 nt, Mycobacterium tuberculosis H37Rv
caccguuugcgcaccggu

SEQ ID NO: 3243520 - RNA, 19 nt, Mycobacterium tuberculosis H37Rv
caccguuugggcgccggug

SEQ ID NO: 3243521 - RNA, 22 nt, Mycobacterium tuberculosis H37Rv
caccuaccgagaucaccgccac

SEQ ID NO: 3243522 - RNA, 19 nt, Mycobacterium tuberculosis H37Rv
caccuaccguacgcagcgu

SEQ ID NO: 3243523 - RNA, 17 nt, Mycobacterium tuberculosis H37Rv
caccuagucgcggccgu

SEQ ID NO: 3243524 - RNA, 18 nt, Mycobacterium tuberculosis H37Rv
caccucaaacgccugguc

SEQ ID NO: 3243525 - RNA, 12 nt, Mycobacterium tuberculosis H37Rv
caccucaccagu

SEQ ID NO: 3243526 - RNA, 17 nt, Mycobacterium tuberculosis H37Rv
caccucaugaucucacc

SEQ ID NO: 3243527 - RNA, 22 nt, Mycobacterium tuberculosis H37Rv
caccuccaauugcgaaccggcc

SEQ ID NO: 3243528 - RNA, 16 nt, Mycobacterium tuberculosis H37Rv
caccuccagcaccacc

SEQ ID NO: 3243529 - RNA, 19 nt, Mycobacterium tuberculosis H37Rv
caccuccagguagucgcgg

SEQ ID NO: 3243530 - RNA, 21 nt, Mycobacterium tuberculosis H37Rv
caccuccagguagucgcggua

SEQ ID NO: 3243531 - RNA, 14 nt, Mycobacterium tuberculosis H37Rv
caccucccgcagcc

SEQ ID NO: 3243532 - RNA, 16 nt, Mycobacterium tuberculosis H37Rv
caccucccgcagccgg

SEQ ID NO: 3243533 - RNA, 16 nt, Mycobacterium tuberculosis H37Rv
caccuccgacggccgc

SEQ ID NO: 3243534 - RNA, 18 nt, Mycobacterium tuberculosis H37Rv
caccuccgacggccgcgg

SEQ ID NO: 3243535 - RNA, 21 nt, Mycobacterium tuberculosis H37Rv
caccuccgacggccgcggcgu

SEQ ID NO: 3243536 - RNA, 19 nt, Mycobacterium tuberculosis H37Rv
caccuccgaggccgccauc

SEQ ID NO: 3243537 - RNA, 14 nt, Mycobacterium tuberculosis H37Rv
caccuccgccggca

SEQ ID NO: 3243538 - RNA, 22 nt, Mycobacterium tuberculosis H37Rv
caccuccgccggcaccuccggc

SEQ ID NO: 3243539 - RNA, 14 nt, Mycobacterium tuberculosis H37Rv
caccuccgcgucgg

SEQ ID NO: 3243540 - RNA, 19 nt, Mycobacterium tuberculosis H37Rv
caccuccggcaccgcccuu

SEQ ID NO: 3243541 - RNA, 20 nt, Mycobacterium tuberculosis H37Rv
caccuccucgagcaggaugc

SEQ ID NO: 3243542 - RNA, 15 nt, Mycobacterium tuberculosis H37Rv
caccuccugguugac

SEQ ID NO: 3243543 - RNA, 15 nt, Mycobacterium tuberculosis H37Rv
caccucgaaggcacu

SEQ ID NO: 3243544 - RNA, 16 nt, Mycobacterium tuberculosis H37Rv
caccucgaaggcacug

SEQ ID NO: 3243545 - RNA, 18 nt, Mycobacterium tuberculosis H37Rv
caccucgaaugcauccgc

SEQ ID NO: 3243546 - RNA, 11 nt, Mycobacterium tuberculosis H37Rv
caccucgacgc

SEQ ID NO: 3243547 - RNA, 21 nt, Mycobacterium tuberculosis H37Rv
caccucgagcccgcguucagg

SEQ ID NO: 3243548 - RNA, 17 nt, Mycobacterium tuberculosis H37Rv
caccucgaucgcgccgu

SEQ ID NO: 3243549 - RNA, 18 nt, Mycobacterium tuberculosis H37Rv
caccucgaucgcgccguc

SEQ ID NO: 3243550 - RNA, 13 nt, Mycobacterium tuberculosis H37Rv
caccucgaugccg

SEQ ID NO: 3243551 - RNA, 15 nt, Mycobacterium tuberculosis H37Rv
cacgagcggcggugg

SEQ ID NO: 3243552 - RNA, 13 nt, Mycobacterium tuberculosis H37Rv
cacgagcgguacg

SEQ ID NO: 3243553 - RNA, 13 nt, Mycobacterium tuberculosis H37Rv
cacgaggcguuca

SEQ ID NO: 3243554 - RNA, 21 nt, Mycobacterium tuberculosis H37Rv
cacgagggccacguagcagca

SEQ ID NO: 3243555 - RNA, 19 nt, Mycobacterium tuberculosis H37Rv
cacgaguccgcggaucacc

SEQ ID NO: 3243556 - RNA, 22 nt, Mycobacterium tuberculosis H37Rv
cacgaguccgcggaucaccauc

SEQ ID NO: 3243557 - RNA, 17 nt, Mycobacterium tuberculosis H37Rv
cacgagucgccagaccg

SEQ ID NO: 3243558 - RNA, 21 nt, Mycobacterium tuberculosis H37Rv
cacgagucgccagaccgcacc

SEQ ID NO: 3243559 - RNA, 14 nt, Mycobacterium tuberculosis H37Rv
cacgaguuggccaa

SEQ ID NO: 3243560 - RNA, 16 nt, Mycobacterium tuberculosis H37Rv
cacgauaucgaugcgg

SEQ ID NO: 3243561 - RNA, 19 nt, Mycobacterium tuberculosis H37Rv
cacgauaucgaugcggcga

SEQ ID NO: 3243562 - RNA, 23 nt, Mycobacterium tuberculosis H37Rv
cacgauaucgggcucagcggcga

SEQ ID NO: 3243563 - RNA, 14 nt, Mycobacterium tuberculosis H37Rv
cacgaucacccgga

SEQ ID NO: 3243564 - RNA, 14 nt, Mycobacterium tuberculosis H37Rv
cacgaucgcaccga

SEQ ID NO: 3243565 - RNA, 13 nt, Mycobacterium tuberculosis H37Rv
cacgaucgccaac

SEQ ID NO: 3243566 - RNA, 21 nt, Mycobacterium tuberculosis H37Rv
cacgaucgccaacgacucacc

SEQ ID NO: 3243567 - RNA, 17 nt, Mycobacterium tuberculosis H37Rv
cacgaucgcggugaugg

SEQ ID NO: 3243568 - RNA, 22 nt, Mycobacterium tuberculosis H37Rv
cacgaucgcggugauggugaau

SEQ ID NO: 3243569 - RNA, 22 nt, Mycobacterium tuberculosis H37Rv
cacgaucggcagucccagcgcc

SEQ ID NO: 3243570 - RNA, 23 nt, Mycobacterium tuberculosis H37Rv
cacgaucggcggggguggaauca

SEQ ID NO: 3243571 - RNA, 22 nt, Mycobacterium tuberculosis H37Rv
cacgaucggcugguuacucacc

SEQ ID NO: 3243572 - RNA, 17 nt, Mycobacterium tuberculosis H37Rv
cacgaucgucgcggcca

SEQ ID NO: 3243573 - RNA, 20 nt, Mycobacterium tuberculosis H37Rv
cacgaucugcaggcccaggc

SEQ ID NO: 3243574 - RNA, 16 nt, Mycobacterium tuberculosis H37Rv
cacgaucugcgcguca

SEQ ID NO: 3243575 - RNA, 20 nt, Mycobacterium tuberculosis H37Rv
cacgaugaucuugccgcggc

SEQ ID NO: 3243576 - RNA, 18 nt, Mycobacterium tuberculosis H37Rv
cacgaugcgguucucgag

SEQ ID NO: 3243577 - RNA, 23 nt, Mycobacterium tuberculosis H37Rv
cacgaugcgguucucgagcucgg

SEQ ID NO: 3243578 - RNA, 20 nt, Mycobacterium tuberculosis H37Rv
cacgauuucgagcgcugcuc

SEQ ID NO: 3243579 - RNA, 19 nt, Mycobacterium tuberculosis H37Rv
cacgcaagggaauccgaac

SEQ ID NO: 3243580 - RNA, 18 nt, Mycobacterium tuberculosis H37Rv
cacgcaaugucggcaggg

SEQ ID NO: 3243581 - RNA, 18 nt, Mycobacterium tuberculosis H37Rv
cacgcacaaguucuucga

SEQ ID NO: 3243582 - RNA, 23 nt, Mycobacterium tuberculosis H37Rv
cacgcacaaguucuucgacagcg

SEQ ID NO: 3243583 - RNA, 16 nt, Mycobacterium tuberculosis H37Rv
cacgcacagcccgaug

SEQ ID NO: 3243584 - RNA, 14 nt, Mycobacterium tuberculosis H37Rv
cacgcaccacaaac

SEQ ID NO: 3243585 - RNA, 15 nt, Mycobacterium tuberculosis H37Rv
cacgcaccacaaaca

SEQ ID NO: 3243586 - RNA, 17 nt, Mycobacterium tuberculosis H37Rv
cacgcaccacaaacacc

SEQ ID NO: 3243587 - RNA, 12 nt, Mycobacterium tuberculosis H37Rv
cacgcacccggc

SEQ ID NO: 3243588 - RNA, 13 nt, Mycobacterium tuberculosis H37Rv
cacgcacccggca

SEQ ID NO: 3243589 - RNA, 22 nt, Mycobacterium tuberculosis H37Rv
cacgcacccggcgcaacaaccg

SEQ ID NO: 3243590 - RNA, 23 nt, Mycobacterium tuberculosis H37Rv
cacgcacccggcgcaacaaccgg

SEQ ID NO: 3243591 - RNA, 14 nt, Mycobacterium tuberculosis H37Rv
cacgcacgccgcgu

SEQ ID NO: 3243592 - RNA, 15 nt, Mycobacterium tuberculosis H37Rv
cacgcacucacuacc

SEQ ID NO: 3243593 - RNA, 16 nt, Mycobacterium tuberculosis H37Rv
cacgcacucgucgggg

SEQ ID NO: 3243594 - RNA, 14 nt, Mycobacterium tuberculosis H37Rv
cacgcacugccgcg

SEQ ID NO: 3243595 - RNA, 22 nt, Mycobacterium tuberculosis H37Rv
cacgcagcacccugcgggccga

SEQ ID NO: 3243596 - RNA, 12 nt, Mycobacterium tuberculosis H37Rv
cacgcagcacgg

SEQ ID NO: 3243597 - RNA, 19 nt, Mycobacterium tuberculosis H37Rv
cacgcagccccucgucguc

SEQ ID NO: 3243598 - RNA, 14 nt, Mycobacterium tuberculosis H37Rv
cacgcagucgggca

SEQ ID NO: 3243599 - RNA, 17 nt, Mycobacterium tuberculosis H37Rv
cacgcagucgggcagcg

SEQ ID NO: 3243600 - RNA, 19 nt, Mycobacterium tuberculosis H37Rv
cacgccaccgcaacucgcc

SEQ ID NO: 3243601 - RNA, 13 nt, Mycobacterium tuberculosis H37Rv
cacgccaccgcgg

SEQ ID NO: 3243602 - RNA, 20 nt, Mycobacterium tuberculosis H37Rv
cacgccaccgcggucaccga

SEQ ID NO: 3243603 - RNA, 22 nt, Mycobacterium tuberculosis H37Rv
cacgccaccgcggucaccgacg

SEQ ID NO: 3243604 - RNA, 14 nt, Mycobacterium tuberculosis H37Rv
cacgccacguccaa

SEQ ID NO: 3243605 - RNA, 21 nt, Mycobacterium tuberculosis H37Rv
cacgccacguccaacucggcc

SEQ ID NO: 3243606 - RNA, 17 nt, Mycobacterium tuberculosis H37Rv
cacgccacuucuucggg

SEQ ID NO: 3243607 - RNA, 13 nt, Mycobacterium tuberculosis H37Rv
cacgccagccggu

SEQ ID NO: 3243608 - RNA, 15 nt, Mycobacterium tuberculosis H37Rv
cacgccagccgugcc

SEQ ID NO: 3243609 - RNA, 15 nt, Mycobacterium tuberculosis H37Rv
cacgccagcucgccg

SEQ ID NO: 3243610 - RNA, 23 nt, Mycobacterium tuberculosis H37Rv
cacgccauaccggcuggccaggu

SEQ ID NO: 3243611 - RNA, 17 nt, Mycobacterium tuberculosis H37Rv
cacgccaucgagcagca

SEQ ID NO: 3243612 - RNA, 22 nt, Mycobacterium tuberculosis H37Rv
cacgccaugguaugacccgccu

SEQ ID NO: 3243613 - RNA, 21 nt, Mycobacterium tuberculosis H37Rv
cacgcccaauguccaggcgcg

SEQ ID NO: 3243614 - RNA, 13 nt, Mycobacterium tuberculosis H37Rv
cacgcccacagcu

SEQ ID NO: 3243615 - RNA, 14 nt, Mycobacterium tuberculosis H37Rv
cacgcccaccacug

SEQ ID NO: 3243616 - RNA, 14 nt, Mycobacterium tuberculosis H37Rv
cacgcccaggcaag

SEQ ID NO: 3243617 - RNA, 21 nt, Mycobacterium tuberculosis H37Rv
cacgcccgaagaaugggaugg

SEQ ID NO: 3243618 - RNA, 13 nt, Mycobacterium tuberculosis H37Rv
cacgcccgcacuc

SEQ ID NO: 3243619 - RNA, 14 nt, Mycobacterium tuberculosis H37Rv
cacgcccggcgugg

SEQ ID NO: 3243620 - RNA, 18 nt, Mycobacterium tuberculosis H37Rv
cacgcccucgucgaucgc

SEQ ID NO: 3243621 - RNA, 18 nt, Mycobacterium tuberculosis H37Rv
cacgcccugaagggccgc

SEQ ID NO: 3243622 - RNA, 13 nt, Mycobacterium tuberculosis H37Rv
cacgccgaccagc

SEQ ID NO: 3243623 - RNA, 17 nt, Mycobacterium tuberculosis H37Rv
cacgccgaccagcaccc

SEQ ID NO: 3243624 - RNA, 18 nt, Mycobacterium tuberculosis H37Rv
cacgccgaccggcccgca

SEQ ID NO: 3243625 - RNA, 13 nt, Mycobacterium tuberculosis H37Rv
cacgccgauaccg

SEQ ID NO: 3243626 - RNA, 15 nt, Mycobacterium tuberculosis H37Rv
cacgccgaucaacau

SEQ ID NO: 3243627 - RNA, 13 nt, Mycobacterium tuberculosis H37Rv
cacgccgaucugg

SEQ ID NO: 3243628 - RNA, 15 nt, Mycobacterium tuberculosis H37Rv
cacgccgaugaugga

SEQ ID NO: 3243629 - RNA, 20 nt, Mycobacterium tuberculosis H37Rv
cacgccgaugauggacacca

SEQ ID NO: 3243630 - RNA, 13 nt, Mycobacterium tuberculosis H37Rv
cacgccgaugcgg

SEQ ID NO: 3243631 - RNA, 13 nt, Mycobacterium tuberculosis H37Rv
cacgccgauucgc

SEQ ID NO: 3243632 - RNA, 14 nt, Mycobacterium tuberculosis H37Rv
cacgccgccgacgu

SEQ ID NO: 3243633 - RNA, 20 nt, Mycobacterium tuberculosis H37Rv
cacgccgccggccgccagcg

SEQ ID NO: 3243634 - RNA, 13 nt, Mycobacterium tuberculosis H37Rv
cacgccgccggug

SEQ ID NO: 3243635 - RNA, 18 nt, Mycobacterium tuberculosis H37Rv
cacgccgccggugaacgu

SEQ ID NO: 3243636 - RNA, 21 nt, Mycobacterium tuberculosis H37Rv
cacgccggcaugccagccacg

SEQ ID NO: 3243637 - RNA, 16 nt, Mycobacterium tuberculosis H37Rv
cacgccggcccgguga

SEQ ID NO: 3243638 - RNA, 19 nt, Mycobacterium tuberculosis H37Rv
cacgccggccgcgcugaac

SEQ ID NO: 3243639 - RNA, 21 nt, Mycobacterium tuberculosis H37Rv
cacgccggccucgccgaagcg

SEQ ID NO: 3243640 - RNA, 13 nt, Mycobacterium tuberculosis H37Rv
cacgccggcgcug

SEQ ID NO: 3243641 - RNA, 19 nt, Mycobacterium tuberculosis H37Rv
cacgccgggcaucggcggu

SEQ ID NO: 3243642 - RNA, 15 nt, Mycobacterium tuberculosis H37Rv
cacgccgggugccgc

SEQ ID NO: 3243643 - RNA, 17 nt, Mycobacterium tuberculosis H37Rv
cacgccgggugccgcca

SEQ ID NO: 3243644 - RNA, 20 nt, Mycobacterium tuberculosis H37Rv
cacgccgggugccgccacgu

SEQ ID NO: 3243645 - RNA, 19 nt, Mycobacterium tuberculosis H37Rv
cacgccggugucguucggc

SEQ ID NO: 3243646 - RNA, 20 nt, Mycobacterium tuberculosis H37Rv
cacgccguagcgcagcgccu

SEQ ID NO: 3243647 - RNA, 16 nt, Mycobacterium tuberculosis H37Rv
cacggcgaaccggccc

SEQ ID NO: 3243648 - RNA, 17 nt, Mycobacterium tuberculosis H37Rv
cacggcgaccacgccgc

SEQ ID NO: 3243649 - RNA, 18 nt, Mycobacterium tuberculosis H37Rv
cacggcgaccacgccgcc

SEQ ID NO: 3243650 - RNA, 13 nt, Mycobacterium tuberculosis H37Rv
cacggcgaggccg

SEQ ID NO: 3243651 - RNA, 16 nt, Mycobacterium tuberculosis H37Rv
cacggcgaggccgaac

SEQ ID NO: 3243652 - RNA, 13 nt, Mycobacterium tuberculosis H37Rv
cacggcgauccgg

SEQ ID NO: 3243653 - RNA, 23 nt, Mycobacterium tuberculosis H37Rv
cacggcgauccggucggccaggc

SEQ ID NO: 3243654 - RNA, 19 nt, Mycobacterium tuberculosis H37Rv
cacggcgaugcagccacau

SEQ ID NO: 3243655 - RNA, 15 nt, Mycobacterium tuberculosis H37Rv
cacggcgauugcccg

SEQ ID NO: 3243656 - RNA, 14 nt, Mycobacterium tuberculosis H37Rv
cacggcgccgccac

SEQ ID NO: 3243657 - RNA, 23 nt, Mycobacterium tuberculosis H37Rv
cacggcgccgccacggaucgcgg

SEQ ID NO: 3243658 - RNA, 18 nt, Mycobacterium tuberculosis H37Rv
cacggcgcguugggacca

SEQ ID NO: 3243659 - RNA, 15 nt, Mycobacterium tuberculosis H37Rv
cacggcgcuaccagc

SEQ ID NO: 3243660 - RNA, 17 nt, Mycobacterium tuberculosis H37Rv
cacggcggcaucaccug

SEQ ID NO: 3243661 - RNA, 21 nt, Mycobacterium tuberculosis H37Rv
cacggcggcaucaccuggcgu

SEQ ID NO: 3243662 - RNA, 12 nt, Mycobacterium tuberculosis H37Rv
cacggcggcgaa

SEQ ID NO: 3243663 - RNA, 14 nt, Mycobacterium tuberculosis H37Rv
cacggcgguguguu

SEQ ID NO: 3243664 - RNA, 20 nt, Mycobacterium tuberculosis H37Rv
cacggcgguugccccgaccg

SEQ ID NO: 3243665 - RNA, 17 nt, Mycobacterium tuberculosis H37Rv
cacggcgucggccaccc

SEQ ID NO: 3243666 - RNA, 21 nt, Mycobacterium tuberculosis H37Rv
cacggcgucuuccucggccac

SEQ ID NO: 3243667 - RNA, 17 nt, Mycobacterium tuberculosis H37Rv
cacggcguggcgccgga

SEQ ID NO: 3243668 - RNA, 15 nt, Mycobacterium tuberculosis H37Rv
cacggcguggucggc

SEQ ID NO: 3243669 - RNA, 14 nt, Mycobacterium tuberculosis H37Rv
cacggcugaccggg

SEQ ID NO: 3243670 - RNA, 12 nt, Mycobacterium tuberculosis H37Rv
cacggcugccca

SEQ ID NO: 3243671 - RNA, 21 nt, Mycobacterium tuberculosis H37Rv
cacggcugcccaugguggcga

SEQ ID NO: 3243672 - RNA, 14 nt, Mycobacterium tuberculosis H37Rv
cacggcuucggcga

SEQ ID NO: 3243673 - RNA, 21 nt, Mycobacterium tuberculosis H37Rv
cacggcuucggcgagcgcauc

SEQ ID NO: 3243674 - RNA, 14 nt, Mycobacterium tuberculosis H37Rv
cacggcuuugcggc

SEQ ID NO: 3243675 - RNA, 18 nt, Mycobacterium tuberculosis H37Rv
cacgggaucgaucugcgg

SEQ ID NO: 3243676 - RNA, 17 nt, Mycobacterium tuberculosis H37Rv
cacgggaugcaugucuu

SEQ ID NO: 3243677 - RNA, 22 nt, Mycobacterium tuberculosis H37Rv
cacgggcagauacgccaaccgc

SEQ ID NO: 3243678 - RNA, 12 nt, Mycobacterium tuberculosis H37Rv
cacgggcggcca

SEQ ID NO: 3243679 - RNA, 15 nt, Mycobacterium tuberculosis H37Rv
cacgggcggccaccg

SEQ ID NO: 3243680 - RNA, 15 nt, Mycobacterium tuberculosis H37Rv
cacgggcuaccggca

SEQ ID NO: 3243681 - RNA, 15 nt, Mycobacterium tuberculosis H37Rv
cacgggcucgcugca

SEQ ID NO: 3243682 - RNA, 15 nt, Mycobacterium tuberculosis H37Rv
cacggguagcgucca

SEQ ID NO: 3243683 - RNA, 19 nt, Mycobacterium tuberculosis H37Rv
cacggguagcguccagguc

SEQ ID NO: 3243684 - RNA, 17 nt, Mycobacterium tuberculosis H37Rv
cacgggucgucaugcca

SEQ ID NO: 3243685 - RNA, 18 nt, Mycobacterium tuberculosis H37Rv
cacgggucgucaugccag

SEQ ID NO: 3243686 - RNA, 12 nt, Mycobacterium tuberculosis H37Rv
cacgggugacuc

SEQ ID NO: 3243687 - RNA, 18 nt, Mycobacterium tuberculosis H37Rv
cacgggugagcaccacgu

SEQ ID NO: 3243688 - RNA, 17 nt, Mycobacterium tuberculosis H37Rv
cacgggugcgccacaac

SEQ ID NO: 3243689 - RNA, 16 nt, Mycobacterium tuberculosis H37Rv
cacggguggugccagg

SEQ ID NO: 3243690 - RNA, 17 nt, Mycobacterium tuberculosis H37Rv
cacggguggugccaggu

SEQ ID NO: 3243691 - RNA, 22 nt, Mycobacterium tuberculosis H37Rv
cacggguguucucgcgcgucgc

SEQ ID NO: 3243692 - RNA, 19 nt, Mycobacterium tuberculosis H37Rv
cacgguacauccagagaca

SEQ ID NO: 3243693 - RNA, 13 nt, Mycobacterium tuberculosis H37Rv
cacggucaagccg

SEQ ID NO: 3243694 - RNA, 21 nt, Mycobacterium tuberculosis H37Rv
cacggucaauugugcggcccc

SEQ ID NO: 3243695 - RNA, 12 nt, Mycobacterium tuberculosis H37Rv
cacggucacacg

SEQ ID NO: 3243696 - RNA, 16 nt, Mycobacterium tuberculosis H37Rv
cacggucacacgccag

SEQ ID NO: 3243697 - RNA, 14 nt, Mycobacterium tuberculosis H37Rv
cacggucagcacgc

SEQ ID NO: 3243698 - RNA, 18 nt, Mycobacterium tuberculosis H37Rv
cacggucagcacgcugac

SEQ ID NO: 3243699 - RNA, 19 nt, Mycobacterium tuberculosis H37Rv
cacggucagcacgcugacc

SEQ ID NO: 3243700 - RNA, 20 nt, Mycobacterium tuberculosis H37Rv
cacggucagcacgcugacca

SEQ ID NO: 3243701 - RNA, 15 nt, Mycobacterium tuberculosis H37Rv
cacggucagcgcgca

SEQ ID NO: 3243702 - RNA, 22 nt, Mycobacterium tuberculosis H37Rv
cacggucagcucgcugacggca

SEQ ID NO: 3243703 - RNA, 17 nt, Mycobacterium tuberculosis H37Rv
cacggucaggcguaggu

SEQ ID NO: 3243704 - RNA, 17 nt, Mycobacterium tuberculosis H37Rv
cacggucaucucggugg

SEQ ID NO: 3243705 - RNA, 16 nt, Mycobacterium tuberculosis H37Rv
cacggucauugggugu

SEQ ID NO: 3243706 - RNA, 16 nt, Mycobacterium tuberculosis H37Rv
cacggucgaccaggac

SEQ ID NO: 3243707 - RNA, 19 nt, Mycobacterium tuberculosis H37Rv
cacggucgaccaggacggu

SEQ ID NO: 3243708 - RNA, 14 nt, Mycobacterium tuberculosis H37Rv
cacggucgccgacc

SEQ ID NO: 3243709 - RNA, 16 nt, Mycobacterium tuberculosis H37Rv
cacggugaacaauccg

SEQ ID NO: 3243710 - RNA, 17 nt, Mycobacterium tuberculosis H37Rv
cacggugaccacgccgu

SEQ ID NO: 3243711 - RNA, 17 nt, Mycobacterium tuberculosis H37Rv
cacggugaucagcagca

SEQ ID NO: 3243712 - RNA, 19 nt, Mycobacterium tuberculosis H37Rv
cacggugccgacgaugacg

SEQ ID NO: 3243713 - RNA, 18 nt, Mycobacterium tuberculosis H37Rv
cacggugccgccgucgau

SEQ ID NO: 3243714 - RNA, 17 nt, Mycobacterium tuberculosis H37Rv
cacgguggagcgcgccu

SEQ ID NO: 3243715 - RNA, 22 nt, Mycobacterium tuberculosis H37Rv
cacgguggagcgcgccucgccc

SEQ ID NO: 3243716 - RNA, 13 nt, Mycobacterium tuberculosis H37Rv
cacgguggccgca

SEQ ID NO: 3243717 - RNA, 14 nt, Mycobacterium tuberculosis H37Rv
cacgguggccgcac

SEQ ID NO: 3243718 - RNA, 20 nt, Mycobacterium tuberculosis H37Rv
cacgguggccgcaucgacgc

SEQ ID NO: 3243719 - RNA, 18 nt, Mycobacterium tuberculosis H37Rv
cacggugggcgccgacac

SEQ ID NO: 3243720 - RNA, 21 nt, Mycobacterium tuberculosis H37Rv
cacggugggcgccgacaccgg

SEQ ID NO: 3243721 - RNA, 15 nt, Mycobacterium tuberculosis H37Rv
cacggugggcgcugg

SEQ ID NO: 3243722 - RNA, 22 nt, Mycobacterium tuberculosis H37Rv
cacggugggguuggcuccggug

SEQ ID NO: 3243723 - RNA, 22 nt, Mycobacterium tuberculosis H37Rv
cacggugguggugggaguucgc

SEQ ID NO: 3243724 - RNA, 16 nt, Mycobacterium tuberculosis H37Rv
cacgguguaccccgcg

SEQ ID NO: 3243725 - RNA, 23 nt, Mycobacterium tuberculosis H37Rv
cacgguguauugggguggcagcu

SEQ ID NO: 3243726 - RNA, 17 nt, Mycobacterium tuberculosis H37Rv
cacggugucgcgcgacc

SEQ ID NO: 3243727 - RNA, 20 nt, Mycobacterium tuberculosis H37Rv
cacggugucgcgcgaccugg

SEQ ID NO: 3243728 - RNA, 19 nt, Mycobacterium tuberculosis H37Rv
cacggugugcacggcgaau

SEQ ID NO: 3243729 - RNA, 15 nt, Mycobacterium tuberculosis H37Rv
cacgguguugcgcac

SEQ ID NO: 3243730 - RNA, 20 nt, Mycobacterium tuberculosis H37Rv
cacgguguugcgcacccgcg

SEQ ID NO: 3243731 - RNA, 16 nt, Mycobacterium tuberculosis H37Rv
cacgguuagacgucgu

SEQ ID NO: 3243732 - RNA, 16 nt, Mycobacterium tuberculosis H37Rv
cacgguucgggcagca

SEQ ID NO: 3243733 - RNA, 17 nt, Mycobacterium tuberculosis H37Rv
cacgguucuuggcgucu

SEQ ID NO: 3243734 - RNA, 21 nt, Mycobacterium tuberculosis H37Rv
cacgguugccggcggcgacgu

SEQ ID NO: 3243735 - RNA, 14 nt, Mycobacterium tuberculosis H37Rv
cacgguugccguca

SEQ ID NO: 3243736 - RNA, 15 nt, Mycobacterium tuberculosis H37Rv
cacgguuggccacca

SEQ ID NO: 3243737 - RNA, 13 nt, Mycobacterium tuberculosis H37Rv
cacguaacccagu

SEQ ID NO: 3243738 - RNA, 12 nt, Mycobacterium tuberculosis H37Rv
cacguaauuccc

SEQ ID NO: 3243739 - RNA, 14 nt, Mycobacterium tuberculosis H37Rv
cacguaauucccca

SEQ ID NO: 3243740 - RNA, 14 nt, Mycobacterium tuberculosis H37Rv
cacguacucggcca

SEQ ID NO: 3243741 - RNA, 23 nt, Mycobacterium tuberculosis H37Rv
cacguagcagcagacgacgauca

SEQ ID NO: 3243742 - RNA, 16 nt, Mycobacterium tuberculosis H37Rv
cacguagcgaccgcgg

SEQ ID NO: 3243743 - RNA, 17 nt, Mycobacterium tuberculosis H37Rv
cacguauccacggucga

SEQ ID NO: 3243744 - RNA, 23 nt, Mycobacterium tuberculosis H37Rv
cacucggucguugccgcggucgg

SEQ ID NO: 3243745 - RNA, 18 nt, Mycobacterium tuberculosis H37Rv
cacucggugucggccgcg

SEQ ID NO: 3243746 - RNA, 17 nt, Mycobacterium tuberculosis H37Rv
cacucgguuugacgaga

SEQ ID NO: 3243747 - RNA, 13 nt, Mycobacterium tuberculosis H37Rv
cacucuagccggg

SEQ ID NO: 3243748 - RNA, 14 nt, Mycobacterium tuberculosis H37Rv
cacucucggcgcuc

SEQ ID NO: 3243749 - RNA, 21 nt, Mycobacterium tuberculosis H37Rv
cacucucggugaacgccgccc

SEQ ID NO: 3243750 - RNA, 22 nt, Mycobacterium tuberculosis H37Rv
cacucucggugaacgccgcccc

SEQ ID NO: 3243751 - RNA, 23 nt, Mycobacterium tuberculosis H37Rv
cacucucggugaacgccgccccg

SEQ ID NO: 3243752 - RNA, 22 nt, Mycobacterium tuberculosis H37Rv
cacucugaucuguguuugcggc

SEQ ID NO: 3243753 - RNA, 17 nt, Mycobacterium tuberculosis H37Rv
cacucuucgggcggcgu

SEQ ID NO: 3243754 - RNA, 16 nt, Mycobacterium tuberculosis H37Rv
cacugaacaggccggu

SEQ ID NO: 3243755 - RNA, 19 nt, Mycobacterium tuberculosis H37Rv
cacugaaccgguugacacc

SEQ ID NO: 3243756 - RNA, 21 nt, Mycobacterium tuberculosis H37Rv
cacugaccaggucugcggugc

SEQ ID NO: 3243757 - RNA, 15 nt, Mycobacterium tuberculosis H37Rv
cacugaccccgccgc

SEQ ID NO: 3243758 - RNA, 21 nt, Mycobacterium tuberculosis H37Rv
cacugaccgaacgcaacagcc

SEQ ID NO: 3243759 - RNA, 12 nt, Mycobacterium tuberculosis H37Rv
cacugaccgcgg

SEQ ID NO: 3243760 - RNA, 20 nt, Mycobacterium tuberculosis H37Rv
cacugacgucucaucaaacc

SEQ ID NO: 3243761 - RNA, 11 nt, Mycobacterium tuberculosis H37Rv
cacugagaucc

SEQ ID NO: 3243762 - RNA, 13 nt, Mycobacterium tuberculosis H37Rv
cacugagauccag

SEQ ID NO: 3243763 - RNA, 21 nt, Mycobacterium tuberculosis H37Rv
cacugaggagaugagcaccaa

SEQ ID NO: 3243764 - RNA, 22 nt, Mycobacterium tuberculosis H37Rv
cacugaggagaugagcaccaaa

SEQ ID NO: 3243765 - RNA, 18 nt, Mycobacterium tuberculosis H37Rv
cacugaguucggugcugu

SEQ ID NO: 3243766 - RNA, 15 nt, Mycobacterium tuberculosis H37Rv
cacugaugggccggu

SEQ ID NO: 3243767 - RNA, 21 nt, Mycobacterium tuberculosis H37Rv
cacugaugggccgguuccuca

SEQ ID NO: 3243768 - RNA, 13 nt, Mycobacterium tuberculosis H37Rv
cacugccagccgu

SEQ ID NO: 3243769 - RNA, 14 nt, Mycobacterium tuberculosis H37Rv
cacugcccagcaga

SEQ ID NO: 3243770 - RNA, 16 nt, Mycobacterium tuberculosis H37Rv
cacugcccagcagacc

SEQ ID NO: 3243771 - RNA, 17 nt, Mycobacterium tuberculosis H37Rv
cacugccccgcaucgcc

SEQ ID NO: 3243772 - RNA, 15 nt, Mycobacterium tuberculosis H37Rv
cacugcccggggugc

SEQ ID NO: 3243773 - RNA, 22 nt, Mycobacterium tuberculosis H37Rv
cacugcccucaacgaucgcgcc

SEQ ID NO: 3243774 - RNA, 23 nt, Mycobacterium tuberculosis H37Rv
cacugcccucaacgaucgcgccg

SEQ ID NO: 3243775 - RNA, 22 nt, Mycobacterium tuberculosis H37Rv
cacugccgccgguuccgccggc

SEQ ID NO: 3243776 - RNA, 15 nt, Mycobacterium tuberculosis H37Rv
cacugccgcgcgccc

SEQ ID NO: 3243777 - RNA, 23 nt, Mycobacterium tuberculosis H37Rv
cacugccgcgcucgcgcaccguc

SEQ ID NO: 3243778 - RNA, 14 nt, Mycobacterium tuberculosis H37Rv
cacugccggcagcg

SEQ ID NO: 3243779 - RNA, 18 nt, Mycobacterium tuberculosis H37Rv
cacugccggcagcgcccc

SEQ ID NO: 3243780 - RNA, 23 nt, Mycobacterium tuberculosis H37Rv
cacugccggugggcguucccccg

SEQ ID NO: 3243781 - RNA, 22 nt, Mycobacterium tuberculosis H37Rv
cacugccuuaaccgagccgacc

SEQ ID NO: 3243782 - RNA, 22 nt, Mycobacterium tuberculosis H37Rv
cacugcgaaaauggcgccuugg

SEQ ID NO: 3243783 - RNA, 19 nt, Mycobacterium tuberculosis H37Rv
cacugcgaaucuccgcgcg

SEQ ID NO: 3243784 - RNA, 19 nt, Mycobacterium tuberculosis H37Rv
cacugcgaccgucccggcc

SEQ ID NO: 3243785 - RNA, 10 nt, Mycobacterium tuberculosis H37Rv
cacugcgagc

SEQ ID NO: 3243786 - RNA, 17 nt, Mycobacterium tuberculosis H37Rv
cacugcgagcgccggcu

SEQ ID NO: 3243787 - RNA, 13 nt, Mycobacterium tuberculosis H37Rv
cacugcgcccgcc

SEQ ID NO: 3243788 - RNA, 15 nt, Mycobacterium tuberculosis H37Rv
cacugcgcccgccac

SEQ ID NO: 3243789 - RNA, 16 nt, Mycobacterium tuberculosis H37Rv
cacugcgcccgccacg

SEQ ID NO: 3243790 - RNA, 15 nt, Mycobacterium tuberculosis H37Rv
cacugcgccggccgc

SEQ ID NO: 3243791 - RNA, 17 nt, Mycobacterium tuberculosis H37Rv
cacugcgccggccgcag

SEQ ID NO: 3243792 - RNA, 16 nt, Mycobacterium tuberculosis H37Rv
cacugcgccgugaccc

SEQ ID NO: 3243793 - RNA, 17 nt, Mycobacterium tuberculosis H37Rv
cacugcgccgugaccca

SEQ ID NO: 3243794 - RNA, 13 nt, Mycobacterium tuberculosis H37Rv
cacugcggcagcg

SEQ ID NO: 3243795 - RNA, 17 nt, Mycobacterium tuberculosis H37Rv
cacugcggcagguucgg

SEQ ID NO: 3243796 - RNA, 22 nt, Mycobacterium tuberculosis H37Rv
cacugcguuccaucgccgacgc

SEQ ID NO: 3243797 - RNA, 17 nt, Mycobacterium tuberculosis H37Rv
cacugcucgucgcgcau

SEQ ID NO: 3243798 - RNA, 16 nt, Mycobacterium tuberculosis H37Rv
cacugcugcggcagcg

SEQ ID NO: 3243799 - RNA, 19 nt, Mycobacterium tuberculosis H37Rv
cacuggaagccaagcuaac

SEQ ID NO: 3243800 - RNA, 15 nt, Mycobacterium tuberculosis H37Rv
cacuggaccaccgcc

SEQ ID NO: 3243801 - RNA, 23 nt, Mycobacterium tuberculosis H37Rv
cacuggacccgcccaggcgucca

SEQ ID NO: 3243802 - RNA, 20 nt, Mycobacterium tuberculosis H37Rv
cacuggauggcucgccgaaa

SEQ ID NO: 3243803 - RNA, 19 nt, Mycobacterium tuberculosis H37Rv
cacuggcgauaucggcccc

SEQ ID NO: 3243804 - RNA, 22 nt, Mycobacterium tuberculosis H37Rv
cacuggcgauaucggcccccaa

SEQ ID NO: 3243805 - RNA, 18 nt, Mycobacterium tuberculosis H37Rv
cacuggcgccggugccgc

SEQ ID NO: 3243806 - RNA, 16 nt, Mycobacterium tuberculosis H37Rv
cacuggggugcugcgc

SEQ ID NO: 3243807 - RNA, 19 nt, Mycobacterium tuberculosis H37Rv
cacuggggugcugcgcgcg

SEQ ID NO: 3243808 - RNA, 14 nt, Mycobacterium tuberculosis H37Rv
cacuggucaacggg

SEQ ID NO: 3243809 - RNA, 23 nt, Mycobacterium tuberculosis H37Rv
cacuggucaacgggaugccggcg

SEQ ID NO: 3243810 - RNA, 16 nt, Mycobacterium tuberculosis H37Rv
cacuggugacccugau

SEQ ID NO: 3243811 - RNA, 12 nt, Mycobacterium tuberculosis H37Rv
cacuggugaucu

SEQ ID NO: 3243812 - RNA, 21 nt, Mycobacterium tuberculosis H37Rv
cacuggugaucugguccggca

SEQ ID NO: 3243813 - RNA, 20 nt, Mycobacterium tuberculosis H37Rv
cacugucagcgauccucgcc

SEQ ID NO: 3243814 - RNA, 16 nt, Mycobacterium tuberculosis H37Rv
cacugugcgagcugcg

SEQ ID NO: 3243815 - RNA, 15 nt, Mycobacterium tuberculosis H37Rv
cacugugcgccugcg

SEQ ID NO: 3243816 - RNA, 13 nt, Mycobacterium tuberculosis H37Rv
cacugugcucgcc

SEQ ID NO: 3243817 - RNA, 20 nt, Mycobacterium tuberculosis H37Rv
cacuguuacuccgacggccc

SEQ ID NO: 3243818 - RNA, 18 nt, Mycobacterium tuberculosis H37Rv
cacuguugcccaauucga

SEQ ID NO: 3243819 - RNA, 22 nt, Mycobacterium tuberculosis H37Rv
cacuguugcccuugggacugcg

SEQ ID NO: 3243820 - RNA, 17 nt, Mycobacterium tuberculosis H37Rv
cacuguuggugccgcca

SEQ ID NO: 3243821 - RNA, 20 nt, Mycobacterium tuberculosis H37Rv
cacuguuggugccgccacca

SEQ ID NO: 3243822 - RNA, 22 nt, Mycobacterium tuberculosis H37Rv
cacuguuggugccgccaccacc

SEQ ID NO: 3243823 - RNA, 23 nt, Mycobacterium tuberculosis H37Rv
cacuguuggugccgccaccaccg

SEQ ID NO: 3243824 - RNA, 18 nt, Mycobacterium tuberculosis H37Rv
cacuucauggggcuaugg

SEQ ID NO: 3243825 - RNA, 14 nt, Mycobacterium tuberculosis H37Rv
cacuuccaagccga

SEQ ID NO: 3243826 - RNA, 16 nt, Mycobacterium tuberculosis H37Rv
cacuuccagcccggca

SEQ ID NO: 3243827 - RNA, 14 nt, Mycobacterium tuberculosis H37Rv
cacuuccggcgugg

SEQ ID NO: 3243828 - RNA, 22 nt, Mycobacterium tuberculosis H37Rv
cacuuccgggcagcugggcagg

SEQ ID NO: 3243829 - RNA, 17 nt, Mycobacterium tuberculosis H37Rv
cacuucgguguuggaca

SEQ ID NO: 3243830 - RNA, 21 nt, Mycobacterium tuberculosis H37Rv
cacuucuuucgaaaugagguc

SEQ ID NO: 3243831 - RNA, 21 nt, Mycobacterium tuberculosis H37Rv
cacuugaaauugagccggccc

SEQ ID NO: 3243832 - RNA, 13 nt, Mycobacterium tuberculosis H37Rv
cacuugaucgacg

SEQ ID NO: 3243833 - RNA, 18 nt, Mycobacterium tuberculosis H37Rv
cacuugaucgacggccau

SEQ ID NO: 3243834 - RNA, 19 nt, Mycobacterium tuberculosis H37Rv
cacuugaugccgcacccga

SEQ ID NO: 3243835 - RNA, 12 nt, Mycobacterium tuberculosis H37Rv
cacuugaugcuc

SEQ ID NO: 3243836 - RNA, 13 nt, Mycobacterium tuberculosis H37Rv
cacuugccgggca

SEQ ID NO: 3243837 - RNA, 15 nt, Mycobacterium tuberculosis H37Rv
cacuugcgccaccgu

SEQ ID NO: 3243838 - RNA, 13 nt, Mycobacterium tuberculosis H37Rv
cacuuggacccgg

SEQ ID NO: 3243839 - RNA, 19 nt, Mycobacterium tuberculosis H37Rv
cacuuggacccggccggcc

SEQ ID NO: 3243840 - RNA, 19 nt, Mycobacterium tuberculosis H37Rv
cagacgccgucugacagca

SEQ ID NO: 3243841 - RNA, 16 nt, Mycobacterium tuberculosis H37Rv
cagacgcggaaucgca

SEQ ID NO: 3243842 - RNA, 20 nt, Mycobacterium tuberculosis H37Rv
cagacgcggaaucgcaccgu

SEQ ID NO: 3243843 - RNA, 22 nt, Mycobacterium tuberculosis H37Rv
cagacgcggaaucgcaccgugu

SEQ ID NO: 3243844 - RNA, 19 nt, Mycobacterium tuberculosis H37Rv
cagacgcugccaagcgacc

SEQ ID NO: 3243845 - RNA, 14 nt, Mycobacterium tuberculosis H37Rv
cagacggcucagcg

SEQ ID NO: 3243846 - RNA, 21 nt, Mycobacterium tuberculosis H37Rv
cagacggguggcccgaccggg

SEQ ID NO: 3243847 - RNA, 17 nt, Mycobacterium tuberculosis H37Rv
cagacggugcagcuccc

SEQ ID NO: 3243848 - RNA, 21 nt, Mycobacterium tuberculosis H37Rv
cagacggugcagcuccccgcc

SEQ ID NO: 3243849 - RNA, 17 nt, Mycobacterium tuberculosis H37Rv
cagacgucaugcggaua

SEQ ID NO: 3243850 - RNA, 18 nt, Mycobacterium tuberculosis H37Rv
cagacguccugggcccga

SEQ ID NO: 3243851 - RNA, 19 nt, Mycobacterium tuberculosis H37Rv
cagacguccuucgcuggua

SEQ ID NO: 3243852 - RNA, 24 nt, Mycobacterium tuberculosis H37Rv
cagacguuccaucacggaccaggc

SEQ ID NO: 3243853 - RNA, 14 nt, Mycobacterium tuberculosis H37Rv
cagacucgauaugc

SEQ ID NO: 3243854 - RNA, 14 nt, Mycobacterium tuberculosis H37Rv
cagagacagcgcca

SEQ ID NO: 3243855 - RNA, 16 nt, Mycobacterium tuberculosis H37Rv
cagagacaugccggcg

SEQ ID NO: 3243856 - RNA, 16 nt, Mycobacterium tuberculosis H37Rv
cagagacgaucaucuc

SEQ ID NO: 3243857 - RNA, 20 nt, Mycobacterium tuberculosis H37Rv
cagagacgaucaucucgucg

SEQ ID NO: 3243858 - RNA, 16 nt, Mycobacterium tuberculosis H37Rv
cagagcacgcgcggcg

SEQ ID NO: 3243859 - RNA, 17 nt, Mycobacterium tuberculosis H37Rv
cagagcacgcgcggcgu

SEQ ID NO: 3243860 - RNA, 13 nt, Mycobacterium tuberculosis H37Rv
cagagccaacgcg

SEQ ID NO: 3243861 - RNA, 14 nt, Mycobacterium tuberculosis H37Rv
cagagccccggcaa

SEQ ID NO: 3243862 - RNA, 18 nt, Mycobacterium tuberculosis H37Rv
cagagccccggcaagcgc

SEQ ID NO: 3243863 - RNA, 17 nt, Mycobacterium tuberculosis H37Rv
cagagccgcccuugccu

SEQ ID NO: 3243864 - RNA, 20 nt, Mycobacterium tuberculosis H37Rv
cagagccgccguugccgccg

SEQ ID NO: 3243865 - RNA, 15 nt, Mycobacterium tuberculosis H37Rv
cagagccgggcuggc

SEQ ID NO: 3243866 - RNA, 16 nt, Mycobacterium tuberculosis H37Rv
cagagccgucgaagcg

SEQ ID NO: 3243867 - RNA, 14 nt, Mycobacterium tuberculosis H37Rv
cagagcggcacgca

SEQ ID NO: 3243868 - RNA, 14 nt, Mycobacterium tuberculosis H37Rv
cagagcggcaguca

SEQ ID NO: 3243869 - RNA, 22 nt, Mycobacterium tuberculosis H37Rv
cagagcucgaaguuggcuuucg

SEQ ID NO: 3243870 - RNA, 14 nt, Mycobacterium tuberculosis H37Rv
cagaggacccgugc

SEQ ID NO: 3243871 - RNA, 19 nt, Mycobacterium tuberculosis H37Rv
cagaggaucaucgacgccu

SEQ ID NO: 3243872 - RNA, 21 nt, Mycobacterium tuberculosis H37Rv
cagaggcgcaagaaugccgcc

SEQ ID NO: 3243873 - RNA, 13 nt, Mycobacterium tuberculosis H37Rv
cagaggucgccgg

SEQ ID NO: 3243874 - RNA, 19 nt, Mycobacterium tuberculosis H37Rv
cagaggucggucagccacc

SEQ ID NO: 3243875 - RNA, 19 nt, Mycobacterium tuberculosis H37Rv
cagaguagacaacagucga

SEQ ID NO: 3243876 - RNA, 12 nt, Mycobacterium tuberculosis H37Rv
cagagucaacau

SEQ ID NO: 3243877 - RNA, 18 nt, Mycobacterium tuberculosis H37Rv
cagagucaacaucagcac

SEQ ID NO: 3243878 - RNA, 14 nt, Mycobacterium tuberculosis H37Rv
cagagucgcccgca

SEQ ID NO: 3243879 - RNA, 12 nt, Mycobacterium tuberculosis H37Rv
cagagugaaucc

SEQ ID NO: 3243880 - RNA, 22 nt, Mycobacterium tuberculosis H37Rv
cagagugguggcgaucugggug

SEQ ID NO: 3243881 - RNA, 17 nt, Mycobacterium tuberculosis H37Rv
cagaguucccgaaaccc

SEQ ID NO: 3243882 - RNA, 14 nt, Mycobacterium tuberculosis H37Rv
cagaguucccugau

SEQ ID NO: 3243883 - RNA, 19 nt, Mycobacterium tuberculosis H37Rv
cagaguucccugaugggcg

SEQ ID NO: 3243884 - RNA, 16 nt, Mycobacterium tuberculosis H37Rv
cagauacaucgggauc

SEQ ID NO: 3243885 - RNA, 15 nt, Mycobacterium tuberculosis H37Rv
cagauaccaccgccg

SEQ ID NO: 3243886 - RNA, 23 nt, Mycobacterium tuberculosis H37Rv
cagauaccaccgccgcugccggu

SEQ ID NO: 3243887 - RNA, 14 nt, Mycobacterium tuberculosis H37Rv
cagauacgagcugu

SEQ ID NO: 3243888 - RNA, 19 nt, Mycobacterium tuberculosis H37Rv
cagauaggacccagccagc

SEQ ID NO: 3243889 - RNA, 21 nt, Mycobacterium tuberculosis H37Rv
cagauagguuccaccgggcgu

SEQ ID NO: 3243890 - RNA, 21 nt, Mycobacterium tuberculosis H37Rv
cagauaguccggcuuguccuc

SEQ ID NO: 3243891 - RNA, 14 nt, Mycobacterium tuberculosis H37Rv
cagauagucgccgc

SEQ ID NO: 3243892 - RNA, 20 nt, Mycobacterium tuberculosis H37Rv
cagauagucgccgccgucgu

SEQ ID NO: 3243893 - RNA, 17 nt, Mycobacterium tuberculosis H37Rv
cagauagugcauguauu

SEQ ID NO: 3243894 - RNA, 16 nt, Mycobacterium tuberculosis H37Rv
cagauagugcuccacg

SEQ ID NO: 3243895 - RNA, 17 nt, Mycobacterium tuberculosis H37Rv
cagauaucguacuggcu

SEQ ID NO: 3243896 - RNA, 21 nt, Mycobacterium tuberculosis H37Rv
cagauaugacggcagaccaug

SEQ ID NO: 3243897 - RNA, 17 nt, Mycobacterium tuberculosis H37Rv
cagaucaacaucaucac

SEQ ID NO: 3243898 - RNA, 20 nt, Mycobacterium tuberculosis H37Rv
cagaucaacaucaucacugu

SEQ ID NO: 3243899 - RNA, 14 nt, Mycobacterium tuberculosis H37Rv
cagaucaccgccag

SEQ ID NO: 3243900 - RNA, 16 nt, Mycobacterium tuberculosis H37Rv
cagaucaccgccagcu

SEQ ID NO: 3243901 - RNA, 15 nt, Mycobacterium tuberculosis H37Rv
cagauccgcagcguc

SEQ ID NO: 3243902 - RNA, 21 nt, Mycobacterium tuberculosis H37Rv
cagauccgggcaugcgccgua

SEQ ID NO: 3243903 - RNA, 18 nt, Mycobacterium tuberculosis H37Rv
cagauccgguccaccgcc

SEQ ID NO: 3243904 - RNA, 20 nt, Mycobacterium tuberculosis H37Rv
cagaucgacgcauuccucga

SEQ ID NO: 3243905 - RNA, 14 nt, Mycobacterium tuberculosis H37Rv
cagaucgccccagc

SEQ ID NO: 3243906 - RNA, 16 nt, Mycobacterium tuberculosis H37Rv
cagaucggccggauac

SEQ ID NO: 3243907 - RNA, 22 nt, Mycobacterium tuberculosis H37Rv
cagaucggccggauacgggcug

SEQ ID NO: 3243908 - RNA, 17 nt, Mycobacterium tuberculosis H37Rv
cagaucgucacucccga

SEQ ID NO: 3243909 - RNA, 14 nt, Mycobacterium tuberculosis H37Rv
cagaucguccaccg

SEQ ID NO: 3243910 - RNA, 17 nt, Mycobacterium tuberculosis H37Rv
cagaucuggguucccga

SEQ ID NO: 3243911 - RNA, 17 nt, Mycobacterium tuberculosis H37Rv
cagaucuuccgagcacu

SEQ ID NO: 3243912 - RNA, 12 nt, Mycobacterium tuberculosis H37Rv
cagaucuugcag

SEQ ID NO: 3243913 - RNA, 17 nt, Mycobacterium tuberculosis H37Rv
cagaucuuucuugcugu

SEQ ID NO: 3243914 - RNA, 16 nt, Mycobacterium tuberculosis H37Rv
cagaugaaggugacga

SEQ ID NO: 3243915 - RNA, 19 nt, Mycobacterium tuberculosis H37Rv
cagaugaaggugacgacga

SEQ ID NO: 3243916 - RNA, 23 nt, Mycobacterium tuberculosis H37Rv
cagaugaauugccgggcgcacgc

SEQ ID NO: 3243917 - RNA, 13 nt, Mycobacterium tuberculosis H37Rv
cagaugcaccucg

SEQ ID NO: 3243918 - RNA, 22 nt, Mycobacterium tuberculosis H37Rv
cagaugcaccucgcccugcaga

SEQ ID NO: 3243919 - RNA, 24 nt, Mycobacterium tuberculosis H37Rv
cagaugcaccucgcccugcagacg

SEQ ID NO: 3243920 - RNA, 15 nt, Mycobacterium tuberculosis H37Rv
cagaugcagcggucc

SEQ ID NO: 3243921 - RNA, 16 nt, Mycobacterium tuberculosis H37Rv
cagaugcagcggucca

SEQ ID NO: 3243922 - RNA, 17 nt, Mycobacterium tuberculosis H37Rv
cagaugcauccagcugc

SEQ ID NO: 3243923 - RNA, 15 nt, Mycobacterium tuberculosis H37Rv
cagaugccgggcuga

SEQ ID NO: 3243924 - RNA, 17 nt, Mycobacterium tuberculosis H37Rv
cagaugcggcccgggcu

SEQ ID NO: 3243925 - RNA, 21 nt, Mycobacterium tuberculosis H37Rv
cagauggcauugcgcccaccg

SEQ ID NO: 3243926 - RNA, 14 nt, Mycobacterium tuberculosis H37Rv
cagauggccacgga

SEQ ID NO: 3243927 - RNA, 23 nt, Mycobacterium tuberculosis H37Rv
cagauggcgaggucggugagguc

SEQ ID NO: 3243928 - RNA, 15 nt, Mycobacterium tuberculosis H37Rv
cagaugggccuccac

SEQ ID NO: 3243929 - RNA, 12 nt, Mycobacterium tuberculosis H37Rv
cagauggggcuc

SEQ ID NO: 3243930 - RNA, 21 nt, Mycobacterium tuberculosis H37Rv
cagauggugaaguugccgguc

SEQ ID NO: 3243931 - RNA, 15 nt, Mycobacterium tuberculosis H37Rv
cagaugguggcaugc

SEQ ID NO: 3243932 - RNA, 18 nt, Mycobacterium tuberculosis H37Rv
cagaugguuggaucgcca

SEQ ID NO: 3243933 - RNA, 19 nt, Mycobacterium tuberculosis H37Rv
cagaugguuggaucgccac

SEQ ID NO: 3243934 - RNA, 22 nt, Mycobacterium tuberculosis H37Rv
cagaugguuggaucgccaccgg

SEQ ID NO: 3243935 - RNA, 19 nt, Mycobacterium tuberculosis H37Rv
cagauguaccucaucgcag

SEQ ID NO: 3243936 - RNA, 15 nt, Mycobacterium tuberculosis H37Rv
cagcaccgugacagc

SEQ ID NO: 3243937 - RNA, 20 nt, Mycobacterium tuberculosis H37Rv
cagcaccgugacccugaugg

SEQ ID NO: 3243938 - RNA, 22 nt, Mycobacterium tuberculosis H37Rv
cagcaccucagaaaguccccgc

SEQ ID NO: 3243939 - RNA, 14 nt, Mycobacterium tuberculosis H37Rv
cagcaccuccaccg

SEQ ID NO: 3243940 - RNA, 16 nt, Mycobacterium tuberculosis H37Rv
cagcaccuccaccgcg

SEQ ID NO: 3243941 - RNA, 21 nt, Mycobacterium tuberculosis H37Rv
cagcaccuccaccgcgccggc

SEQ ID NO: 3243942 - RNA, 13 nt, Mycobacterium tuberculosis H37Rv
cagcaccuccgua

SEQ ID NO: 3243943 - RNA, 14 nt, Mycobacterium tuberculosis H37Rv
cagcaccucgucga

SEQ ID NO: 3243944 - RNA, 20 nt, Mycobacterium tuberculosis H37Rv
cagcaccucgucgaucgccg

SEQ ID NO: 3243945 - RNA, 16 nt, Mycobacterium tuberculosis H37Rv
cagcacgaccucgcgc

SEQ ID NO: 3243946 - RNA, 14 nt, Mycobacterium tuberculosis H37Rv
cagcacgaccuggu

SEQ ID NO: 3243947 - RNA, 15 nt, Mycobacterium tuberculosis H37Rv
cagcacgaccugguu

SEQ ID NO: 3243948 - RNA, 16 nt, Mycobacterium tuberculosis H37Rv
cagcacgaccugguua

SEQ ID NO: 3243949 - RNA, 12 nt, Mycobacterium tuberculosis H37Rv
cagcacgacggc

SEQ ID NO: 3243950 - RNA, 18 nt, Mycobacterium tuberculosis H37Rv
cagcacgauccagcugua

SEQ ID NO: 3243951 - RNA, 13 nt, Mycobacterium tuberculosis H37Rv
cagcacgccaggc

SEQ ID NO: 3243952 - RNA, 13 nt, Mycobacterium tuberculosis H37Rv
cagcacgcccgaa

SEQ ID NO: 3243953 - RNA, 14 nt, Mycobacterium tuberculosis H37Rv
cagcacgcccucga

SEQ ID NO: 3243954 - RNA, 20 nt, Mycobacterium tuberculosis H37Rv
cagcacgccgccggccgcca

SEQ ID NO: 3243955 - RNA, 21 nt, Mycobacterium tuberculosis H37Rv
cagcacgccgccggccgccag

SEQ ID NO: 3243956 - RNA, 12 nt, Mycobacterium tuberculosis H37Rv
cagcacgccggg

SEQ ID NO: 3243957 - RNA, 22 nt, Mycobacterium tuberculosis H37Rv
cagcacgcucgugacgaucagc

SEQ ID NO: 3243958 - RNA, 17 nt, Mycobacterium tuberculosis H37Rv
cagcacgcuggcguugu

SEQ ID NO: 3243959 - RNA, 17 nt, Mycobacterium tuberculosis H37Rv
cagcacggcaaccagcg

SEQ ID NO: 3243960 - RNA, 17 nt, Mycobacterium tuberculosis H37Rv
cagcacggcacccaccc

SEQ ID NO: 3243961 - RNA, 13 nt, Mycobacterium tuberculosis H37Rv
cagcacggcaucg

SEQ ID NO: 3243962 - RNA, 17 nt, Mycobacterium tuberculosis H37Rv
cagcacggcggccacgu

SEQ ID NO: 3243963 - RNA, 17 nt, Mycobacterium tuberculosis H37Rv
cagcacggcuucgacca

SEQ ID NO: 3243964 - RNA, 18 nt, Mycobacterium tuberculosis H37Rv
cagcacgggugagcacca

SEQ ID NO: 3243965 - RNA, 12 nt, Mycobacterium tuberculosis H37Rv
cagcacggucaa

SEQ ID NO: 3243966 - RNA, 21 nt, Mycobacterium tuberculosis H37Rv
cagcacgguggcuucgacggc

SEQ ID NO: 3243967 - RNA, 22 nt, Mycobacterium tuberculosis H37Rv
cagcacgguguacgcccgcucg

SEQ ID NO: 3243968 - RNA, 21 nt, Mycobacterium tuberculosis H37Rv
cagcacgguguugcgcacccg

SEQ ID NO: 3243969 - RNA, 15 nt, Mycobacterium tuberculosis H37Rv
cagcacguaacccag

SEQ ID NO: 3243970 - RNA, 22 nt, Mycobacterium tuberculosis H37Rv
cagcacguaaccuggggugaac

SEQ ID NO: 3243971 - RNA, 23 nt, Mycobacterium tuberculosis H37Rv
cagcacguaaccuggggugaacu

SEQ ID NO: 3243972 - RNA, 16 nt, Mycobacterium tuberculosis H37Rv
cagcacguaacgccgc

SEQ ID NO: 3243973 - RNA, 17 nt, Mycobacterium tuberculosis H37Rv
cagcacguaacgccgcu

SEQ ID NO: 3243974 - RNA, 20 nt, Mycobacterium tuberculosis H37Rv
cagcacgucaaccucgccac

SEQ ID NO: 3243975 - RNA, 12 nt, Mycobacterium tuberculosis H37Rv
cagcacgucgca

SEQ ID NO: 3243976 - RNA, 13 nt, Mycobacterium tuberculosis H37Rv
cagcacgucgcgg

SEQ ID NO: 3243977 - RNA, 18 nt, Mycobacterium tuberculosis H37Rv
cagcacgucuugcugcac

SEQ ID NO: 3243978 - RNA, 18 nt, Mycobacterium tuberculosis H37Rv
cagcacgugccccaugcg

SEQ ID NO: 3243979 - RNA, 18 nt, Mycobacterium tuberculosis H37Rv
cagcacgugugcgggcac

SEQ ID NO: 3243980 - RNA, 15 nt, Mycobacterium tuberculosis H37Rv
cagcacguucaggug

SEQ ID NO: 3243981 - RNA, 14 nt, Mycobacterium tuberculosis H37Rv
cagcacuccgcggg

SEQ ID NO: 3243982 - RNA, 22 nt, Mycobacterium tuberculosis H37Rv
cagcacucuucgaugaagcugg

SEQ ID NO: 3243983 - RNA, 19 nt, Mycobacterium tuberculosis H37Rv
cagcacuuccaagccgacc

SEQ ID NO: 3243984 - RNA, 16 nt, Mycobacterium tuberculosis H37Rv
cagcacuuggccagcu

SEQ ID NO: 3243985 - RNA, 19 nt, Mycobacterium tuberculosis H37Rv
cagcagaaacaucgacagc

SEQ ID NO: 3243986 - RNA, 23 nt, Mycobacterium tuberculosis H37Rv
cagcagaauccugcgcugcacca

SEQ ID NO: 3243987 - RNA, 23 nt, Mycobacterium tuberculosis H37Rv
cagcagaccaaguccggucgcgg

SEQ ID NO: 3243988 - RNA, 17 nt, Mycobacterium tuberculosis H37Rv
cagcagagccaacgcgc

SEQ ID NO: 3243989 - RNA, 21 nt, Mycobacterium tuberculosis H37Rv
cagcagagccaacgcgcgacc

SEQ ID NO: 3243990 - RNA, 13 nt, Mycobacterium tuberculosis H37Rv
cagcagagcggca

SEQ ID NO: 3243991 - RNA, 20 nt, Mycobacterium tuberculosis H37Rv
cagcagagcggcacgcacgc

SEQ ID NO: 3243992 - RNA, 13 nt, Mycobacterium tuberculosis H37Rv
cagcagaucaggu

SEQ ID NO: 3243993 - RNA, 17 nt, Mycobacterium tuberculosis H37Rv
cagcagauugaugucag

SEQ ID NO: 3243994 - RNA, 13 nt, Mycobacterium tuberculosis H37Rv
cagcagauugucg

SEQ ID NO: 3243995 - RNA, 22 nt, Mycobacterium tuberculosis H37Rv
cagcagauugucgacggucacc

SEQ ID NO: 3243996 - RNA, 23 nt, Mycobacterium tuberculosis H37Rv
cagcagauugucgacggucaccg

SEQ ID NO: 3243997 - RNA, 22 nt, Mycobacterium tuberculosis H37Rv
cagcagcaaaacccgagccugg

SEQ ID NO: 3243998 - RNA, 17 nt, Mycobacterium tuberculosis H37Rv
cagcagcaaacaucgca

SEQ ID NO: 3243999 - RNA, 18 nt, Mycobacterium tuberculosis H37Rv
cagcagcaaacaucgcag

SEQ ID NO: 3244000 - RNA, 11 nt, Mycobacterium tuberculosis H37Rv
cagcagcaacg

SEQ ID NO: 3244001 - RNA, 13 nt, Mycobacterium tuberculosis H37Rv
cagcagcaacgcg

SEQ ID NO: 3244002 - RNA, 15 nt, Mycobacterium tuberculosis H37Rv
cagcagcaaucagcc

SEQ ID NO: 3244003 - RNA, 20 nt, Mycobacterium tuberculosis H37Rv
cagcagcaaugcgguaccaa

SEQ ID NO: 3244004 - RNA, 15 nt, Mycobacterium tuberculosis H37Rv
cagcagcagauccca

SEQ ID NO: 3244005 - RNA, 16 nt, Mycobacterium tuberculosis H37Rv
cagcagcagauccugg

SEQ ID NO: 3244006 - RNA, 14 nt, Mycobacterium tuberculosis H37Rv
cagcagcagcgccg

SEQ ID NO: 3244007 - RNA, 16 nt, Mycobacterium tuberculosis H37Rv
cagcagcagcgccgcg

SEQ ID NO: 3244008 - RNA, 14 nt, Mycobacterium tuberculosis H37Rv
cagcagcagguugu

SEQ ID NO: 3244009 - RNA, 14 nt, Mycobacterium tuberculosis H37Rv
cagcagcaucggca

SEQ ID NO: 3244010 - RNA, 23 nt, Mycobacterium tuberculosis H37Rv
cagcagccagcccagccgccagc

SEQ ID NO: 3244011 - RNA, 23 nt, Mycobacterium tuberculosis H37Rv
cagcagcccgcccugaccgcccg

SEQ ID NO: 3244012 - RNA, 16 nt, Mycobacterium tuberculosis H37Rv
cagcagcccgggcagc

SEQ ID NO: 3244013 - RNA, 18 nt, Mycobacterium tuberculosis H37Rv
cagcagcccgguggugcu

SEQ ID NO: 3244014 - RNA, 12 nt, Mycobacterium tuberculosis H37Rv
cagcagccgcga

SEQ ID NO: 3244015 - RNA, 18 nt, Mycobacterium tuberculosis H37Rv
cagcagccgcgacgcggc

SEQ ID NO: 3244016 - RNA, 23 nt, Mycobacterium tuberculosis H37Rv
cagcagccggcguacuucgacag

SEQ ID NO: 3244017 - RNA, 21 nt, Mycobacterium tuberculosis H37Rv
cagcagcgaaaaccgucgcag

SEQ ID NO: 3244018 - RNA, 22 nt, Mycobacterium tuberculosis H37Rv
cagcagcgaaaaccgucgcaga

SEQ ID NO: 3244019 - RNA, 15 nt, Mycobacterium tuberculosis H37Rv
cagcagcgacgguca

SEQ ID NO: 3244020 - RNA, 16 nt, Mycobacterium tuberculosis H37Rv
cagcagcgacuccagc

SEQ ID NO: 3244021 - RNA, 22 nt, Mycobacterium tuberculosis H37Rv
cagcagcgagucgaaugucccg

SEQ ID NO: 3244022 - RNA, 18 nt, Mycobacterium tuberculosis H37Rv
cagcagcgcaacggccag

SEQ ID NO: 3244023 - RNA, 19 nt, Mycobacterium tuberculosis H37Rv
cagcagcgcacugcccggg

SEQ ID NO: 3244024 - RNA, 14 nt, Mycobacterium tuberculosis H37Rv
cagcagcgccaccc

SEQ ID NO: 3244025 - RNA, 14 nt, Mycobacterium tuberculosis H37Rv
cagcagcgccgcgu

SEQ ID NO: 3244026 - RNA, 21 nt, Mycobacterium tuberculosis H37Rv
cagcagcgccgcguggcuggc

SEQ ID NO: 3244027 - RNA, 13 nt, Mycobacterium tuberculosis H37Rv
cagcagcgcgaca

SEQ ID NO: 3244028 - RNA, 16 nt, Mycobacterium tuberculosis H37Rv
cagcagcggcgaccgc

SEQ ID NO: 3244029 - RNA, 15 nt, Mycobacterium tuberculosis H37Rv
cagcagcggcgagcc

SEQ ID NO: 3244030 - RNA, 22 nt, Mycobacterium tuberculosis H37Rv
cagcagcggcggaaggacggca

SEQ ID NO: 3244031 - RNA, 22 nt, Mycobacterium tuberculosis H37Rv
cagcagcgggccgaagccccga

SEQ ID NO: 3244032 - RNA, 15 nt, Mycobacterium tuberculosis H37Rv
cagccaccagcgacg

SEQ ID NO: 3244033 - RNA, 21 nt, Mycobacterium tuberculosis H37Rv
cagccaccagcgacgaccaca

SEQ ID NO: 3244034 - RNA, 14 nt, Mycobacterium tuberculosis H37Rv
cagccaccaucugg

SEQ ID NO: 3244035 - RNA, 18 nt, Mycobacterium tuberculosis H37Rv
cagccaccgcauguggga

SEQ ID NO: 3244036 - RNA, 17 nt, Mycobacterium tuberculosis H37Rv
cagccaccgcggucagc

SEQ ID NO: 3244037 - RNA, 19 nt, Mycobacterium tuberculosis H37Rv
cagccaccgcggucagcuc

SEQ ID NO: 3244038 - RNA, 22 nt, Mycobacterium tuberculosis H37Rv
cagccaccggugagcgcagcuu

SEQ ID NO: 3244039 - RNA, 16 nt, Mycobacterium tuberculosis H37Rv
cagccaccgucaugcc

SEQ ID NO: 3244040 - RNA, 23 nt, Mycobacterium tuberculosis H37Rv
cagccaccugccgacucaucggc

SEQ ID NO: 3244041 - RNA, 18 nt, Mycobacterium tuberculosis H37Rv
cagccacgauccuuggcg

SEQ ID NO: 3244042 - RNA, 15 nt, Mycobacterium tuberculosis H37Rv
cagccacgcaaauac

SEQ ID NO: 3244043 - RNA, 15 nt, Mycobacterium tuberculosis H37Rv
cagccacgcacaaua

SEQ ID NO: 3244044 - RNA, 15 nt, Mycobacterium tuberculosis H37Rv
cagccacgccacguc

SEQ ID NO: 3244045 - RNA, 14 nt, Mycobacterium tuberculosis H37Rv
cagccacgucuccu

SEQ ID NO: 3244046 - RNA, 20 nt, Mycobacterium tuberculosis H37Rv
cagccacguuacgcucgcgg

SEQ ID NO: 3244047 - RNA, 13 nt, Mycobacterium tuberculosis H37Rv
cagccacuccucg

SEQ ID NO: 3244048 - RNA, 11 nt, Mycobacterium tuberculosis H37Rv
cagccagacca

SEQ ID NO: 3244049 - RNA, 15 nt, Mycobacterium tuberculosis H37Rv
cagccagaccaacau

SEQ ID NO: 3244050 - RNA, 13 nt, Mycobacterium tuberculosis H37Rv
cagccagaucucc

SEQ ID NO: 3244051 - RNA, 15 nt, Mycobacterium tuberculosis H37Rv
cagccagaucuccag

SEQ ID NO: 3244052 - RNA, 19 nt, Mycobacterium tuberculosis H37Rv
cagccagaucuccagguuc

SEQ ID NO: 3244053 - RNA, 18 nt, Mycobacterium tuberculosis H37Rv
cagccagaucuccccgac

SEQ ID NO: 3244054 - RNA, 20 nt, Mycobacterium tuberculosis H37Rv
cagccagaucuccccgaccg

SEQ ID NO: 3244055 - RNA, 15 nt, Mycobacterium tuberculosis H37Rv
cagccagaugccggu

SEQ ID NO: 3244056 - RNA, 21 nt, Mycobacterium tuberculosis H37Rv
cagccagaugccgguaacgaa

SEQ ID NO: 3244057 - RNA, 18 nt, Mycobacterium tuberculosis H37Rv
cagccagauucauuggcc

SEQ ID NO: 3244058 - RNA, 11 nt, Mycobacterium tuberculosis H37Rv
cagccagcaag

SEQ ID NO: 3244059 - RNA, 14 nt, Mycobacterium tuberculosis H37Rv
cagccagcccagcc

SEQ ID NO: 3244060 - RNA, 18 nt, Mycobacterium tuberculosis H37Rv
cagccagcccagccgcca

SEQ ID NO: 3244061 - RNA, 12 nt, Mycobacterium tuberculosis H37Rv
cagccagccgga

SEQ ID NO: 3244062 - RNA, 12 nt, Mycobacterium tuberculosis H37Rv
cagccagccugc

SEQ ID NO: 3244063 - RNA, 14 nt, Mycobacterium tuberculosis H37Rv
cagccagccugcug

SEQ ID NO: 3244064 - RNA, 19 nt, Mycobacterium tuberculosis H37Rv
cagccagcguccauggucg

SEQ ID NO: 3244065 - RNA, 18 nt, Mycobacterium tuberculosis H37Rv
cagccagcuggacuccgg

SEQ ID NO: 3244066 - RNA, 18 nt, Mycobacterium tuberculosis H37Rv
cagccaggccgcaaugcg

SEQ ID NO: 3244067 - RNA, 20 nt, Mycobacterium tuberculosis H37Rv
cagccaggccuuggugcggc

SEQ ID NO: 3244068 - RNA, 16 nt, Mycobacterium tuberculosis H37Rv
cagccaggcgauugcc

SEQ ID NO: 3244069 - RNA, 12 nt, Mycobacterium tuberculosis H37Rv
cagccaggcugc

SEQ ID NO: 3244070 - RNA, 23 nt, Mycobacterium tuberculosis H37Rv
cagccagggucccgccgccugga

SEQ ID NO: 3244071 - RNA, 22 nt, Mycobacterium tuberculosis H37Rv
cagccaggugauuaccugguuc

SEQ ID NO: 3244072 - RNA, 15 nt, Mycobacterium tuberculosis H37Rv
cagccaggugcccaa

SEQ ID NO: 3244073 - RNA, 21 nt, Mycobacterium tuberculosis H37Rv
cagccaggugcccaagcaguc

SEQ ID NO: 3244074 - RNA, 17 nt, Mycobacterium tuberculosis H37Rv
cagccaguccagcgcgc

SEQ ID NO: 3244075 - RNA, 19 nt, Mycobacterium tuberculosis H37Rv
cagccaguguugcaguggc

SEQ ID NO: 3244076 - RNA, 20 nt, Mycobacterium tuberculosis H37Rv
cagccaguguugcaguggcg

SEQ ID NO: 3244077 - RNA, 19 nt, Mycobacterium tuberculosis H37Rv
cagccaguugaucaggccg

SEQ ID NO: 3244078 - RNA, 15 nt, Mycobacterium tuberculosis H37Rv
cagccauagugcggc

SEQ ID NO: 3244079 - RNA, 21 nt, Mycobacterium tuberculosis H37Rv
cagccaucucuugcaaccugg

SEQ ID NO: 3244080 - RNA, 18 nt, Mycobacterium tuberculosis H37Rv
cagccaugcucgucuugg

SEQ ID NO: 3244081 - RNA, 20 nt, Mycobacterium tuberculosis H37Rv
cagccaugcucgucuugggc

SEQ ID NO: 3244082 - RNA, 19 nt, Mycobacterium tuberculosis H37Rv
cagccauggcagcgccgca

SEQ ID NO: 3244083 - RNA, 16 nt, Mycobacterium tuberculosis H37Rv
cagccauggugggccu

SEQ ID NO: 3244084 - RNA, 18 nt, Mycobacterium tuberculosis H37Rv
cagccauggugggccuuc

SEQ ID NO: 3244085 - RNA, 20 nt, Mycobacterium tuberculosis H37Rv
cagccauggugggccuuccu

SEQ ID NO: 3244086 - RNA, 22 nt, Mycobacterium tuberculosis H37Rv
cagccauguccgcaguucgguc

SEQ ID NO: 3244087 - RNA, 15 nt, Mycobacterium tuberculosis H37Rv
cagcccaaaucccag

SEQ ID NO: 3244088 - RNA, 19 nt, Mycobacterium tuberculosis H37Rv
cagcccaacucggccagcu

SEQ ID NO: 3244089 - RNA, 17 nt, Mycobacterium tuberculosis H37Rv
cagcccacaggcggcgc

SEQ ID NO: 3244090 - RNA, 12 nt, Mycobacterium tuberculosis H37Rv
cagcccaccggu

SEQ ID NO: 3244091 - RNA, 13 nt, Mycobacterium tuberculosis H37Rv
cagcccaccggug

SEQ ID NO: 3244092 - RNA, 14 nt, Mycobacterium tuberculosis H37Rv
cagcccaccggugc

SEQ ID NO: 3244093 - RNA, 21 nt, Mycobacterium tuberculosis H37Rv
cagcccaccggugccgcccgc

SEQ ID NO: 3244094 - RNA, 14 nt, Mycobacterium tuberculosis H37Rv
cagcccagcacgcu

SEQ ID NO: 3244095 - RNA, 22 nt, Mycobacterium tuberculosis H37Rv
cagcccagcagguuccacggcc

SEQ ID NO: 3244096 - RNA, 16 nt, Mycobacterium tuberculosis H37Rv
cagcccagccgccagc

SEQ ID NO: 3244097 - RNA, 21 nt, Mycobacterium tuberculosis H37Rv
cagcccagccguucgucgcgg

SEQ ID NO: 3244098 - RNA, 17 nt, Mycobacterium tuberculosis H37Rv
cagcccaggccuuagau

SEQ ID NO: 3244099 - RNA, 15 nt, Mycobacterium tuberculosis H37Rv
cagcccaugcccggc

SEQ ID NO: 3244100 - RNA, 12 nt, Mycobacterium tuberculosis H37Rv
cagcccaugggg

SEQ ID NO: 3244101 - RNA, 15 nt, Mycobacterium tuberculosis H37Rv
cagcccaugucgagc

SEQ ID NO: 3244102 - RNA, 22 nt, Mycobacterium tuberculosis H37Rv
cagcccaugucgagcacgccaa

SEQ ID NO: 3244103 - RNA, 13 nt, Mycobacterium tuberculosis H37Rv
cagccccaacccu

SEQ ID NO: 3244104 - RNA, 14 nt, Mycobacterium tuberculosis H37Rv
cagccccagggugc

SEQ ID NO: 3244105 - RNA, 15 nt, Mycobacterium tuberculosis H37Rv
cagccccagggugcg

SEQ ID NO: 3244106 - RNA, 20 nt, Mycobacterium tuberculosis H37Rv
cagccccccggcgacggcgu

SEQ ID NO: 3244107 - RNA, 19 nt, Mycobacterium tuberculosis H37Rv
cagccccgacugcgcccau

SEQ ID NO: 3244108 - RNA, 18 nt, Mycobacterium tuberculosis H37Rv
cagccccgccggggccgc

SEQ ID NO: 3244109 - RNA, 23 nt, Mycobacterium tuberculosis H37Rv
cagccccgccggggccgccgucg

SEQ ID NO: 3244110 - RNA, 21 nt, Mycobacterium tuberculosis H37Rv
cagccccguuucgccagaugg

SEQ ID NO: 3244111 - RNA, 13 nt, Mycobacterium tuberculosis H37Rv
cagccccuccgcg

SEQ ID NO: 3244112 - RNA, 18 nt, Mycobacterium tuberculosis H37Rv
cagcccgaaccguuuggu

SEQ ID NO: 3244113 - RNA, 17 nt, Mycobacterium tuberculosis H37Rv
cagcccgaacucguugg

SEQ ID NO: 3244114 - RNA, 16 nt, Mycobacterium tuberculosis H37Rv
cagcccgacgcccgac

SEQ ID NO: 3244115 - RNA, 17 nt, Mycobacterium tuberculosis H37Rv
cagcccgacguugcgua

SEQ ID NO: 3244116 - RNA, 16 nt, Mycobacterium tuberculosis H37Rv
cagcccgagcagaaac

SEQ ID NO: 3244117 - RNA, 15 nt, Mycobacterium tuberculosis H37Rv
cagcccgagcucggg

SEQ ID NO: 3244118 - RNA, 20 nt, Mycobacterium tuberculosis H37Rv
cagcccgaugaucccgccac

SEQ ID NO: 3244119 - RNA, 12 nt, Mycobacterium tuberculosis H37Rv
cagcccgaugcc

SEQ ID NO: 3244120 - RNA, 13 nt, Mycobacterium tuberculosis H37Rv
cagcccgcccaau

SEQ ID NO: 3244121 - RNA, 17 nt, Mycobacterium tuberculosis H37Rv
cagcccgcccggugugu

SEQ ID NO: 3244122 - RNA, 20 nt, Mycobacterium tuberculosis H37Rv
cagcccgcccugaccgcccg

SEQ ID NO: 3244123 - RNA, 19 nt, Mycobacterium tuberculosis H37Rv
cagcccgccggacccgccc

SEQ ID NO: 3244124 - RNA, 18 nt, Mycobacterium tuberculosis H37Rv
cagcccgccggauccgcc

SEQ ID NO: 3244125 - RNA, 13 nt, Mycobacterium tuberculosis H37Rv
cagcccgccgucg

SEQ ID NO: 3244126 - RNA, 14 nt, Mycobacterium tuberculosis H37Rv
cagcccgcgcagca

SEQ ID NO: 3244127 - RNA, 16 nt, Mycobacterium tuberculosis H37Rv
cagcccgcgcagcggu

SEQ ID NO: 3244128 - RNA, 14 nt, Mycobacterium tuberculosis H37Rv
cagcccggacgcgc

SEQ ID NO: 3244129 - RNA, 22 nt, Mycobacterium tuberculosis H37Rv
cagcccggacguaggcaccccg

SEQ ID NO: 3244130 - RNA, 23 nt, Mycobacterium tuberculosis H37Rv
cagcccggacguaggcaccccgg

SEQ ID NO: 3244131 - RNA, 21 nt, Mycobacterium tuberculosis H37Rv
cagcccggcacugaccgcgau

SEQ ID NO: 3244132 - RNA, 14 nt, Mycobacterium tuberculosis H37Rv
cagcccggccagcc

SEQ ID NO: 3244133 - RNA, 16 nt, Mycobacterium tuberculosis H37Rv
cagcccggccagccgc

SEQ ID NO: 3244134 - RNA, 16 nt, Mycobacterium tuberculosis H37Rv
cagcccggccgccgag

SEQ ID NO: 3244135 - RNA, 18 nt, Mycobacterium tuberculosis H37Rv
cagcccggccgccgagga

SEQ ID NO: 3244136 - RNA, 16 nt, Mycobacterium tuberculosis H37Rv
cagcccggccggucga

SEQ ID NO: 3244137 - RNA, 18 nt, Mycobacterium tuberculosis H37Rv
cagcccggccggucgaga

SEQ ID NO: 3244138 - RNA, 13 nt, Mycobacterium tuberculosis H37Rv
cagcccggccuug

SEQ ID NO: 3244139 - RNA, 21 nt, Mycobacterium tuberculosis H37Rv
cagcccggccuugccgccggc

SEQ ID NO: 3244140 - RNA, 17 nt, Mycobacterium tuberculosis H37Rv
cagcccggcgacgaccc

SEQ ID NO: 3244141 - RNA, 20 nt, Mycobacterium tuberculosis H37Rv
cagcccggcgacgacccggg

SEQ ID NO: 3244142 - RNA, 21 nt, Mycobacterium tuberculosis H37Rv
cagcccggcgacgacccgggu

SEQ ID NO: 3244143 - RNA, 15 nt, Mycobacterium tuberculosis H37Rv
cagcccggcggccgc

SEQ ID NO: 3244144 - RNA, 17 nt, Mycobacterium tuberculosis H37Rv
cagcccggcgugcagaa

SEQ ID NO: 3244145 - RNA, 21 nt, Mycobacterium tuberculosis H37Rv
cagcccggcuaacuggacugg

SEQ ID NO: 3244146 - RNA, 17 nt, Mycobacterium tuberculosis H37Rv
cagcccgggcagcacca

SEQ ID NO: 3244147 - RNA, 18 nt, Mycobacterium tuberculosis H37Rv
cagcccgggcagcaccag

SEQ ID NO: 3244148 - RNA, 14 nt, Mycobacterium tuberculosis H37Rv
cagcccgggcagcc

SEQ ID NO: 3244149 - RNA, 16 nt, Mycobacterium tuberculosis H37Rv
cagcccgggcagcccc

SEQ ID NO: 3244150 - RNA, 20 nt, Mycobacterium tuberculosis H37Rv
cagcccgggcagccccuccg

SEQ ID NO: 3244151 - RNA, 21 nt, Mycobacterium tuberculosis H37Rv
cagcccgggcagccccuccgc

SEQ ID NO: 3244152 - RNA, 18 nt, Mycobacterium tuberculosis H37Rv
cagcccggucauggucag

SEQ ID NO: 3244153 - RNA, 15 nt, Mycobacterium tuberculosis H37Rv
cagcccggugauggu

SEQ ID NO: 3244154 - RNA, 17 nt, Mycobacterium tuberculosis H37Rv
cagcccggugugcugca

SEQ ID NO: 3244155 - RNA, 23 nt, Mycobacterium tuberculosis H37Rv
cagcccguccaggcgcugcagca

SEQ ID NO: 3244156 - RNA, 13 nt, Mycobacterium tuberculosis H37Rv
cagcccguccggc

SEQ ID NO: 3244157 - RNA, 16 nt, Mycobacterium tuberculosis H37Rv
cagcccguccggcccc

SEQ ID NO: 3244158 - RNA, 14 nt, Mycobacterium tuberculosis H37Rv
cagcccgucggcgc

SEQ ID NO: 3244159 - RNA, 18 nt, Mycobacterium tuberculosis H37Rv
cagcccgucggcgccgaa

SEQ ID NO: 3244160 - RNA, 19 nt, Mycobacterium tuberculosis H37Rv
cagcccgucggcgccgaac

SEQ ID NO: 3244161 - RNA, 17 nt, Mycobacterium tuberculosis H37Rv
cagcccgucgggcaguu

SEQ ID NO: 3244162 - RNA, 19 nt, Mycobacterium tuberculosis H37Rv
cagcccgugacuggugaac

SEQ ID NO: 3244163 - RNA, 16 nt, Mycobacterium tuberculosis H37Rv
cagcccguucgugccg

SEQ ID NO: 3244164 - RNA, 15 nt, Mycobacterium tuberculosis H37Rv
cagcccguugcagga

SEQ ID NO: 3244165 - RNA, 14 nt, Mycobacterium tuberculosis H37Rv
cagcccuaucagcc

SEQ ID NO: 3244166 - RNA, 21 nt, Mycobacterium tuberculosis H37Rv
cagcccuaucagccgagacac

SEQ ID NO: 3244167 - RNA, 22 nt, Mycobacterium tuberculosis H37Rv
cagcccucugguggcgcugaag

SEQ ID NO: 3244168 - RNA, 14 nt, Mycobacterium tuberculosis H37Rv
cagcccugcgcagc

SEQ ID NO: 3244169 - RNA, 18 nt, Mycobacterium tuberculosis H37Rv
cagcccuguuugacugcg

SEQ ID NO: 3244170 - RNA, 19 nt, Mycobacterium tuberculosis H37Rv
cagcccuguuugacugcga

SEQ ID NO: 3244171 - RNA, 13 nt, Mycobacterium tuberculosis H37Rv
cagcccuucagcg

SEQ ID NO: 3244172 - RNA, 16 nt, Mycobacterium tuberculosis H37Rv
cagccgaaccggcacc

SEQ ID NO: 3244173 - RNA, 17 nt, Mycobacterium tuberculosis H37Rv
cagccgaaccggcacca

SEQ ID NO: 3244174 - RNA, 16 nt, Mycobacterium tuberculosis H37Rv
cagccgaagaaccggu

SEQ ID NO: 3244175 - RNA, 14 nt, Mycobacterium tuberculosis H37Rv
cagccgaagcgccc

SEQ ID NO: 3244176 - RNA, 18 nt, Mycobacterium tuberculosis H37Rv
cagccgaagcgcccguug

SEQ ID NO: 3244177 - RNA, 16 nt, Mycobacterium tuberculosis H37Rv
cagccgacagaugguc

SEQ ID NO: 3244178 - RNA, 20 nt, Mycobacterium tuberculosis H37Rv
cagccgaccgaaucagcacg

SEQ ID NO: 3244179 - RNA, 22 nt, Mycobacterium tuberculosis H37Rv
cagccgacgcacgugaugcccu

SEQ ID NO: 3244180 - RNA, 15 nt, Mycobacterium tuberculosis H37Rv
cagccgacgcggcgg

SEQ ID NO: 3244181 - RNA, 17 nt, Mycobacterium tuberculosis H37Rv
cagccgagcggcggcac

SEQ ID NO: 3244182 - RNA, 19 nt, Mycobacterium tuberculosis H37Rv
cagccgagcggcggcacug

SEQ ID NO: 3244183 - RNA, 16 nt, Mycobacterium tuberculosis H37Rv
cagccgagcguggcgu

SEQ ID NO: 3244184 - RNA, 19 nt, Mycobacterium tuberculosis H37Rv
cagccgagcguggcguugg

SEQ ID NO: 3244185 - RNA, 17 nt, Mycobacterium tuberculosis H37Rv
cagccgauacaggccac

SEQ ID NO: 3244186 - RNA, 17 nt, Mycobacterium tuberculosis H37Rv
cagccgauccgaucgca

SEQ ID NO: 3244187 - RNA, 21 nt, Mycobacterium tuberculosis H37Rv
cagccgaucgucucggccacg

SEQ ID NO: 3244188 - RNA, 22 nt, Mycobacterium tuberculosis H37Rv
cagccgaucgucucggccacga

SEQ ID NO: 3244189 - RNA, 18 nt, Mycobacterium tuberculosis H37Rv
cagccgaugacguacggc

SEQ ID NO: 3244190 - RNA, 23 nt, Mycobacterium tuberculosis H37Rv
cagccgaugauaauuccagcacc

SEQ ID NO: 3244191 - RNA, 12 nt, Mycobacterium tuberculosis H37Rv
cagccgaugcug

SEQ ID NO: 3244192 - RNA, 16 nt, Mycobacterium tuberculosis H37Rv
cagccgaugcugcggg

SEQ ID NO: 3244193 - RNA, 15 nt, Mycobacterium tuberculosis H37Rv
cagccgcaccccgcc

SEQ ID NO: 3244194 - RNA, 14 nt, Mycobacterium tuberculosis H37Rv
cagccgcacgguuc

SEQ ID NO: 3244195 - RNA, 21 nt, Mycobacterium tuberculosis H37Rv
cagccgcacgguugccgucag

SEQ ID NO: 3244196 - RNA, 16 nt, Mycobacterium tuberculosis H37Rv
cagccgcagcaccucg

SEQ ID NO: 3244197 - RNA, 14 nt, Mycobacterium tuberculosis H37Rv
cagccgcagccagg

SEQ ID NO: 3244198 - RNA, 22 nt, Mycobacterium tuberculosis H37Rv
cagccgcauaggccccgccagc

SEQ ID NO: 3244199 - RNA, 13 nt, Mycobacterium tuberculosis H37Rv
cagccgccaugcg

SEQ ID NO: 3244200 - RNA, 13 nt, Mycobacterium tuberculosis H37Rv
cagccgcccgccc

SEQ ID NO: 3244201 - RNA, 20 nt, Mycobacterium tuberculosis H37Rv
cagccgcccgcccaccucga

SEQ ID NO: 3244202 - RNA, 14 nt, Mycobacterium tuberculosis H37Rv
cagccgccgaugau

SEQ ID NO: 3244203 - RNA, 20 nt, Mycobacterium tuberculosis H37Rv
cagccgcgacacgugcaucu

SEQ ID NO: 3244204 - RNA, 21 nt, Mycobacterium tuberculosis H37Rv
cagccgcgacacgugcaucug

SEQ ID NO: 3244205 - RNA, 17 nt, Mycobacterium tuberculosis H37Rv
cagccgcgacgcggcgu

SEQ ID NO: 3244206 - RNA, 14 nt, Mycobacterium tuberculosis H37Rv
cagccgcgagccgg

SEQ ID NO: 3244207 - RNA, 17 nt, Mycobacterium tuberculosis H37Rv
cagccgcgagccgguga

SEQ ID NO: 3244208 - RNA, 21 nt, Mycobacterium tuberculosis H37Rv
cagccgcgccgaccucaucgg

SEQ ID NO: 3244209 - RNA, 18 nt, Mycobacterium tuberculosis H37Rv
cagccgcgcgggucacga

SEQ ID NO: 3244210 - RNA, 14 nt, Mycobacterium tuberculosis H37Rv
cagccgcggaucau

SEQ ID NO: 3244211 - RNA, 15 nt, Mycobacterium tuberculosis H37Rv
cagccgcggccacau

SEQ ID NO: 3244212 - RNA, 14 nt, Mycobacterium tuberculosis H37Rv
cagccgcggcccuc

SEQ ID NO: 3244213 - RNA, 20 nt, Mycobacterium tuberculosis H37Rv
cagccgcggcggcagcaccc

SEQ ID NO: 3244214 - RNA, 16 nt, Mycobacterium tuberculosis H37Rv
cagccgcggggcccac

SEQ ID NO: 3244215 - RNA, 14 nt, Mycobacterium tuberculosis H37Rv
cagccgcggggcga

SEQ ID NO: 3244216 - RNA, 16 nt, Mycobacterium tuberculosis H37Rv
cagccgcgucgucggc

SEQ ID NO: 3244217 - RNA, 15 nt, Mycobacterium tuberculosis H37Rv
cagccgcucacccgg

SEQ ID NO: 3244218 - RNA, 13 nt, Mycobacterium tuberculosis H37Rv
cagccgcuccacg

SEQ ID NO: 3244219 - RNA, 15 nt, Mycobacterium tuberculosis H37Rv
cagccgcucgacggc

SEQ ID NO: 3244220 - RNA, 12 nt, Mycobacterium tuberculosis H37Rv
cagccgcugauc

SEQ ID NO: 3244221 - RNA, 14 nt, Mycobacterium tuberculosis H37Rv
cagccggaccacca

SEQ ID NO: 3244222 - RNA, 17 nt, Mycobacterium tuberculosis H37Rv
cagccggaccaccaggu

SEQ ID NO: 3244223 - RNA, 20 nt, Mycobacterium tuberculosis H37Rv
cagccggaccgcgacggcgc

SEQ ID NO: 3244224 - RNA, 14 nt, Mycobacterium tuberculosis H37Rv
cagccggaccgugu

SEQ ID NO: 3244225 - RNA, 17 nt, Mycobacterium tuberculosis H37Rv
cagcgacgcugccgcca

SEQ ID NO: 3244226 - RNA, 20 nt, Mycobacterium tuberculosis H37Rv
cagcgacgggaaagccaccu

SEQ ID NO: 3244227 - RNA, 17 nt, Mycobacterium tuberculosis H37Rv
cagcgacuccagcgccc

SEQ ID NO: 3244228 - RNA, 18 nt, Mycobacterium tuberculosis H37Rv
cagcgacuccguaccggg

SEQ ID NO: 3244229 - RNA, 18 nt, Mycobacterium tuberculosis H37Rv
cagcgacuugcggugcuc

SEQ ID NO: 3244230 - RNA, 14 nt, Mycobacterium tuberculosis H37Rv
cagcgacuugcugg

SEQ ID NO: 3244231 - RNA, 20 nt, Mycobacterium tuberculosis H37Rv
cagcgacuuggcaucgcgag

SEQ ID NO: 3244232 - RNA, 16 nt, Mycobacterium tuberculosis H37Rv
cagcgagaccucucug

SEQ ID NO: 3244233 - RNA, 19 nt, Mycobacterium tuberculosis H37Rv
cagcgagacuucgacgcgg

SEQ ID NO: 3244234 - RNA, 22 nt, Mycobacterium tuberculosis H37Rv
cagcgagacuucgacgcggcga

SEQ ID NO: 3244235 - RNA, 17 nt, Mycobacterium tuberculosis H37Rv
cagcgagcauaccgccg

SEQ ID NO: 3244236 - RNA, 23 nt, Mycobacterium tuberculosis H37Rv
cagcgagcccagcugcgccgaac

SEQ ID NO: 3244237 - RNA, 15 nt, Mycobacterium tuberculosis H37Rv
cagcgaggagcaggg

SEQ ID NO: 3244238 - RNA, 16 nt, Mycobacterium tuberculosis H37Rv
cagcgaggccagcggu

SEQ ID NO: 3244239 - RNA, 14 nt, Mycobacterium tuberculosis H37Rv
cagcgaggccaugu

SEQ ID NO: 3244240 - RNA, 21 nt, Mycobacterium tuberculosis H37Rv
cagcgaggugggcgucaucga

SEQ ID NO: 3244241 - RNA, 17 nt, Mycobacterium tuberculosis H37Rv
cagcgaguugagcaugu

SEQ ID NO: 3244242 - RNA, 19 nt, Mycobacterium tuberculosis H37Rv
cagcgauauccacaauccg

SEQ ID NO: 3244243 - RNA, 23 nt, Mycobacterium tuberculosis H37Rv
cagcgauauccacaauccgcucg

SEQ ID NO: 3244244 - RNA, 14 nt, Mycobacterium tuberculosis H37Rv
cagcgauccggggc

SEQ ID NO: 3244245 - RNA, 21 nt, Mycobacterium tuberculosis H37Rv
cagcgaucggggcggugacuc

SEQ ID NO: 3244246 - RNA, 15 nt, Mycobacterium tuberculosis H37Rv
cagcgaugacgacca

SEQ ID NO: 3244247 - RNA, 18 nt, Mycobacterium tuberculosis H37Rv
cagcgaugcgcucacugc

SEQ ID NO: 3244248 - RNA, 18 nt, Mycobacterium tuberculosis H37Rv
cagcgaugcggcccucga

SEQ ID NO: 3244249 - RNA, 14 nt, Mycobacterium tuberculosis H37Rv
cagcgaugcggcgu

SEQ ID NO: 3244250 - RNA, 19 nt, Mycobacterium tuberculosis H37Rv
cagcgauggguguugcugg

SEQ ID NO: 3244251 - RNA, 21 nt, Mycobacterium tuberculosis H37Rv
cagcgauggguguugcuggcc

SEQ ID NO: 3244252 - RNA, 22 nt, Mycobacterium tuberculosis H37Rv
cagcgauucacgggugcgccac

SEQ ID NO: 3244253 - RNA, 21 nt, Mycobacterium tuberculosis H37Rv
cagcgauuuugaugcgauucu

SEQ ID NO: 3244254 - RNA, 14 nt, Mycobacterium tuberculosis H37Rv
cagcgcaacaucga

SEQ ID NO: 3244255 - RNA, 18 nt, Mycobacterium tuberculosis H37Rv
cagcgcaacaucgaaaac

SEQ ID NO: 3244256 - RNA, 21 nt, Mycobacterium tuberculosis H37Rv
cagcgcaaccgaccgggccgc

SEQ ID NO: 3244257 - RNA, 16 nt, Mycobacterium tuberculosis H37Rv
cagcgcaaccuccgcg

SEQ ID NO: 3244258 - RNA, 17 nt, Mycobacterium tuberculosis H37Rv
cagcgcaaccuccgcga

SEQ ID NO: 3244259 - RNA, 19 nt, Mycobacterium tuberculosis H37Rv
cagcgcaaccuccgcgagc

SEQ ID NO: 3244260 - RNA, 20 nt, Mycobacterium tuberculosis H37Rv
cagcgcaaccuccgcgagca

SEQ ID NO: 3244261 - RNA, 21 nt, Mycobacterium tuberculosis H37Rv
cagcgcaaccuccgcgagcag

SEQ ID NO: 3244262 - RNA, 22 nt, Mycobacterium tuberculosis H37Rv
cagcgcaacggccagcgcugcu

SEQ ID NO: 3244263 - RNA, 20 nt, Mycobacterium tuberculosis H37Rv
cagcgcaacgugauagccgg

SEQ ID NO: 3244264 - RNA, 23 nt, Mycobacterium tuberculosis H37Rv
cagcgcaagguugccaacgccuu

SEQ ID NO: 3244265 - RNA, 12 nt, Mycobacterium tuberculosis H37Rv
cagcgcacccgg

SEQ ID NO: 3244266 - RNA, 16 nt, Mycobacterium tuberculosis H37Rv
cagcgcaccggcguuc

SEQ ID NO: 3244267 - RNA, 21 nt, Mycobacterium tuberculosis H37Rv
cagcgcaccggugauggugac

SEQ ID NO: 3244268 - RNA, 15 nt, Mycobacterium tuberculosis H37Rv
cagcgcacgauuucg

SEQ ID NO: 3244269 - RNA, 16 nt, Mycobacterium tuberculosis H37Rv
cagcgcacgcagccga

SEQ ID NO: 3244270 - RNA, 14 nt, Mycobacterium tuberculosis H37Rv
cagcgcacggacca

SEQ ID NO: 3244271 - RNA, 20 nt, Mycobacterium tuberculosis H37Rv
cagcgcacggaccaucgcca

SEQ ID NO: 3244272 - RNA, 15 nt, Mycobacterium tuberculosis H37Rv
cagcgcacuacucga

SEQ ID NO: 3244273 - RNA, 17 nt, Mycobacterium tuberculosis H37Rv
cagcgcacuacucgaac

SEQ ID NO: 3244274 - RNA, 19 nt, Mycobacterium tuberculosis H37Rv
cagcgcacuacucgaacaa

SEQ ID NO: 3244275 - RNA, 15 nt, Mycobacterium tuberculosis H37Rv
cagcgcacuggccgc

SEQ ID NO: 3244276 - RNA, 15 nt, Mycobacterium tuberculosis H37Rv
cagcgcagccgaucg

SEQ ID NO: 3244277 - RNA, 20 nt, Mycobacterium tuberculosis H37Rv
cagcgcaggauucugcugac

SEQ ID NO: 3244278 - RNA, 13 nt, Mycobacterium tuberculosis H37Rv
cagcgcagugccu

SEQ ID NO: 3244279 - RNA, 14 nt, Mycobacterium tuberculosis H37Rv
cagcgcaucgccgc

SEQ ID NO: 3244280 - RNA, 18 nt, Mycobacterium tuberculosis H37Rv
cagcgcaucggucaccaa

SEQ ID NO: 3244281 - RNA, 18 nt, Mycobacterium tuberculosis H37Rv
cagcgcaucguugccgca

SEQ ID NO: 3244282 - RNA, 21 nt, Mycobacterium tuberculosis H37Rv
cagcgcaucuuugaacgccau

SEQ ID NO: 3244283 - RNA, 20 nt, Mycobacterium tuberculosis H37Rv
cagcgcauuucggaucucga

SEQ ID NO: 3244284 - RNA, 18 nt, Mycobacterium tuberculosis H37Rv
cagcgccaacgcccccau

SEQ ID NO: 3244285 - RNA, 19 nt, Mycobacterium tuberculosis H37Rv
cagcgccaacgcccccauc

SEQ ID NO: 3244286 - RNA, 20 nt, Mycobacterium tuberculosis H37Rv
cagcgccaacucgagagugg

SEQ ID NO: 3244287 - RNA, 16 nt, Mycobacterium tuberculosis H37Rv
cagcgccaagacgucg

SEQ ID NO: 3244288 - RNA, 17 nt, Mycobacterium tuberculosis H37Rv
cagcgccaagacgucgg

SEQ ID NO: 3244289 - RNA, 18 nt, Mycobacterium tuberculosis H37Rv
cagcgccaagacgucggc

SEQ ID NO: 3244290 - RNA, 13 nt, Mycobacterium tuberculosis H37Rv
cagcgccacccga

SEQ ID NO: 3244291 - RNA, 18 nt, Mycobacterium tuberculosis H37Rv
cagcgccacccgaucggg

SEQ ID NO: 3244292 - RNA, 14 nt, Mycobacterium tuberculosis H37Rv
cagcgccacccggu

SEQ ID NO: 3244293 - RNA, 21 nt, Mycobacterium tuberculosis H37Rv
cagcgccaccgaccgagucga

SEQ ID NO: 3244294 - RNA, 20 nt, Mycobacterium tuberculosis H37Rv
cagcgccaccguuaccgccg

SEQ ID NO: 3244295 - RNA, 23 nt, Mycobacterium tuberculosis H37Rv
cagcgccacuggaagccaagcua

SEQ ID NO: 3244296 - RNA, 14 nt, Mycobacterium tuberculosis H37Rv
cagcgccagcagcu

SEQ ID NO: 3244297 - RNA, 16 nt, Mycobacterium tuberculosis H37Rv
cagcgccaggccguug

SEQ ID NO: 3244298 - RNA, 15 nt, Mycobacterium tuberculosis H37Rv
cagcgccaggggugu

SEQ ID NO: 3244299 - RNA, 22 nt, Mycobacterium tuberculosis H37Rv
cagcgccagugccucgcggggu

SEQ ID NO: 3244300 - RNA, 13 nt, Mycobacterium tuberculosis H37Rv
cagcgccaucauc

SEQ ID NO: 3244301 - RNA, 16 nt, Mycobacterium tuberculosis H37Rv
cagcgccaucgaugcg

SEQ ID NO: 3244302 - RNA, 17 nt, Mycobacterium tuberculosis H37Rv
cagcgcccagaucgccg

SEQ ID NO: 3244303 - RNA, 21 nt, Mycobacterium tuberculosis H37Rv
cagcgcccagaucgccgagau

SEQ ID NO: 3244304 - RNA, 16 nt, Mycobacterium tuberculosis H37Rv
cagcgccccaugcaac

SEQ ID NO: 3244305 - RNA, 21 nt, Mycobacterium tuberculosis H37Rv
cagcgccccaugcaacacacc

SEQ ID NO: 3244306 - RNA, 12 nt, Mycobacterium tuberculosis H37Rv
cagcgcccccag

SEQ ID NO: 3244307 - RNA, 14 nt, Mycobacterium tuberculosis H37Rv
cagcgcccccggac

SEQ ID NO: 3244308 - RNA, 14 nt, Mycobacterium tuberculosis H37Rv
cagcgcccggccac

SEQ ID NO: 3244309 - RNA, 13 nt, Mycobacterium tuberculosis H37Rv
cagcgcccggccc

SEQ ID NO: 3244310 - RNA, 15 nt, Mycobacterium tuberculosis H37Rv
cagcgcccggcccgc

SEQ ID NO: 3244311 - RNA, 17 nt, Mycobacterium tuberculosis H37Rv
cagcgcccggcccgcca

SEQ ID NO: 3244312 - RNA, 20 nt, Mycobacterium tuberculosis H37Rv
cagcgcccggcccgccaccc

SEQ ID NO: 3244313 - RNA, 18 nt, Mycobacterium tuberculosis H37Rv
cagcgcccggucacgcug

SEQ ID NO: 3244314 - RNA, 14 nt, Mycobacterium tuberculosis H37Rv
cagcgccgacagcc

SEQ ID NO: 3244315 - RNA, 17 nt, Mycobacterium tuberculosis H37Rv
cagcgccgacagccgau

SEQ ID NO: 3244316 - RNA, 22 nt, Mycobacterium tuberculosis H37Rv
cagcgccgacccaacccgaucu

SEQ ID NO: 3244317 - RNA, 18 nt, Mycobacterium tuberculosis H37Rv
cagcgccgacuccaguuc

SEQ ID NO: 3244318 - RNA, 21 nt, Mycobacterium tuberculosis H37Rv
cagcgccgagagcaccgcucg

SEQ ID NO: 3244319 - RNA, 16 nt, Mycobacterium tuberculosis H37Rv
cagcgccgauaccagc

SEQ ID NO: 3244320 - RNA, 14 nt, Mycobacterium tuberculosis H37Rv
cagcgccgcacccg

SEQ ID NO: 3244321 - RNA, 18 nt, Mycobacterium tuberculosis H37Rv
cagcggagccacucggcc

SEQ ID NO: 3244322 - RNA, 15 nt, Mycobacterium tuberculosis H37Rv
cagcggaucgcauuu

SEQ ID NO: 3244323 - RNA, 23 nt, Mycobacterium tuberculosis H37Rv
cagcggaucgucguugucagcga

SEQ ID NO: 3244324 - RNA, 17 nt, Mycobacterium tuberculosis H37Rv
cagcggcaacgccuccg

SEQ ID NO: 3244325 - RNA, 23 nt, Mycobacterium tuberculosis H37Rv
cagcggcaaggucaacgggaggu

SEQ ID NO: 3244326 - RNA, 21 nt, Mycobacterium tuberculosis H37Rv
cagcggcaaggucggacuggc

SEQ ID NO: 3244327 - RNA, 18 nt, Mycobacterium tuberculosis H37Rv
cagcggcaauggccagca

SEQ ID NO: 3244328 - RNA, 21 nt, Mycobacterium tuberculosis H37Rv
cagcggcaauggccagcacca

SEQ ID NO: 3244329 - RNA, 23 nt, Mycobacterium tuberculosis H37Rv
cagcggcaauggccagcaccacg

SEQ ID NO: 3244330 - RNA, 17 nt, Mycobacterium tuberculosis H37Rv
cagcggcacacccauca

SEQ ID NO: 3244331 - RNA, 16 nt, Mycobacterium tuberculosis H37Rv
cagcggcaccgcggcc

SEQ ID NO: 3244332 - RNA, 17 nt, Mycobacterium tuberculosis H37Rv
cagcggcacgaucggca

SEQ ID NO: 3244333 - RNA, 13 nt, Mycobacterium tuberculosis H37Rv
cagcggcagcacc

SEQ ID NO: 3244334 - RNA, 18 nt, Mycobacterium tuberculosis H37Rv
cagcggcagcaccgcacg

SEQ ID NO: 3244335 - RNA, 16 nt, Mycobacterium tuberculosis H37Rv
cagcggcagcgagugg

SEQ ID NO: 3244336 - RNA, 22 nt, Mycobacterium tuberculosis H37Rv
cagcggcaggaagaaaccgcag

SEQ ID NO: 3244337 - RNA, 17 nt, Mycobacterium tuberculosis H37Rv
cagcggcauccagcuuc

SEQ ID NO: 3244338 - RNA, 19 nt, Mycobacterium tuberculosis H37Rv
cagcggcaucgcgggcggc

SEQ ID NO: 3244339 - RNA, 20 nt, Mycobacterium tuberculosis H37Rv
cagcggcaucgcgggcggcg

SEQ ID NO: 3244340 - RNA, 22 nt, Mycobacterium tuberculosis H37Rv
cagcggcaucgcgggcggcgcu

SEQ ID NO: 3244341 - RNA, 15 nt, Mycobacterium tuberculosis H37Rv
cagcggcaucggcca

SEQ ID NO: 3244342 - RNA, 13 nt, Mycobacterium tuberculosis H37Rv
cagcggccaaccc

SEQ ID NO: 3244343 - RNA, 16 nt, Mycobacterium tuberculosis H37Rv
cagcggccagcagugc

SEQ ID NO: 3244344 - RNA, 19 nt, Mycobacterium tuberculosis H37Rv
cagcggccagcagugcggu

SEQ ID NO: 3244345 - RNA, 14 nt, Mycobacterium tuberculosis H37Rv
cagcggccagccca

SEQ ID NO: 3244346 - RNA, 15 nt, Mycobacterium tuberculosis H37Rv
cagcggccagcccag

SEQ ID NO: 3244347 - RNA, 18 nt, Mycobacterium tuberculosis H37Rv
cagcggccagggcaccca

SEQ ID NO: 3244348 - RNA, 23 nt, Mycobacterium tuberculosis H37Rv
cagcggccauaucgcccaccacg

SEQ ID NO: 3244349 - RNA, 17 nt, Mycobacterium tuberculosis H37Rv
cagcggcccgcugcgcg

SEQ ID NO: 3244350 - RNA, 20 nt, Mycobacterium tuberculosis H37Rv
cagcggcccgcugcgcggcc

SEQ ID NO: 3244351 - RNA, 17 nt, Mycobacterium tuberculosis H37Rv
cagcggcccgucaccgc

SEQ ID NO: 3244352 - RNA, 13 nt, Mycobacterium tuberculosis H37Rv
cagcggccgaccg

SEQ ID NO: 3244353 - RNA, 16 nt, Mycobacterium tuberculosis H37Rv
cagcggccgaccgcga

SEQ ID NO: 3244354 - RNA, 13 nt, Mycobacterium tuberculosis H37Rv
cagcggccgcucc

SEQ ID NO: 3244355 - RNA, 13 nt, Mycobacterium tuberculosis H37Rv
cagcggccgguac

SEQ ID NO: 3244356 - RNA, 16 nt, Mycobacterium tuberculosis H37Rv
cagcggccugaccggc

SEQ ID NO: 3244357 - RNA, 17 nt, Mycobacterium tuberculosis H37Rv
cagcggcgacacaucgc

SEQ ID NO: 3244358 - RNA, 19 nt, Mycobacterium tuberculosis H37Rv
cagcggcgacacaucgccc

SEQ ID NO: 3244359 - RNA, 18 nt, Mycobacterium tuberculosis H37Rv
cagcggcgaguuggccgu

SEQ ID NO: 3244360 - RNA, 15 nt, Mycobacterium tuberculosis H37Rv
cagcggcgaucaggc

SEQ ID NO: 3244361 - RNA, 17 nt, Mycobacterium tuberculosis H37Rv
cagcggcgaucaggcgg

SEQ ID NO: 3244362 - RNA, 15 nt, Mycobacterium tuberculosis H37Rv
cagcggcgccgccaa

SEQ ID NO: 3244363 - RNA, 18 nt, Mycobacterium tuberculosis H37Rv
cagcggcgccgccaaggg

SEQ ID NO: 3244364 - RNA, 18 nt, Mycobacterium tuberculosis H37Rv
cagcggcgcgaccgucug

SEQ ID NO: 3244365 - RNA, 20 nt, Mycobacterium tuberculosis H37Rv
cagcggcgcgaccgucugga

SEQ ID NO: 3244366 - RNA, 15 nt, Mycobacterium tuberculosis H37Rv
cagcggcgcgcugca

SEQ ID NO: 3244367 - RNA, 19 nt, Mycobacterium tuberculosis H37Rv
cagcggcgcucggcgccac

SEQ ID NO: 3244368 - RNA, 20 nt, Mycobacterium tuberculosis H37Rv
cagcggcgcucggcgccacg

SEQ ID NO: 3244369 - RNA, 17 nt, Mycobacterium tuberculosis H37Rv
cagcggcgggcgaugac

SEQ ID NO: 3244370 - RNA, 20 nt, Mycobacterium tuberculosis H37Rv
cagcggcggguagauccgcc

SEQ ID NO: 3244371 - RNA, 12 nt, Mycobacterium tuberculosis H37Rv
cagcggcgucgg

SEQ ID NO: 3244372 - RNA, 21 nt, Mycobacterium tuberculosis H37Rv
cagcggcgugacgucgucggu

SEQ ID NO: 3244373 - RNA, 14 nt, Mycobacterium tuberculosis H37Rv
cagcggcucggcgg

SEQ ID NO: 3244374 - RNA, 16 nt, Mycobacterium tuberculosis H37Rv
cagcggcugaccgggc

SEQ ID NO: 3244375 - RNA, 13 nt, Mycobacterium tuberculosis H37Rv
cagcggcugccca

SEQ ID NO: 3244376 - RNA, 12 nt, Mycobacterium tuberculosis H37Rv
cagcggcugggc

SEQ ID NO: 3244377 - RNA, 22 nt, Mycobacterium tuberculosis H37Rv
cagcggcugguugcgccacugc

SEQ ID NO: 3244378 - RNA, 21 nt, Mycobacterium tuberculosis H37Rv
cagcgggacauccagugcggu

SEQ ID NO: 3244379 - RNA, 14 nt, Mycobacterium tuberculosis H37Rv
cagcgggacugcgg

SEQ ID NO: 3244380 - RNA, 17 nt, Mycobacterium tuberculosis H37Rv
cagcgggaucugaccca

SEQ ID NO: 3244381 - RNA, 17 nt, Mycobacterium tuberculosis H37Rv
cagcgggcagcaggcga

SEQ ID NO: 3244382 - RNA, 19 nt, Mycobacterium tuberculosis H37Rv
cagcgggcauaacccgcac

SEQ ID NO: 3244383 - RNA, 15 nt, Mycobacterium tuberculosis H37Rv
cagcgggcaucgcga

SEQ ID NO: 3244384 - RNA, 17 nt, Mycobacterium tuberculosis H37Rv
cagcgggcaucgcgaau

SEQ ID NO: 3244385 - RNA, 17 nt, Mycobacterium tuberculosis H37Rv
cagcgggccgaagcccc

SEQ ID NO: 3244386 - RNA, 12 nt, Mycobacterium tuberculosis H37Rv
cagcgggcgaug

SEQ ID NO: 3244387 - RNA, 14 nt, Mycobacterium tuberculosis H37Rv
cagcgggcgcgcua

SEQ ID NO: 3244388 - RNA, 15 nt, Mycobacterium tuberculosis H37Rv
cagcgggcuccccgg

SEQ ID NO: 3244389 - RNA, 16 nt, Mycobacterium tuberculosis H37Rv
cagcgggcuccccgga

SEQ ID NO: 3244390 - RNA, 13 nt, Mycobacterium tuberculosis H37Rv
cagcgggcuggcg

SEQ ID NO: 3244391 - RNA, 17 nt, Mycobacterium tuberculosis H37Rv
cagcgggcuggcgaagg

SEQ ID NO: 3244392 - RNA, 21 nt, Mycobacterium tuberculosis H37Rv
cagcgggggcagcgcgaacac

SEQ ID NO: 3244393 - RNA, 18 nt, Mycobacterium tuberculosis H37Rv
cagcgggucgccgggccc

SEQ ID NO: 3244394 - RNA, 13 nt, Mycobacterium tuberculosis H37Rv
cagcgggucgcgg

SEQ ID NO: 3244395 - RNA, 21 nt, Mycobacterium tuberculosis H37Rv
cagcgggugaaucgacaccgc

SEQ ID NO: 3244396 - RNA, 18 nt, Mycobacterium tuberculosis H37Rv
cagcggguggugccaggu

SEQ ID NO: 3244397 - RNA, 17 nt, Mycobacterium tuberculosis H37Rv
cagcggguuugccgggc

SEQ ID NO: 3244398 - RNA, 18 nt, Mycobacterium tuberculosis H37Rv
cagcgguaagcgcaucga

SEQ ID NO: 3244399 - RNA, 16 nt, Mycobacterium tuberculosis H37Rv
cagcgguagccgagcu

SEQ ID NO: 3244400 - RNA, 16 nt, Mycobacterium tuberculosis H37Rv
cagcgguaucccccag

SEQ ID NO: 3244401 - RNA, 13 nt, Mycobacterium tuberculosis H37Rv
cagcggucagccg

SEQ ID NO: 3244402 - RNA, 17 nt, Mycobacterium tuberculosis H37Rv
cagcggucagccggcca

SEQ ID NO: 3244403 - RNA, 18 nt, Mycobacterium tuberculosis H37Rv
cagcgguccagccaccgc

SEQ ID NO: 3244404 - RNA, 20 nt, Mycobacterium tuberculosis H37Rv
cagcgguccagccaccgccg

SEQ ID NO: 3244405 - RNA, 15 nt, Mycobacterium tuberculosis H37Rv
cagcggugcagcccg

SEQ ID NO: 3244406 - RNA, 20 nt, Mycobacterium tuberculosis H37Rv
cagcggugcugguggcggca

SEQ ID NO: 3244407 - RNA, 15 nt, Mycobacterium tuberculosis H37Rv
cagcgguggaccacc

SEQ ID NO: 3244408 - RNA, 17 nt, Mycobacterium tuberculosis H37Rv
cagcgguggcaagccua

SEQ ID NO: 3244409 - RNA, 19 nt, Mycobacterium tuberculosis H37Rv
cagcgguggcccgccggca

SEQ ID NO: 3244410 - RNA, 22 nt, Mycobacterium tuberculosis H37Rv
cagcgguggcccgccggcaaca

SEQ ID NO: 3244411 - RNA, 17 nt, Mycobacterium tuberculosis H37Rv
cagcgguggcuugcccc

SEQ ID NO: 3244412 - RNA, 16 nt, Mycobacterium tuberculosis H37Rv
cagcgguggucggcgc

SEQ ID NO: 3244413 - RNA, 17 nt, Mycobacterium tuberculosis H37Rv
cagcgguggucggcgcg

SEQ ID NO: 3244414 - RNA, 16 nt, Mycobacterium tuberculosis H37Rv
cagcguaagaccugag

SEQ ID NO: 3244415 - RNA, 19 nt, Mycobacterium tuberculosis H37Rv
cagcguaucucccaacggc

SEQ ID NO: 3244416 - RNA, 21 nt, Mycobacterium tuberculosis H37Rv
cagcguaucucccaacggcag

SEQ ID NO: 3244417 - RNA, 13 nt, Mycobacterium tuberculosis H37Rv
cagcucgccaggg

SEQ ID NO: 3244418 - RNA, 17 nt, Mycobacterium tuberculosis H37Rv
cagcucgccggcacgca

SEQ ID NO: 3244419 - RNA, 14 nt, Mycobacterium tuberculosis H37Rv
cagcucgccgugac

SEQ ID NO: 3244420 - RNA, 16 nt, Mycobacterium tuberculosis H37Rv
cagcucgcgcacccag

SEQ ID NO: 3244421 - RNA, 18 nt, Mycobacterium tuberculosis H37Rv
cagcucgcgcacccagcc

SEQ ID NO: 3244422 - RNA, 19 nt, Mycobacterium tuberculosis H37Rv
cagcucgcgcacccagccc

SEQ ID NO: 3244423 - RNA, 23 nt, Mycobacterium tuberculosis H37Rv
cagcucgcgcacccagcccagcc

SEQ ID NO: 3244424 - RNA, 23 nt, Mycobacterium tuberculosis H37Rv
cagcucggcagcaucuccgucgg

SEQ ID NO: 3244425 - RNA, 16 nt, Mycobacterium tuberculosis H37Rv
cagcucggccagugcc

SEQ ID NO: 3244426 - RNA, 21 nt, Mycobacterium tuberculosis H37Rv
cagcucggccagugccgguuc

SEQ ID NO: 3244427 - RNA, 16 nt, Mycobacterium tuberculosis H37Rv
cagcucggccgaggcg

SEQ ID NO: 3244428 - RNA, 17 nt, Mycobacterium tuberculosis H37Rv
cagcucggcgggcucgu

SEQ ID NO: 3244429 - RNA, 19 nt, Mycobacterium tuberculosis H37Rv
cagcucgggcgcgcggcga

SEQ ID NO: 3244430 - RNA, 14 nt, Mycobacterium tuberculosis H37Rv
cagcucgggcucgu

SEQ ID NO: 3244431 - RNA, 16 nt, Mycobacterium tuberculosis H37Rv
cagcucggggcgauga

SEQ ID NO: 3244432 - RNA, 20 nt, Mycobacterium tuberculosis H37Rv
cagcucggguugcgcgaugg

SEQ ID NO: 3244433 - RNA, 14 nt, Mycobacterium tuberculosis H37Rv
cagcucguccagcg

SEQ ID NO: 3244434 - RNA, 17 nt, Mycobacterium tuberculosis H37Rv
cagcucgucgacgucgu

SEQ ID NO: 3244435 - RNA, 19 nt, Mycobacterium tuberculosis H37Rv
cagcucgucgacgucguag

SEQ ID NO: 3244436 - RNA, 16 nt, Mycobacterium tuberculosis H37Rv
cagcucgucgcugaac

SEQ ID NO: 3244437 - RNA, 17 nt, Mycobacterium tuberculosis H37Rv
cagcucgucgcugaaca

SEQ ID NO: 3244438 - RNA, 20 nt, Mycobacterium tuberculosis H37Rv
cagcucguuggcgaaauccg

SEQ ID NO: 3244439 - RNA, 15 nt, Mycobacterium tuberculosis H37Rv
cagcugaaucgggau

SEQ ID NO: 3244440 - RNA, 20 nt, Mycobacterium tuberculosis H37Rv
cagcugaaucguucucgguc

SEQ ID NO: 3244441 - RNA, 16 nt, Mycobacterium tuberculosis H37Rv
cagcugaccagcgucc

SEQ ID NO: 3244442 - RNA, 14 nt, Mycobacterium tuberculosis H37Rv
cagcugacggcgca

SEQ ID NO: 3244443 - RNA, 16 nt, Mycobacterium tuberculosis H37Rv
cagcugacgggccgcu

SEQ ID NO: 3244444 - RNA, 18 nt, Mycobacterium tuberculosis H37Rv
cagcugacgggccgcugu

SEQ ID NO: 3244445 - RNA, 13 nt, Mycobacterium tuberculosis H37Rv
cagcugagaugag

SEQ ID NO: 3244446 - RNA, 15 nt, Mycobacterium tuberculosis H37Rv
cagcugaucccagau

SEQ ID NO: 3244447 - RNA, 22 nt, Mycobacterium tuberculosis H37Rv
cagcugaucccagaucggcguu

SEQ ID NO: 3244448 - RNA, 19 nt, Mycobacterium tuberculosis H37Rv
cagcugaucuuggcaagcc

SEQ ID NO: 3244449 - RNA, 20 nt, Mycobacterium tuberculosis H37Rv
cagcugauuaccgacaccgu

SEQ ID NO: 3244450 - RNA, 16 nt, Mycobacterium tuberculosis H37Rv
cagcugcaaugacugg

SEQ ID NO: 3244451 - RNA, 17 nt, Mycobacterium tuberculosis H37Rv
cagcugcacacagaggu

SEQ ID NO: 3244452 - RNA, 13 nt, Mycobacterium tuberculosis H37Rv
cagcugcaccucc

SEQ ID NO: 3244453 - RNA, 15 nt, Mycobacterium tuberculosis H37Rv
cagcugcaccuccga

SEQ ID NO: 3244454 - RNA, 21 nt, Mycobacterium tuberculosis H37Rv
cagcugcaccuccgacggccg

SEQ ID NO: 3244455 - RNA, 14 nt, Mycobacterium tuberculosis H37Rv
cagcugcccggcgu

SEQ ID NO: 3244456 - RNA, 19 nt, Mycobacterium tuberculosis H37Rv
cagcugccgcacccccucc

SEQ ID NO: 3244457 - RNA, 23 nt, Mycobacterium tuberculosis H37Rv
cagcugccgcacccccuccgcga

SEQ ID NO: 3244458 - RNA, 17 nt, Mycobacterium tuberculosis H37Rv
cagcugccugaccggcg

SEQ ID NO: 3244459 - RNA, 15 nt, Mycobacterium tuberculosis H37Rv
cagcugcgcgggcga

SEQ ID NO: 3244460 - RNA, 16 nt, Mycobacterium tuberculosis H37Rv
cagcugcggacuggca

SEQ ID NO: 3244461 - RNA, 22 nt, Mycobacterium tuberculosis H37Rv
cagcugcggacuggcauccgcc

SEQ ID NO: 3244462 - RNA, 17 nt, Mycobacterium tuberculosis H37Rv
cagcugcggauacagcc

SEQ ID NO: 3244463 - RNA, 21 nt, Mycobacterium tuberculosis H37Rv
cagcugcggauacagccgccg

SEQ ID NO: 3244464 - RNA, 22 nt, Mycobacterium tuberculosis H37Rv
cagcugcggauacagccgccgc

SEQ ID NO: 3244465 - RNA, 16 nt, Mycobacterium tuberculosis H37Rv
cagcugcggauccacc

SEQ ID NO: 3244466 - RNA, 19 nt, Mycobacterium tuberculosis H37Rv
cagcugcggauccaccacg

SEQ ID NO: 3244467 - RNA, 20 nt, Mycobacterium tuberculosis H37Rv
cagcugcggauccaccacgc

SEQ ID NO: 3244468 - RNA, 23 nt, Mycobacterium tuberculosis H37Rv
cagcugcggauuaagucggcggc

SEQ ID NO: 3244469 - RNA, 20 nt, Mycobacterium tuberculosis H37Rv
cagcugcgggucgugccccg

SEQ ID NO: 3244470 - RNA, 22 nt, Mycobacterium tuberculosis H37Rv
cagcugcgggucgugccccggc

SEQ ID NO: 3244471 - RNA, 15 nt, Mycobacterium tuberculosis H37Rv
cagcugcggucgcgg

SEQ ID NO: 3244472 - RNA, 13 nt, Mycobacterium tuberculosis H37Rv
cagcugcucgguc

SEQ ID NO: 3244473 - RNA, 19 nt, Mycobacterium tuberculosis H37Rv
cagcugcucggucaggcgg

SEQ ID NO: 3244474 - RNA, 11 nt, Mycobacterium tuberculosis H37Rv
cagcugcucgu

SEQ ID NO: 3244475 - RNA, 11 nt, Mycobacterium tuberculosis H37Rv
cagcugcugcc

SEQ ID NO: 3244476 - RNA, 19 nt, Mycobacterium tuberculosis H37Rv
cagcugcugccgauacagc

SEQ ID NO: 3244477 - RNA, 16 nt, Mycobacterium tuberculosis H37Rv
cagcuggacggccucc

SEQ ID NO: 3244478 - RNA, 19 nt, Mycobacterium tuberculosis H37Rv
cagcuggacuccggucagc

SEQ ID NO: 3244479 - RNA, 21 nt, Mycobacterium tuberculosis H37Rv
cagcuggccgcggcgaguacu

SEQ ID NO: 3244480 - RNA, 15 nt, Mycobacterium tuberculosis H37Rv
cagcuggcggcagcg

SEQ ID NO: 3244481 - RNA, 15 nt, Mycobacterium tuberculosis H37Rv
cagcuggcucaccga

SEQ ID NO: 3244482 - RNA, 14 nt, Mycobacterium tuberculosis H37Rv
cagcugggcagcca

SEQ ID NO: 3244483 - RNA, 17 nt, Mycobacterium tuberculosis H37Rv
cagcugggcagccagau

SEQ ID NO: 3244484 - RNA, 13 nt, Mycobacterium tuberculosis H37Rv
cagcugggccgcu

SEQ ID NO: 3244485 - RNA, 20 nt, Mycobacterium tuberculosis H37Rv
cagcuggggcccggccgcca

SEQ ID NO: 3244486 - RNA, 20 nt, Mycobacterium tuberculosis H37Rv
cagcugggucccgcuggcau

SEQ ID NO: 3244487 - RNA, 20 nt, Mycobacterium tuberculosis H37Rv
cagcugggugaccucgucga

SEQ ID NO: 3244488 - RNA, 22 nt, Mycobacterium tuberculosis H37Rv
cagcugguaaccggcggcagcg

SEQ ID NO: 3244489 - RNA, 19 nt, Mycobacterium tuberculosis H37Rv
cagcugguagcgcaccaca

SEQ ID NO: 3244490 - RNA, 19 nt, Mycobacterium tuberculosis H37Rv
cagcuggucgugggccacc

SEQ ID NO: 3244491 - RNA, 22 nt, Mycobacterium tuberculosis H37Rv
cagcuggucgugggccaccacc

SEQ ID NO: 3244492 - RNA, 23 nt, Mycobacterium tuberculosis H37Rv
cagcuggucgugggccaccaccu

SEQ ID NO: 3244493 - RNA, 16 nt, Mycobacterium tuberculosis H37Rv
cagcugguugugcugg

SEQ ID NO: 3244494 - RNA, 16 nt, Mycobacterium tuberculosis H37Rv
cagcugguuugcggug

SEQ ID NO: 3244495 - RNA, 13 nt, Mycobacterium tuberculosis H37Rv
cagcugucgggca

SEQ ID NO: 3244496 - RNA, 15 nt, Mycobacterium tuberculosis H37Rv
cagcugucgggcagc

SEQ ID NO: 3244497 - RNA, 18 nt, Mycobacterium tuberculosis H37Rv
cagcugugaacaggccga

SEQ ID NO: 3244498 - RNA, 22 nt, Mycobacterium tuberculosis H37Rv
cagcuguucggccaacccgggc

SEQ ID NO: 3244499 - RNA, 13 nt, Mycobacterium tuberculosis H37Rv
cagcuguugcggg

SEQ ID NO: 3244500 - RNA, 22 nt, Mycobacterium tuberculosis H37Rv
cagcuuagccgcagcuuggccu

SEQ ID NO: 3244501 - RNA, 19 nt, Mycobacterium tuberculosis H37Rv
cagcuucggacuggggcac

SEQ ID NO: 3244502 - RNA, 13 nt, Mycobacterium tuberculosis H37Rv
cagcuucggccag

SEQ ID NO: 3244503 - RNA, 14 nt, Mycobacterium tuberculosis H37Rv
cagcuucucagcac

SEQ ID NO: 3244504 - RNA, 14 nt, Mycobacterium tuberculosis H37Rv
cagcuugagcacac

SEQ ID NO: 3244505 - RNA, 15 nt, Mycobacterium tuberculosis H37Rv
cagcuugagcacacg

SEQ ID NO: 3244506 - RNA, 20 nt, Mycobacterium tuberculosis H37Rv
cagcuugaugucuuuggcgu

SEQ ID NO: 3244507 - RNA, 17 nt, Mycobacterium tuberculosis H37Rv
cagcuugcagugccgcc

SEQ ID NO: 3244508 - RNA, 16 nt, Mycobacterium tuberculosis H37Rv
cagcuugcccgacggc

SEQ ID NO: 3244509 - RNA, 20 nt, Mycobacterium tuberculosis H37Rv
cagcuugcccgagcccagcc

SEQ ID NO: 3244510 - RNA, 16 nt, Mycobacterium tuberculosis H37Rv
cagcuugccgaccugc

SEQ ID NO: 3244511 - RNA, 17 nt, Mycobacterium tuberculosis H37Rv
cagcuugccgaccugcg

SEQ ID NO: 3244512 - RNA, 14 nt, Mycobacterium tuberculosis H37Rv
cagcuugcgcagcc

SEQ ID NO: 3244513 - RNA, 22 nt, Mycobacterium tuberculosis H37Rv
caggcaguccaccgcgcggcgc

SEQ ID NO: 3244514 - RNA, 22 nt, Mycobacterium tuberculosis H37Rv
caggcaucaccggaacccccag

SEQ ID NO: 3244515 - RNA, 20 nt, Mycobacterium tuberculosis H37Rv
caggcaucggaggaaccccg

SEQ ID NO: 3244516 - RNA, 21 nt, Mycobacterium tuberculosis H37Rv
caggcaucggaggaaccccgc

SEQ ID NO: 3244517 - RNA, 23 nt, Mycobacterium tuberculosis H37Rv
caggcaucggugagcccguugac

SEQ ID NO: 3244518 - RNA, 17 nt, Mycobacterium tuberculosis H37Rv
caggcauggcgccguug

SEQ ID NO: 3244519 - RNA, 19 nt, Mycobacterium tuberculosis H37Rv
caggcauggcgccguugcc

SEQ ID NO: 3244520 - RNA, 20 nt, Mycobacterium tuberculosis H37Rv
caggcauuuucacugugccg

SEQ ID NO: 3244521 - RNA, 22 nt, Mycobacterium tuberculosis H37Rv
caggcauuuucacugugccgcu

SEQ ID NO: 3244522 - RNA, 15 nt, Mycobacterium tuberculosis H37Rv
caggccaagguggcc

SEQ ID NO: 3244523 - RNA, 15 nt, Mycobacterium tuberculosis H37Rv
caggccaccccgacc

SEQ ID NO: 3244524 - RNA, 17 nt, Mycobacterium tuberculosis H37Rv
caggccaccccgaccuc

SEQ ID NO: 3244525 - RNA, 23 nt, Mycobacterium tuberculosis H37Rv
caggccaccgcagacgccgucug

SEQ ID NO: 3244526 - RNA, 12 nt, Mycobacterium tuberculosis H37Rv
caggccacgggc

SEQ ID NO: 3244527 - RNA, 16 nt, Mycobacterium tuberculosis H37Rv
caggccacugccgacc

SEQ ID NO: 3244528 - RNA, 17 nt, Mycobacterium tuberculosis H37Rv
caggccagagccgcccu

SEQ ID NO: 3244529 - RNA, 13 nt, Mycobacterium tuberculosis H37Rv
caggccagcgcuc

SEQ ID NO: 3244530 - RNA, 21 nt, Mycobacterium tuberculosis H37Rv
caggccagggcgguggccacc

SEQ ID NO: 3244531 - RNA, 17 nt, Mycobacterium tuberculosis H37Rv
caggccagugccaccug

SEQ ID NO: 3244532 - RNA, 19 nt, Mycobacterium tuberculosis H37Rv
caggccagugccaccuggg

SEQ ID NO: 3244533 - RNA, 21 nt, Mycobacterium tuberculosis H37Rv
caggccagugccaccugggcg

SEQ ID NO: 3244534 - RNA, 22 nt, Mycobacterium tuberculosis H37Rv
caggccagugccaccugggcgg

SEQ ID NO: 3244535 - RNA, 18 nt, Mycobacterium tuberculosis H37Rv
caggccauccgggcugcc

SEQ ID NO: 3244536 - RNA, 12 nt, Mycobacterium tuberculosis H37Rv
caggcccacccg

SEQ ID NO: 3244537 - RNA, 13 nt, Mycobacterium tuberculosis H37Rv
caggcccagccga

SEQ ID NO: 3244538 - RNA, 17 nt, Mycobacterium tuberculosis H37Rv
caggcccagccgagcgg

SEQ ID NO: 3244539 - RNA, 19 nt, Mycobacterium tuberculosis H37Rv
caggcccaggucaacgacg

SEQ ID NO: 3244540 - RNA, 20 nt, Mycobacterium tuberculosis H37Rv
caggccccacuggugcagcg

SEQ ID NO: 3244541 - RNA, 19 nt, Mycobacterium tuberculosis H37Rv
caggccccggugccgaccg

SEQ ID NO: 3244542 - RNA, 18 nt, Mycobacterium tuberculosis H37Rv
caggcccgccagcagggc

SEQ ID NO: 3244543 - RNA, 16 nt, Mycobacterium tuberculosis H37Rv
caggcccggcaccgcg

SEQ ID NO: 3244544 - RNA, 16 nt, Mycobacterium tuberculosis H37Rv
caggcccgggcggaug

SEQ ID NO: 3244545 - RNA, 20 nt, Mycobacterium tuberculosis H37Rv
caggcccgggcggaugcugu

SEQ ID NO: 3244546 - RNA, 23 nt, Mycobacterium tuberculosis H37Rv
caggcccgugccuggccggugcg

SEQ ID NO: 3244547 - RNA, 19 nt, Mycobacterium tuberculosis H37Rv
caggcccucgggacugcgc

SEQ ID NO: 3244548 - RNA, 23 nt, Mycobacterium tuberculosis H37Rv
caggcccugccgacgcuccaggg

SEQ ID NO: 3244549 - RNA, 15 nt, Mycobacterium tuberculosis H37Rv
caggcccuggccacc

SEQ ID NO: 3244550 - RNA, 18 nt, Mycobacterium tuberculosis H37Rv
caggcccuggccacccag

SEQ ID NO: 3244551 - RNA, 23 nt, Mycobacterium tuberculosis H37Rv
caggcccugguagugaacggauc

SEQ ID NO: 3244552 - RNA, 11 nt, Mycobacterium tuberculosis H37Rv
caggccgacac

SEQ ID NO: 3244553 - RNA, 15 nt, Mycobacterium tuberculosis H37Rv
caggccgaccgcgca

SEQ ID NO: 3244554 - RNA, 17 nt, Mycobacterium tuberculosis H37Rv
caggccgacgaugugcc

SEQ ID NO: 3244555 - RNA, 22 nt, Mycobacterium tuberculosis H37Rv
caggccgagccgcccgcccgga

SEQ ID NO: 3244556 - RNA, 15 nt, Mycobacterium tuberculosis H37Rv
caggccgagcucguu

SEQ ID NO: 3244557 - RNA, 19 nt, Mycobacterium tuberculosis H37Rv
caggccgaggaaggagcca

SEQ ID NO: 3244558 - RNA, 15 nt, Mycobacterium tuberculosis H37Rv
caggccgaggcgagu

SEQ ID NO: 3244559 - RNA, 16 nt, Mycobacterium tuberculosis H37Rv
caggccgaugcggguc

SEQ ID NO: 3244560 - RNA, 17 nt, Mycobacterium tuberculosis H37Rv
caggccgcacagcacca

SEQ ID NO: 3244561 - RNA, 13 nt, Mycobacterium tuberculosis H37Rv
caggccgccaccg

SEQ ID NO: 3244562 - RNA, 19 nt, Mycobacterium tuberculosis H37Rv
caggccgccaccgucaccg

SEQ ID NO: 3244563 - RNA, 22 nt, Mycobacterium tuberculosis H37Rv
caggccgccaccgucaccgccg

SEQ ID NO: 3244564 - RNA, 14 nt, Mycobacterium tuberculosis H37Rv
caggccgccugggg

SEQ ID NO: 3244565 - RNA, 15 nt, Mycobacterium tuberculosis H37Rv
caggccgcgcauggu

SEQ ID NO: 3244566 - RNA, 17 nt, Mycobacterium tuberculosis H37Rv
caggccgcgcaugguca

SEQ ID NO: 3244567 - RNA, 23 nt, Mycobacterium tuberculosis H37Rv
caggccgcgcgacaacccggcgu

SEQ ID NO: 3244568 - RNA, 23 nt, Mycobacterium tuberculosis H37Rv
caggccgcgcggacccagcaccc

SEQ ID NO: 3244569 - RNA, 17 nt, Mycobacterium tuberculosis H37Rv
caggccgcggagaaggc

SEQ ID NO: 3244570 - RNA, 13 nt, Mycobacterium tuberculosis H37Rv
caggccgcgucga

SEQ ID NO: 3244571 - RNA, 18 nt, Mycobacterium tuberculosis H37Rv
caggccgcuugccccgcc

SEQ ID NO: 3244572 - RNA, 17 nt, Mycobacterium tuberculosis H37Rv
caggccggcacccacca

SEQ ID NO: 3244573 - RNA, 18 nt, Mycobacterium tuberculosis H37Rv
caggccggccaccaccgc

SEQ ID NO: 3244574 - RNA, 18 nt, Mycobacterium tuberculosis H37Rv
caggccggcggcggcgcu

SEQ ID NO: 3244575 - RNA, 15 nt, Mycobacterium tuberculosis H37Rv
caggccgggacagcg

SEQ ID NO: 3244576 - RNA, 18 nt, Mycobacterium tuberculosis H37Rv
caggccgggacagcgccg

SEQ ID NO: 3244577 - RNA, 19 nt, Mycobacterium tuberculosis H37Rv
caggccgggcaccaauacc

SEQ ID NO: 3244578 - RNA, 14 nt, Mycobacterium tuberculosis H37Rv
caggccgggcgcaa

SEQ ID NO: 3244579 - RNA, 16 nt, Mycobacterium tuberculosis H37Rv
caggccgggcgcaagc

SEQ ID NO: 3244580 - RNA, 24 nt, Mycobacterium tuberculosis H37Rv
caggccgggcgcaagcagcccggg

SEQ ID NO: 3244581 - RNA, 15 nt, Mycobacterium tuberculosis H37Rv
caggccgguaccggg

SEQ ID NO: 3244582 - RNA, 14 nt, Mycobacterium tuberculosis H37Rv
caggccggugugcg

SEQ ID NO: 3244583 - RNA, 21 nt, Mycobacterium tuberculosis H37Rv
caggccgguuugcacgcacca

SEQ ID NO: 3244584 - RNA, 17 nt, Mycobacterium tuberculosis H37Rv
caggccguacgacggca

SEQ ID NO: 3244585 - RNA, 21 nt, Mycobacterium tuberculosis H37Rv
caggccguagcccacgacgaa

SEQ ID NO: 3244586 - RNA, 16 nt, Mycobacterium tuberculosis H37Rv
caggccguaguggccg

SEQ ID NO: 3244587 - RNA, 17 nt, Mycobacterium tuberculosis H37Rv
caggccgucaggcgugc

SEQ ID NO: 3244588 - RNA, 19 nt, Mycobacterium tuberculosis H37Rv
caggccguccucggucagc

SEQ ID NO: 3244589 - RNA, 17 nt, Mycobacterium tuberculosis H37Rv
caggccgucggcgucga

SEQ ID NO: 3244590 - RNA, 20 nt, Mycobacterium tuberculosis H37Rv
caggccuaguccggcacugc

SEQ ID NO: 3244591 - RNA, 20 nt, Mycobacterium tuberculosis H37Rv
caggccuccaaaaucgcggc

SEQ ID NO: 3244592 - RNA, 17 nt, Mycobacterium tuberculosis H37Rv
caggccuccaagcccgc

SEQ ID NO: 3244593 - RNA, 14 nt, Mycobacterium tuberculosis H37Rv
caggccucggcgcc

SEQ ID NO: 3244594 - RNA, 19 nt, Mycobacterium tuberculosis H37Rv
caggccuugaccucgggua

SEQ ID NO: 3244595 - RNA, 19 nt, Mycobacterium tuberculosis H37Rv
caggccuugggauaggccg

SEQ ID NO: 3244596 - RNA, 17 nt, Mycobacterium tuberculosis H37Rv
caggccuuuuggcgaac

SEQ ID NO: 3244597 - RNA, 18 nt, Mycobacterium tuberculosis H37Rv
caggcgaagucgacucgc

SEQ ID NO: 3244598 - RNA, 23 nt, Mycobacterium tuberculosis H37Rv
caggcgaagucgacucgccacau

SEQ ID NO: 3244599 - RNA, 18 nt, Mycobacterium tuberculosis H37Rv
caggcgagccggcgcgca

SEQ ID NO: 3244600 - RNA, 18 nt, Mycobacterium tuberculosis H37Rv
caggcgaucgcccggccc

SEQ ID NO: 3244601 - RNA, 14 nt, Mycobacterium tuberculosis H37Rv
caggcgaugcgcca

SEQ ID NO: 3244602 - RNA, 14 nt, Mycobacterium tuberculosis H37Rv
caggcgcagcuggg

SEQ ID NO: 3244603 - RNA, 19 nt, Mycobacterium tuberculosis H37Rv
caggcgcauagggccaccg

SEQ ID NO: 3244604 - RNA, 17 nt, Mycobacterium tuberculosis H37Rv
caggcgccacugcuucc

SEQ ID NO: 3244605 - RNA, 23 nt, Mycobacterium tuberculosis H37Rv
caggcgccacugcuuccggaaca

SEQ ID NO: 3244606 - RNA, 16 nt, Mycobacterium tuberculosis H37Rv
caggcgcccagcaccc

SEQ ID NO: 3244607 - RNA, 21 nt, Mycobacterium tuberculosis H37Rv
caggcgccgucucgcggugcg

SEQ ID NO: 3244608 - RNA, 16 nt, Mycobacterium tuberculosis H37Rv
caggcgcgcaccaccg

SEQ ID NO: 3244609 - RNA, 15 nt, Mycobacterium tuberculosis H37Rv
cagggcgacggccac

SEQ ID NO: 3244610 - RNA, 14 nt, Mycobacterium tuberculosis H37Rv
cagggcgaucugcg

SEQ ID NO: 3244611 - RNA, 20 nt, Mycobacterium tuberculosis H37Rv
cagggcgcaaaccacccgca

SEQ ID NO: 3244612 - RNA, 21 nt, Mycobacterium tuberculosis H37Rv
cagggcgcaaaccacccgcaa

SEQ ID NO: 3244613 - RNA, 20 nt, Mycobacterium tuberculosis H37Rv
cagggcgccgaucgugcccc

SEQ ID NO: 3244614 - RNA, 20 nt, Mycobacterium tuberculosis H37Rv
cagggcgcggaucugcagca

SEQ ID NO: 3244615 - RNA, 22 nt, Mycobacterium tuberculosis H37Rv
cagggcggcguuaccaccguca

SEQ ID NO: 3244616 - RNA, 20 nt, Mycobacterium tuberculosis H37Rv
cagggcgguggccacccggc

SEQ ID NO: 3244617 - RNA, 18 nt, Mycobacterium tuberculosis H37Rv
cagggcgucgaacucauc

SEQ ID NO: 3244618 - RNA, 16 nt, Mycobacterium tuberculosis H37Rv
cagggcgucgaccgcg

SEQ ID NO: 3244619 - RNA, 17 nt, Mycobacterium tuberculosis H37Rv
cagggcgucgaccgcgg

SEQ ID NO: 3244620 - RNA, 15 nt, Mycobacterium tuberculosis H37Rv
cagggcucggcggcc

SEQ ID NO: 3244621 - RNA, 16 nt, Mycobacterium tuberculosis H37Rv
cagggcugcgaugcgg

SEQ ID NO: 3244622 - RNA, 21 nt, Mycobacterium tuberculosis H37Rv
cagggcuucgugcaccacauu

SEQ ID NO: 3244623 - RNA, 19 nt, Mycobacterium tuberculosis H37Rv
cagggcuuguacgaacugc

SEQ ID NO: 3244624 - RNA, 15 nt, Mycobacterium tuberculosis H37Rv
caggggacccggggc

SEQ ID NO: 3244625 - RNA, 20 nt, Mycobacterium tuberculosis H37Rv
caggggacgaccaugccgau

SEQ ID NO: 3244626 - RNA, 16 nt, Mycobacterium tuberculosis H37Rv
caggggacgggcggcc

SEQ ID NO: 3244627 - RNA, 19 nt, Mycobacterium tuberculosis H37Rv
caggggaucaccggcugcu

SEQ ID NO: 3244628 - RNA, 19 nt, Mycobacterium tuberculosis H37Rv
caggggaucccccgcgcga

SEQ ID NO: 3244629 - RNA, 14 nt, Mycobacterium tuberculosis H37Rv
caggggcagcgcgg

SEQ ID NO: 3244630 - RNA, 16 nt, Mycobacterium tuberculosis H37Rv
caggggcgcagcgcgg

SEQ ID NO: 3244631 - RNA, 18 nt, Mycobacterium tuberculosis H37Rv
caggggcgcagcgcggca

SEQ ID NO: 3244632 - RNA, 14 nt, Mycobacterium tuberculosis H37Rv
caggggcuggugcu

SEQ ID NO: 3244633 - RNA, 11 nt, Mycobacterium tuberculosis H37Rv
cagggggcgag

SEQ ID NO: 3244634 - RNA, 18 nt, Mycobacterium tuberculosis H37Rv
cagggggcgagagcgcgg

SEQ ID NO: 3244635 - RNA, 18 nt, Mycobacterium tuberculosis H37Rv
cagggguggcgcgggccg

SEQ ID NO: 3244636 - RNA, 23 nt, Mycobacterium tuberculosis H37Rv
caggggugugccguggucgaaga

SEQ ID NO: 3244637 - RNA, 15 nt, Mycobacterium tuberculosis H37Rv
cagggguuggcguca

SEQ ID NO: 3244638 - RNA, 20 nt, Mycobacterium tuberculosis H37Rv
caggguauccacgccgggca

SEQ ID NO: 3244639 - RNA, 21 nt, Mycobacterium tuberculosis H37Rv
caggguauccacgccgggcaa

SEQ ID NO: 3244640 - RNA, 18 nt, Mycobacterium tuberculosis H37Rv
cagggucacaaacccagc

SEQ ID NO: 3244641 - RNA, 16 nt, Mycobacterium tuberculosis H37Rv
cagggucaccugcggg

SEQ ID NO: 3244642 - RNA, 14 nt, Mycobacterium tuberculosis H37Rv
cagggucagcuggg

SEQ ID NO: 3244643 - RNA, 20 nt, Mycobacterium tuberculosis H37Rv
cagggucgccccgaagcggg

SEQ ID NO: 3244644 - RNA, 18 nt, Mycobacterium tuberculosis H37Rv
cagggucgcgagcccgcc

SEQ ID NO: 3244645 - RNA, 16 nt, Mycobacterium tuberculosis H37Rv
cagggucugcgccgcc

SEQ ID NO: 3244646 - RNA, 13 nt, Mycobacterium tuberculosis H37Rv
cagggucugcuca

SEQ ID NO: 3244647 - RNA, 14 nt, Mycobacterium tuberculosis H37Rv
cagggucugcucau

SEQ ID NO: 3244648 - RNA, 20 nt, Mycobacterium tuberculosis H37Rv
cagggucugcucauccgggu

SEQ ID NO: 3244649 - RNA, 20 nt, Mycobacterium tuberculosis H37Rv
cagggugacuucgcugcggu

SEQ ID NO: 3244650 - RNA, 14 nt, Mycobacterium tuberculosis H37Rv
cagggugcccucgg

SEQ ID NO: 3244651 - RNA, 13 nt, Mycobacterium tuberculosis H37Rv
cagggugccggcg

SEQ ID NO: 3244652 - RNA, 23 nt, Mycobacterium tuberculosis H37Rv
cagggugcgcuugcggccgcgcg

SEQ ID NO: 3244653 - RNA, 21 nt, Mycobacterium tuberculosis H37Rv
caggguggcccggggacgggu

SEQ ID NO: 3244654 - RNA, 10 nt, Mycobacterium tuberculosis H37Rv
cagggugggc

SEQ ID NO: 3244655 - RNA, 15 nt, Mycobacterium tuberculosis H37Rv
caggguguccgucga

SEQ ID NO: 3244656 - RNA, 17 nt, Mycobacterium tuberculosis H37Rv
cagggugucgaagagca

SEQ ID NO: 3244657 - RNA, 18 nt, Mycobacterium tuberculosis H37Rv
cagggugucgaagagcag

SEQ ID NO: 3244658 - RNA, 20 nt, Mycobacterium tuberculosis H37Rv
cagggugucgaagagcaggc

SEQ ID NO: 3244659 - RNA, 15 nt, Mycobacterium tuberculosis H37Rv
cagggugucugugau

SEQ ID NO: 3244660 - RNA, 20 nt, Mycobacterium tuberculosis H37Rv
cagggugugcgaacaagugg

SEQ ID NO: 3244661 - RNA, 19 nt, Mycobacterium tuberculosis H37Rv
cagggugugcgucugcggc

SEQ ID NO: 3244662 - RNA, 21 nt, Mycobacterium tuberculosis H37Rv
caggguguucacguucagccc

SEQ ID NO: 3244663 - RNA, 21 nt, Mycobacterium tuberculosis H37Rv
caggguucgucgggacgccgc

SEQ ID NO: 3244664 - RNA, 17 nt, Mycobacterium tuberculosis H37Rv
caggguugccaucaagg

SEQ ID NO: 3244665 - RNA, 14 nt, Mycobacterium tuberculosis H37Rv
caggguuggcagca

SEQ ID NO: 3244666 - RNA, 17 nt, Mycobacterium tuberculosis H37Rv
cagguaaacggauucga

SEQ ID NO: 3244667 - RNA, 13 nt, Mycobacterium tuberculosis H37Rv
cagguaagcagcc

SEQ ID NO: 3244668 - RNA, 20 nt, Mycobacterium tuberculosis H37Rv
cagguaagcagccagcaaca

SEQ ID NO: 3244669 - RNA, 22 nt, Mycobacterium tuberculosis H37Rv
cagguaaugguggcguccaggg

SEQ ID NO: 3244670 - RNA, 18 nt, Mycobacterium tuberculosis H37Rv
cagguacuccccguugcc

SEQ ID NO: 3244671 - RNA, 14 nt, Mycobacterium tuberculosis H37Rv
cagguacucgcccc

SEQ ID NO: 3244672 - RNA, 23 nt, Mycobacterium tuberculosis H37Rv
cagguagaacuccucgcugucga

SEQ ID NO: 3244673 - RNA, 14 nt, Mycobacterium tuberculosis H37Rv
cagguagcgcucga

SEQ ID NO: 3244674 - RNA, 13 nt, Mycobacterium tuberculosis H37Rv
cagguaggcgcga

SEQ ID NO: 3244675 - RNA, 21 nt, Mycobacterium tuberculosis H37Rv
cagguagucgucgacuugcag

SEQ ID NO: 3244676 - RNA, 22 nt, Mycobacterium tuberculosis H37Rv
caggucaauggucuuuguccac

SEQ ID NO: 3244677 - RNA, 21 nt, Mycobacterium tuberculosis H37Rv
caggucacuacuccggucccg

SEQ ID NO: 3244678 - RNA, 18 nt, Mycobacterium tuberculosis H37Rv
caggucacuggguugcga

SEQ ID NO: 3244679 - RNA, 20 nt, Mycobacterium tuberculosis H37Rv
caggucagaaaaucgguugu

SEQ ID NO: 3244680 - RNA, 13 nt, Mycobacterium tuberculosis H37Rv
caggucagccgcg

SEQ ID NO: 3244681 - RNA, 14 nt, Mycobacterium tuberculosis H37Rv
caggucagccgcgc

SEQ ID NO: 3244682 - RNA, 21 nt, Mycobacterium tuberculosis H37Rv
caggucaucggcggcggggac

SEQ ID NO: 3244683 - RNA, 18 nt, Mycobacterium tuberculosis H37Rv
caggucaucggcuaucgc

SEQ ID NO: 3244684 - RNA, 18 nt, Mycobacterium tuberculosis H37Rv
caggucauugcacgccug

SEQ ID NO: 3244685 - RNA, 16 nt, Mycobacterium tuberculosis H37Rv
caggucauugccggcg

SEQ ID NO: 3244686 - RNA, 15 nt, Mycobacterium tuberculosis H37Rv
cagguccaccgcugc

SEQ ID NO: 3244687 - RNA, 14 nt, Mycobacterium tuberculosis H37Rv
cagguccaguaccu

SEQ ID NO: 3244688 - RNA, 20 nt, Mycobacterium tuberculosis H37Rv
cagguccgccaacggcaccu

SEQ ID NO: 3244689 - RNA, 23 nt, Mycobacterium tuberculosis H37Rv
cagguccgccaacggcaccucga

SEQ ID NO: 3244690 - RNA, 14 nt, Mycobacterium tuberculosis H37Rv
cagguccgccaccg

SEQ ID NO: 3244691 - RNA, 17 nt, Mycobacterium tuberculosis H37Rv
cagguccgccggugccg

SEQ ID NO: 3244692 - RNA, 22 nt, Mycobacterium tuberculosis H37Rv
cagguccgccggugccgccguc

SEQ ID NO: 3244693 - RNA, 17 nt, Mycobacterium tuberculosis H37Rv
cagguccgcgugcugcc

SEQ ID NO: 3244694 - RNA, 18 nt, Mycobacterium tuberculosis H37Rv
cagguccggguuggccac

SEQ ID NO: 3244695 - RNA, 20 nt, Mycobacterium tuberculosis H37Rv
cagguccggguuggccaccu

SEQ ID NO: 3244696 - RNA, 12 nt, Mycobacterium tuberculosis H37Rv
caggucgaaugg

SEQ ID NO: 3244697 - RNA, 17 nt, Mycobacterium tuberculosis H37Rv
caggucgacaccgcggu

SEQ ID NO: 3244698 - RNA, 22 nt, Mycobacterium tuberculosis H37Rv
caggucgacaccgcggugcccc

SEQ ID NO: 3244699 - RNA, 20 nt, Mycobacterium tuberculosis H37Rv
caggucgacauaggccaccu

SEQ ID NO: 3244700 - RNA, 16 nt, Mycobacterium tuberculosis H37Rv
caggucgagcaccggc

SEQ ID NO: 3244701 - RNA, 22 nt, Mycobacterium tuberculosis H37Rv
caggucgagcgcccacugguga

SEQ ID NO: 3244702 - RNA, 23 nt, Mycobacterium tuberculosis H37Rv
caggucgaggcaggccucggcgc

SEQ ID NO: 3244703 - RNA, 17 nt, Mycobacterium tuberculosis H37Rv
caggucgagguccucgg

SEQ ID NO: 3244704 - RNA, 22 nt, Mycobacterium tuberculosis H37Rv
caggucgauaccggcgugcagu

SEQ ID NO: 3244705 - RNA, 13 nt, Mycobacterium tuberculosis H37Rv
cagucaacagggc

SEQ ID NO: 3244706 - RNA, 18 nt, Mycobacterium tuberculosis H37Rv
cagucaacagggccagga

SEQ ID NO: 3244707 - RNA, 21 nt, Mycobacterium tuberculosis H37Rv
cagucaacagggccaggacaa

SEQ ID NO: 3244708 - RNA, 17 nt, Mycobacterium tuberculosis H37Rv
cagucaccaaccacaug

SEQ ID NO: 3244709 - RNA, 13 nt, Mycobacterium tuberculosis H37Rv
cagucacgcccac

SEQ ID NO: 3244710 - RNA, 17 nt, Mycobacterium tuberculosis H37Rv
cagucacgcccaccacu

SEQ ID NO: 3244711 - RNA, 17 nt, Mycobacterium tuberculosis H37Rv
cagucaggaaaccggcg

SEQ ID NO: 3244712 - RNA, 18 nt, Mycobacterium tuberculosis H37Rv
cagucauuauucgcgcaa

SEQ ID NO: 3244713 - RNA, 24 nt, Mycobacterium tuberculosis H37Rv
caguccaccgcgcggcgcagcacc

SEQ ID NO: 3244714 - RNA, 12 nt, Mycobacterium tuberculosis H37Rv
caguccagccgg

SEQ ID NO: 3244715 - RNA, 21 nt, Mycobacterium tuberculosis H37Rv
caguccagccgggugccggca

SEQ ID NO: 3244716 - RNA, 21 nt, Mycobacterium tuberculosis H37Rv
caguccaggacggucgccagg

SEQ ID NO: 3244717 - RNA, 18 nt, Mycobacterium tuberculosis H37Rv
caguccaugugcccaggu

SEQ ID NO: 3244718 - RNA, 18 nt, Mycobacterium tuberculosis H37Rv
cagucccacugggccggu

SEQ ID NO: 3244719 - RNA, 21 nt, Mycobacterium tuberculosis H37Rv
cagucccagcacacccccguc

SEQ ID NO: 3244720 - RNA, 16 nt, Mycobacterium tuberculosis H37Rv
cagucccagcgccgca

SEQ ID NO: 3244721 - RNA, 23 nt, Mycobacterium tuberculosis H37Rv
cagucccagcgccgcacagaaaa

SEQ ID NO: 3244722 - RNA, 12 nt, Mycobacterium tuberculosis H37Rv
caguccccagac

SEQ ID NO: 3244723 - RNA, 18 nt, Mycobacterium tuberculosis H37Rv
cagucccggugggcggcu

SEQ ID NO: 3244724 - RNA, 14 nt, Mycobacterium tuberculosis H37Rv
caguccgacaccgg

SEQ ID NO: 3244725 - RNA, 15 nt, Mycobacterium tuberculosis H37Rv
caguccgacaccggc

SEQ ID NO: 3244726 - RNA, 15 nt, Mycobacterium tuberculosis H37Rv
caguccgaugccgga

SEQ ID NO: 3244727 - RNA, 12 nt, Mycobacterium tuberculosis H37Rv
caguccggcccc

SEQ ID NO: 3244728 - RNA, 15 nt, Mycobacterium tuberculosis H37Rv
caguccggccccccg

SEQ ID NO: 3244729 - RNA, 18 nt, Mycobacterium tuberculosis H37Rv
caguccggccccccgacu

SEQ ID NO: 3244730 - RNA, 22 nt, Mycobacterium tuberculosis H37Rv
caguccggccccccgacuccgg

SEQ ID NO: 3244731 - RNA, 16 nt, Mycobacterium tuberculosis H37Rv
caguccgguagcagcg

SEQ ID NO: 3244732 - RNA, 14 nt, Mycobacterium tuberculosis H37Rv
caguccguccaggu

SEQ ID NO: 3244733 - RNA, 14 nt, Mycobacterium tuberculosis H37Rv
caguccgucggccu

SEQ ID NO: 3244734 - RNA, 19 nt, Mycobacterium tuberculosis H37Rv
caguccucaucgagcgcgc

SEQ ID NO: 3244735 - RNA, 17 nt, Mycobacterium tuberculosis H37Rv
caguccucgacguggcc

SEQ ID NO: 3244736 - RNA, 20 nt, Mycobacterium tuberculosis H37Rv
caguccucgggcaggcggcc

SEQ ID NO: 3244737 - RNA, 19 nt, Mycobacterium tuberculosis H37Rv
cagucgaacaagaccgcgg

SEQ ID NO: 3244738 - RNA, 20 nt, Mycobacterium tuberculosis H37Rv
cagucgaacaagaccgcggc

SEQ ID NO: 3244739 - RNA, 22 nt, Mycobacterium tuberculosis H37Rv
cagucgaacaagaccgcggcgu

SEQ ID NO: 3244740 - RNA, 21 nt, Mycobacterium tuberculosis H37Rv
cagucgaccggacacuccugc

SEQ ID NO: 3244741 - RNA, 14 nt, Mycobacterium tuberculosis H37Rv
cagucgagcaccug

SEQ ID NO: 3244742 - RNA, 15 nt, Mycobacterium tuberculosis H37Rv
cagucgagcaccugc

SEQ ID NO: 3244743 - RNA, 16 nt, Mycobacterium tuberculosis H37Rv
cagucgagcaucucgu

SEQ ID NO: 3244744 - RNA, 19 nt, Mycobacterium tuberculosis H37Rv
cagucgaucgcggcccgca

SEQ ID NO: 3244745 - RNA, 21 nt, Mycobacterium tuberculosis H37Rv
cagucgaugagugacgguccg

SEQ ID NO: 3244746 - RNA, 23 nt, Mycobacterium tuberculosis H37Rv
cagucgcaacaguucacgccggu

SEQ ID NO: 3244747 - RNA, 14 nt, Mycobacterium tuberculosis H37Rv
cagucgcagccagg

SEQ ID NO: 3244748 - RNA, 17 nt, Mycobacterium tuberculosis H37Rv
cagucgccggccggccc

SEQ ID NO: 3244749 - RNA, 12 nt, Mycobacterium tuberculosis H37Rv
cagucgcggcgu

SEQ ID NO: 3244750 - RNA, 22 nt, Mycobacterium tuberculosis H37Rv
cagucgcgguaccaucaccgcg

SEQ ID NO: 3244751 - RNA, 18 nt, Mycobacterium tuberculosis H37Rv
cagucgcuaaagcccccg

SEQ ID NO: 3244752 - RNA, 20 nt, Mycobacterium tuberculosis H37Rv
cagucgcuaaagcccccgac

SEQ ID NO: 3244753 - RNA, 23 nt, Mycobacterium tuberculosis H37Rv
cagucgcuggguggcgggccgga

SEQ ID NO: 3244754 - RNA, 12 nt, Mycobacterium tuberculosis H37Rv
cagucgggcagc

SEQ ID NO: 3244755 - RNA, 15 nt, Mycobacterium tuberculosis H37Rv
cagucgggcagcgcu

SEQ ID NO: 3244756 - RNA, 11 nt, Mycobacterium tuberculosis H37Rv
cagucggugca

SEQ ID NO: 3244757 - RNA, 19 nt, Mycobacterium tuberculosis H37Rv
cagucucaagguuucgaca

SEQ ID NO: 3244758 - RNA, 23 nt, Mycobacterium tuberculosis H37Rv
cagucugggcgaucgcuucgcaa

SEQ ID NO: 3244759 - RNA, 14 nt, Mycobacterium tuberculosis H37Rv
cagugaaaccaccg

SEQ ID NO: 3244760 - RNA, 20 nt, Mycobacterium tuberculosis H37Rv
cagugaaauugccgccgccg

SEQ ID NO: 3244761 - RNA, 19 nt, Mycobacterium tuberculosis H37Rv
cagugaacauuggguaccu

SEQ ID NO: 3244762 - RNA, 14 nt, Mycobacterium tuberculosis H37Rv
cagugaacgcgcgu

SEQ ID NO: 3244763 - RNA, 19 nt, Mycobacterium tuberculosis H37Rv
cagugaacucgugacagcg

SEQ ID NO: 3244764 - RNA, 15 nt, Mycobacterium tuberculosis H37Rv
cagugaagacaccag

SEQ ID NO: 3244765 - RNA, 19 nt, Mycobacterium tuberculosis H37Rv
cagugaaucggaccgaccg

SEQ ID NO: 3244766 - RNA, 16 nt, Mycobacterium tuberculosis H37Rv
cagugaauugcccaag

SEQ ID NO: 3244767 - RNA, 19 nt, Mycobacterium tuberculosis H37Rv
cagugacaacgcgaugccg

SEQ ID NO: 3244768 - RNA, 12 nt, Mycobacterium tuberculosis H37Rv
cagugacagcag

SEQ ID NO: 3244769 - RNA, 18 nt, Mycobacterium tuberculosis H37Rv
cagugaccgcuggugugu

SEQ ID NO: 3244770 - RNA, 15 nt, Mycobacterium tuberculosis H37Rv
cagugaccucgucgg

SEQ ID NO: 3244771 - RNA, 19 nt, Mycobacterium tuberculosis H37Rv
cagugaccucgucggcgac

SEQ ID NO: 3244772 - RNA, 22 nt, Mycobacterium tuberculosis H37Rv
cagugaccugggcgccccaggg

SEQ ID NO: 3244773 - RNA, 14 nt, Mycobacterium tuberculosis H37Rv
cagugacgccucga

SEQ ID NO: 3244774 - RNA, 21 nt, Mycobacterium tuberculosis H37Rv
cagugacgccucgacacccag

SEQ ID NO: 3244775 - RNA, 13 nt, Mycobacterium tuberculosis H37Rv
cagugagcccgcu

SEQ ID NO: 3244776 - RNA, 15 nt, Mycobacterium tuberculosis H37Rv
cagugagccgccauu

SEQ ID NO: 3244777 - RNA, 15 nt, Mycobacterium tuberculosis H37Rv
cagugaugcgccccg

SEQ ID NO: 3244778 - RNA, 12 nt, Mycobacterium tuberculosis H37Rv
cagugauucggc

SEQ ID NO: 3244779 - RNA, 23 nt, Mycobacterium tuberculosis H37Rv
cagugauucggccugagcggcca

SEQ ID NO: 3244780 - RNA, 16 nt, Mycobacterium tuberculosis H37Rv
cagugauugagcagca

SEQ ID NO: 3244781 - RNA, 22 nt, Mycobacterium tuberculosis H37Rv
cagugauugagcagcaagccgc

SEQ ID NO: 3244782 - RNA, 17 nt, Mycobacterium tuberculosis H37Rv
cagugcacccgggccgc

SEQ ID NO: 3244783 - RNA, 16 nt, Mycobacterium tuberculosis H37Rv
cagugcagacaggcgg

SEQ ID NO: 3244784 - RNA, 12 nt, Mycobacterium tuberculosis H37Rv
cagugcaggcgg

SEQ ID NO: 3244785 - RNA, 18 nt, Mycobacterium tuberculosis H37Rv
cagugcaggcggccgcca

SEQ ID NO: 3244786 - RNA, 20 nt, Mycobacterium tuberculosis H37Rv
cagugcaucgaucaccgcuu

SEQ ID NO: 3244787 - RNA, 15 nt, Mycobacterium tuberculosis H37Rv
cagugcaucggucag

SEQ ID NO: 3244788 - RNA, 19 nt, Mycobacterium tuberculosis H37Rv
cagugccaccugggcgggc

SEQ ID NO: 3244789 - RNA, 15 nt, Mycobacterium tuberculosis H37Rv
cagugccacgccuga

SEQ ID NO: 3244790 - RNA, 22 nt, Mycobacterium tuberculosis H37Rv
cagugccagaacccggacaggg

SEQ ID NO: 3244791 - RNA, 19 nt, Mycobacterium tuberculosis H37Rv
cagugccaggugggugaac

SEQ ID NO: 3244792 - RNA, 14 nt, Mycobacterium tuberculosis H37Rv
cagugccaucgcca

SEQ ID NO: 3244793 - RNA, 14 nt, Mycobacterium tuberculosis H37Rv
cagugccaucuaca

SEQ ID NO: 3244794 - RNA, 17 nt, Mycobacterium tuberculosis H37Rv
cagugccaucuacaucg

SEQ ID NO: 3244795 - RNA, 18 nt, Mycobacterium tuberculosis H37Rv
cagugccccgcagcacuc

SEQ ID NO: 3244796 - RNA, 14 nt, Mycobacterium tuberculosis H37Rv
cagugccccgcccg

SEQ ID NO: 3244797 - RNA, 17 nt, Mycobacterium tuberculosis H37Rv
cagugccccgccgagcg

SEQ ID NO: 3244798 - RNA, 16 nt, Mycobacterium tuberculosis H37Rv
cagugcccgcacugcc

SEQ ID NO: 3244799 - RNA, 19 nt, Mycobacterium tuberculosis H37Rv
cagugcccgcacugccgcc

SEQ ID NO: 3244800 - RNA, 23 nt, Mycobacterium tuberculosis H37Rv
cagugcccgcacugccgccgguu

SEQ ID NO: 3244801 - RNA, 16 nt, Mycobacterium tuberculosis H37Rv
cauagagcggcaccag

SEQ ID NO: 3244802 - RNA, 18 nt, Mycobacterium tuberculosis H37Rv
cauagcaauccgcacagc

SEQ ID NO: 3244803 - RNA, 19 nt, Mycobacterium tuberculosis H37Rv
cauagcaauccgcacagcg

SEQ ID NO: 3244804 - RNA, 22 nt, Mycobacterium tuberculosis H37Rv
cauagcaccucgaugaugcgcu

SEQ ID NO: 3244805 - RNA, 17 nt, Mycobacterium tuberculosis H37Rv
cauagccccgcagaguc

SEQ ID NO: 3244806 - RNA, 15 nt, Mycobacterium tuberculosis H37Rv
cauagcccgagcgcu

SEQ ID NO: 3244807 - RNA, 21 nt, Mycobacterium tuberculosis H37Rv
cauagcgacggcgcucggcga

SEQ ID NO: 3244808 - RNA, 16 nt, Mycobacterium tuberculosis H37Rv
cauagcgccgcgccca

SEQ ID NO: 3244809 - RNA, 20 nt, Mycobacterium tuberculosis H37Rv
cauagcucaacggaaccgau

SEQ ID NO: 3244810 - RNA, 11 nt, Mycobacterium tuberculosis H37Rv
cauagcugccg

SEQ ID NO: 3244811 - RNA, 19 nt, Mycobacterium tuberculosis H37Rv
cauaggccccgccagcgcc

SEQ ID NO: 3244812 - RNA, 17 nt, Mycobacterium tuberculosis H37Rv
cauaggccugcagccga

SEQ ID NO: 3244813 - RNA, 20 nt, Mycobacterium tuberculosis H37Rv
cauagggccaccgccgccug

SEQ ID NO: 3244814 - RNA, 16 nt, Mycobacterium tuberculosis H37Rv
cauagguaugcccgga

SEQ ID NO: 3244815 - RNA, 20 nt, Mycobacterium tuberculosis H37Rv
cauagucgaauggcaacaca

SEQ ID NO: 3244816 - RNA, 15 nt, Mycobacterium tuberculosis H37Rv
cauagugcggcaccg

SEQ ID NO: 3244817 - RNA, 21 nt, Mycobacterium tuberculosis H37Rv
cauagugcggcagcgguggcu

SEQ ID NO: 3244818 - RNA, 18 nt, Mycobacterium tuberculosis H37Rv
cauagugcggcugcaacg

SEQ ID NO: 3244819 - RNA, 13 nt, Mycobacterium tuberculosis H37Rv
cauauccgccggc

SEQ ID NO: 3244820 - RNA, 14 nt, Mycobacterium tuberculosis H37Rv
cauaucgcccacca

SEQ ID NO: 3244821 - RNA, 12 nt, Mycobacterium tuberculosis H37Rv
cauaucggugcc

SEQ ID NO: 3244822 - RNA, 22 nt, Mycobacterium tuberculosis H37Rv
cauaucgugaugugcccauuca

SEQ ID NO: 3244823 - RNA, 14 nt, Mycobacterium tuberculosis H37Rv
cauaugccgccggc

SEQ ID NO: 3244824 - RNA, 16 nt, Mycobacterium tuberculosis H37Rv
cauaugccgccggcag

SEQ ID NO: 3244825 - RNA, 23 nt, Mycobacterium tuberculosis H37Rv
cauauuggcgcggccgaaagagc

SEQ ID NO: 3244826 - RNA, 21 nt, Mycobacterium tuberculosis H37Rv
caucaaaaacgaacccaggca

SEQ ID NO: 3244827 - RNA, 22 nt, Mycobacterium tuberculosis H37Rv
caucaacgacaccagaucguuc

SEQ ID NO: 3244828 - RNA, 21 nt, Mycobacterium tuberculosis H37Rv
caucaacgccggcgacggcgu

SEQ ID NO: 3244829 - RNA, 12 nt, Mycobacterium tuberculosis H37Rv
caucaacugcau

SEQ ID NO: 3244830 - RNA, 19 nt, Mycobacterium tuberculosis H37Rv
caucaacugcaucaccacu

SEQ ID NO: 3244831 - RNA, 13 nt, Mycobacterium tuberculosis H37Rv
caucaccaccggc

SEQ ID NO: 3244832 - RNA, 14 nt, Mycobacterium tuberculosis H37Rv
caucaccaccggca

SEQ ID NO: 3244833 - RNA, 20 nt, Mycobacterium tuberculosis H37Rv
caucaccaccggcaccgcug

SEQ ID NO: 3244834 - RNA, 13 nt, Mycobacterium tuberculosis H37Rv
caucaccagcggc

SEQ ID NO: 3244835 - RNA, 15 nt, Mycobacterium tuberculosis H37Rv
caucacccagcgccg

SEQ ID NO: 3244836 - RNA, 13 nt, Mycobacterium tuberculosis H37Rv
caucaccccggcc

SEQ ID NO: 3244837 - RNA, 16 nt, Mycobacterium tuberculosis H37Rv
caucaccccggccuug

SEQ ID NO: 3244838 - RNA, 17 nt, Mycobacterium tuberculosis H37Rv
caucaccccggccuugg

SEQ ID NO: 3244839 - RNA, 12 nt, Mycobacterium tuberculosis H37Rv
caucaccgacgc

SEQ ID NO: 3244840 - RNA, 16 nt, Mycobacterium tuberculosis H37Rv
caucaccgcagcaccg

SEQ ID NO: 3244841 - RNA, 16 nt, Mycobacterium tuberculosis H37Rv
caucaccgccagcccc

SEQ ID NO: 3244842 - RNA, 24 nt, Mycobacterium tuberculosis H37Rv
caucaccgcgccagccuccaccag

SEQ ID NO: 3244843 - RNA, 13 nt, Mycobacterium tuberculosis H37Rv
caucaccgcgcuc

SEQ ID NO: 3244844 - RNA, 22 nt, Mycobacterium tuberculosis H37Rv
caucaccggaacccccagcugc

SEQ ID NO: 3244845 - RNA, 22 nt, Mycobacterium tuberculosis H37Rv
caucaccggagcuuguugcagc

SEQ ID NO: 3244846 - RNA, 12 nt, Mycobacterium tuberculosis H37Rv
caucaccggcau

SEQ ID NO: 3244847 - RNA, 20 nt, Mycobacterium tuberculosis H37Rv
caucaccggcggccccaggg

SEQ ID NO: 3244848 - RNA, 14 nt, Mycobacterium tuberculosis H37Rv
caucaccuccgcga

SEQ ID NO: 3244849 - RNA, 17 nt, Mycobacterium tuberculosis H37Rv
caucacgaaggcguucg

SEQ ID NO: 3244850 - RNA, 21 nt, Mycobacterium tuberculosis H37Rv
caucacgaaggcguucgccgg

SEQ ID NO: 3244851 - RNA, 17 nt, Mycobacterium tuberculosis H37Rv
caucacgacucccccgg

SEQ ID NO: 3244852 - RNA, 18 nt, Mycobacterium tuberculosis H37Rv
caucacgcacugauguca

SEQ ID NO: 3244853 - RNA, 17 nt, Mycobacterium tuberculosis H37Rv
caucacgccccagguuc

SEQ ID NO: 3244854 - RNA, 20 nt, Mycobacterium tuberculosis H37Rv
caucacgcgcucaccgacgc

SEQ ID NO: 3244855 - RNA, 15 nt, Mycobacterium tuberculosis H37Rv
caucacggaccaggc

SEQ ID NO: 3244856 - RNA, 16 nt, Mycobacterium tuberculosis H37Rv
caucacggaccaggcc

SEQ ID NO: 3244857 - RNA, 17 nt, Mycobacterium tuberculosis H37Rv
caucacgggacgacggc

SEQ ID NO: 3244858 - RNA, 20 nt, Mycobacterium tuberculosis H37Rv
caucacggucagccguacgc

SEQ ID NO: 3244859 - RNA, 17 nt, Mycobacterium tuberculosis H37Rv
caucacggucagcucgc

SEQ ID NO: 3244860 - RNA, 12 nt, Mycobacterium tuberculosis H37Rv
caucacucgcgc

SEQ ID NO: 3244861 - RNA, 14 nt, Mycobacterium tuberculosis H37Rv
caucacucgcgcca

SEQ ID NO: 3244862 - RNA, 16 nt, Mycobacterium tuberculosis H37Rv
caucagaaugccuggc

SEQ ID NO: 3244863 - RNA, 19 nt, Mycobacterium tuberculosis H37Rv
caucagaccaaugaccgcc

SEQ ID NO: 3244864 - RNA, 17 nt, Mycobacterium tuberculosis H37Rv
caucagauucgcgcugg

SEQ ID NO: 3244865 - RNA, 19 nt, Mycobacterium tuberculosis H37Rv
caucagauucgcgcuggcc

SEQ ID NO: 3244866 - RNA, 17 nt, Mycobacterium tuberculosis H37Rv
caucagcccuucagcga

SEQ ID NO: 3244867 - RNA, 20 nt, Mycobacterium tuberculosis H37Rv
caucagcccuucagcgaagc

SEQ ID NO: 3244868 - RNA, 15 nt, Mycobacterium tuberculosis H37Rv
caucagccgcaccag

SEQ ID NO: 3244869 - RNA, 18 nt, Mycobacterium tuberculosis H37Rv
caucagcgacaagugcac

SEQ ID NO: 3244870 - RNA, 13 nt, Mycobacterium tuberculosis H37Rv
caucagcggcgcc

SEQ ID NO: 3244871 - RNA, 20 nt, Mycobacterium tuberculosis H37Rv
caucaggaagcgugcggucg

SEQ ID NO: 3244872 - RNA, 21 nt, Mycobacterium tuberculosis H37Rv
caucagggccuuggcgggauc

SEQ ID NO: 3244873 - RNA, 14 nt, Mycobacterium tuberculosis H37Rv
caucaggucggcga

SEQ ID NO: 3244874 - RNA, 16 nt, Mycobacterium tuberculosis H37Rv
caucaggugcgccugg

SEQ ID NO: 3244875 - RNA, 17 nt, Mycobacterium tuberculosis H37Rv
caucaggugcgccuggc

SEQ ID NO: 3244876 - RNA, 17 nt, Mycobacterium tuberculosis H37Rv
caucaguuugacgccga

SEQ ID NO: 3244877 - RNA, 14 nt, Mycobacterium tuberculosis H37Rv
caucaucucggugg

SEQ ID NO: 3244878 - RNA, 22 nt, Mycobacterium tuberculosis H37Rv
caucaucuggucgaccaucggu

SEQ ID NO: 3244879 - RNA, 12 nt, Mycobacterium tuberculosis H37Rv
caucaugccgcc

SEQ ID NO: 3244880 - RNA, 22 nt, Mycobacterium tuberculosis H37Rv
caucauggccgugaacugcgua

SEQ ID NO: 3244881 - RNA, 16 nt, Mycobacterium tuberculosis H37Rv
caucauuugcaguccc

SEQ ID NO: 3244882 - RNA, 17 nt, Mycobacterium tuberculosis H37Rv
cauccaaaaucgccuga

SEQ ID NO: 3244883 - RNA, 15 nt, Mycobacterium tuberculosis H37Rv
cauccaacgcggcgc

SEQ ID NO: 3244884 - RNA, 20 nt, Mycobacterium tuberculosis H37Rv
cauccaagaaagugcacaca

SEQ ID NO: 3244885 - RNA, 16 nt, Mycobacterium tuberculosis H37Rv
cauccaauaucgcuuu

SEQ ID NO: 3244886 - RNA, 14 nt, Mycobacterium tuberculosis H37Rv
cauccacaaucaca

SEQ ID NO: 3244887 - RNA, 15 nt, Mycobacterium tuberculosis H37Rv
cauccacaccgaccg

SEQ ID NO: 3244888 - RNA, 17 nt, Mycobacterium tuberculosis H37Rv
cauccacaccgcggcgg

SEQ ID NO: 3244889 - RNA, 23 nt, Mycobacterium tuberculosis H37Rv
cauccaccgcagauccccgccac

SEQ ID NO: 3244890 - RNA, 14 nt, Mycobacterium tuberculosis H37Rv
cauccacgucgccc

SEQ ID NO: 3244891 - RNA, 17 nt, Mycobacterium tuberculosis H37Rv
cauccagaagccggcca

SEQ ID NO: 3244892 - RNA, 20 nt, Mycobacterium tuberculosis H37Rv
cauccagaagccggccacua

SEQ ID NO: 3244893 - RNA, 22 nt, Mycobacterium tuberculosis H37Rv
cauccagaaguaggcgaccgcc

SEQ ID NO: 3244894 - RNA, 19 nt, Mycobacterium tuberculosis H37Rv
cauccagagacaugucgcu

SEQ ID NO: 3244895 - RNA, 18 nt, Mycobacterium tuberculosis H37Rv
cauccagaugcccagcag

SEQ ID NO: 3244896 - RNA, 11 nt, Mycobacterium tuberculosis H37Rv
cauccagccgu

SEQ ID NO: 3244897 - RNA, 20 nt, Mycobacterium tuberculosis H37Rv
caucgcccgaugcgccagcg

SEQ ID NO: 3244898 - RNA, 23 nt, Mycobacterium tuberculosis H37Rv
caucgcccugggcgccggcgucc

SEQ ID NO: 3244899 - RNA, 18 nt, Mycobacterium tuberculosis H37Rv
caucgccgaacgggacga

SEQ ID NO: 3244900 - RNA, 17 nt, Mycobacterium tuberculosis H37Rv
caucgccgacacccucg

SEQ ID NO: 3244901 - RNA, 14 nt, Mycobacterium tuberculosis H37Rv
caucgccgacccgc

SEQ ID NO: 3244902 - RNA, 17 nt, Mycobacterium tuberculosis H37Rv
caucgccgagguggaca

SEQ ID NO: 3244903 - RNA, 23 nt, Mycobacterium tuberculosis H37Rv
caucgccgaugauguuuuccccg

SEQ ID NO: 3244904 - RNA, 14 nt, Mycobacterium tuberculosis H37Rv
caucgccgccggug

SEQ ID NO: 3244905 - RNA, 14 nt, Mycobacterium tuberculosis H37Rv
caucgccgcggcca

SEQ ID NO: 3244906 - RNA, 13 nt, Mycobacterium tuberculosis H37Rv
caucgccgcuggc

SEQ ID NO: 3244907 - RNA, 18 nt, Mycobacterium tuberculosis H37Rv
caucgccgcuggccagca

SEQ ID NO: 3244908 - RNA, 19 nt, Mycobacterium tuberculosis H37Rv
caucgccggcacggugaac

SEQ ID NO: 3244909 - RNA, 15 nt, Mycobacterium tuberculosis H37Rv
caucgccucaccacg

SEQ ID NO: 3244910 - RNA, 20 nt, Mycobacterium tuberculosis H37Rv
caucgccuccucgacgucgg

SEQ ID NO: 3244911 - RNA, 14 nt, Mycobacterium tuberculosis H37Rv
caucgccucgagga

SEQ ID NO: 3244912 - RNA, 23 nt, Mycobacterium tuberculosis H37Rv
caucgccucggcgcugcgcaccg

SEQ ID NO: 3244913 - RNA, 23 nt, Mycobacterium tuberculosis H37Rv
caucgcgaaaccggaccugaccg

SEQ ID NO: 3244914 - RNA, 12 nt, Mycobacterium tuberculosis H37Rv
caucgcgacauc

SEQ ID NO: 3244915 - RNA, 19 nt, Mycobacterium tuberculosis H37Rv
caucgcgacuagacgccgc

SEQ ID NO: 3244916 - RNA, 22 nt, Mycobacterium tuberculosis H37Rv
caucgcgacuagacgccgccgc

SEQ ID NO: 3244917 - RNA, 21 nt, Mycobacterium tuberculosis H37Rv
caucgcgagaaggugcugcgc

SEQ ID NO: 3244918 - RNA, 15 nt, Mycobacterium tuberculosis H37Rv
caucgcgcacgcccu

SEQ ID NO: 3244919 - RNA, 15 nt, Mycobacterium tuberculosis H37Rv
caucgcgcgccgacc

SEQ ID NO: 3244920 - RNA, 14 nt, Mycobacterium tuberculosis H37Rv
caucgcgcgcggcu

SEQ ID NO: 3244921 - RNA, 16 nt, Mycobacterium tuberculosis H37Rv
caucgcgcgcggcucc

SEQ ID NO: 3244922 - RNA, 15 nt, Mycobacterium tuberculosis H37Rv
caucgcgcugcggcc

SEQ ID NO: 3244923 - RNA, 17 nt, Mycobacterium tuberculosis H37Rv
caucgcgcugcggccca

SEQ ID NO: 3244924 - RNA, 20 nt, Mycobacterium tuberculosis H37Rv
caucgcgcugcggcccacac

SEQ ID NO: 3244925 - RNA, 22 nt, Mycobacterium tuberculosis H37Rv
caucgcggcaucgacgcggcca

SEQ ID NO: 3244926 - RNA, 19 nt, Mycobacterium tuberculosis H37Rv
caucgcggccgcugggccc

SEQ ID NO: 3244927 - RNA, 19 nt, Mycobacterium tuberculosis H37Rv
caucgcggcgacgucguug

SEQ ID NO: 3244928 - RNA, 16 nt, Mycobacterium tuberculosis H37Rv
caucgcggcggcgcuc

SEQ ID NO: 3244929 - RNA, 16 nt, Mycobacterium tuberculosis H37Rv
caucgcgggcggcgcu

SEQ ID NO: 3244930 - RNA, 15 nt, Mycobacterium tuberculosis H37Rv
caucgcguuguaggc

SEQ ID NO: 3244931 - RNA, 17 nt, Mycobacterium tuberculosis H37Rv
caucgcucaucgucacc

SEQ ID NO: 3244932 - RNA, 21 nt, Mycobacterium tuberculosis H37Rv
caucggaaccguuugacgcgc

SEQ ID NO: 3244933 - RNA, 11 nt, Mycobacterium tuberculosis H37Rv
caucggacagg

SEQ ID NO: 3244934 - RNA, 21 nt, Mycobacterium tuberculosis H37Rv
caucggagauacgggccaccg

SEQ ID NO: 3244935 - RNA, 15 nt, Mycobacterium tuberculosis H37Rv
caucggaucaaagcc

SEQ ID NO: 3244936 - RNA, 20 nt, Mycobacterium tuberculosis H37Rv
caucggaugaccagugauca

SEQ ID NO: 3244937 - RNA, 19 nt, Mycobacterium tuberculosis H37Rv
caucggcacaggcggccag

SEQ ID NO: 3244938 - RNA, 21 nt, Mycobacterium tuberculosis H37Rv
caucggcacaggcggccagca

SEQ ID NO: 3244939 - RNA, 11 nt, Mycobacterium tuberculosis H37Rv
caucggcaccc

SEQ ID NO: 3244940 - RNA, 18 nt, Mycobacterium tuberculosis H37Rv
caucggcaccgucucgca

SEQ ID NO: 3244941 - RNA, 16 nt, Mycobacterium tuberculosis H37Rv
caucggcagcagcgca

SEQ ID NO: 3244942 - RNA, 14 nt, Mycobacterium tuberculosis H37Rv
caucggcaucgacu

SEQ ID NO: 3244943 - RNA, 24 nt, Mycobacterium tuberculosis H37Rv
caucggccaacaccacuagcggcu

SEQ ID NO: 3244944 - RNA, 14 nt, Mycobacterium tuberculosis H37Rv
caucggccagccgu

SEQ ID NO: 3244945 - RNA, 19 nt, Mycobacterium tuberculosis H37Rv
caucggccagccguucucg

SEQ ID NO: 3244946 - RNA, 12 nt, Mycobacterium tuberculosis H37Rv
caucggccagcg

SEQ ID NO: 3244947 - RNA, 18 nt, Mycobacterium tuberculosis H37Rv
caucggccaucucgucga

SEQ ID NO: 3244948 - RNA, 22 nt, Mycobacterium tuberculosis H37Rv
caucggccgucucggcaugcuc

SEQ ID NO: 3244949 - RNA, 13 nt, Mycobacterium tuberculosis H37Rv
caucggccucuga

SEQ ID NO: 3244950 - RNA, 16 nt, Mycobacterium tuberculosis H37Rv
caucggccucugacca

SEQ ID NO: 3244951 - RNA, 18 nt, Mycobacterium tuberculosis H37Rv
caucggccucugaccagc

SEQ ID NO: 3244952 - RNA, 20 nt, Mycobacterium tuberculosis H37Rv
caucggccucugaccagccg

SEQ ID NO: 3244953 - RNA, 11 nt, Mycobacterium tuberculosis H37Rv
caucggcgcca

SEQ ID NO: 3244954 - RNA, 19 nt, Mycobacterium tuberculosis H37Rv
caucggcggccugcucgca

SEQ ID NO: 3244955 - RNA, 18 nt, Mycobacterium tuberculosis H37Rv
caucggcggggcccacac

SEQ ID NO: 3244956 - RNA, 21 nt, Mycobacterium tuberculosis H37Rv
caucggcgugcuugcccaggu

SEQ ID NO: 3244957 - RNA, 23 nt, Mycobacterium tuberculosis H37Rv
caucggcuaucgcuagccggcuc

SEQ ID NO: 3244958 - RNA, 15 nt, Mycobacterium tuberculosis H37Rv
caucggcucugaugg

SEQ ID NO: 3244959 - RNA, 19 nt, Mycobacterium tuberculosis H37Rv
caucggcugcgacaggacg

SEQ ID NO: 3244960 - RNA, 20 nt, Mycobacterium tuberculosis H37Rv
caucggcuuugaggcgugca

SEQ ID NO: 3244961 - RNA, 13 nt, Mycobacterium tuberculosis H37Rv
caucgggagccgc

SEQ ID NO: 3244962 - RNA, 16 nt, Mycobacterium tuberculosis H37Rv
caucgggauggacacc

SEQ ID NO: 3244963 - RNA, 12 nt, Mycobacterium tuberculosis H37Rv
caucgggccaca

SEQ ID NO: 3244964 - RNA, 19 nt, Mycobacterium tuberculosis H37Rv
caucgggcgcgguaaccac

SEQ ID NO: 3244965 - RNA, 22 nt, Mycobacterium tuberculosis H37Rv
caucggggccugcguccgacgc

SEQ ID NO: 3244966 - RNA, 17 nt, Mycobacterium tuberculosis H37Rv
caucgggguggccacca

SEQ ID NO: 3244967 - RNA, 17 nt, Mycobacterium tuberculosis H37Rv
caucgguagaccccccu

SEQ ID NO: 3244968 - RNA, 15 nt, Mycobacterium tuberculosis H37Rv
caucggucaaugcca

SEQ ID NO: 3244969 - RNA, 20 nt, Mycobacterium tuberculosis H37Rv
caucggucagcaugggguag

SEQ ID NO: 3244970 - RNA, 17 nt, Mycobacterium tuberculosis H37Rv
caucggucagcgcggca

SEQ ID NO: 3244971 - RNA, 17 nt, Mycobacterium tuberculosis H37Rv
caucggucccacugccg

SEQ ID NO: 3244972 - RNA, 22 nt, Mycobacterium tuberculosis H37Rv
caucggugaauguugccgccgc

SEQ ID NO: 3244973 - RNA, 20 nt, Mycobacterium tuberculosis H37Rv
caucggugccacguucgcgg

SEQ ID NO: 3244974 - RNA, 20 nt, Mycobacterium tuberculosis H37Rv
caucgguggcgccgaacgcc

SEQ ID NO: 3244975 - RNA, 21 nt, Mycobacterium tuberculosis H37Rv
caucggugucuuccuccucga

SEQ ID NO: 3244976 - RNA, 14 nt, Mycobacterium tuberculosis H37Rv
caucgguguggccc

SEQ ID NO: 3244977 - RNA, 18 nt, Mycobacterium tuberculosis H37Rv
caucgguugaccggucga

SEQ ID NO: 3244978 - RNA, 16 nt, Mycobacterium tuberculosis H37Rv
caucguaggccggcau

SEQ ID NO: 3244979 - RNA, 14 nt, Mycobacterium tuberculosis H37Rv
caucgucaggaacc

SEQ ID NO: 3244980 - RNA, 17 nt, Mycobacterium tuberculosis H37Rv
caucgucaggaaccacc

SEQ ID NO: 3244981 - RNA, 14 nt, Mycobacterium tuberculosis H37Rv
caucgucaucgacg

SEQ ID NO: 3244982 - RNA, 14 nt, Mycobacterium tuberculosis H37Rv
caucgucgaagacc

SEQ ID NO: 3244983 - RNA, 22 nt, Mycobacterium tuberculosis H37Rv
caucgucgccaagcccaggcga

SEQ ID NO: 3244984 - RNA, 22 nt, Mycobacterium tuberculosis H37Rv
caucgucgccacgaugccggcu

SEQ ID NO: 3244985 - RNA, 16 nt, Mycobacterium tuberculosis H37Rv
caucgucgccgaccgu

SEQ ID NO: 3244986 - RNA, 15 nt, Mycobacterium tuberculosis H37Rv
caucgucgccgagcg

SEQ ID NO: 3244987 - RNA, 14 nt, Mycobacterium tuberculosis H37Rv
caucgucgcgacga

SEQ ID NO: 3244988 - RNA, 19 nt, Mycobacterium tuberculosis H37Rv
caucgucgggucaaugcug

SEQ ID NO: 3244989 - RNA, 19 nt, Mycobacterium tuberculosis H37Rv
caucgucguggugaugucc

SEQ ID NO: 3244990 - RNA, 14 nt, Mycobacterium tuberculosis H37Rv
caucgugcugaagc

SEQ ID NO: 3244991 - RNA, 13 nt, Mycobacterium tuberculosis H37Rv
caucguggccgca

SEQ ID NO: 3244992 - RNA, 15 nt, Mycobacterium tuberculosis H37Rv
caucguggccgcacc

SEQ ID NO: 3244993 - RNA, 21 nt, Mycobacterium tuberculosis H37Rv
caugcccagaaaaccgccgca

SEQ ID NO: 3244994 - RNA, 18 nt, Mycobacterium tuberculosis H37Rv
caugcccaucuccaacag

SEQ ID NO: 3244995 - RNA, 17 nt, Mycobacterium tuberculosis H37Rv
caugccccgaccgcgua

SEQ ID NO: 3244996 - RNA, 17 nt, Mycobacterium tuberculosis H37Rv
caugcccgacgagucgc

SEQ ID NO: 3244997 - RNA, 19 nt, Mycobacterium tuberculosis H37Rv
caugcccgcacgcucggcg

SEQ ID NO: 3244998 - RNA, 23 nt, Mycobacterium tuberculosis H37Rv
caugcccgcggugaccaccccgg

SEQ ID NO: 3244999 - RNA, 15 nt, Mycobacterium tuberculosis H37Rv
caugcccgggaugac

SEQ ID NO: 3245000 - RNA, 19 nt, Mycobacterium tuberculosis H37Rv
caugcccgucagcggacag

SEQ ID NO: 3245001 - RNA, 20 nt, Mycobacterium tuberculosis H37Rv
caugcccucgcuguuggccg

SEQ ID NO: 3245002 - RNA, 16 nt, Mycobacterium tuberculosis H37Rv
caugcccuuguaggcc

SEQ ID NO: 3245003 - RNA, 18 nt, Mycobacterium tuberculosis H37Rv
caugcccuuguaggccau

SEQ ID NO: 3245004 - RNA, 21 nt, Mycobacterium tuberculosis H37Rv
caugccgaacaauaaggccgc

SEQ ID NO: 3245005 - RNA, 17 nt, Mycobacterium tuberculosis H37Rv
caugccgacgacaacag

SEQ ID NO: 3245006 - RNA, 23 nt, Mycobacterium tuberculosis H37Rv
caugccgacgacaacagccagcu

SEQ ID NO: 3245007 - RNA, 21 nt, Mycobacterium tuberculosis H37Rv
caugccgccaugcgcaccagu

SEQ ID NO: 3245008 - RNA, 21 nt, Mycobacterium tuberculosis H37Rv
caugccgcccagugcggccac

SEQ ID NO: 3245009 - RNA, 18 nt, Mycobacterium tuberculosis H37Rv
caugccgcccgcgccgcc

SEQ ID NO: 3245010 - RNA, 15 nt, Mycobacterium tuberculosis H37Rv
caugccgcucggcaa

SEQ ID NO: 3245011 - RNA, 15 nt, Mycobacterium tuberculosis H37Rv
caugccggcgcacca

SEQ ID NO: 3245012 - RNA, 19 nt, Mycobacterium tuberculosis H37Rv
caugccggcgcaccacacc

SEQ ID NO: 3245013 - RNA, 12 nt, Mycobacterium tuberculosis H37Rv
caugccggcgug

SEQ ID NO: 3245014 - RNA, 16 nt, Mycobacterium tuberculosis H37Rv
caugccgggauugccg

SEQ ID NO: 3245015 - RNA, 23 nt, Mycobacterium tuberculosis H37Rv
caugccggucauccgggcgacca

SEQ ID NO: 3245016 - RNA, 13 nt, Mycobacterium tuberculosis H37Rv
caugccgguguug

SEQ ID NO: 3245017 - RNA, 18 nt, Mycobacterium tuberculosis H37Rv
caugccgucgucggcgua

SEQ ID NO: 3245018 - RNA, 20 nt, Mycobacterium tuberculosis H37Rv
caugccuucggccaaccaug

SEQ ID NO: 3245019 - RNA, 16 nt, Mycobacterium tuberculosis H37Rv
caugcgacagaugccg

SEQ ID NO: 3245020 - RNA, 13 nt, Mycobacterium tuberculosis H37Rv
caugcgacgucag

SEQ ID NO: 3245021 - RNA, 19 nt, Mycobacterium tuberculosis H37Rv
caugcgauacacggcggcg

SEQ ID NO: 3245022 - RNA, 13 nt, Mycobacterium tuberculosis H37Rv
caugcgcaccagu

SEQ ID NO: 3245023 - RNA, 13 nt, Mycobacterium tuberculosis H37Rv
caugcgcuccggc

SEQ ID NO: 3245024 - RNA, 19 nt, Mycobacterium tuberculosis H37Rv
caugcgcuggaaugcgguc

SEQ ID NO: 3245025 - RNA, 23 nt, Mycobacterium tuberculosis H37Rv
caugcggaauuugcuugggcccc

SEQ ID NO: 3245026 - RNA, 20 nt, Mycobacterium tuberculosis H37Rv
caugcggauucgcgcugucc

SEQ ID NO: 3245027 - RNA, 22 nt, Mycobacterium tuberculosis H37Rv
caugcggcugccucccuuccgc

SEQ ID NO: 3245028 - RNA, 19 nt, Mycobacterium tuberculosis H37Rv
caugcggguaaaccaggug

SEQ ID NO: 3245029 - RNA, 22 nt, Mycobacterium tuberculosis H37Rv
caugcgggucugacaucggcca

SEQ ID NO: 3245030 - RNA, 19 nt, Mycobacterium tuberculosis H37Rv
caugcgugacccgacaugg

SEQ ID NO: 3245031 - RNA, 15 nt, Mycobacterium tuberculosis H37Rv
caugcuaggaccacc

SEQ ID NO: 3245032 - RNA, 22 nt, Mycobacterium tuberculosis H37Rv
caugcuaggaccaccagcgcuc

SEQ ID NO: 3245033 - RNA, 22 nt, Mycobacterium tuberculosis H37Rv
caugcuaggcaugccacacacu

SEQ ID NO: 3245034 - RNA, 13 nt, Mycobacterium tuberculosis H37Rv
caugcuaggccac

SEQ ID NO: 3245035 - RNA, 23 nt, Mycobacterium tuberculosis H37Rv
caugcucaccgaaacgaugcggc

SEQ ID NO: 3245036 - RNA, 21 nt, Mycobacterium tuberculosis H37Rv
caugcucacgaucacccgcac

SEQ ID NO: 3245037 - RNA, 16 nt, Mycobacterium tuberculosis H37Rv
caugcucacgaucugc

SEQ ID NO: 3245038 - RNA, 18 nt, Mycobacterium tuberculosis H37Rv
caugcucacgaucugcgc

SEQ ID NO: 3245039 - RNA, 21 nt, Mycobacterium tuberculosis H37Rv
caugcucagucgcucucgggc

SEQ ID NO: 3245040 - RNA, 16 nt, Mycobacterium tuberculosis H37Rv
caugcucgacaaccgc

SEQ ID NO: 3245041 - RNA, 19 nt, Mycobacterium tuberculosis H37Rv
caugcucgacgcccgccac

SEQ ID NO: 3245042 - RNA, 21 nt, Mycobacterium tuberculosis H37Rv
caugcucgacgcccgccaccg

SEQ ID NO: 3245043 - RNA, 22 nt, Mycobacterium tuberculosis H37Rv
caugcucgacgcccgccaccgg

SEQ ID NO: 3245044 - RNA, 15 nt, Mycobacterium tuberculosis H37Rv
caugcugcucgagga

SEQ ID NO: 3245045 - RNA, 22 nt, Mycobacterium tuberculosis H37Rv
caugcuggggagggccgucuug

SEQ ID NO: 3245046 - RNA, 18 nt, Mycobacterium tuberculosis H37Rv
cauggaaacccucgaggc

SEQ ID NO: 3245047 - RNA, 16 nt, Mycobacterium tuberculosis H37Rv
cauggauacgcagcac

SEQ ID NO: 3245048 - RNA, 20 nt, Mycobacterium tuberculosis H37Rv
cauggauguaggcuucgccg

SEQ ID NO: 3245049 - RNA, 22 nt, Mycobacterium tuberculosis H37Rv
cauggcacgcgggaagugcacc

SEQ ID NO: 3245050 - RNA, 12 nt, Mycobacterium tuberculosis H37Rv
cauggccaccga

SEQ ID NO: 3245051 - RNA, 20 nt, Mycobacterium tuberculosis H37Rv
cauggccagcaucagcgcca

SEQ ID NO: 3245052 - RNA, 16 nt, Mycobacterium tuberculosis H37Rv
cauggcccgaucgacc

SEQ ID NO: 3245053 - RNA, 20 nt, Mycobacterium tuberculosis H37Rv
cauggcccguuggcagcaca

SEQ ID NO: 3245054 - RNA, 14 nt, Mycobacterium tuberculosis H37Rv
cauggcccuggcga

SEQ ID NO: 3245055 - RNA, 22 nt, Mycobacterium tuberculosis H37Rv
cauggcccuggcgaccagccga

SEQ ID NO: 3245056 - RNA, 18 nt, Mycobacterium tuberculosis H37Rv
cauggccgauuccgcgcg

SEQ ID NO: 3245057 - RNA, 18 nt, Mycobacterium tuberculosis H37Rv
cauggccucccacucacc

SEQ ID NO: 3245058 - RNA, 21 nt, Mycobacterium tuberculosis H37Rv
cauggcgaacacgucggccag

SEQ ID NO: 3245059 - RNA, 16 nt, Mycobacterium tuberculosis H37Rv
cauggcgaaccgucag

SEQ ID NO: 3245060 - RNA, 19 nt, Mycobacterium tuberculosis H37Rv
cauggcgccguugccggcg

SEQ ID NO: 3245061 - RNA, 21 nt, Mycobacterium tuberculosis H37Rv
cauggcgcggguccagccacc

SEQ ID NO: 3245062 - RNA, 23 nt, Mycobacterium tuberculosis H37Rv
cauggcggcagcaacgacgucgu

SEQ ID NO: 3245063 - RNA, 22 nt, Mycobacterium tuberculosis H37Rv
cauggcguucugcgcccguccg

SEQ ID NO: 3245064 - RNA, 15 nt, Mycobacterium tuberculosis H37Rv
cauggcuccgcccag

SEQ ID NO: 3245065 - RNA, 22 nt, Mycobacterium tuberculosis H37Rv
caugggacacaauccacgucgc

SEQ ID NO: 3245066 - RNA, 21 nt, Mycobacterium tuberculosis H37Rv
caugggccaggucagccgcgc

SEQ ID NO: 3245067 - RNA, 17 nt, Mycobacterium tuberculosis H37Rv
caugggccggcgccgca

SEQ ID NO: 3245068 - RNA, 18 nt, Mycobacterium tuberculosis H37Rv
caugggccggcgccgcac

SEQ ID NO: 3245069 - RNA, 18 nt, Mycobacterium tuberculosis H37Rv
caugggcgccaucccgcc

SEQ ID NO: 3245070 - RNA, 21 nt, Mycobacterium tuberculosis H37Rv
caugggggaacccccucgcga

SEQ ID NO: 3245071 - RNA, 14 nt, Mycobacterium tuberculosis H37Rv
cauggggucagcuc

SEQ ID NO: 3245072 - RNA, 16 nt, Mycobacterium tuberculosis H37Rv
cauggguagccgccca

SEQ ID NO: 3245073 - RNA, 20 nt, Mycobacterium tuberculosis H37Rv
caugguagcgccccgaugcu

SEQ ID NO: 3245074 - RNA, 18 nt, Mycobacterium tuberculosis H37Rv
caugguccaaccagcacc

SEQ ID NO: 3245075 - RNA, 21 nt, Mycobacterium tuberculosis H37Rv
caugguccacagccggcggcu

SEQ ID NO: 3245076 - RNA, 16 nt, Mycobacterium tuberculosis H37Rv
caugguccgaccagcg

SEQ ID NO: 3245077 - RNA, 19 nt, Mycobacterium tuberculosis H37Rv
caugguggcgccgaccugg

SEQ ID NO: 3245078 - RNA, 16 nt, Mycobacterium tuberculosis H37Rv
cauguagcggucguag

SEQ ID NO: 3245079 - RNA, 21 nt, Mycobacterium tuberculosis H37Rv
caugucaagcgaugucccauc

SEQ ID NO: 3245080 - RNA, 20 nt, Mycobacterium tuberculosis H37Rv
caugucagcgcugagccgcu

SEQ ID NO: 3245081 - RNA, 16 nt, Mycobacterium tuberculosis H37Rv
caugucagcggccugc

SEQ ID NO: 3245082 - RNA, 17 nt, Mycobacterium tuberculosis H37Rv
cauguccgaccucugcg

SEQ ID NO: 3245083 - RNA, 18 nt, Mycobacterium tuberculosis H37Rv
cauguccgcaguucgguc

SEQ ID NO: 3245084 - RNA, 22 nt, Mycobacterium tuberculosis H37Rv
cauguccugggccgccgcccug

SEQ ID NO: 3245085 - RNA, 18 nt, Mycobacterium tuberculosis H37Rv
caugucgaagaaccggcc

SEQ ID NO: 3245086 - RNA, 19 nt, Mycobacterium tuberculosis H37Rv
caugucgaagaaccggccg

SEQ ID NO: 3245087 - RNA, 23 nt, Mycobacterium tuberculosis H37Rv
caugucgaucagcgcgacggucc

SEQ ID NO: 3245088 - RNA, 15 nt, Mycobacterium tuberculosis H37Rv
ccaaagggaguguuu

SEQ ID NO: 3245089 - RNA, 15 nt, Mycobacterium tuberculosis H37Rv
ccaaaucccagagca

SEQ ID NO: 3245090 - RNA, 17 nt, Mycobacterium tuberculosis H37Rv
ccaacaacuccagcagg

SEQ ID NO: 3245091 - RNA, 18 nt, Mycobacterium tuberculosis H37Rv
ccaacacaaacgccgccg

SEQ ID NO: 3245092 - RNA, 19 nt, Mycobacterium tuberculosis H37Rv
ccaacacaaacgccgccgg

SEQ ID NO: 3245093 - RNA, 13 nt, Mycobacterium tuberculosis H37Rv
ccaacacagccgu

SEQ ID NO: 3245094 - RNA, 17 nt, Mycobacterium tuberculosis H37Rv
ccaacacagccgucgca

SEQ ID NO: 3245095 - RNA, 19 nt, Mycobacterium tuberculosis H37Rv
ccaacaccgccagcaugac

SEQ ID NO: 3245096 - RNA, 14 nt, Mycobacterium tuberculosis H37Rv
ccaacaccgcccgc

SEQ ID NO: 3245097 - RNA, 18 nt, Mycobacterium tuberculosis H37Rv
ccaacaccggcgaucacc

SEQ ID NO: 3245098 - RNA, 21 nt, Mycobacterium tuberculosis H37Rv
ccaacaccuguuugagcgcac

SEQ ID NO: 3245099 - RNA, 16 nt, Mycobacterium tuberculosis H37Rv
ccaacacgucgagcag

SEQ ID NO: 3245100 - RNA, 18 nt, Mycobacterium tuberculosis H37Rv
ccaacacgucgagcagcc

SEQ ID NO: 3245101 - RNA, 21 nt, Mycobacterium tuberculosis H37Rv
ccaacaggccuaggucgacgc

SEQ ID NO: 3245102 - RNA, 20 nt, Mycobacterium tuberculosis H37Rv
ccaacagucgcagcacggcu

SEQ ID NO: 3245103 - RNA, 21 nt, Mycobacterium tuberculosis H37Rv
ccaacauguugucgucgccgc

SEQ ID NO: 3245104 - RNA, 23 nt, Mycobacterium tuberculosis H37Rv
ccaacauguugucgucgccgccg

SEQ ID NO: 3245105 - RNA, 16 nt, Mycobacterium tuberculosis H37Rv
ccaaccacgagcauca

SEQ ID NO: 3245106 - RNA, 15 nt, Mycobacterium tuberculosis H37Rv
ccaaccagcccggcc

SEQ ID NO: 3245107 - RNA, 22 nt, Mycobacterium tuberculosis H37Rv
ccaaccaugcgguuagcagccg

SEQ ID NO: 3245108 - RNA, 15 nt, Mycobacterium tuberculosis H37Rv
ccaacccacccccca

SEQ ID NO: 3245109 - RNA, 16 nt, Mycobacterium tuberculosis H37Rv
ccaaccccauggccag

SEQ ID NO: 3245110 - RNA, 14 nt, Mycobacterium tuberculosis H37Rv
ccaaccccgccggc

SEQ ID NO: 3245111 - RNA, 19 nt, Mycobacterium tuberculosis H37Rv
ccaacccggcgggcccgcc

SEQ ID NO: 3245112 - RNA, 20 nt, Mycobacterium tuberculosis H37Rv
ccaacccggcgggcccgccg

SEQ ID NO: 3245113 - RNA, 16 nt, Mycobacterium tuberculosis H37Rv
ccaacccgggccgcca

SEQ ID NO: 3245114 - RNA, 22 nt, Mycobacterium tuberculosis H37Rv
ccaacccuaaaccagccaccac

SEQ ID NO: 3245115 - RNA, 17 nt, Mycobacterium tuberculosis H37Rv
ccaacccugcggcgucg

SEQ ID NO: 3245116 - RNA, 17 nt, Mycobacterium tuberculosis H37Rv
ccaaccgcauauucacc

SEQ ID NO: 3245117 - RNA, 20 nt, Mycobacterium tuberculosis H37Rv
ccaaccgcgggaacccccca

SEQ ID NO: 3245118 - RNA, 21 nt, Mycobacterium tuberculosis H37Rv
ccaaccgggacaaccccuugc

SEQ ID NO: 3245119 - RNA, 14 nt, Mycobacterium tuberculosis H37Rv
ccaaccgggccgcc

SEQ ID NO: 3245120 - RNA, 21 nt, Mycobacterium tuberculosis H37Rv
ccaaccgggccgccuggagcu

SEQ ID NO: 3245121 - RNA, 17 nt, Mycobacterium tuberculosis H37Rv
ccaaccgguucgucgaa

SEQ ID NO: 3245122 - RNA, 14 nt, Mycobacterium tuberculosis H37Rv
ccaaccuacccuga

SEQ ID NO: 3245123 - RNA, 21 nt, Mycobacterium tuberculosis H37Rv
ccaaccucggaucgccaggcc

SEQ ID NO: 3245124 - RNA, 16 nt, Mycobacterium tuberculosis H37Rv
ccaaccugggccauca

SEQ ID NO: 3245125 - RNA, 13 nt, Mycobacterium tuberculosis H37Rv
ccaacgaccacca

SEQ ID NO: 3245126 - RNA, 12 nt, Mycobacterium tuberculosis H37Rv
ccaacgaccucc

SEQ ID NO: 3245127 - RNA, 21 nt, Mycobacterium tuberculosis H37Rv
ccaacgacuguggcgccgccg

SEQ ID NO: 3245128 - RNA, 19 nt, Mycobacterium tuberculosis H37Rv
ccaacgagaugugagcaca

SEQ ID NO: 3245129 - RNA, 14 nt, Mycobacterium tuberculosis H37Rv
ccaacgagucagug

SEQ ID NO: 3245130 - RNA, 22 nt, Mycobacterium tuberculosis H37Rv
ccaacgcaauaagggagaccgc

SEQ ID NO: 3245131 - RNA, 13 nt, Mycobacterium tuberculosis H37Rv
ccaacgccaccgu

SEQ ID NO: 3245132 - RNA, 14 nt, Mycobacterium tuberculosis H37Rv
ccaacgccaccguc

SEQ ID NO: 3245133 - RNA, 13 nt, Mycobacterium tuberculosis H37Rv
ccaacgccagcgg

SEQ ID NO: 3245134 - RNA, 13 nt, Mycobacterium tuberculosis H37Rv
ccaacgcgaccgc

SEQ ID NO: 3245135 - RNA, 18 nt, Mycobacterium tuberculosis H37Rv
ccaacgcgcaggccgaca

SEQ ID NO: 3245136 - RNA, 20 nt, Mycobacterium tuberculosis H37Rv
ccaacgcgcaggccgacacg

SEQ ID NO: 3245137 - RNA, 15 nt, Mycobacterium tuberculosis H37Rv
ccaacgcgcgaccgc

SEQ ID NO: 3245138 - RNA, 16 nt, Mycobacterium tuberculosis H37Rv
ccaacgcgcgaccgcg

SEQ ID NO: 3245139 - RNA, 19 nt, Mycobacterium tuberculosis H37Rv
ccaacgcgggugccgggca

SEQ ID NO: 3245140 - RNA, 15 nt, Mycobacterium tuberculosis H37Rv
ccaacgcggugacga

SEQ ID NO: 3245141 - RNA, 13 nt, Mycobacterium tuberculosis H37Rv
ccaacgcgguggg

SEQ ID NO: 3245142 - RNA, 21 nt, Mycobacterium tuberculosis H37Rv
ccaacgcggugggcacagcca

SEQ ID NO: 3245143 - RNA, 21 nt, Mycobacterium tuberculosis H37Rv
ccaacgcgucccgccgcaccg

SEQ ID NO: 3245144 - RNA, 22 nt, Mycobacterium tuberculosis H37Rv
ccaacgcgucccgccgcaccgc

SEQ ID NO: 3245145 - RNA, 20 nt, Mycobacterium tuberculosis H37Rv
ccaacgcucccuacgagccc

SEQ ID NO: 3245146 - RNA, 18 nt, Mycobacterium tuberculosis H37Rv
ccaacggcagcgccaccg

SEQ ID NO: 3245147 - RNA, 23 nt, Mycobacterium tuberculosis H37Rv
ccaacgggcagguaggucugggc

SEQ ID NO: 3245148 - RNA, 23 nt, Mycobacterium tuberculosis H37Rv
ccaacggggcagucaacucccga

SEQ ID NO: 3245149 - RNA, 24 nt, Mycobacterium tuberculosis H37Rv
ccaacggguaguucuuggucaggc

SEQ ID NO: 3245150 - RNA, 19 nt, Mycobacterium tuberculosis H37Rv
ccaacgucgacuucagcgg

SEQ ID NO: 3245151 - RNA, 18 nt, Mycobacterium tuberculosis H37Rv
ccaacgucgccaggucau

SEQ ID NO: 3245152 - RNA, 18 nt, Mycobacterium tuberculosis H37Rv
ccaacguuuugggcgccg

SEQ ID NO: 3245153 - RNA, 21 nt, Mycobacterium tuberculosis H37Rv
ccaacuccaagaugccgcccc

SEQ ID NO: 3245154 - RNA, 13 nt, Mycobacterium tuberculosis H37Rv
ccaacucgaccga

SEQ ID NO: 3245155 - RNA, 14 nt, Mycobacterium tuberculosis H37Rv
ccaacucggccagc

SEQ ID NO: 3245156 - RNA, 13 nt, Mycobacterium tuberculosis H37Rv
ccaacucggcccg

SEQ ID NO: 3245157 - RNA, 13 nt, Mycobacterium tuberculosis H37Rv
ccaacucggcgac

SEQ ID NO: 3245158 - RNA, 18 nt, Mycobacterium tuberculosis H37Rv
ccaacucgguucgccccu

SEQ ID NO: 3245159 - RNA, 23 nt, Mycobacterium tuberculosis H37Rv
ccaacucguggaacuccguccgc

SEQ ID NO: 3245160 - RNA, 22 nt, Mycobacterium tuberculosis H37Rv
ccaacucuucagcaagccaacc

SEQ ID NO: 3245161 - RNA, 14 nt, Mycobacterium tuberculosis H37Rv
ccaacugaaccgag

SEQ ID NO: 3245162 - RNA, 18 nt, Mycobacterium tuberculosis H37Rv
ccaacugaauggcaccga

SEQ ID NO: 3245163 - RNA, 20 nt, Mycobacterium tuberculosis H37Rv
ccaacugaauggcaccgagg

SEQ ID NO: 3245164 - RNA, 14 nt, Mycobacterium tuberculosis H37Rv
ccaacugaucccgu

SEQ ID NO: 3245165 - RNA, 16 nt, Mycobacterium tuberculosis H37Rv
ccaacugggccgagcg

SEQ ID NO: 3245166 - RNA, 13 nt, Mycobacterium tuberculosis H37Rv
ccaacuucaccac

SEQ ID NO: 3245167 - RNA, 18 nt, Mycobacterium tuberculosis H37Rv
ccaacuucaccacccugu

SEQ ID NO: 3245168 - RNA, 17 nt, Mycobacterium tuberculosis H37Rv
ccaacuuggcggccagc

SEQ ID NO: 3245169 - RNA, 21 nt, Mycobacterium tuberculosis H37Rv
ccaacuuggcggccagccgcu

SEQ ID NO: 3245170 - RNA, 12 nt, Mycobacterium tuberculosis H37Rv
ccaagacaccgg

SEQ ID NO: 3245171 - RNA, 15 nt, Mycobacterium tuberculosis H37Rv
ccaagacgucggcgu

SEQ ID NO: 3245172 - RNA, 18 nt, Mycobacterium tuberculosis H37Rv
ccaagaucggcgccccug

SEQ ID NO: 3245173 - RNA, 12 nt, Mycobacterium tuberculosis H37Rv
ccaagauggcgc

SEQ ID NO: 3245174 - RNA, 22 nt, Mycobacterium tuberculosis H37Rv
ccaagcagcugggcaucaccgc

SEQ ID NO: 3245175 - RNA, 18 nt, Mycobacterium tuberculosis H37Rv
ccaagccauguggcgucg

SEQ ID NO: 3245176 - RNA, 13 nt, Mycobacterium tuberculosis H37Rv
ccaagcccgccgg

SEQ ID NO: 3245177 - RNA, 21 nt, Mycobacterium tuberculosis H37Rv
ccaagccgcggcuaggccagc

SEQ ID NO: 3245178 - RNA, 16 nt, Mycobacterium tuberculosis H37Rv
ccaagccggagcccgg

SEQ ID NO: 3245179 - RNA, 19 nt, Mycobacterium tuberculosis H37Rv
ccaagccggcugcauccuc

SEQ ID NO: 3245180 - RNA, 18 nt, Mycobacterium tuberculosis H37Rv
ccaagccgggugggagca

SEQ ID NO: 3245181 - RNA, 21 nt, Mycobacterium tuberculosis H37Rv
ccaagccgggugggagcagcc

SEQ ID NO: 3245182 - RNA, 22 nt, Mycobacterium tuberculosis H37Rv
ccaagccgggugggagcagccg

SEQ ID NO: 3245183 - RNA, 23 nt, Mycobacterium tuberculosis H37Rv
ccaagccguaguaguggccgcca

SEQ ID NO: 3245184 - RNA, 23 nt, Mycobacterium tuberculosis H37Rv
ccacaggggcagcgcggccaccc

SEQ ID NO: 3245185 - RNA, 16 nt, Mycobacterium tuberculosis H37Rv
ccacagguagaccguc

SEQ ID NO: 3245186 - RNA, 17 nt, Mycobacterium tuberculosis H37Rv
ccacagguuugcgccgc

SEQ ID NO: 3245187 - RNA, 21 nt, Mycobacterium tuberculosis H37Rv
ccacagucgccggccggcccg

SEQ ID NO: 3245188 - RNA, 18 nt, Mycobacterium tuberculosis H37Rv
ccacagucgucgagcgcu

SEQ ID NO: 3245189 - RNA, 16 nt, Mycobacterium tuberculosis H37Rv
ccacagucgugagcca

SEQ ID NO: 3245190 - RNA, 22 nt, Mycobacterium tuberculosis H37Rv
ccacagugaaauccgagccgcg

SEQ ID NO: 3245191 - RNA, 17 nt, Mycobacterium tuberculosis H37Rv
ccacauacaggcccgcc

SEQ ID NO: 3245192 - RNA, 13 nt, Mycobacterium tuberculosis H37Rv
ccacauaccccga

SEQ ID NO: 3245193 - RNA, 17 nt, Mycobacterium tuberculosis H37Rv
ccacaucaaaacggcgg

SEQ ID NO: 3245194 - RNA, 17 nt, Mycobacterium tuberculosis H37Rv
ccacaucaccggcgauc

SEQ ID NO: 3245195 - RNA, 15 nt, Mycobacterium tuberculosis H37Rv
ccacaucagccgcac

SEQ ID NO: 3245196 - RNA, 19 nt, Mycobacterium tuberculosis H37Rv
ccacaucagccgcaccagu

SEQ ID NO: 3245197 - RNA, 16 nt, Mycobacterium tuberculosis H37Rv
ccacaucaugccagcc

SEQ ID NO: 3245198 - RNA, 20 nt, Mycobacterium tuberculosis H37Rv
ccacauccaacgaccuccac

SEQ ID NO: 3245199 - RNA, 20 nt, Mycobacterium tuberculosis H37Rv
ccacauccuggcggcugcag

SEQ ID NO: 3245200 - RNA, 19 nt, Mycobacterium tuberculosis H37Rv
ccacaucgaugucggcucg

SEQ ID NO: 3245201 - RNA, 14 nt, Mycobacterium tuberculosis H37Rv
ccacaucgccagca

SEQ ID NO: 3245202 - RNA, 12 nt, Mycobacterium tuberculosis H37Rv
ccacaucggugu

SEQ ID NO: 3245203 - RNA, 21 nt, Mycobacterium tuberculosis H37Rv
ccacaugacgaucgcggcggg

SEQ ID NO: 3245204 - RNA, 21 nt, Mycobacterium tuberculosis H37Rv
ccacaugaucgagcaguucca

SEQ ID NO: 3245205 - RNA, 17 nt, Mycobacterium tuberculosis H37Rv
ccacaugguacggacgc

SEQ ID NO: 3245206 - RNA, 13 nt, Mycobacterium tuberculosis H37Rv
ccacauguccagc

SEQ ID NO: 3245207 - RNA, 23 nt, Mycobacterium tuberculosis H37Rv
ccacauguucuccucgucgcggg

SEQ ID NO: 3245208 - RNA, 18 nt, Mycobacterium tuberculosis H37Rv
ccacauuccgcagucccg

SEQ ID NO: 3245209 - RNA, 20 nt, Mycobacterium tuberculosis H37Rv
ccacauuccgcagucccgaa

SEQ ID NO: 3245210 - RNA, 20 nt, Mycobacterium tuberculosis H37Rv
ccacauuccguagccggcgg

SEQ ID NO: 3245211 - RNA, 21 nt, Mycobacterium tuberculosis H37Rv
ccacauuggcgaucagcagcc

SEQ ID NO: 3245212 - RNA, 14 nt, Mycobacterium tuberculosis H37Rv
ccaccaaaccccaa

SEQ ID NO: 3245213 - RNA, 15 nt, Mycobacterium tuberculosis H37Rv
ccaccaaaccgccgg

SEQ ID NO: 3245214 - RNA, 21 nt, Mycobacterium tuberculosis H37Rv
ccaccaaacgcugcuggcaug

SEQ ID NO: 3245215 - RNA, 16 nt, Mycobacterium tuberculosis H37Rv
ccaccaacgagucagu

SEQ ID NO: 3245216 - RNA, 13 nt, Mycobacterium tuberculosis H37Rv
ccaccaacucggc

SEQ ID NO: 3245217 - RNA, 14 nt, Mycobacterium tuberculosis H37Rv
ccaccaagcucgca

SEQ ID NO: 3245218 - RNA, 19 nt, Mycobacterium tuberculosis H37Rv
ccaccaagcucgcaaccga

SEQ ID NO: 3245219 - RNA, 19 nt, Mycobacterium tuberculosis H37Rv
ccaccaagguguggccuug

SEQ ID NO: 3245220 - RNA, 14 nt, Mycobacterium tuberculosis H37Rv
ccaccacagacgac

SEQ ID NO: 3245221 - RNA, 22 nt, Mycobacterium tuberculosis H37Rv
ccaccacaucgcgggcgugccg

SEQ ID NO: 3245222 - RNA, 18 nt, Mycobacterium tuberculosis H37Rv
ccaccacaugcgagucgc

SEQ ID NO: 3245223 - RNA, 15 nt, Mycobacterium tuberculosis H37Rv
ccaccacccaggcca

SEQ ID NO: 3245224 - RNA, 12 nt, Mycobacterium tuberculosis H37Rv
ccaccaccgcuc

SEQ ID NO: 3245225 - RNA, 15 nt, Mycobacterium tuberculosis H37Rv
ccaccaccggcgccu

SEQ ID NO: 3245226 - RNA, 13 nt, Mycobacterium tuberculosis H37Rv
ccaccaccuccgc

SEQ ID NO: 3245227 - RNA, 14 nt, Mycobacterium tuberculosis H37Rv
ccaccaccuccgcg

SEQ ID NO: 3245228 - RNA, 14 nt, Mycobacterium tuberculosis H37Rv
ccaccaccuggccg

SEQ ID NO: 3245229 - RNA, 18 nt, Mycobacterium tuberculosis H37Rv
ccaccacgacgucgguga

SEQ ID NO: 3245230 - RNA, 13 nt, Mycobacterium tuberculosis H37Rv
ccaccacgccguc

SEQ ID NO: 3245231 - RNA, 19 nt, Mycobacterium tuberculosis H37Rv
ccaccacgccgucgacaac

SEQ ID NO: 3245232 - RNA, 22 nt, Mycobacterium tuberculosis H37Rv
ccaccacggccagaaacccggc

SEQ ID NO: 3245233 - RNA, 23 nt, Mycobacterium tuberculosis H37Rv
ccaccacggucaagccggcgccc

SEQ ID NO: 3245234 - RNA, 23 nt, Mycobacterium tuberculosis H37Rv
ccaccacgucgggaugcccgcug

SEQ ID NO: 3245235 - RNA, 21 nt, Mycobacterium tuberculosis H37Rv
ccaccacuaggucgccggcca

SEQ ID NO: 3245236 - RNA, 14 nt, Mycobacterium tuberculosis H37Rv
ccaccacugcgccc

SEQ ID NO: 3245237 - RNA, 18 nt, Mycobacterium tuberculosis H37Rv
ccaccacugcgcccgcca

SEQ ID NO: 3245238 - RNA, 17 nt, Mycobacterium tuberculosis H37Rv
ccaccacugcggccgcg

SEQ ID NO: 3245239 - RNA, 22 nt, Mycobacterium tuberculosis H37Rv
ccaccacugugacacccgaggg

SEQ ID NO: 3245240 - RNA, 13 nt, Mycobacterium tuberculosis H37Rv
ccaccagaaacac

SEQ ID NO: 3245241 - RNA, 12 nt, Mycobacterium tuberculosis H37Rv
ccaccagaacca

SEQ ID NO: 3245242 - RNA, 12 nt, Mycobacterium tuberculosis H37Rv
ccaccagaaucc

SEQ ID NO: 3245243 - RNA, 14 nt, Mycobacterium tuberculosis H37Rv
ccaccagacaacgc

SEQ ID NO: 3245244 - RNA, 13 nt, Mycobacterium tuberculosis H37Rv
ccaccagcaccgc

SEQ ID NO: 3245245 - RNA, 12 nt, Mycobacterium tuberculosis H37Rv
ccaccagcgccc

SEQ ID NO: 3245246 - RNA, 17 nt, Mycobacterium tuberculosis H37Rv
ccaccagcgcccggccc

SEQ ID NO: 3245247 - RNA, 18 nt, Mycobacterium tuberculosis H37Rv
ccaccagcgcccggcccg

SEQ ID NO: 3245248 - RNA, 16 nt, Mycobacterium tuberculosis H37Rv
ccaccagcgccuugac

SEQ ID NO: 3245249 - RNA, 18 nt, Mycobacterium tuberculosis H37Rv
ccaccaggacguggucgg

SEQ ID NO: 3245250 - RNA, 13 nt, Mycobacterium tuberculosis H37Rv
ccaccaggcuguc

SEQ ID NO: 3245251 - RNA, 23 nt, Mycobacterium tuberculosis H37Rv
ccaccagggacgaugcccuccuc

SEQ ID NO: 3245252 - RNA, 16 nt, Mycobacterium tuberculosis H37Rv
ccaccagggccaccgc

SEQ ID NO: 3245253 - RNA, 20 nt, Mycobacterium tuberculosis H37Rv
ccaccaggggaccgcggcgc

SEQ ID NO: 3245254 - RNA, 12 nt, Mycobacterium tuberculosis H37Rv
ccaccaggucgg

SEQ ID NO: 3245255 - RNA, 17 nt, Mycobacterium tuberculosis H37Rv
ccaccagugagcccgcu

SEQ ID NO: 3245256 - RNA, 19 nt, Mycobacterium tuberculosis H37Rv
ccaccagugagcccgcuuc

SEQ ID NO: 3245257 - RNA, 22 nt, Mycobacterium tuberculosis H37Rv
ccaccagugcgggguccagcgg

SEQ ID NO: 3245258 - RNA, 21 nt, Mycobacterium tuberculosis H37Rv
ccaccaguuccgggguggacg

SEQ ID NO: 3245259 - RNA, 16 nt, Mycobacterium tuberculosis H37Rv
ccaccaucaccgccuu

SEQ ID NO: 3245260 - RNA, 23 nt, Mycobacterium tuberculosis H37Rv
ccaccaucaccgccuuugccgcc

SEQ ID NO: 3245261 - RNA, 15 nt, Mycobacterium tuberculosis H37Rv
ccaccaucaccucgc

SEQ ID NO: 3245262 - RNA, 14 nt, Mycobacterium tuberculosis H37Rv
ccaccaucacggug

SEQ ID NO: 3245263 - RNA, 14 nt, Mycobacterium tuberculosis H37Rv
ccaccaucgccucg

SEQ ID NO: 3245264 - RNA, 15 nt, Mycobacterium tuberculosis H37Rv
ccaccaucgccucgg

SEQ ID NO: 3245265 - RNA, 23 nt, Mycobacterium tuberculosis H37Rv
ccaccaucgccucggcgcugcgc

SEQ ID NO: 3245266 - RNA, 23 nt, Mycobacterium tuberculosis H37Rv
ccaccaucuguuccgugccagcu

SEQ ID NO: 3245267 - RNA, 24 nt, Mycobacterium tuberculosis H37Rv
ccacccaacgcggugggcacagcc

SEQ ID NO: 3245268 - RNA, 19 nt, Mycobacterium tuberculosis H37Rv
ccacccacauggcggcccg

SEQ ID NO: 3245269 - RNA, 13 nt, Mycobacterium tuberculosis H37Rv
ccacccaccacag

SEQ ID NO: 3245270 - RNA, 13 nt, Mycobacterium tuberculosis H37Rv
ccacccaccgaca

SEQ ID NO: 3245271 - RNA, 13 nt, Mycobacterium tuberculosis H37Rv
ccacccagaugca

SEQ ID NO: 3245272 - RNA, 16 nt, Mycobacterium tuberculosis H37Rv
ccacccagaugcagcg

SEQ ID NO: 3245273 - RNA, 12 nt, Mycobacterium tuberculosis H37Rv
ccacccaggccg

SEQ ID NO: 3245274 - RNA, 15 nt, Mycobacterium tuberculosis H37Rv
ccacccauauccgag

SEQ ID NO: 3245275 - RNA, 14 nt, Mycobacterium tuberculosis H37Rv
ccaccccacccagc

SEQ ID NO: 3245276 - RNA, 14 nt, Mycobacterium tuberculosis H37Rv
ccacccccaccgaa

SEQ ID NO: 3245277 - RNA, 13 nt, Mycobacterium tuberculosis H37Rv
ccacccccgguuc

SEQ ID NO: 3245278 - RNA, 15 nt, Mycobacterium tuberculosis H37Rv
ccaccccgagcucac

SEQ ID NO: 3245279 - RNA, 18 nt, Mycobacterium tuberculosis H37Rv
ccaccccgagcucaccaa

SEQ ID NO: 3245280 - RNA, 20 nt, Mycobacterium tuberculosis H37Rv
ccaccccgaggccgaccucg

SEQ ID NO: 3245281 - RNA, 21 nt, Mycobacterium tuberculosis H37Rv
ccaccggcacccccgucgcca

SEQ ID NO: 3245282 - RNA, 14 nt, Mycobacterium tuberculosis H37Rv
ccaccggcacccgc

SEQ ID NO: 3245283 - RNA, 20 nt, Mycobacterium tuberculosis H37Rv
ccaccggcaccgccugcgcc

SEQ ID NO: 3245284 - RNA, 21 nt, Mycobacterium tuberculosis H37Rv
ccaccggcaccgccugcgccg

SEQ ID NO: 3245285 - RNA, 16 nt, Mycobacterium tuberculosis H37Rv
ccaccggcaccgcugc

SEQ ID NO: 3245286 - RNA, 15 nt, Mycobacterium tuberculosis H37Rv
ccaccggcacgguga

SEQ ID NO: 3245287 - RNA, 12 nt, Mycobacterium tuberculosis H37Rv
ccaccggccacc

SEQ ID NO: 3245288 - RNA, 14 nt, Mycobacterium tuberculosis H37Rv
ccaccggccagugg

SEQ ID NO: 3245289 - RNA, 12 nt, Mycobacterium tuberculosis H37Rv
ccaccggcccca

SEQ ID NO: 3245290 - RNA, 15 nt, Mycobacterium tuberculosis H37Rv
ccaccggcccucgcc

SEQ ID NO: 3245291 - RNA, 13 nt, Mycobacterium tuberculosis H37Rv
ccaccggccgcgc

SEQ ID NO: 3245292 - RNA, 21 nt, Mycobacterium tuberculosis H37Rv
ccaccggccggcgcaguggug

SEQ ID NO: 3245293 - RNA, 14 nt, Mycobacterium tuberculosis H37Rv
ccaccggccguccc

SEQ ID NO: 3245294 - RNA, 22 nt, Mycobacterium tuberculosis H37Rv
ccaccggccgucccgcgagcag

SEQ ID NO: 3245295 - RNA, 15 nt, Mycobacterium tuberculosis H37Rv
ccaccggcgccgccg

SEQ ID NO: 3245296 - RNA, 16 nt, Mycobacterium tuberculosis H37Rv
ccaccggcgccgccgg

SEQ ID NO: 3245297 - RNA, 18 nt, Mycobacterium tuberculosis H37Rv
ccaccggcgccgccggca

SEQ ID NO: 3245298 - RNA, 21 nt, Mycobacterium tuberculosis H37Rv
ccaccggcgccggaguugaag

SEQ ID NO: 3245299 - RNA, 17 nt, Mycobacterium tuberculosis H37Rv
ccaccggcgccguguca

SEQ ID NO: 3245300 - RNA, 16 nt, Mycobacterium tuberculosis H37Rv
ccaccggcgcgaccgc

SEQ ID NO: 3245301 - RNA, 15 nt, Mycobacterium tuberculosis H37Rv
ccaccggcguccagu

SEQ ID NO: 3245302 - RNA, 19 nt, Mycobacterium tuberculosis H37Rv
ccaccggcgucgacgucgg

SEQ ID NO: 3245303 - RNA, 22 nt, Mycobacterium tuberculosis H37Rv
ccaccggcgucgacgucggccc

SEQ ID NO: 3245304 - RNA, 23 nt, Mycobacterium tuberculosis H37Rv
ccaccggcgucugcccgcccagc

SEQ ID NO: 3245305 - RNA, 20 nt, Mycobacterium tuberculosis H37Rv
ccaccggcugauucgagcca

SEQ ID NO: 3245306 - RNA, 12 nt, Mycobacterium tuberculosis H37Rv
ccaccggcuggu

SEQ ID NO: 3245307 - RNA, 21 nt, Mycobacterium tuberculosis H37Rv
ccaccggcuggugccuuacca

SEQ ID NO: 3245308 - RNA, 14 nt, Mycobacterium tuberculosis H37Rv
ccaccgggcccgcc

SEQ ID NO: 3245309 - RNA, 15 nt, Mycobacterium tuberculosis H37Rv
ccaccgggcccgccg

SEQ ID NO: 3245310 - RNA, 19 nt, Mycobacterium tuberculosis H37Rv
ccaccgggcccgccguccc

SEQ ID NO: 3245311 - RNA, 16 nt, Mycobacterium tuberculosis H37Rv
ccaccgggccgacagc

SEQ ID NO: 3245312 - RNA, 21 nt, Mycobacterium tuberculosis H37Rv
ccaccgggcgugcggcggccc

SEQ ID NO: 3245313 - RNA, 21 nt, Mycobacterium tuberculosis H37Rv
ccaccggggaagaucucggcc

SEQ ID NO: 3245314 - RNA, 23 nt, Mycobacterium tuberculosis H37Rv
ccaccggggaagaucucggccag

SEQ ID NO: 3245315 - RNA, 16 nt, Mycobacterium tuberculosis H37Rv
ccaccgguaccgccac

SEQ ID NO: 3245316 - RNA, 19 nt, Mycobacterium tuberculosis H37Rv
ccaccgguaccgccggcuc

SEQ ID NO: 3245317 - RNA, 12 nt, Mycobacterium tuberculosis H37Rv
ccaccggucgcg

SEQ ID NO: 3245318 - RNA, 16 nt, Mycobacterium tuberculosis H37Rv
ccaccggugccggcga

SEQ ID NO: 3245319 - RNA, 18 nt, Mycobacterium tuberculosis H37Rv
ccaccgguuaaccuccag

SEQ ID NO: 3245320 - RNA, 22 nt, Mycobacterium tuberculosis H37Rv
ccaccgguuaaccuccaggucg

SEQ ID NO: 3245321 - RNA, 23 nt, Mycobacterium tuberculosis H37Rv
ccaccguagccagcaggaacgcc

SEQ ID NO: 3245322 - RNA, 16 nt, Mycobacterium tuberculosis H37Rv
ccaccguagccgaggg

SEQ ID NO: 3245323 - RNA, 13 nt, Mycobacterium tuberculosis H37Rv
ccaccgucaccgc

SEQ ID NO: 3245324 - RNA, 19 nt, Mycobacterium tuberculosis H37Rv
ccaccgucaccgccggcac

SEQ ID NO: 3245325 - RNA, 18 nt, Mycobacterium tuberculosis H37Rv
ccaccgucaccgccguca

SEQ ID NO: 3245326 - RNA, 19 nt, Mycobacterium tuberculosis H37Rv
ccaccgucgccgccggucc

SEQ ID NO: 3245327 - RNA, 22 nt, Mycobacterium tuberculosis H37Rv
ccaccgucuccggcgccaccgc

SEQ ID NO: 3245328 - RNA, 17 nt, Mycobacterium tuberculosis H37Rv
ccaccgucucgccgcgc

SEQ ID NO: 3245329 - RNA, 15 nt, Mycobacterium tuberculosis H37Rv
ccaccgugacggcca

SEQ ID NO: 3245330 - RNA, 18 nt, Mycobacterium tuberculosis H37Rv
ccaccgugccgggcgacg

SEQ ID NO: 3245331 - RNA, 14 nt, Mycobacterium tuberculosis H37Rv
ccaccguggccgca

SEQ ID NO: 3245332 - RNA, 22 nt, Mycobacterium tuberculosis H37Rv
ccaccgugguggacgaccgcgc

SEQ ID NO: 3245333 - RNA, 23 nt, Mycobacterium tuberculosis H37Rv
ccaccgugucacgcgaccaccgc

SEQ ID NO: 3245334 - RNA, 15 nt, Mycobacterium tuberculosis H37Rv
ccaccguuaccgccg

SEQ ID NO: 3245335 - RNA, 16 nt, Mycobacterium tuberculosis H37Rv
ccaccguuaccgccgu

SEQ ID NO: 3245336 - RNA, 22 nt, Mycobacterium tuberculosis H37Rv
ccaccguugccgccgucaccgc

SEQ ID NO: 3245337 - RNA, 20 nt, Mycobacterium tuberculosis H37Rv
ccaccguuugcgcaccgguc

SEQ ID NO: 3245338 - RNA, 21 nt, Mycobacterium tuberculosis H37Rv
ccaccucaccgaucucgacca

SEQ ID NO: 3245339 - RNA, 16 nt, Mycobacterium tuberculosis H37Rv
ccaccucccacgccgc

SEQ ID NO: 3245340 - RNA, 17 nt, Mycobacterium tuberculosis H37Rv
ccaccuccgaggccgcc

SEQ ID NO: 3245341 - RNA, 19 nt, Mycobacterium tuberculosis H37Rv
ccaccuccgaggccgccau

SEQ ID NO: 3245342 - RNA, 18 nt, Mycobacterium tuberculosis H37Rv
ccaccucgacgagcacca

SEQ ID NO: 3245343 - RNA, 15 nt, Mycobacterium tuberculosis H37Rv
ccaccucgacgcacc

SEQ ID NO: 3245344 - RNA, 19 nt, Mycobacterium tuberculosis H37Rv
ccaccucgauggcguccau

SEQ ID NO: 3245345 - RNA, 18 nt, Mycobacterium tuberculosis H37Rv
ccaccucggugaccaggc

SEQ ID NO: 3245346 - RNA, 20 nt, Mycobacterium tuberculosis H37Rv
ccaccucggugaccaggccg

SEQ ID NO: 3245347 - RNA, 22 nt, Mycobacterium tuberculosis H37Rv
ccaccucggugaccaggccggc

SEQ ID NO: 3245348 - RNA, 20 nt, Mycobacterium tuberculosis H37Rv
ccaccucuucucggacacgc

SEQ ID NO: 3245349 - RNA, 14 nt, Mycobacterium tuberculosis H37Rv
ccaccuggaucagc

SEQ ID NO: 3245350 - RNA, 16 nt, Mycobacterium tuberculosis H37Rv
ccaccugugcgaacag

SEQ ID NO: 3245351 - RNA, 23 nt, Mycobacterium tuberculosis H37Rv
ccaccuguuggcaugccgcccgc

SEQ ID NO: 3245352 - RNA, 23 nt, Mycobacterium tuberculosis H37Rv
ccaccuuagcgcuugccgcugag

SEQ ID NO: 3245353 - RNA, 22 nt, Mycobacterium tuberculosis H37Rv
ccaccuucugguccagcaccgg

SEQ ID NO: 3245354 - RNA, 15 nt, Mycobacterium tuberculosis H37Rv
ccaccuuggacacca

SEQ ID NO: 3245355 - RNA, 20 nt, Mycobacterium tuberculosis H37Rv
ccaccuuggcugggcccgcc

SEQ ID NO: 3245356 - RNA, 17 nt, Mycobacterium tuberculosis H37Rv
ccaccuugugcaggccc

SEQ ID NO: 3245357 - RNA, 21 nt, Mycobacterium tuberculosis H37Rv
ccacgaacgcuuccagcgugu

SEQ ID NO: 3245358 - RNA, 22 nt, Mycobacterium tuberculosis H37Rv
ccacgacacuaggggcggggcu

SEQ ID NO: 3245359 - RNA, 23 nt, Mycobacterium tuberculosis H37Rv
ccacgacaggucgcccggucucg

SEQ ID NO: 3245360 - RNA, 13 nt, Mycobacterium tuberculosis H37Rv
ccacgaccgccga

SEQ ID NO: 3245361 - RNA, 16 nt, Mycobacterium tuberculosis H37Rv
ccacgaccucgggauc

SEQ ID NO: 3245362 - RNA, 21 nt, Mycobacterium tuberculosis H37Rv
ccacgacguucgacgacagca

SEQ ID NO: 3245363 - RNA, 13 nt, Mycobacterium tuberculosis H37Rv
ccacgagcagccg

SEQ ID NO: 3245364 - RNA, 17 nt, Mycobacterium tuberculosis H37Rv
ccacgaggcuugcggca

SEQ ID NO: 3245365 - RNA, 18 nt, Mycobacterium tuberculosis H37Rv
ccacgaguuggccaagca

SEQ ID NO: 3245366 - RNA, 13 nt, Mycobacterium tuberculosis H37Rv
ccacgaucagcag

SEQ ID NO: 3245367 - RNA, 15 nt, Mycobacterium tuberculosis H37Rv
ccacgaucagcagcg

SEQ ID NO: 3245368 - RNA, 13 nt, Mycobacterium tuberculosis H37Rv
ccacgauccuugg

SEQ ID NO: 3245369 - RNA, 13 nt, Mycobacterium tuberculosis H37Rv
ccacgaucggccc

SEQ ID NO: 3245370 - RNA, 15 nt, Mycobacterium tuberculosis H37Rv
ccacgaucggcccag

SEQ ID NO: 3245371 - RNA, 20 nt, Mycobacterium tuberculosis H37Rv
ccacgaucggcccagcccuu

SEQ ID NO: 3245372 - RNA, 23 nt, Mycobacterium tuberculosis H37Rv
ccacgaucggcugguuacucacc

SEQ ID NO: 3245373 - RNA, 20 nt, Mycobacterium tuberculosis H37Rv
ccacgaucuguggaagcccg

SEQ ID NO: 3245374 - RNA, 20 nt, Mycobacterium tuberculosis H37Rv
ccacgauggcggccaccguc

SEQ ID NO: 3245375 - RNA, 14 nt, Mycobacterium tuberculosis H37Rv
ccacgaugucgucg

SEQ ID NO: 3245376 - RNA, 19 nt, Mycobacterium tuberculosis H37Rv
ccacgcacaauacggucag

SEQ ID NO: 3245377 - RNA, 14 nt, Mycobacterium tuberculosis H37Rv
ccacguccucagcc

SEQ ID NO: 3245378 - RNA, 21 nt, Mycobacterium tuberculosis H37Rv
ccacguccucagccgugccca

SEQ ID NO: 3245379 - RNA, 16 nt, Mycobacterium tuberculosis H37Rv
ccacgucgacggucug

SEQ ID NO: 3245380 - RNA, 12 nt, Mycobacterium tuberculosis H37Rv
ccacgucgagca

SEQ ID NO: 3245381 - RNA, 15 nt, Mycobacterium tuberculosis H37Rv
ccacgucgagcaccc

SEQ ID NO: 3245382 - RNA, 19 nt, Mycobacterium tuberculosis H37Rv
ccacgucgagcacccgcuc

SEQ ID NO: 3245383 - RNA, 21 nt, Mycobacterium tuberculosis H37Rv
ccacgucgagcacccgcucca

SEQ ID NO: 3245384 - RNA, 19 nt, Mycobacterium tuberculosis H37Rv
ccacgucgaugugcgccca

SEQ ID NO: 3245385 - RNA, 20 nt, Mycobacterium tuberculosis H37Rv
ccacgucgcggcguuguugc

SEQ ID NO: 3245386 - RNA, 12 nt, Mycobacterium tuberculosis H37Rv
ccacgucgguga

SEQ ID NO: 3245387 - RNA, 15 nt, Mycobacterium tuberculosis H37Rv
ccacgucgucgccca

SEQ ID NO: 3245388 - RNA, 14 nt, Mycobacterium tuberculosis H37Rv
ccacgucucgauca

SEQ ID NO: 3245389 - RNA, 14 nt, Mycobacterium tuberculosis H37Rv
ccacgugaucagau

SEQ ID NO: 3245390 - RNA, 21 nt, Mycobacterium tuberculosis H37Rv
ccacguguggugugucaccgg

SEQ ID NO: 3245391 - RNA, 15 nt, Mycobacterium tuberculosis H37Rv
ccacguuacgcucgc

SEQ ID NO: 3245392 - RNA, 16 nt, Mycobacterium tuberculosis H37Rv
ccacguucgcgggcgu

SEQ ID NO: 3245393 - RNA, 20 nt, Mycobacterium tuberculosis H37Rv
ccacguugacggcgaacccg

SEQ ID NO: 3245394 - RNA, 20 nt, Mycobacterium tuberculosis H37Rv
ccacguugaugaugccggcg

SEQ ID NO: 3245395 - RNA, 14 nt, Mycobacterium tuberculosis H37Rv
ccacguugcugaug

SEQ ID NO: 3245396 - RNA, 12 nt, Mycobacterium tuberculosis H37Rv
ccacuacggccu

SEQ ID NO: 3245397 - RNA, 17 nt, Mycobacterium tuberculosis H37Rv
ccacuaggucgccggcc

SEQ ID NO: 3245398 - RNA, 16 nt, Mycobacterium tuberculosis H37Rv
ccacuccacgcagccc

SEQ ID NO: 3245399 - RNA, 14 nt, Mycobacterium tuberculosis H37Rv
ccacucccgccccg

SEQ ID NO: 3245400 - RNA, 16 nt, Mycobacterium tuberculosis H37Rv
ccacuccgccaacauc

SEQ ID NO: 3245401 - RNA, 15 nt, Mycobacterium tuberculosis H37Rv
ccacuccgguggcca

SEQ ID NO: 3245402 - RNA, 16 nt, Mycobacterium tuberculosis H37Rv
ccacucgcggauccgg

SEQ ID NO: 3245403 - RNA, 18 nt, Mycobacterium tuberculosis H37Rv
ccacucgcucaggaacaa

SEQ ID NO: 3245404 - RNA, 13 nt, Mycobacterium tuberculosis H37Rv
ccacucggacccg

SEQ ID NO: 3245405 - RNA, 20 nt, Mycobacterium tuberculosis H37Rv
ccacucggucguugccgcgg

SEQ ID NO: 3245406 - RNA, 14 nt, Mycobacterium tuberculosis H37Rv
ccacugagccacag

SEQ ID NO: 3245407 - RNA, 16 nt, Mycobacterium tuberculosis H37Rv
ccacugagucugaugg

SEQ ID NO: 3245408 - RNA, 16 nt, Mycobacterium tuberculosis H37Rv
ccacugaucaggccga

SEQ ID NO: 3245409 - RNA, 14 nt, Mycobacterium tuberculosis H37Rv
ccacugcacccgau

SEQ ID NO: 3245410 - RNA, 18 nt, Mycobacterium tuberculosis H37Rv
ccacugcaucacgccguc

SEQ ID NO: 3245411 - RNA, 20 nt, Mycobacterium tuberculosis H37Rv
ccacugcaugaacugcucgc

SEQ ID NO: 3245412 - RNA, 15 nt, Mycobacterium tuberculosis H37Rv
ccacugccagccgug

SEQ ID NO: 3245413 - RNA, 20 nt, Mycobacterium tuberculosis H37Rv
ccacugcccgccgacgccag

SEQ ID NO: 3245414 - RNA, 16 nt, Mycobacterium tuberculosis H37Rv
ccacugccgcgcgccc

SEQ ID NO: 3245415 - RNA, 21 nt, Mycobacterium tuberculosis H37Rv
ccacugccgcgcgcccgccuc

SEQ ID NO: 3245416 - RNA, 22 nt, Mycobacterium tuberculosis H37Rv
ccacugccgcgcgcccgccuca

SEQ ID NO: 3245417 - RNA, 20 nt, Mycobacterium tuberculosis H37Rv
ccacugccgugccggugugu

SEQ ID NO: 3245418 - RNA, 13 nt, Mycobacterium tuberculosis H37Rv
ccacugcgcgucg

SEQ ID NO: 3245419 - RNA, 20 nt, Mycobacterium tuberculosis H37Rv
ccacugcguuccaucgccga

SEQ ID NO: 3245420 - RNA, 12 nt, Mycobacterium tuberculosis H37Rv
ccacuggauggc

SEQ ID NO: 3245421 - RNA, 17 nt, Mycobacterium tuberculosis H37Rv
ccacuggauggcucgcc

SEQ ID NO: 3245422 - RNA, 19 nt, Mycobacterium tuberculosis H37Rv
ccacuggauggcucgccga

SEQ ID NO: 3245423 - RNA, 14 nt, Mycobacterium tuberculosis H37Rv
ccacugggccugcc

SEQ ID NO: 3245424 - RNA, 14 nt, Mycobacterium tuberculosis H37Rv
ccacuggugcagcg

SEQ ID NO: 3245425 - RNA, 15 nt, Mycobacterium tuberculosis H37Rv
ccacuggugcagcgc

SEQ ID NO: 3245426 - RNA, 16 nt, Mycobacterium tuberculosis H37Rv
ccacuggugcagcgcc

SEQ ID NO: 3245427 - RNA, 21 nt, Mycobacterium tuberculosis H37Rv
ccacuggugcagcgccgacag

SEQ ID NO: 3245428 - RNA, 18 nt, Mycobacterium tuberculosis H37Rv
ccacuguagggccgguga

SEQ ID NO: 3245429 - RNA, 16 nt, Mycobacterium tuberculosis H37Rv
ccacuguuacggccac

SEQ ID NO: 3245430 - RNA, 18 nt, Mycobacterium tuberculosis H37Rv
ccacuguugaagaagccc

SEQ ID NO: 3245431 - RNA, 19 nt, Mycobacterium tuberculosis H37Rv
ccacuguuggugccgccac

SEQ ID NO: 3245432 - RNA, 18 nt, Mycobacterium tuberculosis H37Rv
ccacuguuucugagcgcg

SEQ ID NO: 3245433 - RNA, 20 nt, Mycobacterium tuberculosis H37Rv
ccacuguuucugagcgcgcu

SEQ ID NO: 3245434 - RNA, 13 nt, Mycobacterium tuberculosis H37Rv
ccacuuccgggcg

SEQ ID NO: 3245435 - RNA, 13 nt, Mycobacterium tuberculosis H37Rv
ccacuucgguguu

SEQ ID NO: 3245436 - RNA, 11 nt, Mycobacterium tuberculosis H37Rv
ccacuucuuca

SEQ ID NO: 3245437 - RNA, 13 nt, Mycobacterium tuberculosis H37Rv
ccacuucuucacu

SEQ ID NO: 3245438 - RNA, 18 nt, Mycobacterium tuberculosis H37Rv
ccacuucuucacuggcga

SEQ ID NO: 3245439 - RNA, 13 nt, Mycobacterium tuberculosis H37Rv
ccacuugcagcac

SEQ ID NO: 3245440 - RNA, 22 nt, Mycobacterium tuberculosis H37Rv
ccacuuggggcgccagggucgg

SEQ ID NO: 3245441 - RNA, 17 nt, Mycobacterium tuberculosis H37Rv
ccacuugugacccggcg

SEQ ID NO: 3245442 - RNA, 15 nt, Mycobacterium tuberculosis H37Rv
ccacuuuucgguggc

SEQ ID NO: 3245443 - RNA, 21 nt, Mycobacterium tuberculosis H37Rv
ccacuuuucgguggcggcagc

SEQ ID NO: 3245444 - RNA, 14 nt, Mycobacterium tuberculosis H37Rv
ccagaaaaccgccg

SEQ ID NO: 3245445 - RNA, 16 nt, Mycobacterium tuberculosis H37Rv
ccagaaauggcgccau

SEQ ID NO: 3245446 - RNA, 12 nt, Mycobacterium tuberculosis H37Rv
ccagaaccggcu

SEQ ID NO: 3245447 - RNA, 15 nt, Mycobacterium tuberculosis H37Rv
ccagaaccggugcgg

SEQ ID NO: 3245448 - RNA, 15 nt, Mycobacterium tuberculosis H37Rv
ccagaacgacgccgc

SEQ ID NO: 3245449 - RNA, 14 nt, Mycobacterium tuberculosis H37Rv
ccagaacggcgauc

SEQ ID NO: 3245450 - RNA, 19 nt, Mycobacterium tuberculosis H37Rv
ccagaacggcgaucaccga

SEQ ID NO: 3245451 - RNA, 17 nt, Mycobacterium tuberculosis H37Rv
ccagaacggcgucgaau

SEQ ID NO: 3245452 - RNA, 18 nt, Mycobacterium tuberculosis H37Rv
ccagaaggccgcaccgcc

SEQ ID NO: 3245453 - RNA, 22 nt, Mycobacterium tuberculosis H37Rv
ccagaaggccgcaccgccaccc

SEQ ID NO: 3245454 - RNA, 23 nt, Mycobacterium tuberculosis H37Rv
ccagaaucggguucuuuugcguc

SEQ ID NO: 3245455 - RNA, 18 nt, Mycobacterium tuberculosis H37Rv
ccagaaucucgccgggcu

SEQ ID NO: 3245456 - RNA, 21 nt, Mycobacterium tuberculosis H37Rv
ccagaaucucgccgggcugca

SEQ ID NO: 3245457 - RNA, 15 nt, Mycobacterium tuberculosis H37Rv
ccagacacaaccgcu

SEQ ID NO: 3245458 - RNA, 19 nt, Mycobacterium tuberculosis H37Rv
ccagacacaaccgcuuuga

SEQ ID NO: 3245459 - RNA, 19 nt, Mycobacterium tuberculosis H37Rv
ccagacaucagugcgccgg

SEQ ID NO: 3245460 - RNA, 14 nt, Mycobacterium tuberculosis H37Rv
ccagaccagggcag

SEQ ID NO: 3245461 - RNA, 16 nt, Mycobacterium tuberculosis H37Rv
ccagacccaccaccgc

SEQ ID NO: 3245462 - RNA, 15 nt, Mycobacterium tuberculosis H37Rv
ccagacccacgaugg

SEQ ID NO: 3245463 - RNA, 15 nt, Mycobacterium tuberculosis H37Rv
ccagacccagcucgu

SEQ ID NO: 3245464 - RNA, 12 nt, Mycobacterium tuberculosis H37Rv
ccagaccgccga

SEQ ID NO: 3245465 - RNA, 18 nt, Mycobacterium tuberculosis H37Rv
ccagaccgccgacgccgu

SEQ ID NO: 3245466 - RNA, 19 nt, Mycobacterium tuberculosis H37Rv
ccagaccggccgacgugac

SEQ ID NO: 3245467 - RNA, 12 nt, Mycobacterium tuberculosis H37Rv
ccagacgauggc

SEQ ID NO: 3245468 - RNA, 16 nt, Mycobacterium tuberculosis H37Rv
ccagacgccacugcca

SEQ ID NO: 3245469 - RNA, 18 nt, Mycobacterium tuberculosis H37Rv
ccagacggugcagcuccc

SEQ ID NO: 3245470 - RNA, 19 nt, Mycobacterium tuberculosis H37Rv
ccagagaaaucgguggugc

SEQ ID NO: 3245471 - RNA, 22 nt, Mycobacterium tuberculosis H37Rv
ccagagacagcgccaugcccuc

SEQ ID NO: 3245472 - RNA, 18 nt, Mycobacterium tuberculosis H37Rv
ccagagacaugucgcugc

SEQ ID NO: 3245473 - RNA, 13 nt, Mycobacterium tuberculosis H37Rv
ccagagcagcuca

SEQ ID NO: 3245474 - RNA, 15 nt, Mycobacterium tuberculosis H37Rv
ccagcagcagcgccg

SEQ ID NO: 3245475 - RNA, 16 nt, Mycobacterium tuberculosis H37Rv
ccagcagcagcgccgc

SEQ ID NO: 3245476 - RNA, 14 nt, Mycobacterium tuberculosis H37Rv
ccagcagcagcgcu

SEQ ID NO: 3245477 - RNA, 16 nt, Mycobacterium tuberculosis H37Rv
ccagcagcagcgcuuc

SEQ ID NO: 3245478 - RNA, 15 nt, Mycobacterium tuberculosis H37Rv
ccagcagcagugcca

SEQ ID NO: 3245479 - RNA, 23 nt, Mycobacterium tuberculosis H37Rv
ccagcagccacccgacaacgcug

SEQ ID NO: 3245480 - RNA, 15 nt, Mycobacterium tuberculosis H37Rv
ccagcagcgaaaacc

SEQ ID NO: 3245481 - RNA, 19 nt, Mycobacterium tuberculosis H37Rv
ccagcagcgacuccagcgc

SEQ ID NO: 3245482 - RNA, 16 nt, Mycobacterium tuberculosis H37Rv
ccagcagcgcaaccag

SEQ ID NO: 3245483 - RNA, 21 nt, Mycobacterium tuberculosis H37Rv
ccagcagcggcacgucggcgc

SEQ ID NO: 3245484 - RNA, 13 nt, Mycobacterium tuberculosis H37Rv
ccagcagcggcga

SEQ ID NO: 3245485 - RNA, 14 nt, Mycobacterium tuberculosis H37Rv
ccagcagcucgccg

SEQ ID NO: 3245486 - RNA, 24 nt, Mycobacterium tuberculosis H37Rv
ccagcagcucgccggcacgcagcc

SEQ ID NO: 3245487 - RNA, 14 nt, Mycobacterium tuberculosis H37Rv
ccagcagcucggcc

SEQ ID NO: 3245488 - RNA, 15 nt, Mycobacterium tuberculosis H37Rv
ccagcagcucggccg

SEQ ID NO: 3245489 - RNA, 13 nt, Mycobacterium tuberculosis H37Rv
ccagcagcugcga

SEQ ID NO: 3245490 - RNA, 15 nt, Mycobacterium tuberculosis H37Rv
ccagcaggccacugc

SEQ ID NO: 3245491 - RNA, 18 nt, Mycobacterium tuberculosis H37Rv
ccagcaggccacugcguu

SEQ ID NO: 3245492 - RNA, 19 nt, Mycobacterium tuberculosis H37Rv
ccagcaggcccuggccacc

SEQ ID NO: 3245493 - RNA, 19 nt, Mycobacterium tuberculosis H37Rv
ccagcaggcccuuggcgau

SEQ ID NO: 3245494 - RNA, 21 nt, Mycobacterium tuberculosis H37Rv
ccagcaggccgggcgcaagca

SEQ ID NO: 3245495 - RNA, 14 nt, Mycobacterium tuberculosis H37Rv
ccagcaggcggcuc

SEQ ID NO: 3245496 - RNA, 17 nt, Mycobacterium tuberculosis H37Rv
ccagcagggccaccacc

SEQ ID NO: 3245497 - RNA, 20 nt, Mycobacterium tuberculosis H37Rv
ccagcagguaguuaccauau

SEQ ID NO: 3245498 - RNA, 19 nt, Mycobacterium tuberculosis H37Rv
ccagcagguccgccaccgc

SEQ ID NO: 3245499 - RNA, 21 nt, Mycobacterium tuberculosis H37Rv
ccagcagguccgccaccgcga

SEQ ID NO: 3245500 - RNA, 16 nt, Mycobacterium tuberculosis H37Rv
ccagcagguccgcggc

SEQ ID NO: 3245501 - RNA, 20 nt, Mycobacterium tuberculosis H37Rv
ccagcagguccgcggccgcg

SEQ ID NO: 3245502 - RNA, 21 nt, Mycobacterium tuberculosis H37Rv
ccagcagguccgcggccgcgg

SEQ ID NO: 3245503 - RNA, 23 nt, Mycobacterium tuberculosis H37Rv
ccagcagugcgguaaagaucuug

SEQ ID NO: 3245504 - RNA, 22 nt, Mycobacterium tuberculosis H37Rv
ccagcaucagcgccagcgagca

SEQ ID NO: 3245505 - RNA, 20 nt, Mycobacterium tuberculosis H37Rv
ccagcaucgcggugguuggg

SEQ ID NO: 3245506 - RNA, 14 nt, Mycobacterium tuberculosis H37Rv
ccagcaucucggcc

SEQ ID NO: 3245507 - RNA, 15 nt, Mycobacterium tuberculosis H37Rv
ccagcaugcccgcca

SEQ ID NO: 3245508 - RNA, 17 nt, Mycobacterium tuberculosis H37Rv
ccagcaugcccgccauc

SEQ ID NO: 3245509 - RNA, 23 nt, Mycobacterium tuberculosis H37Rv
ccagcauggcggaacagcaauuu

SEQ ID NO: 3245510 - RNA, 23 nt, Mycobacterium tuberculosis H37Rv
ccagcauggcuuuugcgccgaau

SEQ ID NO: 3245511 - RNA, 20 nt, Mycobacterium tuberculosis H37Rv
ccagcauggggucagcucgc

SEQ ID NO: 3245512 - RNA, 19 nt, Mycobacterium tuberculosis H37Rv
ccagcauucucgccgacgg

SEQ ID NO: 3245513 - RNA, 17 nt, Mycobacterium tuberculosis H37Rv
ccagcauugaagaagcc

SEQ ID NO: 3245514 - RNA, 18 nt, Mycobacterium tuberculosis H37Rv
ccagcauugaagaagccc

SEQ ID NO: 3245515 - RNA, 17 nt, Mycobacterium tuberculosis H37Rv
ccagccaaaucagccag

SEQ ID NO: 3245516 - RNA, 18 nt, Mycobacterium tuberculosis H37Rv
ccagccaccaccaggucg

SEQ ID NO: 3245517 - RNA, 14 nt, Mycobacterium tuberculosis H37Rv
ccagccaccgaccc

SEQ ID NO: 3245518 - RNA, 20 nt, Mycobacterium tuberculosis H37Rv
ccagccacgcugucccgcgg

SEQ ID NO: 3245519 - RNA, 14 nt, Mycobacterium tuberculosis H37Rv
ccagccagaugccg

SEQ ID NO: 3245520 - RNA, 19 nt, Mycobacterium tuberculosis H37Rv
ccagccagcaagcgguagc

SEQ ID NO: 3245521 - RNA, 20 nt, Mycobacterium tuberculosis H37Rv
ccagccagcagcggcgagcc

SEQ ID NO: 3245522 - RNA, 18 nt, Mycobacterium tuberculosis H37Rv
ccagccagccugcuggcc

SEQ ID NO: 3245523 - RNA, 13 nt, Mycobacterium tuberculosis H37Rv
ccagccagcgggc

SEQ ID NO: 3245524 - RNA, 16 nt, Mycobacterium tuberculosis H37Rv
ccagccagcgggcgau

SEQ ID NO: 3245525 - RNA, 20 nt, Mycobacterium tuberculosis H37Rv
ccagccagcuggacuccggu

SEQ ID NO: 3245526 - RNA, 21 nt, Mycobacterium tuberculosis H37Rv
ccagccauagugcggcagcgg

SEQ ID NO: 3245527 - RNA, 13 nt, Mycobacterium tuberculosis H37Rv
ccagccauggcag

SEQ ID NO: 3245528 - RNA, 15 nt, Mycobacterium tuberculosis H37Rv
ccagccauggcagcg

SEQ ID NO: 3245529 - RNA, 13 nt, Mycobacterium tuberculosis H37Rv
ccagcccagcacg

SEQ ID NO: 3245530 - RNA, 20 nt, Mycobacterium tuberculosis H37Rv
ccagccccaucgcuggucga

SEQ ID NO: 3245531 - RNA, 22 nt, Mycobacterium tuberculosis H37Rv
ccagccccgcgcccaccccggc

SEQ ID NO: 3245532 - RNA, 17 nt, Mycobacterium tuberculosis H37Rv
ccagcccgaugaucccg

SEQ ID NO: 3245533 - RNA, 21 nt, Mycobacterium tuberculosis H37Rv
ccagcccgaugaucccgccac

SEQ ID NO: 3245534 - RNA, 17 nt, Mycobacterium tuberculosis H37Rv
ccagcccggcccagugg

SEQ ID NO: 3245535 - RNA, 14 nt, Mycobacterium tuberculosis H37Rv
ccagcccggccgcc

SEQ ID NO: 3245536 - RNA, 13 nt, Mycobacterium tuberculosis H37Rv
ccagcccggccgg

SEQ ID NO: 3245537 - RNA, 15 nt, Mycobacterium tuberculosis H37Rv
ccagcccggcgugca

SEQ ID NO: 3245538 - RNA, 20 nt, Mycobacterium tuberculosis H37Rv
ccagcccguugcaggacgcc

SEQ ID NO: 3245539 - RNA, 13 nt, Mycobacterium tuberculosis H37Rv
ccagccgacguac

SEQ ID NO: 3245540 - RNA, 16 nt, Mycobacterium tuberculosis H37Rv
ccagccgagcggcggc

SEQ ID NO: 3245541 - RNA, 12 nt, Mycobacterium tuberculosis H37Rv
ccagccgaucac

SEQ ID NO: 3245542 - RNA, 13 nt, Mycobacterium tuberculosis H37Rv
ccagccgaucacg

SEQ ID NO: 3245543 - RNA, 12 nt, Mycobacterium tuberculosis H37Rv
ccagccgaucau

SEQ ID NO: 3245544 - RNA, 15 nt, Mycobacterium tuberculosis H37Rv
ccagccgcagcaccu

SEQ ID NO: 3245545 - RNA, 16 nt, Mycobacterium tuberculosis H37Rv
ccagccgcaucgggca

SEQ ID NO: 3245546 - RNA, 12 nt, Mycobacterium tuberculosis H37Rv
ccagccgccccg

SEQ ID NO: 3245547 - RNA, 13 nt, Mycobacterium tuberculosis H37Rv
ccagccgcccucg

SEQ ID NO: 3245548 - RNA, 15 nt, Mycobacterium tuberculosis H37Rv
ccagccgcccucggg

SEQ ID NO: 3245549 - RNA, 16 nt, Mycobacterium tuberculosis H37Rv
ccagccgcgagccggu

SEQ ID NO: 3245550 - RNA, 14 nt, Mycobacterium tuberculosis H37Rv
ccagccgcgccagc

SEQ ID NO: 3245551 - RNA, 15 nt, Mycobacterium tuberculosis H37Rv
ccagccgcuccacgu

SEQ ID NO: 3245552 - RNA, 17 nt, Mycobacterium tuberculosis H37Rv
ccagccgcugccacagg

SEQ ID NO: 3245553 - RNA, 16 nt, Mycobacterium tuberculosis H37Rv
ccagccggaaccggac

SEQ ID NO: 3245554 - RNA, 19 nt, Mycobacterium tuberculosis H37Rv
ccagccggaaccggacagc

SEQ ID NO: 3245555 - RNA, 13 nt, Mycobacterium tuberculosis H37Rv
ccagccggcagca

SEQ ID NO: 3245556 - RNA, 14 nt, Mycobacterium tuberculosis H37Rv
ccagccggcagcag

SEQ ID NO: 3245557 - RNA, 16 nt, Mycobacterium tuberculosis H37Rv
ccagccggcagcagcg

SEQ ID NO: 3245558 - RNA, 17 nt, Mycobacterium tuberculosis H37Rv
ccagccggcagcagcgg

SEQ ID NO: 3245559 - RNA, 13 nt, Mycobacterium tuberculosis H37Rv
ccagccggccuca

SEQ ID NO: 3245560 - RNA, 12 nt, Mycobacterium tuberculosis H37Rv
ccagccggccug

SEQ ID NO: 3245561 - RNA, 24 nt, Mycobacterium tuberculosis H37Rv
ccagccgggagucgucggcauggg

SEQ ID NO: 3245562 - RNA, 21 nt, Mycobacterium tuberculosis H37Rv
ccagccgggcacccuugccga

SEQ ID NO: 3245563 - RNA, 18 nt, Mycobacterium tuberculosis H37Rv
ccagccgguagccgggca

SEQ ID NO: 3245564 - RNA, 18 nt, Mycobacterium tuberculosis H37Rv
ccagccgguccagaccca

SEQ ID NO: 3245565 - RNA, 21 nt, Mycobacterium tuberculosis H37Rv
ccagccgguccagacccagcu

SEQ ID NO: 3245566 - RNA, 17 nt, Mycobacterium tuberculosis H37Rv
ccagccgguccagcagc

SEQ ID NO: 3245567 - RNA, 19 nt, Mycobacterium tuberculosis H37Rv
ccagccgguccagcagcuc

SEQ ID NO: 3245568 - RNA, 20 nt, Mycobacterium tuberculosis H37Rv
ccagccgguccagcagcucg

SEQ ID NO: 3245569 - RNA, 20 nt, Mycobacterium tuberculosis H37Rv
ccagccggucuuggacagca

SEQ ID NO: 3245570 - RNA, 13 nt, Mycobacterium tuberculosis H37Rv
ccagccggugagc

SEQ ID NO: 3245571 - RNA, 21 nt, Mycobacterium tuberculosis H37Rv
ccagcggcaccgcggccagcg

SEQ ID NO: 3245572 - RNA, 17 nt, Mycobacterium tuberculosis H37Rv
ccagcggccaccgaggc

SEQ ID NO: 3245573 - RNA, 12 nt, Mycobacterium tuberculosis H37Rv
ccagcggccgcc

SEQ ID NO: 3245574 - RNA, 19 nt, Mycobacterium tuberculosis H37Rv
ccagcggccgggcggccag

SEQ ID NO: 3245575 - RNA, 13 nt, Mycobacterium tuberculosis H37Rv
ccagcggcgccac

SEQ ID NO: 3245576 - RNA, 21 nt, Mycobacterium tuberculosis H37Rv
ccagcggcgccacguggucga

SEQ ID NO: 3245577 - RNA, 12 nt, Mycobacterium tuberculosis H37Rv
ccagcggcggcc

SEQ ID NO: 3245578 - RNA, 23 nt, Mycobacterium tuberculosis H37Rv
ccagcggcggucuuuuugggcuu

SEQ ID NO: 3245579 - RNA, 16 nt, Mycobacterium tuberculosis H37Rv
ccagcggcgugacguc

SEQ ID NO: 3245580 - RNA, 17 nt, Mycobacterium tuberculosis H37Rv
ccagcggcgugacgucg

SEQ ID NO: 3245581 - RNA, 21 nt, Mycobacterium tuberculosis H37Rv
ccagcggcugcccaucgguga

SEQ ID NO: 3245582 - RNA, 20 nt, Mycobacterium tuberculosis H37Rv
ccagcggcugguugcgccac

SEQ ID NO: 3245583 - RNA, 21 nt, Mycobacterium tuberculosis H37Rv
ccagcgggaucugacccagca

SEQ ID NO: 3245584 - RNA, 23 nt, Mycobacterium tuberculosis H37Rv
ccagcgggaucugacccagcagc

SEQ ID NO: 3245585 - RNA, 19 nt, Mycobacterium tuberculosis H37Rv
ccagcgggcauaacccgca

SEQ ID NO: 3245586 - RNA, 14 nt, Mycobacterium tuberculosis H37Rv
ccagcgggcaucgc

SEQ ID NO: 3245587 - RNA, 19 nt, Mycobacterium tuberculosis H37Rv
ccagcgggcgaugagcgcg

SEQ ID NO: 3245588 - RNA, 13 nt, Mycobacterium tuberculosis H37Rv
ccagcggggucuu

SEQ ID NO: 3245589 - RNA, 21 nt, Mycobacterium tuberculosis H37Rv
ccagcgggugaaucgacaccg

SEQ ID NO: 3245590 - RNA, 15 nt, Mycobacterium tuberculosis H37Rv
ccagcggguggccau

SEQ ID NO: 3245591 - RNA, 16 nt, Mycobacterium tuberculosis H37Rv
ccagcgguaaugccag

SEQ ID NO: 3245592 - RNA, 16 nt, Mycobacterium tuberculosis H37Rv
ccagcgguagcugccc

SEQ ID NO: 3245593 - RNA, 17 nt, Mycobacterium tuberculosis H37Rv
ccagcggucagccggcc

SEQ ID NO: 3245594 - RNA, 19 nt, Mycobacterium tuberculosis H37Rv
ccagcggucagccggccau

SEQ ID NO: 3245595 - RNA, 14 nt, Mycobacterium tuberculosis H37Rv
ccagcggucggcga

SEQ ID NO: 3245596 - RNA, 17 nt, Mycobacterium tuberculosis H37Rv
ccagcggucggcgacca

SEQ ID NO: 3245597 - RNA, 22 nt, Mycobacterium tuberculosis H37Rv
ccagcggucggcgaccaccagc

SEQ ID NO: 3245598 - RNA, 23 nt, Mycobacterium tuberculosis H37Rv
ccagcggucggcgaccaccagcg

SEQ ID NO: 3245599 - RNA, 17 nt, Mycobacterium tuberculosis H37Rv
ccagcgguggaccaccg

SEQ ID NO: 3245600 - RNA, 15 nt, Mycobacterium tuberculosis H37Rv
ccagcguccaaccca

SEQ ID NO: 3245601 - RNA, 15 nt, Mycobacterium tuberculosis H37Rv
ccagcguccagccgc

SEQ ID NO: 3245602 - RNA, 21 nt, Mycobacterium tuberculosis H37Rv
ccagcguccagccgcccucgg

SEQ ID NO: 3245603 - RNA, 22 nt, Mycobacterium tuberculosis H37Rv
ccagcgucccgauguaugacag

SEQ ID NO: 3245604 - RNA, 17 nt, Mycobacterium tuberculosis H37Rv
ccagcgucgacacaccc

SEQ ID NO: 3245605 - RNA, 22 nt, Mycobacterium tuberculosis H37Rv
ccagcgucgacacacccacugg

SEQ ID NO: 3245606 - RNA, 14 nt, Mycobacterium tuberculosis H37Rv
ccagcgucgccgcc

SEQ ID NO: 3245607 - RNA, 20 nt, Mycobacterium tuberculosis H37Rv
ccagcgucgccgccagguug

SEQ ID NO: 3245608 - RNA, 16 nt, Mycobacterium tuberculosis H37Rv
ccagcgucgcggccac

SEQ ID NO: 3245609 - RNA, 16 nt, Mycobacterium tuberculosis H37Rv
ccagcguggggccgcc

SEQ ID NO: 3245610 - RNA, 23 nt, Mycobacterium tuberculosis H37Rv
ccagcguggggccgccaccagcg

SEQ ID NO: 3245611 - RNA, 21 nt, Mycobacterium tuberculosis H37Rv
ccagcguggugaagucggugc

SEQ ID NO: 3245612 - RNA, 19 nt, Mycobacterium tuberculosis H37Rv
ccagcgugucuugucgcgc

SEQ ID NO: 3245613 - RNA, 19 nt, Mycobacterium tuberculosis H37Rv
ccagcguguggagcucgcg

SEQ ID NO: 3245614 - RNA, 21 nt, Mycobacterium tuberculosis H37Rv
ccagcguguggagcucgcggc

SEQ ID NO: 3245615 - RNA, 21 nt, Mycobacterium tuberculosis H37Rv
ccagcguuugaacgcaugcga

SEQ ID NO: 3245616 - RNA, 22 nt, Mycobacterium tuberculosis H37Rv
ccagcucacccggagcacccgg

SEQ ID NO: 3245617 - RNA, 23 nt, Mycobacterium tuberculosis H37Rv
ccagcucacccggagcacccggg

SEQ ID NO: 3245618 - RNA, 16 nt, Mycobacterium tuberculosis H37Rv
ccagcucagcugcgga

SEQ ID NO: 3245619 - RNA, 15 nt, Mycobacterium tuberculosis H37Rv
ccagcuccagcgccg

SEQ ID NO: 3245620 - RNA, 17 nt, Mycobacterium tuberculosis H37Rv
ccagcuccagcgccgcg

SEQ ID NO: 3245621 - RNA, 16 nt, Mycobacterium tuberculosis H37Rv
ccagcucccgcgagcg

SEQ ID NO: 3245622 - RNA, 13 nt, Mycobacterium tuberculosis H37Rv
ccagcuccgccug

SEQ ID NO: 3245623 - RNA, 20 nt, Mycobacterium tuberculosis H37Rv
ccagcuccgccugccgcugg

SEQ ID NO: 3245624 - RNA, 16 nt, Mycobacterium tuberculosis H37Rv
ccagcuccucagccac

SEQ ID NO: 3245625 - RNA, 18 nt, Mycobacterium tuberculosis H37Rv
ccagcuccucagccaccg

SEQ ID NO: 3245626 - RNA, 19 nt, Mycobacterium tuberculosis H37Rv
ccagcuccucagccaccgc

SEQ ID NO: 3245627 - RNA, 15 nt, Mycobacterium tuberculosis H37Rv
ccagcucgcgcaccc

SEQ ID NO: 3245628 - RNA, 18 nt, Mycobacterium tuberculosis H37Rv
ccagcucgcgcacccagc

SEQ ID NO: 3245629 - RNA, 20 nt, Mycobacterium tuberculosis H37Rv
ccagcucgcgcacccagccc

SEQ ID NO: 3245630 - RNA, 22 nt, Mycobacterium tuberculosis H37Rv
ccagcucgcgcacccagcccag

SEQ ID NO: 3245631 - RNA, 18 nt, Mycobacterium tuberculosis H37Rv
ccagcucgcgggccgcgu

SEQ ID NO: 3245632 - RNA, 19 nt, Mycobacterium tuberculosis H37Rv
ccagcucgcgggccgcguc

SEQ ID NO: 3245633 - RNA, 18 nt, Mycobacterium tuberculosis H37Rv
ccagcucggcaccgagcu

SEQ ID NO: 3245634 - RNA, 12 nt, Mycobacterium tuberculosis H37Rv
ccagcucggcca

SEQ ID NO: 3245635 - RNA, 20 nt, Mycobacterium tuberculosis H37Rv
ccagcucggugcuguugcgc

SEQ ID NO: 3245636 - RNA, 21 nt, Mycobacterium tuberculosis H37Rv
ccagcucgugaucuucggcga

SEQ ID NO: 3245637 - RNA, 14 nt, Mycobacterium tuberculosis H37Rv
ccagcugaccagcg

SEQ ID NO: 3245638 - RNA, 17 nt, Mycobacterium tuberculosis H37Rv
ccagcugacggcgcaac

SEQ ID NO: 3245639 - RNA, 18 nt, Mycobacterium tuberculosis H37Rv
ccagcugcgagucgucgc

SEQ ID NO: 3245640 - RNA, 18 nt, Mycobacterium tuberculosis H37Rv
ccagcugcgcagcgcaac

SEQ ID NO: 3245641 - RNA, 22 nt, Mycobacterium tuberculosis H37Rv
ccagcugcgccgaacgcuccag

SEQ ID NO: 3245642 - RNA, 20 nt, Mycobacterium tuberculosis H37Rv
ccagcugcguggcgaaccag

SEQ ID NO: 3245643 - RNA, 17 nt, Mycobacterium tuberculosis H37Rv
ccagcuggaacggcagc

SEQ ID NO: 3245644 - RNA, 15 nt, Mycobacterium tuberculosis H37Rv
ccagcuggacuccgg

SEQ ID NO: 3245645 - RNA, 14 nt, Mycobacterium tuberculosis H37Rv
ccagcugggcagcc

SEQ ID NO: 3245646 - RNA, 18 nt, Mycobacterium tuberculosis H37Rv
ccagcuguacaacgccgu

SEQ ID NO: 3245647 - RNA, 19 nt, Mycobacterium tuberculosis H37Rv
ccagcuguccucgcgggcu

SEQ ID NO: 3245648 - RNA, 16 nt, Mycobacterium tuberculosis H37Rv
ccagcugucgggcagc

SEQ ID NO: 3245649 - RNA, 18 nt, Mycobacterium tuberculosis H37Rv
ccagcuguucgagccgcg

SEQ ID NO: 3245650 - RNA, 16 nt, Mycobacterium tuberculosis H37Rv
ccagcuucucagcacc

SEQ ID NO: 3245651 - RNA, 20 nt, Mycobacterium tuberculosis H37Rv
ccagcuugccgaccugcgcg

SEQ ID NO: 3245652 - RNA, 15 nt, Mycobacterium tuberculosis H37Rv
ccagcuugcgccgca

SEQ ID NO: 3245653 - RNA, 23 nt, Mycobacterium tuberculosis H37Rv
ccagcuuggagaggcggugcagc

SEQ ID NO: 3245654 - RNA, 22 nt, Mycobacterium tuberculosis H37Rv
ccagcuugucguagcgacgcca

SEQ ID NO: 3245655 - RNA, 13 nt, Mycobacterium tuberculosis H37Rv
ccaggaacccgug

SEQ ID NO: 3245656 - RNA, 16 nt, Mycobacterium tuberculosis H37Rv
ccaggaacucggccca

SEQ ID NO: 3245657 - RNA, 17 nt, Mycobacterium tuberculosis H37Rv
ccaggaacucggcccac

SEQ ID NO: 3245658 - RNA, 16 nt, Mycobacterium tuberculosis H37Rv
ccaggacaacgcaccg

SEQ ID NO: 3245659 - RNA, 18 nt, Mycobacterium tuberculosis H37Rv
ccaggaccaacuguggug

SEQ ID NO: 3245660 - RNA, 13 nt, Mycobacterium tuberculosis H37Rv
ccaggaccaccgc

SEQ ID NO: 3245661 - RNA, 12 nt, Mycobacterium tuberculosis H37Rv
ccaggaccgcgc

SEQ ID NO: 3245662 - RNA, 17 nt, Mycobacterium tuberculosis H37Rv
ccaggacgaguccuagc

SEQ ID NO: 3245663 - RNA, 20 nt, Mycobacterium tuberculosis H37Rv
ccaggacggaucgucgugca

SEQ ID NO: 3245664 - RNA, 23 nt, Mycobacterium tuberculosis H37Rv
ccaggacgguugguccgccgucg

SEQ ID NO: 3245665 - RNA, 16 nt, Mycobacterium tuberculosis H37Rv
ccaggacguggucggg

SEQ ID NO: 3245666 - RNA, 17 nt, Mycobacterium tuberculosis H37Rv
ccaggacuggcaccgcc

SEQ ID NO: 3245667 - RNA, 22 nt, Mycobacterium tuberculosis H37Rv
ccagggcgccgaauuggcccgg

SEQ ID NO: 3245668 - RNA, 16 nt, Mycobacterium tuberculosis H37Rv
ccagggcgcggaucug

SEQ ID NO: 3245669 - RNA, 16 nt, Mycobacterium tuberculosis H37Rv
ccagggcggccauccg

SEQ ID NO: 3245670 - RNA, 15 nt, Mycobacterium tuberculosis H37Rv
ccagggcgugcgcga

SEQ ID NO: 3245671 - RNA, 15 nt, Mycobacterium tuberculosis H37Rv
ccaggggaccgcggc

SEQ ID NO: 3245672 - RNA, 20 nt, Mycobacterium tuberculosis H37Rv
ccaggggaccgcggcgcguc

SEQ ID NO: 3245673 - RNA, 14 nt, Mycobacterium tuberculosis H37Rv
ccaggggauugccc

SEQ ID NO: 3245674 - RNA, 15 nt, Mycobacterium tuberculosis H37Rv
ccaggggcaccagcg

SEQ ID NO: 3245675 - RNA, 14 nt, Mycobacterium tuberculosis H37Rv
ccaggggcgcagcg

SEQ ID NO: 3245676 - RNA, 13 nt, Mycobacterium tuberculosis H37Rv
ccaggggcgcguc

SEQ ID NO: 3245677 - RNA, 17 nt, Mycobacterium tuberculosis H37Rv
ccagggggcgugccgcc

SEQ ID NO: 3245678 - RNA, 22 nt, Mycobacterium tuberculosis H37Rv
ccagggucaccucgucgccuag

SEQ ID NO: 3245679 - RNA, 15 nt, Mycobacterium tuberculosis H37Rv
ccagggucagcucgg

SEQ ID NO: 3245680 - RNA, 14 nt, Mycobacterium tuberculosis H37Rv
ccagggucccgccg

SEQ ID NO: 3245681 - RNA, 21 nt, Mycobacterium tuberculosis H37Rv
ccagggucccgccgccuggaa

SEQ ID NO: 3245682 - RNA, 20 nt, Mycobacterium tuberculosis H37Rv
ccagggucgcgagcccgcca

SEQ ID NO: 3245683 - RNA, 17 nt, Mycobacterium tuberculosis H37Rv
ccagggucugcucaucc

SEQ ID NO: 3245684 - RNA, 14 nt, Mycobacterium tuberculosis H37Rv
ccaggguggucagu

SEQ ID NO: 3245685 - RNA, 17 nt, Mycobacterium tuberculosis H37Rv
ccaggguguauggccac

SEQ ID NO: 3245686 - RNA, 20 nt, Mycobacterium tuberculosis H37Rv
ccaggguguauggccaccac

SEQ ID NO: 3245687 - RNA, 12 nt, Mycobacterium tuberculosis H37Rv
ccagggugucca

SEQ ID NO: 3245688 - RNA, 15 nt, Mycobacterium tuberculosis H37Rv
ccaggguguccaugu

SEQ ID NO: 3245689 - RNA, 18 nt, Mycobacterium tuberculosis H37Rv
ccagggugucgucuugcg

SEQ ID NO: 3245690 - RNA, 16 nt, Mycobacterium tuberculosis H37Rv
ccagggugucugugau

SEQ ID NO: 3245691 - RNA, 18 nt, Mycobacterium tuberculosis H37Rv
ccagguaaacggauucga

SEQ ID NO: 3245692 - RNA, 14 nt, Mycobacterium tuberculosis H37Rv
ccagguaaccccgc

SEQ ID NO: 3245693 - RNA, 17 nt, Mycobacterium tuberculosis H37Rv
ccagguaauugccgacc

SEQ ID NO: 3245694 - RNA, 22 nt, Mycobacterium tuberculosis H37Rv
ccagguaauugccgaccgccug

SEQ ID NO: 3245695 - RNA, 19 nt, Mycobacterium tuberculosis H37Rv
ccagguacgggagcccgag

SEQ ID NO: 3245696 - RNA, 14 nt, Mycobacterium tuberculosis H37Rv
ccagguacucagug

SEQ ID NO: 3245697 - RNA, 15 nt, Mycobacterium tuberculosis H37Rv
ccagguacucagugu

SEQ ID NO: 3245698 - RNA, 16 nt, Mycobacterium tuberculosis H37Rv
ccagguagucgaccau

SEQ ID NO: 3245699 - RNA, 16 nt, Mycobacterium tuberculosis H37Rv
ccagguauguccgcca

SEQ ID NO: 3245700 - RNA, 13 nt, Mycobacterium tuberculosis H37Rv
ccagguccacauc

SEQ ID NO: 3245701 - RNA, 15 nt, Mycobacterium tuberculosis H37Rv
ccagguccaccccgc

SEQ ID NO: 3245702 - RNA, 17 nt, Mycobacterium tuberculosis H37Rv
ccagguccaccccgccg

SEQ ID NO: 3245703 - RNA, 18 nt, Mycobacterium tuberculosis H37Rv
ccagguccaccccgccga

SEQ ID NO: 3245704 - RNA, 15 nt, Mycobacterium tuberculosis H37Rv
ccagguccgccggug

SEQ ID NO: 3245705 - RNA, 14 nt, Mycobacterium tuberculosis H37Rv
ccaggucgacaccg

SEQ ID NO: 3245706 - RNA, 16 nt, Mycobacterium tuberculosis H37Rv
ccaggucgagcaccgg

SEQ ID NO: 3245707 - RNA, 21 nt, Mycobacterium tuberculosis H37Rv
ccaggucgauaccggcgugca

SEQ ID NO: 3245708 - RNA, 15 nt, Mycobacterium tuberculosis H37Rv
ccaggucgcauucug

SEQ ID NO: 3245709 - RNA, 22 nt, Mycobacterium tuberculosis H37Rv
ccaggucgcauucugcugccag

SEQ ID NO: 3245710 - RNA, 22 nt, Mycobacterium tuberculosis H37Rv
ccaggucgccuuucauagcuga

SEQ ID NO: 3245711 - RNA, 19 nt, Mycobacterium tuberculosis H37Rv
ccaggucgcgauagccgcc

SEQ ID NO: 3245712 - RNA, 21 nt, Mycobacterium tuberculosis H37Rv
ccaggucgcgauagccgccgc

SEQ ID NO: 3245713 - RNA, 23 nt, Mycobacterium tuberculosis H37Rv
ccaggucgcgauagccgccgcgg

SEQ ID NO: 3245714 - RNA, 12 nt, Mycobacterium tuberculosis H37Rv
ccaggucggcca

SEQ ID NO: 3245715 - RNA, 15 nt, Mycobacterium tuberculosis H37Rv
ccaggucggccaccg

SEQ ID NO: 3245716 - RNA, 18 nt, Mycobacterium tuberculosis H37Rv
ccaggucggccaccgugg

SEQ ID NO: 3245717 - RNA, 15 nt, Mycobacterium tuberculosis H37Rv
ccaggucggccgccu

SEQ ID NO: 3245718 - RNA, 21 nt, Mycobacterium tuberculosis H37Rv
ccaggucggcguugaucgaca

SEQ ID NO: 3245719 - RNA, 14 nt, Mycobacterium tuberculosis H37Rv
ccaggucggucagg

SEQ ID NO: 3245720 - RNA, 22 nt, Mycobacterium tuberculosis H37Rv
ccaggucggucauccggauggg

SEQ ID NO: 3245721 - RNA, 22 nt, Mycobacterium tuberculosis H37Rv
ccaggucguaggcgcuaggaac

SEQ ID NO: 3245722 - RNA, 15 nt, Mycobacterium tuberculosis H37Rv
ccaggucuccaucaa

SEQ ID NO: 3245723 - RNA, 21 nt, Mycobacterium tuberculosis H37Rv
ccaggucuccaucaaccgcgc

SEQ ID NO: 3245724 - RNA, 12 nt, Mycobacterium tuberculosis H37Rv
ccaggucugcgg

SEQ ID NO: 3245725 - RNA, 14 nt, Mycobacterium tuberculosis H37Rv
ccaggucugcggug

SEQ ID NO: 3245726 - RNA, 18 nt, Mycobacterium tuberculosis H37Rv
ccaggugagcgacgcuga

SEQ ID NO: 3245727 - RNA, 16 nt, Mycobacterium tuberculosis H37Rv
ccaggugaugccgccg

SEQ ID NO: 3245728 - RNA, 19 nt, Mycobacterium tuberculosis H37Rv
ccaggugcagcaccagcca

SEQ ID NO: 3245729 - RNA, 16 nt, Mycobacterium tuberculosis H37Rv
ccaggugcccaagcag

SEQ ID NO: 3245730 - RNA, 19 nt, Mycobacterium tuberculosis H37Rv
ccaggugcccaagcagucc

SEQ ID NO: 3245731 - RNA, 13 nt, Mycobacterium tuberculosis H37Rv
ccaggugcccgcc

SEQ ID NO: 3245732 - RNA, 16 nt, Mycobacterium tuberculosis H37Rv
ccaggugcccgccccg

SEQ ID NO: 3245733 - RNA, 18 nt, Mycobacterium tuberculosis H37Rv
ccaggugcguccaggcca

SEQ ID NO: 3245734 - RNA, 15 nt, Mycobacterium tuberculosis H37Rv
ccagguggaccggcc

SEQ ID NO: 3245735 - RNA, 13 nt, Mycobacterium tuberculosis H37Rv
ccagguggccgcu

SEQ ID NO: 3245736 - RNA, 15 nt, Mycobacterium tuberculosis H37Rv
ccagguggccgcucu

SEQ ID NO: 3245737 - RNA, 20 nt, Mycobacterium tuberculosis H37Rv
ccagguggucaucgccacgc

SEQ ID NO: 3245738 - RNA, 21 nt, Mycobacterium tuberculosis H37Rv
ccagguguccccgcccggcca

SEQ ID NO: 3245739 - RNA, 22 nt, Mycobacterium tuberculosis H37Rv
ccagguguucgccggagacccg

SEQ ID NO: 3245740 - RNA, 17 nt, Mycobacterium tuberculosis H37Rv
ccagguucaugcaaaag

SEQ ID NO: 3245741 - RNA, 16 nt, Mycobacterium tuberculosis H37Rv
ccagguuccaggucug

SEQ ID NO: 3245742 - RNA, 23 nt, Mycobacterium tuberculosis H37Rv
ccagguuccgcugucgagccggu

SEQ ID NO: 3245743 - RNA, 23 nt, Mycobacterium tuberculosis H37Rv
ccagguucuucuccaccaccguc

SEQ ID NO: 3245744 - RNA, 23 nt, Mycobacterium tuberculosis H37Rv
ccagguugaagaaugccgucuga

SEQ ID NO: 3245745 - RNA, 14 nt, Mycobacterium tuberculosis H37Rv
ccagguugccaacc

SEQ ID NO: 3245746 - RNA, 15 nt, Mycobacterium tuberculosis H37Rv
ccagguuuugccgcg

SEQ ID NO: 3245747 - RNA, 21 nt, Mycobacterium tuberculosis H37Rv
ccaguaaaaaggcaggacuga

SEQ ID NO: 3245748 - RNA, 13 nt, Mycobacterium tuberculosis H37Rv
ccaguaagccgcg

SEQ ID NO: 3245749 - RNA, 18 nt, Mycobacterium tuberculosis H37Rv
ccaguaccgucaucgcgg

SEQ ID NO: 3245750 - RNA, 14 nt, Mycobacterium tuberculosis H37Rv
ccaguagaucgcga

SEQ ID NO: 3245751 - RNA, 12 nt, Mycobacterium tuberculosis H37Rv
ccaguagccggu

SEQ ID NO: 3245752 - RNA, 20 nt, Mycobacterium tuberculosis H37Rv
ccaguagccggugccggcgc

SEQ ID NO: 3245753 - RNA, 13 nt, Mycobacterium tuberculosis H37Rv
ccaguaggcuucg

SEQ ID NO: 3245754 - RNA, 19 nt, Mycobacterium tuberculosis H37Rv
ccaguaggcuucgaccgug

SEQ ID NO: 3245755 - RNA, 17 nt, Mycobacterium tuberculosis H37Rv
ccagucacgcccaccac

SEQ ID NO: 3245756 - RNA, 12 nt, Mycobacterium tuberculosis H37Rv
ccaguccgcugg

SEQ ID NO: 3245757 - RNA, 17 nt, Mycobacterium tuberculosis H37Rv
ccaguccucgacguggc

SEQ ID NO: 3245758 - RNA, 14 nt, Mycobacterium tuberculosis H37Rv
ccaguccucgggca

SEQ ID NO: 3245759 - RNA, 20 nt, Mycobacterium tuberculosis H37Rv
ccagucgaagaagacccgug

SEQ ID NO: 3245760 - RNA, 15 nt, Mycobacterium tuberculosis H37Rv
ccagucgacccagcg

SEQ ID NO: 3245761 - RNA, 17 nt, Mycobacterium tuberculosis H37Rv
ccagucgaucgcggccc

SEQ ID NO: 3245762 - RNA, 16 nt, Mycobacterium tuberculosis H37Rv
ccagucgauguccugc

SEQ ID NO: 3245763 - RNA, 20 nt, Mycobacterium tuberculosis H37Rv
ccagucgcaggaucggcgga

SEQ ID NO: 3245764 - RNA, 15 nt, Mycobacterium tuberculosis H37Rv
ccaucccggccucca

SEQ ID NO: 3245765 - RNA, 15 nt, Mycobacterium tuberculosis H37Rv
ccaucccggcgccgc

SEQ ID NO: 3245766 - RNA, 16 nt, Mycobacterium tuberculosis H37Rv
ccaucccguucagcga

SEQ ID NO: 3245767 - RNA, 16 nt, Mycobacterium tuberculosis H37Rv
ccauccggcggcggcc

SEQ ID NO: 3245768 - RNA, 20 nt, Mycobacterium tuberculosis H37Rv
ccauccgggccgcggccaca

SEQ ID NO: 3245769 - RNA, 19 nt, Mycobacterium tuberculosis H37Rv
ccauccgggcugccacggc

SEQ ID NO: 3245770 - RNA, 22 nt, Mycobacterium tuberculosis H37Rv
ccauccgugaaucgagcaccgc

SEQ ID NO: 3245771 - RNA, 11 nt, Mycobacterium tuberculosis H37Rv
ccaucgaccga

SEQ ID NO: 3245772 - RNA, 13 nt, Mycobacterium tuberculosis H37Rv
ccaucgaccgccc

SEQ ID NO: 3245773 - RNA, 14 nt, Mycobacterium tuberculosis H37Rv
ccaucgaccgcccg

SEQ ID NO: 3245774 - RNA, 13 nt, Mycobacterium tuberculosis H37Rv
ccaucgacgccgc

SEQ ID NO: 3245775 - RNA, 18 nt, Mycobacterium tuberculosis H37Rv
ccaucgaggcgaucaccg

SEQ ID NO: 3245776 - RNA, 15 nt, Mycobacterium tuberculosis H37Rv
ccaucgaguccacca

SEQ ID NO: 3245777 - RNA, 23 nt, Mycobacterium tuberculosis H37Rv
ccaucgcauccccagcacaacca

SEQ ID NO: 3245778 - RNA, 22 nt, Mycobacterium tuberculosis H37Rv
ccaucgccaccgcgucacuucc

SEQ ID NO: 3245779 - RNA, 16 nt, Mycobacterium tuberculosis H37Rv
ccaucgccgacggcga

SEQ ID NO: 3245780 - RNA, 12 nt, Mycobacterium tuberculosis H37Rv
ccaucgccgccg

SEQ ID NO: 3245781 - RNA, 22 nt, Mycobacterium tuberculosis H37Rv
ccaucgccgccgcgcguucggc

SEQ ID NO: 3245782 - RNA, 12 nt, Mycobacterium tuberculosis H37Rv
ccaucgccucca

SEQ ID NO: 3245783 - RNA, 20 nt, Mycobacterium tuberculosis H37Rv
ccaucgccuccagccggcga

SEQ ID NO: 3245784 - RNA, 15 nt, Mycobacterium tuberculosis H37Rv
ccaucgcgacaucgg

SEQ ID NO: 3245785 - RNA, 18 nt, Mycobacterium tuberculosis H37Rv
ccaucgcgacaucggugg

SEQ ID NO: 3245786 - RNA, 13 nt, Mycobacterium tuberculosis H37Rv
ccaucgcgacggc

SEQ ID NO: 3245787 - RNA, 15 nt, Mycobacterium tuberculosis H37Rv
ccaucgcgacggccc

SEQ ID NO: 3245788 - RNA, 17 nt, Mycobacterium tuberculosis H37Rv
ccaucgcgacggcccga

SEQ ID NO: 3245789 - RNA, 20 nt, Mycobacterium tuberculosis H37Rv
ccaucgcgacuagacgccgc

SEQ ID NO: 3245790 - RNA, 19 nt, Mycobacterium tuberculosis H37Rv
ccaucgcggaaccguacgc

SEQ ID NO: 3245791 - RNA, 18 nt, Mycobacterium tuberculosis H37Rv
ccaucgcggcguugugac

SEQ ID NO: 3245792 - RNA, 13 nt, Mycobacterium tuberculosis H37Rv
ccaucgcgucggc

SEQ ID NO: 3245793 - RNA, 19 nt, Mycobacterium tuberculosis H37Rv
ccaucgcgucgucuucuuc

SEQ ID NO: 3245794 - RNA, 21 nt, Mycobacterium tuberculosis H37Rv
ccaucgcgucgucuucuucgc

SEQ ID NO: 3245795 - RNA, 15 nt, Mycobacterium tuberculosis H37Rv
ccaucgcuugcgcac

SEQ ID NO: 3245796 - RNA, 18 nt, Mycobacterium tuberculosis H37Rv
ccaucggcuaggccggcc

SEQ ID NO: 3245797 - RNA, 19 nt, Mycobacterium tuberculosis H37Rv
ccaucgggcgcgguaacca

SEQ ID NO: 3245798 - RNA, 22 nt, Mycobacterium tuberculosis H37Rv
ccaucgguaucgagggcagccg

SEQ ID NO: 3245799 - RNA, 19 nt, Mycobacterium tuberculosis H37Rv
ccaucgguuugcacucguc

SEQ ID NO: 3245800 - RNA, 15 nt, Mycobacterium tuberculosis H37Rv
ccaucguccagcagg

SEQ ID NO: 3245801 - RNA, 13 nt, Mycobacterium tuberculosis H37Rv
ccaucgucgagcg

SEQ ID NO: 3245802 - RNA, 16 nt, Mycobacterium tuberculosis H37Rv
ccaucgugcugaagcu

SEQ ID NO: 3245803 - RNA, 20 nt, Mycobacterium tuberculosis H37Rv
ccaucguguacuggucugga

SEQ ID NO: 3245804 - RNA, 19 nt, Mycobacterium tuberculosis H37Rv
ccaucguuguugaccacca

SEQ ID NO: 3245805 - RNA, 19 nt, Mycobacterium tuberculosis H37Rv
ccaucuacaucgucgagcg

SEQ ID NO: 3245806 - RNA, 17 nt, Mycobacterium tuberculosis H37Rv
ccaucuaccagcucacc

SEQ ID NO: 3245807 - RNA, 14 nt, Mycobacterium tuberculosis H37Rv
ccaucucaugcauc

SEQ ID NO: 3245808 - RNA, 16 nt, Mycobacterium tuberculosis H37Rv
ccaucuccgccgucgc

SEQ ID NO: 3245809 - RNA, 13 nt, Mycobacterium tuberculosis H37Rv
ccaucucggacca

SEQ ID NO: 3245810 - RNA, 14 nt, Mycobacterium tuberculosis H37Rv
ccaucucggaccac

SEQ ID NO: 3245811 - RNA, 16 nt, Mycobacterium tuberculosis H37Rv
ccaucucggaccacau

SEQ ID NO: 3245812 - RNA, 17 nt, Mycobacterium tuberculosis H37Rv
ccaucucggaccacauc

SEQ ID NO: 3245813 - RNA, 20 nt, Mycobacterium tuberculosis H37Rv
ccaucucggaccacaucugg

SEQ ID NO: 3245814 - RNA, 22 nt, Mycobacterium tuberculosis H37Rv
ccaucucgggcaggccgucgag

SEQ ID NO: 3245815 - RNA, 15 nt, Mycobacterium tuberculosis H37Rv
ccaucugccugccug

SEQ ID NO: 3245816 - RNA, 14 nt, Mycobacterium tuberculosis H37Rv
ccaucugcuggcug

SEQ ID NO: 3245817 - RNA, 22 nt, Mycobacterium tuberculosis H37Rv
ccaucuggccgcgggcgcggcc

SEQ ID NO: 3245818 - RNA, 20 nt, Mycobacterium tuberculosis H37Rv
ccaucuggcugagcagacug

SEQ ID NO: 3245819 - RNA, 20 nt, Mycobacterium tuberculosis H37Rv
ccaucugugcgcggacaccu

SEQ ID NO: 3245820 - RNA, 23 nt, Mycobacterium tuberculosis H37Rv
ccaucuucaucgccucgaggacc

SEQ ID NO: 3245821 - RNA, 18 nt, Mycobacterium tuberculosis H37Rv
ccaugaagccgggcgcuu

SEQ ID NO: 3245822 - RNA, 16 nt, Mycobacterium tuberculosis H37Rv
ccaugaaggagauccc

SEQ ID NO: 3245823 - RNA, 14 nt, Mycobacterium tuberculosis H37Rv
ccaugaagucgagg

SEQ ID NO: 3245824 - RNA, 16 nt, Mycobacterium tuberculosis H37Rv
ccaugagcuugguggc

SEQ ID NO: 3245825 - RNA, 14 nt, Mycobacterium tuberculosis H37Rv
ccaugaucccgcug

SEQ ID NO: 3245826 - RNA, 15 nt, Mycobacterium tuberculosis H37Rv
ccaugaucucggcga

SEQ ID NO: 3245827 - RNA, 18 nt, Mycobacterium tuberculosis H37Rv
ccaugaugaacagcucac

SEQ ID NO: 3245828 - RNA, 13 nt, Mycobacterium tuberculosis H37Rv
ccaugauggacag

SEQ ID NO: 3245829 - RNA, 15 nt, Mycobacterium tuberculosis H37Rv
ccaugauggacagcu

SEQ ID NO: 3245830 - RNA, 20 nt, Mycobacterium tuberculosis H37Rv
ccaugauugccaggaccgcg

SEQ ID NO: 3245831 - RNA, 16 nt, Mycobacterium tuberculosis H37Rv
ccaugcaccgaugccg

SEQ ID NO: 3245832 - RNA, 18 nt, Mycobacterium tuberculosis H37Rv
ccaugcccgcacgcucgg

SEQ ID NO: 3245833 - RNA, 23 nt, Mycobacterium tuberculosis H37Rv
ccaugccgaauaccgguggcagc

SEQ ID NO: 3245834 - RNA, 14 nt, Mycobacterium tuberculosis H37Rv
ccaugccgaucggc

SEQ ID NO: 3245835 - RNA, 17 nt, Mycobacterium tuberculosis H37Rv
ccaugccgaucggccug

SEQ ID NO: 3245836 - RNA, 19 nt, Mycobacterium tuberculosis H37Rv
ccaugccgccgaagccgcg

SEQ ID NO: 3245837 - RNA, 15 nt, Mycobacterium tuberculosis H37Rv
ccaugccgggaacca

SEQ ID NO: 3245838 - RNA, 12 nt, Mycobacterium tuberculosis H37Rv
ccaugccuccag

SEQ ID NO: 3245839 - RNA, 15 nt, Mycobacterium tuberculosis H37Rv
ccaugcgcaccaguc

SEQ ID NO: 3245840 - RNA, 16 nt, Mycobacterium tuberculosis H37Rv
ccaugcgcaccagucc

SEQ ID NO: 3245841 - RNA, 18 nt, Mycobacterium tuberculosis H37Rv
ccaugcgcaccaguccag

SEQ ID NO: 3245842 - RNA, 18 nt, Mycobacterium tuberculosis H37Rv
ccaugcgccaacccggcc

SEQ ID NO: 3245843 - RNA, 21 nt, Mycobacterium tuberculosis H37Rv
ccaugcgccaacccggccaaa

SEQ ID NO: 3245844 - RNA, 23 nt, Mycobacterium tuberculosis H37Rv
ccaugcggaauuugcuugggccc

SEQ ID NO: 3245845 - RNA, 21 nt, Mycobacterium tuberculosis H37Rv
ccaugcggguaaaccaggugg

SEQ ID NO: 3245846 - RNA, 18 nt, Mycobacterium tuberculosis H37Rv
ccaugcgguuagcagccg

SEQ ID NO: 3245847 - RNA, 17 nt, Mycobacterium tuberculosis H37Rv
ccaugcuaggaccacca

SEQ ID NO: 3245848 - RNA, 19 nt, Mycobacterium tuberculosis H37Rv
ccaugcuaggaccaccagc

SEQ ID NO: 3245849 - RNA, 22 nt, Mycobacterium tuberculosis H37Rv
ccaugcuaggaccaccagcgcu

SEQ ID NO: 3245850 - RNA, 23 nt, Mycobacterium tuberculosis H37Rv
ccaugcuaggaccaccagcgcuc

SEQ ID NO: 3245851 - RNA, 19 nt, Mycobacterium tuberculosis H37Rv
ccaugcugcccuuguugaa

SEQ ID NO: 3245852 - RNA, 11 nt, Mycobacterium tuberculosis H37Rv
ccaugcugcgc

SEQ ID NO: 3245853 - RNA, 14 nt, Mycobacterium tuberculosis H37Rv
ccaugcugcgcaac

SEQ ID NO: 3245854 - RNA, 17 nt, Mycobacterium tuberculosis H37Rv
ccauggaucccacgagu

SEQ ID NO: 3245855 - RNA, 13 nt, Mycobacterium tuberculosis H37Rv
ccauggcagcgcc

SEQ ID NO: 3245856 - RNA, 12 nt, Mycobacterium tuberculosis H37Rv
ccauggccacca

SEQ ID NO: 3245857 - RNA, 14 nt, Mycobacterium tuberculosis H37Rv
ccauggccaccagg

SEQ ID NO: 3245858 - RNA, 13 nt, Mycobacterium tuberculosis H37Rv
ccauggccaccga

SEQ ID NO: 3245859 - RNA, 23 nt, Mycobacterium tuberculosis H37Rv
ccauggccaccgaacgcggccac

SEQ ID NO: 3245860 - RNA, 14 nt, Mycobacterium tuberculosis H37Rv
ccauggccagcgcu

SEQ ID NO: 3245861 - RNA, 13 nt, Mycobacterium tuberculosis H37Rv
cccacccgcacca

SEQ ID NO: 3245862 - RNA, 13 nt, Mycobacterium tuberculosis H37Rv
cccacccgcaccg

SEQ ID NO: 3245863 - RNA, 15 nt, Mycobacterium tuberculosis H37Rv
cccacccgcaccgcc

SEQ ID NO: 3245864 - RNA, 16 nt, Mycobacterium tuberculosis H37Rv
cccacccgcaccgccg

SEQ ID NO: 3245865 - RNA, 19 nt, Mycobacterium tuberculosis H37Rv
cccacccucggguccaacc

SEQ ID NO: 3245866 - RNA, 21 nt, Mycobacterium tuberculosis H37Rv
cccaccgaagcggugacccac

SEQ ID NO: 3245867 - RNA, 13 nt, Mycobacterium tuberculosis H37Rv
cccaccgacagcc

SEQ ID NO: 3245868 - RNA, 13 nt, Mycobacterium tuberculosis H37Rv
cccaccgacgccg

SEQ ID NO: 3245869 - RNA, 14 nt, Mycobacterium tuberculosis H37Rv
cccaccgccccggc

SEQ ID NO: 3245870 - RNA, 13 nt, Mycobacterium tuberculosis H37Rv
cccaccgcgccga

SEQ ID NO: 3245871 - RNA, 16 nt, Mycobacterium tuberculosis H37Rv
cccaccgcugcggcac

SEQ ID NO: 3245872 - RNA, 12 nt, Mycobacterium tuberculosis H37Rv
cccaccggcacc

SEQ ID NO: 3245873 - RNA, 16 nt, Mycobacterium tuberculosis H37Rv
cccaccgguaccgcca

SEQ ID NO: 3245874 - RNA, 15 nt, Mycobacterium tuberculosis H37Rv
cccaccggucgccgc

SEQ ID NO: 3245875 - RNA, 17 nt, Mycobacterium tuberculosis H37Rv
cccaccggugccgcccg

SEQ ID NO: 3245876 - RNA, 18 nt, Mycobacterium tuberculosis H37Rv
cccaccggugccgcccgc

SEQ ID NO: 3245877 - RNA, 14 nt, Mycobacterium tuberculosis H37Rv
cccaccgucacccc

SEQ ID NO: 3245878 - RNA, 23 nt, Mycobacterium tuberculosis H37Rv
cccaccgucgucguuucgccagc

SEQ ID NO: 3245879 - RNA, 21 nt, Mycobacterium tuberculosis H37Rv
cccaccguugcgaagaagaag

SEQ ID NO: 3245880 - RNA, 16 nt, Mycobacterium tuberculosis H37Rv
cccaccuggaucagcg

SEQ ID NO: 3245881 - RNA, 14 nt, Mycobacterium tuberculosis H37Rv
cccacgagagcgcu

SEQ ID NO: 3245882 - RNA, 21 nt, Mycobacterium tuberculosis H37Rv
cccacgagagcgcugucccga

SEQ ID NO: 3245883 - RNA, 12 nt, Mycobacterium tuberculosis H37Rv
cccacgauaggu

SEQ ID NO: 3245884 - RNA, 16 nt, Mycobacterium tuberculosis H37Rv
cccacgcacagcaacg

SEQ ID NO: 3245885 - RNA, 19 nt, Mycobacterium tuberculosis H37Rv
cccacgcacagcaacgccc

SEQ ID NO: 3245886 - RNA, 22 nt, Mycobacterium tuberculosis H37Rv
cccacgcacagcaacgcccaac

SEQ ID NO: 3245887 - RNA, 13 nt, Mycobacterium tuberculosis H37Rv
cccacgccagcgc

SEQ ID NO: 3245888 - RNA, 14 nt, Mycobacterium tuberculosis H37Rv
cccacgccagcgcg

SEQ ID NO: 3245889 - RNA, 22 nt, Mycobacterium tuberculosis H37Rv
cccacgccugccgaaacgccga

SEQ ID NO: 3245890 - RNA, 21 nt, Mycobacterium tuberculosis H37Rv
cccacgcgcacucgaccagga

SEQ ID NO: 3245891 - RNA, 16 nt, Mycobacterium tuberculosis H37Rv
cccacggagggcagga

SEQ ID NO: 3245892 - RNA, 15 nt, Mycobacterium tuberculosis H37Rv
cccacggcaccacca

SEQ ID NO: 3245893 - RNA, 15 nt, Mycobacterium tuberculosis H37Rv
cccacggcagcgccg

SEQ ID NO: 3245894 - RNA, 22 nt, Mycobacterium tuberculosis H37Rv
cccacggccggccgcugccacu

SEQ ID NO: 3245895 - RNA, 15 nt, Mycobacterium tuberculosis H37Rv
cccacggcgaccacg

SEQ ID NO: 3245896 - RNA, 17 nt, Mycobacterium tuberculosis H37Rv
cccacggcgaccacgcc

SEQ ID NO: 3245897 - RNA, 18 nt, Mycobacterium tuberculosis H37Rv
cccacggcgaccacgccg

SEQ ID NO: 3245898 - RNA, 17 nt, Mycobacterium tuberculosis H37Rv
cccacggcgggcgagcc

SEQ ID NO: 3245899 - RNA, 19 nt, Mycobacterium tuberculosis H37Rv
cccacggcggguuccacac

SEQ ID NO: 3245900 - RNA, 14 nt, Mycobacterium tuberculosis H37Rv
cccacgggccggcc

SEQ ID NO: 3245901 - RNA, 19 nt, Mycobacterium tuberculosis H37Rv
cccacgggccggccgagcg

SEQ ID NO: 3245902 - RNA, 13 nt, Mycobacterium tuberculosis H37Rv
cccacgucgagca

SEQ ID NO: 3245903 - RNA, 16 nt, Mycobacterium tuberculosis H37Rv
cccacguggggccggg

SEQ ID NO: 3245904 - RNA, 16 nt, Mycobacterium tuberculosis H37Rv
cccacguugcugaugc

SEQ ID NO: 3245905 - RNA, 13 nt, Mycobacterium tuberculosis H37Rv
cccacuccagcag

SEQ ID NO: 3245906 - RNA, 18 nt, Mycobacterium tuberculosis H37Rv
cccacucccgccccgcuc

SEQ ID NO: 3245907 - RNA, 13 nt, Mycobacterium tuberculosis H37Rv
cccacuccgccga

SEQ ID NO: 3245908 - RNA, 16 nt, Mycobacterium tuberculosis H37Rv
cccacucggacccgca

SEQ ID NO: 3245909 - RNA, 21 nt, Mycobacterium tuberculosis H37Rv
cccacucggacccgcaauucc

SEQ ID NO: 3245910 - RNA, 23 nt, Mycobacterium tuberculosis H37Rv
cccacugaccgaacgcaacagcc

SEQ ID NO: 3245911 - RNA, 14 nt, Mycobacterium tuberculosis H37Rv
cccacugccacucc

SEQ ID NO: 3245912 - RNA, 22 nt, Mycobacterium tuberculosis H37Rv
cccacugccgugccgguguguc

SEQ ID NO: 3245913 - RNA, 15 nt, Mycobacterium tuberculosis H37Rv
cccacuggaccaccg

SEQ ID NO: 3245914 - RNA, 18 nt, Mycobacterium tuberculosis H37Rv
cccacuggaccaccgccg

SEQ ID NO: 3245915 - RNA, 13 nt, Mycobacterium tuberculosis H37Rv
cccacugggccgg

SEQ ID NO: 3245916 - RNA, 14 nt, Mycobacterium tuberculosis H37Rv
cccacugggccggu

SEQ ID NO: 3245917 - RNA, 18 nt, Mycobacterium tuberculosis H37Rv
cccacuggugcagcgccg

SEQ ID NO: 3245918 - RNA, 22 nt, Mycobacterium tuberculosis H37Rv
cccacuugauuuggggcagucc

SEQ ID NO: 3245919 - RNA, 22 nt, Mycobacterium tuberculosis H37Rv
cccagaaguagguuuucggcgg

SEQ ID NO: 3245920 - RNA, 17 nt, Mycobacterium tuberculosis H37Rv
cccagaauuccggcgga

SEQ ID NO: 3245921 - RNA, 12 nt, Mycobacterium tuberculosis H37Rv
cccagaccgccg

SEQ ID NO: 3245922 - RNA, 22 nt, Mycobacterium tuberculosis H37Rv
cccagaccgccgaagaagguga

SEQ ID NO: 3245923 - RNA, 18 nt, Mycobacterium tuberculosis H37Rv
cccagaccgccgacgccg

SEQ ID NO: 3245924 - RNA, 16 nt, Mycobacterium tuberculosis H37Rv
cccagacugucgagcg

SEQ ID NO: 3245925 - RNA, 17 nt, Mycobacterium tuberculosis H37Rv
cccagagaaucagcgug

SEQ ID NO: 3245926 - RNA, 20 nt, Mycobacterium tuberculosis H37Rv
cccagagcaucagguuguac

SEQ ID NO: 3245927 - RNA, 17 nt, Mycobacterium tuberculosis H37Rv
cccagauacccgcguac

SEQ ID NO: 3245928 - RNA, 23 nt, Mycobacterium tuberculosis H37Rv
cccagauaucguacuggcuauaa

SEQ ID NO: 3245929 - RNA, 17 nt, Mycobacterium tuberculosis H37Rv
cccagauauugaaccgg

SEQ ID NO: 3245930 - RNA, 17 nt, Mycobacterium tuberculosis H37Rv
cccagcacaaccagcug

SEQ ID NO: 3245931 - RNA, 16 nt, Mycobacterium tuberculosis H37Rv
cccagcacauucugca

SEQ ID NO: 3245932 - RNA, 22 nt, Mycobacterium tuberculosis H37Rv
cccagcaccaccgcggugugcg

SEQ ID NO: 3245933 - RNA, 15 nt, Mycobacterium tuberculosis H37Rv
cccagcaccacggug

SEQ ID NO: 3245934 - RNA, 21 nt, Mycobacterium tuberculosis H37Rv
cccagcacccccugcaccguc

SEQ ID NO: 3245935 - RNA, 15 nt, Mycobacterium tuberculosis H37Rv
cccagcacccggcuu

SEQ ID NO: 3245936 - RNA, 14 nt, Mycobacterium tuberculosis H37Rv
cccagcacgcuggc

SEQ ID NO: 3245937 - RNA, 13 nt, Mycobacterium tuberculosis H37Rv
cccagcacgguca

SEQ ID NO: 3245938 - RNA, 18 nt, Mycobacterium tuberculosis H37Rv
cccagcagcaccugcacc

SEQ ID NO: 3245939 - RNA, 20 nt, Mycobacterium tuberculosis H37Rv
cccagcagcaccugcaccgc

SEQ ID NO: 3245940 - RNA, 14 nt, Mycobacterium tuberculosis H37Rv
cccagcagggugug

SEQ ID NO: 3245941 - RNA, 15 nt, Mycobacterium tuberculosis H37Rv
cccagcagggugugc

SEQ ID NO: 3245942 - RNA, 23 nt, Mycobacterium tuberculosis H37Rv
cccagcagguuccacggccaggu

SEQ ID NO: 3245943 - RNA, 24 nt, Mycobacterium tuberculosis H37Rv
cccagcauggggucagcucgccag

SEQ ID NO: 3245944 - RNA, 16 nt, Mycobacterium tuberculosis H37Rv
cccagccaacucaggc

SEQ ID NO: 3245945 - RNA, 13 nt, Mycobacterium tuberculosis H37Rv
cccagcccagccg

SEQ ID NO: 3245946 - RNA, 23 nt, Mycobacterium tuberculosis H37Rv
cccagcccaugucgagcacgcca

SEQ ID NO: 3245947 - RNA, 14 nt, Mycobacterium tuberculosis H37Rv
cccagcccggccca

SEQ ID NO: 3245948 - RNA, 13 nt, Mycobacterium tuberculosis H37Rv
cccagcccggcgu

SEQ ID NO: 3245949 - RNA, 15 nt, Mycobacterium tuberculosis H37Rv
cccagcccuuggcgc

SEQ ID NO: 3245950 - RNA, 18 nt, Mycobacterium tuberculosis H37Rv
cccagcccuuggcgcgca

SEQ ID NO: 3245951 - RNA, 18 nt, Mycobacterium tuberculosis H37Rv
cccagccgagcggcggca

SEQ ID NO: 3245952 - RNA, 12 nt, Mycobacterium tuberculosis H37Rv
cccagccgcagc

SEQ ID NO: 3245953 - RNA, 15 nt, Mycobacterium tuberculosis H37Rv
cccagccgcagcacc

SEQ ID NO: 3245954 - RNA, 19 nt, Mycobacterium tuberculosis H37Rv
cccagccgcagcaccucgg

SEQ ID NO: 3245955 - RNA, 16 nt, Mycobacterium tuberculosis H37Rv
cccagccgcaucgggc

SEQ ID NO: 3245956 - RNA, 19 nt, Mycobacterium tuberculosis H37Rv
cccagccgcgccagcuccg

SEQ ID NO: 3245957 - RNA, 16 nt, Mycobacterium tuberculosis H37Rv
cccagccgcggcgcca

SEQ ID NO: 3245958 - RNA, 17 nt, Mycobacterium tuberculosis H37Rv
cccagucggcgccgccg

SEQ ID NO: 3245959 - RNA, 22 nt, Mycobacterium tuberculosis H37Rv
cccagucggcgccgccguccag

SEQ ID NO: 3245960 - RNA, 16 nt, Mycobacterium tuberculosis H37Rv
cccagugccagaaccc

SEQ ID NO: 3245961 - RNA, 15 nt, Mycobacterium tuberculosis H37Rv
cccagugggacaggu

SEQ ID NO: 3245962 - RNA, 13 nt, Mycobacterium tuberculosis H37Rv
cccagugucagca

SEQ ID NO: 3245963 - RNA, 15 nt, Mycobacterium tuberculosis H37Rv
cccaguguucgacga

SEQ ID NO: 3245964 - RNA, 18 nt, Mycobacterium tuberculosis H37Rv
cccaguucguugguguug

SEQ ID NO: 3245965 - RNA, 16 nt, Mycobacterium tuberculosis H37Rv
cccauaccuucggcga

SEQ ID NO: 3245966 - RNA, 23 nt, Mycobacterium tuberculosis H37Rv
cccauaccuucggcgaucuugac

SEQ ID NO: 3245967 - RNA, 15 nt, Mycobacterium tuberculosis H37Rv
cccauagcaccucga

SEQ ID NO: 3245968 - RNA, 17 nt, Mycobacterium tuberculosis H37Rv
cccaucacacccgguau

SEQ ID NO: 3245969 - RNA, 22 nt, Mycobacterium tuberculosis H37Rv
cccaucacacccgguaugcgcg

SEQ ID NO: 3245970 - RNA, 20 nt, Mycobacterium tuberculosis H37Rv
cccaucagaaugccuggccc

SEQ ID NO: 3245971 - RNA, 15 nt, Mycobacterium tuberculosis H37Rv
cccaucagcccucgg

SEQ ID NO: 3245972 - RNA, 21 nt, Mycobacterium tuberculosis H37Rv
cccaucaguugcacaccgauc

SEQ ID NO: 3245973 - RNA, 18 nt, Mycobacterium tuberculosis H37Rv
cccaucgaccgcccgcca

SEQ ID NO: 3245974 - RNA, 22 nt, Mycobacterium tuberculosis H37Rv
cccaucgaccgcccgccagcga

SEQ ID NO: 3245975 - RNA, 16 nt, Mycobacterium tuberculosis H37Rv
cccaucgccacaccca

SEQ ID NO: 3245976 - RNA, 16 nt, Mycobacterium tuberculosis H37Rv
cccaucgccuggaugc

SEQ ID NO: 3245977 - RNA, 13 nt, Mycobacterium tuberculosis H37Rv
cccaucgcgucgg

SEQ ID NO: 3245978 - RNA, 15 nt, Mycobacterium tuberculosis H37Rv
cccaucgggcgccca

SEQ ID NO: 3245979 - RNA, 23 nt, Mycobacterium tuberculosis H37Rv
cccaucggggcuacaacugccga

SEQ ID NO: 3245980 - RNA, 14 nt, Mycobacterium tuberculosis H37Rv
cccaucgugcugaa

SEQ ID NO: 3245981 - RNA, 19 nt, Mycobacterium tuberculosis H37Rv
cccaucuaccagcucaccc

SEQ ID NO: 3245982 - RNA, 16 nt, Mycobacterium tuberculosis H37Rv
cccaucucgucgucgg

SEQ ID NO: 3245983 - RNA, 13 nt, Mycobacterium tuberculosis H37Rv
cccaugaucuggu

SEQ ID NO: 3245984 - RNA, 17 nt, Mycobacterium tuberculosis H37Rv
cccaugauggccgcggc

SEQ ID NO: 3245985 - RNA, 13 nt, Mycobacterium tuberculosis H37Rv
cccaugccgaccg

SEQ ID NO: 3245986 - RNA, 15 nt, Mycobacterium tuberculosis H37Rv
cccaugcgccagcga

SEQ ID NO: 3245987 - RNA, 18 nt, Mycobacterium tuberculosis H37Rv
cccaugcgccagcgagcg

SEQ ID NO: 3245988 - RNA, 23 nt, Mycobacterium tuberculosis H37Rv
cccaugcgguuuggaucacccgc

SEQ ID NO: 3245989 - RNA, 13 nt, Mycobacterium tuberculosis H37Rv
cccaugcugcgca

SEQ ID NO: 3245990 - RNA, 17 nt, Mycobacterium tuberculosis H37Rv
cccauggccaccgaacg

SEQ ID NO: 3245991 - RNA, 19 nt, Mycobacterium tuberculosis H37Rv
cccauggcuccgcccagga

SEQ ID NO: 3245992 - RNA, 17 nt, Mycobacterium tuberculosis H37Rv
cccaugggguauggugu

SEQ ID NO: 3245993 - RNA, 13 nt, Mycobacterium tuberculosis H37Rv
cccaugucggcgc

SEQ ID NO: 3245994 - RNA, 19 nt, Mycobacterium tuberculosis H37Rv
cccaugucggcgcgccgca

SEQ ID NO: 3245995 - RNA, 12 nt, Mycobacterium tuberculosis H37Rv
cccauucggcgg

SEQ ID NO: 3245996 - RNA, 23 nt, Mycobacterium tuberculosis H37Rv
cccauucucggccggcggcgccc

SEQ ID NO: 3245997 - RNA, 12 nt, Mycobacterium tuberculosis H37Rv
cccauugccgcc

SEQ ID NO: 3245998 - RNA, 13 nt, Mycobacterium tuberculosis H37Rv
cccauugccgccg

SEQ ID NO: 3245999 - RNA, 16 nt, Mycobacterium tuberculosis H37Rv
cccauugccgccgucg

SEQ ID NO: 3246000 - RNA, 12 nt, Mycobacterium tuberculosis H37Rv
cccauugcgccc

SEQ ID NO: 3246001 - RNA, 14 nt, Mycobacterium tuberculosis H37Rv
cccauugcgcccca

SEQ ID NO: 3246002 - RNA, 23 nt, Mycobacterium tuberculosis H37Rv
cccauuggaccgagacuugcugg

SEQ ID NO: 3246003 - RNA, 13 nt, Mycobacterium tuberculosis H37Rv
cccauuucggcac

SEQ ID NO: 3246004 - RNA, 17 nt, Mycobacterium tuberculosis H37Rv
cccauuucgucagcgac

SEQ ID NO: 3246005 - RNA, 16 nt, Mycobacterium tuberculosis H37Rv
cccauuugccuugagc

SEQ ID NO: 3246006 - RNA, 21 nt, Mycobacterium tuberculosis H37Rv
ccccaacugcgaaacgccacc

SEQ ID NO: 3246007 - RNA, 15 nt, Mycobacterium tuberculosis H37Rv
ccccaagcccgauuc

SEQ ID NO: 3246008 - RNA, 16 nt, Mycobacterium tuberculosis H37Rv
ccccaaucagugcagc

SEQ ID NO: 3246009 - RNA, 22 nt, Mycobacterium tuberculosis H37Rv
ccccaaucgaccgcccgccaac

SEQ ID NO: 3246010 - RNA, 13 nt, Mycobacterium tuberculosis H37Rv
ccccacacagucg

SEQ ID NO: 3246011 - RNA, 13 nt, Mycobacterium tuberculosis H37Rv
ccccacccaccac

SEQ ID NO: 3246012 - RNA, 15 nt, Mycobacterium tuberculosis H37Rv
ccccaccgaagcggu

SEQ ID NO: 3246013 - RNA, 15 nt, Mycobacterium tuberculosis H37Rv
ccccaccggcacccc

SEQ ID NO: 3246014 - RNA, 19 nt, Mycobacterium tuberculosis H37Rv
ccccaccgguaccgccacu

SEQ ID NO: 3246015 - RNA, 16 nt, Mycobacterium tuberculosis H37Rv
ccccaccggugccgcc

SEQ ID NO: 3246016 - RNA, 12 nt, Mycobacterium tuberculosis H37Rv
ccccaccgguua

SEQ ID NO: 3246017 - RNA, 19 nt, Mycobacterium tuberculosis H37Rv
ccccacuggugcagcgccg

SEQ ID NO: 3246018 - RNA, 22 nt, Mycobacterium tuberculosis H37Rv
ccccacuggugcagcgccgaca

SEQ ID NO: 3246019 - RNA, 21 nt, Mycobacterium tuberculosis H37Rv
ccccacuugccgggcaaucgc

SEQ ID NO: 3246020 - RNA, 14 nt, Mycobacterium tuberculosis H37Rv
ccccagacaaagau

SEQ ID NO: 3246021 - RNA, 18 nt, Mycobacterium tuberculosis H37Rv
ccccagacaauccgccgc

SEQ ID NO: 3246022 - RNA, 12 nt, Mycobacterium tuberculosis H37Rv
ccccagaccgcc

SEQ ID NO: 3246023 - RNA, 12 nt, Mycobacterium tuberculosis H37Rv
ccccagagcugg

SEQ ID NO: 3246024 - RNA, 22 nt, Mycobacterium tuberculosis H37Rv
ccccagcacccggcuucgccgc

SEQ ID NO: 3246025 - RNA, 14 nt, Mycobacterium tuberculosis H37Rv
ccccagcagggugu

SEQ ID NO: 3246026 - RNA, 22 nt, Mycobacterium tuberculosis H37Rv
ccccagcaucuuuggcggccgc

SEQ ID NO: 3246027 - RNA, 13 nt, Mycobacterium tuberculosis H37Rv
ccccagccaugcu

SEQ ID NO: 3246028 - RNA, 19 nt, Mycobacterium tuberculosis H37Rv
ccccagcgacaugcccgcc

SEQ ID NO: 3246029 - RNA, 13 nt, Mycobacterium tuberculosis H37Rv
ccccagcgacggc

SEQ ID NO: 3246030 - RNA, 15 nt, Mycobacterium tuberculosis H37Rv
ccccagcgacggcaa

SEQ ID NO: 3246031 - RNA, 12 nt, Mycobacterium tuberculosis H37Rv
ccccagcgacgu

SEQ ID NO: 3246032 - RNA, 19 nt, Mycobacterium tuberculosis H37Rv
ccccagcgacgucgcaaua

SEQ ID NO: 3246033 - RNA, 15 nt, Mycobacterium tuberculosis H37Rv
ccccagcgccaccgu

SEQ ID NO: 3246034 - RNA, 13 nt, Mycobacterium tuberculosis H37Rv
ccccagcgccgcc

SEQ ID NO: 3246035 - RNA, 15 nt, Mycobacterium tuberculosis H37Rv
ccccagcgccgccgc

SEQ ID NO: 3246036 - RNA, 18 nt, Mycobacterium tuberculosis H37Rv
ccccagcggccaccgagg

SEQ ID NO: 3246037 - RNA, 15 nt, Mycobacterium tuberculosis H37Rv
ccccagcguucccgc

SEQ ID NO: 3246038 - RNA, 19 nt, Mycobacterium tuberculosis H37Rv
ccccagcugcggucgcggc

SEQ ID NO: 3246039 - RNA, 16 nt, Mycobacterium tuberculosis H37Rv
ccccagcuugcgguga

SEQ ID NO: 3246040 - RNA, 21 nt, Mycobacterium tuberculosis H37Rv
ccccaggccgcuugccccgcc

SEQ ID NO: 3246041 - RNA, 14 nt, Mycobacterium tuberculosis H37Rv
ccccaggcgaacag

SEQ ID NO: 3246042 - RNA, 16 nt, Mycobacterium tuberculosis H37Rv
ccccagggagugccgc

SEQ ID NO: 3246043 - RNA, 13 nt, Mycobacterium tuberculosis H37Rv
ccccaggugggca

SEQ ID NO: 3246044 - RNA, 21 nt, Mycobacterium tuberculosis H37Rv
ccccaggugggcagcaggccc

SEQ ID NO: 3246045 - RNA, 24 nt, Mycobacterium tuberculosis H37Rv
ccccaggugggcagcaggcccacc

SEQ ID NO: 3246046 - RNA, 18 nt, Mycobacterium tuberculosis H37Rv
ccccaguucgacggcguc

SEQ ID NO: 3246047 - RNA, 21 nt, Mycobacterium tuberculosis H37Rv
ccccaguugugcggccaggcg

SEQ ID NO: 3246048 - RNA, 13 nt, Mycobacterium tuberculosis H37Rv
ccccauagcaaga

SEQ ID NO: 3246049 - RNA, 23 nt, Mycobacterium tuberculosis H37Rv
ccccauaguuguuccuggucgag

SEQ ID NO: 3246050 - RNA, 21 nt, Mycobacterium tuberculosis H37Rv
ccccaucagaaugccuggccc

SEQ ID NO: 3246051 - RNA, 14 nt, Mycobacterium tuberculosis H37Rv
ccccaugaccggga

SEQ ID NO: 3246052 - RNA, 19 nt, Mycobacterium tuberculosis H37Rv
ccccaugaugaacagcuca

SEQ ID NO: 3246053 - RNA, 16 nt, Mycobacterium tuberculosis H37Rv
ccccaugcgguuugga

SEQ ID NO: 3246054 - RNA, 12 nt, Mycobacterium tuberculosis H37Rv
ccccauugccgc

SEQ ID NO: 3246055 - RNA, 17 nt, Mycobacterium tuberculosis H37Rv
ccccgcgaaguugcggg

SEQ ID NO: 3246056 - RNA, 23 nt, Mycobacterium tuberculosis H37Rv
ccccgcgauuggaaugguggugc

SEQ ID NO: 3246057 - RNA, 12 nt, Mycobacterium tuberculosis H37Rv
ccccgcgcugag

SEQ ID NO: 3246058 - RNA, 11 nt, Mycobacterium tuberculosis H37Rv
ccccgcggcgg

SEQ ID NO: 3246059 - RNA, 12 nt, Mycobacterium tuberculosis H37Rv
ccccgcggcggu

SEQ ID NO: 3246060 - RNA, 15 nt, Mycobacterium tuberculosis H37Rv
ccccgcuacgcgcgc

SEQ ID NO: 3246061 - RNA, 19 nt, Mycobacterium tuberculosis H37Rv
ccccgcucgaccagacgcu

SEQ ID NO: 3246062 - RNA, 13 nt, Mycobacterium tuberculosis H37Rv
ccccgcugcgacg

SEQ ID NO: 3246063 - RNA, 23 nt, Mycobacterium tuberculosis H37Rv
ccccggaaagccuaguacgccga

SEQ ID NO: 3246064 - RNA, 17 nt, Mycobacterium tuberculosis H37Rv
ccccggaacgaccccac

SEQ ID NO: 3246065 - RNA, 19 nt, Mycobacterium tuberculosis H37Rv
ccccggaaugcccgagcag

SEQ ID NO: 3246066 - RNA, 16 nt, Mycobacterium tuberculosis H37Rv
ccccggaccaucgaca

SEQ ID NO: 3246067 - RNA, 16 nt, Mycobacterium tuberculosis H37Rv
ccccggaccgcggcca

SEQ ID NO: 3246068 - RNA, 12 nt, Mycobacterium tuberculosis H37Rv
ccccggagccag

SEQ ID NO: 3246069 - RNA, 15 nt, Mycobacterium tuberculosis H37Rv
ccccggcaccgccgg

SEQ ID NO: 3246070 - RNA, 23 nt, Mycobacterium tuberculosis H37Rv
ccccggccacuugguaguccugc

SEQ ID NO: 3246071 - RNA, 19 nt, Mycobacterium tuberculosis H37Rv
ccccggcccgaucggcaac

SEQ ID NO: 3246072 - RNA, 16 nt, Mycobacterium tuberculosis H37Rv
ccccggccuuggcggc

SEQ ID NO: 3246073 - RNA, 15 nt, Mycobacterium tuberculosis H37Rv
ccccggcgacggcgu

SEQ ID NO: 3246074 - RNA, 18 nt, Mycobacterium tuberculosis H37Rv
ccccggcgacggcguagc

SEQ ID NO: 3246075 - RNA, 17 nt, Mycobacterium tuberculosis H37Rv
ccccggcgcggccagcu

SEQ ID NO: 3246076 - RNA, 19 nt, Mycobacterium tuberculosis H37Rv
ccccggcgguaccagagca

SEQ ID NO: 3246077 - RNA, 18 nt, Mycobacterium tuberculosis H37Rv
ccccggcucucuucgcgc

SEQ ID NO: 3246078 - RNA, 18 nt, Mycobacterium tuberculosis H37Rv
ccccggcugccagcgccg

SEQ ID NO: 3246079 - RNA, 15 nt, Mycobacterium tuberculosis H37Rv
ccccgggcggcgccg

SEQ ID NO: 3246080 - RNA, 19 nt, Mycobacterium tuberculosis H37Rv
ccccgggcggcgccggcgc

SEQ ID NO: 3246081 - RNA, 15 nt, Mycobacterium tuberculosis H37Rv
ccccggggcgcucgc

SEQ ID NO: 3246082 - RNA, 19 nt, Mycobacterium tuberculosis H37Rv
ccccgggggaagcgccaac

SEQ ID NO: 3246083 - RNA, 20 nt, Mycobacterium tuberculosis H37Rv
ccccgguaccgcccgcaccg

SEQ ID NO: 3246084 - RNA, 17 nt, Mycobacterium tuberculosis H37Rv
ccccggucaggacggca

SEQ ID NO: 3246085 - RNA, 15 nt, Mycobacterium tuberculosis H37Rv
ccccggucccgccga

SEQ ID NO: 3246086 - RNA, 13 nt, Mycobacterium tuberculosis H37Rv
ccccggucgccgc

SEQ ID NO: 3246087 - RNA, 21 nt, Mycobacterium tuberculosis H37Rv
ccccggucggcgacguauacc

SEQ ID NO: 3246088 - RNA, 18 nt, Mycobacterium tuberculosis H37Rv
ccccggugcagaugcggc

SEQ ID NO: 3246089 - RNA, 16 nt, Mycobacterium tuberculosis H37Rv
ccccggugccgcccgc

SEQ ID NO: 3246090 - RNA, 19 nt, Mycobacterium tuberculosis H37Rv
ccccgguugacucgcuccg

SEQ ID NO: 3246091 - RNA, 22 nt, Mycobacterium tuberculosis H37Rv
ccccgguugacucgcuccgacc

SEQ ID NO: 3246092 - RNA, 21 nt, Mycobacterium tuberculosis H37Rv
ccccguaaauaucggggccac

SEQ ID NO: 3246093 - RNA, 22 nt, Mycobacterium tuberculosis H37Rv
ccccguagauggugguggcccg

SEQ ID NO: 3246094 - RNA, 17 nt, Mycobacterium tuberculosis H37Rv
ccccguaggcgccgaac

SEQ ID NO: 3246095 - RNA, 23 nt, Mycobacterium tuberculosis H37Rv
ccccguaggugcacaacccgugc

SEQ ID NO: 3246096 - RNA, 18 nt, Mycobacterium tuberculosis H37Rv
ccccgucagcgggcagca

SEQ ID NO: 3246097 - RNA, 16 nt, Mycobacterium tuberculosis H37Rv
ccccguccucgaucgc

SEQ ID NO: 3246098 - RNA, 17 nt, Mycobacterium tuberculosis H37Rv
ccccgucgaccuccacc

SEQ ID NO: 3246099 - RNA, 14 nt, Mycobacterium tuberculosis H37Rv
ccccgucgaucagc

SEQ ID NO: 3246100 - RNA, 14 nt, Mycobacterium tuberculosis H37Rv
ccccgucgccaccg

SEQ ID NO: 3246101 - RNA, 19 nt, Mycobacterium tuberculosis H37Rv
ccccguuaccgccgucgcc

SEQ ID NO: 3246102 - RNA, 15 nt, Mycobacterium tuberculosis H37Rv
ccccguucuggaacc

SEQ ID NO: 3246103 - RNA, 21 nt, Mycobacterium tuberculosis H37Rv
ccccguucuggaaccccgagc

SEQ ID NO: 3246104 - RNA, 12 nt, Mycobacterium tuberculosis H37Rv
ccccguugccgc

SEQ ID NO: 3246105 - RNA, 16 nt, Mycobacterium tuberculosis H37Rv
ccccguugccgcccgu

SEQ ID NO: 3246106 - RNA, 14 nt, Mycobacterium tuberculosis H37Rv
ccccguugcgguaa

SEQ ID NO: 3246107 - RNA, 14 nt, Mycobacterium tuberculosis H37Rv
ccccguuucgccag

SEQ ID NO: 3246108 - RNA, 22 nt, Mycobacterium tuberculosis H37Rv
ccccguuucgccagauggccac

SEQ ID NO: 3246109 - RNA, 16 nt, Mycobacterium tuberculosis H37Rv
ccccuaaaccggcagg

SEQ ID NO: 3246110 - RNA, 15 nt, Mycobacterium tuberculosis H37Rv
ccccuccgggcgcac

SEQ ID NO: 3246111 - RNA, 18 nt, Mycobacterium tuberculosis H37Rv
ccccuccuucggugaggu

SEQ ID NO: 3246112 - RNA, 14 nt, Mycobacterium tuberculosis H37Rv
ccccucggccgccc

SEQ ID NO: 3246113 - RNA, 16 nt, Mycobacterium tuberculosis H37Rv
ccccucggcuucggag

SEQ ID NO: 3246114 - RNA, 21 nt, Mycobacterium tuberculosis H37Rv
ccccucgucgucaucgagcgg

SEQ ID NO: 3246115 - RNA, 15 nt, Mycobacterium tuberculosis H37Rv
ccccucuagcgccuc

SEQ ID NO: 3246116 - RNA, 18 nt, Mycobacterium tuberculosis H37Rv
ccccucuagcgccucgcc

SEQ ID NO: 3246117 - RNA, 19 nt, Mycobacterium tuberculosis H37Rv
ccccugaaucaccggagcg

SEQ ID NO: 3246118 - RNA, 13 nt, Mycobacterium tuberculosis H37Rv
ccccugccacagc

SEQ ID NO: 3246119 - RNA, 14 nt, Mycobacterium tuberculosis H37Rv
ccccugccacagcg

SEQ ID NO: 3246120 - RNA, 19 nt, Mycobacterium tuberculosis H37Rv
ccccuggacuucgggggcc

SEQ ID NO: 3246121 - RNA, 14 nt, Mycobacterium tuberculosis H37Rv
ccccuggcaccucg

SEQ ID NO: 3246122 - RNA, 13 nt, Mycobacterium tuberculosis H37Rv
ccccuggccaacc

SEQ ID NO: 3246123 - RNA, 13 nt, Mycobacterium tuberculosis H37Rv
ccccuggccagca

SEQ ID NO: 3246124 - RNA, 12 nt, Mycobacterium tuberculosis H37Rv
ccccuggccgcc

SEQ ID NO: 3246125 - RNA, 14 nt, Mycobacterium tuberculosis H37Rv
ccccuggccgccgg

SEQ ID NO: 3246126 - RNA, 17 nt, Mycobacterium tuberculosis H37Rv
ccccuggccgccggcgc

SEQ ID NO: 3246127 - RNA, 22 nt, Mycobacterium tuberculosis H37Rv
ccccuggccgccggcgccgcca

SEQ ID NO: 3246128 - RNA, 11 nt, Mycobacterium tuberculosis H37Rv
ccccuggcgau

SEQ ID NO: 3246129 - RNA, 18 nt, Mycobacterium tuberculosis H37Rv
ccccugguacaccaggcc

SEQ ID NO: 3246130 - RNA, 16 nt, Mycobacterium tuberculosis H37Rv
ccccugucaacgccgc

SEQ ID NO: 3246131 - RNA, 19 nt, Mycobacterium tuberculosis H37Rv
cccgaacaauucacgcacc

SEQ ID NO: 3246132 - RNA, 19 nt, Mycobacterium tuberculosis H37Rv
cccgaacauugcgcccagc

SEQ ID NO: 3246133 - RNA, 15 nt, Mycobacterium tuberculosis H37Rv
cccgaaccaccgcgu

SEQ ID NO: 3246134 - RNA, 16 nt, Mycobacterium tuberculosis H37Rv
cccgaaccaccgcguu

SEQ ID NO: 3246135 - RNA, 14 nt, Mycobacterium tuberculosis H37Rv
cccgaaccccgacc

SEQ ID NO: 3246136 - RNA, 13 nt, Mycobacterium tuberculosis H37Rv
cccgaaccgagcg

SEQ ID NO: 3246137 - RNA, 14 nt, Mycobacterium tuberculosis H37Rv
cccgaaccgcgcug

SEQ ID NO: 3246138 - RNA, 18 nt, Mycobacterium tuberculosis H37Rv
cccgaagaucuccuccug

SEQ ID NO: 3246139 - RNA, 20 nt, Mycobacterium tuberculosis H37Rv
cccgaagaucuccuccugug

SEQ ID NO: 3246140 - RNA, 23 nt, Mycobacterium tuberculosis H37Rv
cccgaagaugaccucggcgacga

SEQ ID NO: 3246141 - RNA, 14 nt, Mycobacterium tuberculosis H37Rv
cccgaagccgaccg

SEQ ID NO: 3246142 - RNA, 21 nt, Mycobacterium tuberculosis H37Rv
cccgaagccggugccggcguu

SEQ ID NO: 3246143 - RNA, 18 nt, Mycobacterium tuberculosis H37Rv
cccgaaguagaagcccag

SEQ ID NO: 3246144 - RNA, 19 nt, Mycobacterium tuberculosis H37Rv
cccgacacccguaagcgga

SEQ ID NO: 3246145 - RNA, 13 nt, Mycobacterium tuberculosis H37Rv
cccgacaccgccg

SEQ ID NO: 3246146 - RNA, 19 nt, Mycobacterium tuberculosis H37Rv
cccgacaccguccagcagc

SEQ ID NO: 3246147 - RNA, 23 nt, Mycobacterium tuberculosis H37Rv
cccgacacucgauccggauucag

SEQ ID NO: 3246148 - RNA, 22 nt, Mycobacterium tuberculosis H37Rv
cccgacagauggucacccacgu

SEQ ID NO: 3246149 - RNA, 16 nt, Mycobacterium tuberculosis H37Rv
cccgacaguggucccg

SEQ ID NO: 3246150 - RNA, 14 nt, Mycobacterium tuberculosis H37Rv
cccgacaucgcugc

SEQ ID NO: 3246151 - RNA, 22 nt, Mycobacterium tuberculosis H37Rv
cccgacaugguccgaccagcgg

SEQ ID NO: 3246152 - RNA, 14 nt, Mycobacterium tuberculosis H37Rv
cccgcacugccgcc

SEQ ID NO: 3246153 - RNA, 13 nt, Mycobacterium tuberculosis H37Rv
cccgcagaauccg

SEQ ID NO: 3246154 - RNA, 23 nt, Mycobacterium tuberculosis H37Rv
cccgcagaccgguuucuucggcc

SEQ ID NO: 3246155 - RNA, 15 nt, Mycobacterium tuberculosis H37Rv
cccgcagcccgccgg

SEQ ID NO: 3246156 - RNA, 14 nt, Mycobacterium tuberculosis H37Rv
cccgcagccgcgag

SEQ ID NO: 3246157 - RNA, 23 nt, Mycobacterium tuberculosis H37Rv
cccgcagccgcgaguccaggcug

SEQ ID NO: 3246158 - RNA, 20 nt, Mycobacterium tuberculosis H37Rv
cccgcagcgccuaccagcac

SEQ ID NO: 3246159 - RNA, 19 nt, Mycobacterium tuberculosis H37Rv
cccgcagcuaucuccaugc

SEQ ID NO: 3246160 - RNA, 14 nt, Mycobacterium tuberculosis H37Rv
cccgcagcucgacc

SEQ ID NO: 3246161 - RNA, 19 nt, Mycobacterium tuberculosis H37Rv
cccgcagcucgaccaggaa

SEQ ID NO: 3246162 - RNA, 14 nt, Mycobacterium tuberculosis H37Rv
cccgcagcugcgga

SEQ ID NO: 3246163 - RNA, 15 nt, Mycobacterium tuberculosis H37Rv
cccgcaggacgcugc

SEQ ID NO: 3246164 - RNA, 19 nt, Mycobacterium tuberculosis H37Rv
cccgcagguagucgucgac

SEQ ID NO: 3246165 - RNA, 13 nt, Mycobacterium tuberculosis H37Rv
cccgcaggucgca

SEQ ID NO: 3246166 - RNA, 18 nt, Mycobacterium tuberculosis H37Rv
cccgcauccacgucgccc

SEQ ID NO: 3246167 - RNA, 15 nt, Mycobacterium tuberculosis H37Rv
cccgcaucgcaccag

SEQ ID NO: 3246168 - RNA, 14 nt, Mycobacterium tuberculosis H37Rv
cccgcaucgcccaa

SEQ ID NO: 3246169 - RNA, 18 nt, Mycobacterium tuberculosis H37Rv
cccgcaucgucgccgacc

SEQ ID NO: 3246170 - RNA, 22 nt, Mycobacterium tuberculosis H37Rv
cccgcaucguugccgaccguca

SEQ ID NO: 3246171 - RNA, 18 nt, Mycobacterium tuberculosis H37Rv
cccgcaugcccuggacca

SEQ ID NO: 3246172 - RNA, 19 nt, Mycobacterium tuberculosis H37Rv
cccgcauugacgaaacccg

SEQ ID NO: 3246173 - RNA, 12 nt, Mycobacterium tuberculosis H37Rv
cccgcauugcca

SEQ ID NO: 3246174 - RNA, 17 nt, Mycobacterium tuberculosis H37Rv
cccgcauugccaacgcc

SEQ ID NO: 3246175 - RNA, 18 nt, Mycobacterium tuberculosis H37Rv
cccgcauugccaacgccc

SEQ ID NO: 3246176 - RNA, 22 nt, Mycobacterium tuberculosis H37Rv
cccgccacaaccaccggaucgg

SEQ ID NO: 3246177 - RNA, 15 nt, Mycobacterium tuberculosis H37Rv
cccgccacagcccca

SEQ ID NO: 3246178 - RNA, 16 nt, Mycobacterium tuberculosis H37Rv
cccgccacagccccag

SEQ ID NO: 3246179 - RNA, 18 nt, Mycobacterium tuberculosis H37Rv
cccgccaccgaacgcacc

SEQ ID NO: 3246180 - RNA, 19 nt, Mycobacterium tuberculosis H37Rv
cccgccaccggguucaccg

SEQ ID NO: 3246181 - RNA, 18 nt, Mycobacterium tuberculosis H37Rv
cccgccaccucgccggcc

SEQ ID NO: 3246182 - RNA, 16 nt, Mycobacterium tuberculosis H37Rv
cccgccacgaugucgu

SEQ ID NO: 3246183 - RNA, 22 nt, Mycobacterium tuberculosis H37Rv
cccgccacgguucgggcagcac

SEQ ID NO: 3246184 - RNA, 18 nt, Mycobacterium tuberculosis H37Rv
cccgccacguacuccacc

SEQ ID NO: 3246185 - RNA, 24 nt, Mycobacterium tuberculosis H37Rv
cccgccacgucgccggcuaccgcc

SEQ ID NO: 3246186 - RNA, 21 nt, Mycobacterium tuberculosis H37Rv
cccgccagaacggcgucgaau

SEQ ID NO: 3246187 - RNA, 14 nt, Mycobacterium tuberculosis H37Rv
cccgccagcccagc

SEQ ID NO: 3246188 - RNA, 15 nt, Mycobacterium tuberculosis H37Rv
cccgccagcgccgcc

SEQ ID NO: 3246189 - RNA, 22 nt, Mycobacterium tuberculosis H37Rv
cccgccagcgccgccgcgagcg

SEQ ID NO: 3246190 - RNA, 15 nt, Mycobacterium tuberculosis H37Rv
cccgccagcggcagc

SEQ ID NO: 3246191 - RNA, 13 nt, Mycobacterium tuberculosis H37Rv
cccgccaggaucu

SEQ ID NO: 3246192 - RNA, 22 nt, Mycobacterium tuberculosis H37Rv
cccgccaggccgcgcgacaacc

SEQ ID NO: 3246193 - RNA, 21 nt, Mycobacterium tuberculosis H37Rv
cccgccagggcggcaucccca

SEQ ID NO: 3246194 - RNA, 15 nt, Mycobacterium tuberculosis H37Rv
cccgccaucugccug

SEQ ID NO: 3246195 - RNA, 16 nt, Mycobacterium tuberculosis H37Rv
cccgccaucugccugc

SEQ ID NO: 3246196 - RNA, 14 nt, Mycobacterium tuberculosis H37Rv
cccgccauugccgc

SEQ ID NO: 3246197 - RNA, 21 nt, Mycobacterium tuberculosis H37Rv
cccgcccaagguggcggccag

SEQ ID NO: 3246198 - RNA, 13 nt, Mycobacterium tuberculosis H37Rv
cccgcccaaugcg

SEQ ID NO: 3246199 - RNA, 12 nt, Mycobacterium tuberculosis H37Rv
cccgcccaccuc

SEQ ID NO: 3246200 - RNA, 13 nt, Mycobacterium tuberculosis H37Rv
cccgcccagcagc

SEQ ID NO: 3246201 - RNA, 12 nt, Mycobacterium tuberculosis H37Rv
cccgccccgacc

SEQ ID NO: 3246202 - RNA, 14 nt, Mycobacterium tuberculosis H37Rv
cccgccccgcgccu

SEQ ID NO: 3246203 - RNA, 21 nt, Mycobacterium tuberculosis H37Rv
cccgcccgacgugaagccaag

SEQ ID NO: 3246204 - RNA, 12 nt, Mycobacterium tuberculosis H37Rv
cccgcccgagcc

SEQ ID NO: 3246205 - RNA, 16 nt, Mycobacterium tuberculosis H37Rv
cccgcccgagccgcug

SEQ ID NO: 3246206 - RNA, 19 nt, Mycobacterium tuberculosis H37Rv
cccgcccgagccgcugcga

SEQ ID NO: 3246207 - RNA, 16 nt, Mycobacterium tuberculosis H37Rv
cccgcccggaacgggu

SEQ ID NO: 3246208 - RNA, 22 nt, Mycobacterium tuberculosis H37Rv
cccgcccggaacggguuggcga

SEQ ID NO: 3246209 - RNA, 21 nt, Mycobacterium tuberculosis H37Rv
cccgcccguagacccacaguc

SEQ ID NO: 3246210 - RNA, 15 nt, Mycobacterium tuberculosis H37Rv
cccgcccugaccgcc

SEQ ID NO: 3246211 - RNA, 14 nt, Mycobacterium tuberculosis H37Rv
cccgcccuugccgc

SEQ ID NO: 3246212 - RNA, 16 nt, Mycobacterium tuberculosis H37Rv
cccgcccuugccgcca

SEQ ID NO: 3246213 - RNA, 17 nt, Mycobacterium tuberculosis H37Rv
cccgcccuugccgccag

SEQ ID NO: 3246214 - RNA, 19 nt, Mycobacterium tuberculosis H37Rv
cccgcccuugccgccagcc

SEQ ID NO: 3246215 - RNA, 21 nt, Mycobacterium tuberculosis H37Rv
cccgcccuugccgccagcccc

SEQ ID NO: 3246216 - RNA, 16 nt, Mycobacterium tuberculosis H37Rv
cccgcccuugccgccg

SEQ ID NO: 3246217 - RNA, 14 nt, Mycobacterium tuberculosis H37Rv
cccgccgaccgaca

SEQ ID NO: 3246218 - RNA, 19 nt, Mycobacterium tuberculosis H37Rv
cccgccgaccgacaccacc

SEQ ID NO: 3246219 - RNA, 15 nt, Mycobacterium tuberculosis H37Rv
cccgccgacgaccgc

SEQ ID NO: 3246220 - RNA, 16 nt, Mycobacterium tuberculosis H37Rv
cccgccgacgaccgcc

SEQ ID NO: 3246221 - RNA, 17 nt, Mycobacterium tuberculosis H37Rv
cccgccgacgaccgccu

SEQ ID NO: 3246222 - RNA, 21 nt, Mycobacterium tuberculosis H37Rv
cccgccgacgccgccggcccc

SEQ ID NO: 3246223 - RNA, 14 nt, Mycobacterium tuberculosis H37Rv
cccgccgagcaccg

SEQ ID NO: 3246224 - RNA, 13 nt, Mycobacterium tuberculosis H37Rv
cccgccgagcgcg

SEQ ID NO: 3246225 - RNA, 22 nt, Mycobacterium tuberculosis H37Rv
cccgccgagcggugccggcgua

SEQ ID NO: 3246226 - RNA, 16 nt, Mycobacterium tuberculosis H37Rv
cccgccgaucacuguc

SEQ ID NO: 3246227 - RNA, 19 nt, Mycobacterium tuberculosis H37Rv
cccgccgaugaugcggcgc

SEQ ID NO: 3246228 - RNA, 17 nt, Mycobacterium tuberculosis H37Rv
cccgccgaugccgccgc

SEQ ID NO: 3246229 - RNA, 13 nt, Mycobacterium tuberculosis H37Rv
cccgccgcacgca

SEQ ID NO: 3246230 - RNA, 15 nt, Mycobacterium tuberculosis H37Rv
cccgccgccaccagc

SEQ ID NO: 3246231 - RNA, 17 nt, Mycobacterium tuberculosis H37Rv
cccgccgccaccagcug

SEQ ID NO: 3246232 - RNA, 20 nt, Mycobacterium tuberculosis H37Rv
cccgccgccacgggugacga

SEQ ID NO: 3246233 - RNA, 22 nt, Mycobacterium tuberculosis H37Rv
cccgccgccugcuggagcagcu

SEQ ID NO: 3246234 - RNA, 22 nt, Mycobacterium tuberculosis H37Rv
cccgccgcgaacuccagcagcc

SEQ ID NO: 3246235 - RNA, 11 nt, Mycobacterium tuberculosis H37Rv
cccgccgcgac

SEQ ID NO: 3246236 - RNA, 13 nt, Mycobacterium tuberculosis H37Rv
cccgccgcgacgg

SEQ ID NO: 3246237 - RNA, 13 nt, Mycobacterium tuberculosis H37Rv
cccgccgcgugcu

SEQ ID NO: 3246238 - RNA, 14 nt, Mycobacterium tuberculosis H37Rv
cccgccggaacugc

SEQ ID NO: 3246239 - RNA, 16 nt, Mycobacterium tuberculosis H37Rv
cccgccggacccgccc

SEQ ID NO: 3246240 - RNA, 17 nt, Mycobacterium tuberculosis H37Rv
cccgccggacccgcccu

SEQ ID NO: 3246241 - RNA, 24 nt, Mycobacterium tuberculosis H37Rv
cccgccggauccgccagaccgcgg

SEQ ID NO: 3246242 - RNA, 11 nt, Mycobacterium tuberculosis H37Rv
cccgccggcaa

SEQ ID NO: 3246243 - RNA, 15 nt, Mycobacterium tuberculosis H37Rv
cccgccggcaacauc

SEQ ID NO: 3246244 - RNA, 13 nt, Mycobacterium tuberculosis H37Rv
cccgccggcagug

SEQ ID NO: 3246245 - RNA, 12 nt, Mycobacterium tuberculosis H37Rv
cccgccggcccc

SEQ ID NO: 3246246 - RNA, 19 nt, Mycobacterium tuberculosis H37Rv
cccgccggccccgccggcc

SEQ ID NO: 3246247 - RNA, 21 nt, Mycobacterium tuberculosis H37Rv
cccgccggccccgccggcccc

SEQ ID NO: 3246248 - RNA, 22 nt, Mycobacterium tuberculosis H37Rv
cccgccggccccgccggccccg

SEQ ID NO: 3246249 - RNA, 17 nt, Mycobacterium tuberculosis H37Rv
cccgcuccgccgucgcc

SEQ ID NO: 3246250 - RNA, 21 nt, Mycobacterium tuberculosis H37Rv
cccgcuccgccgucgccgccg

SEQ ID NO: 3246251 - RNA, 17 nt, Mycobacterium tuberculosis H37Rv
cccgcuccgcgccgccc

SEQ ID NO: 3246252 - RNA, 12 nt, Mycobacterium tuberculosis H37Rv
cccgcucgaugu

SEQ ID NO: 3246253 - RNA, 17 nt, Mycobacterium tuberculosis H37Rv
cccgcucgcccgccgcc

SEQ ID NO: 3246254 - RNA, 23 nt, Mycobacterium tuberculosis H37Rv
cccgcucgcccgccgccaccagc

SEQ ID NO: 3246255 - RNA, 15 nt, Mycobacterium tuberculosis H37Rv
cccgcucgcggcgac

SEQ ID NO: 3246256 - RNA, 15 nt, Mycobacterium tuberculosis H37Rv
cccgcucggccgccg

SEQ ID NO: 3246257 - RNA, 14 nt, Mycobacterium tuberculosis H37Rv
cccgcucgucggua

SEQ ID NO: 3246258 - RNA, 13 nt, Mycobacterium tuberculosis H37Rv
cccgcugaucucg

SEQ ID NO: 3246259 - RNA, 17 nt, Mycobacterium tuberculosis H37Rv
cccgcugaucucggucu

SEQ ID NO: 3246260 - RNA, 16 nt, Mycobacterium tuberculosis H37Rv
cccgcugccacccauc

SEQ ID NO: 3246261 - RNA, 12 nt, Mycobacterium tuberculosis H37Rv
cccgcugccauu

SEQ ID NO: 3246262 - RNA, 16 nt, Mycobacterium tuberculosis H37Rv
cccgcuggccuccugg

SEQ ID NO: 3246263 - RNA, 18 nt, Mycobacterium tuberculosis H37Rv
cccgcuggcgagcagacg

SEQ ID NO: 3246264 - RNA, 21 nt, Mycobacterium tuberculosis H37Rv
cccgcugggcuuggggccgga

SEQ ID NO: 3246265 - RNA, 15 nt, Mycobacterium tuberculosis H37Rv
cccgcuucagcacgg

SEQ ID NO: 3246266 - RNA, 12 nt, Mycobacterium tuberculosis H37Rv
cccgcuucgccc

SEQ ID NO: 3246267 - RNA, 15 nt, Mycobacterium tuberculosis H37Rv
cccgcuucgcccggc

SEQ ID NO: 3246268 - RNA, 17 nt, Mycobacterium tuberculosis H37Rv
cccgcuuggcgugaccu

SEQ ID NO: 3246269 - RNA, 18 nt, Mycobacterium tuberculosis H37Rv
cccgcuuuuucccggcgg

SEQ ID NO: 3246270 - RNA, 22 nt, Mycobacterium tuberculosis H37Rv
cccggaaaaauuucuucgccga

SEQ ID NO: 3246271 - RNA, 20 nt, Mycobacterium tuberculosis H37Rv
cccggaaagaucucggucac

SEQ ID NO: 3246272 - RNA, 17 nt, Mycobacterium tuberculosis H37Rv
cccggaaccagccgcgg

SEQ ID NO: 3246273 - RNA, 13 nt, Mycobacterium tuberculosis H37Rv
cccggaagcgccg

SEQ ID NO: 3246274 - RNA, 17 nt, Mycobacterium tuberculosis H37Rv
cccggaagcgccggccc

SEQ ID NO: 3246275 - RNA, 16 nt, Mycobacterium tuberculosis H37Rv
cccggaaucgucgcgg

SEQ ID NO: 3246276 - RNA, 19 nt, Mycobacterium tuberculosis H37Rv
cccggaaucgucgcggccg

SEQ ID NO: 3246277 - RNA, 21 nt, Mycobacterium tuberculosis H37Rv
cccggacagggugggggcauc

SEQ ID NO: 3246278 - RNA, 21 nt, Mycobacterium tuberculosis H37Rv
cccggacaugcgggcagcacu

SEQ ID NO: 3246279 - RNA, 20 nt, Mycobacterium tuberculosis H37Rv
cccggaccgcggccaccgcc

SEQ ID NO: 3246280 - RNA, 22 nt, Mycobacterium tuberculosis H37Rv
cccggaccgcggccaccgccug

SEQ ID NO: 3246281 - RNA, 18 nt, Mycobacterium tuberculosis H37Rv
cccggaccgucguggcgg

SEQ ID NO: 3246282 - RNA, 12 nt, Mycobacterium tuberculosis H37Rv
cccggaccuggg

SEQ ID NO: 3246283 - RNA, 17 nt, Mycobacterium tuberculosis H37Rv
cccggacgauggcgucg

SEQ ID NO: 3246284 - RNA, 22 nt, Mycobacterium tuberculosis H37Rv
cccggacgauggcgucggccag

SEQ ID NO: 3246285 - RNA, 12 nt, Mycobacterium tuberculosis H37Rv
cccggacgucgg

SEQ ID NO: 3246286 - RNA, 22 nt, Mycobacterium tuberculosis H37Rv
cccggacuccaaagccgugcca

SEQ ID NO: 3246287 - RNA, 23 nt, Mycobacterium tuberculosis H37Rv
cccggacucuccccuggccccca

SEQ ID NO: 3246288 - RNA, 15 nt, Mycobacterium tuberculosis H37Rv
cccggagcacccggg

SEQ ID NO: 3246289 - RNA, 12 nt, Mycobacterium tuberculosis H37Rv
cccggagccaga

SEQ ID NO: 3246290 - RNA, 17 nt, Mycobacterium tuberculosis H37Rv
cccggagccgccaggug

SEQ ID NO: 3246291 - RNA, 12 nt, Mycobacterium tuberculosis H37Rv
cccggagccgcu

SEQ ID NO: 3246292 - RNA, 20 nt, Mycobacterium tuberculosis H37Rv
cccggaggguucggacggcu

SEQ ID NO: 3246293 - RNA, 15 nt, Mycobacterium tuberculosis H37Rv
cccggauagacggcg

SEQ ID NO: 3246294 - RNA, 18 nt, Mycobacterium tuberculosis H37Rv
cccggauaucgaccaccg

SEQ ID NO: 3246295 - RNA, 16 nt, Mycobacterium tuberculosis H37Rv
cccggaugucgugcgg

SEQ ID NO: 3246296 - RNA, 21 nt, Mycobacterium tuberculosis H37Rv
cccggaugucgugcgggcgca

SEQ ID NO: 3246297 - RNA, 19 nt, Mycobacterium tuberculosis H37Rv
cccggauuccucgucaccg

SEQ ID NO: 3246298 - RNA, 19 nt, Mycobacterium tuberculosis H37Rv
cccggcaaacuccagcuug

SEQ ID NO: 3246299 - RNA, 17 nt, Mycobacterium tuberculosis H37Rv
cccggcaaccuggacug

SEQ ID NO: 3246300 - RNA, 15 nt, Mycobacterium tuberculosis H37Rv
cccggcaaugaucau

SEQ ID NO: 3246301 - RNA, 17 nt, Mycobacterium tuberculosis H37Rv
cccggcacccggugaga

SEQ ID NO: 3246302 - RNA, 13 nt, Mycobacterium tuberculosis H37Rv
cccggcaccgccg

SEQ ID NO: 3246303 - RNA, 12 nt, Mycobacterium tuberculosis H37Rv
cccggcaccgcg

SEQ ID NO: 3246304 - RNA, 14 nt, Mycobacterium tuberculosis H37Rv
cccggcacgcucgg

SEQ ID NO: 3246305 - RNA, 15 nt, Mycobacterium tuberculosis H37Rv
cccggcagaugcagc

SEQ ID NO: 3246306 - RNA, 16 nt, Mycobacterium tuberculosis H37Rv
cccggcagcacgugga

SEQ ID NO: 3246307 - RNA, 15 nt, Mycobacterium tuberculosis H37Rv
cccggcagcgugcgg

SEQ ID NO: 3246308 - RNA, 23 nt, Mycobacterium tuberculosis H37Rv
cccggcagcgugcggggcgccug

SEQ ID NO: 3246309 - RNA, 20 nt, Mycobacterium tuberculosis H37Rv
cccggcaguucgcggccauc

SEQ ID NO: 3246310 - RNA, 23 nt, Mycobacterium tuberculosis H37Rv
cccggcauacaacuggugggcca

SEQ ID NO: 3246311 - RNA, 13 nt, Mycobacterium tuberculosis H37Rv
cccggcaucgcga

SEQ ID NO: 3246312 - RNA, 17 nt, Mycobacterium tuberculosis H37Rv
cccggcaucgcgaucgg

SEQ ID NO: 3246313 - RNA, 17 nt, Mycobacterium tuberculosis H37Rv
cccggcauugcccgagc

SEQ ID NO: 3246314 - RNA, 15 nt, Mycobacterium tuberculosis H37Rv
cccggccaaccacca

SEQ ID NO: 3246315 - RNA, 16 nt, Mycobacterium tuberculosis H37Rv
cccggccaaccaccaa

SEQ ID NO: 3246316 - RNA, 13 nt, Mycobacterium tuberculosis H37Rv
cccggccaagccg

SEQ ID NO: 3246317 - RNA, 14 nt, Mycobacterium tuberculosis H37Rv
cccggccaccagca

SEQ ID NO: 3246318 - RNA, 16 nt, Mycobacterium tuberculosis H37Rv
cccggccaccagcaug

SEQ ID NO: 3246319 - RNA, 21 nt, Mycobacterium tuberculosis H37Rv
cccggccaccagcaugccugc

SEQ ID NO: 3246320 - RNA, 17 nt, Mycobacterium tuberculosis H37Rv
cccggccagccgcacgg

SEQ ID NO: 3246321 - RNA, 22 nt, Mycobacterium tuberculosis H37Rv
cccggccagcuccucagccacc

SEQ ID NO: 3246322 - RNA, 18 nt, Mycobacterium tuberculosis H37Rv
cccggccagcucgggcgc

SEQ ID NO: 3246323 - RNA, 11 nt, Mycobacterium tuberculosis H37Rv
cccggccaggc

SEQ ID NO: 3246324 - RNA, 14 nt, Mycobacterium tuberculosis H37Rv
cccggccaggccga

SEQ ID NO: 3246325 - RNA, 15 nt, Mycobacterium tuberculosis H37Rv
cccggccaggggcgc

SEQ ID NO: 3246326 - RNA, 18 nt, Mycobacterium tuberculosis H37Rv
cccggccaggucgacacc

SEQ ID NO: 3246327 - RNA, 20 nt, Mycobacterium tuberculosis H37Rv
cccggccaggucgacaccgc

SEQ ID NO: 3246328 - RNA, 21 nt, Mycobacterium tuberculosis H37Rv
cccggccauagcccgagcgcu

SEQ ID NO: 3246329 - RNA, 19 nt, Mycobacterium tuberculosis H37Rv
cccggcccaaggaacggcg

SEQ ID NO: 3246330 - RNA, 15 nt, Mycobacterium tuberculosis H37Rv
cccggcccagcgccc

SEQ ID NO: 3246331 - RNA, 22 nt, Mycobacterium tuberculosis H37Rv
cccggcccgaucggcaacccgc

SEQ ID NO: 3246332 - RNA, 14 nt, Mycobacterium tuberculosis H37Rv
cccggcccgccacc

SEQ ID NO: 3246333 - RNA, 13 nt, Mycobacterium tuberculosis H37Rv
cccggcccggcuc

SEQ ID NO: 3246334 - RNA, 18 nt, Mycobacterium tuberculosis H37Rv
cccggccgaacgccucgc

SEQ ID NO: 3246335 - RNA, 15 nt, Mycobacterium tuberculosis H37Rv
cccggccgaucucgg

SEQ ID NO: 3246336 - RNA, 11 nt, Mycobacterium tuberculosis H37Rv
cccggccgcca

SEQ ID NO: 3246337 - RNA, 14 nt, Mycobacterium tuberculosis H37Rv
cccggccgccgaaa

SEQ ID NO: 3246338 - RNA, 23 nt, Mycobacterium tuberculosis H37Rv
cccggccgcgcacccguccgccg

SEQ ID NO: 3246339 - RNA, 14 nt, Mycobacterium tuberculosis H37Rv
cccggccgcggccc

SEQ ID NO: 3246340 - RNA, 15 nt, Mycobacterium tuberculosis H37Rv
cccggccgcggccca

SEQ ID NO: 3246341 - RNA, 23 nt, Mycobacterium tuberculosis H37Rv
cccggccgcgucacggaccugga

SEQ ID NO: 3246342 - RNA, 14 nt, Mycobacterium tuberculosis H37Rv
cccggccggcccgg

SEQ ID NO: 3246343 - RNA, 19 nt, Mycobacterium tuberculosis H37Rv
cccggccggucgagacgcu

SEQ ID NO: 3246344 - RNA, 17 nt, Mycobacterium tuberculosis H37Rv
cccggccuggagcagcc

SEQ ID NO: 3246345 - RNA, 18 nt, Mycobacterium tuberculosis H37Rv
cccggccuggagcagcca

SEQ ID NO: 3246346 - RNA, 23 nt, Mycobacterium tuberculosis H37Rv
cccggucacgcugugcgguaucg

SEQ ID NO: 3246347 - RNA, 19 nt, Mycobacterium tuberculosis H37Rv
cccggucaggacggcaccc

SEQ ID NO: 3246348 - RNA, 22 nt, Mycobacterium tuberculosis H37Rv
cccgguccggcccggggacgcc

SEQ ID NO: 3246349 - RNA, 18 nt, Mycobacterium tuberculosis H37Rv
cccgguccugcucgcaca

SEQ ID NO: 3246350 - RNA, 22 nt, Mycobacterium tuberculosis H37Rv
cccgguccugcucgcacagcac

SEQ ID NO: 3246351 - RNA, 12 nt, Mycobacterium tuberculosis H37Rv
cccggucgacgg

SEQ ID NO: 3246352 - RNA, 12 nt, Mycobacterium tuberculosis H37Rv
cccggucgagcg

SEQ ID NO: 3246353 - RNA, 23 nt, Mycobacterium tuberculosis H37Rv
cccggucgauucggcucaucccg

SEQ ID NO: 3246354 - RNA, 18 nt, Mycobacterium tuberculosis H37Rv
cccggucgcacuuggccc

SEQ ID NO: 3246355 - RNA, 21 nt, Mycobacterium tuberculosis H37Rv
cccggucgcacuuggcccccg

SEQ ID NO: 3246356 - RNA, 20 nt, Mycobacterium tuberculosis H37Rv
cccggucggagcggugccga

SEQ ID NO: 3246357 - RNA, 22 nt, Mycobacterium tuberculosis H37Rv
cccggucggagcggugccgacg

SEQ ID NO: 3246358 - RNA, 15 nt, Mycobacterium tuberculosis H37Rv
cccggucggcagcug

SEQ ID NO: 3246359 - RNA, 22 nt, Mycobacterium tuberculosis H37Rv
cccggucggguccaacgccgcc

SEQ ID NO: 3246360 - RNA, 18 nt, Mycobacterium tuberculosis H37Rv
cccggucgguguggacug

SEQ ID NO: 3246361 - RNA, 18 nt, Mycobacterium tuberculosis H37Rv
cccggucuacgacgucgc

SEQ ID NO: 3246362 - RNA, 22 nt, Mycobacterium tuberculosis H37Rv
cccggucuacgacgucgcugua

SEQ ID NO: 3246363 - RNA, 17 nt, Mycobacterium tuberculosis H37Rv
cccggucuacgccaccg

SEQ ID NO: 3246364 - RNA, 11 nt, Mycobacterium tuberculosis H37Rv
cccggucucga

SEQ ID NO: 3246365 - RNA, 16 nt, Mycobacterium tuberculosis H37Rv
cccggucuuacggucg

SEQ ID NO: 3246366 - RNA, 22 nt, Mycobacterium tuberculosis H37Rv
cccggucuuuaauccagcgccg

SEQ ID NO: 3246367 - RNA, 13 nt, Mycobacterium tuberculosis H37Rv
cccggugaccacu

SEQ ID NO: 3246368 - RNA, 16 nt, Mycobacterium tuberculosis H37Rv
cccggugaccagcaac

SEQ ID NO: 3246369 - RNA, 16 nt, Mycobacterium tuberculosis H37Rv
cccggugacgccgucg

SEQ ID NO: 3246370 - RNA, 15 nt, Mycobacterium tuberculosis H37Rv
cccggugagaagaag

SEQ ID NO: 3246371 - RNA, 19 nt, Mycobacterium tuberculosis H37Rv
cccggugaguccggagacu

SEQ ID NO: 3246372 - RNA, 22 nt, Mycobacterium tuberculosis H37Rv
cccggugaguccggagacucuc

SEQ ID NO: 3246373 - RNA, 17 nt, Mycobacterium tuberculosis H37Rv
cccggugaugaagcgcg

SEQ ID NO: 3246374 - RNA, 22 nt, Mycobacterium tuberculosis H37Rv
cccggugaugaccggacgcuga

SEQ ID NO: 3246375 - RNA, 14 nt, Mycobacterium tuberculosis H37Rv
cccggugccgcagc

SEQ ID NO: 3246376 - RNA, 23 nt, Mycobacterium tuberculosis H37Rv
cccggugccgcagcaggggacga

SEQ ID NO: 3246377 - RNA, 22 nt, Mycobacterium tuberculosis H37Rv
cccggugccgcccgcgccuccg

SEQ ID NO: 3246378 - RNA, 14 nt, Mycobacterium tuberculosis H37Rv
cccggugccggcgg

SEQ ID NO: 3246379 - RNA, 23 nt, Mycobacterium tuberculosis H37Rv
cccggugccguuggagccgccac

SEQ ID NO: 3246380 - RNA, 18 nt, Mycobacterium tuberculosis H37Rv
cccggugcggaucugcug

SEQ ID NO: 3246381 - RNA, 19 nt, Mycobacterium tuberculosis H37Rv
cccggugcggaucugcugc

SEQ ID NO: 3246382 - RNA, 21 nt, Mycobacterium tuberculosis H37Rv
cccgguggacagaaucgaccg

SEQ ID NO: 3246383 - RNA, 22 nt, Mycobacterium tuberculosis H37Rv
cccgguggcguggucucgguca

SEQ ID NO: 3246384 - RNA, 20 nt, Mycobacterium tuberculosis H37Rv
cccgguggcguuugaugcgg

SEQ ID NO: 3246385 - RNA, 14 nt, Mycobacterium tuberculosis H37Rv
cccgguguccagcc

SEQ ID NO: 3246386 - RNA, 23 nt, Mycobacterium tuberculosis H37Rv
cccgguguccagccacgcugucc

SEQ ID NO: 3246387 - RNA, 14 nt, Mycobacterium tuberculosis H37Rv
cccgguguccagug

SEQ ID NO: 3246388 - RNA, 16 nt, Mycobacterium tuberculosis H37Rv
cccgguguguucggcc

SEQ ID NO: 3246389 - RNA, 22 nt, Mycobacterium tuberculosis H37Rv
cccgguguucaucacgccgccg

SEQ ID NO: 3246390 - RNA, 23 nt, Mycobacterium tuberculosis H37Rv
cccgguguucaucacgccgccgg

SEQ ID NO: 3246391 - RNA, 19 nt, Mycobacterium tuberculosis H37Rv
cccgguguuccggucgccc

SEQ ID NO: 3246392 - RNA, 23 nt, Mycobacterium tuberculosis H37Rv
cccgguguugagcgaacccgcgu

SEQ ID NO: 3246393 - RNA, 19 nt, Mycobacterium tuberculosis H37Rv
cccgguguugccgugacga

SEQ ID NO: 3246394 - RNA, 21 nt, Mycobacterium tuberculosis H37Rv
cccgguucgacgucugcccag

SEQ ID NO: 3246395 - RNA, 12 nt, Mycobacterium tuberculosis H37Rv
cccgguugacgc

SEQ ID NO: 3246396 - RNA, 18 nt, Mycobacterium tuberculosis H37Rv
cccgguugacgccggucc

SEQ ID NO: 3246397 - RNA, 23 nt, Mycobacterium tuberculosis H37Rv
cccgguugcggucagacgccggc

SEQ ID NO: 3246398 - RNA, 18 nt, Mycobacterium tuberculosis H37Rv
cccgguuggaccacguga

SEQ ID NO: 3246399 - RNA, 23 nt, Mycobacterium tuberculosis H37Rv
cccgguugugcgcgcgcccgaau

SEQ ID NO: 3246400 - RNA, 14 nt, Mycobacterium tuberculosis H37Rv
cccguaaaccgaua

SEQ ID NO: 3246401 - RNA, 17 nt, Mycobacterium tuberculosis H37Rv
cccguaagcggaugucc

SEQ ID NO: 3246402 - RNA, 18 nt, Mycobacterium tuberculosis H37Rv
cccguacccacgacgggc

SEQ ID NO: 3246403 - RNA, 22 nt, Mycobacterium tuberculosis H37Rv
cccguacccacgacgggccgag

SEQ ID NO: 3246404 - RNA, 20 nt, Mycobacterium tuberculosis H37Rv
cccguagaacaguucgacau

SEQ ID NO: 3246405 - RNA, 14 nt, Mycobacterium tuberculosis H37Rv
cccguagcaccaca

SEQ ID NO: 3246406 - RNA, 21 nt, Mycobacterium tuberculosis H37Rv
cccguagcaccacaucggugc

SEQ ID NO: 3246407 - RNA, 14 nt, Mycobacterium tuberculosis H37Rv
cccguagccgugcc

SEQ ID NO: 3246408 - RNA, 18 nt, Mycobacterium tuberculosis H37Rv
cccguagcgucgaucacg

SEQ ID NO: 3246409 - RNA, 15 nt, Mycobacterium tuberculosis H37Rv
cccguauggcggcuc

SEQ ID NO: 3246410 - RNA, 18 nt, Mycobacterium tuberculosis H37Rv
cccguauugaugcugccc

SEQ ID NO: 3246411 - RNA, 13 nt, Mycobacterium tuberculosis H37Rv
cccgucacgcccg

SEQ ID NO: 3246412 - RNA, 19 nt, Mycobacterium tuberculosis H37Rv
cccgucauacucgacaccg

SEQ ID NO: 3246413 - RNA, 20 nt, Mycobacterium tuberculosis H37Rv
cccgucauacucgacaccga

SEQ ID NO: 3246414 - RNA, 12 nt, Mycobacterium tuberculosis H37Rv
cccguccaggcc

SEQ ID NO: 3246415 - RNA, 20 nt, Mycobacterium tuberculosis H37Rv
cccguccaggcgcugcagca

SEQ ID NO: 3246416 - RNA, 12 nt, Mycobacterium tuberculosis H37Rv
cccgucccccgc

SEQ ID NO: 3246417 - RNA, 12 nt, Mycobacterium tuberculosis H37Rv
cccgucccgccg

SEQ ID NO: 3246418 - RNA, 13 nt, Mycobacterium tuberculosis H37Rv
cccguccgcgccc

SEQ ID NO: 3246419 - RNA, 19 nt, Mycobacterium tuberculosis H37Rv
cccguccgcgcccaccggc

SEQ ID NO: 3246420 - RNA, 12 nt, Mycobacterium tuberculosis H37Rv
cccgucgaccuc

SEQ ID NO: 3246421 - RNA, 14 nt, Mycobacterium tuberculosis H37Rv
cccgucgagcagca

SEQ ID NO: 3246422 - RNA, 17 nt, Mycobacterium tuberculosis H37Rv
cccgucgagcagcaugu

SEQ ID NO: 3246423 - RNA, 12 nt, Mycobacterium tuberculosis H37Rv
cccgucgagccg

SEQ ID NO: 3246424 - RNA, 19 nt, Mycobacterium tuberculosis H37Rv
cccgucgaucagcggcagc

SEQ ID NO: 3246425 - RNA, 14 nt, Mycobacterium tuberculosis H37Rv
cccgucgccaccga

SEQ ID NO: 3246426 - RNA, 12 nt, Mycobacterium tuberculosis H37Rv
cccgucgccgcc

SEQ ID NO: 3246427 - RNA, 13 nt, Mycobacterium tuberculosis H37Rv
cccgucgccgccc

SEQ ID NO: 3246428 - RNA, 18 nt, Mycobacterium tuberculosis H37Rv
cccgucgcgaaucugcgc

SEQ ID NO: 3246429 - RNA, 12 nt, Mycobacterium tuberculosis H37Rv
cccgucggcgcc

SEQ ID NO: 3246430 - RNA, 14 nt, Mycobacterium tuberculosis H37Rv
cccgucggcgugcg

SEQ ID NO: 3246431 - RNA, 16 nt, Mycobacterium tuberculosis H37Rv
cccgucgggugcugau

SEQ ID NO: 3246432 - RNA, 15 nt, Mycobacterium tuberculosis H37Rv
cccgugauccgccga

SEQ ID NO: 3246433 - RNA, 21 nt, Mycobacterium tuberculosis H37Rv
cccgugauccgccgacagccc

SEQ ID NO: 3246434 - RNA, 14 nt, Mycobacterium tuberculosis H37Rv
cccgugcacgaucg

SEQ ID NO: 3246435 - RNA, 15 nt, Mycobacterium tuberculosis H37Rv
cccgugcacgaucgc

SEQ ID NO: 3246436 - RNA, 17 nt, Mycobacterium tuberculosis H37Rv
cccgugccacagcucgc

SEQ ID NO: 3246437 - RNA, 18 nt, Mycobacterium tuberculosis H37Rv
cccgugccgcccgcgccg

SEQ ID NO: 3246438 - RNA, 21 nt, Mycobacterium tuberculosis H37Rv
cccgugccgcccgcgccgccc

SEQ ID NO: 3246439 - RNA, 17 nt, Mycobacterium tuberculosis H37Rv
cccgugccgccgaugcc

SEQ ID NO: 3246440 - RNA, 12 nt, Mycobacterium tuberculosis H37Rv
cccgugccgucg

SEQ ID NO: 3246441 - RNA, 13 nt, Mycobacterium tuberculosis H37Rv
cccgugccuggcc

SEQ ID NO: 3246442 - RNA, 21 nt, Mycobacterium tuberculosis H37Rv
cccugcggccacgguggcgca

SEQ ID NO: 3246443 - RNA, 13 nt, Mycobacterium tuberculosis H37Rv
cccugcgggccga

SEQ ID NO: 3246444 - RNA, 23 nt, Mycobacterium tuberculosis H37Rv
cccugcgggccgagaucacgccg

SEQ ID NO: 3246445 - RNA, 13 nt, Mycobacterium tuberculosis H37Rv
cccugcgugcggc

SEQ ID NO: 3246446 - RNA, 20 nt, Mycobacterium tuberculosis H37Rv
cccugcuggugucggcucga

SEQ ID NO: 3246447 - RNA, 16 nt, Mycobacterium tuberculosis H37Rv
cccugcuugcaggcga

SEQ ID NO: 3246448 - RNA, 17 nt, Mycobacterium tuberculosis H37Rv
cccuggaaugccgccac

SEQ ID NO: 3246449 - RNA, 17 nt, Mycobacterium tuberculosis H37Rv
cccuggacauaccggcc

SEQ ID NO: 3246450 - RNA, 17 nt, Mycobacterium tuberculosis H37Rv
cccuggacuucgggggc

SEQ ID NO: 3246451 - RNA, 15 nt, Mycobacterium tuberculosis H37Rv
cccuggccaaccggg

SEQ ID NO: 3246452 - RNA, 14 nt, Mycobacterium tuberculosis H37Rv
cccuggccagcaga

SEQ ID NO: 3246453 - RNA, 15 nt, Mycobacterium tuberculosis H37Rv
cccuggccagcccga

SEQ ID NO: 3246454 - RNA, 14 nt, Mycobacterium tuberculosis H37Rv
cccuggccgcccag

SEQ ID NO: 3246455 - RNA, 15 nt, Mycobacterium tuberculosis H37Rv
cccuggccgccggcg

SEQ ID NO: 3246456 - RNA, 19 nt, Mycobacterium tuberculosis H37Rv
cccuggccgccggcgccgc

SEQ ID NO: 3246457 - RNA, 16 nt, Mycobacterium tuberculosis H37Rv
cccuggcgaccagccg

SEQ ID NO: 3246458 - RNA, 14 nt, Mycobacterium tuberculosis H37Rv
cccuggcggcccgg

SEQ ID NO: 3246459 - RNA, 17 nt, Mycobacterium tuberculosis H37Rv
cccuggcggcccggguu

SEQ ID NO: 3246460 - RNA, 14 nt, Mycobacterium tuberculosis H37Rv
cccuggcgugugug

SEQ ID NO: 3246461 - RNA, 18 nt, Mycobacterium tuberculosis H37Rv
cccuggggccguccggcu

SEQ ID NO: 3246462 - RNA, 23 nt, Mycobacterium tuberculosis H37Rv
cccuggggguggcagcgcggccg

SEQ ID NO: 3246463 - RNA, 14 nt, Mycobacterium tuberculosis H37Rv
cccugggguccagc

SEQ ID NO: 3246464 - RNA, 21 nt, Mycobacterium tuberculosis H37Rv
cccugguagugaacggaucgu

SEQ ID NO: 3246465 - RNA, 21 nt, Mycobacterium tuberculosis H37Rv
cccugguggucagucaccaac

SEQ ID NO: 3246466 - RNA, 14 nt, Mycobacterium tuberculosis H37Rv
cccugguucggcga

SEQ ID NO: 3246467 - RNA, 15 nt, Mycobacterium tuberculosis H37Rv
cccugucaacgccgc

SEQ ID NO: 3246468 - RNA, 19 nt, Mycobacterium tuberculosis H37Rv
cccugucauguccugggcc

SEQ ID NO: 3246469 - RNA, 13 nt, Mycobacterium tuberculosis H37Rv
cccugucgcgcac

SEQ ID NO: 3246470 - RNA, 14 nt, Mycobacterium tuberculosis H37Rv
cccugucgcgcacc

SEQ ID NO: 3246471 - RNA, 14 nt, Mycobacterium tuberculosis H37Rv
cccugugccagcag

SEQ ID NO: 3246472 - RNA, 23 nt, Mycobacterium tuberculosis H37Rv
cccuguucggcccuauggguucc

SEQ ID NO: 3246473 - RNA, 19 nt, Mycobacterium tuberculosis H37Rv
cccuguucuccgugaucga

SEQ ID NO: 3246474 - RNA, 13 nt, Mycobacterium tuberculosis H37Rv
cccuucgucacau

SEQ ID NO: 3246475 - RNA, 14 nt, Mycobacterium tuberculosis H37Rv
cccuugaccaugug

SEQ ID NO: 3246476 - RNA, 16 nt, Mycobacterium tuberculosis H37Rv
cccuugaccgcugccc

SEQ ID NO: 3246477 - RNA, 16 nt, Mycobacterium tuberculosis H37Rv
cccuugacggugagau

SEQ ID NO: 3246478 - RNA, 18 nt, Mycobacterium tuberculosis H37Rv
cccuugacggugagaucg

SEQ ID NO: 3246479 - RNA, 20 nt, Mycobacterium tuberculosis H37Rv
cccuugccgcagaaucccaa

SEQ ID NO: 3246480 - RNA, 21 nt, Mycobacterium tuberculosis H37Rv
cccuugccgccguugccgccg

SEQ ID NO: 3246481 - RNA, 16 nt, Mycobacterium tuberculosis H37Rv
cccuugccgccuuggc

SEQ ID NO: 3246482 - RNA, 12 nt, Mycobacterium tuberculosis H37Rv
cccuugccgucc

SEQ ID NO: 3246483 - RNA, 20 nt, Mycobacterium tuberculosis H37Rv
cccuugccuccggcgccgcc

SEQ ID NO: 3246484 - RNA, 19 nt, Mycobacterium tuberculosis H37Rv
cccuugcucguccaggucg

SEQ ID NO: 3246485 - RNA, 13 nt, Mycobacterium tuberculosis H37Rv
cccuuggccagca

SEQ ID NO: 3246486 - RNA, 20 nt, Mycobacterium tuberculosis H37Rv
cccuuggccagcagggccac

SEQ ID NO: 3246487 - RNA, 15 nt, Mycobacterium tuberculosis H37Rv
cccuugggcaccacc

SEQ ID NO: 3246488 - RNA, 18 nt, Mycobacterium tuberculosis H37Rv
cccuugggcaccacccga

SEQ ID NO: 3246489 - RNA, 14 nt, Mycobacterium tuberculosis H37Rv
cccuugucggucga

SEQ ID NO: 3246490 - RNA, 23 nt, Mycobacterium tuberculosis H37Rv
cccuugugaacggugucaacggc

SEQ ID NO: 3246491 - RNA, 14 nt, Mycobacterium tuberculosis H37Rv
cccuuuacaccccc

SEQ ID NO: 3246492 - RNA, 14 nt, Mycobacterium tuberculosis H37Rv
cccuuugacgccga

SEQ ID NO: 3246493 - RNA, 20 nt, Mycobacterium tuberculosis H37Rv
cccuuuggguagcaaacccc

SEQ ID NO: 3246494 - RNA, 19 nt, Mycobacterium tuberculosis H37Rv
cccuuuucccugccuucuu

SEQ ID NO: 3246495 - RNA, 15 nt, Mycobacterium tuberculosis H37Rv
ccgaaaaacaccagc

SEQ ID NO: 3246496 - RNA, 19 nt, Mycobacterium tuberculosis H37Rv
ccgaaaaacaccagcgagg

SEQ ID NO: 3246497 - RNA, 23 nt, Mycobacterium tuberculosis H37Rv
ccgaaaaccucgccccaccggcc

SEQ ID NO: 3246498 - RNA, 14 nt, Mycobacterium tuberculosis H37Rv
ccgaaaaucgcagc

SEQ ID NO: 3246499 - RNA, 14 nt, Mycobacterium tuberculosis H37Rv
ccgaaaaugccgcc

SEQ ID NO: 3246500 - RNA, 20 nt, Mycobacterium tuberculosis H37Rv
ccgaaacaccgucuggccgu

SEQ ID NO: 3246501 - RNA, 23 nt, Mycobacterium tuberculosis H37Rv
ccgaaaccaugccgccgaagccg

SEQ ID NO: 3246502 - RNA, 13 nt, Mycobacterium tuberculosis H37Rv
ccgaaacgccgac

SEQ ID NO: 3246503 - RNA, 14 nt, Mycobacterium tuberculosis H37Rv
ccgaaauacccagc

SEQ ID NO: 3246504 - RNA, 20 nt, Mycobacterium tuberculosis H37Rv
ccgaaaucaccucaccaguc

SEQ ID NO: 3246505 - RNA, 20 nt, Mycobacterium tuberculosis H37Rv
ccgaaaucaguugcgcucca

SEQ ID NO: 3246506 - RNA, 23 nt, Mycobacterium tuberculosis H37Rv
ccgaaaucaguugcgcuccaaca

SEQ ID NO: 3246507 - RNA, 21 nt, Mycobacterium tuberculosis H37Rv
ccgaaaugccgggcccgacgu

SEQ ID NO: 3246508 - RNA, 18 nt, Mycobacterium tuberculosis H37Rv
ccgaacaccacaccgagc

SEQ ID NO: 3246509 - RNA, 20 nt, Mycobacterium tuberculosis H37Rv
ccgaacaccacaccgagcac

SEQ ID NO: 3246510 - RNA, 19 nt, Mycobacterium tuberculosis H37Rv
ccgaacaccggcuccagca

SEQ ID NO: 3246511 - RNA, 23 nt, Mycobacterium tuberculosis H37Rv
ccgaacacgcacacgaucgcggu

SEQ ID NO: 3246512 - RNA, 17 nt, Mycobacterium tuberculosis H37Rv
ccgaacagcagcccgcc

SEQ ID NO: 3246513 - RNA, 18 nt, Mycobacterium tuberculosis H37Rv
ccgaacagcagcccgccc

SEQ ID NO: 3246514 - RNA, 13 nt, Mycobacterium tuberculosis H37Rv
ccgaacagcaggc

SEQ ID NO: 3246515 - RNA, 13 nt, Mycobacterium tuberculosis H37Rv
ccgaacagccgag

SEQ ID NO: 3246516 - RNA, 15 nt, Mycobacterium tuberculosis H37Rv
ccgaacagcggcagc

SEQ ID NO: 3246517 - RNA, 13 nt, Mycobacterium tuberculosis H37Rv
ccgaacagcgggu

SEQ ID NO: 3246518 - RNA, 12 nt, Mycobacterium tuberculosis H37Rv
ccgaacagcugc

SEQ ID NO: 3246519 - RNA, 21 nt, Mycobacterium tuberculosis H37Rv
ccgaacagcugcccgccagcg

SEQ ID NO: 3246520 - RNA, 22 nt, Mycobacterium tuberculosis H37Rv
ccgaacagcugcccgccagcgc

SEQ ID NO: 3246521 - RNA, 18 nt, Mycobacterium tuberculosis H37Rv
ccgaacagcuggacggcc

SEQ ID NO: 3246522 - RNA, 17 nt, Mycobacterium tuberculosis H37Rv
ccgaacagucgcagcca

SEQ ID NO: 3246523 - RNA, 19 nt, Mycobacterium tuberculosis H37Rv
ccgaacauccgccgccccc

SEQ ID NO: 3246524 - RNA, 16 nt, Mycobacterium tuberculosis H37Rv
ccgaacauggccagca

SEQ ID NO: 3246525 - RNA, 16 nt, Mycobacterium tuberculosis H37Rv
ccgaacauucccaugc

SEQ ID NO: 3246526 - RNA, 17 nt, Mycobacterium tuberculosis H37Rv
ccgaaccaccaccggca

SEQ ID NO: 3246527 - RNA, 15 nt, Mycobacterium tuberculosis H37Rv
ccgaaccaccgcguu

SEQ ID NO: 3246528 - RNA, 18 nt, Mycobacterium tuberculosis H37Rv
ccgaaccacgcgcccgca

SEQ ID NO: 3246529 - RNA, 18 nt, Mycobacterium tuberculosis H37Rv
ccgaacccgccaccgcga

SEQ ID NO: 3246530 - RNA, 15 nt, Mycobacterium tuberculosis H37Rv
ccgaacccggcggac

SEQ ID NO: 3246531 - RNA, 17 nt, Mycobacterium tuberculosis H37Rv
ccgaaccgacguucccc

SEQ ID NO: 3246532 - RNA, 13 nt, Mycobacterium tuberculosis H37Rv
ccgaaccgcgcgu

SEQ ID NO: 3246533 - RNA, 19 nt, Mycobacterium tuberculosis H37Rv
ccgaaccgcguuaugccag

SEQ ID NO: 3246534 - RNA, 23 nt, Mycobacterium tuberculosis H37Rv
ccgaaccgcguuaugccaggcgc

SEQ ID NO: 3246535 - RNA, 14 nt, Mycobacterium tuberculosis H37Rv
ccgaaccgcugcgg

SEQ ID NO: 3246536 - RNA, 17 nt, Mycobacterium tuberculosis H37Rv
ccgaaccggcaccagcg

SEQ ID NO: 3246537 - RNA, 16 nt, Mycobacterium tuberculosis H37Rv
ccgaaccgucagcggc

SEQ ID NO: 3246538 - RNA, 19 nt, Mycobacterium tuberculosis H37Rv
ccgaaccgucagcggcaac

SEQ ID NO: 3246539 - RNA, 19 nt, Mycobacterium tuberculosis H37Rv
ccgaccaaaccgacgcggg

SEQ ID NO: 3246540 - RNA, 20 nt, Mycobacterium tuberculosis H37Rv
ccgaccaauucgcaaucggc

SEQ ID NO: 3246541 - RNA, 13 nt, Mycobacterium tuberculosis H37Rv
ccgaccacauucc

SEQ ID NO: 3246542 - RNA, 13 nt, Mycobacterium tuberculosis H37Rv
ccgaccaccgcga

SEQ ID NO: 3246543 - RNA, 16 nt, Mycobacterium tuberculosis H37Rv
ccgaccaccucagcug

SEQ ID NO: 3246544 - RNA, 13 nt, Mycobacterium tuberculosis H37Rv
ccgaccacgcgag

SEQ ID NO: 3246545 - RNA, 19 nt, Mycobacterium tuberculosis H37Rv
ccgaccacgcgagggcauc

SEQ ID NO: 3246546 - RNA, 14 nt, Mycobacterium tuberculosis H37Rv
ccgaccacuccacg

SEQ ID NO: 3246547 - RNA, 23 nt, Mycobacterium tuberculosis H37Rv
ccgaccacuccacgcagcccguc

SEQ ID NO: 3246548 - RNA, 12 nt, Mycobacterium tuberculosis H37Rv
ccgaccagaacg

SEQ ID NO: 3246549 - RNA, 15 nt, Mycobacterium tuberculosis H37Rv
ccgaccagcacaccg

SEQ ID NO: 3246550 - RNA, 15 nt, Mycobacterium tuberculosis H37Rv
ccgaccagcacccgc

SEQ ID NO: 3246551 - RNA, 13 nt, Mycobacterium tuberculosis H37Rv
ccgaccagccgau

SEQ ID NO: 3246552 - RNA, 16 nt, Mycobacterium tuberculosis H37Rv
ccgaccagcgcggcac

SEQ ID NO: 3246553 - RNA, 20 nt, Mycobacterium tuberculosis H37Rv
ccgaccagcuugaccgacca

SEQ ID NO: 3246554 - RNA, 19 nt, Mycobacterium tuberculosis H37Rv
ccgaccaggccagagccgc

SEQ ID NO: 3246555 - RNA, 21 nt, Mycobacterium tuberculosis H37Rv
ccgaccaggccagagccgccc

SEQ ID NO: 3246556 - RNA, 17 nt, Mycobacterium tuberculosis H37Rv
ccgaccaucucaccggg

SEQ ID NO: 3246557 - RNA, 20 nt, Mycobacterium tuberculosis H37Rv
ccgaccaucucaccgggccc

SEQ ID NO: 3246558 - RNA, 13 nt, Mycobacterium tuberculosis H37Rv
ccgacccagaugg

SEQ ID NO: 3246559 - RNA, 19 nt, Mycobacterium tuberculosis H37Rv
ccgacccaucaccagcggc

SEQ ID NO: 3246560 - RNA, 19 nt, Mycobacterium tuberculosis H37Rv
ccgaccccgccgagcgcgc

SEQ ID NO: 3246561 - RNA, 16 nt, Mycobacterium tuberculosis H37Rv
ccgacccgcccgaaga

SEQ ID NO: 3246562 - RNA, 17 nt, Mycobacterium tuberculosis H37Rv
ccgacccgccgcgcccg

SEQ ID NO: 3246563 - RNA, 17 nt, Mycobacterium tuberculosis H37Rv
ccgacccgcgcgccggc

SEQ ID NO: 3246564 - RNA, 18 nt, Mycobacterium tuberculosis H37Rv
ccgacccgcugccaccca

SEQ ID NO: 3246565 - RNA, 20 nt, Mycobacterium tuberculosis H37Rv
ccgacccgcuucgcccggcu

SEQ ID NO: 3246566 - RNA, 23 nt, Mycobacterium tuberculosis H37Rv
ccgacccgcuucgcccggcugcg

SEQ ID NO: 3246567 - RNA, 17 nt, Mycobacterium tuberculosis H37Rv
ccgacccguaccagccc

SEQ ID NO: 3246568 - RNA, 13 nt, Mycobacterium tuberculosis H37Rv
ccgaccgaaccgu

SEQ ID NO: 3246569 - RNA, 17 nt, Mycobacterium tuberculosis H37Rv
ccgaccgaaccgucagc

SEQ ID NO: 3246570 - RNA, 14 nt, Mycobacterium tuberculosis H37Rv
ccgaccgacaccac

SEQ ID NO: 3246571 - RNA, 16 nt, Mycobacterium tuberculosis H37Rv
ccgaccgacaccacca

SEQ ID NO: 3246572 - RNA, 19 nt, Mycobacterium tuberculosis H37Rv
ccgaccgacaccaccaggu

SEQ ID NO: 3246573 - RNA, 20 nt, Mycobacterium tuberculosis H37Rv
ccgaccgauaacacccgggc

SEQ ID NO: 3246574 - RNA, 14 nt, Mycobacterium tuberculosis H37Rv
ccgaccgccaccgc

SEQ ID NO: 3246575 - RNA, 14 nt, Mycobacterium tuberculosis H37Rv
ccgaccgccgagcg

SEQ ID NO: 3246576 - RNA, 13 nt, Mycobacterium tuberculosis H37Rv
ccgaccgccugau

SEQ ID NO: 3246577 - RNA, 14 nt, Mycobacterium tuberculosis H37Rv
ccgaccgcgacccg

SEQ ID NO: 3246578 - RNA, 16 nt, Mycobacterium tuberculosis H37Rv
ccgaccgcgccgcauc

SEQ ID NO: 3246579 - RNA, 11 nt, Mycobacterium tuberculosis H37Rv
ccgaccgcguu

SEQ ID NO: 3246580 - RNA, 15 nt, Mycobacterium tuberculosis H37Rv
ccgaccggcacccgc

SEQ ID NO: 3246581 - RNA, 15 nt, Mycobacterium tuberculosis H37Rv
ccgaccggcagcgau

SEQ ID NO: 3246582 - RNA, 23 nt, Mycobacterium tuberculosis H37Rv
ccgaccggcagcgaugcgguguc

SEQ ID NO: 3246583 - RNA, 13 nt, Mycobacterium tuberculosis H37Rv
ccgaccgggccgc

SEQ ID NO: 3246584 - RNA, 23 nt, Mycobacterium tuberculosis H37Rv
ccgaccgggcucuggccaguccg

SEQ ID NO: 3246585 - RNA, 18 nt, Mycobacterium tuberculosis H37Rv
ccgaccggguugauggcg

SEQ ID NO: 3246586 - RNA, 22 nt, Mycobacterium tuberculosis H37Rv
ccgaccgguacccguagcacca

SEQ ID NO: 3246587 - RNA, 19 nt, Mycobacterium tuberculosis H37Rv
ccgaccggucuggcgauga

SEQ ID NO: 3246588 - RNA, 12 nt, Mycobacterium tuberculosis H37Rv
ccgaccgguugg

SEQ ID NO: 3246589 - RNA, 18 nt, Mycobacterium tuberculosis H37Rv
ccgaccgucgucgugcag

SEQ ID NO: 3246590 - RNA, 16 nt, Mycobacterium tuberculosis H37Rv
ccgaccgugaucagcg

SEQ ID NO: 3246591 - RNA, 15 nt, Mycobacterium tuberculosis H37Rv
ccgaccuaccgucga

SEQ ID NO: 3246592 - RNA, 18 nt, Mycobacterium tuberculosis H37Rv
ccgaccuaccgucgacca

SEQ ID NO: 3246593 - RNA, 20 nt, Mycobacterium tuberculosis H37Rv
ccgaccuaccgucgaccacu

SEQ ID NO: 3246594 - RNA, 23 nt, Mycobacterium tuberculosis H37Rv
ccgaccuagucaccuugaccggg

SEQ ID NO: 3246595 - RNA, 16 nt, Mycobacterium tuberculosis H37Rv
ccgaccucaucggcac

SEQ ID NO: 3246596 - RNA, 22 nt, Mycobacterium tuberculosis H37Rv
ccgaccuccuccuugaaccggg

SEQ ID NO: 3246597 - RNA, 15 nt, Mycobacterium tuberculosis H37Rv
ccgaccucgacgccc

SEQ ID NO: 3246598 - RNA, 22 nt, Mycobacterium tuberculosis H37Rv
ccgaccucgagugcgaaccacg

SEQ ID NO: 3246599 - RNA, 15 nt, Mycobacterium tuberculosis H37Rv
ccgaccucgccgcgc

SEQ ID NO: 3246600 - RNA, 11 nt, Mycobacterium tuberculosis H37Rv
ccgaccuggac

SEQ ID NO: 3246601 - RNA, 17 nt, Mycobacterium tuberculosis H37Rv
ccgaccugguaugccgc

SEQ ID NO: 3246602 - RNA, 20 nt, Mycobacterium tuberculosis H37Rv
ccgaccugguaugccgcccg

SEQ ID NO: 3246603 - RNA, 21 nt, Mycobacterium tuberculosis H37Rv
ccgaccugguaugccgcccgc

SEQ ID NO: 3246604 - RNA, 23 nt, Mycobacterium tuberculosis H37Rv
ccgaccugguaugccgcccgcag

SEQ ID NO: 3246605 - RNA, 14 nt, Mycobacterium tuberculosis H37Rv
ccgaccuucggccc

SEQ ID NO: 3246606 - RNA, 19 nt, Mycobacterium tuberculosis H37Rv
ccgaccuuuugcggcaagc

SEQ ID NO: 3246607 - RNA, 20 nt, Mycobacterium tuberculosis H37Rv
ccgacgaacgaaccgccgcc

SEQ ID NO: 3246608 - RNA, 21 nt, Mycobacterium tuberculosis H37Rv
ccgacgaacgaaccgccgccg

SEQ ID NO: 3246609 - RNA, 15 nt, Mycobacterium tuberculosis H37Rv
ccgacgaagaucgcu

SEQ ID NO: 3246610 - RNA, 17 nt, Mycobacterium tuberculosis H37Rv
ccgacgacaccagagcg

SEQ ID NO: 3246611 - RNA, 23 nt, Mycobacterium tuberculosis H37Rv
ccgacgacaccagagcgaacccc

SEQ ID NO: 3246612 - RNA, 15 nt, Mycobacterium tuberculosis H37Rv
ccgacgaccagcaga

SEQ ID NO: 3246613 - RNA, 17 nt, Mycobacterium tuberculosis H37Rv
ccgacgaccagcagauc

SEQ ID NO: 3246614 - RNA, 17 nt, Mycobacterium tuberculosis H37Rv
ccgacgaccgccugcaa

SEQ ID NO: 3246615 - RNA, 14 nt, Mycobacterium tuberculosis H37Rv
ccgacgacgcgcgc

SEQ ID NO: 3246616 - RNA, 16 nt, Mycobacterium tuberculosis H37Rv
ccgacgacggcgacgg

SEQ ID NO: 3246617 - RNA, 19 nt, Mycobacterium tuberculosis H37Rv
ccgacgacggcgacggcgc

SEQ ID NO: 3246618 - RNA, 21 nt, Mycobacterium tuberculosis H37Rv
ccgacgacggcgacggcgccc

SEQ ID NO: 3246619 - RNA, 22 nt, Mycobacterium tuberculosis H37Rv
ccgacgagauacggccaccagg

SEQ ID NO: 3246620 - RNA, 23 nt, Mycobacterium tuberculosis H37Rv
ccgacgagauacggccaccaggu

SEQ ID NO: 3246621 - RNA, 15 nt, Mycobacterium tuberculosis H37Rv
ccgacgaggaugucg

SEQ ID NO: 3246622 - RNA, 15 nt, Mycobacterium tuberculosis H37Rv
ccgacgaucaacgga

SEQ ID NO: 3246623 - RNA, 14 nt, Mycobacterium tuberculosis H37Rv
ccgacgaucgacgc

SEQ ID NO: 3246624 - RNA, 20 nt, Mycobacterium tuberculosis H37Rv
ccgacgaucgacgccgccac

SEQ ID NO: 3246625 - RNA, 14 nt, Mycobacterium tuberculosis H37Rv
ccgacgaugccgcg

SEQ ID NO: 3246626 - RNA, 16 nt, Mycobacterium tuberculosis H37Rv
ccgacgaugcgggcga

SEQ ID NO: 3246627 - RNA, 17 nt, Mycobacterium tuberculosis H37Rv
ccgacgaugcgggcgau

SEQ ID NO: 3246628 - RNA, 19 nt, Mycobacterium tuberculosis H37Rv
ccgacgaugugcacggugu

SEQ ID NO: 3246629 - RNA, 15 nt, Mycobacterium tuberculosis H37Rv
ccgacgaugugccag

SEQ ID NO: 3246630 - RNA, 19 nt, Mycobacterium tuberculosis H37Rv
ccgacgcaccaacgcgauc

SEQ ID NO: 3246631 - RNA, 18 nt, Mycobacterium tuberculosis H37Rv
ccgacgcagcuugcccga

SEQ ID NO: 3246632 - RNA, 13 nt, Mycobacterium tuberculosis H37Rv
ccgacgcagguga

SEQ ID NO: 3246633 - RNA, 16 nt, Mycobacterium tuberculosis H37Rv
ccgacgccaacgccag

SEQ ID NO: 3246634 - RNA, 19 nt, Mycobacterium tuberculosis H37Rv
ccgacgccaacgccagcgg

SEQ ID NO: 3246635 - RNA, 22 nt, Mycobacterium tuberculosis H37Rv
ccgagaccgcgugcucgagcac

SEQ ID NO: 3246636 - RNA, 21 nt, Mycobacterium tuberculosis H37Rv
ccgagaccgggcaacggcggg

SEQ ID NO: 3246637 - RNA, 21 nt, Mycobacterium tuberculosis H37Rv
ccgagacgaccuccucgauga

SEQ ID NO: 3246638 - RNA, 17 nt, Mycobacterium tuberculosis H37Rv
ccgagacggcgucgggc

SEQ ID NO: 3246639 - RNA, 20 nt, Mycobacterium tuberculosis H37Rv
ccgagacuugcuggcccgca

SEQ ID NO: 3246640 - RNA, 13 nt, Mycobacterium tuberculosis H37Rv
ccgagagcaccgc

SEQ ID NO: 3246641 - RNA, 14 nt, Mycobacterium tuberculosis H37Rv
ccgagagcaccgcu

SEQ ID NO: 3246642 - RNA, 15 nt, Mycobacterium tuberculosis H37Rv
ccgagagcaccgcuc

SEQ ID NO: 3246643 - RNA, 15 nt, Mycobacterium tuberculosis H37Rv
ccgagauagcaacga

SEQ ID NO: 3246644 - RNA, 22 nt, Mycobacterium tuberculosis H37Rv
ccgagauagcaacgaagccggc

SEQ ID NO: 3246645 - RNA, 16 nt, Mycobacterium tuberculosis H37Rv
ccgagaucaccgguac

SEQ ID NO: 3246646 - RNA, 20 nt, Mycobacterium tuberculosis H37Rv
ccgagaucaugccggcgaac

SEQ ID NO: 3246647 - RNA, 15 nt, Mycobacterium tuberculosis H37Rv
ccgagaucccagcgg

SEQ ID NO: 3246648 - RNA, 12 nt, Mycobacterium tuberculosis H37Rv
ccgagaucgaca

SEQ ID NO: 3246649 - RNA, 16 nt, Mycobacterium tuberculosis H37Rv
ccgagaucggacaggu

SEQ ID NO: 3246650 - RNA, 18 nt, Mycobacterium tuberculosis H37Rv
ccgagaugcguuccgcga

SEQ ID NO: 3246651 - RNA, 19 nt, Mycobacterium tuberculosis H37Rv
ccgagaugcuggucggcga

SEQ ID NO: 3246652 - RNA, 22 nt, Mycobacterium tuberculosis H37Rv
ccgagaugcuggucggcgauga

SEQ ID NO: 3246653 - RNA, 15 nt, Mycobacterium tuberculosis H37Rv
ccgagauggcgauca

SEQ ID NO: 3246654 - RNA, 16 nt, Mycobacterium tuberculosis H37Rv
ccgagauuggugcaga

SEQ ID NO: 3246655 - RNA, 20 nt, Mycobacterium tuberculosis H37Rv
ccgagcaaacauccacccgc

SEQ ID NO: 3246656 - RNA, 20 nt, Mycobacterium tuberculosis H37Rv
ccgagcaacaccgucggcag

SEQ ID NO: 3246657 - RNA, 18 nt, Mycobacterium tuberculosis H37Rv
ccgagcacaggaucaccc

SEQ ID NO: 3246658 - RNA, 16 nt, Mycobacterium tuberculosis H37Rv
ccgagcaccucggcca

SEQ ID NO: 3246659 - RNA, 22 nt, Mycobacterium tuberculosis H37Rv
ccgagcacggguagcguccagg

SEQ ID NO: 3246660 - RNA, 16 nt, Mycobacterium tuberculosis H37Rv
ccgagcacuccggagc

SEQ ID NO: 3246661 - RNA, 14 nt, Mycobacterium tuberculosis H37Rv
ccgagcacucggcc

SEQ ID NO: 3246662 - RNA, 19 nt, Mycobacterium tuberculosis H37Rv
ccgagcagacgcagaaucg

SEQ ID NO: 3246663 - RNA, 16 nt, Mycobacterium tuberculosis H37Rv
ccgagcagcagaaacg

SEQ ID NO: 3246664 - RNA, 18 nt, Mycobacterium tuberculosis H37Rv
ccgagcagcccgcggauc

SEQ ID NO: 3246665 - RNA, 13 nt, Mycobacterium tuberculosis H37Rv
ccgagcagcuccu

SEQ ID NO: 3246666 - RNA, 20 nt, Mycobacterium tuberculosis H37Rv
ccgagcagcuucucggcgag

SEQ ID NO: 3246667 - RNA, 14 nt, Mycobacterium tuberculosis H37Rv
ccgagccagcuccg

SEQ ID NO: 3246668 - RNA, 14 nt, Mycobacterium tuberculosis H37Rv
ccgagcccagccgg

SEQ ID NO: 3246669 - RNA, 16 nt, Mycobacterium tuberculosis H37Rv
ccgagcccagcgccuc

SEQ ID NO: 3246670 - RNA, 20 nt, Mycobacterium tuberculosis H37Rv
ccgagcccagcgccuccagc

SEQ ID NO: 3246671 - RNA, 18 nt, Mycobacterium tuberculosis H37Rv
ccgagcccgaugguggug

SEQ ID NO: 3246672 - RNA, 16 nt, Mycobacterium tuberculosis H37Rv
ccgagcccgccagcgc

SEQ ID NO: 3246673 - RNA, 15 nt, Mycobacterium tuberculosis H37Rv
ccgagcccgcugcgc

SEQ ID NO: 3246674 - RNA, 20 nt, Mycobacterium tuberculosis H37Rv
ccgagcccgggccugaacca

SEQ ID NO: 3246675 - RNA, 13 nt, Mycobacterium tuberculosis H37Rv
ccgagcccggugc

SEQ ID NO: 3246676 - RNA, 22 nt, Mycobacterium tuberculosis H37Rv
ccgagccgauauaccagggcau

SEQ ID NO: 3246677 - RNA, 14 nt, Mycobacterium tuberculosis H37Rv
ccgagccucgcucu

SEQ ID NO: 3246678 - RNA, 13 nt, Mycobacterium tuberculosis H37Rv
ccgagccuggauc

SEQ ID NO: 3246679 - RNA, 16 nt, Mycobacterium tuberculosis H37Rv
ccgagccuugagcgcg

SEQ ID NO: 3246680 - RNA, 18 nt, Mycobacterium tuberculosis H37Rv
ccgagcgaccgucccagc

SEQ ID NO: 3246681 - RNA, 17 nt, Mycobacterium tuberculosis H37Rv
ccgagcgcaacucccag

SEQ ID NO: 3246682 - RNA, 18 nt, Mycobacterium tuberculosis H37Rv
ccgagcgccaguucgcgg

SEQ ID NO: 3246683 - RNA, 19 nt, Mycobacterium tuberculosis H37Rv
ccgagcgccaguucgcggc

SEQ ID NO: 3246684 - RNA, 13 nt, Mycobacterium tuberculosis H37Rv
ccgagcgcccucc

SEQ ID NO: 3246685 - RNA, 18 nt, Mycobacterium tuberculosis H37Rv
ccgagcgcccuccucgau

SEQ ID NO: 3246686 - RNA, 20 nt, Mycobacterium tuberculosis H37Rv
ccgagcgcgaugaugaucgg

SEQ ID NO: 3246687 - RNA, 12 nt, Mycobacterium tuberculosis H37Rv
ccgagcgcgccg

SEQ ID NO: 3246688 - RNA, 12 nt, Mycobacterium tuberculosis H37Rv
ccgagcgcgcgc

SEQ ID NO: 3246689 - RNA, 18 nt, Mycobacterium tuberculosis H37Rv
ccgagcgcucgaucacgg

SEQ ID NO: 3246690 - RNA, 20 nt, Mycobacterium tuberculosis H37Rv
ccgagcgcuugaccccgccg

SEQ ID NO: 3246691 - RNA, 16 nt, Mycobacterium tuberculosis H37Rv
ccgagcggagccgccg

SEQ ID NO: 3246692 - RNA, 17 nt, Mycobacterium tuberculosis H37Rv
ccgagcggagccgccga

SEQ ID NO: 3246693 - RNA, 15 nt, Mycobacterium tuberculosis H37Rv
ccgagcggcaucggu

SEQ ID NO: 3246694 - RNA, 13 nt, Mycobacterium tuberculosis H37Rv
ccgagcggcggca

SEQ ID NO: 3246695 - RNA, 15 nt, Mycobacterium tuberculosis H37Rv
ccgagcggcggcacu

SEQ ID NO: 3246696 - RNA, 12 nt, Mycobacterium tuberculosis H37Rv
ccgagcgggaac

SEQ ID NO: 3246697 - RNA, 23 nt, Mycobacterium tuberculosis H37Rv
ccgagcgggaacgagccacgcca

SEQ ID NO: 3246698 - RNA, 20 nt, Mycobacterium tuberculosis H37Rv
ccgagcgguugccuucuugg

SEQ ID NO: 3246699 - RNA, 19 nt, Mycobacterium tuberculosis H37Rv
ccgagcguaaugcugcugc

SEQ ID NO: 3246700 - RNA, 15 nt, Mycobacterium tuberculosis H37Rv
ccgagcguccggugg

SEQ ID NO: 3246701 - RNA, 13 nt, Mycobacterium tuberculosis H37Rv
ccgagcgugaagu

SEQ ID NO: 3246702 - RNA, 20 nt, Mycobacterium tuberculosis H37Rv
ccgagcgugaagucacggcg

SEQ ID NO: 3246703 - RNA, 24 nt, Mycobacterium tuberculosis H37Rv
ccgagcucaggucgacaggugcca

SEQ ID NO: 3246704 - RNA, 22 nt, Mycobacterium tuberculosis H37Rv
ccgagcuccgcggcgagcuccg

SEQ ID NO: 3246705 - RNA, 15 nt, Mycobacterium tuberculosis H37Rv
ccgagcuccuccacc

SEQ ID NO: 3246706 - RNA, 15 nt, Mycobacterium tuberculosis H37Rv
ccgagcucggcgccc

SEQ ID NO: 3246707 - RNA, 16 nt, Mycobacterium tuberculosis H37Rv
ccgagcucggcgccca

SEQ ID NO: 3246708 - RNA, 22 nt, Mycobacterium tuberculosis H37Rv
ccgagcucguugcuggcggcca

SEQ ID NO: 3246709 - RNA, 21 nt, Mycobacterium tuberculosis H37Rv
ccgagcucuuggagcuuggcc

SEQ ID NO: 3246710 - RNA, 15 nt, Mycobacterium tuberculosis H37Rv
ccgagcugagcggcc

SEQ ID NO: 3246711 - RNA, 19 nt, Mycobacterium tuberculosis H37Rv
ccgagcugagcggccagca

SEQ ID NO: 3246712 - RNA, 21 nt, Mycobacterium tuberculosis H37Rv
ccgagcugagcggccagcauc

SEQ ID NO: 3246713 - RNA, 20 nt, Mycobacterium tuberculosis H37Rv
ccgagcugccaacgcccgug

SEQ ID NO: 3246714 - RNA, 19 nt, Mycobacterium tuberculosis H37Rv
ccgagcuggcaacgccgcg

SEQ ID NO: 3246715 - RNA, 15 nt, Mycobacterium tuberculosis H37Rv
ccgagcuggcgcgcg

SEQ ID NO: 3246716 - RNA, 21 nt, Mycobacterium tuberculosis H37Rv
ccgagcugugcgcagacaucg

SEQ ID NO: 3246717 - RNA, 20 nt, Mycobacterium tuberculosis H37Rv
ccgagcuguggucacccgug

SEQ ID NO: 3246718 - RNA, 12 nt, Mycobacterium tuberculosis H37Rv
ccgagcuucagc

SEQ ID NO: 3246719 - RNA, 23 nt, Mycobacterium tuberculosis H37Rv
ccgagcuucagcgcgcugcagug

SEQ ID NO: 3246720 - RNA, 17 nt, Mycobacterium tuberculosis H37Rv
ccgagcuuccaaacccg

SEQ ID NO: 3246721 - RNA, 20 nt, Mycobacterium tuberculosis H37Rv
ccgagcuuccaaacccggug

SEQ ID NO: 3246722 - RNA, 22 nt, Mycobacterium tuberculosis H37Rv
ccgagcuuggccgccgccaccu

SEQ ID NO: 3246723 - RNA, 22 nt, Mycobacterium tuberculosis H37Rv
ccgagcuugggccggugcagca

SEQ ID NO: 3246724 - RNA, 18 nt, Mycobacterium tuberculosis H37Rv
ccgagcuugucgagcagg

SEQ ID NO: 3246725 - RNA, 19 nt, Mycobacterium tuberculosis H37Rv
ccgaggaaaccaccagugg

SEQ ID NO: 3246726 - RNA, 21 nt, Mycobacterium tuberculosis H37Rv
ccgaggacacauugaccaggu

SEQ ID NO: 3246727 - RNA, 15 nt, Mycobacterium tuberculosis H37Rv
ccgaggacgccggcg

SEQ ID NO: 3246728 - RNA, 20 nt, Mycobacterium tuberculosis H37Rv
ccgaggaucucgcgguccag

SEQ ID NO: 3246729 - RNA, 14 nt, Mycobacterium tuberculosis H37Rv
ccgaggaugccgaa

SEQ ID NO: 3246730 - RNA, 22 nt, Mycobacterium tuberculosis H37Rv
ccgaggauguugugccgaucgg

SEQ ID NO: 3246731 - RNA, 15 nt, Mycobacterium tuberculosis H37Rv
ccgaucggcggaucg

SEQ ID NO: 3246732 - RNA, 20 nt, Mycobacterium tuberculosis H37Rv
ccgaucgggcccaccgcugc

SEQ ID NO: 3246733 - RNA, 21 nt, Mycobacterium tuberculosis H37Rv
ccgaucgggcucacucgccga

SEQ ID NO: 3246734 - RNA, 23 nt, Mycobacterium tuberculosis H37Rv
ccgaucgggcucacucgccgaau

SEQ ID NO: 3246735 - RNA, 20 nt, Mycobacterium tuberculosis H37Rv
ccgaucggucguccggaucg

SEQ ID NO: 3246736 - RNA, 13 nt, Mycobacterium tuberculosis H37Rv
ccgaucggugacg

SEQ ID NO: 3246737 - RNA, 20 nt, Mycobacterium tuberculosis H37Rv
ccgaucguaggacucggcgg

SEQ ID NO: 3246738 - RNA, 15 nt, Mycobacterium tuberculosis H37Rv
ccgaucgucucggcc

SEQ ID NO: 3246739 - RNA, 17 nt, Mycobacterium tuberculosis H37Rv
ccgaucgucucggccac

SEQ ID NO: 3246740 - RNA, 14 nt, Mycobacterium tuberculosis H37Rv
ccgaucugcuccuc

SEQ ID NO: 3246741 - RNA, 16 nt, Mycobacterium tuberculosis H37Rv
ccgaucugcucgccga

SEQ ID NO: 3246742 - RNA, 20 nt, Mycobacterium tuberculosis H37Rv
ccgaucuggaugucccaugc

SEQ ID NO: 3246743 - RNA, 14 nt, Mycobacterium tuberculosis H37Rv
ccgaugaaccaggc

SEQ ID NO: 3246744 - RNA, 21 nt, Mycobacterium tuberculosis H37Rv
ccgaugaccgaagagcgcgcg

SEQ ID NO: 3246745 - RNA, 17 nt, Mycobacterium tuberculosis H37Rv
ccgaugacgaugccgcc

SEQ ID NO: 3246746 - RNA, 13 nt, Mycobacterium tuberculosis H37Rv
ccgaugacgcguu

SEQ ID NO: 3246747 - RNA, 15 nt, Mycobacterium tuberculosis H37Rv
ccgaugacggucccc

SEQ ID NO: 3246748 - RNA, 21 nt, Mycobacterium tuberculosis H37Rv
ccgaugacgguccccaggucg

SEQ ID NO: 3246749 - RNA, 19 nt, Mycobacterium tuberculosis H37Rv
ccgaugacguacggcugug

SEQ ID NO: 3246750 - RNA, 18 nt, Mycobacterium tuberculosis H37Rv
ccgaugaggacauccggc

SEQ ID NO: 3246751 - RNA, 19 nt, Mycobacterium tuberculosis H37Rv
ccgaugaggacauccggcg

SEQ ID NO: 3246752 - RNA, 14 nt, Mycobacterium tuberculosis H37Rv
ccgaugaggcgcca

SEQ ID NO: 3246753 - RNA, 16 nt, Mycobacterium tuberculosis H37Rv
ccgaugaugcggcgca

SEQ ID NO: 3246754 - RNA, 19 nt, Mycobacterium tuberculosis H37Rv
ccgaugauggacaccagcc

SEQ ID NO: 3246755 - RNA, 22 nt, Mycobacterium tuberculosis H37Rv
ccgaugauggacaccagccaga

SEQ ID NO: 3246756 - RNA, 21 nt, Mycobacterium tuberculosis H37Rv
ccgaugauguuuuccccgccc

SEQ ID NO: 3246757 - RNA, 22 nt, Mycobacterium tuberculosis H37Rv
ccgaugcaucggugcagcccgc

SEQ ID NO: 3246758 - RNA, 13 nt, Mycobacterium tuberculosis H37Rv
ccgaugccacauc

SEQ ID NO: 3246759 - RNA, 17 nt, Mycobacterium tuberculosis H37Rv
ccgaugcccgacaccgc

SEQ ID NO: 3246760 - RNA, 20 nt, Mycobacterium tuberculosis H37Rv
ccgaugcccucgauggccag

SEQ ID NO: 3246761 - RNA, 18 nt, Mycobacterium tuberculosis H37Rv
ccgaugccgacggcgccc

SEQ ID NO: 3246762 - RNA, 15 nt, Mycobacterium tuberculosis H37Rv
ccgaugccgccgccg

SEQ ID NO: 3246763 - RNA, 13 nt, Mycobacterium tuberculosis H37Rv
ccgaugccgccgg

SEQ ID NO: 3246764 - RNA, 19 nt, Mycobacterium tuberculosis H37Rv
ccgaugccgccggcaccgc

SEQ ID NO: 3246765 - RNA, 15 nt, Mycobacterium tuberculosis H37Rv
ccgaugccgccggcc

SEQ ID NO: 3246766 - RNA, 13 nt, Mycobacterium tuberculosis H37Rv
ccgaugccuugac

SEQ ID NO: 3246767 - RNA, 16 nt, Mycobacterium tuberculosis H37Rv
ccgaugccuugaccgc

SEQ ID NO: 3246768 - RNA, 19 nt, Mycobacterium tuberculosis H37Rv
ccgaugccuugaccgcggu

SEQ ID NO: 3246769 - RNA, 16 nt, Mycobacterium tuberculosis H37Rv
ccgaugcgcagugcac

SEQ ID NO: 3246770 - RNA, 19 nt, Mycobacterium tuberculosis H37Rv
ccgaugcgcagugcaccgc

SEQ ID NO: 3246771 - RNA, 22 nt, Mycobacterium tuberculosis H37Rv
ccgaugcgcagugcaccgcguc

SEQ ID NO: 3246772 - RNA, 21 nt, Mycobacterium tuberculosis H37Rv
ccgaugcgccggaccagcucc

SEQ ID NO: 3246773 - RNA, 16 nt, Mycobacterium tuberculosis H37Rv
ccgaugcgggucucga

SEQ ID NO: 3246774 - RNA, 21 nt, Mycobacterium tuberculosis H37Rv
ccgaugcgugccgacccgcuu

SEQ ID NO: 3246775 - RNA, 22 nt, Mycobacterium tuberculosis H37Rv
ccgaugcguucgggcuccagca

SEQ ID NO: 3246776 - RNA, 14 nt, Mycobacterium tuberculosis H37Rv
ccgaugcugacgau

SEQ ID NO: 3246777 - RNA, 22 nt, Mycobacterium tuberculosis H37Rv
ccgaugcuggcaaaguaucgca

SEQ ID NO: 3246778 - RNA, 17 nt, Mycobacterium tuberculosis H37Rv
ccgauggaugggcugcg

SEQ ID NO: 3246779 - RNA, 23 nt, Mycobacterium tuberculosis H37Rv
ccgauggauuggcgucagcagca

SEQ ID NO: 3246780 - RNA, 13 nt, Mycobacterium tuberculosis H37Rv
ccgauggcgcacc

SEQ ID NO: 3246781 - RNA, 21 nt, Mycobacterium tuberculosis H37Rv
ccgauggcgguggugccgcgg

SEQ ID NO: 3246782 - RNA, 17 nt, Mycobacterium tuberculosis H37Rv
ccgauggcgucgccggc

SEQ ID NO: 3246783 - RNA, 21 nt, Mycobacterium tuberculosis H37Rv
ccgauggcgucgccggccccg

SEQ ID NO: 3246784 - RNA, 16 nt, Mycobacterium tuberculosis H37Rv
ccgauggcuaccuugg

SEQ ID NO: 3246785 - RNA, 18 nt, Mycobacterium tuberculosis H37Rv
ccgaugguacccgcgccg

SEQ ID NO: 3246786 - RNA, 14 nt, Mycobacterium tuberculosis H37Rv
ccgaugguggccgc

SEQ ID NO: 3246787 - RNA, 21 nt, Mycobacterium tuberculosis H37Rv
ccgaugguggugccaaccugg

SEQ ID NO: 3246788 - RNA, 19 nt, Mycobacterium tuberculosis H37Rv
ccgauguggccggcgaugg

SEQ ID NO: 3246789 - RNA, 18 nt, Mycobacterium tuberculosis H37Rv
ccgaugugggcgccgucg

SEQ ID NO: 3246790 - RNA, 20 nt, Mycobacterium tuberculosis H37Rv
ccgaugugggcgccgucgcc

SEQ ID NO: 3246791 - RNA, 18 nt, Mycobacterium tuberculosis H37Rv
ccgauguggucggcuguc

SEQ ID NO: 3246792 - RNA, 20 nt, Mycobacterium tuberculosis H37Rv
ccgaugugucgaugaggauc

SEQ ID NO: 3246793 - RNA, 23 nt, Mycobacterium tuberculosis H37Rv
ccgauguuggcagggccagcggc

SEQ ID NO: 3246794 - RNA, 14 nt, Mycobacterium tuberculosis H37Rv
ccgauuccagcgga

SEQ ID NO: 3246795 - RNA, 22 nt, Mycobacterium tuberculosis H37Rv
ccgauuccggaguucuuguagc

SEQ ID NO: 3246796 - RNA, 14 nt, Mycobacterium tuberculosis H37Rv
ccgauucucgaucu

SEQ ID NO: 3246797 - RNA, 15 nt, Mycobacterium tuberculosis H37Rv
ccgauugaguucggc

SEQ ID NO: 3246798 - RNA, 18 nt, Mycobacterium tuberculosis H37Rv
ccgauugcguucaucauc

SEQ ID NO: 3246799 - RNA, 12 nt, Mycobacterium tuberculosis H37Rv
ccgauuggccaa

SEQ ID NO: 3246800 - RNA, 16 nt, Mycobacterium tuberculosis H37Rv
ccgauuggccaacccc

SEQ ID NO: 3246801 - RNA, 15 nt, Mycobacterium tuberculosis H37Rv
ccgauugucggcaac

SEQ ID NO: 3246802 - RNA, 16 nt, Mycobacterium tuberculosis H37Rv
ccgauuuauccggauc

SEQ ID NO: 3246803 - RNA, 13 nt, Mycobacterium tuberculosis H37Rv
ccgauuucccagc

SEQ ID NO: 3246804 - RNA, 14 nt, Mycobacterium tuberculosis H37Rv
ccgauuuugggauc

SEQ ID NO: 3246805 - RNA, 18 nt, Mycobacterium tuberculosis H37Rv
ccgcaaaaucgucagcgc

SEQ ID NO: 3246806 - RNA, 14 nt, Mycobacterium tuberculosis H37Rv
ccgcaaacgcggcg

SEQ ID NO: 3246807 - RNA, 19 nt, Mycobacterium tuberculosis H37Rv
ccgcaacauuuucgcccgc

SEQ ID NO: 3246808 - RNA, 22 nt, Mycobacterium tuberculosis H37Rv
ccgcaaccacgccccgaucggu

SEQ ID NO: 3246809 - RNA, 12 nt, Mycobacterium tuberculosis H37Rv
ccgcaaccgcga

SEQ ID NO: 3246810 - RNA, 19 nt, Mycobacterium tuberculosis H37Rv
ccgcaaccgguaucgccgc

SEQ ID NO: 3246811 - RNA, 16 nt, Mycobacterium tuberculosis H37Rv
ccgcaacgacggccgu

SEQ ID NO: 3246812 - RNA, 18 nt, Mycobacterium tuberculosis H37Rv
ccgcaacgcgucggucgc

SEQ ID NO: 3246813 - RNA, 18 nt, Mycobacterium tuberculosis H37Rv
ccgcaacgcuucggcagc

SEQ ID NO: 3246814 - RNA, 21 nt, Mycobacterium tuberculosis H37Rv
ccgcaacgcuucggcagcucc

SEQ ID NO: 3246815 - RNA, 12 nt, Mycobacterium tuberculosis H37Rv
ccgcaacggaug

SEQ ID NO: 3246816 - RNA, 16 nt, Mycobacterium tuberculosis H37Rv
ccgcaacucgccgaaa

SEQ ID NO: 3246817 - RNA, 23 nt, Mycobacterium tuberculosis H37Rv
ccgcaacucgccgaaaucggcca

SEQ ID NO: 3246818 - RNA, 14 nt, Mycobacterium tuberculosis H37Rv
ccgcaagaaucagc

SEQ ID NO: 3246819 - RNA, 17 nt, Mycobacterium tuberculosis H37Rv
ccgcaagaaucagcagc

SEQ ID NO: 3246820 - RNA, 18 nt, Mycobacterium tuberculosis H37Rv
ccgcaagaaucagcagca

SEQ ID NO: 3246821 - RNA, 14 nt, Mycobacterium tuberculosis H37Rv
ccgcaaggcgccga

SEQ ID NO: 3246822 - RNA, 24 nt, Mycobacterium tuberculosis H37Rv
ccgcaagugucuccggcaacagca

SEQ ID NO: 3246823 - RNA, 18 nt, Mycobacterium tuberculosis H37Rv
ccgcaaucaugucagcgc

SEQ ID NO: 3246824 - RNA, 13 nt, Mycobacterium tuberculosis H37Rv
ccgcaaucgcgac

SEQ ID NO: 3246825 - RNA, 14 nt, Mycobacterium tuberculosis H37Rv
ccgcaaucugcuug

SEQ ID NO: 3246826 - RNA, 21 nt, Mycobacterium tuberculosis H37Rv
ccgcaaugaccuggccgcccg

SEQ ID NO: 3246827 - RNA, 15 nt, Mycobacterium tuberculosis H37Rv
ccgcagcaccgucgg

SEQ ID NO: 3246828 - RNA, 17 nt, Mycobacterium tuberculosis H37Rv
ccgcagcaccgucgggc

SEQ ID NO: 3246829 - RNA, 11 nt, Mycobacterium tuberculosis H37Rv
ccgcagcagca

SEQ ID NO: 3246830 - RNA, 23 nt, Mycobacterium tuberculosis H37Rv
ccgcagcaggugcaucgccacag

SEQ ID NO: 3246831 - RNA, 15 nt, Mycobacterium tuberculosis H37Rv
ccgcagcaucgccag

SEQ ID NO: 3246832 - RNA, 15 nt, Mycobacterium tuberculosis H37Rv
ccgcagccagaucuc

SEQ ID NO: 3246833 - RNA, 12 nt, Mycobacterium tuberculosis H37Rv
ccgcagccagca

SEQ ID NO: 3246834 - RNA, 22 nt, Mycobacterium tuberculosis H37Rv
ccgcagcccaaaucccagagca

SEQ ID NO: 3246835 - RNA, 20 nt, Mycobacterium tuberculosis H37Rv
ccgcagcccgugacugguga

SEQ ID NO: 3246836 - RNA, 13 nt, Mycobacterium tuberculosis H37Rv
ccgcagccgguua

SEQ ID NO: 3246837 - RNA, 19 nt, Mycobacterium tuberculosis H37Rv
ccgcagcgaaaacccgguc

SEQ ID NO: 3246838 - RNA, 20 nt, Mycobacterium tuberculosis H37Rv
ccgcagcgaagaccagcggc

SEQ ID NO: 3246839 - RNA, 14 nt, Mycobacterium tuberculosis H37Rv
ccgcagcgccaccc

SEQ ID NO: 3246840 - RNA, 21 nt, Mycobacterium tuberculosis H37Rv
ccgcagcgcgaaggucagcga

SEQ ID NO: 3246841 - RNA, 22 nt, Mycobacterium tuberculosis H37Rv
ccgcagcgcgaaggucagcgac

SEQ ID NO: 3246842 - RNA, 23 nt, Mycobacterium tuberculosis H37Rv
ccgcagcgcgaaggucagcgacu

SEQ ID NO: 3246843 - RNA, 23 nt, Mycobacterium tuberculosis H37Rv
ccgcagcgcuuccaggucagaga

SEQ ID NO: 3246844 - RNA, 19 nt, Mycobacterium tuberculosis H37Rv
ccgcagcggaacugggccc

SEQ ID NO: 3246845 - RNA, 20 nt, Mycobacterium tuberculosis H37Rv
ccgcagcggaacugggcccc

SEQ ID NO: 3246846 - RNA, 22 nt, Mycobacterium tuberculosis H37Rv
ccgcagcggcggcaacccugcc

SEQ ID NO: 3246847 - RNA, 15 nt, Mycobacterium tuberculosis H37Rv
ccgcagcgugaucug

SEQ ID NO: 3246848 - RNA, 18 nt, Mycobacterium tuberculosis H37Rv
ccgcagcgugaucuggcc

SEQ ID NO: 3246849 - RNA, 22 nt, Mycobacterium tuberculosis H37Rv
ccgcagcuccccgaccgaaccg

SEQ ID NO: 3246850 - RNA, 13 nt, Mycobacterium tuberculosis H37Rv
ccgcagcucgacc

SEQ ID NO: 3246851 - RNA, 16 nt, Mycobacterium tuberculosis H37Rv
ccgcagcucgaccagg

SEQ ID NO: 3246852 - RNA, 23 nt, Mycobacterium tuberculosis H37Rv
ccgcagcuuuaaucguggcacug

SEQ ID NO: 3246853 - RNA, 22 nt, Mycobacterium tuberculosis H37Rv
ccgcaggccagggucagcucgg

SEQ ID NO: 3246854 - RNA, 21 nt, Mycobacterium tuberculosis H37Rv
ccgcaggcgaacaccagaugg

SEQ ID NO: 3246855 - RNA, 14 nt, Mycobacterium tuberculosis H37Rv
ccgcaggcucaccg

SEQ ID NO: 3246856 - RNA, 19 nt, Mycobacterium tuberculosis H37Rv
ccgcagggccgccgcgaac

SEQ ID NO: 3246857 - RNA, 14 nt, Mycobacterium tuberculosis H37Rv
ccgcaggucgcacc

SEQ ID NO: 3246858 - RNA, 13 nt, Mycobacterium tuberculosis H37Rv
ccgcaggucggcc

SEQ ID NO: 3246859 - RNA, 21 nt, Mycobacterium tuberculosis H37Rv
ccgcaggucggccaccugcuc

SEQ ID NO: 3246860 - RNA, 23 nt, Mycobacterium tuberculosis H37Rv
ccgcaguccggggcgcaggucgu

SEQ ID NO: 3246861 - RNA, 22 nt, Mycobacterium tuberculosis H37Rv
ccgcagucgcggcagacgcguu

SEQ ID NO: 3246862 - RNA, 23 nt, Mycobacterium tuberculosis H37Rv
ccgcaguggcaagcugucgucgc

SEQ ID NO: 3246863 - RNA, 17 nt, Mycobacterium tuberculosis H37Rv
ccgcaguucaucgagag

SEQ ID NO: 3246864 - RNA, 16 nt, Mycobacterium tuberculosis H37Rv
ccgcaguucggucguc

SEQ ID NO: 3246865 - RNA, 15 nt, Mycobacterium tuberculosis H37Rv
ccgcaguucuugauu

SEQ ID NO: 3246866 - RNA, 14 nt, Mycobacterium tuberculosis H37Rv
ccgcauaacgccag

SEQ ID NO: 3246867 - RNA, 18 nt, Mycobacterium tuberculosis H37Rv
ccgcauaacgcgaacccg

SEQ ID NO: 3246868 - RNA, 23 nt, Mycobacterium tuberculosis H37Rv
ccgcauaaggcccaugccgucgg

SEQ ID NO: 3246869 - RNA, 19 nt, Mycobacterium tuberculosis H37Rv
ccgcauaccuuccagaucg

SEQ ID NO: 3246870 - RNA, 23 nt, Mycobacterium tuberculosis H37Rv
ccgcauacgcggcuuugacgccc

SEQ ID NO: 3246871 - RNA, 21 nt, Mycobacterium tuberculosis H37Rv
ccgcauaggccccgccagcgc

SEQ ID NO: 3246872 - RNA, 16 nt, Mycobacterium tuberculosis H37Rv
ccgcaucacccgggau

SEQ ID NO: 3246873 - RNA, 19 nt, Mycobacterium tuberculosis H37Rv
ccgcauccacgucgcccag

SEQ ID NO: 3246874 - RNA, 22 nt, Mycobacterium tuberculosis H37Rv
ccgcauccggcaagccggggaa

SEQ ID NO: 3246875 - RNA, 15 nt, Mycobacterium tuberculosis H37Rv
ccgcauccggucucg

SEQ ID NO: 3246876 - RNA, 15 nt, Mycobacterium tuberculosis H37Rv
ccgcaucgcaccagg

SEQ ID NO: 3246877 - RNA, 14 nt, Mycobacterium tuberculosis H37Rv
ccgcaucgccucac

SEQ ID NO: 3246878 - RNA, 15 nt, Mycobacterium tuberculosis H37Rv
ccgcaucgcggcauc

SEQ ID NO: 3246879 - RNA, 13 nt, Mycobacterium tuberculosis H37Rv
ccgcaucggcaag

SEQ ID NO: 3246880 - RNA, 14 nt, Mycobacterium tuberculosis H37Rv
ccgcaucggcacgc

SEQ ID NO: 3246881 - RNA, 15 nt, Mycobacterium tuberculosis H37Rv
ccgcaucggcgaaca

SEQ ID NO: 3246882 - RNA, 19 nt, Mycobacterium tuberculosis H37Rv
ccgcaucggugucuuccuc

SEQ ID NO: 3246883 - RNA, 15 nt, Mycobacterium tuberculosis H37Rv
ccgcaucgucgccga

SEQ ID NO: 3246884 - RNA, 23 nt, Mycobacterium tuberculosis H37Rv
ccgcaucgucgccgaccgucacu

SEQ ID NO: 3246885 - RNA, 18 nt, Mycobacterium tuberculosis H37Rv
ccgcaucgucgccgcgca

SEQ ID NO: 3246886 - RNA, 15 nt, Mycobacterium tuberculosis H37Rv
ccgcaucguugccga

SEQ ID NO: 3246887 - RNA, 23 nt, Mycobacterium tuberculosis H37Rv
ccgcaucguugccgaccgucacu

SEQ ID NO: 3246888 - RNA, 18 nt, Mycobacterium tuberculosis H37Rv
ccgcaucguuuucgccga

SEQ ID NO: 3246889 - RNA, 19 nt, Mycobacterium tuberculosis H37Rv
ccgcaugccacggcaagcc

SEQ ID NO: 3246890 - RNA, 14 nt, Mycobacterium tuberculosis H37Rv
ccgcaugcccugga

SEQ ID NO: 3246891 - RNA, 22 nt, Mycobacterium tuberculosis H37Rv
ccgcaugcccuggaccagcggg

SEQ ID NO: 3246892 - RNA, 13 nt, Mycobacterium tuberculosis H37Rv
ccgcaugccggcg

SEQ ID NO: 3246893 - RNA, 17 nt, Mycobacterium tuberculosis H37Rv
ccgcaugcgcuccggcg

SEQ ID NO: 3246894 - RNA, 15 nt, Mycobacterium tuberculosis H37Rv
ccgcauggacgcgau

SEQ ID NO: 3246895 - RNA, 21 nt, Mycobacterium tuberculosis H37Rv
ccgcauggcgcggguccagcc

SEQ ID NO: 3246896 - RNA, 21 nt, Mycobacterium tuberculosis H37Rv
ccgcaugugggaacuggacca

SEQ ID NO: 3246897 - RNA, 16 nt, Mycobacterium tuberculosis H37Rv
ccgcauucgcgacaac

SEQ ID NO: 3246898 - RNA, 13 nt, Mycobacterium tuberculosis H37Rv
ccgcauucggacg

SEQ ID NO: 3246899 - RNA, 15 nt, Mycobacterium tuberculosis H37Rv
ccgcauucggacgcc

SEQ ID NO: 3246900 - RNA, 20 nt, Mycobacterium tuberculosis H37Rv
ccgcauucguggagccggcc

SEQ ID NO: 3246901 - RNA, 19 nt, Mycobacterium tuberculosis H37Rv
ccgcauugaacagcggauc

SEQ ID NO: 3246902 - RNA, 19 nt, Mycobacterium tuberculosis H37Rv
ccgcauugagcuggcgccc

SEQ ID NO: 3246903 - RNA, 18 nt, Mycobacterium tuberculosis H37Rv
ccgcauugcagaaccgcc

SEQ ID NO: 3246904 - RNA, 23 nt, Mycobacterium tuberculosis H37Rv
ccgcauugccaacgcccacguua

SEQ ID NO: 3246905 - RNA, 23 nt, Mycobacterium tuberculosis H37Rv
ccgccaaccccaacaucccggac

SEQ ID NO: 3246906 - RNA, 15 nt, Mycobacterium tuberculosis H37Rv
ccgccaaccgcgugc

SEQ ID NO: 3246907 - RNA, 13 nt, Mycobacterium tuberculosis H37Rv
ccgccaacggcac

SEQ ID NO: 3246908 - RNA, 16 nt, Mycobacterium tuberculosis H37Rv
ccgccaacuccucagc

SEQ ID NO: 3246909 - RNA, 17 nt, Mycobacterium tuberculosis H37Rv
ccgccaacuccucagcc

SEQ ID NO: 3246910 - RNA, 18 nt, Mycobacterium tuberculosis H37Rv
ccgccaacuccucagccg

SEQ ID NO: 3246911 - RNA, 14 nt, Mycobacterium tuberculosis H37Rv
ccgccaaggaggcc

SEQ ID NO: 3246912 - RNA, 22 nt, Mycobacterium tuberculosis H37Rv
ccgccaaguacugggccaaagc

SEQ ID NO: 3246913 - RNA, 15 nt, Mycobacterium tuberculosis H37Rv
ccgccaaugccacca

SEQ ID NO: 3246914 - RNA, 14 nt, Mycobacterium tuberculosis H37Rv
ccgccacaccgccg

SEQ ID NO: 3246915 - RNA, 15 nt, Mycobacterium tuberculosis H37Rv
ccgccacaccgccgc

SEQ ID NO: 3246916 - RNA, 15 nt, Mycobacterium tuberculosis H37Rv
ccgccacacggggcc

SEQ ID NO: 3246917 - RNA, 22 nt, Mycobacterium tuberculosis H37Rv
ccgccacacggggccgccagcu

SEQ ID NO: 3246918 - RNA, 18 nt, Mycobacterium tuberculosis H37Rv
ccgccacagccccagggu

SEQ ID NO: 3246919 - RNA, 15 nt, Mycobacterium tuberculosis H37Rv
ccgccaccaccaggg

SEQ ID NO: 3246920 - RNA, 14 nt, Mycobacterium tuberculosis H37Rv
ccgccaccaccggc

SEQ ID NO: 3246921 - RNA, 17 nt, Mycobacterium tuberculosis H37Rv
ccgccaccacgccgucg

SEQ ID NO: 3246922 - RNA, 22 nt, Mycobacterium tuberculosis H37Rv
ccgccaccacgccgucgacaac

SEQ ID NO: 3246923 - RNA, 22 nt, Mycobacterium tuberculosis H37Rv
ccgccgauaccgccggccccac

SEQ ID NO: 3246924 - RNA, 13 nt, Mycobacterium tuberculosis H37Rv
ccgccgaucaccg

SEQ ID NO: 3246925 - RNA, 12 nt, Mycobacterium tuberculosis H37Rv
ccgccgaucccg

SEQ ID NO: 3246926 - RNA, 18 nt, Mycobacterium tuberculosis H37Rv
ccgccgaucccgucgggc

SEQ ID NO: 3246927 - RNA, 22 nt, Mycobacterium tuberculosis H37Rv
ccgccgaucccgucgggcacac

SEQ ID NO: 3246928 - RNA, 20 nt, Mycobacterium tuberculosis H37Rv
ccgccgauccuagaucgaga

SEQ ID NO: 3246929 - RNA, 18 nt, Mycobacterium tuberculosis H37Rv
ccgccgaucgaaccgcug

SEQ ID NO: 3246930 - RNA, 15 nt, Mycobacterium tuberculosis H37Rv
ccgccgaucgacacc

SEQ ID NO: 3246931 - RNA, 21 nt, Mycobacterium tuberculosis H37Rv
ccgccgaucgacacccgcucg

SEQ ID NO: 3246932 - RNA, 15 nt, Mycobacterium tuberculosis H37Rv
ccgccgaucgggcuu

SEQ ID NO: 3246933 - RNA, 22 nt, Mycobacterium tuberculosis H37Rv
ccgccgaucgggcuucggccag

SEQ ID NO: 3246934 - RNA, 16 nt, Mycobacterium tuberculosis H37Rv
ccgccgaucugcugca

SEQ ID NO: 3246935 - RNA, 12 nt, Mycobacterium tuberculosis H37Rv
ccgccgaugcca

SEQ ID NO: 3246936 - RNA, 16 nt, Mycobacterium tuberculosis H37Rv
ccgccgaugccaccgc

SEQ ID NO: 3246937 - RNA, 18 nt, Mycobacterium tuberculosis H37Rv
ccgccgaugccaccgcuu

SEQ ID NO: 3246938 - RNA, 19 nt, Mycobacterium tuberculosis H37Rv
ccgccgaugccaccgcuug

SEQ ID NO: 3246939 - RNA, 20 nt, Mycobacterium tuberculosis H37Rv
ccgccgaugccaccgcuuga

SEQ ID NO: 3246940 - RNA, 17 nt, Mycobacterium tuberculosis H37Rv
ccgccgaugcccgacac

SEQ ID NO: 3246941 - RNA, 18 nt, Mycobacterium tuberculosis H37Rv
ccgccgaugccgccgccg

SEQ ID NO: 3246942 - RNA, 18 nt, Mycobacterium tuberculosis H37Rv
ccgccgaugccgccggca

SEQ ID NO: 3246943 - RNA, 19 nt, Mycobacterium tuberculosis H37Rv
ccgccgaugccgccggcac

SEQ ID NO: 3246944 - RNA, 21 nt, Mycobacterium tuberculosis H37Rv
ccgccgaugcgauuccgcguc

SEQ ID NO: 3246945 - RNA, 22 nt, Mycobacterium tuberculosis H37Rv
ccgccgauguagacgguggcgc

SEQ ID NO: 3246946 - RNA, 15 nt, Mycobacterium tuberculosis H37Rv
ccgccgcaccgccgc

SEQ ID NO: 3246947 - RNA, 19 nt, Mycobacterium tuberculosis H37Rv
ccgccgcaccggaucaccg

SEQ ID NO: 3246948 - RNA, 20 nt, Mycobacterium tuberculosis H37Rv
ccgccgcaccggaucaccgc

SEQ ID NO: 3246949 - RNA, 21 nt, Mycobacterium tuberculosis H37Rv
ccgccgcacgcuagccgacag

SEQ ID NO: 3246950 - RNA, 21 nt, Mycobacterium tuberculosis H37Rv
ccgccgcagacgccgacuccg

SEQ ID NO: 3246951 - RNA, 13 nt, Mycobacterium tuberculosis H37Rv
ccgccgcagcgca

SEQ ID NO: 3246952 - RNA, 21 nt, Mycobacterium tuberculosis H37Rv
ccgccgcaucguuuucgccga

SEQ ID NO: 3246953 - RNA, 23 nt, Mycobacterium tuberculosis H37Rv
ccgccgccaaugccaccauugcc

SEQ ID NO: 3246954 - RNA, 14 nt, Mycobacterium tuberculosis H37Rv
ccgccgccaccggc

SEQ ID NO: 3246955 - RNA, 16 nt, Mycobacterium tuberculosis H37Rv
ccgccgccaccggcgc

SEQ ID NO: 3246956 - RNA, 21 nt, Mycobacterium tuberculosis H37Rv
ccgccgccauaccucggcgac

SEQ ID NO: 3246957 - RNA, 20 nt, Mycobacterium tuberculosis H37Rv
ccgccgccauuggacagcgc

SEQ ID NO: 3246958 - RNA, 16 nt, Mycobacterium tuberculosis H37Rv
ccgccgccccggcgcu

SEQ ID NO: 3246959 - RNA, 18 nt, Mycobacterium tuberculosis H37Rv
ccgccgccccggcgcugg

SEQ ID NO: 3246960 - RNA, 22 nt, Mycobacterium tuberculosis H37Rv
ccgccgcccugguccaggcccu

SEQ ID NO: 3246961 - RNA, 14 nt, Mycobacterium tuberculosis H37Rv
ccgccgccgacaau

SEQ ID NO: 3246962 - RNA, 15 nt, Mycobacterium tuberculosis H37Rv
ccgccgccgacgaag

SEQ ID NO: 3246963 - RNA, 21 nt, Mycobacterium tuberculosis H37Rv
ccgccgccgaucuugagccgg

SEQ ID NO: 3246964 - RNA, 16 nt, Mycobacterium tuberculosis H37Rv
ccgccgccgccgacgc

SEQ ID NO: 3246965 - RNA, 16 nt, Mycobacterium tuberculosis H37Rv
ccgccgccgccgcgua

SEQ ID NO: 3246966 - RNA, 16 nt, Mycobacterium tuberculosis H37Rv
ccgccgccgccggcgc

SEQ ID NO: 3246967 - RNA, 14 nt, Mycobacterium tuberculosis H37Rv
ccgccgccgcguac

SEQ ID NO: 3246968 - RNA, 22 nt, Mycobacterium tuberculosis H37Rv
ccgccgccggaggucgggcggc

SEQ ID NO: 3246969 - RNA, 16 nt, Mycobacterium tuberculosis H37Rv
ccgccgccggaucgcc

SEQ ID NO: 3246970 - RNA, 12 nt, Mycobacterium tuberculosis H37Rv
ccgccgccggca

SEQ ID NO: 3246971 - RNA, 16 nt, Mycobacterium tuberculosis H37Rv
ccgccgccgucggcga

SEQ ID NO: 3246972 - RNA, 23 nt, Mycobacterium tuberculosis H37Rv
ccgccgccguucccgccggcccc

SEQ ID NO: 3246973 - RNA, 20 nt, Mycobacterium tuberculosis H37Rv
ccgccgccuuuuuucgccgc

SEQ ID NO: 3246974 - RNA, 19 nt, Mycobacterium tuberculosis H37Rv
ccgccgcgaccacgcaccg

SEQ ID NO: 3246975 - RNA, 20 nt, Mycobacterium tuberculosis H37Rv
ccgccgcgaccacgcaccgc

SEQ ID NO: 3246976 - RNA, 22 nt, Mycobacterium tuberculosis H37Rv
ccgccgcgaccacgcaccgccc

SEQ ID NO: 3246977 - RNA, 18 nt, Mycobacterium tuberculosis H37Rv
ccgccgcgaccgccucgc

SEQ ID NO: 3246978 - RNA, 20 nt, Mycobacterium tuberculosis H37Rv
ccgccgcgaccgccucgccg

SEQ ID NO: 3246979 - RNA, 12 nt, Mycobacterium tuberculosis H37Rv
ccgccgcgacgg

SEQ ID NO: 3246980 - RNA, 17 nt, Mycobacterium tuberculosis H37Rv
ccgccgcgagcgccggc

SEQ ID NO: 3246981 - RNA, 13 nt, Mycobacterium tuberculosis H37Rv
ccgccgcgaugac

SEQ ID NO: 3246982 - RNA, 21 nt, Mycobacterium tuberculosis H37Rv
ccgccgcgauggccccuguca

SEQ ID NO: 3246983 - RNA, 15 nt, Mycobacterium tuberculosis H37Rv
ccgccgcgcagccgc

SEQ ID NO: 3246984 - RNA, 14 nt, Mycobacterium tuberculosis H37Rv
ccgccgcgccggca

SEQ ID NO: 3246985 - RNA, 13 nt, Mycobacterium tuberculosis H37Rv
ccgccgcgcgucg

SEQ ID NO: 3246986 - RNA, 13 nt, Mycobacterium tuberculosis H37Rv
ccgccgcgcguuc

SEQ ID NO: 3246987 - RNA, 14 nt, Mycobacterium tuberculosis H37Rv
ccgccgcggccaca

SEQ ID NO: 3246988 - RNA, 18 nt, Mycobacterium tuberculosis H37Rv
ccgccgcggccaccaccg

SEQ ID NO: 3246989 - RNA, 19 nt, Mycobacterium tuberculosis H37Rv
ccgccgcggccaccaccgc

SEQ ID NO: 3246990 - RNA, 22 nt, Mycobacterium tuberculosis H37Rv
ccgccgcggccaccaccgccgc

SEQ ID NO: 3246991 - RNA, 14 nt, Mycobacterium tuberculosis H37Rv
ccgccgcggccgcc

SEQ ID NO: 3246992 - RNA, 17 nt, Mycobacterium tuberculosis H37Rv
ccgccgcggccggcgcu

SEQ ID NO: 3246993 - RNA, 20 nt, Mycobacterium tuberculosis H37Rv
ccgccgcgggacaccaccgc

SEQ ID NO: 3246994 - RNA, 18 nt, Mycobacterium tuberculosis H37Rv
ccgccgcggucagaucca

SEQ ID NO: 3246995 - RNA, 24 nt, Mycobacterium tuberculosis H37Rv
ccgccgcgucauucaccgcguuga

SEQ ID NO: 3246996 - RNA, 13 nt, Mycobacterium tuberculosis H37Rv
ccgccgcgucgag

SEQ ID NO: 3246997 - RNA, 13 nt, Mycobacterium tuberculosis H37Rv
ccgccgcguuucg

SEQ ID NO: 3246998 - RNA, 15 nt, Mycobacterium tuberculosis H37Rv
ccgccgcuaccgccg

SEQ ID NO: 3246999 - RNA, 17 nt, Mycobacterium tuberculosis H37Rv
ccgccgcugccgccgag

SEQ ID NO: 3247000 - RNA, 16 nt, Mycobacterium tuberculosis H37Rv
ccgccgcugccgccgg

SEQ ID NO: 3247001 - RNA, 21 nt, Mycobacterium tuberculosis H37Rv
ccgccgcugccgccggugccg

SEQ ID NO: 3247002 - RNA, 15 nt, Mycobacterium tuberculosis H37Rv
ccgccggacccgccc

SEQ ID NO: 3247003 - RNA, 17 nt, Mycobacterium tuberculosis H37Rv
ccgccggacccgucgag

SEQ ID NO: 3247004 - RNA, 19 nt, Mycobacterium tuberculosis H37Rv
ccgccggacccgucgagca

SEQ ID NO: 3247005 - RNA, 23 nt, Mycobacterium tuberculosis H37Rv
ccgccggacccgucgagcagcau

SEQ ID NO: 3247006 - RNA, 14 nt, Mycobacterium tuberculosis H37Rv
ccgccggaguuggu

SEQ ID NO: 3247007 - RNA, 19 nt, Mycobacterium tuberculosis H37Rv
ccgccggauagcaccggca

SEQ ID NO: 3247008 - RNA, 21 nt, Mycobacterium tuberculosis H37Rv
ccgccggcaauaccgccagcg

SEQ ID NO: 3247009 - RNA, 23 nt, Mycobacterium tuberculosis H37Rv
ccgccggcaauaccgccagcgcc

SEQ ID NO: 3247010 - RNA, 15 nt, Mycobacterium tuberculosis H37Rv
ccgccggcaccaccg

SEQ ID NO: 3247011 - RNA, 15 nt, Mycobacterium tuberculosis H37Rv
ccgccggcaccgccg

SEQ ID NO: 3247012 - RNA, 19 nt, Mycobacterium tuberculosis H37Rv
ccgccggcaccgccgcccc

SEQ ID NO: 3247013 - RNA, 16 nt, Mycobacterium tuberculosis H37Rv
ccgccggcaccgccgg

SEQ ID NO: 3247014 - RNA, 23 nt, Mycobacterium tuberculosis H37Rv
ccgccggcaccgccggcaccgcc

SEQ ID NO: 3247015 - RNA, 14 nt, Mycobacterium tuberculosis H37Rv
ccgccggcaccggg

SEQ ID NO: 3247016 - RNA, 13 nt, Mycobacterium tuberculosis H37Rv
ccgccggcaccgu

SEQ ID NO: 3247017 - RNA, 14 nt, Mycobacterium tuberculosis H37Rv
ccgccggcaccucc

SEQ ID NO: 3247018 - RNA, 16 nt, Mycobacterium tuberculosis H37Rv
ccgccggcaccucccu

SEQ ID NO: 3247019 - RNA, 23 nt, Mycobacterium tuberculosis H37Rv
ccgccgugcugcggcgacgguga

SEQ ID NO: 3247020 - RNA, 19 nt, Mycobacterium tuberculosis H37Rv
ccgccguggcgucggcguc

SEQ ID NO: 3247021 - RNA, 15 nt, Mycobacterium tuberculosis H37Rv
ccgccguuaccgccg

SEQ ID NO: 3247022 - RNA, 16 nt, Mycobacterium tuberculosis H37Rv
ccgccguuaccgccgg

SEQ ID NO: 3247023 - RNA, 20 nt, Mycobacterium tuberculosis H37Rv
ccgccguuaccgccguugcc

SEQ ID NO: 3247024 - RNA, 21 nt, Mycobacterium tuberculosis H37Rv
ccgccguucccaccaccaccg

SEQ ID NO: 3247025 - RNA, 22 nt, Mycobacterium tuberculosis H37Rv
ccgccguucccaccaccaccgc

SEQ ID NO: 3247026 - RNA, 16 nt, Mycobacterium tuberculosis H37Rv
ccgccguucgggaugc

SEQ ID NO: 3247027 - RNA, 21 nt, Mycobacterium tuberculosis H37Rv
ccgccguucgggaugcaagga

SEQ ID NO: 3247028 - RNA, 16 nt, Mycobacterium tuberculosis H37Rv
ccgccguugccaccgu

SEQ ID NO: 3247029 - RNA, 20 nt, Mycobacterium tuberculosis H37Rv
ccgccguugccaccguagcc

SEQ ID NO: 3247030 - RNA, 14 nt, Mycobacterium tuberculosis H37Rv
ccgccguugccgau

SEQ ID NO: 3247031 - RNA, 15 nt, Mycobacterium tuberculosis H37Rv
ccgccguugccgauc

SEQ ID NO: 3247032 - RNA, 16 nt, Mycobacterium tuberculosis H37Rv
ccgccguugccgauca

SEQ ID NO: 3247033 - RNA, 18 nt, Mycobacterium tuberculosis H37Rv
ccgccguugccgaucagc

SEQ ID NO: 3247034 - RNA, 21 nt, Mycobacterium tuberculosis H37Rv
ccgccguugccgaucaguccg

SEQ ID NO: 3247035 - RNA, 13 nt, Mycobacterium tuberculosis H37Rv
ccgccguugccgc

SEQ ID NO: 3247036 - RNA, 18 nt, Mycobacterium tuberculosis H37Rv
ccgccguugccgccgaag

SEQ ID NO: 3247037 - RNA, 19 nt, Mycobacterium tuberculosis H37Rv
ccgccguugccgccgacgc

SEQ ID NO: 3247038 - RNA, 21 nt, Mycobacterium tuberculosis H37Rv
ccgccguugccgccgccuccg

SEQ ID NO: 3247039 - RNA, 16 nt, Mycobacterium tuberculosis H37Rv
ccgccguugccgccgg

SEQ ID NO: 3247040 - RNA, 17 nt, Mycobacterium tuberculosis H37Rv
ccgccguugccgccggc

SEQ ID NO: 3247041 - RNA, 19 nt, Mycobacterium tuberculosis H37Rv
ccgccguugccgccggcgc

SEQ ID NO: 3247042 - RNA, 21 nt, Mycobacterium tuberculosis H37Rv
ccgccguugccgccggcgccg

SEQ ID NO: 3247043 - RNA, 18 nt, Mycobacterium tuberculosis H37Rv
ccgccguugccgccggug

SEQ ID NO: 3247044 - RNA, 19 nt, Mycobacterium tuberculosis H37Rv
ccgccguugccgccgucac

SEQ ID NO: 3247045 - RNA, 18 nt, Mycobacterium tuberculosis H37Rv
ccgccguugccgccgucg

SEQ ID NO: 3247046 - RNA, 21 nt, Mycobacterium tuberculosis H37Rv
ccgccguugccgccguuaccg

SEQ ID NO: 3247047 - RNA, 20 nt, Mycobacterium tuberculosis H37Rv
ccgccguugccgccguugcc

SEQ ID NO: 3247048 - RNA, 22 nt, Mycobacterium tuberculosis H37Rv
ccgccguugccguuggugccgc

SEQ ID NO: 3247049 - RNA, 16 nt, Mycobacterium tuberculosis H37Rv
ccgccguugggccgcg

SEQ ID NO: 3247050 - RNA, 16 nt, Mycobacterium tuberculosis H37Rv
ccgccguuuccgccgc

SEQ ID NO: 3247051 - RNA, 20 nt, Mycobacterium tuberculosis H37Rv
ccgccguuugcgccguugcc

SEQ ID NO: 3247052 - RNA, 16 nt, Mycobacterium tuberculosis H37Rv
ccgccuaaucggccug

SEQ ID NO: 3247053 - RNA, 21 nt, Mycobacterium tuberculosis H37Rv
ccgccuaaucggccugccggc

SEQ ID NO: 3247054 - RNA, 18 nt, Mycobacterium tuberculosis H37Rv
ccgccuacccguucuucg

SEQ ID NO: 3247055 - RNA, 21 nt, Mycobacterium tuberculosis H37Rv
ccgccuacccguucuucgcga

SEQ ID NO: 3247056 - RNA, 20 nt, Mycobacterium tuberculosis H37Rv
ccgccuaggugaguaagccc

SEQ ID NO: 3247057 - RNA, 14 nt, Mycobacterium tuberculosis H37Rv
ccgccuccgccgag

SEQ ID NO: 3247058 - RNA, 13 nt, Mycobacterium tuberculosis H37Rv
ccgccuccgccug

SEQ ID NO: 3247059 - RNA, 23 nt, Mycobacterium tuberculosis H37Rv
ccgccuccgccugccccacccgc

SEQ ID NO: 3247060 - RNA, 12 nt, Mycobacterium tuberculosis H37Rv
ccgccuccucga

SEQ ID NO: 3247061 - RNA, 21 nt, Mycobacterium tuberculosis H37Rv
ccgccuccucgauagcggcgc

SEQ ID NO: 3247062 - RNA, 18 nt, Mycobacterium tuberculosis H37Rv
ccgccucgaccgccagcc

SEQ ID NO: 3247063 - RNA, 14 nt, Mycobacterium tuberculosis H37Rv
ccgccucgccguag

SEQ ID NO: 3247064 - RNA, 18 nt, Mycobacterium tuberculosis H37Rv
ccgccucgggcaccuggu

SEQ ID NO: 3247065 - RNA, 20 nt, Mycobacterium tuberculosis H37Rv
ccgccucguacggaccgucg

SEQ ID NO: 3247066 - RNA, 21 nt, Mycobacterium tuberculosis H37Rv
ccgccucguacggaccgucgc

SEQ ID NO: 3247067 - RNA, 13 nt, Mycobacterium tuberculosis H37Rv
ccgccugacccgg

SEQ ID NO: 3247068 - RNA, 23 nt, Mycobacterium tuberculosis H37Rv
ccgccugcaacacgcgaugcacg

SEQ ID NO: 3247069 - RNA, 22 nt, Mycobacterium tuberculosis H37Rv
ccgccugccccacccgcggcgc

SEQ ID NO: 3247070 - RNA, 15 nt, Mycobacterium tuberculosis H37Rv
ccgccugcccggccc

SEQ ID NO: 3247071 - RNA, 16 nt, Mycobacterium tuberculosis H37Rv
ccgccugcccggcccg

SEQ ID NO: 3247072 - RNA, 15 nt, Mycobacterium tuberculosis H37Rv
ccgccugcgccgccc

SEQ ID NO: 3247073 - RNA, 16 nt, Mycobacterium tuberculosis H37Rv
ccgccugcgcggcugc

SEQ ID NO: 3247074 - RNA, 21 nt, Mycobacterium tuberculosis H37Rv
ccgccuggaaggaaccgaucg

SEQ ID NO: 3247075 - RNA, 15 nt, Mycobacterium tuberculosis H37Rv
ccgccuggacgccgc

SEQ ID NO: 3247076 - RNA, 19 nt, Mycobacterium tuberculosis H37Rv
ccgccuggacgccgccgga

SEQ ID NO: 3247077 - RNA, 17 nt, Mycobacterium tuberculosis H37Rv
ccgccugugccgccggc

SEQ ID NO: 3247078 - RNA, 19 nt, Mycobacterium tuberculosis H37Rv
ccgccugugccgccggcgc

SEQ ID NO: 3247079 - RNA, 16 nt, Mycobacterium tuberculosis H37Rv
ccgccuuacgcaccga

SEQ ID NO: 3247080 - RNA, 20 nt, Mycobacterium tuberculosis H37Rv
ccgccuuacgcaccgaugcc

SEQ ID NO: 3247081 - RNA, 17 nt, Mycobacterium tuberculosis H37Rv
ccgccuuccuggcgggc

SEQ ID NO: 3247082 - RNA, 14 nt, Mycobacterium tuberculosis H37Rv
ccgccuucucccgc

SEQ ID NO: 3247083 - RNA, 15 nt, Mycobacterium tuberculosis H37Rv
ccgccuucuccggcg

SEQ ID NO: 3247084 - RNA, 13 nt, Mycobacterium tuberculosis H37Rv
ccgccuucuuggc

SEQ ID NO: 3247085 - RNA, 21 nt, Mycobacterium tuberculosis H37Rv
ccgccuucuuggcggccuuug

SEQ ID NO: 3247086 - RNA, 14 nt, Mycobacterium tuberculosis H37Rv
ccgccuugaggccc

SEQ ID NO: 3247087 - RNA, 20 nt, Mycobacterium tuberculosis H37Rv
ccgccuugaggcccugcggc

SEQ ID NO: 3247088 - RNA, 15 nt, Mycobacterium tuberculosis H37Rv
ccgccuuggccacca

SEQ ID NO: 3247089 - RNA, 13 nt, Mycobacterium tuberculosis H37Rv
ccgccuuggcccc

SEQ ID NO: 3247090 - RNA, 21 nt, Mycobacterium tuberculosis H37Rv
ccgccuuggcuucgacgcuuc

SEQ ID NO: 3247091 - RNA, 23 nt, Mycobacterium tuberculosis H37Rv
ccgccuuggucaccuucuuggcg

SEQ ID NO: 3247092 - RNA, 15 nt, Mycobacterium tuberculosis H37Rv
ccgccuuugccgccg

SEQ ID NO: 3247093 - RNA, 17 nt, Mycobacterium tuberculosis H37Rv
ccgccuuugccgccggc

SEQ ID NO: 3247094 - RNA, 18 nt, Mycobacterium tuberculosis H37Rv
ccgccuuugccgccggca

SEQ ID NO: 3247095 - RNA, 18 nt, Mycobacterium tuberculosis H37Rv
ccgcgaaauagcgagcgu

SEQ ID NO: 3247096 - RNA, 20 nt, Mycobacterium tuberculosis H37Rv
ccgcgaaauuacuucggcca

SEQ ID NO: 3247097 - RNA, 16 nt, Mycobacterium tuberculosis H37Rv
ccgcgaaccgcggauc

SEQ ID NO: 3247098 - RNA, 17 nt, Mycobacterium tuberculosis H37Rv
ccgcgaacgauuucggc

SEQ ID NO: 3247099 - RNA, 15 nt, Mycobacterium tuberculosis H37Rv
ccgcgaagccgaccg

SEQ ID NO: 3247100 - RNA, 20 nt, Mycobacterium tuberculosis H37Rv
ccgcgaauacgaggacgacg

SEQ ID NO: 3247101 - RNA, 21 nt, Mycobacterium tuberculosis H37Rv
ccgcgaaucaacaggaccggg

SEQ ID NO: 3247102 - RNA, 18 nt, Mycobacterium tuberculosis H37Rv
ccgcgaaugugaucaccc

SEQ ID NO: 3247103 - RNA, 16 nt, Mycobacterium tuberculosis H37Rv
ccgcgaauucccagga

SEQ ID NO: 3247104 - RNA, 14 nt, Mycobacterium tuberculosis H37Rv
ccgcgacagcggcg

SEQ ID NO: 3247105 - RNA, 17 nt, Mycobacterium tuberculosis H37Rv
ccgcgacagcggcgucg

SEQ ID NO: 3247106 - RNA, 20 nt, Mycobacterium tuberculosis H37Rv
ccgcgacauccgcggcaugc

SEQ ID NO: 3247107 - RNA, 20 nt, Mycobacterium tuberculosis H37Rv
ccgcgaccacgcaccgcccc

SEQ ID NO: 3247108 - RNA, 16 nt, Mycobacterium tuberculosis H37Rv
ccgcgaccagcgccgc

SEQ ID NO: 3247109 - RNA, 18 nt, Mycobacterium tuberculosis H37Rv
ccgcgaccagcgccgcac

SEQ ID NO: 3247110 - RNA, 13 nt, Mycobacterium tuberculosis H37Rv
ccgcgaccauggu

SEQ ID NO: 3247111 - RNA, 21 nt, Mycobacterium tuberculosis H37Rv
ccgcgacccggcccagcgccc

SEQ ID NO: 3247112 - RNA, 13 nt, Mycobacterium tuberculosis H37Rv
ccgcgaccgcauu

SEQ ID NO: 3247113 - RNA, 19 nt, Mycobacterium tuberculosis H37Rv
ccgcgaccggcguaaccgg

SEQ ID NO: 3247114 - RNA, 12 nt, Mycobacterium tuberculosis H37Rv
ccgcgaccucgc

SEQ ID NO: 3247115 - RNA, 21 nt, Mycobacterium tuberculosis H37Rv
ccgcgcgaccaugagcuuggu

SEQ ID NO: 3247116 - RNA, 16 nt, Mycobacterium tuberculosis H37Rv
ccgcgcgagauccuuc

SEQ ID NO: 3247117 - RNA, 22 nt, Mycobacterium tuberculosis H37Rv
ccgcgcgaugcuggcgaacucg

SEQ ID NO: 3247118 - RNA, 18 nt, Mycobacterium tuberculosis H37Rv
ccgcgcgcaagucgaugu

SEQ ID NO: 3247119 - RNA, 11 nt, Mycobacterium tuberculosis H37Rv
ccgcgcgcaga

SEQ ID NO: 3247120 - RNA, 19 nt, Mycobacterium tuberculosis H37Rv
ccgcgcgcauuuuucgcca

SEQ ID NO: 3247121 - RNA, 15 nt, Mycobacterium tuberculosis H37Rv
ccgcgcgccggccau

SEQ ID NO: 3247122 - RNA, 14 nt, Mycobacterium tuberculosis H37Rv
ccgcgcgccggcga

SEQ ID NO: 3247123 - RNA, 19 nt, Mycobacterium tuberculosis H37Rv
ccgcgcgccggcgacccgg

SEQ ID NO: 3247124 - RNA, 15 nt, Mycobacterium tuberculosis H37Rv
ccgcgcgccggcggu

SEQ ID NO: 3247125 - RNA, 16 nt, Mycobacterium tuberculosis H37Rv
ccgcgcgcggacagca

SEQ ID NO: 3247126 - RNA, 18 nt, Mycobacterium tuberculosis H37Rv
ccgcgcgcggacagcauc

SEQ ID NO: 3247127 - RNA, 16 nt, Mycobacterium tuberculosis H37Rv
ccgcgcggacacucgc

SEQ ID NO: 3247128 - RNA, 12 nt, Mycobacterium tuberculosis H37Rv
ccgcgcggcagg

SEQ ID NO: 3247129 - RNA, 13 nt, Mycobacterium tuberculosis H37Rv
ccgcgcggcgauc

SEQ ID NO: 3247130 - RNA, 14 nt, Mycobacterium tuberculosis H37Rv
ccgcgcggcgcagc

SEQ ID NO: 3247131 - RNA, 23 nt, Mycobacterium tuberculosis H37Rv
ccgcgcggcggugucacgaccca

SEQ ID NO: 3247132 - RNA, 20 nt, Mycobacterium tuberculosis H37Rv
ccgcgcgggaaacguuccag

SEQ ID NO: 3247133 - RNA, 18 nt, Mycobacterium tuberculosis H37Rv
ccgcgcgggucacgaccu

SEQ ID NO: 3247134 - RNA, 19 nt, Mycobacterium tuberculosis H37Rv
ccgcgcgguacugcgcagc

SEQ ID NO: 3247135 - RNA, 20 nt, Mycobacterium tuberculosis H37Rv
ccgcgcgguacugcgcagcg

SEQ ID NO: 3247136 - RNA, 23 nt, Mycobacterium tuberculosis H37Rv
ccgcgcggugauggucaccgucu

SEQ ID NO: 3247137 - RNA, 20 nt, Mycobacterium tuberculosis H37Rv
ccgcgcggugcccugccggc

SEQ ID NO: 3247138 - RNA, 22 nt, Mycobacterium tuberculosis H37Rv
ccgcgcggugcccugccggcag

SEQ ID NO: 3247139 - RNA, 18 nt, Mycobacterium tuberculosis H37Rv
ccgcgcguccgucggcga

SEQ ID NO: 3247140 - RNA, 11 nt, Mycobacterium tuberculosis H37Rv
ccgcgcgucgc

SEQ ID NO: 3247141 - RNA, 15 nt, Mycobacterium tuberculosis H37Rv
ccgcgcguucggcgc

SEQ ID NO: 3247142 - RNA, 16 nt, Mycobacterium tuberculosis H37Rv
ccgcgcguucggcgcu

SEQ ID NO: 3247143 - RNA, 20 nt, Mycobacterium tuberculosis H37Rv
ccgcgcucaccggggccguc

SEQ ID NO: 3247144 - RNA, 15 nt, Mycobacterium tuberculosis H37Rv
ccgcgcucagcuccg

SEQ ID NO: 3247145 - RNA, 17 nt, Mycobacterium tuberculosis H37Rv
ccgcgcucccggcgucu

SEQ ID NO: 3247146 - RNA, 15 nt, Mycobacterium tuberculosis H37Rv
ccgcgcucgcacccg

SEQ ID NO: 3247147 - RNA, 18 nt, Mycobacterium tuberculosis H37Rv
ccgcgcucgcacccgcuc

SEQ ID NO: 3247148 - RNA, 14 nt, Mycobacterium tuberculosis H37Rv
ccgcgcucucgguc

SEQ ID NO: 3247149 - RNA, 15 nt, Mycobacterium tuberculosis H37Rv
ccgcgcucucgguca

SEQ ID NO: 3247150 - RNA, 14 nt, Mycobacterium tuberculosis H37Rv
ccgcgcugagcacg

SEQ ID NO: 3247151 - RNA, 14 nt, Mycobacterium tuberculosis H37Rv
ccgcgcugcugacc

SEQ ID NO: 3247152 - RNA, 18 nt, Mycobacterium tuberculosis H37Rv
ccgcgcuggugauucgca

SEQ ID NO: 3247153 - RNA, 21 nt, Mycobacterium tuberculosis H37Rv
ccgcgcuggugauucgcagcc

SEQ ID NO: 3247154 - RNA, 18 nt, Mycobacterium tuberculosis H37Rv
ccgcgcuucacagccacc

SEQ ID NO: 3247155 - RNA, 19 nt, Mycobacterium tuberculosis H37Rv
ccgcgcuugcgaucggcac

SEQ ID NO: 3247156 - RNA, 15 nt, Mycobacterium tuberculosis H37Rv
ccgcggaaggccagc

SEQ ID NO: 3247157 - RNA, 16 nt, Mycobacterium tuberculosis H37Rv
ccgcggacccgcagcu

SEQ ID NO: 3247158 - RNA, 23 nt, Mycobacterium tuberculosis H37Rv
ccgcggacggcgaacuuggccga

SEQ ID NO: 3247159 - RNA, 19 nt, Mycobacterium tuberculosis H37Rv
ccgcggacguggucggagc

SEQ ID NO: 3247160 - RNA, 19 nt, Mycobacterium tuberculosis H37Rv
ccgcggacucgggcaggcc

SEQ ID NO: 3247161 - RNA, 23 nt, Mycobacterium tuberculosis H37Rv
ccgcggacucgggcaggccccac

SEQ ID NO: 3247162 - RNA, 17 nt, Mycobacterium tuberculosis H37Rv
ccgcggacuuggcgguc

SEQ ID NO: 3247163 - RNA, 19 nt, Mycobacterium tuberculosis H37Rv
ccgcggacuuggcggucgg

SEQ ID NO: 3247164 - RNA, 12 nt, Mycobacterium tuberculosis H37Rv
ccgcggagcgca

SEQ ID NO: 3247165 - RNA, 13 nt, Mycobacterium tuberculosis H37Rv
ccgcggagcgcau

SEQ ID NO: 3247166 - RNA, 23 nt, Mycobacterium tuberculosis H37Rv
ccgcggagcucaaccaccucgcc

SEQ ID NO: 3247167 - RNA, 21 nt, Mycobacterium tuberculosis H37Rv
ccgcggaggcggccagccuac

SEQ ID NO: 3247168 - RNA, 23 nt, Mycobacterium tuberculosis H37Rv
ccgcggaggcggccagccuaccg

SEQ ID NO: 3247169 - RNA, 22 nt, Mycobacterium tuberculosis H37Rv
ccgcggaguaggccgcgcccga

SEQ ID NO: 3247170 - RNA, 23 nt, Mycobacterium tuberculosis H37Rv
ccgcggauaggccgcgcggcggc

SEQ ID NO: 3247171 - RNA, 13 nt, Mycobacterium tuberculosis H37Rv
ccgcggaucacca

SEQ ID NO: 3247172 - RNA, 21 nt, Mycobacterium tuberculosis H37Rv
ccgcggaucaccaucgccgcc

SEQ ID NO: 3247173 - RNA, 13 nt, Mycobacterium tuberculosis H37Rv
ccgcggaucgacc

SEQ ID NO: 3247174 - RNA, 21 nt, Mycobacterium tuberculosis H37Rv
ccgcggaugcucaggucaccg

SEQ ID NO: 3247175 - RNA, 17 nt, Mycobacterium tuberculosis H37Rv
ccgcggcaacaccaccu

SEQ ID NO: 3247176 - RNA, 15 nt, Mycobacterium tuberculosis H37Rv
ccgcggcaccgcccc

SEQ ID NO: 3247177 - RNA, 16 nt, Mycobacterium tuberculosis H37Rv
ccgcggcaccgccccg

SEQ ID NO: 3247178 - RNA, 17 nt, Mycobacterium tuberculosis H37Rv
ccgcggcacgcuccagc

SEQ ID NO: 3247179 - RNA, 22 nt, Mycobacterium tuberculosis H37Rv
ccgcggcagcggauacauuucg

SEQ ID NO: 3247180 - RNA, 12 nt, Mycobacterium tuberculosis H37Rv
ccgcggcagggc

SEQ ID NO: 3247181 - RNA, 12 nt, Mycobacterium tuberculosis H37Rv
ccgcggccacca

SEQ ID NO: 3247182 - RNA, 15 nt, Mycobacterium tuberculosis H37Rv
ccgcggccaccaccg

SEQ ID NO: 3247183 - RNA, 12 nt, Mycobacterium tuberculosis H37Rv
ccgcggccaccg

SEQ ID NO: 3247184 - RNA, 16 nt, Mycobacterium tuberculosis H37Rv
ccgcggccaccgccgc

SEQ ID NO: 3247185 - RNA, 16 nt, Mycobacterium tuberculosis H37Rv
ccgcggccaccgccug

SEQ ID NO: 3247186 - RNA, 14 nt, Mycobacterium tuberculosis H37Rv
ccgcggccagcggg

SEQ ID NO: 3247187 - RNA, 14 nt, Mycobacterium tuberculosis H37Rv
ccgcggccccgacu

SEQ ID NO: 3247188 - RNA, 13 nt, Mycobacterium tuberculosis H37Rv
ccgcggccccgcc

SEQ ID NO: 3247189 - RNA, 15 nt, Mycobacterium tuberculosis H37Rv
ccgcggcccgcgugc

SEQ ID NO: 3247190 - RNA, 22 nt, Mycobacterium tuberculosis H37Rv
ccgcggcccgcuccacggucag

SEQ ID NO: 3247191 - RNA, 23 nt, Mycobacterium tuberculosis H37Rv
ccgcggcccgcucgaucggcagc

SEQ ID NO: 3247192 - RNA, 18 nt, Mycobacterium tuberculosis H37Rv
ccgcggcccggacgucgg

SEQ ID NO: 3247193 - RNA, 17 nt, Mycobacterium tuberculosis H37Rv
ccgcggcccucgccuuc

SEQ ID NO: 3247194 - RNA, 13 nt, Mycobacterium tuberculosis H37Rv
ccgcggccggcgc

SEQ ID NO: 3247195 - RNA, 20 nt, Mycobacterium tuberculosis H37Rv
ccgcggccggguggcccggc

SEQ ID NO: 3247196 - RNA, 16 nt, Mycobacterium tuberculosis H37Rv
ccgcggccuuggcggc

SEQ ID NO: 3247197 - RNA, 23 nt, Mycobacterium tuberculosis H37Rv
ccgcggccuuggcggccgcgacc

SEQ ID NO: 3247198 - RNA, 21 nt, Mycobacterium tuberculosis H37Rv
ccgcggcgaaccagcgcgucu

SEQ ID NO: 3247199 - RNA, 21 nt, Mycobacterium tuberculosis H37Rv
ccgcggcgacgucucgcaugc

SEQ ID NO: 3247200 - RNA, 15 nt, Mycobacterium tuberculosis H37Rv
ccgcggcgaucacca

SEQ ID NO: 3247201 - RNA, 14 nt, Mycobacterium tuberculosis H37Rv
ccgcggcgauuacg

SEQ ID NO: 3247202 - RNA, 14 nt, Mycobacterium tuberculosis H37Rv
ccgcggcgcagcac

SEQ ID NO: 3247203 - RNA, 12 nt, Mycobacterium tuberculosis H37Rv
ccgcggcgccac

SEQ ID NO: 3247204 - RNA, 15 nt, Mycobacterium tuberculosis H37Rv
ccgcggcgccacccg

SEQ ID NO: 3247205 - RNA, 16 nt, Mycobacterium tuberculosis H37Rv
ccgcggcgccacccgc

SEQ ID NO: 3247206 - RNA, 18 nt, Mycobacterium tuberculosis H37Rv
ccgcggcgccacccgcgc

SEQ ID NO: 3247207 - RNA, 19 nt, Mycobacterium tuberculosis H37Rv
ccgcggcgccacccgcgcc

SEQ ID NO: 3247208 - RNA, 13 nt, Mycobacterium tuberculosis H37Rv
ccgcggcgccgcc

SEQ ID NO: 3247209 - RNA, 18 nt, Mycobacterium tuberculosis H37Rv
ccgcggcgccggugggcg

SEQ ID NO: 3247210 - RNA, 20 nt, Mycobacterium tuberculosis H37Rv
ccgcggcgccguugccgccg

SEQ ID NO: 3247211 - RNA, 23 nt, Mycobacterium tuberculosis H37Rv
ccgcuaacgcaccugcgcgcggc

SEQ ID NO: 3247212 - RNA, 19 nt, Mycobacterium tuberculosis H37Rv
ccgcuaccaacgcaacacg

SEQ ID NO: 3247213 - RNA, 13 nt, Mycobacterium tuberculosis H37Rv
ccgcuaccccagc

SEQ ID NO: 3247214 - RNA, 20 nt, Mycobacterium tuberculosis H37Rv
ccgcuaccccagccggcagc

SEQ ID NO: 3247215 - RNA, 17 nt, Mycobacterium tuberculosis H37Rv
ccgcuaccgcccgcgcc

SEQ ID NO: 3247216 - RNA, 18 nt, Mycobacterium tuberculosis H37Rv
ccgcuaccgcccgcgcca

SEQ ID NO: 3247217 - RNA, 19 nt, Mycobacterium tuberculosis H37Rv
ccgcuaccgcccgcgccac

SEQ ID NO: 3247218 - RNA, 13 nt, Mycobacterium tuberculosis H37Rv
ccgcuacgcgcgc

SEQ ID NO: 3247219 - RNA, 20 nt, Mycobacterium tuberculosis H37Rv
ccgcuacguuacgccgagau

SEQ ID NO: 3247220 - RNA, 22 nt, Mycobacterium tuberculosis H37Rv
ccgcuagaacagacggggucgc

SEQ ID NO: 3247221 - RNA, 15 nt, Mycobacterium tuberculosis H37Rv
ccgcuaggacggcgc

SEQ ID NO: 3247222 - RNA, 20 nt, Mycobacterium tuberculosis H37Rv
ccgcuaggugacgccgccag

SEQ ID NO: 3247223 - RNA, 21 nt, Mycobacterium tuberculosis H37Rv
ccgcuaggugacgccgccagc

SEQ ID NO: 3247224 - RNA, 20 nt, Mycobacterium tuberculosis H37Rv
ccgcuaucgaggaggcgguc

SEQ ID NO: 3247225 - RNA, 15 nt, Mycobacterium tuberculosis H37Rv
ccgcuaugaggcagu

SEQ ID NO: 3247226 - RNA, 23 nt, Mycobacterium tuberculosis H37Rv
ccgcuaugaugccgccggugccg

SEQ ID NO: 3247227 - RNA, 13 nt, Mycobacterium tuberculosis H37Rv
ccgcuauucggcg

SEQ ID NO: 3247228 - RNA, 16 nt, Mycobacterium tuberculosis H37Rv
ccgcuauucggcggca

SEQ ID NO: 3247229 - RNA, 21 nt, Mycobacterium tuberculosis H37Rv
ccgcucacauacagcaggccg

SEQ ID NO: 3247230 - RNA, 20 nt, Mycobacterium tuberculosis H37Rv
ccgcucaccccgcgcuccuc

SEQ ID NO: 3247231 - RNA, 16 nt, Mycobacterium tuberculosis H37Rv
ccgcucacccgcccgg

SEQ ID NO: 3247232 - RNA, 19 nt, Mycobacterium tuberculosis H37Rv
ccgcucacccgcccggaac

SEQ ID NO: 3247233 - RNA, 18 nt, Mycobacterium tuberculosis H37Rv
ccgcucacgcucacccgg

SEQ ID NO: 3247234 - RNA, 15 nt, Mycobacterium tuberculosis H37Rv
ccgcucagcgcagca

SEQ ID NO: 3247235 - RNA, 17 nt, Mycobacterium tuberculosis H37Rv
ccgcucagggugcgccg

SEQ ID NO: 3247236 - RNA, 19 nt, Mycobacterium tuberculosis H37Rv
ccgcucagggugcgccgca

SEQ ID NO: 3247237 - RNA, 17 nt, Mycobacterium tuberculosis H37Rv
ccgcucauccagcgcgu

SEQ ID NO: 3247238 - RNA, 22 nt, Mycobacterium tuberculosis H37Rv
ccgcuccaaaagccucagccgc

SEQ ID NO: 3247239 - RNA, 22 nt, Mycobacterium tuberculosis H37Rv
ccgcucccaugaucgccgaccu

SEQ ID NO: 3247240 - RNA, 12 nt, Mycobacterium tuberculosis H37Rv
ccgcucccccgc

SEQ ID NO: 3247241 - RNA, 18 nt, Mycobacterium tuberculosis H37Rv
ccgcucgaccagacgcug

SEQ ID NO: 3247242 - RNA, 16 nt, Mycobacterium tuberculosis H37Rv
ccgcucgacggcccgc

SEQ ID NO: 3247243 - RNA, 22 nt, Mycobacterium tuberculosis H37Rv
ccgcucgacggcccgccguccg

SEQ ID NO: 3247244 - RNA, 21 nt, Mycobacterium tuberculosis H37Rv
ccgcucgagcuacgacgagug

SEQ ID NO: 3247245 - RNA, 19 nt, Mycobacterium tuberculosis H37Rv
ccgcucgaucggcagccag

SEQ ID NO: 3247246 - RNA, 11 nt, Mycobacterium tuberculosis H37Rv
ccgcucgaugu

SEQ ID NO: 3247247 - RNA, 15 nt, Mycobacterium tuberculosis H37Rv
ccgcucgcaggccgg

SEQ ID NO: 3247248 - RNA, 16 nt, Mycobacterium tuberculosis H37Rv
ccgcucgcaggccggc

SEQ ID NO: 3247249 - RNA, 18 nt, Mycobacterium tuberculosis H37Rv
ccgcucgcaggccggcgg

SEQ ID NO: 3247250 - RNA, 15 nt, Mycobacterium tuberculosis H37Rv
ccgcucgcugaaccg

SEQ ID NO: 3247251 - RNA, 18 nt, Mycobacterium tuberculosis H37Rv
ccgcucggcaaccugcga

SEQ ID NO: 3247252 - RNA, 14 nt, Mycobacterium tuberculosis H37Rv
ccgcucggccgcag

SEQ ID NO: 3247253 - RNA, 14 nt, Mycobacterium tuberculosis H37Rv
ccgcucggccgccg

SEQ ID NO: 3247254 - RNA, 15 nt, Mycobacterium tuberculosis H37Rv
ccgcucggccgucag

SEQ ID NO: 3247255 - RNA, 23 nt, Mycobacterium tuberculosis H37Rv
ccgcucggcgcgcggguugucgg

SEQ ID NO: 3247256 - RNA, 15 nt, Mycobacterium tuberculosis H37Rv
ccgcucggcggucgg

SEQ ID NO: 3247257 - RNA, 23 nt, Mycobacterium tuberculosis H37Rv
ccgcucgggcaacgccucgagca

SEQ ID NO: 3247258 - RNA, 22 nt, Mycobacterium tuberculosis H37Rv
ccgcucgggguugcucgcgauc

SEQ ID NO: 3247259 - RNA, 23 nt, Mycobacterium tuberculosis H37Rv
ccgcucgggguugcucgcgaucg

SEQ ID NO: 3247260 - RNA, 18 nt, Mycobacterium tuberculosis H37Rv
ccgcucgguccagccggu

SEQ ID NO: 3247261 - RNA, 19 nt, Mycobacterium tuberculosis H37Rv
ccgcucgucgccgguggca

SEQ ID NO: 3247262 - RNA, 16 nt, Mycobacterium tuberculosis H37Rv
ccgcucgucguccggc

SEQ ID NO: 3247263 - RNA, 21 nt, Mycobacterium tuberculosis H37Rv
ccgcucguuacgccgagcaca

SEQ ID NO: 3247264 - RNA, 18 nt, Mycobacterium tuberculosis H37Rv
ccgcucucggcgauuuug

SEQ ID NO: 3247265 - RNA, 12 nt, Mycobacterium tuberculosis H37Rv
ccgcucugcggc

SEQ ID NO: 3247266 - RNA, 20 nt, Mycobacterium tuberculosis H37Rv
ccgcucuucgacaucugagc

SEQ ID NO: 3247267 - RNA, 12 nt, Mycobacterium tuberculosis H37Rv
ccgcugaccgca

SEQ ID NO: 3247268 - RNA, 19 nt, Mycobacterium tuberculosis H37Rv
ccgcugaccgcaacgcgua

SEQ ID NO: 3247269 - RNA, 21 nt, Mycobacterium tuberculosis H37Rv
ccgcugacgaagcacaguucg

SEQ ID NO: 3247270 - RNA, 21 nt, Mycobacterium tuberculosis H37Rv
ccgcugacuccugcggcaccg

SEQ ID NO: 3247271 - RNA, 18 nt, Mycobacterium tuberculosis H37Rv
ccgcugagccccccgagc

SEQ ID NO: 3247272 - RNA, 14 nt, Mycobacterium tuberculosis H37Rv
ccgcugagcccugc

SEQ ID NO: 3247273 - RNA, 19 nt, Mycobacterium tuberculosis H37Rv
ccgcugagccggugcacuc

SEQ ID NO: 3247274 - RNA, 15 nt, Mycobacterium tuberculosis H37Rv
ccgcugagcgggcaa

SEQ ID NO: 3247275 - RNA, 20 nt, Mycobacterium tuberculosis H37Rv
ccgcugagguaauucgcggc

SEQ ID NO: 3247276 - RNA, 19 nt, Mycobacterium tuberculosis H37Rv
ccgcugaucagauccucga

SEQ ID NO: 3247277 - RNA, 17 nt, Mycobacterium tuberculosis H37Rv
ccgcugaucgccgacaa

SEQ ID NO: 3247278 - RNA, 15 nt, Mycobacterium tuberculosis H37Rv
ccgcugaucucgguc

SEQ ID NO: 3247279 - RNA, 16 nt, Mycobacterium tuberculosis H37Rv
ccgcugaugagccgca

SEQ ID NO: 3247280 - RNA, 23 nt, Mycobacterium tuberculosis H37Rv
ccgcugaugagccgcagaugcac

SEQ ID NO: 3247281 - RNA, 17 nt, Mycobacterium tuberculosis H37Rv
ccgcugaugcuggccag

SEQ ID NO: 3247282 - RNA, 21 nt, Mycobacterium tuberculosis H37Rv
ccgcugcagugguaccggcgc

SEQ ID NO: 3247283 - RNA, 23 nt, Mycobacterium tuberculosis H37Rv
ccgcugcauccgcagcaccaagg

SEQ ID NO: 3247284 - RNA, 16 nt, Mycobacterium tuberculosis H37Rv
ccgcugccagggugcg

SEQ ID NO: 3247285 - RNA, 12 nt, Mycobacterium tuberculosis H37Rv
ccgcugccgccc

SEQ ID NO: 3247286 - RNA, 13 nt, Mycobacterium tuberculosis H37Rv
ccgcugccgcccu

SEQ ID NO: 3247287 - RNA, 22 nt, Mycobacterium tuberculosis H37Rv
ccgcugccgcccuugccgcccg

SEQ ID NO: 3247288 - RNA, 23 nt, Mycobacterium tuberculosis H37Rv
ccgcugccgccgagcuggcgcgc

SEQ ID NO: 3247289 - RNA, 13 nt, Mycobacterium tuberculosis H37Rv
ccgcugccggcac

SEQ ID NO: 3247290 - RNA, 14 nt, Mycobacterium tuberculosis H37Rv
ccgcugccggcacg

SEQ ID NO: 3247291 - RNA, 16 nt, Mycobacterium tuberculosis H37Rv
ccgcugccggcacgca

SEQ ID NO: 3247292 - RNA, 19 nt, Mycobacterium tuberculosis H37Rv
ccgcugccggcagcguccg

SEQ ID NO: 3247293 - RNA, 19 nt, Mycobacterium tuberculosis H37Rv
ccgcugccgguagcacagc

SEQ ID NO: 3247294 - RNA, 20 nt, Mycobacterium tuberculosis H37Rv
ccgcugccgguagcacagca

SEQ ID NO: 3247295 - RNA, 22 nt, Mycobacterium tuberculosis H37Rv
ccgcugccuucuuugccggcgc

SEQ ID NO: 3247296 - RNA, 20 nt, Mycobacterium tuberculosis H37Rv
ccgcugccuuggcgcggcac

SEQ ID NO: 3247297 - RNA, 21 nt, Mycobacterium tuberculosis H37Rv
ccgcugcgaaagcacgugcac

SEQ ID NO: 3247298 - RNA, 21 nt, Mycobacterium tuberculosis H37Rv
ccgcugcgccgucgcagccag

SEQ ID NO: 3247299 - RNA, 21 nt, Mycobacterium tuberculosis H37Rv
ccgcugcgcggcccgcaucgu

SEQ ID NO: 3247300 - RNA, 20 nt, Mycobacterium tuberculosis H37Rv
ccgcugcggcaccacccggc

SEQ ID NO: 3247301 - RNA, 22 nt, Mycobacterium tuberculosis H37Rv
ccgcugcggcggcuuuggccgc

SEQ ID NO: 3247302 - RNA, 19 nt, Mycobacterium tuberculosis H37Rv
ccgcugcggguagccgucg

SEQ ID NO: 3247303 - RNA, 18 nt, Mycobacterium tuberculosis H37Rv
ccgcugcguaguguucug

SEQ ID NO: 3247304 - RNA, 23 nt, Mycobacterium tuberculosis H37Rv
ccgcugcuagugcgggccgugac

SEQ ID NO: 3247305 - RNA, 15 nt, Mycobacterium tuberculosis H37Rv
ccgcuggagaucacg

SEQ ID NO: 3247306 - RNA, 22 nt, Mycobacterium tuberculosis H37Rv
ccggagcgguguggucgcagga

SEQ ID NO: 3247307 - RNA, 19 nt, Mycobacterium tuberculosis H37Rv
ccggaggaucgcugguugg

SEQ ID NO: 3247308 - RNA, 19 nt, Mycobacterium tuberculosis H37Rv
ccggaggcaagcaaccggu

SEQ ID NO: 3247309 - RNA, 17 nt, Mycobacterium tuberculosis H37Rv
ccggaggcaauccgauc

SEQ ID NO: 3247310 - RNA, 21 nt, Mycobacterium tuberculosis H37Rv
ccggaggcaauccgaucugga

SEQ ID NO: 3247311 - RNA, 18 nt, Mycobacterium tuberculosis H37Rv
ccggagggguuagguugu

SEQ ID NO: 3247312 - RNA, 13 nt, Mycobacterium tuberculosis H37Rv
ccggaggucgggc

SEQ ID NO: 3247313 - RNA, 13 nt, Mycobacterium tuberculosis H37Rv
ccggagucaccga

SEQ ID NO: 3247314 - RNA, 13 nt, Mycobacterium tuberculosis H37Rv
ccggagucgacga

SEQ ID NO: 3247315 - RNA, 14 nt, Mycobacterium tuberculosis H37Rv
ccggagucgacgac

SEQ ID NO: 3247316 - RNA, 13 nt, Mycobacterium tuberculosis H37Rv
ccggagucggcgu

SEQ ID NO: 3247317 - RNA, 17 nt, Mycobacterium tuberculosis H37Rv
ccggagucgucggcaac

SEQ ID NO: 3247318 - RNA, 20 nt, Mycobacterium tuberculosis H37Rv
ccggaguugucgacggccac

SEQ ID NO: 3247319 - RNA, 18 nt, Mycobacterium tuberculosis H37Rv
ccggaguuuaagacgccc

SEQ ID NO: 3247320 - RNA, 18 nt, Mycobacterium tuberculosis H37Rv
ccggauaacccagcggcg

SEQ ID NO: 3247321 - RNA, 14 nt, Mycobacterium tuberculosis H37Rv
ccggauacgggcgu

SEQ ID NO: 3247322 - RNA, 16 nt, Mycobacterium tuberculosis H37Rv
ccggauagacggcgac

SEQ ID NO: 3247323 - RNA, 14 nt, Mycobacterium tuberculosis H37Rv
ccggauagcaccgg

SEQ ID NO: 3247324 - RNA, 13 nt, Mycobacterium tuberculosis H37Rv
ccggauagcgucg

SEQ ID NO: 3247325 - RNA, 15 nt, Mycobacterium tuberculosis H37Rv
ccggauaggucgggc

SEQ ID NO: 3247326 - RNA, 14 nt, Mycobacterium tuberculosis H37Rv
ccggauaucgacca

SEQ ID NO: 3247327 - RNA, 14 nt, Mycobacterium tuberculosis H37Rv
ccggaucaggaucg

SEQ ID NO: 3247328 - RNA, 17 nt, Mycobacterium tuberculosis H37Rv
ccggaucaucgccgcgg

SEQ ID NO: 3247329 - RNA, 14 nt, Mycobacterium tuberculosis H37Rv
ccggaucccaccac

SEQ ID NO: 3247330 - RNA, 15 nt, Mycobacterium tuberculosis H37Rv
ccggaucccaccacc

SEQ ID NO: 3247331 - RNA, 21 nt, Mycobacterium tuberculosis H37Rv
ccggaucccugugccagcagc

SEQ ID NO: 3247332 - RNA, 13 nt, Mycobacterium tuberculosis H37Rv
ccggauccgccag

SEQ ID NO: 3247333 - RNA, 17 nt, Mycobacterium tuberculosis H37Rv
ccggauccgccagaccg

SEQ ID NO: 3247334 - RNA, 13 nt, Mycobacterium tuberculosis H37Rv
ccggauccucggc

SEQ ID NO: 3247335 - RNA, 14 nt, Mycobacterium tuberculosis H37Rv
ccggauccucggcc

SEQ ID NO: 3247336 - RNA, 12 nt, Mycobacterium tuberculosis H37Rv
ccggaucgaaac

SEQ ID NO: 3247337 - RNA, 14 nt, Mycobacterium tuberculosis H37Rv
ccggaucgccacgg

SEQ ID NO: 3247338 - RNA, 20 nt, Mycobacterium tuberculosis H37Rv
ccggaucgccgaaucggcag

SEQ ID NO: 3247339 - RNA, 17 nt, Mycobacterium tuberculosis H37Rv
ccggaucgcucccgucu

SEQ ID NO: 3247340 - RNA, 18 nt, Mycobacterium tuberculosis H37Rv
ccggaucgcucccgucuc

SEQ ID NO: 3247341 - RNA, 18 nt, Mycobacterium tuberculosis H37Rv
ccggaucggucggcacca

SEQ ID NO: 3247342 - RNA, 21 nt, Mycobacterium tuberculosis H37Rv
ccggaucggucggcaccaggu

SEQ ID NO: 3247343 - RNA, 14 nt, Mycobacterium tuberculosis H37Rv
ccggaucgucgaac

SEQ ID NO: 3247344 - RNA, 19 nt, Mycobacterium tuberculosis H37Rv
ccggaucgucgaacagcac

SEQ ID NO: 3247345 - RNA, 21 nt, Mycobacterium tuberculosis H37Rv
ccggaucugacggcgccgucg

SEQ ID NO: 3247346 - RNA, 12 nt, Mycobacterium tuberculosis H37Rv
ccggaugccgac

SEQ ID NO: 3247347 - RNA, 15 nt, Mycobacterium tuberculosis H37Rv
ccggaugcgcaaccg

SEQ ID NO: 3247348 - RNA, 19 nt, Mycobacterium tuberculosis H37Rv
ccggaugcugucagcagcc

SEQ ID NO: 3247349 - RNA, 15 nt, Mycobacterium tuberculosis H37Rv
ccggauguccgccga

SEQ ID NO: 3247350 - RNA, 22 nt, Mycobacterium tuberculosis H37Rv
ccggaugucgacgagcaccgcg

SEQ ID NO: 3247351 - RNA, 16 nt, Mycobacterium tuberculosis H37Rv
ccggauuauucgcggu

SEQ ID NO: 3247352 - RNA, 17 nt, Mycobacterium tuberculosis H37Rv
ccggauucuucggugaa

SEQ ID NO: 3247353 - RNA, 22 nt, Mycobacterium tuberculosis H37Rv
ccggauugaagucgucggccau

SEQ ID NO: 3247354 - RNA, 16 nt, Mycobacterium tuberculosis H37Rv
ccggauugacgccgaa

SEQ ID NO: 3247355 - RNA, 22 nt, Mycobacterium tuberculosis H37Rv
ccggauuucgucgggcaccgcc

SEQ ID NO: 3247356 - RNA, 14 nt, Mycobacterium tuberculosis H37Rv
ccggcaaacuccag

SEQ ID NO: 3247357 - RNA, 15 nt, Mycobacterium tuberculosis H37Rv
ccggcaacagcacca

SEQ ID NO: 3247358 - RNA, 19 nt, Mycobacterium tuberculosis H37Rv
ccggcaacaucagcaggac

SEQ ID NO: 3247359 - RNA, 21 nt, Mycobacterium tuberculosis H37Rv
ccggcaaccaccggccgcgca

SEQ ID NO: 3247360 - RNA, 15 nt, Mycobacterium tuberculosis H37Rv
ccggcaaccuggacu

SEQ ID NO: 3247361 - RNA, 15 nt, Mycobacterium tuberculosis H37Rv
ccggcaacgcggccu

SEQ ID NO: 3247362 - RNA, 23 nt, Mycobacterium tuberculosis H37Rv
ccggcaacggcgcgccgaccacc

SEQ ID NO: 3247363 - RNA, 17 nt, Mycobacterium tuberculosis H37Rv
ccggcaagcacaccgcc

SEQ ID NO: 3247364 - RNA, 22 nt, Mycobacterium tuberculosis H37Rv
ccggcaagcacaccgccagcgg

SEQ ID NO: 3247365 - RNA, 11 nt, Mycobacterium tuberculosis H37Rv
ccggcaagcag

SEQ ID NO: 3247366 - RNA, 18 nt, Mycobacterium tuberculosis H37Rv
ccggcaagccacgccggu

SEQ ID NO: 3247367 - RNA, 12 nt, Mycobacterium tuberculosis H37Rv
ccggcaagcgca

SEQ ID NO: 3247368 - RNA, 14 nt, Mycobacterium tuberculosis H37Rv
ccggcaagcgcaga

SEQ ID NO: 3247369 - RNA, 19 nt, Mycobacterium tuberculosis H37Rv
ccggcaauaccgccagcgc

SEQ ID NO: 3247370 - RNA, 23 nt, Mycobacterium tuberculosis H37Rv
ccggcaauaccgccagcgccacc

SEQ ID NO: 3247371 - RNA, 13 nt, Mycobacterium tuberculosis H37Rv
ccggcaauaccgg

SEQ ID NO: 3247372 - RNA, 21 nt, Mycobacterium tuberculosis H37Rv
ccggcaaucggcggcacccgg

SEQ ID NO: 3247373 - RNA, 19 nt, Mycobacterium tuberculosis H37Rv
ccggcaaucucccgaaucg

SEQ ID NO: 3247374 - RNA, 19 nt, Mycobacterium tuberculosis H37Rv
ccggcaaugccgcggccag

SEQ ID NO: 3247375 - RNA, 18 nt, Mycobacterium tuberculosis H37Rv
ccggcaauuccguuaggc

SEQ ID NO: 3247376 - RNA, 23 nt, Mycobacterium tuberculosis H37Rv
ccggcacauugaucgacggccag

SEQ ID NO: 3247377 - RNA, 16 nt, Mycobacterium tuberculosis H37Rv
ccggcaccaccguugc

SEQ ID NO: 3247378 - RNA, 17 nt, Mycobacterium tuberculosis H37Rv
ccggcaccagcggcacc

SEQ ID NO: 3247379 - RNA, 18 nt, Mycobacterium tuberculosis H37Rv
ccggcacccaccagugca

SEQ ID NO: 3247380 - RNA, 18 nt, Mycobacterium tuberculosis H37Rv
ccggcaccccacggccag

SEQ ID NO: 3247381 - RNA, 21 nt, Mycobacterium tuberculosis H37Rv
ccggcaccccuuugacgccga

SEQ ID NO: 3247382 - RNA, 23 nt, Mycobacterium tuberculosis H37Rv
ccggcacccgcggcgaaccgucu

SEQ ID NO: 3247383 - RNA, 14 nt, Mycobacterium tuberculosis H37Rv
ccggcacccgucgg

SEQ ID NO: 3247384 - RNA, 18 nt, Mycobacterium tuberculosis H37Rv
ccggcaccgccagugccc

SEQ ID NO: 3247385 - RNA, 13 nt, Mycobacterium tuberculosis H37Rv
ccggcaccgcccu

SEQ ID NO: 3247386 - RNA, 19 nt, Mycobacterium tuberculosis H37Rv
ccggcaccgccgguggcgc

SEQ ID NO: 3247387 - RNA, 22 nt, Mycobacterium tuberculosis H37Rv
ccggcaccgccugcgccgcccg

SEQ ID NO: 3247388 - RNA, 13 nt, Mycobacterium tuberculosis H37Rv
ccggcaccggaug

SEQ ID NO: 3247389 - RNA, 12 nt, Mycobacterium tuberculosis H37Rv
ccggcaccggcc

SEQ ID NO: 3247390 - RNA, 18 nt, Mycobacterium tuberculosis H37Rv
ccggcaccggccgugccg

SEQ ID NO: 3247391 - RNA, 14 nt, Mycobacterium tuberculosis H37Rv
ccggcaccggggcu

SEQ ID NO: 3247392 - RNA, 17 nt, Mycobacterium tuberculosis H37Rv
ccggcaccuccagcacc

SEQ ID NO: 3247393 - RNA, 16 nt, Mycobacterium tuberculosis H37Rv
ccggcaccucccuggc

SEQ ID NO: 3247394 - RNA, 17 nt, Mycobacterium tuberculosis H37Rv
ccggcaccucccuggcc

SEQ ID NO: 3247395 - RNA, 21 nt, Mycobacterium tuberculosis H37Rv
ccggcaccucccuggcccccg

SEQ ID NO: 3247396 - RNA, 14 nt, Mycobacterium tuberculosis H37Rv
ccggcaccuccgcc

SEQ ID NO: 3247397 - RNA, 19 nt, Mycobacterium tuberculosis H37Rv
ccggcaccuccgccggcac

SEQ ID NO: 3247398 - RNA, 21 nt, Mycobacterium tuberculosis H37Rv
ccggcaccuccgccggcaccu

SEQ ID NO: 3247399 - RNA, 23 nt, Mycobacterium tuberculosis H37Rv
ccggcaccuccgccggcaccucc

SEQ ID NO: 3247400 - RNA, 17 nt, Mycobacterium tuberculosis H37Rv
ccggcacgaccgcuccc

SEQ ID NO: 3247401 - RNA, 20 nt, Mycobacterium tuberculosis H37Rv
ccggcacgaccgcucccggu

SEQ ID NO: 3247402 - RNA, 16 nt, Mycobacterium tuberculosis H37Rv
ccggcacgcagccaau

SEQ ID NO: 3247403 - RNA, 20 nt, Mycobacterium tuberculosis H37Rv
ccggcccggggacgcccucg

SEQ ID NO: 3247404 - RNA, 16 nt, Mycobacterium tuberculosis H37Rv
ccggcccgguccagcc

SEQ ID NO: 3247405 - RNA, 13 nt, Mycobacterium tuberculosis H37Rv
ccggcccggugau

SEQ ID NO: 3247406 - RNA, 19 nt, Mycobacterium tuberculosis H37Rv
ccggcccugccgccggccc

SEQ ID NO: 3247407 - RNA, 12 nt, Mycobacterium tuberculosis H37Rv
ccggcccugcuc

SEQ ID NO: 3247408 - RNA, 17 nt, Mycobacterium tuberculosis H37Rv
ccggccgacacgccgau

SEQ ID NO: 3247409 - RNA, 13 nt, Mycobacterium tuberculosis H37Rv
ccggccgacccgg

SEQ ID NO: 3247410 - RNA, 14 nt, Mycobacterium tuberculosis H37Rv
ccggccgacccgga

SEQ ID NO: 3247411 - RNA, 13 nt, Mycobacterium tuberculosis H37Rv
ccggccgacgaac

SEQ ID NO: 3247412 - RNA, 19 nt, Mycobacterium tuberculosis H37Rv
ccggccgacgaacagcggu

SEQ ID NO: 3247413 - RNA, 17 nt, Mycobacterium tuberculosis H37Rv
ccggccgacgugacaac

SEQ ID NO: 3247414 - RNA, 14 nt, Mycobacterium tuberculosis H37Rv
ccggccgagcgcac

SEQ ID NO: 3247415 - RNA, 16 nt, Mycobacterium tuberculosis H37Rv
ccggccgagcgcacug

SEQ ID NO: 3247416 - RNA, 16 nt, Mycobacterium tuberculosis H37Rv
ccggccgaucucggug

SEQ ID NO: 3247417 - RNA, 17 nt, Mycobacterium tuberculosis H37Rv
ccggccgaugcgacccg

SEQ ID NO: 3247418 - RNA, 13 nt, Mycobacterium tuberculosis H37Rv
ccggccgcacccg

SEQ ID NO: 3247419 - RNA, 15 nt, Mycobacterium tuberculosis H37Rv
ccggccgcacgccga

SEQ ID NO: 3247420 - RNA, 14 nt, Mycobacterium tuberculosis H37Rv
ccggccgccagcgc

SEQ ID NO: 3247421 - RNA, 15 nt, Mycobacterium tuberculosis H37Rv
ccggccgccaucauc

SEQ ID NO: 3247422 - RNA, 13 nt, Mycobacterium tuberculosis H37Rv
ccggccgccgaaa

SEQ ID NO: 3247423 - RNA, 14 nt, Mycobacterium tuberculosis H37Rv
ccggccgccgaaac

SEQ ID NO: 3247424 - RNA, 22 nt, Mycobacterium tuberculosis H37Rv
ccggccgccgcgggacaccacc

SEQ ID NO: 3247425 - RNA, 22 nt, Mycobacterium tuberculosis H37Rv
ccggccgcgcacccguccgccg

SEQ ID NO: 3247426 - RNA, 23 nt, Mycobacterium tuberculosis H37Rv
ccggccgcgcacccguccgccgc

SEQ ID NO: 3247427 - RNA, 18 nt, Mycobacterium tuberculosis H37Rv
ccggccgcggcggccccg

SEQ ID NO: 3247428 - RNA, 17 nt, Mycobacterium tuberculosis H37Rv
ccggccgcuauggcccg

SEQ ID NO: 3247429 - RNA, 17 nt, Mycobacterium tuberculosis H37Rv
ccggccgcucaccccgc

SEQ ID NO: 3247430 - RNA, 19 nt, Mycobacterium tuberculosis H37Rv
ccggccggaacgcccggcu

SEQ ID NO: 3247431 - RNA, 13 nt, Mycobacterium tuberculosis H37Rv
ccggccggcccau

SEQ ID NO: 3247432 - RNA, 15 nt, Mycobacterium tuberculosis H37Rv
ccggccggccuagcc

SEQ ID NO: 3247433 - RNA, 23 nt, Mycobacterium tuberculosis H37Rv
ccggccggguguagcucggaccc

SEQ ID NO: 3247434 - RNA, 18 nt, Mycobacterium tuberculosis H37Rv
ccggccgguccgggaagu

SEQ ID NO: 3247435 - RNA, 14 nt, Mycobacterium tuberculosis H37Rv
ccggccggugccag

SEQ ID NO: 3247436 - RNA, 22 nt, Mycobacterium tuberculosis H37Rv
ccggccgguggguagccagcgc

SEQ ID NO: 3247437 - RNA, 22 nt, Mycobacterium tuberculosis H37Rv
ccggccgguucuuggcguugau

SEQ ID NO: 3247438 - RNA, 22 nt, Mycobacterium tuberculosis H37Rv
ccggccgguuggccagccacag

SEQ ID NO: 3247439 - RNA, 15 nt, Mycobacterium tuberculosis H37Rv
ccggccgucaucugg

SEQ ID NO: 3247440 - RNA, 20 nt, Mycobacterium tuberculosis H37Rv
ccggccgucccgcgagcagc

SEQ ID NO: 3247441 - RNA, 15 nt, Mycobacterium tuberculosis H37Rv
ccggccgucgcgcga

SEQ ID NO: 3247442 - RNA, 13 nt, Mycobacterium tuberculosis H37Rv
ccggccgucggcc

SEQ ID NO: 3247443 - RNA, 16 nt, Mycobacterium tuberculosis H37Rv
ccggccguugggaaac

SEQ ID NO: 3247444 - RNA, 17 nt, Mycobacterium tuberculosis H37Rv
ccggccuagccgauggc

SEQ ID NO: 3247445 - RNA, 22 nt, Mycobacterium tuberculosis H37Rv
ccggccucagcccgucagccga

SEQ ID NO: 3247446 - RNA, 18 nt, Mycobacterium tuberculosis H37Rv
ccggccuccauaucgcag

SEQ ID NO: 3247447 - RNA, 14 nt, Mycobacterium tuberculosis H37Rv
ccggccucgccgaa

SEQ ID NO: 3247448 - RNA, 15 nt, Mycobacterium tuberculosis H37Rv
ccggccucgccgaag

SEQ ID NO: 3247449 - RNA, 14 nt, Mycobacterium tuberculosis H37Rv
ccggccucuggauc

SEQ ID NO: 3247450 - RNA, 22 nt, Mycobacterium tuberculosis H37Rv
ccggccugcgcgaccgaccagc

SEQ ID NO: 3247451 - RNA, 17 nt, Mycobacterium tuberculosis H37Rv
ccggccugcucggcgag

SEQ ID NO: 3247452 - RNA, 18 nt, Mycobacterium tuberculosis H37Rv
ccggccuuauucacccgg

SEQ ID NO: 3247453 - RNA, 22 nt, Mycobacterium tuberculosis H37Rv
ccggccuuauucacccgguagg

SEQ ID NO: 3247454 - RNA, 22 nt, Mycobacterium tuberculosis H37Rv
ccggccuucaaggaagccgcgg

SEQ ID NO: 3247455 - RNA, 11 nt, Mycobacterium tuberculosis H37Rv
ccggccuucuc

SEQ ID NO: 3247456 - RNA, 21 nt, Mycobacterium tuberculosis H37Rv
ccggccuugugcucgaugcga

SEQ ID NO: 3247457 - RNA, 17 nt, Mycobacterium tuberculosis H37Rv
ccggccuuuacccgggc

SEQ ID NO: 3247458 - RNA, 21 nt, Mycobacterium tuberculosis H37Rv
ccggcgaaaagacugcgccgc

SEQ ID NO: 3247459 - RNA, 20 nt, Mycobacterium tuberculosis H37Rv
ccggcgaaccccagcgcauc

SEQ ID NO: 3247460 - RNA, 18 nt, Mycobacterium tuberculosis H37Rv
ccggcgaacucgcgccga

SEQ ID NO: 3247461 - RNA, 19 nt, Mycobacterium tuberculosis H37Rv
ccggcgaagccggccggga

SEQ ID NO: 3247462 - RNA, 16 nt, Mycobacterium tuberculosis H37Rv
ccggcgaaggccagca

SEQ ID NO: 3247463 - RNA, 20 nt, Mycobacterium tuberculosis H37Rv
ccggcgaauacgaccgucgc

SEQ ID NO: 3247464 - RNA, 22 nt, Mycobacterium tuberculosis H37Rv
ccggcgaauacgaccgucgcgc

SEQ ID NO: 3247465 - RNA, 19 nt, Mycobacterium tuberculosis H37Rv
ccggcgaccggcgagcccg

SEQ ID NO: 3247466 - RNA, 13 nt, Mycobacterium tuberculosis H37Rv
ccggcgacgccgg

SEQ ID NO: 3247467 - RNA, 23 nt, Mycobacterium tuberculosis H37Rv
ccggcgacgccggccuuggcgau

SEQ ID NO: 3247468 - RNA, 19 nt, Mycobacterium tuberculosis H37Rv
ccggcgacgcuaccgccgg

SEQ ID NO: 3247469 - RNA, 17 nt, Mycobacterium tuberculosis H37Rv
ccggcgacgggucgggc

SEQ ID NO: 3247470 - RNA, 22 nt, Mycobacterium tuberculosis H37Rv
ccggcgagcacccgcuggucga

SEQ ID NO: 3247471 - RNA, 16 nt, Mycobacterium tuberculosis H37Rv
ccggcgagcagacgca

SEQ ID NO: 3247472 - RNA, 18 nt, Mycobacterium tuberculosis H37Rv
ccggcgagcagacgcaua

SEQ ID NO: 3247473 - RNA, 22 nt, Mycobacterium tuberculosis H37Rv
ccggcgagcccgcaucgcacca

SEQ ID NO: 3247474 - RNA, 16 nt, Mycobacterium tuberculosis H37Rv
ccggcgagcucgacga

SEQ ID NO: 3247475 - RNA, 19 nt, Mycobacterium tuberculosis H37Rv
ccggcgagugcugucgucu

SEQ ID NO: 3247476 - RNA, 14 nt, Mycobacterium tuberculosis H37Rv
ccggcgaucguguc

SEQ ID NO: 3247477 - RNA, 17 nt, Mycobacterium tuberculosis H37Rv
ccggcgaucguguccac

SEQ ID NO: 3247478 - RNA, 17 nt, Mycobacterium tuberculosis H37Rv
ccggcgaucucgaccgu

SEQ ID NO: 3247479 - RNA, 14 nt, Mycobacterium tuberculosis H37Rv
ccggcgaugaccag

SEQ ID NO: 3247480 - RNA, 17 nt, Mycobacterium tuberculosis H37Rv
ccggcgauguuggccag

SEQ ID NO: 3247481 - RNA, 22 nt, Mycobacterium tuberculosis H37Rv
ccggcgauuccaccuuggccag

SEQ ID NO: 3247482 - RNA, 14 nt, Mycobacterium tuberculosis H37Rv
ccggcgcaagcgcc

SEQ ID NO: 3247483 - RNA, 16 nt, Mycobacterium tuberculosis H37Rv
ccggcgcaagcgccgc

SEQ ID NO: 3247484 - RNA, 14 nt, Mycobacterium tuberculosis H37Rv
ccggcgcaccuggg

SEQ ID NO: 3247485 - RNA, 23 nt, Mycobacterium tuberculosis H37Rv
ccggcgcaccugggcugccggcc

SEQ ID NO: 3247486 - RNA, 16 nt, Mycobacterium tuberculosis H37Rv
ccggcgcacgaaaccg

SEQ ID NO: 3247487 - RNA, 23 nt, Mycobacterium tuberculosis H37Rv
ccggcgcacgaaaccgcagcgcg

SEQ ID NO: 3247488 - RNA, 16 nt, Mycobacterium tuberculosis H37Rv
ccggcgcagguucucg

SEQ ID NO: 3247489 - RNA, 22 nt, Mycobacterium tuberculosis H37Rv
ccggcgcagguucucggugccg

SEQ ID NO: 3247490 - RNA, 23 nt, Mycobacterium tuberculosis H37Rv
ccggcgcagguucucggugccga

SEQ ID NO: 3247491 - RNA, 18 nt, Mycobacterium tuberculosis H37Rv
ccggcgcaguagccgacc

SEQ ID NO: 3247492 - RNA, 18 nt, Mycobacterium tuberculosis H37Rv
ccggcgcagugcagguca

SEQ ID NO: 3247493 - RNA, 14 nt, Mycobacterium tuberculosis H37Rv
ccggcgccacccgc

SEQ ID NO: 3247494 - RNA, 20 nt, Mycobacterium tuberculosis H37Rv
ccggcgccacccgcgccgcc

SEQ ID NO: 3247495 - RNA, 14 nt, Mycobacterium tuberculosis H37Rv
ccggcgccaccgcc

SEQ ID NO: 3247496 - RNA, 16 nt, Mycobacterium tuberculosis H37Rv
ccggcgccaccgccgc

SEQ ID NO: 3247497 - RNA, 19 nt, Mycobacterium tuberculosis H37Rv
ccggcgccaccggcgccgc

SEQ ID NO: 3247498 - RNA, 13 nt, Mycobacterium tuberculosis H37Rv
ccggcgccaccgu

SEQ ID NO: 3247499 - RNA, 20 nt, Mycobacterium tuberculosis H37Rv
ccggcgggaugcgcgcccga

SEQ ID NO: 3247500 - RNA, 20 nt, Mycobacterium tuberculosis H37Rv
ccggcgggcgagugucagca

SEQ ID NO: 3247501 - RNA, 21 nt, Mycobacterium tuberculosis H37Rv
ccggcgggcgagugucagcag

SEQ ID NO: 3247502 - RNA, 19 nt, Mycobacterium tuberculosis H37Rv
ccggcgggcggugggcagc

SEQ ID NO: 3247503 - RNA, 20 nt, Mycobacterium tuberculosis H37Rv
ccggcgggcggugggcagca

SEQ ID NO: 3247504 - RNA, 14 nt, Mycobacterium tuberculosis H37Rv
ccggcgggcucgcc

SEQ ID NO: 3247505 - RNA, 13 nt, Mycobacterium tuberculosis H37Rv
ccggcgggcucgg

SEQ ID NO: 3247506 - RNA, 21 nt, Mycobacterium tuberculosis H37Rv
ccggcgggugccgagcuggcg

SEQ ID NO: 3247507 - RNA, 22 nt, Mycobacterium tuberculosis H37Rv
ccggcgguagccauucaguguc

SEQ ID NO: 3247508 - RNA, 17 nt, Mycobacterium tuberculosis H37Rv
ccggcgguagucggcca

SEQ ID NO: 3247509 - RNA, 23 nt, Mycobacterium tuberculosis H37Rv
ccggcgguagucggccagcucgc

SEQ ID NO: 3247510 - RNA, 23 nt, Mycobacterium tuberculosis H37Rv
ccggcggucagcagcgccgucag

SEQ ID NO: 3247511 - RNA, 17 nt, Mycobacterium tuberculosis H37Rv
ccggcggucagcggcuc

SEQ ID NO: 3247512 - RNA, 14 nt, Mycobacterium tuberculosis H37Rv
ccggcggucgccag

SEQ ID NO: 3247513 - RNA, 15 nt, Mycobacterium tuberculosis H37Rv
ccggcggugccguca

SEQ ID NO: 3247514 - RNA, 16 nt, Mycobacterium tuberculosis H37Rv
ccggcggugccgucag

SEQ ID NO: 3247515 - RNA, 17 nt, Mycobacterium tuberculosis H37Rv
ccggcggugccgucagc

SEQ ID NO: 3247516 - RNA, 20 nt, Mycobacterium tuberculosis H37Rv
ccggcgguggggccggcguc

SEQ ID NO: 3247517 - RNA, 13 nt, Mycobacterium tuberculosis H37Rv
ccggcgguggugu

SEQ ID NO: 3247518 - RNA, 20 nt, Mycobacterium tuberculosis H37Rv
ccggcgguguuggcgccagc

SEQ ID NO: 3247519 - RNA, 22 nt, Mycobacterium tuberculosis H37Rv
ccggcgguguuggcgccagccc

SEQ ID NO: 3247520 - RNA, 23 nt, Mycobacterium tuberculosis H37Rv
ccggcgguguuggcgccagcccc

SEQ ID NO: 3247521 - RNA, 23 nt, Mycobacterium tuberculosis H37Rv
ccggcguaaccggcagcgguaag

SEQ ID NO: 3247522 - RNA, 18 nt, Mycobacterium tuberculosis H37Rv
ccggcguacgccguaccc

SEQ ID NO: 3247523 - RNA, 16 nt, Mycobacterium tuberculosis H37Rv
ccggcguacucgguga

SEQ ID NO: 3247524 - RNA, 19 nt, Mycobacterium tuberculosis H37Rv
ccggcguacucggugaucg

SEQ ID NO: 3247525 - RNA, 22 nt, Mycobacterium tuberculosis H37Rv
ccggcguacuucgacagcggcg

SEQ ID NO: 3247526 - RNA, 17 nt, Mycobacterium tuberculosis H37Rv
ccggcguaggcaggauc

SEQ ID NO: 3247527 - RNA, 20 nt, Mycobacterium tuberculosis H37Rv
ccggcguauagcccguagcc

SEQ ID NO: 3247528 - RNA, 23 nt, Mycobacterium tuberculosis H37Rv
ccggcguauagcccguagccgau

SEQ ID NO: 3247529 - RNA, 22 nt, Mycobacterium tuberculosis H37Rv
ccggcguccaguccgaucaccc

SEQ ID NO: 3247530 - RNA, 19 nt, Mycobacterium tuberculosis H37Rv
ccggcguccggagccccug

SEQ ID NO: 3247531 - RNA, 14 nt, Mycobacterium tuberculosis H37Rv
ccggcgucgacguc

SEQ ID NO: 3247532 - RNA, 16 nt, Mycobacterium tuberculosis H37Rv
ccggcgucgacgucgg

SEQ ID NO: 3247533 - RNA, 15 nt, Mycobacterium tuberculosis H37Rv
ccggcgucgagccgg

SEQ ID NO: 3247534 - RNA, 18 nt, Mycobacterium tuberculosis H37Rv
ccggcgucgaugacgacg

SEQ ID NO: 3247535 - RNA, 13 nt, Mycobacterium tuberculosis H37Rv
ccggcgucggcgc

SEQ ID NO: 3247536 - RNA, 16 nt, Mycobacterium tuberculosis H37Rv
ccggcgucggcgccca

SEQ ID NO: 3247537 - RNA, 18 nt, Mycobacterium tuberculosis H37Rv
ccggcgucggcgcccagc

SEQ ID NO: 3247538 - RNA, 22 nt, Mycobacterium tuberculosis H37Rv
ccggcgucggcgcccagcucga

SEQ ID NO: 3247539 - RNA, 23 nt, Mycobacterium tuberculosis H37Rv
ccggcgucggcgcccagcucgau

SEQ ID NO: 3247540 - RNA, 18 nt, Mycobacterium tuberculosis H37Rv
ccggcgucggcgcggccg

SEQ ID NO: 3247541 - RNA, 14 nt, Mycobacterium tuberculosis H37Rv
ccggcgucggcguc

SEQ ID NO: 3247542 - RNA, 15 nt, Mycobacterium tuberculosis H37Rv
ccggcgucggucguc

SEQ ID NO: 3247543 - RNA, 17 nt, Mycobacterium tuberculosis H37Rv
ccggcgucggucgucgg

SEQ ID NO: 3247544 - RNA, 13 nt, Mycobacterium tuberculosis H37Rv
ccggcgucguuga

SEQ ID NO: 3247545 - RNA, 14 nt, Mycobacterium tuberculosis H37Rv
ccggcgucucgcag

SEQ ID NO: 3247546 - RNA, 17 nt, Mycobacterium tuberculosis H37Rv
ccggcgucugcccgccc

SEQ ID NO: 3247547 - RNA, 22 nt, Mycobacterium tuberculosis H37Rv
ccggcgugcagcacuuggccag

SEQ ID NO: 3247548 - RNA, 13 nt, Mycobacterium tuberculosis H37Rv
ccggcgugcagua

SEQ ID NO: 3247549 - RNA, 13 nt, Mycobacterium tuberculosis H37Rv
ccggcgugcauga

SEQ ID NO: 3247550 - RNA, 17 nt, Mycobacterium tuberculosis H37Rv
ccggcgugcgcaaggca

SEQ ID NO: 3247551 - RNA, 23 nt, Mycobacterium tuberculosis H37Rv
ccggcgugcugugcucacgagca

SEQ ID NO: 3247552 - RNA, 22 nt, Mycobacterium tuberculosis H37Rv
ccggcguggauccguagaaggc

SEQ ID NO: 3247553 - RNA, 16 nt, Mycobacterium tuberculosis H37Rv
ccggcguggccccacc

SEQ ID NO: 3247554 - RNA, 19 nt, Mycobacterium tuberculosis H37Rv
ccggcgugggcaccuugcc

SEQ ID NO: 3247555 - RNA, 15 nt, Mycobacterium tuberculosis H37Rv
ccggcgugucgccgc

SEQ ID NO: 3247556 - RNA, 19 nt, Mycobacterium tuberculosis H37Rv
ccggcgugucgccgccacc

SEQ ID NO: 3247557 - RNA, 18 nt, Mycobacterium tuberculosis H37Rv
ccggcguucccacuggag

SEQ ID NO: 3247558 - RNA, 23 nt, Mycobacterium tuberculosis H37Rv
ccggcguucccacuggaggucgu

SEQ ID NO: 3247559 - RNA, 17 nt, Mycobacterium tuberculosis H37Rv
ccggcguucccccacuc

SEQ ID NO: 3247560 - RNA, 13 nt, Mycobacterium tuberculosis H37Rv
ccggcguugccga

SEQ ID NO: 3247561 - RNA, 19 nt, Mycobacterium tuberculosis H37Rv
ccggcguugccgccguucc

SEQ ID NO: 3247562 - RNA, 21 nt, Mycobacterium tuberculosis H37Rv
ccggcguugcguagacgaagg

SEQ ID NO: 3247563 - RNA, 14 nt, Mycobacterium tuberculosis H37Rv
ccggcguuggccau

SEQ ID NO: 3247564 - RNA, 19 nt, Mycobacterium tuberculosis H37Rv
ccggcguuugggcaucauc

SEQ ID NO: 3247565 - RNA, 21 nt, Mycobacterium tuberculosis H37Rv
ccggcuaccgccuugucggcg

SEQ ID NO: 3247566 - RNA, 16 nt, Mycobacterium tuberculosis H37Rv
ccggcuacggcgacac

SEQ ID NO: 3247567 - RNA, 23 nt, Mycobacterium tuberculosis H37Rv
ccggcuacggcgacacgccagcc

SEQ ID NO: 3247568 - RNA, 22 nt, Mycobacterium tuberculosis H37Rv
ccggcuagauaacccaaccgcg

SEQ ID NO: 3247569 - RNA, 17 nt, Mycobacterium tuberculosis H37Rv
ccggcuauaucccgccc

SEQ ID NO: 3247570 - RNA, 18 nt, Mycobacterium tuberculosis H37Rv
ccggcucaaggacgcacc

SEQ ID NO: 3247571 - RNA, 23 nt, Mycobacterium tuberculosis H37Rv
ccggcucaaggacgcaccgccag

SEQ ID NO: 3247572 - RNA, 13 nt, Mycobacterium tuberculosis H37Rv
ccggcuccacccc

SEQ ID NO: 3247573 - RNA, 18 nt, Mycobacterium tuberculosis H37Rv
ccggcuccagcaugggcg

SEQ ID NO: 3247574 - RNA, 20 nt, Mycobacterium tuberculosis H37Rv
ccggcuccgccagcgccgcc

SEQ ID NO: 3247575 - RNA, 16 nt, Mycobacterium tuberculosis H37Rv
ccggcuccgccguugc

SEQ ID NO: 3247576 - RNA, 21 nt, Mycobacterium tuberculosis H37Rv
ccggcuccuccccggcccgcu

SEQ ID NO: 3247577 - RNA, 14 nt, Mycobacterium tuberculosis H37Rv
ccggcucgacugcc

SEQ ID NO: 3247578 - RNA, 20 nt, Mycobacterium tuberculosis H37Rv
ccggcucggaaaccgccccg

SEQ ID NO: 3247579 - RNA, 12 nt, Mycobacterium tuberculosis H37Rv
ccggcucggcag

SEQ ID NO: 3247580 - RNA, 13 nt, Mycobacterium tuberculosis H37Rv
ccggcucggccag

SEQ ID NO: 3247581 - RNA, 23 nt, Mycobacterium tuberculosis H37Rv
ccggcucggccagccagcgggcg

SEQ ID NO: 3247582 - RNA, 16 nt, Mycobacterium tuberculosis H37Rv
ccggcucggugcgcca

SEQ ID NO: 3247583 - RNA, 22 nt, Mycobacterium tuberculosis H37Rv
ccggcucggugcgccagaucac

SEQ ID NO: 3247584 - RNA, 16 nt, Mycobacterium tuberculosis H37Rv
ccggcucguccgggca

SEQ ID NO: 3247585 - RNA, 14 nt, Mycobacterium tuberculosis H37Rv
ccggcucgucgggc

SEQ ID NO: 3247586 - RNA, 16 nt, Mycobacterium tuberculosis H37Rv
ccggcugaccgacccg

SEQ ID NO: 3247587 - RNA, 17 nt, Mycobacterium tuberculosis H37Rv
ccggcugaccgacccgg

SEQ ID NO: 3247588 - RNA, 22 nt, Mycobacterium tuberculosis H37Rv
ccggcugaccggggcgcccggc

SEQ ID NO: 3247589 - RNA, 19 nt, Mycobacterium tuberculosis H37Rv
ccggcugauucgagccaca

SEQ ID NO: 3247590 - RNA, 18 nt, Mycobacterium tuberculosis H37Rv
ccggcugcaaccagcggc

SEQ ID NO: 3247591 - RNA, 19 nt, Mycobacterium tuberculosis H37Rv
ccggcugcauccuccucgu

SEQ ID NO: 3247592 - RNA, 23 nt, Mycobacterium tuberculosis H37Rv
ccggcugccagcgccgccgccga

SEQ ID NO: 3247593 - RNA, 16 nt, Mycobacterium tuberculosis H37Rv
ccggcugcgccgggcu

SEQ ID NO: 3247594 - RNA, 23 nt, Mycobacterium tuberculosis H37Rv
ccggcugcgccgggcucgcgauc

SEQ ID NO: 3247595 - RNA, 23 nt, Mycobacterium tuberculosis H37Rv
ccggcugcuuuaaccgcgucauc

SEQ ID NO: 3247596 - RNA, 14 nt, Mycobacterium tuberculosis H37Rv
ccggcuggccaggu

SEQ ID NO: 3247597 - RNA, 21 nt, Mycobacterium tuberculosis H37Rv
ccggcuggccagguggccgca

SEQ ID NO: 3247598 - RNA, 22 nt, Mycobacterium tuberculosis H37Rv
ccggcugguugaccgaguugaa

SEQ ID NO: 3247599 - RNA, 17 nt, Mycobacterium tuberculosis H37Rv
ccggcuguuaggcgaua

SEQ ID NO: 3247600 - RNA, 22 nt, Mycobacterium tuberculosis H37Rv
ccggcuguuaggcgauaucgca

SEQ ID NO: 3247601 - RNA, 17 nt, Mycobacterium tuberculosis H37Rv
ccggcuguucucgccga

SEQ ID NO: 3247602 - RNA, 19 nt, Mycobacterium tuberculosis H37Rv
ccggcuguucucgccgaag

SEQ ID NO: 3247603 - RNA, 12 nt, Mycobacterium tuberculosis H37Rv
ccggcuucgccg

SEQ ID NO: 3247604 - RNA, 15 nt, Mycobacterium tuberculosis H37Rv
ccggcuucgccgcgc

SEQ ID NO: 3247605 - RNA, 16 nt, Mycobacterium tuberculosis H37Rv
ccggcuucgccgcgcu

SEQ ID NO: 3247606 - RNA, 14 nt, Mycobacterium tuberculosis H37Rv
ccggcuucggcaac

SEQ ID NO: 3247607 - RNA, 15 nt, Mycobacterium tuberculosis H37Rv
ccggcuucggcaacc

SEQ ID NO: 3247608 - RNA, 18 nt, Mycobacterium tuberculosis H37Rv
ccggcuucggcgaacccu

SEQ ID NO: 3247609 - RNA, 22 nt, Mycobacterium tuberculosis H37Rv
ccggcuucggcgaacccuccgc

SEQ ID NO: 3247610 - RNA, 23 nt, Mycobacterium tuberculosis H37Rv
ccggcuucggcgaacccuccgca

SEQ ID NO: 3247611 - RNA, 19 nt, Mycobacterium tuberculosis H37Rv
ccggcuucguccaccgcga

SEQ ID NO: 3247612 - RNA, 15 nt, Mycobacterium tuberculosis H37Rv
ccggcuucgucggcc

SEQ ID NO: 3247613 - RNA, 13 nt, Mycobacterium tuberculosis H37Rv
ccggcuuggauac

SEQ ID NO: 3247614 - RNA, 15 nt, Mycobacterium tuberculosis H37Rv
ccggcuuggccuuug

SEQ ID NO: 3247615 - RNA, 17 nt, Mycobacterium tuberculosis H37Rv
ccggcuuggccuuugcc

SEQ ID NO: 3247616 - RNA, 21 nt, Mycobacterium tuberculosis H37Rv
ccggcuuggccuuugccgucg

SEQ ID NO: 3247617 - RNA, 17 nt, Mycobacterium tuberculosis H37Rv
ccggcuuggcggcgauc

SEQ ID NO: 3247618 - RNA, 14 nt, Mycobacterium tuberculosis H37Rv
ccggcuugggccag

SEQ ID NO: 3247619 - RNA, 16 nt, Mycobacterium tuberculosis H37Rv
ccggcuugggccaggc

SEQ ID NO: 3247620 - RNA, 17 nt, Mycobacterium tuberculosis H37Rv
ccggcuugggccaggcc

SEQ ID NO: 3247621 - RNA, 21 nt, Mycobacterium tuberculosis H37Rv
ccggcuugggccaggcccagc

SEQ ID NO: 3247622 - RNA, 16 nt, Mycobacterium tuberculosis H37Rv
ccggcuugggcgguag

SEQ ID NO: 3247623 - RNA, 18 nt, Mycobacterium tuberculosis H37Rv
ccggcuuguccgugagca

SEQ ID NO: 3247624 - RNA, 21 nt, Mycobacterium tuberculosis H37Rv
ccggcuugucgaccacgaccg

SEQ ID NO: 3247625 - RNA, 14 nt, Mycobacterium tuberculosis H37Rv
ccgggaaacaccgg

SEQ ID NO: 3247626 - RNA, 15 nt, Mycobacterium tuberculosis H37Rv
ccgggaaacaccggc

SEQ ID NO: 3247627 - RNA, 21 nt, Mycobacterium tuberculosis H37Rv
ccgggaaaguuguaucgcagc

SEQ ID NO: 3247628 - RNA, 22 nt, Mycobacterium tuberculosis H37Rv
ccgggaacgccucaggggcgcc

SEQ ID NO: 3247629 - RNA, 21 nt, Mycobacterium tuberculosis H37Rv
ccgggaagccguuuucgaaac

SEQ ID NO: 3247630 - RNA, 15 nt, Mycobacterium tuberculosis H37Rv
ccgggaaggaaccgg

SEQ ID NO: 3247631 - RNA, 19 nt, Mycobacterium tuberculosis H37Rv
ccgggaaggaaccgggcaa

SEQ ID NO: 3247632 - RNA, 23 nt, Mycobacterium tuberculosis H37Rv
ccgggaauggacaggucgggcag

SEQ ID NO: 3247633 - RNA, 14 nt, Mycobacterium tuberculosis H37Rv
ccgggaauggcgac

SEQ ID NO: 3247634 - RNA, 16 nt, Mycobacterium tuberculosis H37Rv
ccgggaauuucgacac

SEQ ID NO: 3247635 - RNA, 23 nt, Mycobacterium tuberculosis H37Rv
ccgggacaaguucgguagcgauc

SEQ ID NO: 3247636 - RNA, 17 nt, Mycobacterium tuberculosis H37Rv
ccgggacaaucucggcc

SEQ ID NO: 3247637 - RNA, 19 nt, Mycobacterium tuberculosis H37Rv
ccgggacaaucucggccgc

SEQ ID NO: 3247638 - RNA, 20 nt, Mycobacterium tuberculosis H37Rv
ccgggacaaucucggccgca

SEQ ID NO: 3247639 - RNA, 19 nt, Mycobacterium tuberculosis H37Rv
ccgggacagcagccggauc

SEQ ID NO: 3247640 - RNA, 12 nt, Mycobacterium tuberculosis H37Rv
ccgggaccgcga

SEQ ID NO: 3247641 - RNA, 14 nt, Mycobacterium tuberculosis H37Rv
ccgggaccgcgaac

SEQ ID NO: 3247642 - RNA, 14 nt, Mycobacterium tuberculosis H37Rv
ccgggacgugucgg

SEQ ID NO: 3247643 - RNA, 17 nt, Mycobacterium tuberculosis H37Rv
ccgggaggacaccagcu

SEQ ID NO: 3247644 - RNA, 22 nt, Mycobacterium tuberculosis H37Rv
ccgggaggccggcuaccgcgcu

SEQ ID NO: 3247645 - RNA, 22 nt, Mycobacterium tuberculosis H37Rv
ccgggagucgacggugccgucg

SEQ ID NO: 3247646 - RNA, 14 nt, Mycobacterium tuberculosis H37Rv
ccgggagucgucgg

SEQ ID NO: 3247647 - RNA, 20 nt, Mycobacterium tuberculosis H37Rv
ccgggauaacccagcaccac

SEQ ID NO: 3247648 - RNA, 20 nt, Mycobacterium tuberculosis H37Rv
ccgggauagccgcgaccaga

SEQ ID NO: 3247649 - RNA, 19 nt, Mycobacterium tuberculosis H37Rv
ccgggauaguuuucggccg

SEQ ID NO: 3247650 - RNA, 22 nt, Mycobacterium tuberculosis H37Rv
ccgggaucgggucaccgugcgg

SEQ ID NO: 3247651 - RNA, 20 nt, Mycobacterium tuberculosis H37Rv
ccgggaucucgaaggccgcc

SEQ ID NO: 3247652 - RNA, 16 nt, Mycobacterium tuberculosis H37Rv
ccgggaugccgccgcu

SEQ ID NO: 3247653 - RNA, 18 nt, Mycobacterium tuberculosis H37Rv
ccgggaugugcggcugca

SEQ ID NO: 3247654 - RNA, 16 nt, Mycobacterium tuberculosis H37Rv
ccgggauugccgucgg

SEQ ID NO: 3247655 - RNA, 17 nt, Mycobacterium tuberculosis H37Rv
ccgggcaaaucaagcac

SEQ ID NO: 3247656 - RNA, 19 nt, Mycobacterium tuberculosis H37Rv
ccgggcaaaucaagcacag

SEQ ID NO: 3247657 - RNA, 21 nt, Mycobacterium tuberculosis H37Rv
ccgggcaaaucaagcacagcc

SEQ ID NO: 3247658 - RNA, 13 nt, Mycobacterium tuberculosis H37Rv
ccgggcaaccagc

SEQ ID NO: 3247659 - RNA, 22 nt, Mycobacterium tuberculosis H37Rv
ccgggcaaccagcagcagguug

SEQ ID NO: 3247660 - RNA, 20 nt, Mycobacterium tuberculosis H37Rv
ccgggcaacgcgaaccggcc

SEQ ID NO: 3247661 - RNA, 14 nt, Mycobacterium tuberculosis H37Rv
ccgggcaaggccac

SEQ ID NO: 3247662 - RNA, 22 nt, Mycobacterium tuberculosis H37Rv
ccgggcaauacguagucgccga

SEQ ID NO: 3247663 - RNA, 12 nt, Mycobacterium tuberculosis H37Rv
ccgggcaccacc

SEQ ID NO: 3247664 - RNA, 22 nt, Mycobacterium tuberculosis H37Rv
ccgggcacccuugccgauuccg

SEQ ID NO: 3247665 - RNA, 18 nt, Mycobacterium tuberculosis H37Rv
ccgggcacugugauuucg

SEQ ID NO: 3247666 - RNA, 17 nt, Mycobacterium tuberculosis H37Rv
ccgggcagaugaugccg

SEQ ID NO: 3247667 - RNA, 18 nt, Mycobacterium tuberculosis H37Rv
ccgggcagaugaugccgu

SEQ ID NO: 3247668 - RNA, 14 nt, Mycobacterium tuberculosis H37Rv
ccgggcagccccuc

SEQ ID NO: 3247669 - RNA, 17 nt, Mycobacterium tuberculosis H37Rv
ccgggcagccgcgccgc

SEQ ID NO: 3247670 - RNA, 19 nt, Mycobacterium tuberculosis H37Rv
ccgggcaguucacgguuga

SEQ ID NO: 3247671 - RNA, 17 nt, Mycobacterium tuberculosis H37Rv
ccgggcaguuuggcggc

SEQ ID NO: 3247672 - RNA, 18 nt, Mycobacterium tuberculosis H37Rv
ccgggcaguuuggcggca

SEQ ID NO: 3247673 - RNA, 20 nt, Mycobacterium tuberculosis H37Rv
ccgggcaguuuggcggcagg

SEQ ID NO: 3247674 - RNA, 24 nt, Mycobacterium tuberculosis H37Rv
ccgggcauccuucaccagcugcga

SEQ ID NO: 3247675 - RNA, 17 nt, Mycobacterium tuberculosis H37Rv
ccgggcaugaucacacu

SEQ ID NO: 3247676 - RNA, 20 nt, Mycobacterium tuberculosis H37Rv
ccgggcaugaucacacugcc

SEQ ID NO: 3247677 - RNA, 12 nt, Mycobacterium tuberculosis H37Rv
ccgggccaagac

SEQ ID NO: 3247678 - RNA, 17 nt, Mycobacterium tuberculosis H37Rv
ccgggccacgucgagca

SEQ ID NO: 3247679 - RNA, 22 nt, Mycobacterium tuberculosis H37Rv
ccgggccagaucgaagcgcagc

SEQ ID NO: 3247680 - RNA, 18 nt, Mycobacterium tuberculosis H37Rv
ccgggccaggccgaugcc

SEQ ID NO: 3247681 - RNA, 21 nt, Mycobacterium tuberculosis H37Rv
ccgggccaucgcauccccagc

SEQ ID NO: 3247682 - RNA, 20 nt, Mycobacterium tuberculosis H37Rv
ccgggccauucaccgcgcac

SEQ ID NO: 3247683 - RNA, 16 nt, Mycobacterium tuberculosis H37Rv
ccgggcccgccguccc

SEQ ID NO: 3247684 - RNA, 20 nt, Mycobacterium tuberculosis H37Rv
ccgggcccgccguccccgcc

SEQ ID NO: 3247685 - RNA, 14 nt, Mycobacterium tuberculosis H37Rv
ccgggcccgcguuc

SEQ ID NO: 3247686 - RNA, 20 nt, Mycobacterium tuberculosis H37Rv
ccgggcccgcguucucggca

SEQ ID NO: 3247687 - RNA, 16 nt, Mycobacterium tuberculosis H37Rv
ccgggcccgucggaca

SEQ ID NO: 3247688 - RNA, 17 nt, Mycobacterium tuberculosis H37Rv
ccgggcccgucggacau

SEQ ID NO: 3247689 - RNA, 22 nt, Mycobacterium tuberculosis H37Rv
ccggguaaagcgaugggaacgg

SEQ ID NO: 3247690 - RNA, 14 nt, Mycobacterium tuberculosis H37Rv
ccggguacggcgua

SEQ ID NO: 3247691 - RNA, 15 nt, Mycobacterium tuberculosis H37Rv
ccggguagacaccgc

SEQ ID NO: 3247692 - RNA, 18 nt, Mycobacterium tuberculosis H37Rv
ccggguagccggcgugca

SEQ ID NO: 3247693 - RNA, 16 nt, Mycobacterium tuberculosis H37Rv
ccggguagcggcgccg

SEQ ID NO: 3247694 - RNA, 18 nt, Mycobacterium tuberculosis H37Rv
ccggguagcggcgccgcc

SEQ ID NO: 3247695 - RNA, 19 nt, Mycobacterium tuberculosis H37Rv
ccggguagcggcgccgccc

SEQ ID NO: 3247696 - RNA, 19 nt, Mycobacterium tuberculosis H37Rv
ccggguagcucccugggcg

SEQ ID NO: 3247697 - RNA, 14 nt, Mycobacterium tuberculosis H37Rv
ccggguaucgccag

SEQ ID NO: 3247698 - RNA, 14 nt, Mycobacterium tuberculosis H37Rv
ccggguauuaccgc

SEQ ID NO: 3247699 - RNA, 18 nt, Mycobacterium tuberculosis H37Rv
ccgggucaccagcgcauc

SEQ ID NO: 3247700 - RNA, 16 nt, Mycobacterium tuberculosis H37Rv
ccgggucagcccagcc

SEQ ID NO: 3247701 - RNA, 20 nt, Mycobacterium tuberculosis H37Rv
ccgggucagcccggcgcgau

SEQ ID NO: 3247702 - RNA, 15 nt, Mycobacterium tuberculosis H37Rv
ccgggucagcgaccu

SEQ ID NO: 3247703 - RNA, 13 nt, Mycobacterium tuberculosis H37Rv
ccggguccaccgc

SEQ ID NO: 3247704 - RNA, 22 nt, Mycobacterium tuberculosis H37Rv
ccgggucccauuugccuugagc

SEQ ID NO: 3247705 - RNA, 17 nt, Mycobacterium tuberculosis H37Rv
ccggguccgccguugcc

SEQ ID NO: 3247706 - RNA, 19 nt, Mycobacterium tuberculosis H37Rv
ccggguccggugaacccga

SEQ ID NO: 3247707 - RNA, 13 nt, Mycobacterium tuberculosis H37Rv
ccggguccuugcg

SEQ ID NO: 3247708 - RNA, 22 nt, Mycobacterium tuberculosis H37Rv
ccgggucgaacuugaucaccgc

SEQ ID NO: 3247709 - RNA, 14 nt, Mycobacterium tuberculosis H37Rv
ccgggucgacgacg

SEQ ID NO: 3247710 - RNA, 18 nt, Mycobacterium tuberculosis H37Rv
ccgggucgacgacgucgc

SEQ ID NO: 3247711 - RNA, 14 nt, Mycobacterium tuberculosis H37Rv
ccgggucgauuucg

SEQ ID NO: 3247712 - RNA, 18 nt, Mycobacterium tuberculosis H37Rv
ccgggucgauuucgccgg

SEQ ID NO: 3247713 - RNA, 19 nt, Mycobacterium tuberculosis H37Rv
ccgggucgccgaugacggu

SEQ ID NO: 3247714 - RNA, 17 nt, Mycobacterium tuberculosis H37Rv
ccgggucggcacgaccc

SEQ ID NO: 3247715 - RNA, 13 nt, Mycobacterium tuberculosis H37Rv
ccgggucggccgg

SEQ ID NO: 3247716 - RNA, 21 nt, Mycobacterium tuberculosis H37Rv
ccgggucgggcaccgcgcgcu

SEQ ID NO: 3247717 - RNA, 21 nt, Mycobacterium tuberculosis H37Rv
ccgggucguagccgaacccgc

SEQ ID NO: 3247718 - RNA, 17 nt, Mycobacterium tuberculosis H37Rv
ccgggucuccggcgcac

SEQ ID NO: 3247719 - RNA, 21 nt, Mycobacterium tuberculosis H37Rv
ccgggucuuccggugcgccga

SEQ ID NO: 3247720 - RNA, 22 nt, Mycobacterium tuberculosis H37Rv
ccgggugacccgccaacgccau

SEQ ID NO: 3247721 - RNA, 16 nt, Mycobacterium tuberculosis H37Rv
ccgggugacccgugcg

SEQ ID NO: 3247722 - RNA, 21 nt, Mycobacterium tuberculosis H37Rv
ccgggugaggcgggucgccgc

SEQ ID NO: 3247723 - RNA, 23 nt, Mycobacterium tuberculosis H37Rv
ccgggugcaacggcguuggcgcc

SEQ ID NO: 3247724 - RNA, 13 nt, Mycobacterium tuberculosis H37Rv
ccgggugcagauc

SEQ ID NO: 3247725 - RNA, 15 nt, Mycobacterium tuberculosis H37Rv
ccgggugccacaacc

SEQ ID NO: 3247726 - RNA, 13 nt, Mycobacterium tuberculosis H37Rv
ccgggugccgcgc

SEQ ID NO: 3247727 - RNA, 19 nt, Mycobacterium tuberculosis H37Rv
ccgggugcgacgcgaccgc

SEQ ID NO: 3247728 - RNA, 21 nt, Mycobacterium tuberculosis H37Rv
ccgggugcgacgcgaccgcga

SEQ ID NO: 3247729 - RNA, 20 nt, Mycobacterium tuberculosis H37Rv
ccgggugcgacggcguugcc

SEQ ID NO: 3247730 - RNA, 16 nt, Mycobacterium tuberculosis H37Rv
ccgggugcgccguugc

SEQ ID NO: 3247731 - RNA, 21 nt, Mycobacterium tuberculosis H37Rv
ccggguggccacgcccaggca

SEQ ID NO: 3247732 - RNA, 12 nt, Mycobacterium tuberculosis H37Rv
ccggguggcggc

SEQ ID NO: 3247733 - RNA, 16 nt, Mycobacterium tuberculosis H37Rv
ccggguggcggcggcg

SEQ ID NO: 3247734 - RNA, 18 nt, Mycobacterium tuberculosis H37Rv
ccggguggcgucaccgcc

SEQ ID NO: 3247735 - RNA, 19 nt, Mycobacterium tuberculosis H37Rv
ccggguggcgucgaucucg

SEQ ID NO: 3247736 - RNA, 20 nt, Mycobacterium tuberculosis H37Rv
ccgggugggagcagccgaac

SEQ ID NO: 3247737 - RNA, 22 nt, Mycobacterium tuberculosis H37Rv
ccgggugggagcagccgaaccg

SEQ ID NO: 3247738 - RNA, 13 nt, Mycobacterium tuberculosis H37Rv
ccgggugggccag

SEQ ID NO: 3247739 - RNA, 18 nt, Mycobacterium tuberculosis H37Rv
ccggguguggucgguggc

SEQ ID NO: 3247740 - RNA, 13 nt, Mycobacterium tuberculosis H37Rv
ccggguucaccga

SEQ ID NO: 3247741 - RNA, 19 nt, Mycobacterium tuberculosis H37Rv
ccggguuccagcggcaccg

SEQ ID NO: 3247742 - RNA, 20 nt, Mycobacterium tuberculosis H37Rv
ccggguuccagcggcaccgc

SEQ ID NO: 3247743 - RNA, 14 nt, Mycobacterium tuberculosis H37Rv
ccggguugagccgc

SEQ ID NO: 3247744 - RNA, 19 nt, Mycobacterium tuberculosis H37Rv
ccggguugagccgccgcga

SEQ ID NO: 3247745 - RNA, 20 nt, Mycobacterium tuberculosis H37Rv
ccggguugguacccaccagg

SEQ ID NO: 3247746 - RNA, 14 nt, Mycobacterium tuberculosis H37Rv
ccggguuugaucag

SEQ ID NO: 3247747 - RNA, 19 nt, Mycobacterium tuberculosis H37Rv
ccggguuugaucagcucgg

SEQ ID NO: 3247748 - RNA, 18 nt, Mycobacterium tuberculosis H37Rv
ccggguuuuccaucuuca

SEQ ID NO: 3247749 - RNA, 15 nt, Mycobacterium tuberculosis H37Rv
ccgguaacgaacagc

SEQ ID NO: 3247750 - RNA, 16 nt, Mycobacterium tuberculosis H37Rv
ccgguaauccguugcc

SEQ ID NO: 3247751 - RNA, 18 nt, Mycobacterium tuberculosis H37Rv
ccgguacaacccccaggc

SEQ ID NO: 3247752 - RNA, 16 nt, Mycobacterium tuberculosis H37Rv
ccgguacacguccagu

SEQ ID NO: 3247753 - RNA, 20 nt, Mycobacterium tuberculosis H37Rv
ccgguacccguagcaccaca

SEQ ID NO: 3247754 - RNA, 13 nt, Mycobacterium tuberculosis H37Rv
ccgguaccgccac

SEQ ID NO: 3247755 - RNA, 21 nt, Mycobacterium tuberculosis H37Rv
ccgguaccgccggcuccgccg

SEQ ID NO: 3247756 - RNA, 18 nt, Mycobacterium tuberculosis H37Rv
ccgguaccggcgacgaau

SEQ ID NO: 3247757 - RNA, 12 nt, Mycobacterium tuberculosis H37Rv
ccgguacgccgc

SEQ ID NO: 3247758 - RNA, 20 nt, Mycobacterium tuberculosis H37Rv
ccgguagaucuucggccgca

SEQ ID NO: 3247759 - RNA, 14 nt, Mycobacterium tuberculosis H37Rv
ccgguagcacagca

SEQ ID NO: 3247760 - RNA, 12 nt, Mycobacterium tuberculosis H37Rv
ccgguagccggg

SEQ ID NO: 3247761 - RNA, 18 nt, Mycobacterium tuberculosis H37Rv
ccgguagcggcggcauga

SEQ ID NO: 3247762 - RNA, 16 nt, Mycobacterium tuberculosis H37Rv
ccgguaggcggccagc

SEQ ID NO: 3247763 - RNA, 17 nt, Mycobacterium tuberculosis H37Rv
ccgguaggcggccagcg

SEQ ID NO: 3247764 - RNA, 16 nt, Mycobacterium tuberculosis H37Rv
ccgguaguacuagcac

SEQ ID NO: 3247765 - RNA, 16 nt, Mycobacterium tuberculosis H37Rv
ccgguaguagcugacc

SEQ ID NO: 3247766 - RNA, 15 nt, Mycobacterium tuberculosis H37Rv
ccgguaguccgcgcu

SEQ ID NO: 3247767 - RNA, 13 nt, Mycobacterium tuberculosis H37Rv
ccgguaucggcga

SEQ ID NO: 3247768 - RNA, 14 nt, Mycobacterium tuberculosis H37Rv
ccgguaucggcgac

SEQ ID NO: 3247769 - RNA, 16 nt, Mycobacterium tuberculosis H37Rv
ccgguaugcgccaucu

SEQ ID NO: 3247770 - RNA, 22 nt, Mycobacterium tuberculosis H37Rv
ccgguaugcgccaucucgacgg

SEQ ID NO: 3247771 - RNA, 18 nt, Mycobacterium tuberculosis H37Rv
ccggucaccucgccggcg

SEQ ID NO: 3247772 - RNA, 13 nt, Mycobacterium tuberculosis H37Rv
ccggucacgacgu

SEQ ID NO: 3247773 - RNA, 13 nt, Mycobacterium tuberculosis H37Rv
ccggucacgucga

SEQ ID NO: 3247774 - RNA, 22 nt, Mycobacterium tuberculosis H37Rv
ccggucagcaauacggcggcgc

SEQ ID NO: 3247775 - RNA, 15 nt, Mycobacterium tuberculosis H37Rv
ccggucagcacaugg

SEQ ID NO: 3247776 - RNA, 21 nt, Mycobacterium tuberculosis H37Rv
ccggucagccggaccaccagg

SEQ ID NO: 3247777 - RNA, 12 nt, Mycobacterium tuberculosis H37Rv
ccggucagcgac

SEQ ID NO: 3247778 - RNA, 23 nt, Mycobacterium tuberculosis H37Rv
ccggucagcgacgcacgcaguuc

SEQ ID NO: 3247779 - RNA, 18 nt, Mycobacterium tuberculosis H37Rv
ccggucagcgcgcggcuc

SEQ ID NO: 3247780 - RNA, 16 nt, Mycobacterium tuberculosis H37Rv
ccggucagcgcggcga

SEQ ID NO: 3247781 - RNA, 17 nt, Mycobacterium tuberculosis H37Rv
ccggucagcgcggcgca

SEQ ID NO: 3247782 - RNA, 19 nt, Mycobacterium tuberculosis H37Rv
ccggucagcgcggcgcaca

SEQ ID NO: 3247783 - RNA, 23 nt, Mycobacterium tuberculosis H37Rv
ccggucaggcaguccaccgcgcg

SEQ ID NO: 3247784 - RNA, 18 nt, Mycobacterium tuberculosis H37Rv
ccggucauaccaagcgcg

SEQ ID NO: 3247785 - RNA, 16 nt, Mycobacterium tuberculosis H37Rv
ccggugccgggcacca

SEQ ID NO: 3247786 - RNA, 21 nt, Mycobacterium tuberculosis H37Rv
ccggugccggucgagugccuc

SEQ ID NO: 3247787 - RNA, 13 nt, Mycobacterium tuberculosis H37Rv
ccggugccguugg

SEQ ID NO: 3247788 - RNA, 19 nt, Mycobacterium tuberculosis H37Rv
ccggugccguuggagccgc

SEQ ID NO: 3247789 - RNA, 24 nt, Mycobacterium tuberculosis H37Rv
ccggugccguuggagccgccaccg

SEQ ID NO: 3247790 - RNA, 15 nt, Mycobacterium tuberculosis H37Rv
ccggugccugcaacg

SEQ ID NO: 3247791 - RNA, 16 nt, Mycobacterium tuberculosis H37Rv
ccggugcgcagguacg

SEQ ID NO: 3247792 - RNA, 16 nt, Mycobacterium tuberculosis H37Rv
ccggugcgcauccguc

SEQ ID NO: 3247793 - RNA, 19 nt, Mycobacterium tuberculosis H37Rv
ccggugcggaucugcugcg

SEQ ID NO: 3247794 - RNA, 22 nt, Mycobacterium tuberculosis H37Rv
ccggugcggccaaugacgucgg

SEQ ID NO: 3247795 - RNA, 17 nt, Mycobacterium tuberculosis H37Rv
ccggugcuaaccgacgc

SEQ ID NO: 3247796 - RNA, 22 nt, Mycobacterium tuberculosis H37Rv
ccggugcuaaccgacgcugaag

SEQ ID NO: 3247797 - RNA, 19 nt, Mycobacterium tuberculosis H37Rv
ccggugcucaagcgcgucg

SEQ ID NO: 3247798 - RNA, 17 nt, Mycobacterium tuberculosis H37Rv
ccggugcuccucggcag

SEQ ID NO: 3247799 - RNA, 19 nt, Mycobacterium tuberculosis H37Rv
ccggugcuccucggcaggc

SEQ ID NO: 3247800 - RNA, 18 nt, Mycobacterium tuberculosis H37Rv
ccggugcucgucgagcau

SEQ ID NO: 3247801 - RNA, 22 nt, Mycobacterium tuberculosis H37Rv
ccggugcucgucgagcaugcga

SEQ ID NO: 3247802 - RNA, 16 nt, Mycobacterium tuberculosis H37Rv
ccggugcugguccagg

SEQ ID NO: 3247803 - RNA, 21 nt, Mycobacterium tuberculosis H37Rv
ccggugcugguccaggcggug

SEQ ID NO: 3247804 - RNA, 22 nt, Mycobacterium tuberculosis H37Rv
ccgguggaaaagccacggcugc

SEQ ID NO: 3247805 - RNA, 23 nt, Mycobacterium tuberculosis H37Rv
ccgguggcagagccgccguugcc

SEQ ID NO: 3247806 - RNA, 12 nt, Mycobacterium tuberculosis H37Rv
ccgguggcagca

SEQ ID NO: 3247807 - RNA, 19 nt, Mycobacterium tuberculosis H37Rv
ccgguggcagcacagcguc

SEQ ID NO: 3247808 - RNA, 12 nt, Mycobacterium tuberculosis H37Rv
ccgguggcagcc

SEQ ID NO: 3247809 - RNA, 19 nt, Mycobacterium tuberculosis H37Rv
ccgguggcagccugcugca

SEQ ID NO: 3247810 - RNA, 16 nt, Mycobacterium tuberculosis H37Rv
ccgguggcagggaacc

SEQ ID NO: 3247811 - RNA, 22 nt, Mycobacterium tuberculosis H37Rv
ccgguggcagggaaccauugcc

SEQ ID NO: 3247812 - RNA, 13 nt, Mycobacterium tuberculosis H37Rv
ccgguggccaaca

SEQ ID NO: 3247813 - RNA, 15 nt, Mycobacterium tuberculosis H37Rv
ccgguggccaacacc

SEQ ID NO: 3247814 - RNA, 19 nt, Mycobacterium tuberculosis H37Rv
ccgguggcgccgccgccaa

SEQ ID NO: 3247815 - RNA, 19 nt, Mycobacterium tuberculosis H37Rv
ccgguggcgccggggccgc

SEQ ID NO: 3247816 - RNA, 21 nt, Mycobacterium tuberculosis H37Rv
ccgguggcugaucaccguugc

SEQ ID NO: 3247817 - RNA, 19 nt, Mycobacterium tuberculosis H37Rv
ccggugggcggcucgucga

SEQ ID NO: 3247818 - RNA, 22 nt, Mycobacterium tuberculosis H37Rv
ccgguggggacccgcuccaagc

SEQ ID NO: 3247819 - RNA, 22 nt, Mycobacterium tuberculosis H37Rv
ccgguggggauagccgcgucgc

SEQ ID NO: 3247820 - RNA, 19 nt, Mycobacterium tuberculosis H37Rv
ccgguggggucggucuggc

SEQ ID NO: 3247821 - RNA, 22 nt, Mycobacterium tuberculosis H37Rv
ccgguggggucggucuggcugg

SEQ ID NO: 3247822 - RNA, 15 nt, Mycobacterium tuberculosis H37Rv
ccgguggucaggaac

SEQ ID NO: 3247823 - RNA, 23 nt, Mycobacterium tuberculosis H37Rv
ccgguggugaggaucauggcguc

SEQ ID NO: 3247824 - RNA, 15 nt, Mycobacterium tuberculosis H37Rv
ccgguggugccggcg

SEQ ID NO: 3247825 - RNA, 21 nt, Mycobacterium tuberculosis H37Rv
ccgguggugcucgucgguguc

SEQ ID NO: 3247826 - RNA, 15 nt, Mycobacterium tuberculosis H37Rv
ccggugguggcgacc

SEQ ID NO: 3247827 - RNA, 18 nt, Mycobacterium tuberculosis H37Rv
ccggugguggcgaccccg

SEQ ID NO: 3247828 - RNA, 22 nt, Mycobacterium tuberculosis H37Rv
ccgguggugggccguggguguc

SEQ ID NO: 3247829 - RNA, 16 nt, Mycobacterium tuberculosis H37Rv
ccgguggugucgguuc

SEQ ID NO: 3247830 - RNA, 16 nt, Mycobacterium tuberculosis H37Rv
ccgguguaauugccga

SEQ ID NO: 3247831 - RNA, 19 nt, Mycobacterium tuberculosis H37Rv
ccgguguaauugccgacgc

SEQ ID NO: 3247832 - RNA, 20 nt, Mycobacterium tuberculosis H37Rv
ccgguguagcagcgccagca

SEQ ID NO: 3247833 - RNA, 16 nt, Mycobacterium tuberculosis H37Rv
ccgguguaggccucgg

SEQ ID NO: 3247834 - RNA, 19 nt, Mycobacterium tuberculosis H37Rv
ccgguguaggccucggcag

SEQ ID NO: 3247835 - RNA, 21 nt, Mycobacterium tuberculosis H37Rv
ccgguguaggccucggcagca

SEQ ID NO: 3247836 - RNA, 20 nt, Mycobacterium tuberculosis H37Rv
ccgguguaguacagcgcaac

SEQ ID NO: 3247837 - RNA, 15 nt, Mycobacterium tuberculosis H37Rv
ccgguguccagccac

SEQ ID NO: 3247838 - RNA, 20 nt, Mycobacterium tuberculosis H37Rv
ccggugucguucggcgagga

SEQ ID NO: 3247839 - RNA, 17 nt, Mycobacterium tuberculosis H37Rv
ccggugucucccuugcc

SEQ ID NO: 3247840 - RNA, 22 nt, Mycobacterium tuberculosis H37Rv
ccggugucucccuugccgccau

SEQ ID NO: 3247841 - RNA, 21 nt, Mycobacterium tuberculosis H37Rv
ccggugucuggguggacaggu

SEQ ID NO: 3247842 - RNA, 20 nt, Mycobacterium tuberculosis H37Rv
ccggugugcgccaaggucug

SEQ ID NO: 3247843 - RNA, 16 nt, Mycobacterium tuberculosis H37Rv
ccgguguguccagcgg

SEQ ID NO: 3247844 - RNA, 22 nt, Mycobacterium tuberculosis H37Rv
ccgguguucaucacgccgccgg

SEQ ID NO: 3247845 - RNA, 15 nt, Mycobacterium tuberculosis H37Rv
ccgguguugccgccg

SEQ ID NO: 3247846 - RNA, 16 nt, Mycobacterium tuberculosis H37Rv
ccgguguugccgccgg

SEQ ID NO: 3247847 - RNA, 15 nt, Mycobacterium tuberculosis H37Rv
ccgguguugccguga

SEQ ID NO: 3247848 - RNA, 14 nt, Mycobacterium tuberculosis H37Rv
ccgguguugccguu

SEQ ID NO: 3247849 - RNA, 23 nt, Mycobacterium tuberculosis H37Rv
ccgguguuguaggccgggccggc

SEQ ID NO: 3247850 - RNA, 19 nt, Mycobacterium tuberculosis H37Rv
ccgguguuuccgaaacccg

SEQ ID NO: 3247851 - RNA, 24 nt, Mycobacterium tuberculosis H37Rv
ccgguuaauggaaugaucggcguc

SEQ ID NO: 3247852 - RNA, 17 nt, Mycobacterium tuberculosis H37Rv
ccgguuauggcauucga

SEQ ID NO: 3247853 - RNA, 13 nt, Mycobacterium tuberculosis H37Rv
ccgguucaccaug

SEQ ID NO: 3247854 - RNA, 18 nt, Mycobacterium tuberculosis H37Rv
ccgguucagggguggcgc

SEQ ID NO: 3247855 - RNA, 22 nt, Mycobacterium tuberculosis H37Rv
ccgguuccgcaaugaccuggcc

SEQ ID NO: 3247856 - RNA, 13 nt, Mycobacterium tuberculosis H37Rv
ccgguuccucagc

SEQ ID NO: 3247857 - RNA, 22 nt, Mycobacterium tuberculosis H37Rv
ccgguucgauggcaucggccau

SEQ ID NO: 3247858 - RNA, 15 nt, Mycobacterium tuberculosis H37Rv
ccgguucgcccagca

SEQ ID NO: 3247859 - RNA, 21 nt, Mycobacterium tuberculosis H37Rv
ccgguucggggggcaggucga

SEQ ID NO: 3247860 - RNA, 20 nt, Mycobacterium tuberculosis H37Rv
ccgguucugggccugcggca

SEQ ID NO: 3247861 - RNA, 17 nt, Mycobacterium tuberculosis H37Rv
ccgguugacgggcucgg

SEQ ID NO: 3247862 - RNA, 19 nt, Mycobacterium tuberculosis H37Rv
ccgguugaugguccgccag

SEQ ID NO: 3247863 - RNA, 21 nt, Mycobacterium tuberculosis H37Rv
ccgguugccaccugugcgaac

SEQ ID NO: 3247864 - RNA, 20 nt, Mycobacterium tuberculosis H37Rv
ccgguugccguugcccucgg

SEQ ID NO: 3247865 - RNA, 20 nt, Mycobacterium tuberculosis H37Rv
ccgguugcggucaucggcgc

SEQ ID NO: 3247866 - RNA, 14 nt, Mycobacterium tuberculosis H37Rv
ccgguuggacugac

SEQ ID NO: 3247867 - RNA, 15 nt, Mycobacterium tuberculosis H37Rv
ccgguuggccagcca

SEQ ID NO: 3247868 - RNA, 20 nt, Mycobacterium tuberculosis H37Rv
ccgguugucgcagcgcacac

SEQ ID NO: 3247869 - RNA, 19 nt, Mycobacterium tuberculosis H37Rv
ccgguuguggaaccacggc

SEQ ID NO: 3247870 - RNA, 17 nt, Mycobacterium tuberculosis H37Rv
ccgguuucuucggccag

SEQ ID NO: 3247871 - RNA, 13 nt, Mycobacterium tuberculosis H37Rv
ccgguuugacguc

SEQ ID NO: 3247872 - RNA, 23 nt, Mycobacterium tuberculosis H37Rv
ccgguuugacguccagggccacg

SEQ ID NO: 3247873 - RNA, 21 nt, Mycobacterium tuberculosis H37Rv
ccgguuuggagcucaucgacg

SEQ ID NO: 3247874 - RNA, 16 nt, Mycobacterium tuberculosis H37Rv
ccgguuuugccgugcc

SEQ ID NO: 3247875 - RNA, 21 nt, Mycobacterium tuberculosis H37Rv
ccguaaauaucggggccacug

SEQ ID NO: 3247876 - RNA, 16 nt, Mycobacterium tuberculosis H37Rv
ccguacaaccacccac

SEQ ID NO: 3247877 - RNA, 18 nt, Mycobacterium tuberculosis H37Rv
ccguacaguccacgcgua

SEQ ID NO: 3247878 - RNA, 22 nt, Mycobacterium tuberculosis H37Rv
ccguacaucagcgcgaacgccu

SEQ ID NO: 3247879 - RNA, 15 nt, Mycobacterium tuberculosis H37Rv
ccguaccagcccguc

SEQ ID NO: 3247880 - RNA, 22 nt, Mycobacterium tuberculosis H37Rv
ccgucgagucgacggcaucggg

SEQ ID NO: 3247881 - RNA, 19 nt, Mycobacterium tuberculosis H37Rv
ccgucgauagucgccgucg

SEQ ID NO: 3247882 - RNA, 21 nt, Mycobacterium tuberculosis H37Rv
ccgucgauagucgccgucgcc

SEQ ID NO: 3247883 - RNA, 16 nt, Mycobacterium tuberculosis H37Rv
ccgucgaucaagugcg

SEQ ID NO: 3247884 - RNA, 23 nt, Mycobacterium tuberculosis H37Rv
ccgucgaucaagugcgguccggc

SEQ ID NO: 3247885 - RNA, 15 nt, Mycobacterium tuberculosis H37Rv
ccgucgaucagcggc

SEQ ID NO: 3247886 - RNA, 18 nt, Mycobacterium tuberculosis H37Rv
ccgucgaucagcggcagc

SEQ ID NO: 3247887 - RNA, 16 nt, Mycobacterium tuberculosis H37Rv
ccgucgauguugccga

SEQ ID NO: 3247888 - RNA, 18 nt, Mycobacterium tuberculosis H37Rv
ccgucgauguugccgaga

SEQ ID NO: 3247889 - RNA, 12 nt, Mycobacterium tuberculosis H37Rv
ccgucgauuucg

SEQ ID NO: 3247890 - RNA, 16 nt, Mycobacterium tuberculosis H37Rv
ccgucgauuucgacga

SEQ ID NO: 3247891 - RNA, 13 nt, Mycobacterium tuberculosis H37Rv
ccgucgcaccagc

SEQ ID NO: 3247892 - RNA, 14 nt, Mycobacterium tuberculosis H37Rv
ccgucgcaccagcg

SEQ ID NO: 3247893 - RNA, 23 nt, Mycobacterium tuberculosis H37Rv
ccgucgcagaaaccauucggcga

SEQ ID NO: 3247894 - RNA, 17 nt, Mycobacterium tuberculosis H37Rv
ccgucgcagagguauuc

SEQ ID NO: 3247895 - RNA, 20 nt, Mycobacterium tuberculosis H37Rv
ccgucgcagccagcugaaca

SEQ ID NO: 3247896 - RNA, 14 nt, Mycobacterium tuberculosis H37Rv
ccgucgccaccggu

SEQ ID NO: 3247897 - RNA, 22 nt, Mycobacterium tuberculosis H37Rv
ccgucgccacgcccagcgcccg

SEQ ID NO: 3247898 - RNA, 22 nt, Mycobacterium tuberculosis H37Rv
ccgucgccgaacagcagcccgc

SEQ ID NO: 3247899 - RNA, 12 nt, Mycobacterium tuberculosis H37Rv
ccgucgccgcca

SEQ ID NO: 3247900 - RNA, 14 nt, Mycobacterium tuberculosis H37Rv
ccgucgccgcccgu

SEQ ID NO: 3247901 - RNA, 18 nt, Mycobacterium tuberculosis H37Rv
ccgucgccggugccggua

SEQ ID NO: 3247902 - RNA, 12 nt, Mycobacterium tuberculosis H37Rv
ccgucgccuccg

SEQ ID NO: 3247903 - RNA, 17 nt, Mycobacterium tuberculosis H37Rv
ccgucgcgaaucugcgc

SEQ ID NO: 3247904 - RNA, 15 nt, Mycobacterium tuberculosis H37Rv
ccgucgcgacgucgg

SEQ ID NO: 3247905 - RNA, 17 nt, Mycobacterium tuberculosis H37Rv
ccgucgcgacgucggcc

SEQ ID NO: 3247906 - RNA, 18 nt, Mycobacterium tuberculosis H37Rv
ccgucgcgacgucggccg

SEQ ID NO: 3247907 - RNA, 17 nt, Mycobacterium tuberculosis H37Rv
ccgucgcgcucgcacca

SEQ ID NO: 3247908 - RNA, 15 nt, Mycobacterium tuberculosis H37Rv
ccgucgcggcacgcc

SEQ ID NO: 3247909 - RNA, 15 nt, Mycobacterium tuberculosis H37Rv
ccgucgcggcggcac

SEQ ID NO: 3247910 - RNA, 16 nt, Mycobacterium tuberculosis H37Rv
ccgucgcgucgaccgg

SEQ ID NO: 3247911 - RNA, 18 nt, Mycobacterium tuberculosis H37Rv
ccgucgcuacccgccacg

SEQ ID NO: 3247912 - RNA, 21 nt, Mycobacterium tuberculosis H37Rv
ccgucgcugacgcccuccugg

SEQ ID NO: 3247913 - RNA, 21 nt, Mycobacterium tuberculosis H37Rv
ccgucgcugggaggcgcgguc

SEQ ID NO: 3247914 - RNA, 17 nt, Mycobacterium tuberculosis H37Rv
ccgucggacauaccgcg

SEQ ID NO: 3247915 - RNA, 15 nt, Mycobacterium tuberculosis H37Rv
ccgucggagccggcc

SEQ ID NO: 3247916 - RNA, 22 nt, Mycobacterium tuberculosis H37Rv
ccgucggauggaaggcggccag

SEQ ID NO: 3247917 - RNA, 14 nt, Mycobacterium tuberculosis H37Rv
ccgucggcaccagc

SEQ ID NO: 3247918 - RNA, 19 nt, Mycobacterium tuberculosis H37Rv
ccgucggcaccagcagcca

SEQ ID NO: 3247919 - RNA, 15 nt, Mycobacterium tuberculosis H37Rv
ccgucggccaggcca

SEQ ID NO: 3247920 - RNA, 13 nt, Mycobacterium tuberculosis H37Rv
ccgucggcgaagg

SEQ ID NO: 3247921 - RNA, 19 nt, Mycobacterium tuberculosis H37Rv
ccgucggcgccggcaucga

SEQ ID NO: 3247922 - RNA, 20 nt, Mycobacterium tuberculosis H37Rv
ccgucggcgccucggaccag

SEQ ID NO: 3247923 - RNA, 18 nt, Mycobacterium tuberculosis H37Rv
ccgucggcgcgcaccucg

SEQ ID NO: 3247924 - RNA, 11 nt, Mycobacterium tuberculosis H37Rv
ccgucggcgcu

SEQ ID NO: 3247925 - RNA, 20 nt, Mycobacterium tuberculosis H37Rv
ccgucggcgcucgucgcggc

SEQ ID NO: 3247926 - RNA, 21 nt, Mycobacterium tuberculosis H37Rv
ccgucgggacggccaacaggg

SEQ ID NO: 3247927 - RNA, 20 nt, Mycobacterium tuberculosis H37Rv
ccgucgggcaguuugcgggc

SEQ ID NO: 3247928 - RNA, 15 nt, Mycobacterium tuberculosis H37Rv
ccgucgggcccagcc

SEQ ID NO: 3247929 - RNA, 18 nt, Mycobacterium tuberculosis H37Rv
ccgucgggcccagccgga

SEQ ID NO: 3247930 - RNA, 18 nt, Mycobacterium tuberculosis H37Rv
ccgucgggccgucgggug

SEQ ID NO: 3247931 - RNA, 19 nt, Mycobacterium tuberculosis H37Rv
ccgucggggacauccgcuu

SEQ ID NO: 3247932 - RNA, 22 nt, Mycobacterium tuberculosis H37Rv
ccgucggggguaauugccagcc

SEQ ID NO: 3247933 - RNA, 14 nt, Mycobacterium tuberculosis H37Rv
ccgucggggucggg

SEQ ID NO: 3247934 - RNA, 18 nt, Mycobacterium tuberculosis H37Rv
ccgucggguaggccgccg

SEQ ID NO: 3247935 - RNA, 23 nt, Mycobacterium tuberculosis H37Rv
ccgucgggugcugaugggucagg

SEQ ID NO: 3247936 - RNA, 14 nt, Mycobacterium tuberculosis H37Rv
ccgucggucgccgg

SEQ ID NO: 3247937 - RNA, 16 nt, Mycobacterium tuberculosis H37Rv
ccgucggucgccggug

SEQ ID NO: 3247938 - RNA, 21 nt, Mycobacterium tuberculosis H37Rv
ccgucggugccggggcugccg

SEQ ID NO: 3247939 - RNA, 22 nt, Mycobacterium tuberculosis H37Rv
ccgucguacucggcggccacca

SEQ ID NO: 3247940 - RNA, 21 nt, Mycobacterium tuberculosis H37Rv
ccgucgucaaauuuucguuga

SEQ ID NO: 3247941 - RNA, 19 nt, Mycobacterium tuberculosis H37Rv
ccgucgucaccuucaccgg

SEQ ID NO: 3247942 - RNA, 20 nt, Mycobacterium tuberculosis H37Rv
ccgucgucaccuucaccggg

SEQ ID NO: 3247943 - RNA, 16 nt, Mycobacterium tuberculosis H37Rv
ccgucgucgagcacca

SEQ ID NO: 3247944 - RNA, 23 nt, Mycobacterium tuberculosis H37Rv
ccgucgucgagcaccacccgggc

SEQ ID NO: 3247945 - RNA, 18 nt, Mycobacterium tuberculosis H37Rv
ccgucgucggcguacccg

SEQ ID NO: 3247946 - RNA, 15 nt, Mycobacterium tuberculosis H37Rv
ccgucgucguacggc

SEQ ID NO: 3247947 - RNA, 15 nt, Mycobacterium tuberculosis H37Rv
ccgucgucgucggca

SEQ ID NO: 3247948 - RNA, 17 nt, Mycobacterium tuberculosis H37Rv
ccgucgucgucggcagc

SEQ ID NO: 3247949 - RNA, 20 nt, Mycobacterium tuberculosis H37Rv
ccgucgucgucggcagcguc

SEQ ID NO: 3247950 - RNA, 13 nt, Mycobacterium tuberculosis H37Rv
ccgucgucgugca

SEQ ID NO: 3247951 - RNA, 16 nt, Mycobacterium tuberculosis H37Rv
ccgucgucgugcacga

SEQ ID NO: 3247952 - RNA, 15 nt, Mycobacterium tuberculosis H37Rv
ccgucgugaucggcg

SEQ ID NO: 3247953 - RNA, 21 nt, Mycobacterium tuberculosis H37Rv
ccgucgugcggggguggucuc

SEQ ID NO: 3247954 - RNA, 21 nt, Mycobacterium tuberculosis H37Rv
ccgucguugccggcgaccaug

SEQ ID NO: 3247955 - RNA, 19 nt, Mycobacterium tuberculosis H37Rv
ccgucuccggcgccaccgc

SEQ ID NO: 3247956 - RNA, 12 nt, Mycobacterium tuberculosis H37Rv
ccgucucgacac

SEQ ID NO: 3247957 - RNA, 19 nt, Mycobacterium tuberculosis H37Rv
ccgucucgcaccgcguuga

SEQ ID NO: 3247958 - RNA, 14 nt, Mycobacterium tuberculosis H37Rv
ccgucucgccgcgc

SEQ ID NO: 3247959 - RNA, 18 nt, Mycobacterium tuberculosis H37Rv
ccgucucgcggugcggca

SEQ ID NO: 3247960 - RNA, 14 nt, Mycobacterium tuberculosis H37Rv
ccgucucggcaugc

SEQ ID NO: 3247961 - RNA, 13 nt, Mycobacterium tuberculosis H37Rv
ccgucucggcgac

SEQ ID NO: 3247962 - RNA, 15 nt, Mycobacterium tuberculosis H37Rv
ccgucucggcgaccg

SEQ ID NO: 3247963 - RNA, 16 nt, Mycobacterium tuberculosis H37Rv
ccgucucgucggcaac

SEQ ID NO: 3247964 - RNA, 17 nt, Mycobacterium tuberculosis H37Rv
ccgucucgucggcaaca

SEQ ID NO: 3247965 - RNA, 22 nt, Mycobacterium tuberculosis H37Rv
ccgucugcgacccgggccgcgg

SEQ ID NO: 3247966 - RNA, 17 nt, Mycobacterium tuberculosis H37Rv
ccgucugcuggccgggu

SEQ ID NO: 3247967 - RNA, 15 nt, Mycobacterium tuberculosis H37Rv
ccgucuggccguugc

SEQ ID NO: 3247968 - RNA, 16 nt, Mycobacterium tuberculosis H37Rv
ccgucuuaucggcguc

SEQ ID NO: 3247969 - RNA, 15 nt, Mycobacterium tuberculosis H37Rv
ccgucuuccagccag

SEQ ID NO: 3247970 - RNA, 14 nt, Mycobacterium tuberculosis H37Rv
ccgucuucgccgcc

SEQ ID NO: 3247971 - RNA, 14 nt, Mycobacterium tuberculosis H37Rv
ccgucuuggcccgg

SEQ ID NO: 3247972 - RNA, 16 nt, Mycobacterium tuberculosis H37Rv
ccgucuuggcccgguc

SEQ ID NO: 3247973 - RNA, 23 nt, Mycobacterium tuberculosis H37Rv
ccgucuuguaggacaagugccgg

SEQ ID NO: 3247974 - RNA, 19 nt, Mycobacterium tuberculosis H37Rv
ccgucuuuggugccgagca

SEQ ID NO: 3247975 - RNA, 23 nt, Mycobacterium tuberculosis H37Rv
ccgucuuuggugccgagcagcuu

SEQ ID NO: 3247976 - RNA, 20 nt, Mycobacterium tuberculosis H37Rv
ccguuaccgccguugccgau

SEQ ID NO: 3247977 - RNA, 13 nt, Mycobacterium tuberculosis H37Rv
ccguuagccaggu

SEQ ID NO: 3247978 - RNA, 22 nt, Mycobacterium tuberculosis H37Rv
ccguuagcuuagcugccgucgg

SEQ ID NO: 3247979 - RNA, 14 nt, Mycobacterium tuberculosis H37Rv
ccguucacgcucgu

SEQ ID NO: 3247980 - RNA, 14 nt, Mycobacterium tuberculosis H37Rv
ccguucaugcggcg

SEQ ID NO: 3247981 - RNA, 20 nt, Mycobacterium tuberculosis H37Rv
ccguucccacccacgccgac

SEQ ID NO: 3247982 - RNA, 16 nt, Mycobacterium tuberculosis H37Rv
ccguucccgccggccc

SEQ ID NO: 3247983 - RNA, 15 nt, Mycobacterium tuberculosis H37Rv
ccguuccggcugcuu

SEQ ID NO: 3247984 - RNA, 15 nt, Mycobacterium tuberculosis H37Rv
ccguuccguaucggg

SEQ ID NO: 3247985 - RNA, 19 nt, Mycobacterium tuberculosis H37Rv
ccguucgaccguguaacca

SEQ ID NO: 3247986 - RNA, 18 nt, Mycobacterium tuberculosis H37Rv
ccguucgaggucggcgau

SEQ ID NO: 3247987 - RNA, 16 nt, Mycobacterium tuberculosis H37Rv
ccguucgcccgcccgu

SEQ ID NO: 3247988 - RNA, 17 nt, Mycobacterium tuberculosis H37Rv
ccguucgcccgcccguc

SEQ ID NO: 3247989 - RNA, 17 nt, Mycobacterium tuberculosis H37Rv
ccguucgccgucgguga

SEQ ID NO: 3247990 - RNA, 13 nt, Mycobacterium tuberculosis H37Rv
ccguucgcgucgc

SEQ ID NO: 3247991 - RNA, 16 nt, Mycobacterium tuberculosis H37Rv
ccguucgcgucgccga

SEQ ID NO: 3247992 - RNA, 17 nt, Mycobacterium tuberculosis H37Rv
ccguucgcucagggugu

SEQ ID NO: 3247993 - RNA, 14 nt, Mycobacterium tuberculosis H37Rv
ccguucgcuccccc

SEQ ID NO: 3247994 - RNA, 18 nt, Mycobacterium tuberculosis H37Rv
ccguucggcgcccgcucg

SEQ ID NO: 3247995 - RNA, 12 nt, Mycobacterium tuberculosis H37Rv
ccguucggcugc

SEQ ID NO: 3247996 - RNA, 21 nt, Mycobacterium tuberculosis H37Rv
ccguucucggugaaguggcgc

SEQ ID NO: 3247997 - RNA, 16 nt, Mycobacterium tuberculosis H37Rv
ccguucuggaaccccg

SEQ ID NO: 3247998 - RNA, 20 nt, Mycobacterium tuberculosis H37Rv
ccguucugucccggcgcgcc

SEQ ID NO: 3247999 - RNA, 16 nt, Mycobacterium tuberculosis H37Rv
ccguugaacggcacca

SEQ ID NO: 3248000 - RNA, 21 nt, Mycobacterium tuberculosis H37Rv
ccguugaacggcaccagcggg

SEQ ID NO: 3248001 - RNA, 13 nt, Mycobacterium tuberculosis H37Rv
ccguugaagccca

SEQ ID NO: 3248002 - RNA, 19 nt, Mycobacterium tuberculosis H37Rv
ccguugaccucuucgggca

SEQ ID NO: 3248003 - RNA, 13 nt, Mycobacterium tuberculosis H37Rv
ccguugacgccgu

SEQ ID NO: 3248004 - RNA, 18 nt, Mycobacterium tuberculosis H37Rv
ccguugagcauaugacgu

SEQ ID NO: 3248005 - RNA, 20 nt, Mycobacterium tuberculosis H37Rv
ccguugauaaaaaccuggcc

SEQ ID NO: 3248006 - RNA, 16 nt, Mycobacterium tuberculosis H37Rv
ccguugaugucggcag

SEQ ID NO: 3248007 - RNA, 21 nt, Mycobacterium tuberculosis H37Rv
ccguugccaccggugccggcg

SEQ ID NO: 3248008 - RNA, 18 nt, Mycobacterium tuberculosis H37Rv
ccguugccaccguagccg

SEQ ID NO: 3248009 - RNA, 14 nt, Mycobacterium tuberculosis H37Rv
ccguugcccacguu

SEQ ID NO: 3248010 - RNA, 19 nt, Mycobacterium tuberculosis H37Rv
ccguugcccccauugccgc

SEQ ID NO: 3248011 - RNA, 19 nt, Mycobacterium tuberculosis H37Rv
ccguugcccgacucggccg

SEQ ID NO: 3248012 - RNA, 18 nt, Mycobacterium tuberculosis H37Rv
ccguugccgaucagcccg

SEQ ID NO: 3248013 - RNA, 23 nt, Mycobacterium tuberculosis H37Rv
ccguugccgaucaguccggcguu

SEQ ID NO: 3248014 - RNA, 20 nt, Mycobacterium tuberculosis H37Rv
ccguugccgauccccaggcc

SEQ ID NO: 3248015 - RNA, 15 nt, Mycobacterium tuberculosis H37Rv
ccguugccgcccguc

SEQ ID NO: 3248016 - RNA, 17 nt, Mycobacterium tuberculosis H37Rv
ccguugccgcccguccc

SEQ ID NO: 3248017 - RNA, 18 nt, Mycobacterium tuberculosis H37Rv
ccguugccgccgaagccg

SEQ ID NO: 3248018 - RNA, 15 nt, Mycobacterium tuberculosis H37Rv
ccguugccgccgacg

SEQ ID NO: 3248019 - RNA, 15 nt, Mycobacterium tuberculosis H37Rv
ccguugccgccgccu

SEQ ID NO: 3248020 - RNA, 16 nt, Mycobacterium tuberculosis H37Rv
ccguugccgccgucgc

SEQ ID NO: 3248021 - RNA, 17 nt, Mycobacterium tuberculosis H37Rv
ccguugcgaucgcgugc

SEQ ID NO: 3248022 - RNA, 17 nt, Mycobacterium tuberculosis H37Rv
ccguugcuauucgccag

SEQ ID NO: 3248023 - RNA, 21 nt, Mycobacterium tuberculosis H37Rv
ccguugcugcgcagcggcauc

SEQ ID NO: 3248024 - RNA, 13 nt, Mycobacterium tuberculosis H37Rv
ccguuggagccgc

SEQ ID NO: 3248025 - RNA, 23 nt, Mycobacterium tuberculosis H37Rv
ccguuggcaaugaccccggcguu

SEQ ID NO: 3248026 - RNA, 20 nt, Mycobacterium tuberculosis H37Rv
ccguuggcggcgguggccag

SEQ ID NO: 3248027 - RNA, 13 nt, Mycobacterium tuberculosis H37Rv
ccguugguagccg

SEQ ID NO: 3248028 - RNA, 20 nt, Mycobacterium tuberculosis H37Rv
ccguuggugccgccugugcc

SEQ ID NO: 3248029 - RNA, 16 nt, Mycobacterium tuberculosis H37Rv
ccguugucgucggcgg

SEQ ID NO: 3248030 - RNA, 19 nt, Mycobacterium tuberculosis H37Rv
ccguuguggaccaucuuca

SEQ ID NO: 3248031 - RNA, 15 nt, Mycobacterium tuberculosis H37Rv
ccguuguggccgccu

SEQ ID NO: 3248032 - RNA, 21 nt, Mycobacterium tuberculosis H37Rv
ccguuguggccgccuucgccg

SEQ ID NO: 3248033 - RNA, 15 nt, Mycobacterium tuberculosis H37Rv
ccguuuccgccgccg

SEQ ID NO: 3248034 - RNA, 21 nt, Mycobacterium tuberculosis H37Rv
ccguuuccggcgcuccgccag

SEQ ID NO: 3248035 - RNA, 20 nt, Mycobacterium tuberculosis H37Rv
ccguuucgaucucgagcagg

SEQ ID NO: 3248036 - RNA, 20 nt, Mycobacterium tuberculosis H37Rv
ccuaaaccggcgcuaaaccg

SEQ ID NO: 3248037 - RNA, 19 nt, Mycobacterium tuberculosis H37Rv
ccuaacgaaccagcccgcc

SEQ ID NO: 3248038 - RNA, 14 nt, Mycobacterium tuberculosis H37Rv
ccuaacucgccugc

SEQ ID NO: 3248039 - RNA, 18 nt, Mycobacterium tuberculosis H37Rv
ccuaaggcucaccaggcg

SEQ ID NO: 3248040 - RNA, 16 nt, Mycobacterium tuberculosis H37Rv
ccuaccgagaucaccg

SEQ ID NO: 3248041 - RNA, 17 nt, Mycobacterium tuberculosis H37Rv
ccuaccgagaucaccgc

SEQ ID NO: 3248042 - RNA, 19 nt, Mycobacterium tuberculosis H37Rv
ccuaccgagaucaccgcca

SEQ ID NO: 3248043 - RNA, 22 nt, Mycobacterium tuberculosis H37Rv
ccuaccgagaucaccgccacca

SEQ ID NO: 3248044 - RNA, 22 nt, Mycobacterium tuberculosis H37Rv
ccuaccggcuacggcgacacgc

SEQ ID NO: 3248045 - RNA, 12 nt, Mycobacterium tuberculosis H37Rv
ccuaccgggccc

SEQ ID NO: 3248046 - RNA, 18 nt, Mycobacterium tuberculosis H37Rv
ccuaccguacgcagcgug

SEQ ID NO: 3248047 - RNA, 14 nt, Mycobacterium tuberculosis H37Rv
ccuacggugcaguc

SEQ ID NO: 3248048 - RNA, 19 nt, Mycobacterium tuberculosis H37Rv
ccuacugcggucgcccagg

SEQ ID NO: 3248049 - RNA, 16 nt, Mycobacterium tuberculosis H37Rv
ccuagaccgggcgguu

SEQ ID NO: 3248050 - RNA, 22 nt, Mycobacterium tuberculosis H37Rv
ccuagcaccgcgccgaacacgc

SEQ ID NO: 3248051 - RNA, 23 nt, Mycobacterium tuberculosis H37Rv
ccuagcagggugccggcgccgcc

SEQ ID NO: 3248052 - RNA, 16 nt, Mycobacterium tuberculosis H37Rv
ccuagcaugaggcccg

SEQ ID NO: 3248053 - RNA, 14 nt, Mycobacterium tuberculosis H37Rv
ccuagccgcggcac

SEQ ID NO: 3248054 - RNA, 16 nt, Mycobacterium tuberculosis H37Rv
ccuagccggcgcgccc

SEQ ID NO: 3248055 - RNA, 11 nt, Mycobacterium tuberculosis H37Rv
ccuagcgcggc

SEQ ID NO: 3248056 - RNA, 23 nt, Mycobacterium tuberculosis H37Rv
ccuagcucgcgguuuuggucgcg

SEQ ID NO: 3248057 - RNA, 22 nt, Mycobacterium tuberculosis H37Rv
ccuaggccgaggccgcugccag

SEQ ID NO: 3248058 - RNA, 17 nt, Mycobacterium tuberculosis H37Rv
ccuagggcggcggcgcg

SEQ ID NO: 3248059 - RNA, 19 nt, Mycobacterium tuberculosis H37Rv
ccuagggcggcggcgcgau

SEQ ID NO: 3248060 - RNA, 15 nt, Mycobacterium tuberculosis H37Rv
ccuaggucgacgccg

SEQ ID NO: 3248061 - RNA, 17 nt, Mycobacterium tuberculosis H37Rv
ccuaggucgacgccgac

SEQ ID NO: 3248062 - RNA, 17 nt, Mycobacterium tuberculosis H37Rv
ccuaggugugcgacgac

SEQ ID NO: 3248063 - RNA, 20 nt, Mycobacterium tuberculosis H37Rv
ccuagucaccuugaccgggu

SEQ ID NO: 3248064 - RNA, 21 nt, Mycobacterium tuberculosis H37Rv
ccuaucagccgagacaccacg

SEQ ID NO: 3248065 - RNA, 17 nt, Mycobacterium tuberculosis H37Rv
ccuaucagugagccgcc

SEQ ID NO: 3248066 - RNA, 18 nt, Mycobacterium tuberculosis H37Rv
ccuaucagugagccgcca

SEQ ID NO: 3248067 - RNA, 19 nt, Mycobacterium tuberculosis H37Rv
ccuaucagugagccgccau

SEQ ID NO: 3248068 - RNA, 16 nt, Mycobacterium tuberculosis H37Rv
ccuaucgacaacaugc

SEQ ID NO: 3248069 - RNA, 16 nt, Mycobacterium tuberculosis H37Rv
ccuaugauucagccgg

SEQ ID NO: 3248070 - RNA, 17 nt, Mycobacterium tuberculosis H37Rv
ccuaugauucagccggc

SEQ ID NO: 3248071 - RNA, 18 nt, Mycobacterium tuberculosis H37Rv
ccuaugauucagccggcu

SEQ ID NO: 3248072 - RNA, 16 nt, Mycobacterium tuberculosis H37Rv
ccuccuccgcaaucgc

SEQ ID NO: 3248073 - RNA, 15 nt, Mycobacterium tuberculosis H37Rv
ccuccucgacgucgg

SEQ ID NO: 3248074 - RNA, 14 nt, Mycobacterium tuberculosis H37Rv
ccuccucgagcagg

SEQ ID NO: 3248075 - RNA, 17 nt, Mycobacterium tuberculosis H37Rv
ccuccucgagcaggaug

SEQ ID NO: 3248076 - RNA, 20 nt, Mycobacterium tuberculosis H37Rv
ccuccucgaugaggcgcagc

SEQ ID NO: 3248077 - RNA, 21 nt, Mycobacterium tuberculosis H37Rv
ccuccucgcccauuggccagg

SEQ ID NO: 3248078 - RNA, 18 nt, Mycobacterium tuberculosis H37Rv
ccuccucggcaggaagga

SEQ ID NO: 3248079 - RNA, 15 nt, Mycobacterium tuberculosis H37Rv
ccuccucggcgcgaa

SEQ ID NO: 3248080 - RNA, 16 nt, Mycobacterium tuberculosis H37Rv
ccuccucgugcaggac

SEQ ID NO: 3248081 - RNA, 12 nt, Mycobacterium tuberculosis H37Rv
ccuccugccgcc

SEQ ID NO: 3248082 - RNA, 14 nt, Mycobacterium tuberculosis H37Rv
ccuccugcgccgca

SEQ ID NO: 3248083 - RNA, 11 nt, Mycobacterium tuberculosis H37Rv
ccuccugugcg

SEQ ID NO: 3248084 - RNA, 21 nt, Mycobacterium tuberculosis H37Rv
ccuccuugaaccgggacacca

SEQ ID NO: 3248085 - RNA, 18 nt, Mycobacterium tuberculosis H37Rv
ccucgaaaccguggccau

SEQ ID NO: 3248086 - RNA, 21 nt, Mycobacterium tuberculosis H37Rv
ccucgaaacgcuuacccagcc

SEQ ID NO: 3248087 - RNA, 23 nt, Mycobacterium tuberculosis H37Rv
ccucgaacgggaaggcauugccc

SEQ ID NO: 3248088 - RNA, 15 nt, Mycobacterium tuberculosis H37Rv
ccucgaagcccagca

SEQ ID NO: 3248089 - RNA, 17 nt, Mycobacterium tuberculosis H37Rv
ccucgaagcccagcacc

SEQ ID NO: 3248090 - RNA, 23 nt, Mycobacterium tuberculosis H37Rv
ccucgaagcccagcaccaccacc

SEQ ID NO: 3248091 - RNA, 20 nt, Mycobacterium tuberculosis H37Rv
ccucgaagggcuugucgccg

SEQ ID NO: 3248092 - RNA, 16 nt, Mycobacterium tuberculosis H37Rv
ccucgacacccagccg

SEQ ID NO: 3248093 - RNA, 16 nt, Mycobacterium tuberculosis H37Rv
ccucgacacccauccu

SEQ ID NO: 3248094 - RNA, 13 nt, Mycobacterium tuberculosis H37Rv
ccucgacccggcg

SEQ ID NO: 3248095 - RNA, 13 nt, Mycobacterium tuberculosis H37Rv
ccucgaccgccag

SEQ ID NO: 3248096 - RNA, 22 nt, Mycobacterium tuberculosis H37Rv
ccucgaccuggauugccaccag

SEQ ID NO: 3248097 - RNA, 16 nt, Mycobacterium tuberculosis H37Rv
ccucgacgcccgcccu

SEQ ID NO: 3248098 - RNA, 14 nt, Mycobacterium tuberculosis H37Rv
ccucgacgcggcag

SEQ ID NO: 3248099 - RNA, 17 nt, Mycobacterium tuberculosis H37Rv
ccucgacgcggcaggcc

SEQ ID NO: 3248100 - RNA, 16 nt, Mycobacterium tuberculosis H37Rv
ccucgacuucggcggg

SEQ ID NO: 3248101 - RNA, 17 nt, Mycobacterium tuberculosis H37Rv
ccucgacuucggcggga

SEQ ID NO: 3248102 - RNA, 15 nt, Mycobacterium tuberculosis H37Rv
ccucgagacggucga

SEQ ID NO: 3248103 - RNA, 15 nt, Mycobacterium tuberculosis H37Rv
ccucgagcagugccg

SEQ ID NO: 3248104 - RNA, 13 nt, Mycobacterium tuberculosis H37Rv
ccucgagcggcag

SEQ ID NO: 3248105 - RNA, 17 nt, Mycobacterium tuberculosis H37Rv
ccucgagcuugccgucg

SEQ ID NO: 3248106 - RNA, 21 nt, Mycobacterium tuberculosis H37Rv
ccucgagguauucgcgcagca

SEQ ID NO: 3248107 - RNA, 16 nt, Mycobacterium tuberculosis H37Rv
ccucgagguccucguc

SEQ ID NO: 3248108 - RNA, 15 nt, Mycobacterium tuberculosis H37Rv
ccucgagugccgccg

SEQ ID NO: 3248109 - RNA, 16 nt, Mycobacterium tuberculosis H37Rv
ccucgaguucgaccgg

SEQ ID NO: 3248110 - RNA, 20 nt, Mycobacterium tuberculosis H37Rv
ccucgaguucgaccggcggg

SEQ ID NO: 3248111 - RNA, 22 nt, Mycobacterium tuberculosis H37Rv
ccucgaguucgggcugcggcag

SEQ ID NO: 3248112 - RNA, 20 nt, Mycobacterium tuberculosis H37Rv
ccucgauaggugagcgcggg

SEQ ID NO: 3248113 - RNA, 20 nt, Mycobacterium tuberculosis H37Rv
ccucgaugacaucggucagc

SEQ ID NO: 3248114 - RNA, 12 nt, Mycobacterium tuberculosis H37Rv
ccucgaugaccg

SEQ ID NO: 3248115 - RNA, 15 nt, Mycobacterium tuberculosis H37Rv
ccucgaugccgcccg

SEQ ID NO: 3248116 - RNA, 17 nt, Mycobacterium tuberculosis H37Rv
ccucgaugccgcccgug

SEQ ID NO: 3248117 - RNA, 23 nt, Mycobacterium tuberculosis H37Rv
ccucgaugcggguggcgccggug

SEQ ID NO: 3248118 - RNA, 15 nt, Mycobacterium tuberculosis H37Rv
ccucgauggaccgcc

SEQ ID NO: 3248119 - RNA, 17 nt, Mycobacterium tuberculosis H37Rv
ccucgauggaccgccag

SEQ ID NO: 3248120 - RNA, 22 nt, Mycobacterium tuberculosis H37Rv
ccucgcacaauggcggcgccgu

SEQ ID NO: 3248121 - RNA, 15 nt, Mycobacterium tuberculosis H37Rv
ccucgcaggugguga

SEQ ID NO: 3248122 - RNA, 23 nt, Mycobacterium tuberculosis H37Rv
ccucgccacgcucggcggccagc

SEQ ID NO: 3248123 - RNA, 14 nt, Mycobacterium tuberculosis H37Rv
ccucgccaucgacc

SEQ ID NO: 3248124 - RNA, 20 nt, Mycobacterium tuberculosis H37Rv
ccucgccaucgaccuugagc

SEQ ID NO: 3248125 - RNA, 15 nt, Mycobacterium tuberculosis H37Rv
ccucgcccugcagac

SEQ ID NO: 3248126 - RNA, 14 nt, Mycobacterium tuberculosis H37Rv
ccucgccgcacgcc

SEQ ID NO: 3248127 - RNA, 15 nt, Mycobacterium tuberculosis H37Rv
ccucgccgcgcguga

SEQ ID NO: 3248128 - RNA, 14 nt, Mycobacterium tuberculosis H37Rv
ccucgccggcggga

SEQ ID NO: 3248129 - RNA, 22 nt, Mycobacterium tuberculosis H37Rv
ccucgcgaaauaacggagcggc

SEQ ID NO: 3248130 - RNA, 19 nt, Mycobacterium tuberculosis H37Rv
ccucgcggagccgucgcau

SEQ ID NO: 3248131 - RNA, 22 nt, Mycobacterium tuberculosis H37Rv
ccucgcggaugagcucggccau

SEQ ID NO: 3248132 - RNA, 17 nt, Mycobacterium tuberculosis H37Rv
ccucgcgggaagucccg

SEQ ID NO: 3248133 - RNA, 22 nt, Mycobacterium tuberculosis H37Rv
ccucgcgggcuuaugcacgacg

SEQ ID NO: 3248134 - RNA, 16 nt, Mycobacterium tuberculosis H37Rv
ccucgcggugcgccac

SEQ ID NO: 3248135 - RNA, 17 nt, Mycobacterium tuberculosis H37Rv
ccucgcuaacuccccag

SEQ ID NO: 3248136 - RNA, 19 nt, Mycobacterium tuberculosis H37Rv
ccucgcuaauugcggccgc

SEQ ID NO: 3248137 - RNA, 21 nt, Mycobacterium tuberculosis H37Rv
ccucgcuaauugcggccgccg

SEQ ID NO: 3248138 - RNA, 19 nt, Mycobacterium tuberculosis H37Rv
ccucgcucuccauggccga

SEQ ID NO: 3248139 - RNA, 17 nt, Mycobacterium tuberculosis H37Rv
ccucggacacggcagcc

SEQ ID NO: 3248140 - RNA, 16 nt, Mycobacterium tuberculosis H37Rv
ccucggacugcagcgc

SEQ ID NO: 3248141 - RNA, 19 nt, Mycobacterium tuberculosis H37Rv
ccucggacugcagcgcggc

SEQ ID NO: 3248142 - RNA, 20 nt, Mycobacterium tuberculosis H37Rv
ccucggagaucgagaucacc

SEQ ID NO: 3248143 - RNA, 21 nt, Mycobacterium tuberculosis H37Rv
ccucggauugcagcgcgaugg

SEQ ID NO: 3248144 - RNA, 14 nt, Mycobacterium tuberculosis H37Rv
ccucggcaaccacc

SEQ ID NO: 3248145 - RNA, 15 nt, Mycobacterium tuberculosis H37Rv
ccucggcacggucgc

SEQ ID NO: 3248146 - RNA, 14 nt, Mycobacterium tuberculosis H37Rv
ccucggcaucgccg

SEQ ID NO: 3248147 - RNA, 15 nt, Mycobacterium tuberculosis H37Rv
ccucggcaucgccgc

SEQ ID NO: 3248148 - RNA, 11 nt, Mycobacterium tuberculosis H37Rv
ccucggcaugc

SEQ ID NO: 3248149 - RNA, 13 nt, Mycobacterium tuberculosis H37Rv
ccucggccacccg

SEQ ID NO: 3248150 - RNA, 14 nt, Mycobacterium tuberculosis H37Rv
ccucggccacccgc

SEQ ID NO: 3248151 - RNA, 17 nt, Mycobacterium tuberculosis H37Rv
ccucggccgccagcccc

SEQ ID NO: 3248152 - RNA, 18 nt, Mycobacterium tuberculosis H37Rv
ccucggccgccagcccca

SEQ ID NO: 3248153 - RNA, 18 nt, Mycobacterium tuberculosis H37Rv
ccucggccucgucgugca

SEQ ID NO: 3248154 - RNA, 22 nt, Mycobacterium tuberculosis H37Rv
ccucggcgaagucacgcacccg

SEQ ID NO: 3248155 - RNA, 21 nt, Mycobacterium tuberculosis H37Rv
ccucggcgaccugcucgcugg

SEQ ID NO: 3248156 - RNA, 15 nt, Mycobacterium tuberculosis H37Rv
ccucggcgaccuggc

SEQ ID NO: 3248157 - RNA, 18 nt, Mycobacterium tuberculosis H37Rv
ccucggcgagcacgucac

SEQ ID NO: 3248158 - RNA, 18 nt, Mycobacterium tuberculosis H37Rv
ccucggcgaucaauugcc

SEQ ID NO: 3248159 - RNA, 18 nt, Mycobacterium tuberculosis H37Rv
ccucggcgaugggccggu

SEQ ID NO: 3248160 - RNA, 12 nt, Mycobacterium tuberculosis H37Rv
ccucggcgccgu

SEQ ID NO: 3248161 - RNA, 19 nt, Mycobacterium tuberculosis H37Rv
ccucggcgcgcucggccgg

SEQ ID NO: 3248162 - RNA, 15 nt, Mycobacterium tuberculosis H37Rv
ccucggcggccagcu

SEQ ID NO: 3248163 - RNA, 22 nt, Mycobacterium tuberculosis H37Rv
ccucggcggccagcucggccag

SEQ ID NO: 3248164 - RNA, 15 nt, Mycobacterium tuberculosis H37Rv
ccucggcggcggcac

SEQ ID NO: 3248165 - RNA, 22 nt, Mycobacterium tuberculosis H37Rv
ccucggcguaggcgauggcggc

SEQ ID NO: 3248166 - RNA, 19 nt, Mycobacterium tuberculosis H37Rv
ccucggcuuugccgcugug

SEQ ID NO: 3248167 - RNA, 18 nt, Mycobacterium tuberculosis H37Rv
ccucgggcaggcggccag

SEQ ID NO: 3248168 - RNA, 23 nt, Mycobacterium tuberculosis H37Rv
ccugcagcgaaacaccggccagc

SEQ ID NO: 3248169 - RNA, 14 nt, Mycobacterium tuberculosis H37Rv
ccugcagcgaugac

SEQ ID NO: 3248170 - RNA, 12 nt, Mycobacterium tuberculosis H37Rv
ccugcaggccgc

SEQ ID NO: 3248171 - RNA, 15 nt, Mycobacterium tuberculosis H37Rv
ccugcaggccgccgg

SEQ ID NO: 3248172 - RNA, 12 nt, Mycobacterium tuberculosis H37Rv
ccugccacccgg

SEQ ID NO: 3248173 - RNA, 14 nt, Mycobacterium tuberculosis H37Rv
ccugccaguccgca

SEQ ID NO: 3248174 - RNA, 22 nt, Mycobacterium tuberculosis H37Rv
ccugccauaggcccacggcagc

SEQ ID NO: 3248175 - RNA, 14 nt, Mycobacterium tuberculosis H37Rv
ccugccaucacgcg

SEQ ID NO: 3248176 - RNA, 14 nt, Mycobacterium tuberculosis H37Rv
ccugcccccggcgc

SEQ ID NO: 3248177 - RNA, 15 nt, Mycobacterium tuberculosis H37Rv
ccugcccggcccgcc

SEQ ID NO: 3248178 - RNA, 17 nt, Mycobacterium tuberculosis H37Rv
ccugcccggcccgcccg

SEQ ID NO: 3248179 - RNA, 17 nt, Mycobacterium tuberculosis H37Rv
ccugccgaacccggcgg

SEQ ID NO: 3248180 - RNA, 16 nt, Mycobacterium tuberculosis H37Rv
ccugccgacgcuccag

SEQ ID NO: 3248181 - RNA, 18 nt, Mycobacterium tuberculosis H37Rv
ccugccgacgcuccaggg

SEQ ID NO: 3248182 - RNA, 19 nt, Mycobacterium tuberculosis H37Rv
ccugccgacggcaucaacg

SEQ ID NO: 3248183 - RNA, 14 nt, Mycobacterium tuberculosis H37Rv
ccugccgaucccgu

SEQ ID NO: 3248184 - RNA, 22 nt, Mycobacterium tuberculosis H37Rv
ccugccgaucccgugguggcgc

SEQ ID NO: 3248185 - RNA, 14 nt, Mycobacterium tuberculosis H37Rv
ccugccgcgaugag

SEQ ID NO: 3248186 - RNA, 15 nt, Mycobacterium tuberculosis H37Rv
ccugccggcagcggc

SEQ ID NO: 3248187 - RNA, 18 nt, Mycobacterium tuberculosis H37Rv
ccugccgggacauuccca

SEQ ID NO: 3248188 - RNA, 22 nt, Mycobacterium tuberculosis H37Rv
ccugccguauggcaucggccug

SEQ ID NO: 3248189 - RNA, 16 nt, Mycobacterium tuberculosis H37Rv
ccugccucggcgagcc

SEQ ID NO: 3248190 - RNA, 19 nt, Mycobacterium tuberculosis H37Rv
ccugccucggcgagccgcu

SEQ ID NO: 3248191 - RNA, 14 nt, Mycobacterium tuberculosis H37Rv
ccugcgaaacgcug

SEQ ID NO: 3248192 - RNA, 18 nt, Mycobacterium tuberculosis H37Rv
ccugcgacacaacgggug

SEQ ID NO: 3248193 - RNA, 14 nt, Mycobacterium tuberculosis H37Rv
ccugcgaccaggcg

SEQ ID NO: 3248194 - RNA, 15 nt, Mycobacterium tuberculosis H37Rv
ccugcgacgagccca

SEQ ID NO: 3248195 - RNA, 20 nt, Mycobacterium tuberculosis H37Rv
ccugcgacuaagggcacucc

SEQ ID NO: 3248196 - RNA, 17 nt, Mycobacterium tuberculosis H37Rv
ccugcgaggugccgggg

SEQ ID NO: 3248197 - RNA, 19 nt, Mycobacterium tuberculosis H37Rv
ccugcgcaucaccacuggc

SEQ ID NO: 3248198 - RNA, 13 nt, Mycobacterium tuberculosis H37Rv
ccugcgccacacc

SEQ ID NO: 3248199 - RNA, 17 nt, Mycobacterium tuberculosis H37Rv
ccugcgccacacccggc

SEQ ID NO: 3248200 - RNA, 19 nt, Mycobacterium tuberculosis H37Rv
ccugcgccacacccggcac

SEQ ID NO: 3248201 - RNA, 15 nt, Mycobacterium tuberculosis H37Rv
ccugcgccgacccgc

SEQ ID NO: 3248202 - RNA, 15 nt, Mycobacterium tuberculosis H37Rv
ccugcgccgaguugu

SEQ ID NO: 3248203 - RNA, 23 nt, Mycobacterium tuberculosis H37Rv
ccugcgccgaguuguucgcccac

SEQ ID NO: 3248204 - RNA, 13 nt, Mycobacterium tuberculosis H37Rv
ccugcgccgcacg

SEQ ID NO: 3248205 - RNA, 13 nt, Mycobacterium tuberculosis H37Rv
ccugcgccgcagu

SEQ ID NO: 3248206 - RNA, 20 nt, Mycobacterium tuberculosis H37Rv
ccugcgccgccagcgccgcc

SEQ ID NO: 3248207 - RNA, 18 nt, Mycobacterium tuberculosis H37Rv
ccugcgccgcccgcgcca

SEQ ID NO: 3248208 - RNA, 19 nt, Mycobacterium tuberculosis H37Rv
ccugcgccgcccgcgccac

SEQ ID NO: 3248209 - RNA, 13 nt, Mycobacterium tuberculosis H37Rv
ccugcgccgcgcg

SEQ ID NO: 3248210 - RNA, 18 nt, Mycobacterium tuberculosis H37Rv
ccugcgccgguaacuguc

SEQ ID NO: 3248211 - RNA, 19 nt, Mycobacterium tuberculosis H37Rv
ccugcgccgguaacugucc

SEQ ID NO: 3248212 - RNA, 19 nt, Mycobacterium tuberculosis H37Rv
ccugcgccucggcggccag

SEQ ID NO: 3248213 - RNA, 21 nt, Mycobacterium tuberculosis H37Rv
ccugcgcgagugccaguccga

SEQ ID NO: 3248214 - RNA, 18 nt, Mycobacterium tuberculosis H37Rv
ccugcgcggcgaucgcuc

SEQ ID NO: 3248215 - RNA, 24 nt, Mycobacterium tuberculosis H37Rv
ccugcgcggcgaucgcuccgcggc

SEQ ID NO: 3248216 - RNA, 23 nt, Mycobacterium tuberculosis H37Rv
ccugcgcggcugccgucuccugg

SEQ ID NO: 3248217 - RNA, 13 nt, Mycobacterium tuberculosis H37Rv
ccugcggaucgga

SEQ ID NO: 3248218 - RNA, 16 nt, Mycobacterium tuberculosis H37Rv
ccugcggcaacggcuc

SEQ ID NO: 3248219 - RNA, 20 nt, Mycobacterium tuberculosis H37Rv
ccugcggcaccucauugccg

SEQ ID NO: 3248220 - RNA, 19 nt, Mycobacterium tuberculosis H37Rv
ccugcggcaggugcgguca

SEQ ID NO: 3248221 - RNA, 16 nt, Mycobacterium tuberculosis H37Rv
ccugcgggaacgcggc

SEQ ID NO: 3248222 - RNA, 19 nt, Mycobacterium tuberculosis H37Rv
ccugcgggaucgccgagac

SEQ ID NO: 3248223 - RNA, 18 nt, Mycobacterium tuberculosis H37Rv
ccugcggguaggugacga

SEQ ID NO: 3248224 - RNA, 21 nt, Mycobacterium tuberculosis H37Rv
ccugcggugcaggauucggcg

SEQ ID NO: 3248225 - RNA, 18 nt, Mycobacterium tuberculosis H37Rv
ccugcgucgaaauccaca

SEQ ID NO: 3248226 - RNA, 13 nt, Mycobacterium tuberculosis H37Rv
ccugcgucggccc

SEQ ID NO: 3248227 - RNA, 16 nt, Mycobacterium tuberculosis H37Rv
ccugcucauccaccuc

SEQ ID NO: 3248228 - RNA, 17 nt, Mycobacterium tuberculosis H37Rv
ccugcuccgcugucacc

SEQ ID NO: 3248229 - RNA, 15 nt, Mycobacterium tuberculosis H37Rv
ccugcucgauacggc

SEQ ID NO: 3248230 - RNA, 19 nt, Mycobacterium tuberculosis H37Rv
ccugcucgcagcgggcgaa

SEQ ID NO: 3248231 - RNA, 18 nt, Mycobacterium tuberculosis H37Rv
ccugcucggagagcagca

SEQ ID NO: 3248232 - RNA, 19 nt, Mycobacterium tuberculosis H37Rv
ccugcucgggggccgacca

SEQ ID NO: 3248233 - RNA, 20 nt, Mycobacterium tuberculosis H37Rv
ccugcucgggggccgaccag

SEQ ID NO: 3248234 - RNA, 18 nt, Mycobacterium tuberculosis H37Rv
ccugcucgucggccaccg

SEQ ID NO: 3248235 - RNA, 15 nt, Mycobacterium tuberculosis H37Rv
ccugcugagccgucg

SEQ ID NO: 3248236 - RNA, 23 nt, Mycobacterium tuberculosis H37Rv
ccugcugcaaccgacuucgaugg

SEQ ID NO: 3248237 - RNA, 19 nt, Mycobacterium tuberculosis H37Rv
ccugcugcagaaaggccaa

SEQ ID NO: 3248238 - RNA, 16 nt, Mycobacterium tuberculosis H37Rv
ccugcugcggccaggg

SEQ ID NO: 3248239 - RNA, 14 nt, Mycobacterium tuberculosis H37Rv
ccugcugcugcagc

SEQ ID NO: 3248240 - RNA, 12 nt, Mycobacterium tuberculosis H37Rv
ccugcuggagca

SEQ ID NO: 3248241 - RNA, 19 nt, Mycobacterium tuberculosis H37Rv
ccugcuggagcagcuaccg

SEQ ID NO: 3248242 - RNA, 14 nt, Mycobacterium tuberculosis H37Rv
ccugcuggcccugc

SEQ ID NO: 3248243 - RNA, 14 nt, Mycobacterium tuberculosis H37Rv
ccugcuggccgcgg

SEQ ID NO: 3248244 - RNA, 14 nt, Mycobacterium tuberculosis H37Rv
ccugcugggaggga

SEQ ID NO: 3248245 - RNA, 17 nt, Mycobacterium tuberculosis H37Rv
ccugcuggucggugaug

SEQ ID NO: 3248246 - RNA, 14 nt, Mycobacterium tuberculosis H37Rv
ccugcuugcaggcg

SEQ ID NO: 3248247 - RNA, 22 nt, Mycobacterium tuberculosis H37Rv
ccugcuuguagcgcaucgccaa

SEQ ID NO: 3248248 - RNA, 16 nt, Mycobacterium tuberculosis H37Rv
ccuggaaagggccgcc

SEQ ID NO: 3248249 - RNA, 14 nt, Mycobacterium tuberculosis H37Rv
ccuggaaggaggcc

SEQ ID NO: 3248250 - RNA, 16 nt, Mycobacterium tuberculosis H37Rv
ccuggaauccaggagc

SEQ ID NO: 3248251 - RNA, 15 nt, Mycobacterium tuberculosis H37Rv
ccuggaaugccgcca

SEQ ID NO: 3248252 - RNA, 20 nt, Mycobacterium tuberculosis H37Rv
ccuggaaugccgccacaaag

SEQ ID NO: 3248253 - RNA, 20 nt, Mycobacterium tuberculosis H37Rv
ccuggagcagccacgauccu

SEQ ID NO: 3248254 - RNA, 21 nt, Mycobacterium tuberculosis H37Rv
ccuggagguguuugacgcgcu

SEQ ID NO: 3248255 - RNA, 21 nt, Mycobacterium tuberculosis H37Rv
ccuggaguccagcucgggcau

SEQ ID NO: 3248256 - RNA, 14 nt, Mycobacterium tuberculosis H37Rv
ccuggaucagccag

SEQ ID NO: 3248257 - RNA, 19 nt, Mycobacterium tuberculosis H37Rv
ccuggaucagccaguugau

SEQ ID NO: 3248258 - RNA, 16 nt, Mycobacterium tuberculosis H37Rv
ccuggauggguugacg

SEQ ID NO: 3248259 - RNA, 15 nt, Mycobacterium tuberculosis H37Rv
ccuggcaacgacacg

SEQ ID NO: 3248260 - RNA, 13 nt, Mycobacterium tuberculosis H37Rv
ccuggcacccggg

SEQ ID NO: 3248261 - RNA, 18 nt, Mycobacterium tuberculosis H37Rv
ccuggcaccucgcccucc

SEQ ID NO: 3248262 - RNA, 23 nt, Mycobacterium tuberculosis H37Rv
ccuggccaaccgggucguucggg

SEQ ID NO: 3248263 - RNA, 14 nt, Mycobacterium tuberculosis H37Rv
ccuggccaccuggu

SEQ ID NO: 3248264 - RNA, 17 nt, Mycobacterium tuberculosis H37Rv
ccuggccaccugguuua

SEQ ID NO: 3248265 - RNA, 23 nt, Mycobacterium tuberculosis H37Rv
cgaaacgcgcggaucgucgaggc

SEQ ID NO: 3248266 - RNA, 17 nt, Mycobacterium tuberculosis H37Rv
cgaaacggauuggucga

SEQ ID NO: 3248267 - RNA, 23 nt, Mycobacterium tuberculosis H37Rv
cgaaacggugaaugugcauagca

SEQ ID NO: 3248268 - RNA, 14 nt, Mycobacterium tuberculosis H37Rv
cgaaacucaccagc

SEQ ID NO: 3248269 - RNA, 16 nt, Mycobacterium tuberculosis H37Rv
cgaaacucaccagcac

SEQ ID NO: 3248270 - RNA, 18 nt, Mycobacterium tuberculosis H37Rv
cgaaacucaccagcaccc

SEQ ID NO: 3248271 - RNA, 12 nt, Mycobacterium tuberculosis H37Rv
cgaaacugaccc

SEQ ID NO: 3248272 - RNA, 19 nt, Mycobacterium tuberculosis H37Rv
cgaaagccaacucgaccga

SEQ ID NO: 3248273 - RNA, 20 nt, Mycobacterium tuberculosis H37Rv
cgaaagccaacucgaccgac

SEQ ID NO: 3248274 - RNA, 20 nt, Mycobacterium tuberculosis H37Rv
cgaaagccaggcggcaagga

SEQ ID NO: 3248275 - RNA, 16 nt, Mycobacterium tuberculosis H37Rv
cgaaagccucucuucc

SEQ ID NO: 3248276 - RNA, 20 nt, Mycobacterium tuberculosis H37Rv
cgaaagccuugccgucgagc

SEQ ID NO: 3248277 - RNA, 22 nt, Mycobacterium tuberculosis H37Rv
cgaaaguccugcagugcggcgu

SEQ ID NO: 3248278 - RNA, 18 nt, Mycobacterium tuberculosis H37Rv
cgaaagugguggcaacgg

SEQ ID NO: 3248279 - RNA, 15 nt, Mycobacterium tuberculosis H37Rv
cgaaauacccagcgc

SEQ ID NO: 3248280 - RNA, 16 nt, Mycobacterium tuberculosis H37Rv
cgaaaucaccgcugag

SEQ ID NO: 3248281 - RNA, 17 nt, Mycobacterium tuberculosis H37Rv
cgaaaucaguugcgcuc

SEQ ID NO: 3248282 - RNA, 20 nt, Mycobacterium tuberculosis H37Rv
cgaaauccccugcgcugcag

SEQ ID NO: 3248283 - RNA, 19 nt, Mycobacterium tuberculosis H37Rv
cgaaaucgcccugacccgg

SEQ ID NO: 3248284 - RNA, 19 nt, Mycobacterium tuberculosis H37Rv
cgaaaucggccagcuuccc

SEQ ID NO: 3248285 - RNA, 19 nt, Mycobacterium tuberculosis H37Rv
cgaaaucucaucgauuggc

SEQ ID NO: 3248286 - RNA, 18 nt, Mycobacterium tuberculosis H37Rv
cgaaaugaagugcaccga

SEQ ID NO: 3248287 - RNA, 18 nt, Mycobacterium tuberculosis H37Rv
cgaaaugcccaucaccag

SEQ ID NO: 3248288 - RNA, 20 nt, Mycobacterium tuberculosis H37Rv
cgaaaugccgggcccgacgu

SEQ ID NO: 3248289 - RNA, 22 nt, Mycobacterium tuberculosis H37Rv
cgaaauguuggccguaccggug

SEQ ID NO: 3248290 - RNA, 15 nt, Mycobacterium tuberculosis H37Rv
cgaaauucucgcccu

SEQ ID NO: 3248291 - RNA, 19 nt, Mycobacterium tuberculosis H37Rv
cgaacaacgcgacgaagca

SEQ ID NO: 3248292 - RNA, 13 nt, Mycobacterium tuberculosis H37Rv
cgaacaagaaaag

SEQ ID NO: 3248293 - RNA, 20 nt, Mycobacterium tuberculosis H37Rv
cgaacaaguggccagcgcca

SEQ ID NO: 3248294 - RNA, 23 nt, Mycobacterium tuberculosis H37Rv
cgaacaaguggccagcgccaacu

SEQ ID NO: 3248295 - RNA, 14 nt, Mycobacterium tuberculosis H37Rv
cgaacaauucacgc

SEQ ID NO: 3248296 - RNA, 12 nt, Mycobacterium tuberculosis H37Rv
cgaacaccagcg

SEQ ID NO: 3248297 - RNA, 16 nt, Mycobacterium tuberculosis H37Rv
cgaacaccagcgcgcc

SEQ ID NO: 3248298 - RNA, 20 nt, Mycobacterium tuberculosis H37Rv
cgaacaccagcgcgccguag

SEQ ID NO: 3248299 - RNA, 20 nt, Mycobacterium tuberculosis H37Rv
cgaacaccgccgcgucgagc

SEQ ID NO: 3248300 - RNA, 18 nt, Mycobacterium tuberculosis H37Rv
cgaacacgcacacgaucg

SEQ ID NO: 3248301 - RNA, 14 nt, Mycobacterium tuberculosis H37Rv
cgaacagacaugcg

SEQ ID NO: 3248302 - RNA, 21 nt, Mycobacterium tuberculosis H37Rv
cgaacagcaccgaacccgcca

SEQ ID NO: 3248303 - RNA, 21 nt, Mycobacterium tuberculosis H37Rv
cgaacagcaugauccgcuggg

SEQ ID NO: 3248304 - RNA, 15 nt, Mycobacterium tuberculosis H37Rv
cgaacagccccaggg

SEQ ID NO: 3248305 - RNA, 17 nt, Mycobacterium tuberculosis H37Rv
cgaacagccccagggug

SEQ ID NO: 3248306 - RNA, 15 nt, Mycobacterium tuberculosis H37Rv
cgaacagcgaaccgc

SEQ ID NO: 3248307 - RNA, 20 nt, Mycobacterium tuberculosis H37Rv
cgaacagggaggucgccgca

SEQ ID NO: 3248308 - RNA, 17 nt, Mycobacterium tuberculosis H37Rv
cgaacagggcugcgaug

SEQ ID NO: 3248309 - RNA, 15 nt, Mycobacterium tuberculosis H37Rv
cgaacagucgaguga

SEQ ID NO: 3248310 - RNA, 22 nt, Mycobacterium tuberculosis H37Rv
cgaacagucgagugaagccgac

SEQ ID NO: 3248311 - RNA, 13 nt, Mycobacterium tuberculosis H37Rv
cgaacagucgcag

SEQ ID NO: 3248312 - RNA, 22 nt, Mycobacterium tuberculosis H37Rv
cgaacaucaccgucgcccgggu

SEQ ID NO: 3248313 - RNA, 17 nt, Mycobacterium tuberculosis H37Rv
cgaacaucaucgggucc

SEQ ID NO: 3248314 - RNA, 13 nt, Mycobacterium tuberculosis H37Rv
cgaacaucgccag

SEQ ID NO: 3248315 - RNA, 16 nt, Mycobacterium tuberculosis H37Rv
cgaacaucgccagcgc

SEQ ID NO: 3248316 - RNA, 21 nt, Mycobacterium tuberculosis H37Rv
cgaacaugauccgccggcaac

SEQ ID NO: 3248317 - RNA, 15 nt, Mycobacterium tuberculosis H37Rv
cgaacauugcgccca

SEQ ID NO: 3248318 - RNA, 17 nt, Mycobacterium tuberculosis H37Rv
cgaaccaccaccggcaa

SEQ ID NO: 3248319 - RNA, 22 nt, Mycobacterium tuberculosis H37Rv
cgaaccacgcgcccgcaccacc

SEQ ID NO: 3248320 - RNA, 23 nt, Mycobacterium tuberculosis H37Rv
cgaaccacgcgcccgcaccaccg

SEQ ID NO: 3248321 - RNA, 13 nt, Mycobacterium tuberculosis H37Rv
cgaaccacggcag

SEQ ID NO: 3248322 - RNA, 19 nt, Mycobacterium tuberculosis H37Rv
cgaaccagcuugcgccgca

SEQ ID NO: 3248323 - RNA, 23 nt, Mycobacterium tuberculosis H37Rv
cgaaccagucgaagaagacccgu

SEQ ID NO: 3248324 - RNA, 13 nt, Mycobacterium tuberculosis H37Rv
cgaacccacugcc

SEQ ID NO: 3248325 - RNA, 13 nt, Mycobacterium tuberculosis H37Rv
cgaacccaggcac

SEQ ID NO: 3248326 - RNA, 17 nt, Mycobacterium tuberculosis H37Rv
cgaaccccacgcagaag

SEQ ID NO: 3248327 - RNA, 13 nt, Mycobacterium tuberculosis H37Rv
cgaacccccgccg

SEQ ID NO: 3248328 - RNA, 18 nt, Mycobacterium tuberculosis H37Rv
cgaacccgaucgucgagc

SEQ ID NO: 3248329 - RNA, 20 nt, Mycobacterium tuberculosis H37Rv
cgaacccgccaccgcgacac

SEQ ID NO: 3248330 - RNA, 18 nt, Mycobacterium tuberculosis H37Rv
cgaacccgccgucaccgc

SEQ ID NO: 3248331 - RNA, 13 nt, Mycobacterium tuberculosis H37Rv
cgaacccgcguug

SEQ ID NO: 3248332 - RNA, 23 nt, Mycobacterium tuberculosis H37Rv
cgaacccgguguugagcgaaccc

SEQ ID NO: 3248333 - RNA, 18 nt, Mycobacterium tuberculosis H37Rv
cgaaccgacguuccccuu

SEQ ID NO: 3248334 - RNA, 16 nt, Mycobacterium tuberculosis H37Rv
cgaaccgccagaaucc

SEQ ID NO: 3248335 - RNA, 13 nt, Mycobacterium tuberculosis H37Rv
cgaaccgccggca

SEQ ID NO: 3248336 - RNA, 16 nt, Mycobacterium tuberculosis H37Rv
cgaaccgccggcaccg

SEQ ID NO: 3248337 - RNA, 17 nt, Mycobacterium tuberculosis H37Rv
cgaaccgccggcaccgc

SEQ ID NO: 3248338 - RNA, 18 nt, Mycobacterium tuberculosis H37Rv
cgaaccgccggcaccgcc

SEQ ID NO: 3248339 - RNA, 18 nt, Mycobacterium tuberculosis H37Rv
cgaaccgcuccgagcacc

SEQ ID NO: 3248340 - RNA, 12 nt, Mycobacterium tuberculosis H37Rv
cgaaccggauca

SEQ ID NO: 3248341 - RNA, 18 nt, Mycobacterium tuberculosis H37Rv
cgaaccggaucaucgccg

SEQ ID NO: 3248342 - RNA, 15 nt, Mycobacterium tuberculosis H37Rv
cgaaccggcaccagc

SEQ ID NO: 3248343 - RNA, 17 nt, Mycobacterium tuberculosis H37Rv
cgaaccggcaccagcgg

SEQ ID NO: 3248344 - RNA, 18 nt, Mycobacterium tuberculosis H37Rv
cgaaccggcccaccgacg

SEQ ID NO: 3248345 - RNA, 19 nt, Mycobacterium tuberculosis H37Rv
cgaaccgggacaaccgcgc

SEQ ID NO: 3248346 - RNA, 20 nt, Mycobacterium tuberculosis H37Rv
cgaaccgguagucgccgucg

SEQ ID NO: 3248347 - RNA, 20 nt, Mycobacterium tuberculosis H37Rv
cgaaccgguguagcagcgcc

SEQ ID NO: 3248348 - RNA, 17 nt, Mycobacterium tuberculosis H37Rv
cgaaccgguugccguug

SEQ ID NO: 3248349 - RNA, 17 nt, Mycobacterium tuberculosis H37Rv
cgaaccgucucggcgac

SEQ ID NO: 3248350 - RNA, 13 nt, Mycobacterium tuberculosis H37Rv
cgaaccguucgcu

SEQ ID NO: 3248351 - RNA, 20 nt, Mycobacterium tuberculosis H37Rv
cgaaccguucgcucagggug

SEQ ID NO: 3248352 - RNA, 17 nt, Mycobacterium tuberculosis H37Rv
cgaaccguucggcgaca

SEQ ID NO: 3248353 - RNA, 20 nt, Mycobacterium tuberculosis H37Rv
cgaaccguucggcgacagcg

SEQ ID NO: 3248354 - RNA, 22 nt, Mycobacterium tuberculosis H37Rv
cgaaccugucgaucacggccgu

SEQ ID NO: 3248355 - RNA, 18 nt, Mycobacterium tuberculosis H37Rv
cgaaccuugguugccaac

SEQ ID NO: 3248356 - RNA, 16 nt, Mycobacterium tuberculosis H37Rv
cgaacgaagucgacga

SEQ ID NO: 3248357 - RNA, 14 nt, Mycobacterium tuberculosis H37Rv
cgaacgacagcaga

SEQ ID NO: 3248358 - RNA, 14 nt, Mycobacterium tuberculosis H37Rv
cgaacgacccuggc

SEQ ID NO: 3248359 - RNA, 18 nt, Mycobacterium tuberculosis H37Rv
cgaacgacgcuuucccga

SEQ ID NO: 3248360 - RNA, 21 nt, Mycobacterium tuberculosis H37Rv
cgaacgacgcuuucccgauga

SEQ ID NO: 3248361 - RNA, 19 nt, Mycobacterium tuberculosis H37Rv
cgaagcucaucgccgcuac

SEQ ID NO: 3248362 - RNA, 15 nt, Mycobacterium tuberculosis H37Rv
cgaagcugaccagac

SEQ ID NO: 3248363 - RNA, 20 nt, Mycobacterium tuberculosis H37Rv
cgaagcuggcgugcagcagg

SEQ ID NO: 3248364 - RNA, 21 nt, Mycobacterium tuberculosis H37Rv
cgaagcuggcgugcagcagga

SEQ ID NO: 3248365 - RNA, 18 nt, Mycobacterium tuberculosis H37Rv
cgaagcuucggccuucuu

SEQ ID NO: 3248366 - RNA, 17 nt, Mycobacterium tuberculosis H37Rv
cgaagcuugacguugcc

SEQ ID NO: 3248367 - RNA, 22 nt, Mycobacterium tuberculosis H37Rv
cgaagcuugacguugccgggcu

SEQ ID NO: 3248368 - RNA, 23 nt, Mycobacterium tuberculosis H37Rv
cgaaggaaaaugauagcggcgca

SEQ ID NO: 3248369 - RNA, 17 nt, Mycobacterium tuberculosis H37Rv
cgaaggaccggcaccug

SEQ ID NO: 3248370 - RNA, 22 nt, Mycobacterium tuberculosis H37Rv
cgaaggaugcugucagacggcg

SEQ ID NO: 3248371 - RNA, 21 nt, Mycobacterium tuberculosis H37Rv
cgaaggcaaagcgagcaccgc

SEQ ID NO: 3248372 - RNA, 12 nt, Mycobacterium tuberculosis H37Rv
cgaaggcacugc

SEQ ID NO: 3248373 - RNA, 17 nt, Mycobacterium tuberculosis H37Rv
cgaaggccgccaaccgu

SEQ ID NO: 3248374 - RNA, 21 nt, Mycobacterium tuberculosis H37Rv
cgaaggcgacaucaccaccga

SEQ ID NO: 3248375 - RNA, 14 nt, Mycobacterium tuberculosis H37Rv
cgaaggcggcucca

SEQ ID NO: 3248376 - RNA, 18 nt, Mycobacterium tuberculosis H37Rv
cgaaggcgggggagccca

SEQ ID NO: 3248377 - RNA, 20 nt, Mycobacterium tuberculosis H37Rv
cgaaggggugcccggcggcc

SEQ ID NO: 3248378 - RNA, 23 nt, Mycobacterium tuberculosis H37Rv
cgaaggguaagaguucgcgcgcc

SEQ ID NO: 3248379 - RNA, 21 nt, Mycobacterium tuberculosis H37Rv
cgaaggucaucaugucgaggu

SEQ ID NO: 3248380 - RNA, 23 nt, Mycobacterium tuberculosis H37Rv
cgaaggucgcggucgagcaggug

SEQ ID NO: 3248381 - RNA, 22 nt, Mycobacterium tuberculosis H37Rv
cgaaggucgguaccccagcgcu

SEQ ID NO: 3248382 - RNA, 17 nt, Mycobacterium tuberculosis H37Rv
cgaaggugaaucgacug

SEQ ID NO: 3248383 - RNA, 20 nt, Mycobacterium tuberculosis H37Rv
cgaaggugaaucgacugauc

SEQ ID NO: 3248384 - RNA, 21 nt, Mycobacterium tuberculosis H37Rv
cgaaggugaugaacaccggcg

SEQ ID NO: 3248385 - RNA, 18 nt, Mycobacterium tuberculosis H37Rv
cgaagguguccuccagcu

SEQ ID NO: 3248386 - RNA, 20 nt, Mycobacterium tuberculosis H37Rv
cgaagguguccuccagcugc

SEQ ID NO: 3248387 - RNA, 18 nt, Mycobacterium tuberculosis H37Rv
cgaaguacgacgacccga

SEQ ID NO: 3248388 - RNA, 18 nt, Mycobacterium tuberculosis H37Rv
cgaaguacuggccgccgc

SEQ ID NO: 3248389 - RNA, 14 nt, Mycobacterium tuberculosis H37Rv
cgaaguagccgacc

SEQ ID NO: 3248390 - RNA, 22 nt, Mycobacterium tuberculosis H37Rv
cgaaguagccgaccggcagcga

SEQ ID NO: 3248391 - RNA, 15 nt, Mycobacterium tuberculosis H37Rv
cgaagucacgcaccc

SEQ ID NO: 3248392 - RNA, 22 nt, Mycobacterium tuberculosis H37Rv
cgaaguccaccacgacgucggu

SEQ ID NO: 3248393 - RNA, 24 nt, Mycobacterium tuberculosis H37Rv
cgaaguccaccacgacgucgguga

SEQ ID NO: 3248394 - RNA, 12 nt, Mycobacterium tuberculosis H37Rv
cgaagucgacga

SEQ ID NO: 3248395 - RNA, 14 nt, Mycobacterium tuberculosis H37Rv
cgaagucgacgaac

SEQ ID NO: 3248396 - RNA, 21 nt, Mycobacterium tuberculosis H37Rv
cgaagucgacgaacucgccca

SEQ ID NO: 3248397 - RNA, 18 nt, Mycobacterium tuberculosis H37Rv
cgaagucgagugccgcgu

SEQ ID NO: 3248398 - RNA, 22 nt, Mycobacterium tuberculosis H37Rv
cgaagucguacugguagcacuc

SEQ ID NO: 3248399 - RNA, 17 nt, Mycobacterium tuberculosis H37Rv
cgaagucgucgagguca

SEQ ID NO: 3248400 - RNA, 20 nt, Mycobacterium tuberculosis H37Rv
cgaagucgucgaggucacgc

SEQ ID NO: 3248401 - RNA, 13 nt, Mycobacterium tuberculosis H37Rv
cgaagucucggug

SEQ ID NO: 3248402 - RNA, 14 nt, Mycobacterium tuberculosis H37Rv
cgaagucucgguga

SEQ ID NO: 3248403 - RNA, 18 nt, Mycobacterium tuberculosis H37Rv
cgaagucuugaccgcacc

SEQ ID NO: 3248404 - RNA, 14 nt, Mycobacterium tuberculosis H37Rv
cgaagugacccgaa

SEQ ID NO: 3248405 - RNA, 14 nt, Mycobacterium tuberculosis H37Rv
cgaagugcuccacc

SEQ ID NO: 3248406 - RNA, 22 nt, Mycobacterium tuberculosis H37Rv
cgaagugguaguccagggcgcc

SEQ ID NO: 3248407 - RNA, 22 nt, Mycobacterium tuberculosis H37Rv
cgaagugucgcugcaaccgccg

SEQ ID NO: 3248408 - RNA, 14 nt, Mycobacterium tuberculosis H37Rv
cgaaguucucggug

SEQ ID NO: 3248409 - RNA, 21 nt, Mycobacterium tuberculosis H37Rv
cgaaguuggcgaagcccgaca

SEQ ID NO: 3248410 - RNA, 15 nt, Mycobacterium tuberculosis H37Rv
cgaaguuggcuuucg

SEQ ID NO: 3248411 - RNA, 18 nt, Mycobacterium tuberculosis H37Rv
cgaaguuuuggaagcccg

SEQ ID NO: 3248412 - RNA, 19 nt, Mycobacterium tuberculosis H37Rv
cgaauaccacaccgugacc

SEQ ID NO: 3248413 - RNA, 19 nt, Mycobacterium tuberculosis H37Rv
cgaauacggcugccuccau

SEQ ID NO: 3248414 - RNA, 12 nt, Mycobacterium tuberculosis H37Rv
cgaaucagcucg

SEQ ID NO: 3248415 - RNA, 14 nt, Mycobacterium tuberculosis H37Rv
cgaauccaucgaga

SEQ ID NO: 3248416 - RNA, 17 nt, Mycobacterium tuberculosis H37Rv
cgaaucccacagcagga

SEQ ID NO: 3248417 - RNA, 20 nt, Mycobacterium tuberculosis H37Rv
cgaaucccgcgaugcgcacc

SEQ ID NO: 3248418 - RNA, 17 nt, Mycobacterium tuberculosis H37Rv
cgaaucccgcgcccggc

SEQ ID NO: 3248419 - RNA, 23 nt, Mycobacterium tuberculosis H37Rv
cgaauccgcucgagguggucucg

SEQ ID NO: 3248420 - RNA, 21 nt, Mycobacterium tuberculosis H37Rv
cgaauccucgcgaaaccgccg

SEQ ID NO: 3248421 - RNA, 17 nt, Mycobacterium tuberculosis H37Rv
cgaaucgagacggccac

SEQ ID NO: 3248422 - RNA, 20 nt, Mycobacterium tuberculosis H37Rv
cgaaucgccggcggccacca

SEQ ID NO: 3248423 - RNA, 16 nt, Mycobacterium tuberculosis H37Rv
cgaaucgccugccaca

SEQ ID NO: 3248424 - RNA, 16 nt, Mycobacterium tuberculosis H37Rv
cgaaucgcuucgagca

SEQ ID NO: 3248425 - RNA, 19 nt, Mycobacterium tuberculosis H37Rv
cgaaucugaaaaagcauca

SEQ ID NO: 3248426 - RNA, 19 nt, Mycobacterium tuberculosis H37Rv
cgaaugacgauccagccca

SEQ ID NO: 3248427 - RNA, 13 nt, Mycobacterium tuberculosis H37Rv
cgaaugacggcca

SEQ ID NO: 3248428 - RNA, 18 nt, Mycobacterium tuberculosis H37Rv
cgaaugaucgucccgcgg

SEQ ID NO: 3248429 - RNA, 16 nt, Mycobacterium tuberculosis H37Rv
cgaaugccaccucgac

SEQ ID NO: 3248430 - RNA, 18 nt, Mycobacterium tuberculosis H37Rv
cgaaugcgggccuccugc

SEQ ID NO: 3248431 - RNA, 14 nt, Mycobacterium tuberculosis H37Rv
cgaaugcgggugga

SEQ ID NO: 3248432 - RNA, 20 nt, Mycobacterium tuberculosis H37Rv
cgaaugcugggcccgccagc

SEQ ID NO: 3248433 - RNA, 16 nt, Mycobacterium tuberculosis H37Rv
cgaaugggggcugguc

SEQ ID NO: 3248434 - RNA, 15 nt, Mycobacterium tuberculosis H37Rv
cgaaugucgccgccu

SEQ ID NO: 3248435 - RNA, 18 nt, Mycobacterium tuberculosis H37Rv
cgaaugucgcucaaaccc

SEQ ID NO: 3248436 - RNA, 17 nt, Mycobacterium tuberculosis H37Rv
cgaauguugcgaucugc

SEQ ID NO: 3248437 - RNA, 16 nt, Mycobacterium tuberculosis H37Rv
cgaauguuucggcgau

SEQ ID NO: 3248438 - RNA, 15 nt, Mycobacterium tuberculosis H37Rv
cgaauucagcugcac

SEQ ID NO: 3248439 - RNA, 14 nt, Mycobacterium tuberculosis H37Rv
cgaauugcguucgc

SEQ ID NO: 3248440 - RNA, 12 nt, Mycobacterium tuberculosis H37Rv
cgaauuugucgg

SEQ ID NO: 3248441 - RNA, 17 nt, Mycobacterium tuberculosis H37Rv
cgacaaacguguugacc

SEQ ID NO: 3248442 - RNA, 19 nt, Mycobacterium tuberculosis H37Rv
cgacaaagcggcugcccga

SEQ ID NO: 3248443 - RNA, 22 nt, Mycobacterium tuberculosis H37Rv
cgacaaaucggucgacgaucuc

SEQ ID NO: 3248444 - RNA, 18 nt, Mycobacterium tuberculosis H37Rv
cgacaacaaacccggccu

SEQ ID NO: 3248445 - RNA, 15 nt, Mycobacterium tuberculosis H37Rv
cgacaacaccacggu

SEQ ID NO: 3248446 - RNA, 14 nt, Mycobacterium tuberculosis H37Rv
cgacaacacccacg

SEQ ID NO: 3248447 - RNA, 13 nt, Mycobacterium tuberculosis H37Rv
cgacaacacgccg

SEQ ID NO: 3248448 - RNA, 14 nt, Mycobacterium tuberculosis H37Rv
cgacaacagccagc

SEQ ID NO: 3248449 - RNA, 21 nt, Mycobacterium tuberculosis H37Rv
cgacaacaugcccgucagcgg

SEQ ID NO: 3248450 - RNA, 18 nt, Mycobacterium tuberculosis H37Rv
cgacaacccggccgggcc

SEQ ID NO: 3248451 - RNA, 19 nt, Mycobacterium tuberculosis H37Rv
cgacaacgacgucgccgac

SEQ ID NO: 3248452 - RNA, 19 nt, Mycobacterium tuberculosis H37Rv
cgacaacgacugcguuccg

SEQ ID NO: 3248453 - RNA, 17 nt, Mycobacterium tuberculosis H37Rv
cgacaacugcccgauga

SEQ ID NO: 3248454 - RNA, 20 nt, Mycobacterium tuberculosis H37Rv
cgacaacuucgccggacccc

SEQ ID NO: 3248455 - RNA, 21 nt, Mycobacterium tuberculosis H37Rv
cgacaagcugucggcgaccga

SEQ ID NO: 3248456 - RNA, 22 nt, Mycobacterium tuberculosis H37Rv
cgacaagugcacgaaguccugg

SEQ ID NO: 3248457 - RNA, 22 nt, Mycobacterium tuberculosis H37Rv
cgaccaccgcgaaagcaccgag

SEQ ID NO: 3248458 - RNA, 15 nt, Mycobacterium tuberculosis H37Rv
cgaccaccgcgucgg

SEQ ID NO: 3248459 - RNA, 18 nt, Mycobacterium tuberculosis H37Rv
cgaccaccguuugagcgg

SEQ ID NO: 3248460 - RNA, 20 nt, Mycobacterium tuberculosis H37Rv
cgaccaccucagcugcggac

SEQ ID NO: 3248461 - RNA, 16 nt, Mycobacterium tuberculosis H37Rv
cgaccaccucgaugcc

SEQ ID NO: 3248462 - RNA, 14 nt, Mycobacterium tuberculosis H37Rv
cgaccaccugagcc

SEQ ID NO: 3248463 - RNA, 14 nt, Mycobacterium tuberculosis H37Rv
cgaccacgacguuc

SEQ ID NO: 3248464 - RNA, 16 nt, Mycobacterium tuberculosis H37Rv
cgaccacgcaccgccc

SEQ ID NO: 3248465 - RNA, 18 nt, Mycobacterium tuberculosis H37Rv
cgaccacgccgccggcgc

SEQ ID NO: 3248466 - RNA, 14 nt, Mycobacterium tuberculosis H37Rv
cgaccacugcccgg

SEQ ID NO: 3248467 - RNA, 21 nt, Mycobacterium tuberculosis H37Rv
cgaccagaacgccagaccgac

SEQ ID NO: 3248468 - RNA, 12 nt, Mycobacterium tuberculosis H37Rv
cgaccagaaucg

SEQ ID NO: 3248469 - RNA, 13 nt, Mycobacterium tuberculosis H37Rv
cgaccagaaucgg

SEQ ID NO: 3248470 - RNA, 22 nt, Mycobacterium tuberculosis H37Rv
cgaccagaaucggguucuuuug

SEQ ID NO: 3248471 - RNA, 21 nt, Mycobacterium tuberculosis H37Rv
cgaccagaggcgugucgacuc

SEQ ID NO: 3248472 - RNA, 22 nt, Mycobacterium tuberculosis H37Rv
cgaccagaggcgugucgacucc

SEQ ID NO: 3248473 - RNA, 14 nt, Mycobacterium tuberculosis H37Rv
cgaccagcacccgc

SEQ ID NO: 3248474 - RNA, 20 nt, Mycobacterium tuberculosis H37Rv
cgaccagcacccgcucggcc

SEQ ID NO: 3248475 - RNA, 11 nt, Mycobacterium tuberculosis H37Rv
cgaccagcaga

SEQ ID NO: 3248476 - RNA, 14 nt, Mycobacterium tuberculosis H37Rv
cgaccagcagacca

SEQ ID NO: 3248477 - RNA, 13 nt, Mycobacterium tuberculosis H37Rv
cgaccagcagauc

SEQ ID NO: 3248478 - RNA, 15 nt, Mycobacterium tuberculosis H37Rv
cgaccagcagaucca

SEQ ID NO: 3248479 - RNA, 17 nt, Mycobacterium tuberculosis H37Rv
cgaccagccgaucauca

SEQ ID NO: 3248480 - RNA, 19 nt, Mycobacterium tuberculosis H37Rv
cgaccagccgaucaucacc

SEQ ID NO: 3248481 - RNA, 20 nt, Mycobacterium tuberculosis H37Rv
cgaccaggaccggcugcagg

SEQ ID NO: 3248482 - RNA, 19 nt, Mycobacterium tuberculosis H37Rv
cgaccaggccacugccgac

SEQ ID NO: 3248483 - RNA, 20 nt, Mycobacterium tuberculosis H37Rv
cgaccaggccagagccgccc

SEQ ID NO: 3248484 - RNA, 12 nt, Mycobacterium tuberculosis H37Rv
cgaccagggccg

SEQ ID NO: 3248485 - RNA, 18 nt, Mycobacterium tuberculosis H37Rv
cgaccagggccgccgcug

SEQ ID NO: 3248486 - RNA, 14 nt, Mycobacterium tuberculosis H37Rv
cgaccagugguggc

SEQ ID NO: 3248487 - RNA, 13 nt, Mycobacterium tuberculosis H37Rv
cgaccauacccgc

SEQ ID NO: 3248488 - RNA, 18 nt, Mycobacterium tuberculosis H37Rv
cgaccauacccgcgcgca

SEQ ID NO: 3248489 - RNA, 21 nt, Mycobacterium tuberculosis H37Rv
cgaccauacccgcgcgcacca

SEQ ID NO: 3248490 - RNA, 18 nt, Mycobacterium tuberculosis H37Rv
cgaccauauucagcucgg

SEQ ID NO: 3248491 - RNA, 13 nt, Mycobacterium tuberculosis H37Rv
cgaccaucaccac

SEQ ID NO: 3248492 - RNA, 17 nt, Mycobacterium tuberculosis H37Rv
cgaccaucaccacggcc

SEQ ID NO: 3248493 - RNA, 19 nt, Mycobacterium tuberculosis H37Rv
cgaccaucucaccgggccc

SEQ ID NO: 3248494 - RNA, 17 nt, Mycobacterium tuberculosis H37Rv
cgaccaucugaucgggc

SEQ ID NO: 3248495 - RNA, 14 nt, Mycobacterium tuberculosis H37Rv
cgaccaugagccgg

SEQ ID NO: 3248496 - RNA, 14 nt, Mycobacterium tuberculosis H37Rv
cgaccaugcuccua

SEQ ID NO: 3248497 - RNA, 15 nt, Mycobacterium tuberculosis H37Rv
cgaccaugcuccuau

SEQ ID NO: 3248498 - RNA, 22 nt, Mycobacterium tuberculosis H37Rv
cgaccaugguagcgccccgaug

SEQ ID NO: 3248499 - RNA, 23 nt, Mycobacterium tuberculosis H37Rv
cgaccauggucgauucgucgaag

SEQ ID NO: 3248500 - RNA, 20 nt, Mycobacterium tuberculosis H37Rv
cgaccauucgagagccucua

SEQ ID NO: 3248501 - RNA, 13 nt, Mycobacterium tuberculosis H37Rv
cgacccaacccga

SEQ ID NO: 3248502 - RNA, 12 nt, Mycobacterium tuberculosis H37Rv
cgacccagcggu

SEQ ID NO: 3248503 - RNA, 13 nt, Mycobacterium tuberculosis H37Rv
cgacccagcgguu

SEQ ID NO: 3248504 - RNA, 13 nt, Mycobacterium tuberculosis H37Rv
cgacccagcugac

SEQ ID NO: 3248505 - RNA, 14 nt, Mycobacterium tuberculosis H37Rv
cgacccaucaccag

SEQ ID NO: 3248506 - RNA, 17 nt, Mycobacterium tuberculosis H37Rv
cgacccaucaccagcgg

SEQ ID NO: 3248507 - RNA, 20 nt, Mycobacterium tuberculosis H37Rv
cgacccaucaccagcggcug

SEQ ID NO: 3248508 - RNA, 14 nt, Mycobacterium tuberculosis H37Rv
cgacccccugccac

SEQ ID NO: 3248509 - RNA, 19 nt, Mycobacterium tuberculosis H37Rv
cgaccccgaacauccgccg

SEQ ID NO: 3248510 - RNA, 22 nt, Mycobacterium tuberculosis H37Rv
cgaccccgaacauccgccgccc

SEQ ID NO: 3248511 - RNA, 19 nt, Mycobacterium tuberculosis H37Rv
cgaccccgaagaugaccuc

SEQ ID NO: 3248512 - RNA, 17 nt, Mycobacterium tuberculosis H37Rv
cgaccccgcgccgacac

SEQ ID NO: 3248513 - RNA, 22 nt, Mycobacterium tuberculosis H37Rv
cgaccccggaaugcccgagcag

SEQ ID NO: 3248514 - RNA, 17 nt, Mycobacterium tuberculosis H37Rv
cgacccgaacugggcga

SEQ ID NO: 3248515 - RNA, 15 nt, Mycobacterium tuberculosis H37Rv
cgacccgaagccgac

SEQ ID NO: 3248516 - RNA, 13 nt, Mycobacterium tuberculosis H37Rv
cgacccgacgcug

SEQ ID NO: 3248517 - RNA, 22 nt, Mycobacterium tuberculosis H37Rv
cgacccgaucaccuucggccga

SEQ ID NO: 3248518 - RNA, 15 nt, Mycobacterium tuberculosis H37Rv
cgacccgaugaccca

SEQ ID NO: 3248519 - RNA, 18 nt, Mycobacterium tuberculosis H37Rv
cgacccgcagaccgccac

SEQ ID NO: 3248520 - RNA, 21 nt, Mycobacterium tuberculosis H37Rv
cgacccgcagaccgccaccgg

SEQ ID NO: 3248521 - RNA, 12 nt, Mycobacterium tuberculosis H37Rv
cgacccgcccau

SEQ ID NO: 3248522 - RNA, 13 nt, Mycobacterium tuberculosis H37Rv
cgacccgcccgaa

SEQ ID NO: 3248523 - RNA, 13 nt, Mycobacterium tuberculosis H37Rv
cgacccgccgaug

SEQ ID NO: 3248524 - RNA, 12 nt, Mycobacterium tuberculosis H37Rv
cgacccgcgcaa

SEQ ID NO: 3248525 - RNA, 20 nt, Mycobacterium tuberculosis H37Rv
cgacccgcgcaaccggccgu

SEQ ID NO: 3248526 - RNA, 20 nt, Mycobacterium tuberculosis H37Rv
cgacccgcgcgccggcgacc

SEQ ID NO: 3248527 - RNA, 18 nt, Mycobacterium tuberculosis H37Rv
cgacccgcuucgcccggc

SEQ ID NO: 3248528 - RNA, 21 nt, Mycobacterium tuberculosis H37Rv
cgacccgcuucgcccggcugc

SEQ ID NO: 3248529 - RNA, 19 nt, Mycobacterium tuberculosis H37Rv
cgacccggaccugggcgac

SEQ ID NO: 3248530 - RNA, 14 nt, Mycobacterium tuberculosis H37Rv
cgacccggcccagc

SEQ ID NO: 3248531 - RNA, 16 nt, Mycobacterium tuberculosis H37Rv
cgacccggcgcagcaa

SEQ ID NO: 3248532 - RNA, 19 nt, Mycobacterium tuberculosis H37Rv
cgacccggcgcagcaacgc

SEQ ID NO: 3248533 - RNA, 19 nt, Mycobacterium tuberculosis H37Rv
cgacccgggaaggaaccgg

SEQ ID NO: 3248534 - RNA, 13 nt, Mycobacterium tuberculosis H37Rv
cgacccgggccgc

SEQ ID NO: 3248535 - RNA, 23 nt, Mycobacterium tuberculosis H37Rv
cgacccgggccgcggcggccagc

SEQ ID NO: 3248536 - RNA, 18 nt, Mycobacterium tuberculosis H37Rv
cgacccgggccggucggu

SEQ ID NO: 3248537 - RNA, 18 nt, Mycobacterium tuberculosis H37Rv
cgacccgggcgucccaau

SEQ ID NO: 3248538 - RNA, 20 nt, Mycobacterium tuberculosis H37Rv
cgacccgggucggcacgacc

SEQ ID NO: 3248539 - RNA, 21 nt, Mycobacterium tuberculosis H37Rv
cgacccgggucggcacgaccc

SEQ ID NO: 3248540 - RNA, 12 nt, Mycobacterium tuberculosis H37Rv
cgacccggucac

SEQ ID NO: 3248541 - RNA, 16 nt, Mycobacterium tuberculosis H37Rv
cgacccggucgcggaa

SEQ ID NO: 3248542 - RNA, 18 nt, Mycobacterium tuberculosis H37Rv
cgacccguaccagcccgu

SEQ ID NO: 3248543 - RNA, 19 nt, Mycobacterium tuberculosis H37Rv
cgacccgucccccgcacgc

SEQ ID NO: 3248544 - RNA, 19 nt, Mycobacterium tuberculosis H37Rv
cgacccgucgaacgcgcgc

SEQ ID NO: 3248545 - RNA, 22 nt, Mycobacterium tuberculosis H37Rv
cgacccguugaacucgaagacc

SEQ ID NO: 3248546 - RNA, 19 nt, Mycobacterium tuberculosis H37Rv
cgacccuaguucagcgccg

SEQ ID NO: 3248547 - RNA, 12 nt, Mycobacterium tuberculosis H37Rv
cgacccuccagc

SEQ ID NO: 3248548 - RNA, 17 nt, Mycobacterium tuberculosis H37Rv
cgaccgaaagccgcacc

SEQ ID NO: 3248549 - RNA, 15 nt, Mycobacterium tuberculosis H37Rv
cgaccgaaccgucag

SEQ ID NO: 3248550 - RNA, 14 nt, Mycobacterium tuberculosis H37Rv
cgaccgaacgccag

SEQ ID NO: 3248551 - RNA, 23 nt, Mycobacterium tuberculosis H37Rv
cgaccgaacgccaggucaucggc

SEQ ID NO: 3248552 - RNA, 21 nt, Mycobacterium tuberculosis H37Rv
cgaccgaaucagcacggugug

SEQ ID NO: 3248553 - RNA, 16 nt, Mycobacterium tuberculosis H37Rv
cgaccgacaccaccag

SEQ ID NO: 3248554 - RNA, 21 nt, Mycobacterium tuberculosis H37Rv
cgaccuccaccaaugcuccug

SEQ ID NO: 3248555 - RNA, 14 nt, Mycobacterium tuberculosis H37Rv
cgaccuccacgccc

SEQ ID NO: 3248556 - RNA, 21 nt, Mycobacterium tuberculosis H37Rv
cgaccuccgcgaucaccgacg

SEQ ID NO: 3248557 - RNA, 21 nt, Mycobacterium tuberculosis H37Rv
cgaccuccggaaucgcccggg

SEQ ID NO: 3248558 - RNA, 22 nt, Mycobacterium tuberculosis H37Rv
cgaccuccucgaugaccggcga

SEQ ID NO: 3248559 - RNA, 17 nt, Mycobacterium tuberculosis H37Rv
cgaccucgacucugguc

SEQ ID NO: 3248560 - RNA, 16 nt, Mycobacterium tuberculosis H37Rv
cgaccucgcgcggggc

SEQ ID NO: 3248561 - RNA, 17 nt, Mycobacterium tuberculosis H37Rv
cgaccucggcgaccgcg

SEQ ID NO: 3248562 - RNA, 17 nt, Mycobacterium tuberculosis H37Rv
cgaccucgggaucggcg

SEQ ID NO: 3248563 - RNA, 20 nt, Mycobacterium tuberculosis H37Rv
cgaccucguucgucaccacg

SEQ ID NO: 3248564 - RNA, 20 nt, Mycobacterium tuberculosis H37Rv
cgaccucugcacggccguca

SEQ ID NO: 3248565 - RNA, 21 nt, Mycobacterium tuberculosis H37Rv
cgaccucugcacggccgucau

SEQ ID NO: 3248566 - RNA, 16 nt, Mycobacterium tuberculosis H37Rv
cgaccugaaugcggcc

SEQ ID NO: 3248567 - RNA, 14 nt, Mycobacterium tuberculosis H37Rv
cgaccugacugguc

SEQ ID NO: 3248568 - RNA, 18 nt, Mycobacterium tuberculosis H37Rv
cgaccugagucggcauug

SEQ ID NO: 3248569 - RNA, 18 nt, Mycobacterium tuberculosis H37Rv
cgaccugcgcgacggcgc

SEQ ID NO: 3248570 - RNA, 20 nt, Mycobacterium tuberculosis H37Rv
cgaccugcgcgacggcgcug

SEQ ID NO: 3248571 - RNA, 23 nt, Mycobacterium tuberculosis H37Rv
cgaccugcgcgagguuggcguug

SEQ ID NO: 3248572 - RNA, 16 nt, Mycobacterium tuberculosis H37Rv
cgaccugcucauccac

SEQ ID NO: 3248573 - RNA, 21 nt, Mycobacterium tuberculosis H37Rv
cgaccugcucgauacggcccu

SEQ ID NO: 3248574 - RNA, 13 nt, Mycobacterium tuberculosis H37Rv
cgaccugcucgcu

SEQ ID NO: 3248575 - RNA, 17 nt, Mycobacterium tuberculosis H37Rv
cgaccugguaugccgcc

SEQ ID NO: 3248576 - RNA, 21 nt, Mycobacterium tuberculosis H37Rv
cgaccugguaugccgcccgca

SEQ ID NO: 3248577 - RNA, 19 nt, Mycobacterium tuberculosis H37Rv
cgaccuguaugccgcggug

SEQ ID NO: 3248578 - RNA, 12 nt, Mycobacterium tuberculosis H37Rv
cgaccuguccac

SEQ ID NO: 3248579 - RNA, 16 nt, Mycobacterium tuberculosis H37Rv
cgaccuguccacccag

SEQ ID NO: 3248580 - RNA, 22 nt, Mycobacterium tuberculosis H37Rv
cgaccuuggacacuugaagugu

SEQ ID NO: 3248581 - RNA, 14 nt, Mycobacterium tuberculosis H37Rv
cgacgaacaccagc

SEQ ID NO: 3248582 - RNA, 18 nt, Mycobacterium tuberculosis H37Rv
cgacgaacaccagcgcgc

SEQ ID NO: 3248583 - RNA, 18 nt, Mycobacterium tuberculosis H37Rv
cgacgaacaccccgggcg

SEQ ID NO: 3248584 - RNA, 20 nt, Mycobacterium tuberculosis H37Rv
cgacgaacaccccgggcgcc

SEQ ID NO: 3248585 - RNA, 17 nt, Mycobacterium tuberculosis H37Rv
cgacgaaccgccagaau

SEQ ID NO: 3248586 - RNA, 19 nt, Mycobacterium tuberculosis H37Rv
cgacgaaccgguugccguu

SEQ ID NO: 3248587 - RNA, 19 nt, Mycobacterium tuberculosis H37Rv
cgacgaacucacgcaggaa

SEQ ID NO: 3248588 - RNA, 16 nt, Mycobacterium tuberculosis H37Rv
cgacgaacuccgcguu

SEQ ID NO: 3248589 - RNA, 21 nt, Mycobacterium tuberculosis H37Rv
cgacgaacucgcccagggugg

SEQ ID NO: 3248590 - RNA, 14 nt, Mycobacterium tuberculosis H37Rv
cgacgaacugcagc

SEQ ID NO: 3248591 - RNA, 17 nt, Mycobacterium tuberculosis H37Rv
cgacgaacugcagccau

SEQ ID NO: 3248592 - RNA, 22 nt, Mycobacterium tuberculosis H37Rv
cgacgaagaagaacucggcguc

SEQ ID NO: 3248593 - RNA, 23 nt, Mycobacterium tuberculosis H37Rv
cgacgaagaagaacucggcgucg

SEQ ID NO: 3248594 - RNA, 14 nt, Mycobacterium tuberculosis H37Rv
cgacgaagaucgcg

SEQ ID NO: 3248595 - RNA, 17 nt, Mycobacterium tuberculosis H37Rv
cgacgaagaucgcgugc

SEQ ID NO: 3248596 - RNA, 21 nt, Mycobacterium tuberculosis H37Rv
cgacgaauaacgcggucggca

SEQ ID NO: 3248597 - RNA, 20 nt, Mycobacterium tuberculosis H37Rv
cgacgaauaccgggaugcga

SEQ ID NO: 3248598 - RNA, 16 nt, Mycobacterium tuberculosis H37Rv
cgacgaauccccgaca

SEQ ID NO: 3248599 - RNA, 13 nt, Mycobacterium tuberculosis H37Rv
cgacgacaaccgg

SEQ ID NO: 3248600 - RNA, 16 nt, Mycobacterium tuberculosis H37Rv
cgacgacaaggugugg

SEQ ID NO: 3248601 - RNA, 20 nt, Mycobacterium tuberculosis H37Rv
cgacgacaagugcccggcca

SEQ ID NO: 3248602 - RNA, 16 nt, Mycobacterium tuberculosis H37Rv
cgacgacaccagagcg

SEQ ID NO: 3248603 - RNA, 13 nt, Mycobacterium tuberculosis H37Rv
cgacgacaccgcg

SEQ ID NO: 3248604 - RNA, 20 nt, Mycobacterium tuberculosis H37Rv
cgacgacauacgagcaguga

SEQ ID NO: 3248605 - RNA, 20 nt, Mycobacterium tuberculosis H37Rv
cgacgacaucgagccaacgc

SEQ ID NO: 3248606 - RNA, 23 nt, Mycobacterium tuberculosis H37Rv
cgacgacaucgguggcccggugc

SEQ ID NO: 3248607 - RNA, 22 nt, Mycobacterium tuberculosis H37Rv
cgacgaccacaccacgauggcg

SEQ ID NO: 3248608 - RNA, 23 nt, Mycobacterium tuberculosis H37Rv
cgacgaccaccuucugacgcggc

SEQ ID NO: 3248609 - RNA, 12 nt, Mycobacterium tuberculosis H37Rv
cgacgaccagca

SEQ ID NO: 3248610 - RNA, 15 nt, Mycobacterium tuberculosis H37Rv
cgacgaccagcagau

SEQ ID NO: 3248611 - RNA, 16 nt, Mycobacterium tuberculosis H37Rv
cgacgacccgacguag

SEQ ID NO: 3248612 - RNA, 18 nt, Mycobacterium tuberculosis H37Rv
cgacgacccgggucggca

SEQ ID NO: 3248613 - RNA, 18 nt, Mycobacterium tuberculosis H37Rv
cgacgacccguugacguu

SEQ ID NO: 3248614 - RNA, 14 nt, Mycobacterium tuberculosis H37Rv
cgacgaccgccugc

SEQ ID NO: 3248615 - RNA, 18 nt, Mycobacterium tuberculosis H37Rv
cgacgaccgccugcaaca

SEQ ID NO: 3248616 - RNA, 22 nt, Mycobacterium tuberculosis H37Rv
cgacgaccgucacaagucgaca

SEQ ID NO: 3248617 - RNA, 14 nt, Mycobacterium tuberculosis H37Rv
cgacgacgacaccg

SEQ ID NO: 3248618 - RNA, 15 nt, Mycobacterium tuberculosis H37Rv
cgacgacgacaccgc

SEQ ID NO: 3248619 - RNA, 12 nt, Mycobacterium tuberculosis H37Rv
cgacgacgacgu

SEQ ID NO: 3248620 - RNA, 22 nt, Mycobacterium tuberculosis H37Rv
cgacgacgccaaugccgcggag

SEQ ID NO: 3248621 - RNA, 15 nt, Mycobacterium tuberculosis H37Rv
cgacgacgcccacca

SEQ ID NO: 3248622 - RNA, 17 nt, Mycobacterium tuberculosis H37Rv
cgacgacggcgccgucg

SEQ ID NO: 3248623 - RNA, 14 nt, Mycobacterium tuberculosis H37Rv
cgacgacgggcgcc

SEQ ID NO: 3248624 - RNA, 14 nt, Mycobacterium tuberculosis H37Rv
cgacgacgggguug

SEQ ID NO: 3248625 - RNA, 18 nt, Mycobacterium tuberculosis H37Rv
cgacgacuccggcaagca

SEQ ID NO: 3248626 - RNA, 17 nt, Mycobacterium tuberculosis H37Rv
cgacgagaagacaccgc

SEQ ID NO: 3248627 - RNA, 14 nt, Mycobacterium tuberculosis H37Rv
cgacgagacggcag

SEQ ID NO: 3248628 - RNA, 18 nt, Mycobacterium tuberculosis H37Rv
cgacgagauacggccacc

SEQ ID NO: 3248629 - RNA, 14 nt, Mycobacterium tuberculosis H37Rv
cgacgagauccagc

SEQ ID NO: 3248630 - RNA, 18 nt, Mycobacterium tuberculosis H37Rv
cgacgagaucugcgaugg

SEQ ID NO: 3248631 - RNA, 18 nt, Mycobacterium tuberculosis H37Rv
cgacgagauugccgggcc

SEQ ID NO: 3248632 - RNA, 20 nt, Mycobacterium tuberculosis H37Rv
cgacgagcaacgccacccga

SEQ ID NO: 3248633 - RNA, 13 nt, Mycobacterium tuberculosis H37Rv
cgacgagcaccgc

SEQ ID NO: 3248634 - RNA, 13 nt, Mycobacterium tuberculosis H37Rv
cgacgagcagcaa

SEQ ID NO: 3248635 - RNA, 14 nt, Mycobacterium tuberculosis H37Rv
cgacgagggcggga

SEQ ID NO: 3248636 - RNA, 21 nt, Mycobacterium tuberculosis H37Rv
cgacgagggcgggacccguga

SEQ ID NO: 3248637 - RNA, 14 nt, Mycobacterium tuberculosis H37Rv
cgacgagucgccgc

SEQ ID NO: 3248638 - RNA, 16 nt, Mycobacterium tuberculosis H37Rv
cgacgaucaacggaac

SEQ ID NO: 3248639 - RNA, 15 nt, Mycobacterium tuberculosis H37Rv
cgacgaucagcacgu

SEQ ID NO: 3248640 - RNA, 20 nt, Mycobacterium tuberculosis H37Rv
cgacgaucagcacgucgcgg

SEQ ID NO: 3248641 - RNA, 15 nt, Mycobacterium tuberculosis H37Rv
cgacgaucagcgagu

SEQ ID NO: 3248642 - RNA, 16 nt, Mycobacterium tuberculosis H37Rv
cgacgaucagcgagua

SEQ ID NO: 3248643 - RNA, 16 nt, Mycobacterium tuberculosis H37Rv
cgacgauccacggcga

SEQ ID NO: 3248644 - RNA, 21 nt, Mycobacterium tuberculosis H37Rv
cgacgaucgucuugucgccga

SEQ ID NO: 3248645 - RNA, 12 nt, Mycobacterium tuberculosis H37Rv
cgacgaucucuc

SEQ ID NO: 3248646 - RNA, 17 nt, Mycobacterium tuberculosis H37Rv
cgacgaugacgcgcgaa

SEQ ID NO: 3248647 - RNA, 14 nt, Mycobacterium tuberculosis H37Rv
cgacgaugccgcgg

SEQ ID NO: 3248648 - RNA, 16 nt, Mycobacterium tuberculosis H37Rv
cgacgaugccgcggga

SEQ ID NO: 3248649 - RNA, 14 nt, Mycobacterium tuberculosis H37Rv
cgacgaugcgggcg

SEQ ID NO: 3248650 - RNA, 14 nt, Mycobacterium tuberculosis H37Rv
cgacggccagccca

SEQ ID NO: 3248651 - RNA, 18 nt, Mycobacterium tuberculosis H37Rv
cgacggccagcgcgucgg

SEQ ID NO: 3248652 - RNA, 16 nt, Mycobacterium tuberculosis H37Rv
cgacggccagugcgca

SEQ ID NO: 3248653 - RNA, 19 nt, Mycobacterium tuberculosis H37Rv
cgacggccaucgugcggca

SEQ ID NO: 3248654 - RNA, 14 nt, Mycobacterium tuberculosis H37Rv
cgacggcccgccgu

SEQ ID NO: 3248655 - RNA, 14 nt, Mycobacterium tuberculosis H37Rv
cgacggccgcggcg

SEQ ID NO: 3248656 - RNA, 17 nt, Mycobacterium tuberculosis H37Rv
cgacggccgcggcgucg

SEQ ID NO: 3248657 - RNA, 15 nt, Mycobacterium tuberculosis H37Rv
cgacggccggcaagc

SEQ ID NO: 3248658 - RNA, 17 nt, Mycobacterium tuberculosis H37Rv
cgacggccggcaagcag

SEQ ID NO: 3248659 - RNA, 15 nt, Mycobacterium tuberculosis H37Rv
cgacggccucgucga

SEQ ID NO: 3248660 - RNA, 14 nt, Mycobacterium tuberculosis H37Rv
cgacggcgacggcg

SEQ ID NO: 3248661 - RNA, 15 nt, Mycobacterium tuberculosis H37Rv
cgacggcgauggcgc

SEQ ID NO: 3248662 - RNA, 13 nt, Mycobacterium tuberculosis H37Rv
cgacggcgccauu

SEQ ID NO: 3248663 - RNA, 13 nt, Mycobacterium tuberculosis H37Rv
cgacggcgcccau

SEQ ID NO: 3248664 - RNA, 21 nt, Mycobacterium tuberculosis H37Rv
cgacggcgccgucguugugcc

SEQ ID NO: 3248665 - RNA, 18 nt, Mycobacterium tuberculosis H37Rv
cgacggcgcucggcgagc

SEQ ID NO: 3248666 - RNA, 13 nt, Mycobacterium tuberculosis H37Rv
cgacggcggccaa

SEQ ID NO: 3248667 - RNA, 12 nt, Mycobacterium tuberculosis H37Rv
cgacggcggccg

SEQ ID NO: 3248668 - RNA, 16 nt, Mycobacterium tuberculosis H37Rv
cgacggcggccgcgau

SEQ ID NO: 3248669 - RNA, 15 nt, Mycobacterium tuberculosis H37Rv
cgacggcggccuucg

SEQ ID NO: 3248670 - RNA, 19 nt, Mycobacterium tuberculosis H37Rv
cgacggcggcgucgaugag

SEQ ID NO: 3248671 - RNA, 16 nt, Mycobacterium tuberculosis H37Rv
cgacggcgucacccgc

SEQ ID NO: 3248672 - RNA, 14 nt, Mycobacterium tuberculosis H37Rv
cgacggcgucuucg

SEQ ID NO: 3248673 - RNA, 15 nt, Mycobacterium tuberculosis H37Rv
cgacggcuccuccgg

SEQ ID NO: 3248674 - RNA, 14 nt, Mycobacterium tuberculosis H37Rv
cgacgggaaccagc

SEQ ID NO: 3248675 - RNA, 16 nt, Mycobacterium tuberculosis H37Rv
cgacgggaaccucgac

SEQ ID NO: 3248676 - RNA, 21 nt, Mycobacterium tuberculosis H37Rv
cgacgggcacccgagccgcac

SEQ ID NO: 3248677 - RNA, 15 nt, Mycobacterium tuberculosis H37Rv
cgacggggcggucgg

SEQ ID NO: 3248678 - RNA, 16 nt, Mycobacterium tuberculosis H37Rv
cgacgggggucgggcg

SEQ ID NO: 3248679 - RNA, 23 nt, Mycobacterium tuberculosis H37Rv
cgacgggguuguggucgaguuga

SEQ ID NO: 3248680 - RNA, 17 nt, Mycobacterium tuberculosis H37Rv
cgacgggucggcgccga

SEQ ID NO: 3248681 - RNA, 19 nt, Mycobacterium tuberculosis H37Rv
cgacgguaggcccgcgcga

SEQ ID NO: 3248682 - RNA, 20 nt, Mycobacterium tuberculosis H37Rv
cgacggucaaggugcgccgc

SEQ ID NO: 3248683 - RNA, 22 nt, Mycobacterium tuberculosis H37Rv
cgacggucaaggugcgccgcca

SEQ ID NO: 3248684 - RNA, 15 nt, Mycobacterium tuberculosis H37Rv
cgacggucacggugg

SEQ ID NO: 3248685 - RNA, 17 nt, Mycobacterium tuberculosis H37Rv
cgacggucagguccugg

SEQ ID NO: 3248686 - RNA, 17 nt, Mycobacterium tuberculosis H37Rv
cgacggucuggcccgcg

SEQ ID NO: 3248687 - RNA, 12 nt, Mycobacterium tuberculosis H37Rv
cgacggugaacc

SEQ ID NO: 3248688 - RNA, 17 nt, Mycobacterium tuberculosis H37Rv
cgacggugaaccaccac

SEQ ID NO: 3248689 - RNA, 13 nt, Mycobacterium tuberculosis H37Rv
cgacggugaucag

SEQ ID NO: 3248690 - RNA, 22 nt, Mycobacterium tuberculosis H37Rv
cgacgguggcgccgucggccga

SEQ ID NO: 3248691 - RNA, 13 nt, Mycobacterium tuberculosis H37Rv
cgacgguguagcc

SEQ ID NO: 3248692 - RNA, 14 nt, Mycobacterium tuberculosis H37Rv
cgacgguguccgga

SEQ ID NO: 3248693 - RNA, 18 nt, Mycobacterium tuberculosis H37Rv
cgacgguucccagcuucc

SEQ ID NO: 3248694 - RNA, 16 nt, Mycobacterium tuberculosis H37Rv
cgacgguuugcaccgc

SEQ ID NO: 3248695 - RNA, 18 nt, Mycobacterium tuberculosis H37Rv
cgacguagacgacgucgg

SEQ ID NO: 3248696 - RNA, 15 nt, Mycobacterium tuberculosis H37Rv
cgacguagauggugg

SEQ ID NO: 3248697 - RNA, 16 nt, Mycobacterium tuberculosis H37Rv
cgacguaggacugcca

SEQ ID NO: 3248698 - RNA, 20 nt, Mycobacterium tuberculosis H37Rv
cgacguaguggaagccgacc

SEQ ID NO: 3248699 - RNA, 18 nt, Mycobacterium tuberculosis H37Rv
cgacguaguugccggcuu

SEQ ID NO: 3248700 - RNA, 23 nt, Mycobacterium tuberculosis H37Rv
cgacguauuucgcccccuggaug

SEQ ID NO: 3248701 - RNA, 16 nt, Mycobacterium tuberculosis H37Rv
cgacgucaaacgcaaa

SEQ ID NO: 3248702 - RNA, 13 nt, Mycobacterium tuberculosis H37Rv
cgacgucagggua

SEQ ID NO: 3248703 - RNA, 12 nt, Mycobacterium tuberculosis H37Rv
cgacguccacca

SEQ ID NO: 3248704 - RNA, 22 nt, Mycobacterium tuberculosis H37Rv
cgacguccaguccaugugccca

SEQ ID NO: 3248705 - RNA, 16 nt, Mycobacterium tuberculosis H37Rv
cgacguccgaucggug

SEQ ID NO: 3248706 - RNA, 16 nt, Mycobacterium tuberculosis H37Rv
cgacgucgaccacugc

SEQ ID NO: 3248707 - RNA, 23 nt, Mycobacterium tuberculosis H37Rv
cgacgucgagcgccuugucgauc

SEQ ID NO: 3248708 - RNA, 19 nt, Mycobacterium tuberculosis H37Rv
cgacgucgauuucggcgac

SEQ ID NO: 3248709 - RNA, 12 nt, Mycobacterium tuberculosis H37Rv
cgacgucgccaa

SEQ ID NO: 3248710 - RNA, 17 nt, Mycobacterium tuberculosis H37Rv
cgacgucgccaagacca

SEQ ID NO: 3248711 - RNA, 14 nt, Mycobacterium tuberculosis H37Rv
cgacgucgccgacc

SEQ ID NO: 3248712 - RNA, 15 nt, Mycobacterium tuberculosis H37Rv
cgacgucgccgccgc

SEQ ID NO: 3248713 - RNA, 20 nt, Mycobacterium tuberculosis H37Rv
cgacgucgccgccgcgggcg

SEQ ID NO: 3248714 - RNA, 15 nt, Mycobacterium tuberculosis H37Rv
cgacgucgccggacg

SEQ ID NO: 3248715 - RNA, 22 nt, Mycobacterium tuberculosis H37Rv
cgacgucgcggcgccugaggug

SEQ ID NO: 3248716 - RNA, 18 nt, Mycobacterium tuberculosis H37Rv
cgacgucggccgcaucgc

SEQ ID NO: 3248717 - RNA, 21 nt, Mycobacterium tuberculosis H37Rv
cgacgucggccgcaucgccca

SEQ ID NO: 3248718 - RNA, 17 nt, Mycobacterium tuberculosis H37Rv
cgacgucggccguuucc

SEQ ID NO: 3248719 - RNA, 19 nt, Mycobacterium tuberculosis H37Rv
cgacgucggcgaccagguc

SEQ ID NO: 3248720 - RNA, 15 nt, Mycobacterium tuberculosis H37Rv
cgacgucggcgagca

SEQ ID NO: 3248721 - RNA, 12 nt, Mycobacterium tuberculosis H37Rv
cgacgucggcgc

SEQ ID NO: 3248722 - RNA, 18 nt, Mycobacterium tuberculosis H37Rv
cgacgucggcuucaccuu

SEQ ID NO: 3248723 - RNA, 18 nt, Mycobacterium tuberculosis H37Rv
cgacgucgggaacuucuc

SEQ ID NO: 3248724 - RNA, 14 nt, Mycobacterium tuberculosis H37Rv
cgacgucggugacc

SEQ ID NO: 3248725 - RNA, 20 nt, Mycobacterium tuberculosis H37Rv
cgacgucguagaccuccagu

SEQ ID NO: 3248726 - RNA, 22 nt, Mycobacterium tuberculosis H37Rv
cgacgucguuggaaaucccugg

SEQ ID NO: 3248727 - RNA, 16 nt, Mycobacterium tuberculosis H37Rv
cgacgucuaggccaaa

SEQ ID NO: 3248728 - RNA, 15 nt, Mycobacterium tuberculosis H37Rv
cgacgucucgcaugc

SEQ ID NO: 3248729 - RNA, 12 nt, Mycobacterium tuberculosis H37Rv
cgacgucugcca

SEQ ID NO: 3248730 - RNA, 21 nt, Mycobacterium tuberculosis H37Rv
cgacgucugcccaguguccgg

SEQ ID NO: 3248731 - RNA, 17 nt, Mycobacterium tuberculosis H37Rv
cgacgucuuugacgaac

SEQ ID NO: 3248732 - RNA, 23 nt, Mycobacterium tuberculosis H37Rv
cgacgugagggucaugucgauca

SEQ ID NO: 3248733 - RNA, 13 nt, Mycobacterium tuberculosis H37Rv
cgacgugaucgcg

SEQ ID NO: 3248734 - RNA, 15 nt, Mycobacterium tuberculosis H37Rv
cgacgugauggugac

SEQ ID NO: 3248735 - RNA, 19 nt, Mycobacterium tuberculosis H37Rv
cgacgugcaggaacaccca

SEQ ID NO: 3248736 - RNA, 17 nt, Mycobacterium tuberculosis H37Rv
cgacguuaccgaccgcg

SEQ ID NO: 3248737 - RNA, 18 nt, Mycobacterium tuberculosis H37Rv
cgacguucgacgacagca

SEQ ID NO: 3248738 - RNA, 15 nt, Mycobacterium tuberculosis H37Rv
cgacguucgggucga

SEQ ID NO: 3248739 - RNA, 13 nt, Mycobacterium tuberculosis H37Rv
cgacguucggugg

SEQ ID NO: 3248740 - RNA, 18 nt, Mycobacterium tuberculosis H37Rv
cgacguucuuguccagga

SEQ ID NO: 3248741 - RNA, 14 nt, Mycobacterium tuberculosis H37Rv
cgacguugaucgcc

SEQ ID NO: 3248742 - RNA, 15 nt, Mycobacterium tuberculosis H37Rv
cgacguugaucgcca

SEQ ID NO: 3248743 - RNA, 22 nt, Mycobacterium tuberculosis H37Rv
cgacguugaucgccaugguguc

SEQ ID NO: 3248744 - RNA, 17 nt, Mycobacterium tuberculosis H37Rv
cgacguugaugaccugu

SEQ ID NO: 3248745 - RNA, 19 nt, Mycobacterium tuberculosis H37Rv
cgacuaacggugcgguugc

SEQ ID NO: 3248746 - RNA, 20 nt, Mycobacterium tuberculosis H37Rv
cgacuacacauucauccacc

SEQ ID NO: 3248747 - RNA, 15 nt, Mycobacterium tuberculosis H37Rv
cgagaucaccgccac

SEQ ID NO: 3248748 - RNA, 22 nt, Mycobacterium tuberculosis H37Rv
cgagaucaccgccaccaccagg

SEQ ID NO: 3248749 - RNA, 19 nt, Mycobacterium tuberculosis H37Rv
cgagaucagccggcagcga

SEQ ID NO: 3248750 - RNA, 18 nt, Mycobacterium tuberculosis H37Rv
cgagaucagucugggcga

SEQ ID NO: 3248751 - RNA, 13 nt, Mycobacterium tuberculosis H37Rv
cgagauccagcgc

SEQ ID NO: 3248752 - RNA, 15 nt, Mycobacterium tuberculosis H37Rv
cgagauccagcgcaa

SEQ ID NO: 3248753 - RNA, 18 nt, Mycobacterium tuberculosis H37Rv
cgagauccucgucgaggu

SEQ ID NO: 3248754 - RNA, 16 nt, Mycobacterium tuberculosis H37Rv
cgagaucgccgagcag

SEQ ID NO: 3248755 - RNA, 15 nt, Mycobacterium tuberculosis H37Rv
cgagaugccgcgauc

SEQ ID NO: 3248756 - RNA, 20 nt, Mycobacterium tuberculosis H37Rv
cgagaugccgcgaucgugca

SEQ ID NO: 3248757 - RNA, 12 nt, Mycobacterium tuberculosis H37Rv
cgagaugcugca

SEQ ID NO: 3248758 - RNA, 16 nt, Mycobacterium tuberculosis H37Rv
cgagauggcgaucaug

SEQ ID NO: 3248759 - RNA, 16 nt, Mycobacterium tuberculosis H37Rv
cgagauuggugcagac

SEQ ID NO: 3248760 - RNA, 19 nt, Mycobacterium tuberculosis H37Rv
cgagcaaacauccacccgc

SEQ ID NO: 3248761 - RNA, 23 nt, Mycobacterium tuberculosis H37Rv
cgagcaaaccagauugccgagcc

SEQ ID NO: 3248762 - RNA, 16 nt, Mycobacterium tuberculosis H37Rv
cgagcaacaccagggc

SEQ ID NO: 3248763 - RNA, 17 nt, Mycobacterium tuberculosis H37Rv
cgagcaacaccagggcc

SEQ ID NO: 3248764 - RNA, 14 nt, Mycobacterium tuberculosis H37Rv
cgagcaacgccacc

SEQ ID NO: 3248765 - RNA, 19 nt, Mycobacterium tuberculosis H37Rv
cgagcaacgccacccgaau

SEQ ID NO: 3248766 - RNA, 21 nt, Mycobacterium tuberculosis H37Rv
cgagcaacggacgaagcaccu

SEQ ID NO: 3248767 - RNA, 14 nt, Mycobacterium tuberculosis H37Rv
cgagcaacgggcga

SEQ ID NO: 3248768 - RNA, 18 nt, Mycobacterium tuberculosis H37Rv
cgagcaacucguccagca

SEQ ID NO: 3248769 - RNA, 15 nt, Mycobacterium tuberculosis H37Rv
cgagcaaggggaucu

SEQ ID NO: 3248770 - RNA, 15 nt, Mycobacterium tuberculosis H37Rv
cgagcaauuccucag

SEQ ID NO: 3248771 - RNA, 17 nt, Mycobacterium tuberculosis H37Rv
cgagcacacuccuagcc

SEQ ID NO: 3248772 - RNA, 22 nt, Mycobacterium tuberculosis H37Rv
cgagcacaugcugccgcugcga

SEQ ID NO: 3248773 - RNA, 16 nt, Mycobacterium tuberculosis H37Rv
cgagcaccaccccagc

SEQ ID NO: 3248774 - RNA, 18 nt, Mycobacterium tuberculosis H37Rv
cgagcaccacccgggccu

SEQ ID NO: 3248775 - RNA, 20 nt, Mycobacterium tuberculosis H37Rv
cgagcaccauccggucccgc

SEQ ID NO: 3248776 - RNA, 15 nt, Mycobacterium tuberculosis H37Rv
cgagcaccccgacgu

SEQ ID NO: 3248777 - RNA, 20 nt, Mycobacterium tuberculosis H37Rv
cgagcacccguugaucgcgg

SEQ ID NO: 3248778 - RNA, 16 nt, Mycobacterium tuberculosis H37Rv
cgagcaccgacaccgg

SEQ ID NO: 3248779 - RNA, 22 nt, Mycobacterium tuberculosis H37Rv
cgagcaccgacaccggccgcga

SEQ ID NO: 3248780 - RNA, 16 nt, Mycobacterium tuberculosis H37Rv
cgagcaccgcgguagc

SEQ ID NO: 3248781 - RNA, 19 nt, Mycobacterium tuberculosis H37Rv
cgagcaccgcgguagccga

SEQ ID NO: 3248782 - RNA, 20 nt, Mycobacterium tuberculosis H37Rv
cgagcaccgugcccugggug

SEQ ID NO: 3248783 - RNA, 15 nt, Mycobacterium tuberculosis H37Rv
cgagcaccugccgau

SEQ ID NO: 3248784 - RNA, 15 nt, Mycobacterium tuberculosis H37Rv
cgagcacgaugucga

SEQ ID NO: 3248785 - RNA, 14 nt, Mycobacterium tuberculosis H37Rv
cgagcacgccaacg

SEQ ID NO: 3248786 - RNA, 17 nt, Mycobacterium tuberculosis H37Rv
cgagcacgccgaccaau

SEQ ID NO: 3248787 - RNA, 22 nt, Mycobacterium tuberculosis H37Rv
cgagcacgcgggcacugguggc

SEQ ID NO: 3248788 - RNA, 16 nt, Mycobacterium tuberculosis H37Rv
cgagcacgcugcugcg

SEQ ID NO: 3248789 - RNA, 23 nt, Mycobacterium tuberculosis H37Rv
cgagcacgggacuucgugccucg

SEQ ID NO: 3248790 - RNA, 23 nt, Mycobacterium tuberculosis H37Rv
cgagcacggugagccgguggccc

SEQ ID NO: 3248791 - RNA, 14 nt, Mycobacterium tuberculosis H37Rv
cgagcacgucacgc

SEQ ID NO: 3248792 - RNA, 14 nt, Mycobacterium tuberculosis H37Rv
cgagcacguccucg

SEQ ID NO: 3248793 - RNA, 20 nt, Mycobacterium tuberculosis H37Rv
cgagcacuccggagcccaca

SEQ ID NO: 3248794 - RNA, 16 nt, Mycobacterium tuberculosis H37Rv
cgagcacucggccacg

SEQ ID NO: 3248795 - RNA, 18 nt, Mycobacterium tuberculosis H37Rv
cgagcagacacagaaucg

SEQ ID NO: 3248796 - RNA, 19 nt, Mycobacterium tuberculosis H37Rv
cgagcagacacagaaucgc

SEQ ID NO: 3248797 - RNA, 20 nt, Mycobacterium tuberculosis H37Rv
cgagcagacacagaaucgca

SEQ ID NO: 3248798 - RNA, 20 nt, Mycobacterium tuberculosis H37Rv
cgagcagacacagaaucgcc

SEQ ID NO: 3248799 - RNA, 20 nt, Mycobacterium tuberculosis H37Rv
cgagcagacacuaaagcccu

SEQ ID NO: 3248800 - RNA, 19 nt, Mycobacterium tuberculosis H37Rv
cgagcagacgcaaaauccc

SEQ ID NO: 3248801 - RNA, 19 nt, Mycobacterium tuberculosis H37Rv
cgagcagacgcaaaaucgc

SEQ ID NO: 3248802 - RNA, 20 nt, Mycobacterium tuberculosis H37Rv
cgagcagacgcaaaaucgca

SEQ ID NO: 3248803 - RNA, 16 nt, Mycobacterium tuberculosis H37Rv
cgagcagacgcagaau

SEQ ID NO: 3248804 - RNA, 18 nt, Mycobacterium tuberculosis H37Rv
cgagcagacgcagaaucg

SEQ ID NO: 3248805 - RNA, 20 nt, Mycobacterium tuberculosis H37Rv
cgagcagacgcagaaucgca

SEQ ID NO: 3248806 - RNA, 20 nt, Mycobacterium tuberculosis H37Rv
cgagcagacgcagaaucgcc

SEQ ID NO: 3248807 - RNA, 19 nt, Mycobacterium tuberculosis H37Rv
cgagcagacgcagagucgc

SEQ ID NO: 3248808 - RNA, 20 nt, Mycobacterium tuberculosis H37Rv
cgagcagacgcagagucgca

SEQ ID NO: 3248809 - RNA, 17 nt, Mycobacterium tuberculosis H37Rv
cgagcagacgugggcgc

SEQ ID NO: 3248810 - RNA, 20 nt, Mycobacterium tuberculosis H37Rv
cgagcagauacuccgcgguu

SEQ ID NO: 3248811 - RNA, 18 nt, Mycobacterium tuberculosis H37Rv
cgagcagauacuuguuga

SEQ ID NO: 3248812 - RNA, 16 nt, Mycobacterium tuberculosis H37Rv
cgagcagaucagcacg

SEQ ID NO: 3248813 - RNA, 22 nt, Mycobacterium tuberculosis H37Rv
cgagcagaucgcgggcgcguug

SEQ ID NO: 3248814 - RNA, 15 nt, Mycobacterium tuberculosis H37Rv
cgagcagauggugaa

SEQ ID NO: 3248815 - RNA, 13 nt, Mycobacterium tuberculosis H37Rv
cgagcagcacagc

SEQ ID NO: 3248816 - RNA, 13 nt, Mycobacterium tuberculosis H37Rv
cgagcagcccgcg

SEQ ID NO: 3248817 - RNA, 17 nt, Mycobacterium tuberculosis H37Rv
cgagcagcccggcgaau

SEQ ID NO: 3248818 - RNA, 13 nt, Mycobacterium tuberculosis H37Rv
cgagcagcccggg

SEQ ID NO: 3248819 - RNA, 14 nt, Mycobacterium tuberculosis H37Rv
cgagcagcuacagc

SEQ ID NO: 3248820 - RNA, 18 nt, Mycobacterium tuberculosis H37Rv
cgagcagcuucucggcga

SEQ ID NO: 3248821 - RNA, 18 nt, Mycobacterium tuberculosis H37Rv
cgagcaggcccaacgcga

SEQ ID NO: 3248822 - RNA, 23 nt, Mycobacterium tuberculosis H37Rv
cgagcaggcccaacgcgaugucc

SEQ ID NO: 3248823 - RNA, 21 nt, Mycobacterium tuberculosis H37Rv
cgagcaggcuggcugccacga

SEQ ID NO: 3248824 - RNA, 22 nt, Mycobacterium tuberculosis H37Rv
cgagcagggccggcaccgcagc

SEQ ID NO: 3248825 - RNA, 15 nt, Mycobacterium tuberculosis H37Rv
cgagcagggcgucga

SEQ ID NO: 3248826 - RNA, 16 nt, Mycobacterium tuberculosis H37Rv
cgagcagggcgucgac

SEQ ID NO: 3248827 - RNA, 17 nt, Mycobacterium tuberculosis H37Rv
cgagcaggggaguugcu

SEQ ID NO: 3248828 - RNA, 14 nt, Mycobacterium tuberculosis H37Rv
cgagcagggugacc

SEQ ID NO: 3248829 - RNA, 15 nt, Mycobacterium tuberculosis H37Rv
cgagcaggucggcaa

SEQ ID NO: 3248830 - RNA, 22 nt, Mycobacterium tuberculosis H37Rv
cgagcagguguugcacgagcau

SEQ ID NO: 3248831 - RNA, 23 nt, Mycobacterium tuberculosis H37Rv
cgagcagucgcuaaagcccccga

SEQ ID NO: 3248832 - RNA, 20 nt, Mycobacterium tuberculosis H37Rv
cgagcagugccucggcgaug

SEQ ID NO: 3248833 - RNA, 21 nt, Mycobacterium tuberculosis H37Rv
cgagcaguggaguauccggca

SEQ ID NO: 3248834 - RNA, 19 nt, Mycobacterium tuberculosis H37Rv
cgagcaucaacgaaccagc

SEQ ID NO: 3248835 - RNA, 20 nt, Mycobacterium tuberculosis H37Rv
cgagcaucaauugaguagau

SEQ ID NO: 3248836 - RNA, 14 nt, Mycobacterium tuberculosis H37Rv
cgagcaugcccagc

SEQ ID NO: 3248837 - RNA, 17 nt, Mycobacterium tuberculosis H37Rv
cgagcaugcccagcgaa

SEQ ID NO: 3248838 - RNA, 17 nt, Mycobacterium tuberculosis H37Rv
cgagccaacaagucgau

SEQ ID NO: 3248839 - RNA, 13 nt, Mycobacterium tuberculosis H37Rv
cgagccaacgcau

SEQ ID NO: 3248840 - RNA, 20 nt, Mycobacterium tuberculosis H37Rv
cgagccaacuccacccaacg

SEQ ID NO: 3248841 - RNA, 14 nt, Mycobacterium tuberculosis H37Rv
cgagccaaggcuuc

SEQ ID NO: 3248842 - RNA, 17 nt, Mycobacterium tuberculosis H37Rv
cgagccacaugaccuga

SEQ ID NO: 3248843 - RNA, 18 nt, Mycobacterium tuberculosis H37Rv
cgagcgguacgcccgaau

SEQ ID NO: 3248844 - RNA, 21 nt, Mycobacterium tuberculosis H37Rv
cgagcgguacgcccgaaucgc

SEQ ID NO: 3248845 - RNA, 16 nt, Mycobacterium tuberculosis H37Rv
cgagcggucgacgugu

SEQ ID NO: 3248846 - RNA, 15 nt, Mycobacterium tuberculosis H37Rv
cgagcggugccggcg

SEQ ID NO: 3248847 - RNA, 16 nt, Mycobacterium tuberculosis H37Rv
cgagcgguugaucgcg

SEQ ID NO: 3248848 - RNA, 19 nt, Mycobacterium tuberculosis H37Rv
cgagcguaaugcugcugca

SEQ ID NO: 3248849 - RNA, 22 nt, Mycobacterium tuberculosis H37Rv
cgagcguaaugcugcugcagca

SEQ ID NO: 3248850 - RNA, 18 nt, Mycobacterium tuberculosis H37Rv
cgagcguagcgaccucgc

SEQ ID NO: 3248851 - RNA, 22 nt, Mycobacterium tuberculosis H37Rv
cgagcgucagauccggccguug

SEQ ID NO: 3248852 - RNA, 19 nt, Mycobacterium tuberculosis H37Rv
cgagcgugaaccuggcgac

SEQ ID NO: 3248853 - RNA, 22 nt, Mycobacterium tuberculosis H37Rv
cgagcgugaaccuggcgacgcg

SEQ ID NO: 3248854 - RNA, 20 nt, Mycobacterium tuberculosis H37Rv
cgagcgugucacguaacgcc

SEQ ID NO: 3248855 - RNA, 18 nt, Mycobacterium tuberculosis H37Rv
cgagcguuggcuucuucg

SEQ ID NO: 3248856 - RNA, 23 nt, Mycobacterium tuberculosis H37Rv
cgagcguuggcuucuucggucac

SEQ ID NO: 3248857 - RNA, 18 nt, Mycobacterium tuberculosis H37Rv
cgagcguuuggacgggcg

SEQ ID NO: 3248858 - RNA, 17 nt, Mycobacterium tuberculosis H37Rv
cgagcucaccaaggucg

SEQ ID NO: 3248859 - RNA, 21 nt, Mycobacterium tuberculosis H37Rv
cgagcucaccaaggucggcga

SEQ ID NO: 3248860 - RNA, 15 nt, Mycobacterium tuberculosis H37Rv
cgagcucaccgcaca

SEQ ID NO: 3248861 - RNA, 21 nt, Mycobacterium tuberculosis H37Rv
cgagcucaggucgacaggugc

SEQ ID NO: 3248862 - RNA, 19 nt, Mycobacterium tuberculosis H37Rv
cgagcucccgggcgcucac

SEQ ID NO: 3248863 - RNA, 14 nt, Mycobacterium tuberculosis H37Rv
cgagcuccgaugcc

SEQ ID NO: 3248864 - RNA, 22 nt, Mycobacterium tuberculosis H37Rv
cgagcuccuccaccaacucgac

SEQ ID NO: 3248865 - RNA, 18 nt, Mycobacterium tuberculosis H37Rv
cgagcucgaagcccggac

SEQ ID NO: 3248866 - RNA, 21 nt, Mycobacterium tuberculosis H37Rv
cgagcucggcgaacggcacca

SEQ ID NO: 3248867 - RNA, 12 nt, Mycobacterium tuberculosis H37Rv
cgagcucggcgc

SEQ ID NO: 3248868 - RNA, 13 nt, Mycobacterium tuberculosis H37Rv
cgagcucggcgcc

SEQ ID NO: 3248869 - RNA, 14 nt, Mycobacterium tuberculosis H37Rv
cgagcucggcgccc

SEQ ID NO: 3248870 - RNA, 17 nt, Mycobacterium tuberculosis H37Rv
cgagcucggcgcccagc

SEQ ID NO: 3248871 - RNA, 18 nt, Mycobacterium tuberculosis H37Rv
cgagcucguugcuggcgg

SEQ ID NO: 3248872 - RNA, 23 nt, Mycobacterium tuberculosis H37Rv
cgagcucguugcuggcggccagc

SEQ ID NO: 3248873 - RNA, 13 nt, Mycobacterium tuberculosis H37Rv
cgagcugaccacg

SEQ ID NO: 3248874 - RNA, 14 nt, Mycobacterium tuberculosis H37Rv
cgagcugaccuggu

SEQ ID NO: 3248875 - RNA, 17 nt, Mycobacterium tuberculosis H37Rv
cgagcugacgccgagcu

SEQ ID NO: 3248876 - RNA, 20 nt, Mycobacterium tuberculosis H37Rv
cgagcugacgccgagcuggu

SEQ ID NO: 3248877 - RNA, 17 nt, Mycobacterium tuberculosis H37Rv
cgagcugauacgcaugc

SEQ ID NO: 3248878 - RNA, 19 nt, Mycobacterium tuberculosis H37Rv
cgagcugauacgcaugcga

SEQ ID NO: 3248879 - RNA, 14 nt, Mycobacterium tuberculosis H37Rv
cgagcugauccggg

SEQ ID NO: 3248880 - RNA, 14 nt, Mycobacterium tuberculosis H37Rv
cgagcugccaacgc

SEQ ID NO: 3248881 - RNA, 12 nt, Mycobacterium tuberculosis H37Rv
cgagcugccagg

SEQ ID NO: 3248882 - RNA, 18 nt, Mycobacterium tuberculosis H37Rv
cgagcugccgucgcugcc

SEQ ID NO: 3248883 - RNA, 13 nt, Mycobacterium tuberculosis H37Rv
cgagcugcggguc

SEQ ID NO: 3248884 - RNA, 18 nt, Mycobacterium tuberculosis H37Rv
cgagcuggcgaccugguc

SEQ ID NO: 3248885 - RNA, 18 nt, Mycobacterium tuberculosis H37Rv
cgagcuggcgcgcggggu

SEQ ID NO: 3248886 - RNA, 17 nt, Mycobacterium tuberculosis H37Rv
cgagcuguaggucagcg

SEQ ID NO: 3248887 - RNA, 15 nt, Mycobacterium tuberculosis H37Rv
cgagcuguggucacc

SEQ ID NO: 3248888 - RNA, 22 nt, Mycobacterium tuberculosis H37Rv
cgagcuucagcgcgcugcagug

SEQ ID NO: 3248889 - RNA, 18 nt, Mycobacterium tuberculosis H37Rv
cgagcuuccacgccggac

SEQ ID NO: 3248890 - RNA, 23 nt, Mycobacterium tuberculosis H37Rv
cgagcuugagcgugagcgccgcg

SEQ ID NO: 3248891 - RNA, 14 nt, Mycobacterium tuberculosis H37Rv
cgagcuuggccgcc

SEQ ID NO: 3248892 - RNA, 15 nt, Mycobacterium tuberculosis H37Rv
cgagcuuggcuuggc

SEQ ID NO: 3248893 - RNA, 14 nt, Mycobacterium tuberculosis H37Rv
cgaggaacgccggg

SEQ ID NO: 3248894 - RNA, 16 nt, Mycobacterium tuberculosis H37Rv
cgaggaacucggaccc

SEQ ID NO: 3248895 - RNA, 20 nt, Mycobacterium tuberculosis H37Rv
cgaggaacucggacccaccc

SEQ ID NO: 3248896 - RNA, 22 nt, Mycobacterium tuberculosis H37Rv
cgaggaaggagccaagggcugu

SEQ ID NO: 3248897 - RNA, 15 nt, Mycobacterium tuberculosis H37Rv
cgaggaauuccgcua

SEQ ID NO: 3248898 - RNA, 21 nt, Mycobacterium tuberculosis H37Rv
cgaggaauuccgcuaccgcac

SEQ ID NO: 3248899 - RNA, 22 nt, Mycobacterium tuberculosis H37Rv
cgaggacaagcccgcugccauc

SEQ ID NO: 3248900 - RNA, 21 nt, Mycobacterium tuberculosis H37Rv
cgaggacacauugaccaggug

SEQ ID NO: 3248901 - RNA, 17 nt, Mycobacterium tuberculosis H37Rv
cgaggaccagaggcgcu

SEQ ID NO: 3248902 - RNA, 19 nt, Mycobacterium tuberculosis H37Rv
cgaggaccugcucgggcgu

SEQ ID NO: 3248903 - RNA, 14 nt, Mycobacterium tuberculosis H37Rv
cgaggacgccggcg

SEQ ID NO: 3248904 - RNA, 19 nt, Mycobacterium tuberculosis H37Rv
cgaggacgccggcgccgcc

SEQ ID NO: 3248905 - RNA, 15 nt, Mycobacterium tuberculosis H37Rv
cgaggacggcggcca

SEQ ID NO: 3248906 - RNA, 21 nt, Mycobacterium tuberculosis H37Rv
cgaggacggcuugagccgcag

SEQ ID NO: 3248907 - RNA, 17 nt, Mycobacterium tuberculosis H37Rv
cgaggacuggaaagcag

SEQ ID NO: 3248908 - RNA, 22 nt, Mycobacterium tuberculosis H37Rv
cgaggacuggaaagcagcagcg

SEQ ID NO: 3248909 - RNA, 12 nt, Mycobacterium tuberculosis H37Rv
cgaggagggccg

SEQ ID NO: 3248910 - RNA, 15 nt, Mycobacterium tuberculosis H37Rv
cgaggagggccgcga

SEQ ID NO: 3248911 - RNA, 18 nt, Mycobacterium tuberculosis H37Rv
cgaggaguuggugcagcg

SEQ ID NO: 3248912 - RNA, 16 nt, Mycobacterium tuberculosis H37Rv
cgaggauccauuggaa

SEQ ID NO: 3248913 - RNA, 20 nt, Mycobacterium tuberculosis H37Rv
cgaggaucccgcugcacgac

SEQ ID NO: 3248914 - RNA, 20 nt, Mycobacterium tuberculosis H37Rv
cgaggaugcugagcgccagg

SEQ ID NO: 3248915 - RNA, 21 nt, Mycobacterium tuberculosis H37Rv
cgaggauguaguuggugaugc

SEQ ID NO: 3248916 - RNA, 16 nt, Mycobacterium tuberculosis H37Rv
cgaggaugugguuggu

SEQ ID NO: 3248917 - RNA, 20 nt, Mycobacterium tuberculosis H37Rv
cgaggauucauggcggcaua

SEQ ID NO: 3248918 - RNA, 16 nt, Mycobacterium tuberculosis H37Rv
cgaggcaaccgacacu

SEQ ID NO: 3248919 - RNA, 22 nt, Mycobacterium tuberculosis H37Rv
cgaggcacaaucaccgccgcga

SEQ ID NO: 3248920 - RNA, 18 nt, Mycobacterium tuberculosis H37Rv
cgaggcaccgacaucguc

SEQ ID NO: 3248921 - RNA, 22 nt, Mycobacterium tuberculosis H37Rv
cgaggcagacacgagucgccag

SEQ ID NO: 3248922 - RNA, 15 nt, Mycobacterium tuberculosis H37Rv
cgaggcagcacccgc

SEQ ID NO: 3248923 - RNA, 14 nt, Mycobacterium tuberculosis H37Rv
cgaggcagcgucgu

SEQ ID NO: 3248924 - RNA, 15 nt, Mycobacterium tuberculosis H37Rv
cgaggcagcgucguc

SEQ ID NO: 3248925 - RNA, 19 nt, Mycobacterium tuberculosis H37Rv
cgaggcagcgucgucgacg

SEQ ID NO: 3248926 - RNA, 20 nt, Mycobacterium tuberculosis H37Rv
cgaggccacgccagcucgcc

SEQ ID NO: 3248927 - RNA, 14 nt, Mycobacterium tuberculosis H37Rv
cgaggccagcagcu

SEQ ID NO: 3248928 - RNA, 21 nt, Mycobacterium tuberculosis H37Rv
cgaggccagcagcugcuccag

SEQ ID NO: 3248929 - RNA, 16 nt, Mycobacterium tuberculosis H37Rv
cgaggccaugcucgcc

SEQ ID NO: 3248930 - RNA, 15 nt, Mycobacterium tuberculosis H37Rv
cgaggccgccgagau

SEQ ID NO: 3248931 - RNA, 19 nt, Mycobacterium tuberculosis H37Rv
cgaggccgccguugccguu

SEQ ID NO: 3248932 - RNA, 23 nt, Mycobacterium tuberculosis H37Rv
cgaggccgcugccagggugcgcc

SEQ ID NO: 3248933 - RNA, 15 nt, Mycobacterium tuberculosis H37Rv
cgaggccuaccaggc

SEQ ID NO: 3248934 - RNA, 23 nt, Mycobacterium tuberculosis H37Rv
cgaggccuaccaggcgcggccca

SEQ ID NO: 3248935 - RNA, 15 nt, Mycobacterium tuberculosis H37Rv
cgaggccucggccag

SEQ ID NO: 3248936 - RNA, 12 nt, Mycobacterium tuberculosis H37Rv
cgaggcgaaaga

SEQ ID NO: 3248937 - RNA, 23 nt, Mycobacterium tuberculosis H37Rv
cgaggcgaagcgggacugcagcg

SEQ ID NO: 3248938 - RNA, 23 nt, Mycobacterium tuberculosis H37Rv
cgaggcgaguucgcgcacgucgg

SEQ ID NO: 3248939 - RNA, 23 nt, Mycobacterium tuberculosis H37Rv
cgagugcggugugugcaagccga

SEQ ID NO: 3248940 - RNA, 21 nt, Mycobacterium tuberculosis H37Rv
cgaguggaucauguucggcca

SEQ ID NO: 3248941 - RNA, 16 nt, Mycobacterium tuberculosis H37Rv
cgagugggugaggcca

SEQ ID NO: 3248942 - RNA, 17 nt, Mycobacterium tuberculosis H37Rv
cgagugguccagccaga

SEQ ID NO: 3248943 - RNA, 14 nt, Mycobacterium tuberculosis H37Rv
cgagugucagcaga

SEQ ID NO: 3248944 - RNA, 18 nt, Mycobacterium tuberculosis H37Rv
cgaguucgcagucgauga

SEQ ID NO: 3248945 - RNA, 17 nt, Mycobacterium tuberculosis H37Rv
cgaguucgcgaaucccg

SEQ ID NO: 3248946 - RNA, 13 nt, Mycobacterium tuberculosis H37Rv
cgaguucggcagc

SEQ ID NO: 3248947 - RNA, 23 nt, Mycobacterium tuberculosis H37Rv
cgaguugaacaauccgguguuga

SEQ ID NO: 3248948 - RNA, 12 nt, Mycobacterium tuberculosis H37Rv
cgaguugaagaa

SEQ ID NO: 3248949 - RNA, 17 nt, Mycobacterium tuberculosis H37Rv
cgaguugagaaccggcu

SEQ ID NO: 3248950 - RNA, 21 nt, Mycobacterium tuberculosis H37Rv
cgaguugcggugcccgcacca

SEQ ID NO: 3248951 - RNA, 20 nt, Mycobacterium tuberculosis H37Rv
cgaguugcucggccgaugcg

SEQ ID NO: 3248952 - RNA, 12 nt, Mycobacterium tuberculosis H37Rv
cgaguuggccau

SEQ ID NO: 3248953 - RNA, 16 nt, Mycobacterium tuberculosis H37Rv
cgaguugucucgcauc

SEQ ID NO: 3248954 - RNA, 16 nt, Mycobacterium tuberculosis H37Rv
cgaguuguugcugccc

SEQ ID NO: 3248955 - RNA, 16 nt, Mycobacterium tuberculosis H37Rv
cgaguuucugcucgac

SEQ ID NO: 3248956 - RNA, 17 nt, Mycobacterium tuberculosis H37Rv
cgaguuucugcucgacc

SEQ ID NO: 3248957 - RNA, 13 nt, Mycobacterium tuberculosis H37Rv
cgauaagcagcuc

SEQ ID NO: 3248958 - RNA, 18 nt, Mycobacterium tuberculosis H37Rv
cgauacaacgcggcuuug

SEQ ID NO: 3248959 - RNA, 22 nt, Mycobacterium tuberculosis H37Rv
cgauacaacgcggcuuugccgg

SEQ ID NO: 3248960 - RNA, 14 nt, Mycobacterium tuberculosis H37Rv
cgauacagaucugg

SEQ ID NO: 3248961 - RNA, 14 nt, Mycobacterium tuberculosis H37Rv
cgauacccagcggg

SEQ ID NO: 3248962 - RNA, 22 nt, Mycobacterium tuberculosis H37Rv
cgauacccaggauguguugcca

SEQ ID NO: 3248963 - RNA, 16 nt, Mycobacterium tuberculosis H37Rv
cgauaccgcaccaaag

SEQ ID NO: 3248964 - RNA, 20 nt, Mycobacterium tuberculosis H37Rv
cgauaccggcggcgagcggc

SEQ ID NO: 3248965 - RNA, 21 nt, Mycobacterium tuberculosis H37Rv
cgauaccgugcaccuccaggu

SEQ ID NO: 3248966 - RNA, 18 nt, Mycobacterium tuberculosis H37Rv
cgauagccaccgacgaca

SEQ ID NO: 3248967 - RNA, 22 nt, Mycobacterium tuberculosis H37Rv
cgauagcgcggcaccagcaccg

SEQ ID NO: 3248968 - RNA, 17 nt, Mycobacterium tuberculosis H37Rv
cgauagcggauucacgc

SEQ ID NO: 3248969 - RNA, 21 nt, Mycobacterium tuberculosis H37Rv
cgauagcggcccgaucaccag

SEQ ID NO: 3248970 - RNA, 13 nt, Mycobacterium tuberculosis H37Rv
cgauagcggcggc

SEQ ID NO: 3248971 - RNA, 15 nt, Mycobacterium tuberculosis H37Rv
cgauagcuggccgau

SEQ ID NO: 3248972 - RNA, 15 nt, Mycobacterium tuberculosis H37Rv
cgauauaccagggca

SEQ ID NO: 3248973 - RNA, 22 nt, Mycobacterium tuberculosis H37Rv
cgauauagccgccggugccgcc

SEQ ID NO: 3248974 - RNA, 16 nt, Mycobacterium tuberculosis H37Rv
cgauaucgaugcggcg

SEQ ID NO: 3248975 - RNA, 15 nt, Mycobacterium tuberculosis H37Rv
cgauaucgcugcgga

SEQ ID NO: 3248976 - RNA, 16 nt, Mycobacterium tuberculosis H37Rv
cgauaucggcggcuug

SEQ ID NO: 3248977 - RNA, 15 nt, Mycobacterium tuberculosis H37Rv
cgauaucgggcucag

SEQ ID NO: 3248978 - RNA, 12 nt, Mycobacterium tuberculosis H37Rv
cgauaucugcca

SEQ ID NO: 3248979 - RNA, 17 nt, Mycobacterium tuberculosis H37Rv
cgauaugcagcucgcug

SEQ ID NO: 3248980 - RNA, 22 nt, Mycobacterium tuberculosis H37Rv
cgauaugcgugagcugcucgag

SEQ ID NO: 3248981 - RNA, 18 nt, Mycobacterium tuberculosis H37Rv
cgauauggccuugcugcg

SEQ ID NO: 3248982 - RNA, 14 nt, Mycobacterium tuberculosis H37Rv
cgauauucggccau

SEQ ID NO: 3248983 - RNA, 20 nt, Mycobacterium tuberculosis H37Rv
cgauauucggccauguagcc

SEQ ID NO: 3248984 - RNA, 18 nt, Mycobacterium tuberculosis H37Rv
cgauauuggacgcgcaug

SEQ ID NO: 3248985 - RNA, 18 nt, Mycobacterium tuberculosis H37Rv
cgaucaaagccagcaccu

SEQ ID NO: 3248986 - RNA, 21 nt, Mycobacterium tuberculosis H37Rv
cgaucaacaacagccgcagcc

SEQ ID NO: 3248987 - RNA, 22 nt, Mycobacterium tuberculosis H37Rv
cgaucaacaacagccgcagcca

SEQ ID NO: 3248988 - RNA, 21 nt, Mycobacterium tuberculosis H37Rv
cgaucaacaccaacgacagcg

SEQ ID NO: 3248989 - RNA, 15 nt, Mycobacterium tuberculosis H37Rv
cgaucaacagcaccg

SEQ ID NO: 3248990 - RNA, 15 nt, Mycobacterium tuberculosis H37Rv
cgaucaacgcgcacg

SEQ ID NO: 3248991 - RNA, 18 nt, Mycobacterium tuberculosis H37Rv
cgaucaagccuucgucga

SEQ ID NO: 3248992 - RNA, 11 nt, Mycobacterium tuberculosis H37Rv
cgaucaaugcg

SEQ ID NO: 3248993 - RNA, 15 nt, Mycobacterium tuberculosis H37Rv
cgaucaauugcccgg

SEQ ID NO: 3248994 - RNA, 20 nt, Mycobacterium tuberculosis H37Rv
cgaucacaacgugcccacca

SEQ ID NO: 3248995 - RNA, 13 nt, Mycobacterium tuberculosis H37Rv
cgaucacaccacg

SEQ ID NO: 3248996 - RNA, 22 nt, Mycobacterium tuberculosis H37Rv
cgaucaccaccggaucgcuccc

SEQ ID NO: 3248997 - RNA, 18 nt, Mycobacterium tuberculosis H37Rv
cgaucacccgcacuccac

SEQ ID NO: 3248998 - RNA, 16 nt, Mycobacterium tuberculosis H37Rv
cgaucaccgacaccgu

SEQ ID NO: 3248999 - RNA, 21 nt, Mycobacterium tuberculosis H37Rv
cgaucaccgagauggcgauca

SEQ ID NO: 3249000 - RNA, 18 nt, Mycobacterium tuberculosis H37Rv
cgaucaccgcuugcuggc

SEQ ID NO: 3249001 - RNA, 13 nt, Mycobacterium tuberculosis H37Rv
cgaucaccggcau

SEQ ID NO: 3249002 - RNA, 16 nt, Mycobacterium tuberculosis H37Rv
cgaucaccucgcgggu

SEQ ID NO: 3249003 - RNA, 12 nt, Mycobacterium tuberculosis H37Rv
cgaucacgcugc

SEQ ID NO: 3249004 - RNA, 14 nt, Mycobacterium tuberculosis H37Rv
cgaucacggcggga

SEQ ID NO: 3249005 - RNA, 24 nt, Mycobacterium tuberculosis H37Rv
cgaucacggcgggaugcagcugcc

SEQ ID NO: 3249006 - RNA, 12 nt, Mycobacterium tuberculosis H37Rv
cgaucacggugg

SEQ ID NO: 3249007 - RNA, 16 nt, Mycobacterium tuberculosis H37Rv
cgaucagaaucugccu

SEQ ID NO: 3249008 - RNA, 16 nt, Mycobacterium tuberculosis H37Rv
cgaucagauaguccgg

SEQ ID NO: 3249009 - RNA, 20 nt, Mycobacterium tuberculosis H37Rv
cgaucagauaguccggcuug

SEQ ID NO: 3249010 - RNA, 13 nt, Mycobacterium tuberculosis H37Rv
cgaucagcagccg

SEQ ID NO: 3249011 - RNA, 16 nt, Mycobacterium tuberculosis H37Rv
cgaucagcagcgccag

SEQ ID NO: 3249012 - RNA, 20 nt, Mycobacterium tuberculosis H37Rv
cgaucagccgggugcgcacc

SEQ ID NO: 3249013 - RNA, 21 nt, Mycobacterium tuberculosis H37Rv
cgaucagccguggcagucgca

SEQ ID NO: 3249014 - RNA, 15 nt, Mycobacterium tuberculosis H37Rv
cgaucagcgccggau

SEQ ID NO: 3249015 - RNA, 23 nt, Mycobacterium tuberculosis H37Rv
cgaucagcgccggauccacaccg

SEQ ID NO: 3249016 - RNA, 15 nt, Mycobacterium tuberculosis H37Rv
cgaucagcgcgacgg

SEQ ID NO: 3249017 - RNA, 22 nt, Mycobacterium tuberculosis H37Rv
cgaucagcggcagcaccgcacg

SEQ ID NO: 3249018 - RNA, 21 nt, Mycobacterium tuberculosis H37Rv
cgaucagcugcgcaucgccac

SEQ ID NO: 3249019 - RNA, 20 nt, Mycobacterium tuberculosis H37Rv
cgaucaggccgacgucgacc

SEQ ID NO: 3249020 - RNA, 14 nt, Mycobacterium tuberculosis H37Rv
cgaucaggccuugg

SEQ ID NO: 3249021 - RNA, 12 nt, Mycobacterium tuberculosis H37Rv
cgaucaggcugc

SEQ ID NO: 3249022 - RNA, 19 nt, Mycobacterium tuberculosis H37Rv
cgaucaggggcccacccga

SEQ ID NO: 3249023 - RNA, 16 nt, Mycobacterium tuberculosis H37Rv
cgaucagguacgccag

SEQ ID NO: 3249024 - RNA, 17 nt, Mycobacterium tuberculosis H37Rv
cgaucagguuggcggcu

SEQ ID NO: 3249025 - RNA, 19 nt, Mycobacterium tuberculosis H37Rv
cgaucaguucguggcuggc

SEQ ID NO: 3249026 - RNA, 16 nt, Mycobacterium tuberculosis H37Rv
cgaucaucaccggcau

SEQ ID NO: 3249027 - RNA, 17 nt, Mycobacterium tuberculosis H37Rv
cgaucaucaggugcgcc

SEQ ID NO: 3249028 - RNA, 22 nt, Mycobacterium tuberculosis H37Rv
cgaucaucauauccgccccagc

SEQ ID NO: 3249029 - RNA, 21 nt, Mycobacterium tuberculosis H37Rv
cgaucaucgggguggccacca

SEQ ID NO: 3249030 - RNA, 23 nt, Mycobacterium tuberculosis H37Rv
cgaucaucgggguggccaccagc

SEQ ID NO: 3249031 - RNA, 16 nt, Mycobacterium tuberculosis H37Rv
cgaucauggcggcagc

SEQ ID NO: 3249032 - RNA, 12 nt, Mycobacterium tuberculosis H37Rv
cgauccacaggc

SEQ ID NO: 3249033 - RNA, 18 nt, Mycobacterium tuberculosis H37Rv
cgauccacaggcugaaga

SEQ ID NO: 3249034 - RNA, 21 nt, Mycobacterium tuberculosis H37Rv
cgauccacaggcugaagacga

SEQ ID NO: 3249035 - RNA, 19 nt, Mycobacterium tuberculosis H37Rv
cgaucucggcgagcaccac

SEQ ID NO: 3249036 - RNA, 17 nt, Mycobacterium tuberculosis H37Rv
cgaucucggcggccgcg

SEQ ID NO: 3249037 - RNA, 23 nt, Mycobacterium tuberculosis H37Rv
cgaucucgucgcggucgaucaca

SEQ ID NO: 3249038 - RNA, 19 nt, Mycobacterium tuberculosis H37Rv
cgaucucguuuucgcgcuu

SEQ ID NO: 3249039 - RNA, 21 nt, Mycobacterium tuberculosis H37Rv
cgaucugcagcacucgguguc

SEQ ID NO: 3249040 - RNA, 18 nt, Mycobacterium tuberculosis H37Rv
cgaucugcaggcccaggc

SEQ ID NO: 3249041 - RNA, 13 nt, Mycobacterium tuberculosis H37Rv
cgaucugcccggu

SEQ ID NO: 3249042 - RNA, 12 nt, Mycobacterium tuberculosis H37Rv
cgaucugcgcca

SEQ ID NO: 3249043 - RNA, 23 nt, Mycobacterium tuberculosis H37Rv
cgaucugcgcgucaggccagcgc

SEQ ID NO: 3249044 - RNA, 14 nt, Mycobacterium tuberculosis H37Rv
cgaucugcucgccc

SEQ ID NO: 3249045 - RNA, 20 nt, Mycobacterium tuberculosis H37Rv
cgaucugcuggccgaaccgg

SEQ ID NO: 3249046 - RNA, 15 nt, Mycobacterium tuberculosis H37Rv
cgaucugcugugucg

SEQ ID NO: 3249047 - RNA, 21 nt, Mycobacterium tuberculosis H37Rv
cgaucugggcuuucagcaccg

SEQ ID NO: 3249048 - RNA, 17 nt, Mycobacterium tuberculosis H37Rv
cgaucuggucaagaccc

SEQ ID NO: 3249049 - RNA, 19 nt, Mycobacterium tuberculosis H37Rv
cgaucuggucaagacccgc

SEQ ID NO: 3249050 - RNA, 13 nt, Mycobacterium tuberculosis H37Rv
cgaucuggucgcc

SEQ ID NO: 3249051 - RNA, 21 nt, Mycobacterium tuberculosis H37Rv
cgaucugucgcgccggugguc

SEQ ID NO: 3249052 - RNA, 20 nt, Mycobacterium tuberculosis H37Rv
cgaucugugguugcagcaca

SEQ ID NO: 3249053 - RNA, 18 nt, Mycobacterium tuberculosis H37Rv
cgaucuucuccucgucgg

SEQ ID NO: 3249054 - RNA, 13 nt, Mycobacterium tuberculosis H37Rv
cgaucuucucgcg

SEQ ID NO: 3249055 - RNA, 15 nt, Mycobacterium tuberculosis H37Rv
cgaucuucucgcgga

SEQ ID NO: 3249056 - RNA, 17 nt, Mycobacterium tuberculosis H37Rv
cgaucuuggaucgguug

SEQ ID NO: 3249057 - RNA, 14 nt, Mycobacterium tuberculosis H37Rv
cgaucuuggccacc

SEQ ID NO: 3249058 - RNA, 16 nt, Mycobacterium tuberculosis H37Rv
cgaucuugggccacgc

SEQ ID NO: 3249059 - RNA, 17 nt, Mycobacterium tuberculosis H37Rv
cgaucuugguggccuca

SEQ ID NO: 3249060 - RNA, 14 nt, Mycobacterium tuberculosis H37Rv
cgaugaacgcguag

SEQ ID NO: 3249061 - RNA, 19 nt, Mycobacterium tuberculosis H37Rv
cgaugaacgcguagucgcg

SEQ ID NO: 3249062 - RNA, 16 nt, Mycobacterium tuberculosis H37Rv
cgaugaagcgucguug

SEQ ID NO: 3249063 - RNA, 21 nt, Mycobacterium tuberculosis H37Rv
cgaugaauucuuuggggcgcg

SEQ ID NO: 3249064 - RNA, 16 nt, Mycobacterium tuberculosis H37Rv
cgaugaauuucauaaa

SEQ ID NO: 3249065 - RNA, 16 nt, Mycobacterium tuberculosis H37Rv
cgaugacaggcuuggc

SEQ ID NO: 3249066 - RNA, 16 nt, Mycobacterium tuberculosis H37Rv
cgaugacaucggucag

SEQ ID NO: 3249067 - RNA, 18 nt, Mycobacterium tuberculosis H37Rv
cgaugaccacgccgacga

SEQ ID NO: 3249068 - RNA, 20 nt, Mycobacterium tuberculosis H37Rv
cgaugaccagggucugcuca

SEQ ID NO: 3249069 - RNA, 19 nt, Mycobacterium tuberculosis H37Rv
cgaugaccgaagagcgcgc

SEQ ID NO: 3249070 - RNA, 20 nt, Mycobacterium tuberculosis H37Rv
cgaugaccgcaccgaccuga

SEQ ID NO: 3249071 - RNA, 14 nt, Mycobacterium tuberculosis H37Rv
cgaugaccgcagca

SEQ ID NO: 3249072 - RNA, 17 nt, Mycobacterium tuberculosis H37Rv
cgaugaccucggcgaug

SEQ ID NO: 3249073 - RNA, 18 nt, Mycobacterium tuberculosis H37Rv
cgaugaccucgucaaggu

SEQ ID NO: 3249074 - RNA, 16 nt, Mycobacterium tuberculosis H37Rv
cgaugacgaucggcgg

SEQ ID NO: 3249075 - RNA, 18 nt, Mycobacterium tuberculosis H37Rv
cgaugacgaugccgccga

SEQ ID NO: 3249076 - RNA, 22 nt, Mycobacterium tuberculosis H37Rv
cgaugacgccgucagcggccaa

SEQ ID NO: 3249077 - RNA, 15 nt, Mycobacterium tuberculosis H37Rv
cgaugacgccgugcu

SEQ ID NO: 3249078 - RNA, 14 nt, Mycobacterium tuberculosis H37Rv
cgaugacgcguuca

SEQ ID NO: 3249079 - RNA, 19 nt, Mycobacterium tuberculosis H37Rv
cgaugagcaugcccagcgc

SEQ ID NO: 3249080 - RNA, 13 nt, Mycobacterium tuberculosis H37Rv
cgaugagcgugcc

SEQ ID NO: 3249081 - RNA, 21 nt, Mycobacterium tuberculosis H37Rv
cgaugagggcuuguggugagc

SEQ ID NO: 3249082 - RNA, 21 nt, Mycobacterium tuberculosis H37Rv
cgaugagggugcucgucacca

SEQ ID NO: 3249083 - RNA, 19 nt, Mycobacterium tuberculosis H37Rv
cgaugagguggccgcgcag

SEQ ID NO: 3249084 - RNA, 20 nt, Mycobacterium tuberculosis H37Rv
cgaugauaauuccagcaccg

SEQ ID NO: 3249085 - RNA, 14 nt, Mycobacterium tuberculosis H37Rv
cgaugaucaggguc

SEQ ID NO: 3249086 - RNA, 20 nt, Mycobacterium tuberculosis H37Rv
cgaugaucagggucagcgcc

SEQ ID NO: 3249087 - RNA, 14 nt, Mycobacterium tuberculosis H37Rv
cgaugaucccgcca

SEQ ID NO: 3249088 - RNA, 18 nt, Mycobacterium tuberculosis H37Rv
cgaugaucccgccaccga

SEQ ID NO: 3249089 - RNA, 18 nt, Mycobacterium tuberculosis H37Rv
cgaugaucgaacacggca

SEQ ID NO: 3249090 - RNA, 19 nt, Mycobacterium tuberculosis H37Rv
cgaugaucgaacacggcac

SEQ ID NO: 3249091 - RNA, 20 nt, Mycobacterium tuberculosis H37Rv
cgaugaucgaacacggcaca

SEQ ID NO: 3249092 - RNA, 16 nt, Mycobacterium tuberculosis H37Rv
cgaugaucgcaucgac

SEQ ID NO: 3249093 - RNA, 18 nt, Mycobacterium tuberculosis H37Rv
cgaugaucucacccagcu

SEQ ID NO: 3249094 - RNA, 14 nt, Mycobacterium tuberculosis H37Rv
cgaugaugaugacc

SEQ ID NO: 3249095 - RNA, 20 nt, Mycobacterium tuberculosis H37Rv
cgaugaugaugaccacauug

SEQ ID NO: 3249096 - RNA, 17 nt, Mycobacterium tuberculosis H37Rv
cgaugaugccggacagc

SEQ ID NO: 3249097 - RNA, 22 nt, Mycobacterium tuberculosis H37Rv
cgaugaugccggacagcucgcg

SEQ ID NO: 3249098 - RNA, 19 nt, Mycobacterium tuberculosis H37Rv
cgaugaugcgcucggccug

SEQ ID NO: 3249099 - RNA, 13 nt, Mycobacterium tuberculosis H37Rv
cgaugaugcggcg

SEQ ID NO: 3249100 - RNA, 19 nt, Mycobacterium tuberculosis H37Rv
cgaugaugcggcgcagcga

SEQ ID NO: 3249101 - RNA, 17 nt, Mycobacterium tuberculosis H37Rv
cgaugaugcucgacaac

SEQ ID NO: 3249102 - RNA, 15 nt, Mycobacterium tuberculosis H37Rv
cgaugauggacacca

SEQ ID NO: 3249103 - RNA, 16 nt, Mycobacterium tuberculosis H37Rv
cgaugauggacaccag

SEQ ID NO: 3249104 - RNA, 20 nt, Mycobacterium tuberculosis H37Rv
cgaugauggacaccagccag

SEQ ID NO: 3249105 - RNA, 20 nt, Mycobacterium tuberculosis H37Rv
cgaugauggcgcgaucggug

SEQ ID NO: 3249106 - RNA, 13 nt, Mycobacterium tuberculosis H37Rv
cgaugauggcggu

SEQ ID NO: 3249107 - RNA, 19 nt, Mycobacterium tuberculosis H37Rv
cgaugauggcgguaccggg

SEQ ID NO: 3249108 - RNA, 15 nt, Mycobacterium tuberculosis H37Rv
cgaugaugucggccg

SEQ ID NO: 3249109 - RNA, 14 nt, Mycobacterium tuberculosis H37Rv
cgaugaugugcggu

SEQ ID NO: 3249110 - RNA, 13 nt, Mycobacterium tuberculosis H37Rv
cgaugcacaaccg

SEQ ID NO: 3249111 - RNA, 20 nt, Mycobacterium tuberculosis H37Rv
cgaugcacuccaugaaucgc

SEQ ID NO: 3249112 - RNA, 16 nt, Mycobacterium tuberculosis H37Rv
cgaugcagccacauac

SEQ ID NO: 3249113 - RNA, 15 nt, Mycobacterium tuberculosis H37Rv
cgaugcagccgggaa

SEQ ID NO: 3249114 - RNA, 14 nt, Mycobacterium tuberculosis H37Rv
cgaugccacaucgu

SEQ ID NO: 3249115 - RNA, 12 nt, Mycobacterium tuberculosis H37Rv
cgaugccaccgc

SEQ ID NO: 3249116 - RNA, 16 nt, Mycobacterium tuberculosis H37Rv
cgaugccagugcaucg

SEQ ID NO: 3249117 - RNA, 22 nt, Mycobacterium tuberculosis H37Rv
cgaugccagugcaucggucagc

SEQ ID NO: 3249118 - RNA, 18 nt, Mycobacterium tuberculosis H37Rv
cgaugcccacgcacagca

SEQ ID NO: 3249119 - RNA, 16 nt, Mycobacterium tuberculosis H37Rv
cgaugcccaucacgcc

SEQ ID NO: 3249120 - RNA, 18 nt, Mycobacterium tuberculosis H37Rv
cgaugcccucgauggcca

SEQ ID NO: 3249121 - RNA, 20 nt, Mycobacterium tuberculosis H37Rv
cgaugcccuggcccaucuug

SEQ ID NO: 3249122 - RNA, 22 nt, Mycobacterium tuberculosis H37Rv
cgaugccgaggaucgcgccuau

SEQ ID NO: 3249123 - RNA, 17 nt, Mycobacterium tuberculosis H37Rv
cgaugccgccccgcagc

SEQ ID NO: 3249124 - RNA, 20 nt, Mycobacterium tuberculosis H37Rv
cgaugccgccccgcagcugc

SEQ ID NO: 3249125 - RNA, 18 nt, Mycobacterium tuberculosis H37Rv
cgaugccgccggcaccgc

SEQ ID NO: 3249126 - RNA, 20 nt, Mycobacterium tuberculosis H37Rv
cgaugccgccggccccgccg

SEQ ID NO: 3249127 - RNA, 17 nt, Mycobacterium tuberculosis H37Rv
cgaugccgccggcgggc

SEQ ID NO: 3249128 - RNA, 14 nt, Mycobacterium tuberculosis H37Rv
cgaugccggcuggc

SEQ ID NO: 3249129 - RNA, 20 nt, Mycobacterium tuberculosis H37Rv
cgaugccggcuggcggcgug

SEQ ID NO: 3249130 - RNA, 19 nt, Mycobacterium tuberculosis H37Rv
cgaugccguccaagauguc

SEQ ID NO: 3249131 - RNA, 23 nt, Mycobacterium tuberculosis H37Rv
cgaugucgacucguggcgccacg

SEQ ID NO: 3249132 - RNA, 16 nt, Mycobacterium tuberculosis H37Rv
cgaugucgcgcauugc

SEQ ID NO: 3249133 - RNA, 14 nt, Mycobacterium tuberculosis H37Rv
cgaugucggcacca

SEQ ID NO: 3249134 - RNA, 16 nt, Mycobacterium tuberculosis H37Rv
cgaugucggcgaacca

SEQ ID NO: 3249135 - RNA, 20 nt, Mycobacterium tuberculosis H37Rv
cgaugucgguaaucuccuca

SEQ ID NO: 3249136 - RNA, 14 nt, Mycobacterium tuberculosis H37Rv
cgaugucgucguug

SEQ ID NO: 3249137 - RNA, 16 nt, Mycobacterium tuberculosis H37Rv
cgaugucguuggccac

SEQ ID NO: 3249138 - RNA, 21 nt, Mycobacterium tuberculosis H37Rv
cgaugucguuguacggggccg

SEQ ID NO: 3249139 - RNA, 19 nt, Mycobacterium tuberculosis H37Rv
cgaugugaaccgggcacca

SEQ ID NO: 3249140 - RNA, 20 nt, Mycobacterium tuberculosis H37Rv
cgaugugaaccgggcaccac

SEQ ID NO: 3249141 - RNA, 13 nt, Mycobacterium tuberculosis H37Rv
cgaugugcacggu

SEQ ID NO: 3249142 - RNA, 22 nt, Mycobacterium tuberculosis H37Rv
cgaugugcccggcucucagcga

SEQ ID NO: 3249143 - RNA, 22 nt, Mycobacterium tuberculosis H37Rv
cgaugugcgcccaauccaccga

SEQ ID NO: 3249144 - RNA, 17 nt, Mycobacterium tuberculosis H37Rv
cgauguggccggcgaug

SEQ ID NO: 3249145 - RNA, 17 nt, Mycobacterium tuberculosis H37Rv
cgauguggcgcuccggc

SEQ ID NO: 3249146 - RNA, 20 nt, Mycobacterium tuberculosis H37Rv
cgauguggcgcuccggcgug

SEQ ID NO: 3249147 - RNA, 14 nt, Mycobacterium tuberculosis H37Rv
cgaugugguccauc

SEQ ID NO: 3249148 - RNA, 20 nt, Mycobacterium tuberculosis H37Rv
cgauguuguugacgcccgag

SEQ ID NO: 3249149 - RNA, 12 nt, Mycobacterium tuberculosis H37Rv
cgauucaccaau

SEQ ID NO: 3249150 - RNA, 13 nt, Mycobacterium tuberculosis H37Rv
cgauucagccuga

SEQ ID NO: 3249151 - RNA, 20 nt, Mycobacterium tuberculosis H37Rv
cgauucagcgccccaugcaa

SEQ ID NO: 3249152 - RNA, 18 nt, Mycobacterium tuberculosis H37Rv
cgauuccaggauggccau

SEQ ID NO: 3249153 - RNA, 19 nt, Mycobacterium tuberculosis H37Rv
cgauuccgaacuggucgac

SEQ ID NO: 3249154 - RNA, 21 nt, Mycobacterium tuberculosis H37Rv
cgauuccgcccacaugcgcuc

SEQ ID NO: 3249155 - RNA, 17 nt, Mycobacterium tuberculosis H37Rv
cgauuccgcgcgggaaa

SEQ ID NO: 3249156 - RNA, 19 nt, Mycobacterium tuberculosis H37Rv
cgauuccgcgucugcucgg

SEQ ID NO: 3249157 - RNA, 22 nt, Mycobacterium tuberculosis H37Rv
cgauucgagcaacugcucgacg

SEQ ID NO: 3249158 - RNA, 22 nt, Mycobacterium tuberculosis H37Rv
cgauucgccuagcgagcgcaca

SEQ ID NO: 3249159 - RNA, 18 nt, Mycobacterium tuberculosis H37Rv
cgauucgcggcagccggc

SEQ ID NO: 3249160 - RNA, 16 nt, Mycobacterium tuberculosis H37Rv
cgauucggcgacgaac

SEQ ID NO: 3249161 - RNA, 15 nt, Mycobacterium tuberculosis H37Rv
cgauucgugucggug

SEQ ID NO: 3249162 - RNA, 12 nt, Mycobacterium tuberculosis H37Rv
cgauucugcguc

SEQ ID NO: 3249163 - RNA, 20 nt, Mycobacterium tuberculosis H37Rv
cgauucugcgucugcucgcg

SEQ ID NO: 3249164 - RNA, 19 nt, Mycobacterium tuberculosis H37Rv
cgauucugcgucugcucgg

SEQ ID NO: 3249165 - RNA, 20 nt, Mycobacterium tuberculosis H37Rv
cgauucugcgucugcucggc

SEQ ID NO: 3249166 - RNA, 23 nt, Mycobacterium tuberculosis H37Rv
cgauucugggcuucaucggcgau

SEQ ID NO: 3249167 - RNA, 19 nt, Mycobacterium tuberculosis H37Rv
cgauucugugucugcucgc

SEQ ID NO: 3249168 - RNA, 12 nt, Mycobacterium tuberculosis H37Rv
cgauugccacca

SEQ ID NO: 3249169 - RNA, 13 nt, Mycobacterium tuberculosis H37Rv
cgauugccaccga

SEQ ID NO: 3249170 - RNA, 18 nt, Mycobacterium tuberculosis H37Rv
cgauugcccgcgcucgca

SEQ ID NO: 3249171 - RNA, 13 nt, Mycobacterium tuberculosis H37Rv
cgauugccgucgu

SEQ ID NO: 3249172 - RNA, 15 nt, Mycobacterium tuberculosis H37Rv
cgauugcuucuucgg

SEQ ID NO: 3249173 - RNA, 16 nt, Mycobacterium tuberculosis H37Rv
cgauuggaccgccaau

SEQ ID NO: 3249174 - RNA, 23 nt, Mycobacterium tuberculosis H37Rv
cgauuggcaggcaaugcccgacc

SEQ ID NO: 3249175 - RNA, 14 nt, Mycobacterium tuberculosis H37Rv
cgauuggcucgccg

SEQ ID NO: 3249176 - RNA, 17 nt, Mycobacterium tuberculosis H37Rv
cgauuggcugcgccgau

SEQ ID NO: 3249177 - RNA, 16 nt, Mycobacterium tuberculosis H37Rv
cgauuggggugugcgc

SEQ ID NO: 3249178 - RNA, 17 nt, Mycobacterium tuberculosis H37Rv
cgauuguggccagcgcu

SEQ ID NO: 3249179 - RNA, 14 nt, Mycobacterium tuberculosis H37Rv
cgauuuccaugcug

SEQ ID NO: 3249180 - RNA, 15 nt, Mycobacterium tuberculosis H37Rv
cgauuucccaugcaa

SEQ ID NO: 3249181 - RNA, 17 nt, Mycobacterium tuberculosis H37Rv
cgauuuccucugggcug

SEQ ID NO: 3249182 - RNA, 18 nt, Mycobacterium tuberculosis H37Rv
cgauuuccucugggcugu

SEQ ID NO: 3249183 - RNA, 20 nt, Mycobacterium tuberculosis H37Rv
cgauuucgagcgcugcuccc

SEQ ID NO: 3249184 - RNA, 21 nt, Mycobacterium tuberculosis H37Rv
cgauuucgaugacgaacaaga

SEQ ID NO: 3249185 - RNA, 19 nt, Mycobacterium tuberculosis H37Rv
cgauuucgccugcggccca

SEQ ID NO: 3249186 - RNA, 19 nt, Mycobacterium tuberculosis H37Rv
cgauuuugcgucugcucgc

SEQ ID NO: 3249187 - RNA, 20 nt, Mycobacterium tuberculosis H37Rv
cgauuuugcgucugcucgcg

SEQ ID NO: 3249188 - RNA, 20 nt, Mycobacterium tuberculosis H37Rv
cgauuuugcgucugcucggc

SEQ ID NO: 3249189 - RNA, 22 nt, Mycobacterium tuberculosis H37Rv
cgauuuugcgucugcucggcgc

SEQ ID NO: 3249190 - RNA, 22 nt, Mycobacterium tuberculosis H37Rv
cgauuuuggcaagcugccccgc

SEQ ID NO: 3249191 - RNA, 20 nt, Mycobacterium tuberculosis H37Rv
cgauuuugugucugcucgcc

SEQ ID NO: 3249192 - RNA, 22 nt, Mycobacterium tuberculosis H37Rv
cgcaaaagaacccgauucuggu

SEQ ID NO: 3249193 - RNA, 16 nt, Mycobacterium tuberculosis H37Rv
cgcaaaaucgucagcg

SEQ ID NO: 3249194 - RNA, 14 nt, Mycobacterium tuberculosis H37Rv
cgcaaacaagauca

SEQ ID NO: 3249195 - RNA, 14 nt, Mycobacterium tuberculosis H37Rv
cgcaaaccacccgc

SEQ ID NO: 3249196 - RNA, 22 nt, Mycobacterium tuberculosis H37Rv
cgcaaacucagacucugccgau

SEQ ID NO: 3249197 - RNA, 22 nt, Mycobacterium tuberculosis H37Rv
cgcaaagacaccgaaagccucu

SEQ ID NO: 3249198 - RNA, 16 nt, Mycobacterium tuberculosis H37Rv
cgcaaagacagcgcgg

SEQ ID NO: 3249199 - RNA, 17 nt, Mycobacterium tuberculosis H37Rv
cgcaaagacagcgcggg

SEQ ID NO: 3249200 - RNA, 20 nt, Mycobacterium tuberculosis H37Rv
cgcaaaguucgucaccacga

SEQ ID NO: 3249201 - RNA, 22 nt, Mycobacterium tuberculosis H37Rv
cgcaaauacuucauguagcggu

SEQ ID NO: 3249202 - RNA, 21 nt, Mycobacterium tuberculosis H37Rv
cgcaacaaccgguuggcgauc

SEQ ID NO: 3249203 - RNA, 14 nt, Mycobacterium tuberculosis H37Rv
cgcaacaccgugca

SEQ ID NO: 3249204 - RNA, 17 nt, Mycobacterium tuberculosis H37Rv
cgcaacaccgugcacca

SEQ ID NO: 3249205 - RNA, 17 nt, Mycobacterium tuberculosis H37Rv
cgcaacaucggaugacc

SEQ ID NO: 3249206 - RNA, 22 nt, Mycobacterium tuberculosis H37Rv
cgcaacaugggugaugcaacgc

SEQ ID NO: 3249207 - RNA, 16 nt, Mycobacterium tuberculosis H37Rv
cgcaaccaaccgucgg

SEQ ID NO: 3249208 - RNA, 19 nt, Mycobacterium tuberculosis H37Rv
cgcaaccaaccgucgguga

SEQ ID NO: 3249209 - RNA, 21 nt, Mycobacterium tuberculosis H37Rv
cgcaaccauguuaacgcgcgu

SEQ ID NO: 3249210 - RNA, 23 nt, Mycobacterium tuberculosis H37Rv
cgcaaccauguuaacgcgcgucc

SEQ ID NO: 3249211 - RNA, 15 nt, Mycobacterium tuberculosis H37Rv
cgcaacccagccgcg

SEQ ID NO: 3249212 - RNA, 20 nt, Mycobacterium tuberculosis H37Rv
cgcaacccagccgcgccagc

SEQ ID NO: 3249213 - RNA, 22 nt, Mycobacterium tuberculosis H37Rv
cgcaaccccuggggugcucggg

SEQ ID NO: 3249214 - RNA, 13 nt, Mycobacterium tuberculosis H37Rv
cgcaacccggacg

SEQ ID NO: 3249215 - RNA, 14 nt, Mycobacterium tuberculosis H37Rv
cgcaacccggacga

SEQ ID NO: 3249216 - RNA, 14 nt, Mycobacterium tuberculosis H37Rv
cgcaaccgccgcca

SEQ ID NO: 3249217 - RNA, 15 nt, Mycobacterium tuberculosis H37Rv
cgcaaccgccgccau

SEQ ID NO: 3249218 - RNA, 17 nt, Mycobacterium tuberculosis H37Rv
cgcaaccggccguccag

SEQ ID NO: 3249219 - RNA, 19 nt, Mycobacterium tuberculosis H37Rv
cgcaaccgggccucaugcu

SEQ ID NO: 3249220 - RNA, 21 nt, Mycobacterium tuberculosis H37Rv
cgcaacgacugaucaagugcc

SEQ ID NO: 3249221 - RNA, 16 nt, Mycobacterium tuberculosis H37Rv
cgcaacgcgaucaccu

SEQ ID NO: 3249222 - RNA, 18 nt, Mycobacterium tuberculosis H37Rv
cgcaacgcuucggcagcu

SEQ ID NO: 3249223 - RNA, 15 nt, Mycobacterium tuberculosis H37Rv
cgcaacggccagcgc

SEQ ID NO: 3249224 - RNA, 17 nt, Mycobacterium tuberculosis H37Rv
cgcaacggccagcgcug

SEQ ID NO: 3249225 - RNA, 16 nt, Mycobacterium tuberculosis H37Rv
cgcaacgggacgucac

SEQ ID NO: 3249226 - RNA, 17 nt, Mycobacterium tuberculosis H37Rv
cgcaacgggacgucacc

SEQ ID NO: 3249227 - RNA, 19 nt, Mycobacterium tuberculosis H37Rv
cgcaccgcgggaucggugg

SEQ ID NO: 3249228 - RNA, 20 nt, Mycobacterium tuberculosis H37Rv
cgcaccgcgggaucgguggc

SEQ ID NO: 3249229 - RNA, 18 nt, Mycobacterium tuberculosis H37Rv
cgcaccgcgguacgccgg

SEQ ID NO: 3249230 - RNA, 21 nt, Mycobacterium tuberculosis H37Rv
cgcaccgcguugaugaccgcc

SEQ ID NO: 3249231 - RNA, 21 nt, Mycobacterium tuberculosis H37Rv
cgcaccgcugaccccggcagc

SEQ ID NO: 3249232 - RNA, 18 nt, Mycobacterium tuberculosis H37Rv
cgcaccggauccacggag

SEQ ID NO: 3249233 - RNA, 14 nt, Mycobacterium tuberculosis H37Rv
cgcaccggcgucgg

SEQ ID NO: 3249234 - RNA, 15 nt, Mycobacterium tuberculosis H37Rv
cgcaccggcgucggc

SEQ ID NO: 3249235 - RNA, 17 nt, Mycobacterium tuberculosis H37Rv
cgcaccggcgucggcgc

SEQ ID NO: 3249236 - RNA, 17 nt, Mycobacterium tuberculosis H37Rv
cgcaccggcuggcccag

SEQ ID NO: 3249237 - RNA, 22 nt, Mycobacterium tuberculosis H37Rv
cgcaccggcuggcccagcgacc

SEQ ID NO: 3249238 - RNA, 16 nt, Mycobacterium tuberculosis H37Rv
cgcaccgugccgacgc

SEQ ID NO: 3249239 - RNA, 16 nt, Mycobacterium tuberculosis H37Rv
cgcaccguggacaccu

SEQ ID NO: 3249240 - RNA, 19 nt, Mycobacterium tuberculosis H37Rv
cgcaccguggacaccuggc

SEQ ID NO: 3249241 - RNA, 21 nt, Mycobacterium tuberculosis H37Rv
cgcaccguggacaccuggcug

SEQ ID NO: 3249242 - RNA, 22 nt, Mycobacterium tuberculosis H37Rv
cgcaccguggcggaucgcgagc

SEQ ID NO: 3249243 - RNA, 22 nt, Mycobacterium tuberculosis H37Rv
cgcaccgugugggccccgccga

SEQ ID NO: 3249244 - RNA, 18 nt, Mycobacterium tuberculosis H37Rv
cgcaccuacccugcgcgu

SEQ ID NO: 3249245 - RNA, 14 nt, Mycobacterium tuberculosis H37Rv
cgcaccuaugguca

SEQ ID NO: 3249246 - RNA, 22 nt, Mycobacterium tuberculosis H37Rv
cgcaccuccugcgagugcggca

SEQ ID NO: 3249247 - RNA, 13 nt, Mycobacterium tuberculosis H37Rv
cgcaccucggcga

SEQ ID NO: 3249248 - RNA, 21 nt, Mycobacterium tuberculosis H37Rv
cgcaccucggcgaagucacgc

SEQ ID NO: 3249249 - RNA, 16 nt, Mycobacterium tuberculosis H37Rv
cgcaccugaucgguca

SEQ ID NO: 3249250 - RNA, 16 nt, Mycobacterium tuberculosis H37Rv
cgcaccugcgcgcggc

SEQ ID NO: 3249251 - RNA, 20 nt, Mycobacterium tuberculosis H37Rv
cgcacgaaaucagcccgccc

SEQ ID NO: 3249252 - RNA, 17 nt, Mycobacterium tuberculosis H37Rv
cgcacgaaccccacgca

SEQ ID NO: 3249253 - RNA, 21 nt, Mycobacterium tuberculosis H37Rv
cgcacgaaccccacgcagaag

SEQ ID NO: 3249254 - RNA, 19 nt, Mycobacterium tuberculosis H37Rv
cgcacgaagccggcuucgg

SEQ ID NO: 3249255 - RNA, 22 nt, Mycobacterium tuberculosis H37Rv
cgcacgacaacuucgccggacc

SEQ ID NO: 3249256 - RNA, 12 nt, Mycobacterium tuberculosis H37Rv
cgcacgacaccu

SEQ ID NO: 3249257 - RNA, 19 nt, Mycobacterium tuberculosis H37Rv
cgcacgacugugcgccgca

SEQ ID NO: 3249258 - RNA, 20 nt, Mycobacterium tuberculosis H37Rv
cgcacgacugugcgccgcag

SEQ ID NO: 3249259 - RNA, 22 nt, Mycobacterium tuberculosis H37Rv
cgcacgacugugcgccgcagcc

SEQ ID NO: 3249260 - RNA, 19 nt, Mycobacterium tuberculosis H37Rv
cgcacgauagccaccgacg

SEQ ID NO: 3249261 - RNA, 13 nt, Mycobacterium tuberculosis H37Rv
cgcacgaucaggg

SEQ ID NO: 3249262 - RNA, 18 nt, Mycobacterium tuberculosis H37Rv
cgcacgaucgcaccgagg

SEQ ID NO: 3249263 - RNA, 17 nt, Mycobacterium tuberculosis H37Rv
cgcacgaucgcccguga

SEQ ID NO: 3249264 - RNA, 20 nt, Mycobacterium tuberculosis H37Rv
cgcacgaucgcccgugagcg

SEQ ID NO: 3249265 - RNA, 18 nt, Mycobacterium tuberculosis H37Rv
cgcacgaucugcaggccc

SEQ ID NO: 3249266 - RNA, 16 nt, Mycobacterium tuberculosis H37Rv
cgcacgauggccgucg

SEQ ID NO: 3249267 - RNA, 18 nt, Mycobacterium tuberculosis H37Rv
cgcacgauggccgucgau

SEQ ID NO: 3249268 - RNA, 18 nt, Mycobacterium tuberculosis H37Rv
cgcacgauuucgagcgcu

SEQ ID NO: 3249269 - RNA, 18 nt, Mycobacterium tuberculosis H37Rv
cgcacgcaaugcgggccc

SEQ ID NO: 3249270 - RNA, 18 nt, Mycobacterium tuberculosis H37Rv
cgcacgcagccgauacag

SEQ ID NO: 3249271 - RNA, 14 nt, Mycobacterium tuberculosis H37Rv
cgcacgcaguucgg

SEQ ID NO: 3249272 - RNA, 19 nt, Mycobacterium tuberculosis H37Rv
cgcacgccgaccagcaccc

SEQ ID NO: 3249273 - RNA, 14 nt, Mycobacterium tuberculosis H37Rv
cgcacgccgaccgg

SEQ ID NO: 3249274 - RNA, 13 nt, Mycobacterium tuberculosis H37Rv
cgcacgccggcau

SEQ ID NO: 3249275 - RNA, 14 nt, Mycobacterium tuberculosis H37Rv
cgcacgccggcaug

SEQ ID NO: 3249276 - RNA, 16 nt, Mycobacterium tuberculosis H37Rv
cgcacgccggccagcg

SEQ ID NO: 3249277 - RNA, 21 nt, Mycobacterium tuberculosis H37Rv
cgcacgcgggagguaccccca

SEQ ID NO: 3249278 - RNA, 20 nt, Mycobacterium tuberculosis H37Rv
cgcacgcgguucaccacguc

SEQ ID NO: 3249279 - RNA, 19 nt, Mycobacterium tuberculosis H37Rv
cgcacgcucggcggggacc

SEQ ID NO: 3249280 - RNA, 14 nt, Mycobacterium tuberculosis H37Rv
cgcacgcucggcgu

SEQ ID NO: 3249281 - RNA, 15 nt, Mycobacterium tuberculosis H37Rv
cgcacgcuggcgggc

SEQ ID NO: 3249282 - RNA, 16 nt, Mycobacterium tuberculosis H37Rv
cgcacgcuggcgggca

SEQ ID NO: 3249283 - RNA, 18 nt, Mycobacterium tuberculosis H37Rv
cgcacgcuggcgggcacu

SEQ ID NO: 3249284 - RNA, 23 nt, Mycobacterium tuberculosis H37Rv
cgcacggaaggcccggcgcggcc

SEQ ID NO: 3249285 - RNA, 14 nt, Mycobacterium tuberculosis H37Rv
cgcacggaaggucg

SEQ ID NO: 3249286 - RNA, 18 nt, Mycobacterium tuberculosis H37Rv
cgcacggaaggucgacau

SEQ ID NO: 3249287 - RNA, 22 nt, Mycobacterium tuberculosis H37Rv
cgcacggaccaucgccaggccc

SEQ ID NO: 3249288 - RNA, 18 nt, Mycobacterium tuberculosis H37Rv
cgcacggcagacacgcug

SEQ ID NO: 3249289 - RNA, 19 nt, Mycobacterium tuberculosis H37Rv
cgcacggcagacacgcugc

SEQ ID NO: 3249290 - RNA, 13 nt, Mycobacterium tuberculosis H37Rv
cgcacggccaccg

SEQ ID NO: 3249291 - RNA, 14 nt, Mycobacterium tuberculosis H37Rv
cgcacggccaccgc

SEQ ID NO: 3249292 - RNA, 15 nt, Mycobacterium tuberculosis H37Rv
cgcacggccgcagcc

SEQ ID NO: 3249293 - RNA, 14 nt, Mycobacterium tuberculosis H37Rv
cgcacggcgccgac

SEQ ID NO: 3249294 - RNA, 15 nt, Mycobacterium tuberculosis H37Rv
cgcacggcgccgacc

SEQ ID NO: 3249295 - RNA, 17 nt, Mycobacterium tuberculosis H37Rv
cgcacggcgccgacccg

SEQ ID NO: 3249296 - RNA, 13 nt, Mycobacterium tuberculosis H37Rv
cgcacggcgucgg

SEQ ID NO: 3249297 - RNA, 12 nt, Mycobacterium tuberculosis H37Rv
cgcacgggcgac

SEQ ID NO: 3249298 - RNA, 14 nt, Mycobacterium tuberculosis H37Rv
cgcacgggcgaccu

SEQ ID NO: 3249299 - RNA, 20 nt, Mycobacterium tuberculosis H37Rv
cgcacgggcgaccugcggac

SEQ ID NO: 3249300 - RNA, 16 nt, Mycobacterium tuberculosis H37Rv
cgcacggucagcgcgc

SEQ ID NO: 3249301 - RNA, 18 nt, Mycobacterium tuberculosis H37Rv
cgcacggucagcgcgcac

SEQ ID NO: 3249302 - RNA, 21 nt, Mycobacterium tuberculosis H37Rv
cgcacggucagcgcgcacgac

SEQ ID NO: 3249303 - RNA, 17 nt, Mycobacterium tuberculosis H37Rv
cgcacgguccacggugg

SEQ ID NO: 3249304 - RNA, 20 nt, Mycobacterium tuberculosis H37Rv
cgcacggugaccacgccgug

SEQ ID NO: 3249305 - RNA, 21 nt, Mycobacterium tuberculosis H37Rv
cgcacggugaccacgccgugg

SEQ ID NO: 3249306 - RNA, 19 nt, Mycobacterium tuberculosis H37Rv
cgcacggugccgccgucga

SEQ ID NO: 3249307 - RNA, 15 nt, Mycobacterium tuberculosis H37Rv
cgcacgguucgggug

SEQ ID NO: 3249308 - RNA, 16 nt, Mycobacterium tuberculosis H37Rv
cgcacgguugccguca

SEQ ID NO: 3249309 - RNA, 23 nt, Mycobacterium tuberculosis H37Rv
cgcacgguuggcgcucaacucag

SEQ ID NO: 3249310 - RNA, 21 nt, Mycobacterium tuberculosis H37Rv
cgcacguauccacggucgacc

SEQ ID NO: 3249311 - RNA, 13 nt, Mycobacterium tuberculosis H37Rv
cgcacgucgaccu

SEQ ID NO: 3249312 - RNA, 23 nt, Mycobacterium tuberculosis H37Rv
cgcacgucgaccucggcaaccac

SEQ ID NO: 3249313 - RNA, 19 nt, Mycobacterium tuberculosis H37Rv
cgcacgugaugcccugggg

SEQ ID NO: 3249314 - RNA, 14 nt, Mycobacterium tuberculosis H37Rv
cgcacuaccgccuu

SEQ ID NO: 3249315 - RNA, 19 nt, Mycobacterium tuberculosis H37Rv
cgcacuacucgaacaaccc

SEQ ID NO: 3249316 - RNA, 18 nt, Mycobacterium tuberculosis H37Rv
cgcacucaccuugucaaa

SEQ ID NO: 3249317 - RNA, 17 nt, Mycobacterium tuberculosis H37Rv
cgcacucagucugggga

SEQ ID NO: 3249318 - RNA, 22 nt, Mycobacterium tuberculosis H37Rv
cgcacucauagaacucgccgcu

SEQ ID NO: 3249319 - RNA, 22 nt, Mycobacterium tuberculosis H37Rv
cgcacuccaagucacagcucac

SEQ ID NO: 3249320 - RNA, 14 nt, Mycobacterium tuberculosis H37Rv
cgcacuccacgauc

SEQ ID NO: 3249321 - RNA, 15 nt, Mycobacterium tuberculosis H37Rv
cgcacuccacgaucg

SEQ ID NO: 3249322 - RNA, 20 nt, Mycobacterium tuberculosis H37Rv
cgcacuccacgaucggccca

SEQ ID NO: 3249323 - RNA, 15 nt, Mycobacterium tuberculosis H37Rv
cgcagccgcggggcc

SEQ ID NO: 3249324 - RNA, 15 nt, Mycobacterium tuberculosis H37Rv
cgcagccgcucgacg

SEQ ID NO: 3249325 - RNA, 19 nt, Mycobacterium tuberculosis H37Rv
cgcagccgcucgacggccc

SEQ ID NO: 3249326 - RNA, 15 nt, Mycobacterium tuberculosis H37Rv
cgcagccggcccguc

SEQ ID NO: 3249327 - RNA, 13 nt, Mycobacterium tuberculosis H37Rv
cgcagccgggcac

SEQ ID NO: 3249328 - RNA, 20 nt, Mycobacterium tuberculosis H37Rv
cgcagccgggcaccacccuu

SEQ ID NO: 3249329 - RNA, 18 nt, Mycobacterium tuberculosis H37Rv
cgcagccgguccagcgcc

SEQ ID NO: 3249330 - RNA, 12 nt, Mycobacterium tuberculosis H37Rv
cgcagccgguga

SEQ ID NO: 3249331 - RNA, 16 nt, Mycobacterium tuberculosis H37Rv
cgcagccugccgauga

SEQ ID NO: 3249332 - RNA, 18 nt, Mycobacterium tuberculosis H37Rv
cgcagccugccgaugacg

SEQ ID NO: 3249333 - RNA, 16 nt, Mycobacterium tuberculosis H37Rv
cgcagccuggucgcgc

SEQ ID NO: 3249334 - RNA, 20 nt, Mycobacterium tuberculosis H37Rv
cgcagccuggucgcgcagcu

SEQ ID NO: 3249335 - RNA, 23 nt, Mycobacterium tuberculosis H37Rv
cgcagcgaagaccagcggcggcg

SEQ ID NO: 3249336 - RNA, 18 nt, Mycobacterium tuberculosis H37Rv
cgcagcgacacguuggcg

SEQ ID NO: 3249337 - RNA, 13 nt, Mycobacterium tuberculosis H37Rv
cgcagcgacgcgg

SEQ ID NO: 3249338 - RNA, 14 nt, Mycobacterium tuberculosis H37Rv
cgcagcgaggagcc

SEQ ID NO: 3249339 - RNA, 15 nt, Mycobacterium tuberculosis H37Rv
cgcagcgaggagccc

SEQ ID NO: 3249340 - RNA, 17 nt, Mycobacterium tuberculosis H37Rv
cgcagcgauucgccuag

SEQ ID NO: 3249341 - RNA, 14 nt, Mycobacterium tuberculosis H37Rv
cgcagcgccagcgg

SEQ ID NO: 3249342 - RNA, 16 nt, Mycobacterium tuberculosis H37Rv
cgcagcgccagcggga

SEQ ID NO: 3249343 - RNA, 15 nt, Mycobacterium tuberculosis H37Rv
cgcagcgccucggua

SEQ ID NO: 3249344 - RNA, 16 nt, Mycobacterium tuberculosis H37Rv
cgcagcgcgaucgcgg

SEQ ID NO: 3249345 - RNA, 17 nt, Mycobacterium tuberculosis H37Rv
cgcagcgcgaucgcggu

SEQ ID NO: 3249346 - RNA, 11 nt, Mycobacterium tuberculosis H37Rv
cgcagcggcca

SEQ ID NO: 3249347 - RNA, 15 nt, Mycobacterium tuberculosis H37Rv
cgcagcggccagccc

SEQ ID NO: 3249348 - RNA, 13 nt, Mycobacterium tuberculosis H37Rv
cgcagcggcggca

SEQ ID NO: 3249349 - RNA, 15 nt, Mycobacterium tuberculosis H37Rv
cgcagcgggcggugu

SEQ ID NO: 3249350 - RNA, 13 nt, Mycobacterium tuberculosis H37Rv
cgcagcggugagg

SEQ ID NO: 3249351 - RNA, 21 nt, Mycobacterium tuberculosis H37Rv
cgcagcgguggucggcgcgcc

SEQ ID NO: 3249352 - RNA, 16 nt, Mycobacterium tuberculosis H37Rv
cgcagcgucaucgcgu

SEQ ID NO: 3249353 - RNA, 21 nt, Mycobacterium tuberculosis H37Rv
cgcagcguguaguggcccgcg

SEQ ID NO: 3249354 - RNA, 19 nt, Mycobacterium tuberculosis H37Rv
cgcagcuaacccgccacgu

SEQ ID NO: 3249355 - RNA, 20 nt, Mycobacterium tuberculosis H37Rv
cgcagcuaucuccaugcucg

SEQ ID NO: 3249356 - RNA, 22 nt, Mycobacterium tuberculosis H37Rv
cgcagcuccaccgugacggcca

SEQ ID NO: 3249357 - RNA, 17 nt, Mycobacterium tuberculosis H37Rv
cgcagcuccccgaccga

SEQ ID NO: 3249358 - RNA, 16 nt, Mycobacterium tuberculosis H37Rv
cgcagcucgaccagga

SEQ ID NO: 3249359 - RNA, 15 nt, Mycobacterium tuberculosis H37Rv
cgcagcugacgucac

SEQ ID NO: 3249360 - RNA, 22 nt, Mycobacterium tuberculosis H37Rv
cgcagcugacgucaccacgauc

SEQ ID NO: 3249361 - RNA, 23 nt, Mycobacterium tuberculosis H37Rv
cgcagcugaucuuggcaagccaa

SEQ ID NO: 3249362 - RNA, 19 nt, Mycobacterium tuberculosis H37Rv
cgcagcugccgcacccccu

SEQ ID NO: 3249363 - RNA, 13 nt, Mycobacterium tuberculosis H37Rv
cgcagcugcgggu

SEQ ID NO: 3249364 - RNA, 17 nt, Mycobacterium tuberculosis H37Rv
cgcagcuguggcccacu

SEQ ID NO: 3249365 - RNA, 22 nt, Mycobacterium tuberculosis H37Rv
cgcagcuuggccagccacuccu

SEQ ID NO: 3249366 - RNA, 14 nt, Mycobacterium tuberculosis H37Rv
cgcagcuuguccgg

SEQ ID NO: 3249367 - RNA, 17 nt, Mycobacterium tuberculosis H37Rv
cgcagcuuguccgguga

SEQ ID NO: 3249368 - RNA, 21 nt, Mycobacterium tuberculosis H37Rv
cgcaggaaaaccccggccacc

SEQ ID NO: 3249369 - RNA, 19 nt, Mycobacterium tuberculosis H37Rv
cgcaggaagcccacgaucg

SEQ ID NO: 3249370 - RNA, 20 nt, Mycobacterium tuberculosis H37Rv
cgcaggaagcccacgaucgc

SEQ ID NO: 3249371 - RNA, 19 nt, Mycobacterium tuberculosis H37Rv
cgcaggaagccggcgugcu

SEQ ID NO: 3249372 - RNA, 22 nt, Mycobacterium tuberculosis H37Rv
cgcaggaauucgccauagcggg

SEQ ID NO: 3249373 - RNA, 13 nt, Mycobacterium tuberculosis H37Rv
cgcaggacgcugc

SEQ ID NO: 3249374 - RNA, 18 nt, Mycobacterium tuberculosis H37Rv
cgcaggagcgcgaugacc

SEQ ID NO: 3249375 - RNA, 18 nt, Mycobacterium tuberculosis H37Rv
cgcaggaucacacuggcc

SEQ ID NO: 3249376 - RNA, 19 nt, Mycobacterium tuberculosis H37Rv
cgcaggaucacacuggccu

SEQ ID NO: 3249377 - RNA, 18 nt, Mycobacterium tuberculosis H37Rv
cgcaggaucgaguugcgg

SEQ ID NO: 3249378 - RNA, 15 nt, Mycobacterium tuberculosis H37Rv
cgcaggaucggcgga

SEQ ID NO: 3249379 - RNA, 19 nt, Mycobacterium tuberculosis H37Rv
cgcaggauucugcugacca

SEQ ID NO: 3249380 - RNA, 16 nt, Mycobacterium tuberculosis H37Rv
cgcaggcacaucgcga

SEQ ID NO: 3249381 - RNA, 18 nt, Mycobacterium tuberculosis H37Rv
cgcaggcaccccgaucac

SEQ ID NO: 3249382 - RNA, 21 nt, Mycobacterium tuberculosis H37Rv
cgcaggcagugagggucccac

SEQ ID NO: 3249383 - RNA, 22 nt, Mycobacterium tuberculosis H37Rv
cgcaggccgacacgaacgcugc

SEQ ID NO: 3249384 - RNA, 15 nt, Mycobacterium tuberculosis H37Rv
cgcaggccggcggcg

SEQ ID NO: 3249385 - RNA, 19 nt, Mycobacterium tuberculosis H37Rv
cgcaggcgauugcagcuuc

SEQ ID NO: 3249386 - RNA, 21 nt, Mycobacterium tuberculosis H37Rv
cgcaggcgcagauuccucuuc

SEQ ID NO: 3249387 - RNA, 13 nt, Mycobacterium tuberculosis H37Rv
cgcaggcucaccg

SEQ ID NO: 3249388 - RNA, 14 nt, Mycobacterium tuberculosis H37Rv
cgcaggcucaccga

SEQ ID NO: 3249389 - RNA, 20 nt, Mycobacterium tuberculosis H37Rv
cgcaggcuuccagccacagc

SEQ ID NO: 3249390 - RNA, 13 nt, Mycobacterium tuberculosis H37Rv
cgcaggcuucccu

SEQ ID NO: 3249391 - RNA, 15 nt, Mycobacterium tuberculosis H37Rv
cgcagggaucacccc

SEQ ID NO: 3249392 - RNA, 15 nt, Mycobacterium tuberculosis H37Rv
cgcagggccgccgcg

SEQ ID NO: 3249393 - RNA, 17 nt, Mycobacterium tuberculosis H37Rv
cgcagguagucgacgac

SEQ ID NO: 3249394 - RNA, 17 nt, Mycobacterium tuberculosis H37Rv
cgcaggucauagccccg

SEQ ID NO: 3249395 - RNA, 22 nt, Mycobacterium tuberculosis H37Rv
cgcaggucgccuucuucgcggc

SEQ ID NO: 3249396 - RNA, 19 nt, Mycobacterium tuberculosis H37Rv
cgcaggugcugggcgaggu

SEQ ID NO: 3249397 - RNA, 15 nt, Mycobacterium tuberculosis H37Rv
cgcaggugggcguug

SEQ ID NO: 3249398 - RNA, 14 nt, Mycobacterium tuberculosis H37Rv
cgcagguggucgau

SEQ ID NO: 3249399 - RNA, 19 nt, Mycobacterium tuberculosis H37Rv
cgcagguucaacgcgggga

SEQ ID NO: 3249400 - RNA, 15 nt, Mycobacterium tuberculosis H37Rv
cgcagguucucggug

SEQ ID NO: 3249401 - RNA, 19 nt, Mycobacterium tuberculosis H37Rv
cgcagguuggauacggugc

SEQ ID NO: 3249402 - RNA, 16 nt, Mycobacterium tuberculosis H37Rv
cgcagguuggcaagca

SEQ ID NO: 3249403 - RNA, 22 nt, Mycobacterium tuberculosis H37Rv
cgcaguacuugaccguccaccg

SEQ ID NO: 3249404 - RNA, 23 nt, Mycobacterium tuberculosis H37Rv
cgcaguacuugaccguccaccga

SEQ ID NO: 3249405 - RNA, 18 nt, Mycobacterium tuberculosis H37Rv
cgcaguagccgaccagga

SEQ ID NO: 3249406 - RNA, 23 nt, Mycobacterium tuberculosis H37Rv
cgcagucccgaacaauucacgca

SEQ ID NO: 3249407 - RNA, 16 nt, Mycobacterium tuberculosis H37Rv
cgcaguccgcacgcgg

SEQ ID NO: 3249408 - RNA, 21 nt, Mycobacterium tuberculosis H37Rv
cgcaguccgguuacgcucgcg

SEQ ID NO: 3249409 - RNA, 15 nt, Mycobacterium tuberculosis H37Rv
cgcagucgggcagcg

SEQ ID NO: 3249410 - RNA, 12 nt, Mycobacterium tuberculosis H37Rv
cgcagucugacg

SEQ ID NO: 3249411 - RNA, 22 nt, Mycobacterium tuberculosis H37Rv
cgcagugacgggacccgggugg

SEQ ID NO: 3249412 - RNA, 14 nt, Mycobacterium tuberculosis H37Rv
cgcagugcaccgcg

SEQ ID NO: 3249413 - RNA, 20 nt, Mycobacterium tuberculosis H37Rv
cgcagugcccgaucgcuucc

SEQ ID NO: 3249414 - RNA, 14 nt, Mycobacterium tuberculosis H37Rv
cgcagugcgcgagu

SEQ ID NO: 3249415 - RNA, 13 nt, Mycobacterium tuberculosis H37Rv
cgcaguuggcacc

SEQ ID NO: 3249416 - RNA, 15 nt, Mycobacterium tuberculosis H37Rv
cgcaguuggcaccag

SEQ ID NO: 3249417 - RNA, 20 nt, Mycobacterium tuberculosis H37Rv
cgcaguuggcaccagccggu

SEQ ID NO: 3249418 - RNA, 21 nt, Mycobacterium tuberculosis H37Rv
cgcaguuggcaccagccggug

SEQ ID NO: 3249419 - RNA, 19 nt, Mycobacterium tuberculosis H37Rv
cgccaacgcccccauccgg

SEQ ID NO: 3249420 - RNA, 18 nt, Mycobacterium tuberculosis H37Rv
cgccaacgggcugccccu

SEQ ID NO: 3249421 - RNA, 17 nt, Mycobacterium tuberculosis H37Rv
cgccaacgugacgccgg

SEQ ID NO: 3249422 - RNA, 18 nt, Mycobacterium tuberculosis H37Rv
cgccaacguugcgccagc

SEQ ID NO: 3249423 - RNA, 22 nt, Mycobacterium tuberculosis H37Rv
cgccaacucgagaguggccucg

SEQ ID NO: 3249424 - RNA, 11 nt, Mycobacterium tuberculosis H37Rv
cgccaacucgu

SEQ ID NO: 3249425 - RNA, 19 nt, Mycobacterium tuberculosis H37Rv
cgccaacugcggcaggucu

SEQ ID NO: 3249426 - RNA, 19 nt, Mycobacterium tuberculosis H37Rv
cgccaacuucaccacccug

SEQ ID NO: 3249427 - RNA, 19 nt, Mycobacterium tuberculosis H37Rv
cgccaagacgucggcgugg

SEQ ID NO: 3249428 - RNA, 21 nt, Mycobacterium tuberculosis H37Rv
cgccaagaucggguggcgggu

SEQ ID NO: 3249429 - RNA, 15 nt, Mycobacterium tuberculosis H37Rv
cgccaagccgugccg

SEQ ID NO: 3249430 - RNA, 19 nt, Mycobacterium tuberculosis H37Rv
cgccaagccgugccgcaca

SEQ ID NO: 3249431 - RNA, 14 nt, Mycobacterium tuberculosis H37Rv
cgccaaggcgaugg

SEQ ID NO: 3249432 - RNA, 14 nt, Mycobacterium tuberculosis H37Rv
cgccaagggccccu

SEQ ID NO: 3249433 - RNA, 15 nt, Mycobacterium tuberculosis H37Rv
cgccaaggucugccg

SEQ ID NO: 3249434 - RNA, 21 nt, Mycobacterium tuberculosis H37Rv
cgccaaguacgcgaccgcgau

SEQ ID NO: 3249435 - RNA, 19 nt, Mycobacterium tuberculosis H37Rv
cgccaaguccgcucaccuu

SEQ ID NO: 3249436 - RNA, 21 nt, Mycobacterium tuberculosis H37Rv
cgccaaguccgcucaccuuug

SEQ ID NO: 3249437 - RNA, 13 nt, Mycobacterium tuberculosis H37Rv
cgccaagucucgg

SEQ ID NO: 3249438 - RNA, 19 nt, Mycobacterium tuberculosis H37Rv
cgccaauccgcgucgucga

SEQ ID NO: 3249439 - RNA, 15 nt, Mycobacterium tuberculosis H37Rv
cgccaaugccaccau

SEQ ID NO: 3249440 - RNA, 15 nt, Mycobacterium tuberculosis H37Rv
cgccaaugcccaggu

SEQ ID NO: 3249441 - RNA, 18 nt, Mycobacterium tuberculosis H37Rv
cgccaauucagcggcaac

SEQ ID NO: 3249442 - RNA, 22 nt, Mycobacterium tuberculosis H37Rv
cgccacaaccguugcugcgcag

SEQ ID NO: 3249443 - RNA, 16 nt, Mycobacterium tuberculosis H37Rv
cgccacaacggcggcg

SEQ ID NO: 3249444 - RNA, 18 nt, Mycobacterium tuberculosis H37Rv
cgccacaccaacgucgau

SEQ ID NO: 3249445 - RNA, 13 nt, Mycobacterium tuberculosis H37Rv
cgccacaccauga

SEQ ID NO: 3249446 - RNA, 20 nt, Mycobacterium tuberculosis H37Rv
cgccacaccaugauugccag

SEQ ID NO: 3249447 - RNA, 13 nt, Mycobacterium tuberculosis H37Rv
cgccacacccgug

SEQ ID NO: 3249448 - RNA, 17 nt, Mycobacterium tuberculosis H37Rv
cgccacacggggccgcc

SEQ ID NO: 3249449 - RNA, 20 nt, Mycobacterium tuberculosis H37Rv
cgccacacggggccgccagc

SEQ ID NO: 3249450 - RNA, 17 nt, Mycobacterium tuberculosis H37Rv
cgccacagcacccacgc

SEQ ID NO: 3249451 - RNA, 12 nt, Mycobacterium tuberculosis H37Rv
cgccacagcccc

SEQ ID NO: 3249452 - RNA, 18 nt, Mycobacterium tuberculosis H37Rv
cgccacagccccagggug

SEQ ID NO: 3249453 - RNA, 18 nt, Mycobacterium tuberculosis H37Rv
cgccacagucgucgagcg

SEQ ID NO: 3249454 - RNA, 18 nt, Mycobacterium tuberculosis H37Rv
cgccacauuucaccaccg

SEQ ID NO: 3249455 - RNA, 19 nt, Mycobacterium tuberculosis H37Rv
cgccaccaccagggcaacg

SEQ ID NO: 3249456 - RNA, 14 nt, Mycobacterium tuberculosis H37Rv
cgccaccacccagg

SEQ ID NO: 3249457 - RNA, 15 nt, Mycobacterium tuberculosis H37Rv
cgccaccacccaggc

SEQ ID NO: 3249458 - RNA, 14 nt, Mycobacterium tuberculosis H37Rv
cgccaccaccggcg

SEQ ID NO: 3249459 - RNA, 13 nt, Mycobacterium tuberculosis H37Rv
cgccaccaccucc

SEQ ID NO: 3249460 - RNA, 20 nt, Mycobacterium tuberculosis H37Rv
cgccaccaccuccgcgucgg

SEQ ID NO: 3249461 - RNA, 21 nt, Mycobacterium tuberculosis H37Rv
cgccaccaccuccgcgucgga

SEQ ID NO: 3249462 - RNA, 13 nt, Mycobacterium tuberculosis H37Rv
cgccaccacgccg

SEQ ID NO: 3249463 - RNA, 18 nt, Mycobacterium tuberculosis H37Rv
cgccaccagcaccgccgc

SEQ ID NO: 3249464 - RNA, 15 nt, Mycobacterium tuberculosis H37Rv
cgccaccagcgcacg

SEQ ID NO: 3249465 - RNA, 14 nt, Mycobacterium tuberculosis H37Rv
cgccaccagcgcga

SEQ ID NO: 3249466 - RNA, 13 nt, Mycobacterium tuberculosis H37Rv
cgccaccaucccc

SEQ ID NO: 3249467 - RNA, 19 nt, Mycobacterium tuberculosis H37Rv
cgccacccccaaccgccgg

SEQ ID NO: 3249468 - RNA, 20 nt, Mycobacterium tuberculosis H37Rv
cgccaccccgcguaugccag

SEQ ID NO: 3249469 - RNA, 21 nt, Mycobacterium tuberculosis H37Rv
cgccaccccgcuuggaccguu

SEQ ID NO: 3249470 - RNA, 19 nt, Mycobacterium tuberculosis H37Rv
cgccacccgacaugcgccg

SEQ ID NO: 3249471 - RNA, 14 nt, Mycobacterium tuberculosis H37Rv
cgccacccgccaac

SEQ ID NO: 3249472 - RNA, 16 nt, Mycobacterium tuberculosis H37Rv
cgccacccgccaacgc

SEQ ID NO: 3249473 - RNA, 13 nt, Mycobacterium tuberculosis H37Rv
cgccacccgcgcc

SEQ ID NO: 3249474 - RNA, 19 nt, Mycobacterium tuberculosis H37Rv
cgccacccgcgccgccagc

SEQ ID NO: 3249475 - RNA, 17 nt, Mycobacterium tuberculosis H37Rv
cgccacccgcgucaguc

SEQ ID NO: 3249476 - RNA, 18 nt, Mycobacterium tuberculosis H37Rv
cgccacccggcgggcggu

SEQ ID NO: 3249477 - RNA, 11 nt, Mycobacterium tuberculosis H37Rv
cgccacccggu

SEQ ID NO: 3249478 - RNA, 18 nt, Mycobacterium tuberculosis H37Rv
cgccacccuuggcccggu

SEQ ID NO: 3249479 - RNA, 13 nt, Mycobacterium tuberculosis H37Rv
cgccaccgaagcc

SEQ ID NO: 3249480 - RNA, 16 nt, Mycobacterium tuberculosis H37Rv
cgccaccgaagccgcc

SEQ ID NO: 3249481 - RNA, 19 nt, Mycobacterium tuberculosis H37Rv
cgccaccgagcccuccagg

SEQ ID NO: 3249482 - RNA, 19 nt, Mycobacterium tuberculosis H37Rv
cgccaccgauaccgucagc

SEQ ID NO: 3249483 - RNA, 23 nt, Mycobacterium tuberculosis H37Rv
cgccaccgauaccgucagcgccg

SEQ ID NO: 3249484 - RNA, 16 nt, Mycobacterium tuberculosis H37Rv
cgccaccgauggcggu

SEQ ID NO: 3249485 - RNA, 15 nt, Mycobacterium tuberculosis H37Rv
cgccaccgccgcugc

SEQ ID NO: 3249486 - RNA, 16 nt, Mycobacterium tuberculosis H37Rv
cgccaccgccggcagc

SEQ ID NO: 3249487 - RNA, 17 nt, Mycobacterium tuberculosis H37Rv
cgccaccgcgacgagcg

SEQ ID NO: 3249488 - RNA, 14 nt, Mycobacterium tuberculosis H37Rv
cgccaccgcggccu

SEQ ID NO: 3249489 - RNA, 14 nt, Mycobacterium tuberculosis H37Rv
cgccaccgcgguca

SEQ ID NO: 3249490 - RNA, 20 nt, Mycobacterium tuberculosis H37Rv
cgccaccgcggucaccgacg

SEQ ID NO: 3249491 - RNA, 20 nt, Mycobacterium tuberculosis H37Rv
cgccaccgcgucacuucccg

SEQ ID NO: 3249492 - RNA, 16 nt, Mycobacterium tuberculosis H37Rv
cgccaccgcugucgau

SEQ ID NO: 3249493 - RNA, 13 nt, Mycobacterium tuberculosis H37Rv
cgccaccggcaau

SEQ ID NO: 3249494 - RNA, 20 nt, Mycobacterium tuberculosis H37Rv
cgccaccggcaaucggcggc

SEQ ID NO: 3249495 - RNA, 12 nt, Mycobacterium tuberculosis H37Rv
cgccaccggcac

SEQ ID NO: 3249496 - RNA, 14 nt, Mycobacterium tuberculosis H37Rv
cgccaccggcaccg

SEQ ID NO: 3249497 - RNA, 16 nt, Mycobacterium tuberculosis H37Rv
cgccaccggcaccgcc

SEQ ID NO: 3249498 - RNA, 18 nt, Mycobacterium tuberculosis H37Rv
cgccaccggcaccgccug

SEQ ID NO: 3249499 - RNA, 19 nt, Mycobacterium tuberculosis H37Rv
cgccaccggcaccgccugc

SEQ ID NO: 3249500 - RNA, 14 nt, Mycobacterium tuberculosis H37Rv
cgccaccggccgcg

SEQ ID NO: 3249501 - RNA, 14 nt, Mycobacterium tuberculosis H37Rv
cgccaccggcgcca

SEQ ID NO: 3249502 - RNA, 14 nt, Mycobacterium tuberculosis H37Rv
cgccaccggcgccg

SEQ ID NO: 3249503 - RNA, 22 nt, Mycobacterium tuberculosis H37Rv
cgccaccggcgccgcccgcgcc

SEQ ID NO: 3249504 - RNA, 16 nt, Mycobacterium tuberculosis H37Rv
cgccaccggcgcgacc

SEQ ID NO: 3249505 - RNA, 12 nt, Mycobacterium tuberculosis H37Rv
cgccaccggcgu

SEQ ID NO: 3249506 - RNA, 19 nt, Mycobacterium tuberculosis H37Rv
cgccaccggcguccagucc

SEQ ID NO: 3249507 - RNA, 11 nt, Mycobacterium tuberculosis H37Rv
cgccaccggcu

SEQ ID NO: 3249508 - RNA, 20 nt, Mycobacterium tuberculosis H37Rv
cgccaccggguucaccgagg

SEQ ID NO: 3249509 - RNA, 20 nt, Mycobacterium tuberculosis H37Rv
cgccaccgguaccgaucagc

SEQ ID NO: 3249510 - RNA, 18 nt, Mycobacterium tuberculosis H37Rv
cgccaccgguaccggcga

SEQ ID NO: 3249511 - RNA, 22 nt, Mycobacterium tuberculosis H37Rv
cgccaccguacgacagucgcag

SEQ ID NO: 3249512 - RNA, 16 nt, Mycobacterium tuberculosis H37Rv
cgccaccgucaccgcc

SEQ ID NO: 3249513 - RNA, 17 nt, Mycobacterium tuberculosis H37Rv
cgccaccgucaccgccg

SEQ ID NO: 3249514 - RNA, 18 nt, Mycobacterium tuberculosis H37Rv
cgccaccgugucacgcga

SEQ ID NO: 3249515 - RNA, 14 nt, Mycobacterium tuberculosis H37Rv
cgccaccguugccg

SEQ ID NO: 3249516 - RNA, 23 nt, Mycobacterium tuberculosis H37Rv
cgccagcgccgcugaagccagga

SEQ ID NO: 3249517 - RNA, 13 nt, Mycobacterium tuberculosis H37Rv
cgccagcgccggc

SEQ ID NO: 3249518 - RNA, 13 nt, Mycobacterium tuberculosis H37Rv
cgccagcgcgccg

SEQ ID NO: 3249519 - RNA, 15 nt, Mycobacterium tuberculosis H37Rv
cgccagcgcgccgau

SEQ ID NO: 3249520 - RNA, 14 nt, Mycobacterium tuberculosis H37Rv
cgccagcggcagcg

SEQ ID NO: 3249521 - RNA, 17 nt, Mycobacterium tuberculosis H37Rv
cgccagcggcagcggcg

SEQ ID NO: 3249522 - RNA, 13 nt, Mycobacterium tuberculosis H37Rv
cgccagcggccgc

SEQ ID NO: 3249523 - RNA, 17 nt, Mycobacterium tuberculosis H37Rv
cgccagcggccgcucca

SEQ ID NO: 3249524 - RNA, 19 nt, Mycobacterium tuberculosis H37Rv
cgccagcggccgcuccacc

SEQ ID NO: 3249525 - RNA, 18 nt, Mycobacterium tuberculosis H37Rv
cgccagcgggcuguaggc

SEQ ID NO: 3249526 - RNA, 12 nt, Mycobacterium tuberculosis H37Rv
cgccagcggggc

SEQ ID NO: 3249527 - RNA, 17 nt, Mycobacterium tuberculosis H37Rv
cgccagcgguggaccac

SEQ ID NO: 3249528 - RNA, 20 nt, Mycobacterium tuberculosis H37Rv
cgccagcguaaauagcgccc

SEQ ID NO: 3249529 - RNA, 18 nt, Mycobacterium tuberculosis H37Rv
cgccagcucacggacgcu

SEQ ID NO: 3249530 - RNA, 14 nt, Mycobacterium tuberculosis H37Rv
cgccagcucgccgg

SEQ ID NO: 3249531 - RNA, 15 nt, Mycobacterium tuberculosis H37Rv
cgccagcucgccggc

SEQ ID NO: 3249532 - RNA, 18 nt, Mycobacterium tuberculosis H37Rv
cgccagcucgccggccgg

SEQ ID NO: 3249533 - RNA, 14 nt, Mycobacterium tuberculosis H37Rv
cgccagcugcgcag

SEQ ID NO: 3249534 - RNA, 21 nt, Mycobacterium tuberculosis H37Rv
cgccagcugcgcagcgcaaca

SEQ ID NO: 3249535 - RNA, 19 nt, Mycobacterium tuberculosis H37Rv
cgccagcugggcagccaga

SEQ ID NO: 3249536 - RNA, 17 nt, Mycobacterium tuberculosis H37Rv
cgccagcuugucgggca

SEQ ID NO: 3249537 - RNA, 11 nt, Mycobacterium tuberculosis H37Rv
cgccaggaacc

SEQ ID NO: 3249538 - RNA, 19 nt, Mycobacterium tuberculosis H37Rv
cgccaggaucugguugaac

SEQ ID NO: 3249539 - RNA, 13 nt, Mycobacterium tuberculosis H37Rv
cgccaggcaagcc

SEQ ID NO: 3249540 - RNA, 19 nt, Mycobacterium tuberculosis H37Rv
cgccaggcaagccagcacu

SEQ ID NO: 3249541 - RNA, 23 nt, Mycobacterium tuberculosis H37Rv
cgccaggcaagccagcacugcca

SEQ ID NO: 3249542 - RNA, 14 nt, Mycobacterium tuberculosis H37Rv
cgccaggcaugccg

SEQ ID NO: 3249543 - RNA, 17 nt, Mycobacterium tuberculosis H37Rv
cgccaggcaugccgccc

SEQ ID NO: 3249544 - RNA, 21 nt, Mycobacterium tuberculosis H37Rv
cgccaggccgaccgcgcacau

SEQ ID NO: 3249545 - RNA, 15 nt, Mycobacterium tuberculosis H37Rv
cgccaggccgagccc

SEQ ID NO: 3249546 - RNA, 18 nt, Mycobacterium tuberculosis H37Rv
cgccaggccgagcccggu

SEQ ID NO: 3249547 - RNA, 14 nt, Mycobacterium tuberculosis H37Rv
cgccaggccgcaca

SEQ ID NO: 3249548 - RNA, 17 nt, Mycobacterium tuberculosis H37Rv
cgccaggccgcgcgaca

SEQ ID NO: 3249549 - RNA, 22 nt, Mycobacterium tuberculosis H37Rv
cgccaggccguugccccgucgu

SEQ ID NO: 3249550 - RNA, 20 nt, Mycobacterium tuberculosis H37Rv
cgccaggcggcaauucgggc

SEQ ID NO: 3249551 - RNA, 15 nt, Mycobacterium tuberculosis H37Rv
cgccaggcuugcggc

SEQ ID NO: 3249552 - RNA, 19 nt, Mycobacterium tuberculosis H37Rv
cgccaggcuugcggcaccc

SEQ ID NO: 3249553 - RNA, 21 nt, Mycobacterium tuberculosis H37Rv
cgccagggaucuagaggcggc

SEQ ID NO: 3249554 - RNA, 23 nt, Mycobacterium tuberculosis H37Rv
cgccagggaucuagaggcggccc

SEQ ID NO: 3249555 - RNA, 16 nt, Mycobacterium tuberculosis H37Rv
cgccagggcacguggc

SEQ ID NO: 3249556 - RNA, 14 nt, Mycobacterium tuberculosis H37Rv
cgccagggccaucu

SEQ ID NO: 3249557 - RNA, 21 nt, Mycobacterium tuberculosis H37Rv
cgccagggcccuagccggcgc

SEQ ID NO: 3249558 - RNA, 14 nt, Mycobacterium tuberculosis H37Rv
cgccagggccgccg

SEQ ID NO: 3249559 - RNA, 16 nt, Mycobacterium tuberculosis H37Rv
cgccagggucgcgagc

SEQ ID NO: 3249560 - RNA, 23 nt, Mycobacterium tuberculosis H37Rv
cgccagggucgcgagcccgccac

SEQ ID NO: 3249561 - RNA, 18 nt, Mycobacterium tuberculosis H37Rv
cgccagguacucggugca

SEQ ID NO: 3249562 - RNA, 23 nt, Mycobacterium tuberculosis H37Rv
cgccagguccgccggugccgccg

SEQ ID NO: 3249563 - RNA, 15 nt, Mycobacterium tuberculosis H37Rv
cgccaggucggcggg

SEQ ID NO: 3249564 - RNA, 19 nt, Mycobacterium tuberculosis H37Rv
cgccaggucggcgggcgcg

SEQ ID NO: 3249565 - RNA, 17 nt, Mycobacterium tuberculosis H37Rv
cgccaggugcagcacca

SEQ ID NO: 3249566 - RNA, 22 nt, Mycobacterium tuberculosis H37Rv
cgccagguguucgccggagacc

SEQ ID NO: 3249567 - RNA, 22 nt, Mycobacterium tuberculosis H37Rv
cgccagguuaggcaauagccgg

SEQ ID NO: 3249568 - RNA, 14 nt, Mycobacterium tuberculosis H37Rv
cgccagguugcccg

SEQ ID NO: 3249569 - RNA, 21 nt, Mycobacterium tuberculosis H37Rv
cgccaguaccacuguuacggc

SEQ ID NO: 3249570 - RNA, 15 nt, Mycobacterium tuberculosis H37Rv
cgccaguaggcuucg

SEQ ID NO: 3249571 - RNA, 21 nt, Mycobacterium tuberculosis H37Rv
cgccaguauggccgccaccgc

SEQ ID NO: 3249572 - RNA, 18 nt, Mycobacterium tuberculosis H37Rv
cgccagucccacugggcc

SEQ ID NO: 3249573 - RNA, 16 nt, Mycobacterium tuberculosis H37Rv
cgccagucccggcgca

SEQ ID NO: 3249574 - RNA, 17 nt, Mycobacterium tuberculosis H37Rv
cgccaguccgaucgccg

SEQ ID NO: 3249575 - RNA, 17 nt, Mycobacterium tuberculosis H37Rv
cgccagucgagcaccug

SEQ ID NO: 3249576 - RNA, 20 nt, Mycobacterium tuberculosis H37Rv
cgccagugcccgcacugccg

SEQ ID NO: 3249577 - RNA, 21 nt, Mycobacterium tuberculosis H37Rv
cgccagugcccgcacugccgc

SEQ ID NO: 3249578 - RNA, 23 nt, Mycobacterium tuberculosis H37Rv
cgccagugcccgcacugccgccg

SEQ ID NO: 3249579 - RNA, 16 nt, Mycobacterium tuberculosis H37Rv
cgccagugcggucucg

SEQ ID NO: 3249580 - RNA, 21 nt, Mycobacterium tuberculosis H37Rv
cgccagugcggucucgaccgu

SEQ ID NO: 3249581 - RNA, 15 nt, Mycobacterium tuberculosis H37Rv
cgccaguggccacca

SEQ ID NO: 3249582 - RNA, 17 nt, Mycobacterium tuberculosis H37Rv
cgccaguggccaccauc

SEQ ID NO: 3249583 - RNA, 18 nt, Mycobacterium tuberculosis H37Rv
cgccaguggugcaccgau

SEQ ID NO: 3249584 - RNA, 17 nt, Mycobacterium tuberculosis H37Rv
cgccaguguugcgcugc

SEQ ID NO: 3249585 - RNA, 18 nt, Mycobacterium tuberculosis H37Rv
cgccaguguugcgcugcg

SEQ ID NO: 3249586 - RNA, 14 nt, Mycobacterium tuberculosis H37Rv
cgccaguuccggug

SEQ ID NO: 3249587 - RNA, 15 nt, Mycobacterium tuberculosis H37Rv
cgccaguucgcgcca

SEQ ID NO: 3249588 - RNA, 15 nt, Mycobacterium tuberculosis H37Rv
cgccaguucgcggcu

SEQ ID NO: 3249589 - RNA, 20 nt, Mycobacterium tuberculosis H37Rv
cgccaguucgcggcugcguu

SEQ ID NO: 3249590 - RNA, 17 nt, Mycobacterium tuberculosis H37Rv
cgccaguucggauccgg

SEQ ID NO: 3249591 - RNA, 19 nt, Mycobacterium tuberculosis H37Rv
cgccaguucggcgggagcu

SEQ ID NO: 3249592 - RNA, 19 nt, Mycobacterium tuberculosis H37Rv
cgccaguucggcgggcgcg

SEQ ID NO: 3249593 - RNA, 15 nt, Mycobacterium tuberculosis H37Rv
cgccaguucggcguc

SEQ ID NO: 3249594 - RNA, 16 nt, Mycobacterium tuberculosis H37Rv
cgccaguucuucgggc

SEQ ID NO: 3249595 - RNA, 19 nt, Mycobacterium tuberculosis H37Rv
cgccaguucuucgggcggg

SEQ ID NO: 3249596 - RNA, 21 nt, Mycobacterium tuberculosis H37Rv
cgccaguugcguuguccacca

SEQ ID NO: 3249597 - RNA, 15 nt, Mycobacterium tuberculosis H37Rv
cgccauaccagcguu

SEQ ID NO: 3249598 - RNA, 13 nt, Mycobacterium tuberculosis H37Rv
cgccauaccggcu

SEQ ID NO: 3249599 - RNA, 23 nt, Mycobacterium tuberculosis H37Rv
cgccauaccugccggaccaccgg

SEQ ID NO: 3249600 - RNA, 13 nt, Mycobacterium tuberculosis H37Rv
cgccauacgucgc

SEQ ID NO: 3249601 - RNA, 21 nt, Mycobacterium tuberculosis H37Rv
cgccauacgucgccucgagau

SEQ ID NO: 3249602 - RNA, 13 nt, Mycobacterium tuberculosis H37Rv
cgccauagcgggc

SEQ ID NO: 3249603 - RNA, 16 nt, Mycobacterium tuberculosis H37Rv
cgccauagcgggcggu

SEQ ID NO: 3249604 - RNA, 17 nt, Mycobacterium tuberculosis H37Rv
cgccauagcgggcggua

SEQ ID NO: 3249605 - RNA, 19 nt, Mycobacterium tuberculosis H37Rv
cgccaucacaucggccucu

SEQ ID NO: 3249606 - RNA, 20 nt, Mycobacterium tuberculosis H37Rv
cgccaucaccgccguuaccg

SEQ ID NO: 3249607 - RNA, 22 nt, Mycobacterium tuberculosis H37Rv
cgccaucaccgccguuaccgcc

SEQ ID NO: 3249608 - RNA, 14 nt, Mycobacterium tuberculosis H37Rv
cgccaucagcccgg

SEQ ID NO: 3249609 - RNA, 13 nt, Mycobacterium tuberculosis H37Rv
cgccaucagcccu

SEQ ID NO: 3249610 - RNA, 13 nt, Mycobacterium tuberculosis H37Rv
cgccaucaucgcu

SEQ ID NO: 3249611 - RNA, 21 nt, Mycobacterium tuberculosis H37Rv
cgccaucauggcggcccgguc

SEQ ID NO: 3249612 - RNA, 23 nt, Mycobacterium tuberculosis H37Rv
cgcccauuggguaaccagcgcca

SEQ ID NO: 3249613 - RNA, 16 nt, Mycobacterium tuberculosis H37Rv
cgccccacaacaugcu

SEQ ID NO: 3249614 - RNA, 21 nt, Mycobacterium tuberculosis H37Rv
cgccccacaacaugcuggaga

SEQ ID NO: 3249615 - RNA, 12 nt, Mycobacterium tuberculosis H37Rv
cgccccacccga

SEQ ID NO: 3249616 - RNA, 17 nt, Mycobacterium tuberculosis H37Rv
cgccccaccgcgccgag

SEQ ID NO: 3249617 - RNA, 13 nt, Mycobacterium tuberculosis H37Rv
cgccccaccggcc

SEQ ID NO: 3249618 - RNA, 17 nt, Mycobacterium tuberculosis H37Rv
cgccccaccggcccggg

SEQ ID NO: 3249619 - RNA, 18 nt, Mycobacterium tuberculosis H37Rv
cgccccagcugcggucgc

SEQ ID NO: 3249620 - RNA, 13 nt, Mycobacterium tuberculosis H37Rv
cgccccaugauga

SEQ ID NO: 3249621 - RNA, 20 nt, Mycobacterium tuberculosis H37Rv
cgccccaugaugaacagcuc

SEQ ID NO: 3249622 - RNA, 15 nt, Mycobacterium tuberculosis H37Rv
cgccccaugcaacac

SEQ ID NO: 3249623 - RNA, 17 nt, Mycobacterium tuberculosis H37Rv
cgccccaugcaacacac

SEQ ID NO: 3249624 - RNA, 16 nt, Mycobacterium tuberculosis H37Rv
cgcccccagugcacgc

SEQ ID NO: 3249625 - RNA, 18 nt, Mycobacterium tuberculosis H37Rv
cgcccccauccggucgau

SEQ ID NO: 3249626 - RNA, 11 nt, Mycobacterium tuberculosis H37Rv
cgcccccgcca

SEQ ID NO: 3249627 - RNA, 18 nt, Mycobacterium tuberculosis H37Rv
cgcccccgccauugccgc

SEQ ID NO: 3249628 - RNA, 20 nt, Mycobacterium tuberculosis H37Rv
cgcccccgccauugccgccg

SEQ ID NO: 3249629 - RNA, 22 nt, Mycobacterium tuberculosis H37Rv
cgcccccgccauugccgccggc

SEQ ID NO: 3249630 - RNA, 12 nt, Mycobacterium tuberculosis H37Rv
cgcccccgcccg

SEQ ID NO: 3249631 - RNA, 13 nt, Mycobacterium tuberculosis H37Rv
cgcccccgcccgu

SEQ ID NO: 3249632 - RNA, 14 nt, Mycobacterium tuberculosis H37Rv
cgcccccgcugcca

SEQ ID NO: 3249633 - RNA, 18 nt, Mycobacterium tuberculosis H37Rv
cgcccccucuagcgccuc

SEQ ID NO: 3249634 - RNA, 14 nt, Mycobacterium tuberculosis H37Rv
cgccccgaggaugc

SEQ ID NO: 3249635 - RNA, 21 nt, Mycobacterium tuberculosis H37Rv
cgccccgauaaaaaccacccc

SEQ ID NO: 3249636 - RNA, 22 nt, Mycobacterium tuberculosis H37Rv
cgccccgauaaaaaccaccccc

SEQ ID NO: 3249637 - RNA, 15 nt, Mycobacterium tuberculosis H37Rv
cgccccgaucggcca

SEQ ID NO: 3249638 - RNA, 19 nt, Mycobacterium tuberculosis H37Rv
cgccccgaugaccgccuug

SEQ ID NO: 3249639 - RNA, 20 nt, Mycobacterium tuberculosis H37Rv
cgccccgcagcugcgucccg

SEQ ID NO: 3249640 - RNA, 22 nt, Mycobacterium tuberculosis H37Rv
cgccccgcagcugcgucccgga

SEQ ID NO: 3249641 - RNA, 13 nt, Mycobacterium tuberculosis H37Rv
cgccccgccguug

SEQ ID NO: 3249642 - RNA, 14 nt, Mycobacterium tuberculosis H37Rv
cgccccgcgccuug

SEQ ID NO: 3249643 - RNA, 12 nt, Mycobacterium tuberculosis H37Rv
cgccccgcguug

SEQ ID NO: 3249644 - RNA, 11 nt, Mycobacterium tuberculosis H37Rv
cgccccgcucg

SEQ ID NO: 3249645 - RNA, 13 nt, Mycobacterium tuberculosis H37Rv
cgccccggccgcu

SEQ ID NO: 3249646 - RNA, 18 nt, Mycobacterium tuberculosis H37Rv
cgccccggcgcggccagc

SEQ ID NO: 3249647 - RNA, 12 nt, Mycobacterium tuberculosis H37Rv
cgccccggcggc

SEQ ID NO: 3249648 - RNA, 18 nt, Mycobacterium tuberculosis H37Rv
cgccccggggguccaccu

SEQ ID NO: 3249649 - RNA, 22 nt, Mycobacterium tuberculosis H37Rv
cgccccguugugucaccggcgu

SEQ ID NO: 3249650 - RNA, 18 nt, Mycobacterium tuberculosis H37Rv
cgccccguuucggucgac

SEQ ID NO: 3249651 - RNA, 22 nt, Mycobacterium tuberculosis H37Rv
cgccccucacguggacugaccu

SEQ ID NO: 3249652 - RNA, 14 nt, Mycobacterium tuberculosis H37Rv
cgccccuggcaccu

SEQ ID NO: 3249653 - RNA, 14 nt, Mycobacterium tuberculosis H37Rv
cgccccugucgacc

SEQ ID NO: 3249654 - RNA, 15 nt, Mycobacterium tuberculosis H37Rv
cgccccugucgaccg

SEQ ID NO: 3249655 - RNA, 21 nt, Mycobacterium tuberculosis H37Rv
cgcccgaagaaugggauggca

SEQ ID NO: 3249656 - RNA, 18 nt, Mycobacterium tuberculosis H37Rv
cgcccgaagaugccugga

SEQ ID NO: 3249657 - RNA, 14 nt, Mycobacterium tuberculosis H37Rv
cgcccgaagccggg

SEQ ID NO: 3249658 - RNA, 17 nt, Mycobacterium tuberculosis H37Rv
cgcccgaagccgggccc

SEQ ID NO: 3249659 - RNA, 18 nt, Mycobacterium tuberculosis H37Rv
cgcccgaagccgggcccc

SEQ ID NO: 3249660 - RNA, 12 nt, Mycobacterium tuberculosis H37Rv
cgcccgacaccc

SEQ ID NO: 3249661 - RNA, 18 nt, Mycobacterium tuberculosis H37Rv
cgcccgacgaacagcggu

SEQ ID NO: 3249662 - RNA, 22 nt, Mycobacterium tuberculosis H37Rv
cgcccgacgagauugccgggcc

SEQ ID NO: 3249663 - RNA, 22 nt, Mycobacterium tuberculosis H37Rv
cgcccgacgaggaugucgauga

SEQ ID NO: 3249664 - RNA, 23 nt, Mycobacterium tuberculosis H37Rv
cgcccgacgaugugcacggugug

SEQ ID NO: 3249665 - RNA, 16 nt, Mycobacterium tuberculosis H37Rv
cgcccgagccgcugcg

SEQ ID NO: 3249666 - RNA, 20 nt, Mycobacterium tuberculosis H37Rv
cgcccgaggcaacgaacgcc

SEQ ID NO: 3249667 - RNA, 13 nt, Mycobacterium tuberculosis H37Rv
cgcccgaggcacc

SEQ ID NO: 3249668 - RNA, 19 nt, Mycobacterium tuberculosis H37Rv
cgcccgaggcgagacgcuc

SEQ ID NO: 3249669 - RNA, 18 nt, Mycobacterium tuberculosis H37Rv
cgcccgaguuguggacgc

SEQ ID NO: 3249670 - RNA, 20 nt, Mycobacterium tuberculosis H37Rv
cgcccgaguuguggacgccc

SEQ ID NO: 3249671 - RNA, 15 nt, Mycobacterium tuberculosis H37Rv
cgcccgauccgguua

SEQ ID NO: 3249672 - RNA, 14 nt, Mycobacterium tuberculosis H37Rv
cgcccgaucggcgg

SEQ ID NO: 3249673 - RNA, 15 nt, Mycobacterium tuberculosis H37Rv
cgcccgaucggcgga

SEQ ID NO: 3249674 - RNA, 22 nt, Mycobacterium tuberculosis H37Rv
cgcccgcaagucggacgggucu

SEQ ID NO: 3249675 - RNA, 20 nt, Mycobacterium tuberculosis H37Rv
cgcccgcaauuguucgcggc

SEQ ID NO: 3249676 - RNA, 13 nt, Mycobacterium tuberculosis H37Rv
cgcccgcacacag

SEQ ID NO: 3249677 - RNA, 13 nt, Mycobacterium tuberculosis H37Rv
cgcccgcaccacc

SEQ ID NO: 3249678 - RNA, 22 nt, Mycobacterium tuberculosis H37Rv
cgcccgcaccagcugucgggca

SEQ ID NO: 3249679 - RNA, 15 nt, Mycobacterium tuberculosis H37Rv
cgcccgcacccauga

SEQ ID NO: 3249680 - RNA, 16 nt, Mycobacterium tuberculosis H37Rv
cgcccgcacccaugau

SEQ ID NO: 3249681 - RNA, 17 nt, Mycobacterium tuberculosis H37Rv
cgcccgcacccccgaca

SEQ ID NO: 3249682 - RNA, 22 nt, Mycobacterium tuberculosis H37Rv
cgcccgcacccccgacaccgcc

SEQ ID NO: 3249683 - RNA, 20 nt, Mycobacterium tuberculosis H37Rv
cgcccgcacguucacgcgcg

SEQ ID NO: 3249684 - RNA, 23 nt, Mycobacterium tuberculosis H37Rv
cgcccgcaucgcggcaucgacgc

SEQ ID NO: 3249685 - RNA, 12 nt, Mycobacterium tuberculosis H37Rv
cgcccgccaccg

SEQ ID NO: 3249686 - RNA, 14 nt, Mycobacterium tuberculosis H37Rv
cgcccgccaccggg

SEQ ID NO: 3249687 - RNA, 15 nt, Mycobacterium tuberculosis H37Rv
cgcccgccaccgggu

SEQ ID NO: 3249688 - RNA, 17 nt, Mycobacterium tuberculosis H37Rv
cgcccgccaggccguug

SEQ ID NO: 3249689 - RNA, 16 nt, Mycobacterium tuberculosis H37Rv
cgcccgccaucagccc

SEQ ID NO: 3249690 - RNA, 11 nt, Mycobacterium tuberculosis H37Rv
cgcccgccccg

SEQ ID NO: 3249691 - RNA, 17 nt, Mycobacterium tuberculosis H37Rv
cgcccgcccgagccgcu

SEQ ID NO: 3249692 - RNA, 16 nt, Mycobacterium tuberculosis H37Rv
cgcccgcccggacgca

SEQ ID NO: 3249693 - RNA, 13 nt, Mycobacterium tuberculosis H37Rv
cgcccgccgccac

SEQ ID NO: 3249694 - RNA, 13 nt, Mycobacterium tuberculosis H37Rv
cgcccgccggcaa

SEQ ID NO: 3249695 - RNA, 14 nt, Mycobacterium tuberculosis H37Rv
cgcccgccggcaac

SEQ ID NO: 3249696 - RNA, 13 nt, Mycobacterium tuberculosis H37Rv
cgcccgccggcau

SEQ ID NO: 3249697 - RNA, 14 nt, Mycobacterium tuberculosis H37Rv
cgcccgccucgacc

SEQ ID NO: 3249698 - RNA, 17 nt, Mycobacterium tuberculosis H37Rv
cgcccgccucgaccgcc

SEQ ID NO: 3249699 - RNA, 19 nt, Mycobacterium tuberculosis H37Rv
cgcccgccucgaccgccag

SEQ ID NO: 3249700 - RNA, 20 nt, Mycobacterium tuberculosis H37Rv
cgcccgccucgaccgccagc

SEQ ID NO: 3249701 - RNA, 17 nt, Mycobacterium tuberculosis H37Rv
cgcccgccucugucuuc

SEQ ID NO: 3249702 - RNA, 17 nt, Mycobacterium tuberculosis H37Rv
cgcccgccugcaggaug

SEQ ID NO: 3249703 - RNA, 13 nt, Mycobacterium tuberculosis H37Rv
cgcccgcgagcug

SEQ ID NO: 3249704 - RNA, 14 nt, Mycobacterium tuberculosis H37Rv
cgcccgcgagcugu

SEQ ID NO: 3249705 - RNA, 22 nt, Mycobacterium tuberculosis H37Rv
cgcccgcgagcuguaggucagc

SEQ ID NO: 3249706 - RNA, 16 nt, Mycobacterium tuberculosis H37Rv
cgcccgcgccaccggc

SEQ ID NO: 3249707 - RNA, 13 nt, Mycobacterium tuberculosis H37Rv
cgcccgcgccgcc

SEQ ID NO: 3249708 - RNA, 19 nt, Mycobacterium tuberculosis H37Rv
cgcccgcgccgccgccacc

SEQ ID NO: 3249709 - RNA, 20 nt, Mycobacterium tuberculosis H37Rv
cgcccugacgguggugaccg

SEQ ID NO: 3249710 - RNA, 15 nt, Mycobacterium tuberculosis H37Rv
cgcccugccauggga

SEQ ID NO: 3249711 - RNA, 14 nt, Mycobacterium tuberculosis H37Rv
cgcccuggaaugcc

SEQ ID NO: 3249712 - RNA, 15 nt, Mycobacterium tuberculosis H37Rv
cgcccuggacgucgg

SEQ ID NO: 3249713 - RNA, 13 nt, Mycobacterium tuberculosis H37Rv
cgcccuggcaacg

SEQ ID NO: 3249714 - RNA, 22 nt, Mycobacterium tuberculosis H37Rv
cgcccuggcaacgacacgccgc

SEQ ID NO: 3249715 - RNA, 16 nt, Mycobacterium tuberculosis H37Rv
cgcccuggccgcccug

SEQ ID NO: 3249716 - RNA, 13 nt, Mycobacterium tuberculosis H37Rv
cgcccuggccgcu

SEQ ID NO: 3249717 - RNA, 14 nt, Mycobacterium tuberculosis H37Rv
cgcccugggcgccg

SEQ ID NO: 3249718 - RNA, 22 nt, Mycobacterium tuberculosis H37Rv
cgcccuguccggguagcggcgc

SEQ ID NO: 3249719 - RNA, 13 nt, Mycobacterium tuberculosis H37Rv
cgcccuguucggc

SEQ ID NO: 3249720 - RNA, 17 nt, Mycobacterium tuberculosis H37Rv
cgcccuguucggcccga

SEQ ID NO: 3249721 - RNA, 20 nt, Mycobacterium tuberculosis H37Rv
cgcccuguucuccgugaucg

SEQ ID NO: 3249722 - RNA, 19 nt, Mycobacterium tuberculosis H37Rv
cgcccuuagggucgccgca

SEQ ID NO: 3249723 - RNA, 10 nt, Mycobacterium tuberculosis H37Rv
cgcccuugcc

SEQ ID NO: 3249724 - RNA, 15 nt, Mycobacterium tuberculosis H37Rv
cgcccuugccgcccg

SEQ ID NO: 3249725 - RNA, 15 nt, Mycobacterium tuberculosis H37Rv
cgcccuugccgccga

SEQ ID NO: 3249726 - RNA, 17 nt, Mycobacterium tuberculosis H37Rv
cgcccuugccgccggcc

SEQ ID NO: 3249727 - RNA, 21 nt, Mycobacterium tuberculosis H37Rv
cgcccuugccgccggccccgc

SEQ ID NO: 3249728 - RNA, 15 nt, Mycobacterium tuberculosis H37Rv
cgcccuugccgccuu

SEQ ID NO: 3249729 - RNA, 16 nt, Mycobacterium tuberculosis H37Rv
cgcccuugccuccggc

SEQ ID NO: 3249730 - RNA, 13 nt, Mycobacterium tuberculosis H37Rv
cgcccuugugaac

SEQ ID NO: 3249731 - RNA, 16 nt, Mycobacterium tuberculosis H37Rv
cgccgaaaacaacccg

SEQ ID NO: 3249732 - RNA, 19 nt, Mycobacterium tuberculosis H37Rv
cgccgaaaaccucgaaacc

SEQ ID NO: 3249733 - RNA, 14 nt, Mycobacterium tuberculosis H37Rv
cgccgaaaaugccg

SEQ ID NO: 3249734 - RNA, 23 nt, Mycobacterium tuberculosis H37Rv
cgccgaaacagcacccagacgau

SEQ ID NO: 3249735 - RNA, 22 nt, Mycobacterium tuberculosis H37Rv
cgccgaaaccacuuccggcgug

SEQ ID NO: 3249736 - RNA, 13 nt, Mycobacterium tuberculosis H37Rv
cgccgaaaccgcc

SEQ ID NO: 3249737 - RNA, 22 nt, Mycobacterium tuberculosis H37Rv
cgccgaaaccgggacaaucucg

SEQ ID NO: 3249738 - RNA, 23 nt, Mycobacterium tuberculosis H37Rv
cgccgaaaccgggacaaucucgg

SEQ ID NO: 3249739 - RNA, 17 nt, Mycobacterium tuberculosis H37Rv
cgccgaaacucaccagc

SEQ ID NO: 3249740 - RNA, 18 nt, Mycobacterium tuberculosis H37Rv
cgccgaaacucaccagca

SEQ ID NO: 3249741 - RNA, 21 nt, Mycobacterium tuberculosis H37Rv
cgccgaaacucaccagcaccc

SEQ ID NO: 3249742 - RNA, 14 nt, Mycobacterium tuberculosis H37Rv
cgccgaaagccuug

SEQ ID NO: 3249743 - RNA, 18 nt, Mycobacterium tuberculosis H37Rv
cgccgaaagggucgacgu

SEQ ID NO: 3249744 - RNA, 22 nt, Mycobacterium tuberculosis H37Rv
cgccgaaaucaguugcgcucca

SEQ ID NO: 3249745 - RNA, 14 nt, Mycobacterium tuberculosis H37Rv
cgccgaaaucggcc

SEQ ID NO: 3249746 - RNA, 16 nt, Mycobacterium tuberculosis H37Rv
cgccgaaaucggccag

SEQ ID NO: 3249747 - RNA, 18 nt, Mycobacterium tuberculosis H37Rv
cgccgaaaucggccagcu

SEQ ID NO: 3249748 - RNA, 13 nt, Mycobacterium tuberculosis H37Rv
cgccgaacaccga

SEQ ID NO: 3249749 - RNA, 18 nt, Mycobacterium tuberculosis H37Rv
cgccgaacaccggcucca

SEQ ID NO: 3249750 - RNA, 14 nt, Mycobacterium tuberculosis H37Rv
cgccgaacagcagc

SEQ ID NO: 3249751 - RNA, 20 nt, Mycobacterium tuberculosis H37Rv
cgccgaacagcagcccgccc

SEQ ID NO: 3249752 - RNA, 23 nt, Mycobacterium tuberculosis H37Rv
cgccgaacagcagcccgcccuga

SEQ ID NO: 3249753 - RNA, 24 nt, Mycobacterium tuberculosis H37Rv
cgccgaacagcagcccgcccugac

SEQ ID NO: 3249754 - RNA, 19 nt, Mycobacterium tuberculosis H37Rv
cgccgaaccagcgaugggu

SEQ ID NO: 3249755 - RNA, 14 nt, Mycobacterium tuberculosis H37Rv
cgccgaacgccacc

SEQ ID NO: 3249756 - RNA, 16 nt, Mycobacterium tuberculosis H37Rv
cgccgaacgccaccac

SEQ ID NO: 3249757 - RNA, 17 nt, Mycobacterium tuberculosis H37Rv
cgccgaacgcgagguuc

SEQ ID NO: 3249758 - RNA, 21 nt, Mycobacterium tuberculosis H37Rv
cgccgaacgugcaaccacggc

SEQ ID NO: 3249759 - RNA, 20 nt, Mycobacterium tuberculosis H37Rv
cgccgaacgugcaaccaugg

SEQ ID NO: 3249760 - RNA, 13 nt, Mycobacterium tuberculosis H37Rv
cgccgaagccgac

SEQ ID NO: 3249761 - RNA, 17 nt, Mycobacterium tuberculosis H37Rv
cgccgaagccgacgaac

SEQ ID NO: 3249762 - RNA, 21 nt, Mycobacterium tuberculosis H37Rv
cgccgaagccuugcagcgccc

SEQ ID NO: 3249763 - RNA, 22 nt, Mycobacterium tuberculosis H37Rv
cgccgaagcgaugccgugcugg

SEQ ID NO: 3249764 - RNA, 15 nt, Mycobacterium tuberculosis H37Rv
cgccgaagcgccgcu

SEQ ID NO: 3249765 - RNA, 20 nt, Mycobacterium tuberculosis H37Rv
cgccgaagcucaucgccgcu

SEQ ID NO: 3249766 - RNA, 14 nt, Mycobacterium tuberculosis H37Rv
cgccgaaggcggcc

SEQ ID NO: 3249767 - RNA, 20 nt, Mycobacterium tuberculosis H37Rv
cgccgaaggcgggggagccc

SEQ ID NO: 3249768 - RNA, 18 nt, Mycobacterium tuberculosis H37Rv
cgccgaaguagacggugg

SEQ ID NO: 3249769 - RNA, 18 nt, Mycobacterium tuberculosis H37Rv
cgccgaaguagccgaccg

SEQ ID NO: 3249770 - RNA, 23 nt, Mycobacterium tuberculosis H37Rv
cgccgaaguagccgaccggcagc

SEQ ID NO: 3249771 - RNA, 17 nt, Mycobacterium tuberculosis H37Rv
cgccgaauccgacgucg

SEQ ID NO: 3249772 - RNA, 23 nt, Mycobacterium tuberculosis H37Rv
cgccgaaucgcgggcugaccaac

SEQ ID NO: 3249773 - RNA, 22 nt, Mycobacterium tuberculosis H37Rv
cgccgaaucggcaguugaacuc

SEQ ID NO: 3249774 - RNA, 17 nt, Mycobacterium tuberculosis H37Rv
cgccgaaucugggguga

SEQ ID NO: 3249775 - RNA, 14 nt, Mycobacterium tuberculosis H37Rv
cgccgaaugccacc

SEQ ID NO: 3249776 - RNA, 16 nt, Mycobacterium tuberculosis H37Rv
cgccgacaaccccgcc

SEQ ID NO: 3249777 - RNA, 19 nt, Mycobacterium tuberculosis H37Rv
cgccgacaaccccgccagg

SEQ ID NO: 3249778 - RNA, 11 nt, Mycobacterium tuberculosis H37Rv
cgccgacacca

SEQ ID NO: 3249779 - RNA, 18 nt, Mycobacterium tuberculosis H37Rv
cgccgacaccaccggcgc

SEQ ID NO: 3249780 - RNA, 15 nt, Mycobacterium tuberculosis H37Rv
cgccgacaccacggc

SEQ ID NO: 3249781 - RNA, 18 nt, Mycobacterium tuberculosis H37Rv
cgccgacacccucgggca

SEQ ID NO: 3249782 - RNA, 17 nt, Mycobacterium tuberculosis H37Rv
cgccgacaccggcugac

SEQ ID NO: 3249783 - RNA, 18 nt, Mycobacterium tuberculosis H37Rv
cgccgacaccggcugacc

SEQ ID NO: 3249784 - RNA, 16 nt, Mycobacterium tuberculosis H37Rv
cgccgacaccgggccc

SEQ ID NO: 3249785 - RNA, 12 nt, Mycobacterium tuberculosis H37Rv
cgccgacagccc

SEQ ID NO: 3249786 - RNA, 22 nt, Mycobacterium tuberculosis H37Rv
cgccgacagccgauccgaucgc

SEQ ID NO: 3249787 - RNA, 23 nt, Mycobacterium tuberculosis H37Rv
cgccgacagccgauccgaucgca

SEQ ID NO: 3249788 - RNA, 16 nt, Mycobacterium tuberculosis H37Rv
cgccgacaggccggcc

SEQ ID NO: 3249789 - RNA, 20 nt, Mycobacterium tuberculosis H37Rv
cgccgacaggugaaggugcc

SEQ ID NO: 3249790 - RNA, 22 nt, Mycobacterium tuberculosis H37Rv
cgccgacauggcggugcgcagc

SEQ ID NO: 3249791 - RNA, 19 nt, Mycobacterium tuberculosis H37Rv
cgccgaccacauuccgcag

SEQ ID NO: 3249792 - RNA, 14 nt, Mycobacterium tuberculosis H37Rv
cgccgaccacccgg

SEQ ID NO: 3249793 - RNA, 15 nt, Mycobacterium tuberculosis H37Rv
cgccgaccacccgga

SEQ ID NO: 3249794 - RNA, 14 nt, Mycobacterium tuberculosis H37Rv
cgccgaccacucga

SEQ ID NO: 3249795 - RNA, 12 nt, Mycobacterium tuberculosis H37Rv
cgccgaccagaa

SEQ ID NO: 3249796 - RNA, 13 nt, Mycobacterium tuberculosis H37Rv
cgccgaccagcac

SEQ ID NO: 3249797 - RNA, 13 nt, Mycobacterium tuberculosis H37Rv
cgccgaccaggcc

SEQ ID NO: 3249798 - RNA, 22 nt, Mycobacterium tuberculosis H37Rv
cgccgaccaucucaccgggccc

SEQ ID NO: 3249799 - RNA, 13 nt, Mycobacterium tuberculosis H37Rv
cgccgacccgcgc

SEQ ID NO: 3249800 - RNA, 14 nt, Mycobacterium tuberculosis H37Rv
cgccgacccggggg

SEQ ID NO: 3249801 - RNA, 16 nt, Mycobacterium tuberculosis H37Rv
cgccgacccgggggcg

SEQ ID NO: 3249802 - RNA, 22 nt, Mycobacterium tuberculosis H37Rv
cgccgacccgggggcgcccggg

SEQ ID NO: 3249803 - RNA, 13 nt, Mycobacterium tuberculosis H37Rv
cgccgacccguac

SEQ ID NO: 3249804 - RNA, 18 nt, Mycobacterium tuberculosis H37Rv
cgccgacccguaccagcc

SEQ ID NO: 3249805 - RNA, 17 nt, Mycobacterium tuberculosis H37Rv
cgccgaucuugagccgg

SEQ ID NO: 3249806 - RNA, 18 nt, Mycobacterium tuberculosis H37Rv
cgccgaugaacguggcga

SEQ ID NO: 3249807 - RNA, 17 nt, Mycobacterium tuberculosis H37Rv
cgccgaugaccgcaacc

SEQ ID NO: 3249808 - RNA, 15 nt, Mycobacterium tuberculosis H37Rv
cgccgaugacggugu

SEQ ID NO: 3249809 - RNA, 17 nt, Mycobacterium tuberculosis H37Rv
cgccgaugaugcggcgc

SEQ ID NO: 3249810 - RNA, 22 nt, Mycobacterium tuberculosis H37Rv
cgccgaugauguuuuccccgcc

SEQ ID NO: 3249811 - RNA, 13 nt, Mycobacterium tuberculosis H37Rv
cgccgaugccacc

SEQ ID NO: 3249812 - RNA, 15 nt, Mycobacterium tuberculosis H37Rv
cgccgaugccaccgc

SEQ ID NO: 3249813 - RNA, 17 nt, Mycobacterium tuberculosis H37Rv
cgccgaugccaccgcuu

SEQ ID NO: 3249814 - RNA, 19 nt, Mycobacterium tuberculosis H37Rv
cgccgaugcccgacaccgc

SEQ ID NO: 3249815 - RNA, 11 nt, Mycobacterium tuberculosis H37Rv
cgccgaugccg

SEQ ID NO: 3249816 - RNA, 14 nt, Mycobacterium tuberculosis H37Rv
cgccgaugccgaac

SEQ ID NO: 3249817 - RNA, 16 nt, Mycobacterium tuberculosis H37Rv
cgccgaugccgccggc

SEQ ID NO: 3249818 - RNA, 15 nt, Mycobacterium tuberculosis H37Rv
cgccgaugucgacga

SEQ ID NO: 3249819 - RNA, 20 nt, Mycobacterium tuberculosis H37Rv
cgccgauguuggcagggcca

SEQ ID NO: 3249820 - RNA, 15 nt, Mycobacterium tuberculosis H37Rv
cgccgauuccaccgc

SEQ ID NO: 3249821 - RNA, 14 nt, Mycobacterium tuberculosis H37Rv
cgccgauucgccgu

SEQ ID NO: 3249822 - RNA, 13 nt, Mycobacterium tuberculosis H37Rv
cgccgcaaccgcc

SEQ ID NO: 3249823 - RNA, 22 nt, Mycobacterium tuberculosis H37Rv
cgccgcaagugucuccggcaac

SEQ ID NO: 3249824 - RNA, 16 nt, Mycobacterium tuberculosis H37Rv
cgccgcaaucagacgg

SEQ ID NO: 3249825 - RNA, 18 nt, Mycobacterium tuberculosis H37Rv
cgccgcaaugacgucguc

SEQ ID NO: 3249826 - RNA, 22 nt, Mycobacterium tuberculosis H37Rv
cgccgcaaugacgucgucggcc

SEQ ID NO: 3249827 - RNA, 19 nt, Mycobacterium tuberculosis H37Rv
cgccgcacacucucgguga

SEQ ID NO: 3249828 - RNA, 23 nt, Mycobacterium tuberculosis H37Rv
cgccgcacaucugcgggacgucg

SEQ ID NO: 3249829 - RNA, 19 nt, Mycobacterium tuberculosis H37Rv
cgccgcacauuggugucca

SEQ ID NO: 3249830 - RNA, 23 nt, Mycobacterium tuberculosis H37Rv
cgccgcacauugguguccaccac

SEQ ID NO: 3249831 - RNA, 20 nt, Mycobacterium tuberculosis H37Rv
cgccgcaccaagcagcgacc

SEQ ID NO: 3249832 - RNA, 14 nt, Mycobacterium tuberculosis H37Rv
cgccgcacccacau

SEQ ID NO: 3249833 - RNA, 21 nt, Mycobacterium tuberculosis H37Rv
cgccgcacccgggacguuguc

SEQ ID NO: 3249834 - RNA, 18 nt, Mycobacterium tuberculosis H37Rv
cgccgcaccgccgcaucg

SEQ ID NO: 3249835 - RNA, 13 nt, Mycobacterium tuberculosis H37Rv
cgccgcacgcacu

SEQ ID NO: 3249836 - RNA, 15 nt, Mycobacterium tuberculosis H37Rv
cgccgcacgccgacc

SEQ ID NO: 3249837 - RNA, 15 nt, Mycobacterium tuberculosis H37Rv
cgccgcacgccggca

SEQ ID NO: 3249838 - RNA, 18 nt, Mycobacterium tuberculosis H37Rv
cgccgcacggcgacgcca

SEQ ID NO: 3249839 - RNA, 16 nt, Mycobacterium tuberculosis H37Rv
cgccgcagacgccgac

SEQ ID NO: 3249840 - RNA, 17 nt, Mycobacterium tuberculosis H37Rv
cgccgcagacgccgacu

SEQ ID NO: 3249841 - RNA, 19 nt, Mycobacterium tuberculosis H37Rv
cgccgcagaucaccgccag

SEQ ID NO: 3249842 - RNA, 21 nt, Mycobacterium tuberculosis H37Rv
cgccgcagaucaccgccagcu

SEQ ID NO: 3249843 - RNA, 19 nt, Mycobacterium tuberculosis H37Rv
cgccgcagaugggccucca

SEQ ID NO: 3249844 - RNA, 23 nt, Mycobacterium tuberculosis H37Rv
cgccgcagcaggugcaucgccac

SEQ ID NO: 3249845 - RNA, 20 nt, Mycobacterium tuberculosis H37Rv
cgccgcagccugcaacgucu

SEQ ID NO: 3249846 - RNA, 16 nt, Mycobacterium tuberculosis H37Rv
cgccgcagcgcaaccu

SEQ ID NO: 3249847 - RNA, 12 nt, Mycobacterium tuberculosis H37Rv
cgccgcagcguc

SEQ ID NO: 3249848 - RNA, 13 nt, Mycobacterium tuberculosis H37Rv
cgccgcagcgucc

SEQ ID NO: 3249849 - RNA, 19 nt, Mycobacterium tuberculosis H37Rv
cgccgcagcuuguccggug

SEQ ID NO: 3249850 - RNA, 14 nt, Mycobacterium tuberculosis H37Rv
cgccgcagggccgc

SEQ ID NO: 3249851 - RNA, 18 nt, Mycobacterium tuberculosis H37Rv
cgccgcagggccgcgcgc

SEQ ID NO: 3249852 - RNA, 19 nt, Mycobacterium tuberculosis H37Rv
cgccgcagggccgcgcgca

SEQ ID NO: 3249853 - RNA, 18 nt, Mycobacterium tuberculosis H37Rv
cgccgcagguucaacgcg

SEQ ID NO: 3249854 - RNA, 22 nt, Mycobacterium tuberculosis H37Rv
cgccgcagguucaacgcgggga

SEQ ID NO: 3249855 - RNA, 13 nt, Mycobacterium tuberculosis H37Rv
cgccgcaguccgc

SEQ ID NO: 3249856 - RNA, 23 nt, Mycobacterium tuberculosis H37Rv
cgccgcaucauagacagggccgc

SEQ ID NO: 3249857 - RNA, 14 nt, Mycobacterium tuberculosis H37Rv
cgccgcaucggcga

SEQ ID NO: 3249858 - RNA, 14 nt, Mycobacterium tuberculosis H37Rv
cgccgcaucggcgg

SEQ ID NO: 3249859 - RNA, 16 nt, Mycobacterium tuberculosis H37Rv
cgccgcaucguuuucg

SEQ ID NO: 3249860 - RNA, 23 nt, Mycobacterium tuberculosis H37Rv
cgccgcauugcagaaccgccaac

SEQ ID NO: 3249861 - RNA, 17 nt, Mycobacterium tuberculosis H37Rv
cgccgccaacuccucag

SEQ ID NO: 3249862 - RNA, 20 nt, Mycobacterium tuberculosis H37Rv
cgccgccaagcucggccacc

SEQ ID NO: 3249863 - RNA, 16 nt, Mycobacterium tuberculosis H37Rv
cgccgccacagcaccc

SEQ ID NO: 3249864 - RNA, 20 nt, Mycobacterium tuberculosis H37Rv
cgccgccacagcacccacgc

SEQ ID NO: 3249865 - RNA, 22 nt, Mycobacterium tuberculosis H37Rv
cgccgccaccaccgcugccggc

SEQ ID NO: 3249866 - RNA, 14 nt, Mycobacterium tuberculosis H37Rv
cgccgccaccagcg

SEQ ID NO: 3249867 - RNA, 20 nt, Mycobacterium tuberculosis H37Rv
cgccgccaccagcugcgcga

SEQ ID NO: 3249868 - RNA, 23 nt, Mycobacterium tuberculosis H37Rv
cgccgccaccagcugcgcgaugu

SEQ ID NO: 3249869 - RNA, 13 nt, Mycobacterium tuberculosis H37Rv
cgccgccaccagg

SEQ ID NO: 3249870 - RNA, 13 nt, Mycobacterium tuberculosis H37Rv
cgccgccacccgg

SEQ ID NO: 3249871 - RNA, 16 nt, Mycobacterium tuberculosis H37Rv
cgccgccacccggcgg

SEQ ID NO: 3249872 - RNA, 14 nt, Mycobacterium tuberculosis H37Rv
cgccgccaccggcg

SEQ ID NO: 3249873 - RNA, 17 nt, Mycobacterium tuberculosis H37Rv
cgccgccaccggcgacg

SEQ ID NO: 3249874 - RNA, 15 nt, Mycobacterium tuberculosis H37Rv
cgccgccaccggcgc

SEQ ID NO: 3249875 - RNA, 17 nt, Mycobacterium tuberculosis H37Rv
cgccgccaccggcgccg

SEQ ID NO: 3249876 - RNA, 12 nt, Mycobacterium tuberculosis H37Rv
cgccgccacgga

SEQ ID NO: 3249877 - RNA, 22 nt, Mycobacterium tuberculosis H37Rv
cgccgccacggaucgcggcggc

SEQ ID NO: 3249878 - RNA, 15 nt, Mycobacterium tuberculosis H37Rv
cgccgccacugccgg

SEQ ID NO: 3249879 - RNA, 20 nt, Mycobacterium tuberculosis H37Rv
cgccgccagaugaggacggu

SEQ ID NO: 3249880 - RNA, 14 nt, Mycobacterium tuberculosis H37Rv
cgccgccagcacca

SEQ ID NO: 3249881 - RNA, 17 nt, Mycobacterium tuberculosis H37Rv
cgccgccagcaccaccg

SEQ ID NO: 3249882 - RNA, 14 nt, Mycobacterium tuberculosis H37Rv
cgccgccagcagau

SEQ ID NO: 3249883 - RNA, 14 nt, Mycobacterium tuberculosis H37Rv
cgccgccagcgccg

SEQ ID NO: 3249884 - RNA, 18 nt, Mycobacterium tuberculosis H37Rv
cgccgccagcgccgccgg

SEQ ID NO: 3249885 - RNA, 19 nt, Mycobacterium tuberculosis H37Rv
cgccgccagcgccgccggc

SEQ ID NO: 3249886 - RNA, 17 nt, Mycobacterium tuberculosis H37Rv
cgccgccagguccgccg

SEQ ID NO: 3249887 - RNA, 23 nt, Mycobacterium tuberculosis H37Rv
cgccgccagguccgccggugccg

SEQ ID NO: 3249888 - RNA, 19 nt, Mycobacterium tuberculosis H37Rv
cgccgccauaccucggcga

SEQ ID NO: 3249889 - RNA, 13 nt, Mycobacterium tuberculosis H37Rv
cgccgccaucacg

SEQ ID NO: 3249890 - RNA, 13 nt, Mycobacterium tuberculosis H37Rv
cgccgccaucagc

SEQ ID NO: 3249891 - RNA, 15 nt, Mycobacterium tuberculosis H37Rv
cgccgccaucagccc

SEQ ID NO: 3249892 - RNA, 21 nt, Mycobacterium tuberculosis H37Rv
cgccgccauuaggcgcggugc

SEQ ID NO: 3249893 - RNA, 15 nt, Mycobacterium tuberculosis H37Rv
cgccgccauugccgc

SEQ ID NO: 3249894 - RNA, 15 nt, Mycobacterium tuberculosis H37Rv
cgccgccauuggaca

SEQ ID NO: 3249895 - RNA, 24 nt, Mycobacterium tuberculosis H37Rv
cgccgccccauacuugcgccgacu

SEQ ID NO: 3249896 - RNA, 16 nt, Mycobacterium tuberculosis H37Rv
cgccgcccccgccggc

SEQ ID NO: 3249897 - RNA, 13 nt, Mycobacterium tuberculosis H37Rv
cgccgccccgaua

SEQ ID NO: 3249898 - RNA, 15 nt, Mycobacterium tuberculosis H37Rv
cgccgccccggcgcu

SEQ ID NO: 3249899 - RNA, 15 nt, Mycobacterium tuberculosis H37Rv
cgccgcccgcagggc

SEQ ID NO: 3249900 - RNA, 21 nt, Mycobacterium tuberculosis H37Rv
cgccgcccgcagggccgccgc

SEQ ID NO: 3249901 - RNA, 20 nt, Mycobacterium tuberculosis H37Rv
cgccgcgauggcgguccacc

SEQ ID NO: 3249902 - RNA, 13 nt, Mycobacterium tuberculosis H37Rv
cgccgcgcaccgc

SEQ ID NO: 3249903 - RNA, 16 nt, Mycobacterium tuberculosis H37Rv
cgccgcgcaccgcggg

SEQ ID NO: 3249904 - RNA, 15 nt, Mycobacterium tuberculosis H37Rv
cgccgcgcagccgcu

SEQ ID NO: 3249905 - RNA, 17 nt, Mycobacterium tuberculosis H37Rv
cgccgcgcagccggccc

SEQ ID NO: 3249906 - RNA, 19 nt, Mycobacterium tuberculosis H37Rv
cgccgcgcagccggcccgu

SEQ ID NO: 3249907 - RNA, 15 nt, Mycobacterium tuberculosis H37Rv
cgccgcgcagcgagg

SEQ ID NO: 3249908 - RNA, 18 nt, Mycobacterium tuberculosis H37Rv
cgccgcgcauccgcagcc

SEQ ID NO: 3249909 - RNA, 13 nt, Mycobacterium tuberculosis H37Rv
cgccgcgcccggc

SEQ ID NO: 3249910 - RNA, 16 nt, Mycobacterium tuberculosis H37Rv
cgccgcgcccggcgcu

SEQ ID NO: 3249911 - RNA, 12 nt, Mycobacterium tuberculosis H37Rv
cgccgcgccgau

SEQ ID NO: 3249912 - RNA, 18 nt, Mycobacterium tuberculosis H37Rv
cgccgcgccgcgccgccu

SEQ ID NO: 3249913 - RNA, 13 nt, Mycobacterium tuberculosis H37Rv
cgccgcgccggca

SEQ ID NO: 3249914 - RNA, 15 nt, Mycobacterium tuberculosis H37Rv
cgccgcgccggcggc

SEQ ID NO: 3249915 - RNA, 16 nt, Mycobacterium tuberculosis H37Rv
cgccgcgccggcggcc

SEQ ID NO: 3249916 - RNA, 22 nt, Mycobacterium tuberculosis H37Rv
cgccgcgcgcauuuuucgccag

SEQ ID NO: 3249917 - RNA, 17 nt, Mycobacterium tuberculosis H37Rv
cgccgcgcgcgccgcau

SEQ ID NO: 3249918 - RNA, 20 nt, Mycobacterium tuberculosis H37Rv
cgccgcgcggaacaccgagg

SEQ ID NO: 3249919 - RNA, 12 nt, Mycobacterium tuberculosis H37Rv
cgccgcgcgggu

SEQ ID NO: 3249920 - RNA, 13 nt, Mycobacterium tuberculosis H37Rv
cgccgcgcgugac

SEQ ID NO: 3249921 - RNA, 14 nt, Mycobacterium tuberculosis H37Rv
cgccgcgcguucgg

SEQ ID NO: 3249922 - RNA, 16 nt, Mycobacterium tuberculosis H37Rv
cgccgcgcguucggcg

SEQ ID NO: 3249923 - RNA, 18 nt, Mycobacterium tuberculosis H37Rv
cgccgcgcguucggcgcu

SEQ ID NO: 3249924 - RNA, 20 nt, Mycobacterium tuberculosis H37Rv
cgccgcgcguucggcgcuga

SEQ ID NO: 3249925 - RNA, 14 nt, Mycobacterium tuberculosis H37Rv
cgccgcgcucgacg

SEQ ID NO: 3249926 - RNA, 15 nt, Mycobacterium tuberculosis H37Rv
cgccgcgcucgacga

SEQ ID NO: 3249927 - RNA, 20 nt, Mycobacterium tuberculosis H37Rv
cgccgcgcuugcgaucggca

SEQ ID NO: 3249928 - RNA, 22 nt, Mycobacterium tuberculosis H37Rv
cgccgcggacucgggcaggccc

SEQ ID NO: 3249929 - RNA, 22 nt, Mycobacterium tuberculosis H37Rv
cgccgcggaguaggccgcgccc

SEQ ID NO: 3249930 - RNA, 16 nt, Mycobacterium tuberculosis H37Rv
cgccgcggcagcguug

SEQ ID NO: 3249931 - RNA, 20 nt, Mycobacterium tuberculosis H37Rv
cgccgcggcagcguugacgg

SEQ ID NO: 3249932 - RNA, 23 nt, Mycobacterium tuberculosis H37Rv
cgccgcggcagcguugacgguca

SEQ ID NO: 3249933 - RNA, 13 nt, Mycobacterium tuberculosis H37Rv
cgccgcggcaggg

SEQ ID NO: 3249934 - RNA, 14 nt, Mycobacterium tuberculosis H37Rv
cgccgcggccaggu

SEQ ID NO: 3249935 - RNA, 14 nt, Mycobacterium tuberculosis H37Rv
cgccgcggcccgcu

SEQ ID NO: 3249936 - RNA, 19 nt, Mycobacterium tuberculosis H37Rv
cgccgcggcgcccggcgga

SEQ ID NO: 3249937 - RNA, 16 nt, Mycobacterium tuberculosis H37Rv
cgccgcggcggcagcg

SEQ ID NO: 3249938 - RNA, 21 nt, Mycobacterium tuberculosis H37Rv
cgccgcggcuugucgccccau

SEQ ID NO: 3249939 - RNA, 18 nt, Mycobacterium tuberculosis H37Rv
cgccgcgggacaccaccg

SEQ ID NO: 3249940 - RNA, 16 nt, Mycobacterium tuberculosis H37Rv
cgccgcgggugaucug

SEQ ID NO: 3249941 - RNA, 18 nt, Mycobacterium tuberculosis H37Rv
cgccgcgguagacgccgc

SEQ ID NO: 3249942 - RNA, 17 nt, Mycobacterium tuberculosis H37Rv
cgccgcggucagaucca

SEQ ID NO: 3249943 - RNA, 15 nt, Mycobacterium tuberculosis H37Rv
cgccgcggucggacc

SEQ ID NO: 3249944 - RNA, 18 nt, Mycobacterium tuberculosis H37Rv
cgccgcgguuaucgccga

SEQ ID NO: 3249945 - RNA, 20 nt, Mycobacterium tuberculosis H37Rv
cgccgcgucauucaccgcgu

SEQ ID NO: 3249946 - RNA, 19 nt, Mycobacterium tuberculosis H37Rv
cgccgcguccucgcccugg

SEQ ID NO: 3249947 - RNA, 23 nt, Mycobacterium tuberculosis H37Rv
cgccgcguccucgcccuggccgc

SEQ ID NO: 3249948 - RNA, 14 nt, Mycobacterium tuberculosis H37Rv
cgccgcgucgagca

SEQ ID NO: 3249949 - RNA, 16 nt, Mycobacterium tuberculosis H37Rv
cgccgcgucuaccaac

SEQ ID NO: 3249950 - RNA, 16 nt, Mycobacterium tuberculosis H37Rv
cgccgcguggcuggcg

SEQ ID NO: 3249951 - RNA, 16 nt, Mycobacterium tuberculosis H37Rv
cgccgcguucagggca

SEQ ID NO: 3249952 - RNA, 22 nt, Mycobacterium tuberculosis H37Rv
cgccgcguugucggcgcucccc

SEQ ID NO: 3249953 - RNA, 20 nt, Mycobacterium tuberculosis H37Rv
cgccgcuaacgcaccugcgc

SEQ ID NO: 3249954 - RNA, 13 nt, Mycobacterium tuberculosis H37Rv
cgccgcuacccca

SEQ ID NO: 3249955 - RNA, 14 nt, Mycobacterium tuberculosis H37Rv
cgccgcuaccgaac

SEQ ID NO: 3249956 - RNA, 17 nt, Mycobacterium tuberculosis H37Rv
cgccgcuaccgcccgcg

SEQ ID NO: 3249957 - RNA, 18 nt, Mycobacterium tuberculosis H37Rv
cgccgcuaccgcccgcgc

SEQ ID NO: 3249958 - RNA, 14 nt, Mycobacterium tuberculosis H37Rv
cgccgcuacgccgg

SEQ ID NO: 3249959 - RNA, 19 nt, Mycobacterium tuberculosis H37Rv
cgccgcuaggugacgccgc

SEQ ID NO: 3249960 - RNA, 23 nt, Mycobacterium tuberculosis H37Rv
cgccgcuaggugacgccgccagc

SEQ ID NO: 3249961 - RNA, 23 nt, Mycobacterium tuberculosis H37Rv
cgccgcuaucgaggaggcggucg

SEQ ID NO: 3249962 - RNA, 15 nt, Mycobacterium tuberculosis H37Rv
cgccgcucacggggc

SEQ ID NO: 3249963 - RNA, 17 nt, Mycobacterium tuberculosis H37Rv
cgccgcucauccagcgc

SEQ ID NO: 3249964 - RNA, 19 nt, Mycobacterium tuberculosis H37Rv
cgccgcucauccagcgcgu

SEQ ID NO: 3249965 - RNA, 22 nt, Mycobacterium tuberculosis H37Rv
cgccgcugacuccugcggcacc

SEQ ID NO: 3249966 - RNA, 13 nt, Mycobacterium tuberculosis H37Rv
cgccgcugccauc

SEQ ID NO: 3249967 - RNA, 16 nt, Mycobacterium tuberculosis H37Rv
cgccgcugccaucugg

SEQ ID NO: 3249968 - RNA, 22 nt, Mycobacterium tuberculosis H37Rv
cgccgcugccaucuggguccgu

SEQ ID NO: 3249969 - RNA, 13 nt, Mycobacterium tuberculosis H37Rv
cgccgcugccgcc

SEQ ID NO: 3249970 - RNA, 14 nt, Mycobacterium tuberculosis H37Rv
cgccgcugccgccg

SEQ ID NO: 3249971 - RNA, 18 nt, Mycobacterium tuberculosis H37Rv
cgccgcugccgccgagcu

SEQ ID NO: 3249972 - RNA, 17 nt, Mycobacterium tuberculosis H37Rv
cgccgcugccgcgcggc

SEQ ID NO: 3249973 - RNA, 21 nt, Mycobacterium tuberculosis H37Rv
cgccgcugccgguagcacagc

SEQ ID NO: 3249974 - RNA, 21 nt, Mycobacterium tuberculosis H37Rv
cgccgcuggagaucacgccga

SEQ ID NO: 3249975 - RNA, 13 nt, Mycobacterium tuberculosis H37Rv
cgccgcuggcaau

SEQ ID NO: 3249976 - RNA, 20 nt, Mycobacterium tuberculosis H37Rv
cgccgcuuucgccggcgcca

SEQ ID NO: 3249977 - RNA, 20 nt, Mycobacterium tuberculosis H37Rv
cgccggaacgagcggccgcg

SEQ ID NO: 3249978 - RNA, 17 nt, Mycobacterium tuberculosis H37Rv
cgccggaacugcgcaac

SEQ ID NO: 3249979 - RNA, 19 nt, Mycobacterium tuberculosis H37Rv
cgccggaccagcuccugca

SEQ ID NO: 3249980 - RNA, 17 nt, Mycobacterium tuberculosis H37Rv
cgccggaccccgagacc

SEQ ID NO: 3249981 - RNA, 17 nt, Mycobacterium tuberculosis H37Rv
cgccggacccgccgggu

SEQ ID NO: 3249982 - RNA, 20 nt, Mycobacterium tuberculosis H37Rv
cgccggacccgccggguccg

SEQ ID NO: 3249983 - RNA, 16 nt, Mycobacterium tuberculosis H37Rv
cgccggacccgucgag

SEQ ID NO: 3249984 - RNA, 19 nt, Mycobacterium tuberculosis H37Rv
cgccggacccgucgagcag

SEQ ID NO: 3249985 - RNA, 20 nt, Mycobacterium tuberculosis H37Rv
cgccggacccgucgagcagc

SEQ ID NO: 3249986 - RNA, 18 nt, Mycobacterium tuberculosis H37Rv
cgccggacugcggcccga

SEQ ID NO: 3249987 - RNA, 14 nt, Mycobacterium tuberculosis H37Rv
cgccggagaugaca

SEQ ID NO: 3249988 - RNA, 14 nt, Mycobacterium tuberculosis H37Rv
cgccggagaugauc

SEQ ID NO: 3249989 - RNA, 14 nt, Mycobacterium tuberculosis H37Rv
cgccggagccgccc

SEQ ID NO: 3249990 - RNA, 15 nt, Mycobacterium tuberculosis H37Rv
cgccggaggucgggc

SEQ ID NO: 3249991 - RNA, 18 nt, Mycobacterium tuberculosis H37Rv
cgccggaggucgggcggc

SEQ ID NO: 3249992 - RNA, 19 nt, Mycobacterium tuberculosis H37Rv
cgccggaguugaagaagcc

SEQ ID NO: 3249993 - RNA, 21 nt, Mycobacterium tuberculosis H37Rv
cgccggaguugaagaagcccg

SEQ ID NO: 3249994 - RNA, 17 nt, Mycobacterium tuberculosis H37Rv
cgccggaguuuccccua

SEQ ID NO: 3249995 - RNA, 15 nt, Mycobacterium tuberculosis H37Rv
cgccggauagcgcag

SEQ ID NO: 3249996 - RNA, 16 nt, Mycobacterium tuberculosis H37Rv
cgccggauagcgcagc

SEQ ID NO: 3249997 - RNA, 17 nt, Mycobacterium tuberculosis H37Rv
cgccggauagcgcagcu

SEQ ID NO: 3249998 - RNA, 15 nt, Mycobacterium tuberculosis H37Rv
cgccggauauggcag

SEQ ID NO: 3249999 - RNA, 22 nt, Mycobacterium tuberculosis H37Rv
cgccggauccgauccgcacagc

SEQ ID NO: 3250000 - RNA, 14 nt, Mycobacterium tuberculosis H37Rv
cgccggaucgccac

SEQ ID NO: 3250001 - RNA, 17 nt, Mycobacterium tuberculosis H37Rv
cgccggaucgccacggu

SEQ ID NO: 3250002 - RNA, 23 nt, Mycobacterium tuberculosis H37Rv
cgccggaugacaccgaccggguc

SEQ ID NO: 3250003 - RNA, 18 nt, Mycobacterium tuberculosis H37Rv
cgccggaugagccggaug

SEQ ID NO: 3250004 - RNA, 15 nt, Mycobacterium tuberculosis H37Rv
cgccggaugcuguca

SEQ ID NO: 3250005 - RNA, 20 nt, Mycobacterium tuberculosis H37Rv
cgccggauggguggccagca

SEQ ID NO: 3250006 - RNA, 17 nt, Mycobacterium tuberculosis H37Rv
cgccggauucgaugaca

SEQ ID NO: 3250007 - RNA, 17 nt, Mycobacterium tuberculosis H37Rv
cgccggcaacccagugu

SEQ ID NO: 3250008 - RNA, 21 nt, Mycobacterium tuberculosis H37Rv
cgccggcaauaccgccagcgc

SEQ ID NO: 3250009 - RNA, 23 nt, Mycobacterium tuberculosis H37Rv
cgccggcaauaccgccagcgcca

SEQ ID NO: 3250010 - RNA, 19 nt, Mycobacterium tuberculosis H37Rv
cgccggcacacccaucagc

SEQ ID NO: 3250011 - RNA, 20 nt, Mycobacterium tuberculosis H37Rv
cgccggcacauugaucgacg

SEQ ID NO: 3250012 - RNA, 22 nt, Mycobacterium tuberculosis H37Rv
cgccggcacauugaucgacggc

SEQ ID NO: 3250013 - RNA, 15 nt, Mycobacterium tuberculosis H37Rv
cgccggcaccgccag

SEQ ID NO: 3250014 - RNA, 16 nt, Mycobacterium tuberculosis H37Rv
cgccggcaccgccagu

SEQ ID NO: 3250015 - RNA, 14 nt, Mycobacterium tuberculosis H37Rv
cgccggcaccgccg

SEQ ID NO: 3250016 - RNA, 16 nt, Mycobacterium tuberculosis H37Rv
cgccggcaccgccggc

SEQ ID NO: 3250017 - RNA, 23 nt, Mycobacterium tuberculosis H37Rv
cgccggcaccggggcugcccgcg

SEQ ID NO: 3250018 - RNA, 16 nt, Mycobacterium tuberculosis H37Rv
cgccggcaccuccggc

SEQ ID NO: 3250019 - RNA, 20 nt, Mycobacterium tuberculosis H37Rv
cgccggcaccuccggcaccg

SEQ ID NO: 3250020 - RNA, 20 nt, Mycobacterium tuberculosis H37Rv
cgccggcacgaaucccccgg

SEQ ID NO: 3250021 - RNA, 16 nt, Mycobacterium tuberculosis H37Rv
cgccggcacgcagcca

SEQ ID NO: 3250022 - RNA, 17 nt, Mycobacterium tuberculosis H37Rv
cgccggcacgggcgucg

SEQ ID NO: 3250023 - RNA, 14 nt, Mycobacterium tuberculosis H37Rv
cgccggcagcgucg

SEQ ID NO: 3250024 - RNA, 15 nt, Mycobacterium tuberculosis H37Rv
cgccggcaucgacgu

SEQ ID NO: 3250025 - RNA, 16 nt, Mycobacterium tuberculosis H37Rv
cgccggcaucgcgcaa

SEQ ID NO: 3250026 - RNA, 15 nt, Mycobacterium tuberculosis H37Rv
cgccggcaucgcgcg

SEQ ID NO: 3250027 - RNA, 16 nt, Mycobacterium tuberculosis H37Rv
cgccggcaucgcgcgc

SEQ ID NO: 3250028 - RNA, 22 nt, Mycobacterium tuberculosis H37Rv
cgccggcaucgucgacgcccga

SEQ ID NO: 3250029 - RNA, 16 nt, Mycobacterium tuberculosis H37Rv
cgccggcaucuccacc

SEQ ID NO: 3250030 - RNA, 22 nt, Mycobacterium tuberculosis H37Rv
cgccggcaucuccaccgucgcc

SEQ ID NO: 3250031 - RNA, 23 nt, Mycobacterium tuberculosis H37Rv
cgccggccaagaccgcggcccgc

SEQ ID NO: 3250032 - RNA, 13 nt, Mycobacterium tuberculosis H37Rv
cgccggccacccg

SEQ ID NO: 3250033 - RNA, 14 nt, Mycobacterium tuberculosis H37Rv
cgccggccacccgc

SEQ ID NO: 3250034 - RNA, 18 nt, Mycobacterium tuberculosis H37Rv
cgccggccacccgcgcga

SEQ ID NO: 3250035 - RNA, 17 nt, Mycobacterium tuberculosis H37Rv
cgccggccacgagucgc

SEQ ID NO: 3250036 - RNA, 16 nt, Mycobacterium tuberculosis H37Rv
cgccggccagcggcca

SEQ ID NO: 3250037 - RNA, 16 nt, Mycobacterium tuberculosis H37Rv
cgccggccagcgucgc

SEQ ID NO: 3250038 - RNA, 20 nt, Mycobacterium tuberculosis H37Rv
cgccggccaguccgcgcgca

SEQ ID NO: 3250039 - RNA, 13 nt, Mycobacterium tuberculosis H37Rv
cgccggccaguuc

SEQ ID NO: 3250040 - RNA, 20 nt, Mycobacterium tuberculosis H37Rv
cgccggccauaccgcucgcc

SEQ ID NO: 3250041 - RNA, 21 nt, Mycobacterium tuberculosis H37Rv
cgccggccauaccgcucgccg

SEQ ID NO: 3250042 - RNA, 20 nt, Mycobacterium tuberculosis H37Rv
cgccggcccaguucugcagg

SEQ ID NO: 3250043 - RNA, 20 nt, Mycobacterium tuberculosis H37Rv
cgccggcccaucuucggacg

SEQ ID NO: 3250044 - RNA, 13 nt, Mycobacterium tuberculosis H37Rv
cgccggccccgcc

SEQ ID NO: 3250045 - RNA, 14 nt, Mycobacterium tuberculosis H37Rv
cgccggccccgccg

SEQ ID NO: 3250046 - RNA, 15 nt, Mycobacterium tuberculosis H37Rv
cgccggccccgccga

SEQ ID NO: 3250047 - RNA, 16 nt, Mycobacterium tuberculosis H37Rv
cgccggccccgccgau

SEQ ID NO: 3250048 - RNA, 20 nt, Mycobacterium tuberculosis H37Rv
cgccggccccgccgaugccg

SEQ ID NO: 3250049 - RNA, 16 nt, Mycobacterium tuberculosis H37Rv
cgccggccccgccgcu

SEQ ID NO: 3250050 - RNA, 18 nt, Mycobacterium tuberculosis H37Rv
cgccggccccgccggccc

SEQ ID NO: 3250051 - RNA, 18 nt, Mycobacterium tuberculosis H37Rv
cgccggcccgaggcgggu

SEQ ID NO: 3250052 - RNA, 14 nt, Mycobacterium tuberculosis H37Rv
cgccggcccgcagc

SEQ ID NO: 3250053 - RNA, 14 nt, Mycobacterium tuberculosis H37Rv
cgccggcccgcggg

SEQ ID NO: 3250054 - RNA, 13 nt, Mycobacterium tuberculosis H37Rv
cgccggccgccag

SEQ ID NO: 3250055 - RNA, 15 nt, Mycobacterium tuberculosis H37Rv
cgccggccgcgcuga

SEQ ID NO: 3250056 - RNA, 19 nt, Mycobacterium tuberculosis H37Rv
cgccggccgcgggcgcgca

SEQ ID NO: 3250057 - RNA, 20 nt, Mycobacterium tuberculosis H37Rv
cgccggccgcgggcgcgcag

SEQ ID NO: 3250058 - RNA, 21 nt, Mycobacterium tuberculosis H37Rv
cgccggccgcugccuuggcgc

SEQ ID NO: 3250059 - RNA, 15 nt, Mycobacterium tuberculosis H37Rv
cgccggccggcccgg

SEQ ID NO: 3250060 - RNA, 16 nt, Mycobacterium tuberculosis H37Rv
cgccggccguccugac

SEQ ID NO: 3250061 - RNA, 17 nt, Mycobacterium tuberculosis H37Rv
cgccggccucgccgaag

SEQ ID NO: 3250062 - RNA, 15 nt, Mycobacterium tuberculosis H37Rv
cgccggccugcucgg

SEQ ID NO: 3250063 - RNA, 14 nt, Mycobacterium tuberculosis H37Rv
cgccggccuggccg

SEQ ID NO: 3250064 - RNA, 22 nt, Mycobacterium tuberculosis H37Rv
cgccggccuugagcacccgaua

SEQ ID NO: 3250065 - RNA, 22 nt, Mycobacterium tuberculosis H37Rv
cgccggcgaauccgcacagguc

SEQ ID NO: 3250066 - RNA, 15 nt, Mycobacterium tuberculosis H37Rv
cgccggcgacaccgc

SEQ ID NO: 3250067 - RNA, 14 nt, Mycobacterium tuberculosis H37Rv
cgccggcgacggcg

SEQ ID NO: 3250068 - RNA, 14 nt, Mycobacterium tuberculosis H37Rv
cgccggcgacgggu

SEQ ID NO: 3250069 - RNA, 17 nt, Mycobacterium tuberculosis H37Rv
cgccggcgacgggucgg

SEQ ID NO: 3250070 - RNA, 16 nt, Mycobacterium tuberculosis H37Rv
cgccggcgacugcagc

SEQ ID NO: 3250071 - RNA, 13 nt, Mycobacterium tuberculosis H37Rv
cgccggcgaugcc

SEQ ID NO: 3250072 - RNA, 19 nt, Mycobacterium tuberculosis H37Rv
cgccggcgaugccgguggg

SEQ ID NO: 3250073 - RNA, 13 nt, Mycobacterium tuberculosis H37Rv
cgccggcgccacc

SEQ ID NO: 3250074 - RNA, 14 nt, Mycobacterium tuberculosis H37Rv
cgccggcgccaccc

SEQ ID NO: 3250075 - RNA, 18 nt, Mycobacterium tuberculosis H37Rv
cgccggcgccacccgcgc

SEQ ID NO: 3250076 - RNA, 16 nt, Mycobacterium tuberculosis H37Rv
cgccggcgccagcaga

SEQ ID NO: 3250077 - RNA, 17 nt, Mycobacterium tuberculosis H37Rv
cgccggcgccagcagau

SEQ ID NO: 3250078 - RNA, 19 nt, Mycobacterium tuberculosis H37Rv
cgccggcgccagcgccgcc

SEQ ID NO: 3250079 - RNA, 22 nt, Mycobacterium tuberculosis H37Rv
cgccggcgccagcgccgccacc

SEQ ID NO: 3250080 - RNA, 14 nt, Mycobacterium tuberculosis H37Rv
cgccggcgcccagg

SEQ ID NO: 3250081 - RNA, 15 nt, Mycobacterium tuberculosis H37Rv
cgccggcgcccaggc

SEQ ID NO: 3250082 - RNA, 15 nt, Mycobacterium tuberculosis H37Rv
cgccggcgcccccgu

SEQ ID NO: 3250083 - RNA, 14 nt, Mycobacterium tuberculosis H37Rv
cgccggcgccgccc

SEQ ID NO: 3250084 - RNA, 17 nt, Mycobacterium tuberculosis H37Rv
cgccggcgccgcccgcg

SEQ ID NO: 3250085 - RNA, 18 nt, Mycobacterium tuberculosis H37Rv
cgccggcgccgcccgcgc

SEQ ID NO: 3250086 - RNA, 15 nt, Mycobacterium tuberculosis H37Rv
cgccggcgccgccgu

SEQ ID NO: 3250087 - RNA, 19 nt, Mycobacterium tuberculosis H37Rv
cgccggcgccggagccgcc

SEQ ID NO: 3250088 - RNA, 18 nt, Mycobacterium tuberculosis H37Rv
cgccggcgccggugccgc

SEQ ID NO: 3250089 - RNA, 14 nt, Mycobacterium tuberculosis H37Rv
cgccggcgcgcacc

SEQ ID NO: 3250090 - RNA, 17 nt, Mycobacterium tuberculosis H37Rv
cgccggcgcugaucgcg

SEQ ID NO: 3250091 - RNA, 15 nt, Mycobacterium tuberculosis H37Rv
cgccggcggacgccc

SEQ ID NO: 3250092 - RNA, 18 nt, Mycobacterium tuberculosis H37Rv
cgccggcggacgcccggc

SEQ ID NO: 3250093 - RNA, 20 nt, Mycobacterium tuberculosis H37Rv
cgccggcggcaaagagcagc

SEQ ID NO: 3250094 - RNA, 23 nt, Mycobacterium tuberculosis H37Rv
cgccgguggucagguuggcacgc

SEQ ID NO: 3250095 - RNA, 15 nt, Mycobacterium tuberculosis H37Rv
cgccggugucggcug

SEQ ID NO: 3250096 - RNA, 13 nt, Mycobacterium tuberculosis H37Rv
cgccggugucggg

SEQ ID NO: 3250097 - RNA, 14 nt, Mycobacterium tuberculosis H37Rv
cgccggugucgggc

SEQ ID NO: 3250098 - RNA, 18 nt, Mycobacterium tuberculosis H37Rv
cgccggugucguucggcg

SEQ ID NO: 3250099 - RNA, 19 nt, Mycobacterium tuberculosis H37Rv
cgccggugucguucggcga

SEQ ID NO: 3250100 - RNA, 17 nt, Mycobacterium tuberculosis H37Rv
cgccgguuacccggacc

SEQ ID NO: 3250101 - RNA, 14 nt, Mycobacterium tuberculosis H37Rv
cgccgguucagacg

SEQ ID NO: 3250102 - RNA, 22 nt, Mycobacterium tuberculosis H37Rv
cgccgguucccgaucaggcggg

SEQ ID NO: 3250103 - RNA, 19 nt, Mycobacterium tuberculosis H37Rv
cgccguaacagccggccgg

SEQ ID NO: 3250104 - RNA, 20 nt, Mycobacterium tuberculosis H37Rv
cgccguaacagccggccgga

SEQ ID NO: 3250105 - RNA, 16 nt, Mycobacterium tuberculosis H37Rv
cgccguaagcaccagc

SEQ ID NO: 3250106 - RNA, 21 nt, Mycobacterium tuberculosis H37Rv
cgccguaagcaccagccagcc

SEQ ID NO: 3250107 - RNA, 14 nt, Mycobacterium tuberculosis H37Rv
cgccguagaccagc

SEQ ID NO: 3250108 - RNA, 15 nt, Mycobacterium tuberculosis H37Rv
cgccguagagccgcu

SEQ ID NO: 3250109 - RNA, 17 nt, Mycobacterium tuberculosis H37Rv
cgccguagagccgcucg

SEQ ID NO: 3250110 - RNA, 19 nt, Mycobacterium tuberculosis H37Rv
cgccguagcgcagcgccuc

SEQ ID NO: 3250111 - RNA, 13 nt, Mycobacterium tuberculosis H37Rv
cgccguaucggcg

SEQ ID NO: 3250112 - RNA, 13 nt, Mycobacterium tuberculosis H37Rv
cgccguaucgggg

SEQ ID NO: 3250113 - RNA, 15 nt, Mycobacterium tuberculosis H37Rv
cgccgucacccccga

SEQ ID NO: 3250114 - RNA, 17 nt, Mycobacterium tuberculosis H37Rv
cgccgucacccccgaua

SEQ ID NO: 3250115 - RNA, 23 nt, Mycobacterium tuberculosis H37Rv
cgccgucaccgaucgaacagugc

SEQ ID NO: 3250116 - RNA, 22 nt, Mycobacterium tuberculosis H37Rv
cgccgucaccgccauugccacc

SEQ ID NO: 3250117 - RNA, 14 nt, Mycobacterium tuberculosis H37Rv
cgccgucaccgccg

SEQ ID NO: 3250118 - RNA, 15 nt, Mycobacterium tuberculosis H37Rv
cgccgucaccgccga

SEQ ID NO: 3250119 - RNA, 13 nt, Mycobacterium tuberculosis H37Rv
cgccgucaccgcg

SEQ ID NO: 3250120 - RNA, 18 nt, Mycobacterium tuberculosis H37Rv
cgccgucaccgcgcggcu

SEQ ID NO: 3250121 - RNA, 18 nt, Mycobacterium tuberculosis H37Rv
cgccgucaccgcugagcc

SEQ ID NO: 3250122 - RNA, 15 nt, Mycobacterium tuberculosis H37Rv
cgccgucacgcacgc

SEQ ID NO: 3250123 - RNA, 16 nt, Mycobacterium tuberculosis H37Rv
cgccgucacgcacgcc

SEQ ID NO: 3250124 - RNA, 15 nt, Mycobacterium tuberculosis H37Rv
cgccgucacggcagu

SEQ ID NO: 3250125 - RNA, 16 nt, Mycobacterium tuberculosis H37Rv
cgccgucacggcagua

SEQ ID NO: 3250126 - RNA, 16 nt, Mycobacterium tuberculosis H37Rv
cgccgucagaacaccg

SEQ ID NO: 3250127 - RNA, 20 nt, Mycobacterium tuberculosis H37Rv
cgccgucagaacaccggcca

SEQ ID NO: 3250128 - RNA, 16 nt, Mycobacterium tuberculosis H37Rv
cgccgucagcaccgcu

SEQ ID NO: 3250129 - RNA, 11 nt, Mycobacterium tuberculosis H37Rv
cgccgucagcc

SEQ ID NO: 3250130 - RNA, 16 nt, Mycobacterium tuberculosis H37Rv
cgccgucaucgcagca

SEQ ID NO: 3250131 - RNA, 19 nt, Mycobacterium tuberculosis H37Rv
cgccgucaucgugcccgcg

SEQ ID NO: 3250132 - RNA, 14 nt, Mycobacterium tuberculosis H37Rv
cgccgucaugccca

SEQ ID NO: 3250133 - RNA, 23 nt, Mycobacterium tuberculosis H37Rv
cgccguccagcaauaccugagcg

SEQ ID NO: 3250134 - RNA, 17 nt, Mycobacterium tuberculosis H37Rv
cgccguccagcgccgcg

SEQ ID NO: 3250135 - RNA, 18 nt, Mycobacterium tuberculosis H37Rv
cgccguccagucggucgg

SEQ ID NO: 3250136 - RNA, 21 nt, Mycobacterium tuberculosis H37Rv
cgccguccccaccgacgccga

SEQ ID NO: 3250137 - RNA, 14 nt, Mycobacterium tuberculosis H37Rv
cgccguccccgccg

SEQ ID NO: 3250138 - RNA, 15 nt, Mycobacterium tuberculosis H37Rv
cgccguccccgccgc

SEQ ID NO: 3250139 - RNA, 18 nt, Mycobacterium tuberculosis H37Rv
cgccguccccgccgucgc

SEQ ID NO: 3250140 - RNA, 22 nt, Mycobacterium tuberculosis H37Rv
cgccguccccgccgucgccacc

SEQ ID NO: 3250141 - RNA, 16 nt, Mycobacterium tuberculosis H37Rv
cgccgucccggcucga

SEQ ID NO: 3250142 - RNA, 15 nt, Mycobacterium tuberculosis H37Rv
cgccguccggcgccc

SEQ ID NO: 3250143 - RNA, 12 nt, Mycobacterium tuberculosis H37Rv
cgccgucgaacc

SEQ ID NO: 3250144 - RNA, 21 nt, Mycobacterium tuberculosis H37Rv
cgccgucgaaccaguccucgg

SEQ ID NO: 3250145 - RNA, 22 nt, Mycobacterium tuberculosis H37Rv
cgccgucgacaacaaacccggc

SEQ ID NO: 3250146 - RNA, 15 nt, Mycobacterium tuberculosis H37Rv
cgccgucgaccggcg

SEQ ID NO: 3250147 - RNA, 20 nt, Mycobacterium tuberculosis H37Rv
cgccgucgacgcggccggcc

SEQ ID NO: 3250148 - RNA, 12 nt, Mycobacterium tuberculosis H37Rv
cgccgucgacgu

SEQ ID NO: 3250149 - RNA, 15 nt, Mycobacterium tuberculosis H37Rv
cgccgucgacgucga

SEQ ID NO: 3250150 - RNA, 18 nt, Mycobacterium tuberculosis H37Rv
cgccgucgagcacgguga

SEQ ID NO: 3250151 - RNA, 14 nt, Mycobacterium tuberculosis H37Rv
cgccgucgaugugg

SEQ ID NO: 3250152 - RNA, 13 nt, Mycobacterium tuberculosis H37Rv
cgccgucgcagcc

SEQ ID NO: 3250153 - RNA, 17 nt, Mycobacterium tuberculosis H37Rv
cgccgucgcagccagcu

SEQ ID NO: 3250154 - RNA, 20 nt, Mycobacterium tuberculosis H37Rv
cgccgucgccaccgguaccg

SEQ ID NO: 3250155 - RNA, 20 nt, Mycobacterium tuberculosis H37Rv
cgccgucgccacgcccagcg

SEQ ID NO: 3250156 - RNA, 13 nt, Mycobacterium tuberculosis H37Rv
cgccgucgccgau

SEQ ID NO: 3250157 - RNA, 15 nt, Mycobacterium tuberculosis H37Rv
cgccgucgccgauca

SEQ ID NO: 3250158 - RNA, 12 nt, Mycobacterium tuberculosis H37Rv
cgccgucgccgc

SEQ ID NO: 3250159 - RNA, 20 nt, Mycobacterium tuberculosis H37Rv
cgccgucgccgccaaagccg

SEQ ID NO: 3250160 - RNA, 15 nt, Mycobacterium tuberculosis H37Rv
cgccgucggacaccg

SEQ ID NO: 3250161 - RNA, 21 nt, Mycobacterium tuberculosis H37Rv
cgccgucggagccggccaccu

SEQ ID NO: 3250162 - RNA, 15 nt, Mycobacterium tuberculosis H37Rv
cgccgucggcgauga

SEQ ID NO: 3250163 - RNA, 13 nt, Mycobacterium tuberculosis H37Rv
cgccgucggcgcc

SEQ ID NO: 3250164 - RNA, 16 nt, Mycobacterium tuberculosis H37Rv
cgccgucggcgcgcac

SEQ ID NO: 3250165 - RNA, 18 nt, Mycobacterium tuberculosis H37Rv
cgccgucggcgcgcaccu

SEQ ID NO: 3250166 - RNA, 13 nt, Mycobacterium tuberculosis H37Rv
cgccgucgggccu

SEQ ID NO: 3250167 - RNA, 14 nt, Mycobacterium tuberculosis H37Rv
cgccgucgggccug

SEQ ID NO: 3250168 - RNA, 20 nt, Mycobacterium tuberculosis H37Rv
cgccgucgggccugccggag

SEQ ID NO: 3250169 - RNA, 21 nt, Mycobacterium tuberculosis H37Rv
cgccgucgguaaagggcucga

SEQ ID NO: 3250170 - RNA, 24 nt, Mycobacterium tuberculosis H37Rv
cgccgucgguaaagggcucgaugg

SEQ ID NO: 3250171 - RNA, 13 nt, Mycobacterium tuberculosis H37Rv
cgccgucggugcc

SEQ ID NO: 3250172 - RNA, 17 nt, Mycobacterium tuberculosis H37Rv
cgccgucggugccgccg

SEQ ID NO: 3250173 - RNA, 23 nt, Mycobacterium tuberculosis H37Rv
cgccgucguacucgaccgcgagc

SEQ ID NO: 3250174 - RNA, 18 nt, Mycobacterium tuberculosis H37Rv
cgccgucgucgucggcag

SEQ ID NO: 3250175 - RNA, 20 nt, Mycobacterium tuberculosis H37Rv
cgccgucuagcacacgcuug

SEQ ID NO: 3250176 - RNA, 15 nt, Mycobacterium tuberculosis H37Rv
cgccgucucgaagcu

SEQ ID NO: 3250177 - RNA, 15 nt, Mycobacterium tuberculosis H37Rv
cgccgucucugccac

SEQ ID NO: 3250178 - RNA, 20 nt, Mycobacterium tuberculosis H37Rv
cgccgucuuggcccgguccg

SEQ ID NO: 3250179 - RNA, 23 nt, Mycobacterium tuberculosis H37Rv
cgccgugaccaggugccaggaug

SEQ ID NO: 3250180 - RNA, 23 nt, Mycobacterium tuberculosis H37Rv
cgccgugacccauucucggccgg

SEQ ID NO: 3250181 - RNA, 17 nt, Mycobacterium tuberculosis H37Rv
cgccgugaucagcucgc

SEQ ID NO: 3250182 - RNA, 21 nt, Mycobacterium tuberculosis H37Rv
cgccgugaucagcucgcgcac

SEQ ID NO: 3250183 - RNA, 14 nt, Mycobacterium tuberculosis H37Rv
cgccgugcuugcga

SEQ ID NO: 3250184 - RNA, 20 nt, Mycobacterium tuberculosis H37Rv
cgccguggaacacgaagucg

SEQ ID NO: 3250185 - RNA, 19 nt, Mycobacterium tuberculosis H37Rv
cgccguggaucaucccgac

SEQ ID NO: 3250186 - RNA, 20 nt, Mycobacterium tuberculosis H37Rv
cgccguggcaucgccuccag

SEQ ID NO: 3250187 - RNA, 20 nt, Mycobacterium tuberculosis H37Rv
cgccguggcccgcucccugc

SEQ ID NO: 3250188 - RNA, 16 nt, Mycobacterium tuberculosis H37Rv
cgccguggcgucggcg

SEQ ID NO: 3250189 - RNA, 18 nt, Mycobacterium tuberculosis H37Rv
cgccguggugcgcauggc

SEQ ID NO: 3250190 - RNA, 23 nt, Mycobacterium tuberculosis H37Rv
cgccucgggcaccuggucggccg

SEQ ID NO: 3250191 - RNA, 22 nt, Mycobacterium tuberculosis H37Rv
cgccucgggccggcguagcggc

SEQ ID NO: 3250192 - RNA, 18 nt, Mycobacterium tuberculosis H37Rv
cgccucgguaaagccgcg

SEQ ID NO: 3250193 - RNA, 16 nt, Mycobacterium tuberculosis H37Rv
cgccucgugaguugac

SEQ ID NO: 3250194 - RNA, 21 nt, Mycobacterium tuberculosis H37Rv
cgccucgugaguugacggugg

SEQ ID NO: 3250195 - RNA, 16 nt, Mycobacterium tuberculosis H37Rv
cgccucugcgaucagu

SEQ ID NO: 3250196 - RNA, 14 nt, Mycobacterium tuberculosis H37Rv
cgccucugcucagc

SEQ ID NO: 3250197 - RNA, 16 nt, Mycobacterium tuberculosis H37Rv
cgccucugcucagccg

SEQ ID NO: 3250198 - RNA, 14 nt, Mycobacterium tuberculosis H37Rv
cgccucugucuuca

SEQ ID NO: 3250199 - RNA, 14 nt, Mycobacterium tuberculosis H37Rv
cgccucuuccuggc

SEQ ID NO: 3250200 - RNA, 21 nt, Mycobacterium tuberculosis H37Rv
cgccucuuccuggcgugagcc

SEQ ID NO: 3250201 - RNA, 14 nt, Mycobacterium tuberculosis H37Rv
cgccugacccggcg

SEQ ID NO: 3250202 - RNA, 15 nt, Mycobacterium tuberculosis H37Rv
cgccugaccgccacc

SEQ ID NO: 3250203 - RNA, 17 nt, Mycobacterium tuberculosis H37Rv
cgccugaccgccaccgu

SEQ ID NO: 3250204 - RNA, 20 nt, Mycobacterium tuberculosis H37Rv
cgccugacgguaaaugucga

SEQ ID NO: 3250205 - RNA, 20 nt, Mycobacterium tuberculosis H37Rv
cgccugacucaucaccgaug

SEQ ID NO: 3250206 - RNA, 20 nt, Mycobacterium tuberculosis H37Rv
cgccugagcggccucgggac

SEQ ID NO: 3250207 - RNA, 16 nt, Mycobacterium tuberculosis H37Rv
cgccugaggugcugcc

SEQ ID NO: 3250208 - RNA, 18 nt, Mycobacterium tuberculosis H37Rv
cgccugaugcggccggcg

SEQ ID NO: 3250209 - RNA, 19 nt, Mycobacterium tuberculosis H37Rv
cgccugaugcggccggcgc

SEQ ID NO: 3250210 - RNA, 20 nt, Mycobacterium tuberculosis H37Rv
cgccugaugcggccggcgcc

SEQ ID NO: 3250211 - RNA, 14 nt, Mycobacterium tuberculosis H37Rv
cgccugaugcugcc

SEQ ID NO: 3250212 - RNA, 19 nt, Mycobacterium tuberculosis H37Rv
cgccugcaacauccccaug

SEQ ID NO: 3250213 - RNA, 16 nt, Mycobacterium tuberculosis H37Rv
cgccugcacccggcga

SEQ ID NO: 3250214 - RNA, 15 nt, Mycobacterium tuberculosis H37Rv
cgccugcaccgccgc

SEQ ID NO: 3250215 - RNA, 22 nt, Mycobacterium tuberculosis H37Rv
cgccugcaccgccgccgcccgu

SEQ ID NO: 3250216 - RNA, 16 nt, Mycobacterium tuberculosis H37Rv
cgccugcacgcccggc

SEQ ID NO: 3250217 - RNA, 13 nt, Mycobacterium tuberculosis H37Rv
cgccugccacagc

SEQ ID NO: 3250218 - RNA, 18 nt, Mycobacterium tuberculosis H37Rv
cgccugccccacccgcgg

SEQ ID NO: 3250219 - RNA, 15 nt, Mycobacterium tuberculosis H37Rv
cgccugcccgaacca

SEQ ID NO: 3250220 - RNA, 13 nt, Mycobacterium tuberculosis H37Rv
cgccugcccggcc

SEQ ID NO: 3250221 - RNA, 16 nt, Mycobacterium tuberculosis H37Rv
cgccugcccggcccgc

SEQ ID NO: 3250222 - RNA, 18 nt, Mycobacterium tuberculosis H37Rv
cgccugcccggcccgcuc

SEQ ID NO: 3250223 - RNA, 17 nt, Mycobacterium tuberculosis H37Rv
cgccugcccgggugaga

SEQ ID NO: 3250224 - RNA, 16 nt, Mycobacterium tuberculosis H37Rv
cgccugccgaaacgcc

SEQ ID NO: 3250225 - RNA, 14 nt, Mycobacterium tuberculosis H37Rv
cgccugccgcuggu

SEQ ID NO: 3250226 - RNA, 18 nt, Mycobacterium tuberculosis H37Rv
cgccugccucaccgccgc

SEQ ID NO: 3250227 - RNA, 23 nt, Mycobacterium tuberculosis H37Rv
cgccugcgacuaagggcacucca

SEQ ID NO: 3250228 - RNA, 16 nt, Mycobacterium tuberculosis H37Rv
cgccugcgccgcccgc

SEQ ID NO: 3250229 - RNA, 18 nt, Mycobacterium tuberculosis H37Rv
cgccugcgccgcccgcgc

SEQ ID NO: 3250230 - RNA, 17 nt, Mycobacterium tuberculosis H37Rv
cgccugcuccucggcca

SEQ ID NO: 3250231 - RNA, 15 nt, Mycobacterium tuberculosis H37Rv
cgccugcuggccgcg

SEQ ID NO: 3250232 - RNA, 15 nt, Mycobacterium tuberculosis H37Rv
cgccugcugguaccg

SEQ ID NO: 3250233 - RNA, 22 nt, Mycobacterium tuberculosis H37Rv
cgccugcugguaccgggcucca

SEQ ID NO: 3250234 - RNA, 14 nt, Mycobacterium tuberculosis H37Rv
cgccuggaucagcg

SEQ ID NO: 3250235 - RNA, 15 nt, Mycobacterium tuberculosis H37Rv
cgccuggcggcgccg

SEQ ID NO: 3250236 - RNA, 21 nt, Mycobacterium tuberculosis H37Rv
cgccuggcggcgccgcagauc

SEQ ID NO: 3250237 - RNA, 17 nt, Mycobacterium tuberculosis H37Rv
cgccuggcuacgcgcgc

SEQ ID NO: 3250238 - RNA, 21 nt, Mycobacterium tuberculosis H37Rv
cgccuggcuacgcgcgcccga

SEQ ID NO: 3250239 - RNA, 23 nt, Mycobacterium tuberculosis H37Rv
cgccugggugagguuggagcgcc

SEQ ID NO: 3250240 - RNA, 21 nt, Mycobacterium tuberculosis H37Rv
cgccuguacgagcagaucgcg

SEQ ID NO: 3250241 - RNA, 15 nt, Mycobacterium tuberculosis H37Rv
cgccuguccugcggg

SEQ ID NO: 3250242 - RNA, 12 nt, Mycobacterium tuberculosis H37Rv
cgccugucgggc

SEQ ID NO: 3250243 - RNA, 15 nt, Mycobacterium tuberculosis H37Rv
cgccugugccaccgc

SEQ ID NO: 3250244 - RNA, 13 nt, Mycobacterium tuberculosis H37Rv
cgccugugccgcc

SEQ ID NO: 3250245 - RNA, 16 nt, Mycobacterium tuberculosis H37Rv
cgccugugggugcuau

SEQ ID NO: 3250246 - RNA, 21 nt, Mycobacterium tuberculosis H37Rv
cgccuuacgcaccgaugccuu

SEQ ID NO: 3250247 - RNA, 19 nt, Mycobacterium tuberculosis H37Rv
cgccuuaggcguccgagcg

SEQ ID NO: 3250248 - RNA, 17 nt, Mycobacterium tuberculosis H37Rv
cgccuucacgcuggccu

SEQ ID NO: 3250249 - RNA, 18 nt, Mycobacterium tuberculosis H37Rv
cgccuuccagcccgagca

SEQ ID NO: 3250250 - RNA, 15 nt, Mycobacterium tuberculosis H37Rv
cgccuucgccgccgc

SEQ ID NO: 3250251 - RNA, 19 nt, Mycobacterium tuberculosis H37Rv
cgccuucggggugcacgcg

SEQ ID NO: 3250252 - RNA, 18 nt, Mycobacterium tuberculosis H37Rv
cgccuucucccgcacggc

SEQ ID NO: 3250253 - RNA, 21 nt, Mycobacterium tuberculosis H37Rv
cgccuucuccggcgucacggc

SEQ ID NO: 3250254 - RNA, 21 nt, Mycobacterium tuberculosis H37Rv
cgccuucuuggcaggugccuu

SEQ ID NO: 3250255 - RNA, 16 nt, Mycobacterium tuberculosis H37Rv
cgccuugaagcggugg

SEQ ID NO: 3250256 - RNA, 13 nt, Mycobacterium tuberculosis H37Rv
cgccuugaccaca

SEQ ID NO: 3250257 - RNA, 20 nt, Mycobacterium tuberculosis H37Rv
cgccuugacugaacucaaca

SEQ ID NO: 3250258 - RNA, 13 nt, Mycobacterium tuberculosis H37Rv
cgccuugagccga

SEQ ID NO: 3250259 - RNA, 14 nt, Mycobacterium tuberculosis H37Rv
cgccuugaucggcg

SEQ ID NO: 3250260 - RNA, 15 nt, Mycobacterium tuberculosis H37Rv
cgccuugaucggcga

SEQ ID NO: 3250261 - RNA, 18 nt, Mycobacterium tuberculosis H37Rv
cgccuugcacaagcugaa

SEQ ID NO: 3250262 - RNA, 14 nt, Mycobacterium tuberculosis H37Rv
cgccuugcgggccu

SEQ ID NO: 3250263 - RNA, 14 nt, Mycobacterium tuberculosis H37Rv
cgccuuggcacccu

SEQ ID NO: 3250264 - RNA, 17 nt, Mycobacterium tuberculosis H37Rv
cgccuuggcacccuccg

SEQ ID NO: 3250265 - RNA, 16 nt, Mycobacterium tuberculosis H37Rv
cgccuuggccaccauc

SEQ ID NO: 3250266 - RNA, 13 nt, Mycobacterium tuberculosis H37Rv
cgccuuggccagc

SEQ ID NO: 3250267 - RNA, 15 nt, Mycobacterium tuberculosis H37Rv
cgccuuggccagcgc

SEQ ID NO: 3250268 - RNA, 15 nt, Mycobacterium tuberculosis H37Rv
cgccuuggcgcccgc

SEQ ID NO: 3250269 - RNA, 17 nt, Mycobacterium tuberculosis H37Rv
cgccuuggcgcccgcga

SEQ ID NO: 3250270 - RNA, 21 nt, Mycobacterium tuberculosis H37Rv
cgccuuggucaccuucuuggc

SEQ ID NO: 3250271 - RNA, 13 nt, Mycobacterium tuberculosis H37Rv
cgccuuggucgcc

SEQ ID NO: 3250272 - RNA, 17 nt, Mycobacterium tuberculosis H37Rv
cgccuuggucgccgcuu

SEQ ID NO: 3250273 - RNA, 21 nt, Mycobacterium tuberculosis H37Rv
cgccuuggucgccgcuuucuu

SEQ ID NO: 3250274 - RNA, 14 nt, Mycobacterium tuberculosis H37Rv
cgccuugucggcga

SEQ ID NO: 3250275 - RNA, 19 nt, Mycobacterium tuberculosis H37Rv
cgccuuguggcacacccgc

SEQ ID NO: 3250276 - RNA, 21 nt, Mycobacterium tuberculosis H37Rv
cgccuuguggcacacccgcac

SEQ ID NO: 3250277 - RNA, 17 nt, Mycobacterium tuberculosis H37Rv
cgccuuugagcccgcga

SEQ ID NO: 3250278 - RNA, 16 nt, Mycobacterium tuberculosis H37Rv
cgccuuugcccgccgc

SEQ ID NO: 3250279 - RNA, 21 nt, Mycobacterium tuberculosis H37Rv
cgccuuugccgccggcaccgc

SEQ ID NO: 3250280 - RNA, 18 nt, Mycobacterium tuberculosis H37Rv
cgccuuuuuucgccgccu

SEQ ID NO: 3250281 - RNA, 14 nt, Mycobacterium tuberculosis H37Rv
cgcgaaaccggacc

SEQ ID NO: 3250282 - RNA, 15 nt, Mycobacterium tuberculosis H37Rv
cgcgaaacgccgcaa

SEQ ID NO: 3250283 - RNA, 22 nt, Mycobacterium tuberculosis H37Rv
cgcgaaagccugcuucaggauc

SEQ ID NO: 3250284 - RNA, 22 nt, Mycobacterium tuberculosis H37Rv
cgcgaaauaacggagcggccua

SEQ ID NO: 3250285 - RNA, 12 nt, Mycobacterium tuberculosis H37Rv
cgcgaacacccg

SEQ ID NO: 3250286 - RNA, 13 nt, Mycobacterium tuberculosis H37Rv
cgcgagcgagcca

SEQ ID NO: 3250287 - RNA, 20 nt, Mycobacterium tuberculosis H37Rv
cgcgagcgccgcuaugaggc

SEQ ID NO: 3250288 - RNA, 15 nt, Mycobacterium tuberculosis H37Rv
cgcgagcgcggcgga

SEQ ID NO: 3250289 - RNA, 22 nt, Mycobacterium tuberculosis H37Rv
cgcgagcuguaggucagcgcgu

SEQ ID NO: 3250290 - RNA, 20 nt, Mycobacterium tuberculosis H37Rv
cgcgagcuuggccagcagca

SEQ ID NO: 3250291 - RNA, 13 nt, Mycobacterium tuberculosis H37Rv
cgcgaggaacgcc

SEQ ID NO: 3250292 - RNA, 22 nt, Mycobacterium tuberculosis H37Rv
cgcgaggaggcuuacaugcccu

SEQ ID NO: 3250293 - RNA, 15 nt, Mycobacterium tuberculosis H37Rv
cgcgagggccagcaa

SEQ ID NO: 3250294 - RNA, 21 nt, Mycobacterium tuberculosis H37Rv
cgcgaggggccggcucaguca

SEQ ID NO: 3250295 - RNA, 23 nt, Mycobacterium tuberculosis H37Rv
cgcgagggggguguugaggccgg

SEQ ID NO: 3250296 - RNA, 16 nt, Mycobacterium tuberculosis H37Rv
cgcgaggucggcggcg

SEQ ID NO: 3250297 - RNA, 18 nt, Mycobacterium tuberculosis H37Rv
cgcgaggucggcggcgca

SEQ ID NO: 3250298 - RNA, 22 nt, Mycobacterium tuberculosis H37Rv
cgcgaggugaaucgcgucgaga

SEQ ID NO: 3250299 - RNA, 19 nt, Mycobacterium tuberculosis H37Rv
cgcgagguugaccaccagc

SEQ ID NO: 3250300 - RNA, 15 nt, Mycobacterium tuberculosis H37Rv
cgcgagguuggcguu

SEQ ID NO: 3250301 - RNA, 22 nt, Mycobacterium tuberculosis H37Rv
cgcgaguaagcgaacagcggca

SEQ ID NO: 3250302 - RNA, 22 nt, Mycobacterium tuberculosis H37Rv
cgcgaguagcugacccgcggua

SEQ ID NO: 3250303 - RNA, 23 nt, Mycobacterium tuberculosis H37Rv
cgcgagucaccaaaggcgucuga

SEQ ID NO: 3250304 - RNA, 15 nt, Mycobacterium tuberculosis H37Rv
cgcgaguccgcugcu

SEQ ID NO: 3250305 - RNA, 16 nt, Mycobacterium tuberculosis H37Rv
cgcgagugccaguccg

SEQ ID NO: 3250306 - RNA, 18 nt, Mycobacterium tuberculosis H37Rv
cgcgagugccaguccgau

SEQ ID NO: 3250307 - RNA, 15 nt, Mycobacterium tuberculosis H37Rv
cgcgauacagacggg

SEQ ID NO: 3250308 - RNA, 16 nt, Mycobacterium tuberculosis H37Rv
cgcgauagauacccgc

SEQ ID NO: 3250309 - RNA, 23 nt, Mycobacterium tuberculosis H37Rv
cgcgauagauacccgcggcagca

SEQ ID NO: 3250310 - RNA, 15 nt, Mycobacterium tuberculosis H37Rv
cgcgaucaccaccgg

SEQ ID NO: 3250311 - RNA, 17 nt, Mycobacterium tuberculosis H37Rv
cgcgaucacccacaugg

SEQ ID NO: 3250312 - RNA, 14 nt, Mycobacterium tuberculosis H37Rv
cgcgaucaccgacg

SEQ ID NO: 3250313 - RNA, 21 nt, Mycobacterium tuberculosis H37Rv
cgcgaucaccgacgaugccgc

SEQ ID NO: 3250314 - RNA, 16 nt, Mycobacterium tuberculosis H37Rv
cgcgaucaccgagucg

SEQ ID NO: 3250315 - RNA, 21 nt, Mycobacterium tuberculosis H37Rv
cgcgaucacuuccggauucgg

SEQ ID NO: 3250316 - RNA, 19 nt, Mycobacterium tuberculosis H37Rv
cgcgaucagaaacuccgga

SEQ ID NO: 3250317 - RNA, 21 nt, Mycobacterium tuberculosis H37Rv
cgcgaucagaaacuccggacc

SEQ ID NO: 3250318 - RNA, 14 nt, Mycobacterium tuberculosis H37Rv
cgcgaucagcgcgc

SEQ ID NO: 3250319 - RNA, 15 nt, Mycobacterium tuberculosis H37Rv
cgcgaucagcgcgca

SEQ ID NO: 3250320 - RNA, 16 nt, Mycobacterium tuberculosis H37Rv
cgcgaucaggcgcucg

SEQ ID NO: 3250321 - RNA, 21 nt, Mycobacterium tuberculosis H37Rv
cgcgaucaugguggggaccgc

SEQ ID NO: 3250322 - RNA, 15 nt, Mycobacterium tuberculosis H37Rv
cgcgauccgcgcgca

SEQ ID NO: 3250323 - RNA, 15 nt, Mycobacterium tuberculosis H37Rv
cgcgaucgaccuugg

SEQ ID NO: 3250324 - RNA, 14 nt, Mycobacterium tuberculosis H37Rv
cgcgaucgacgcuc

SEQ ID NO: 3250325 - RNA, 22 nt, Mycobacterium tuberculosis H37Rv
cgcgaucgacgcucggcuaugg

SEQ ID NO: 3250326 - RNA, 20 nt, Mycobacterium tuberculosis H37Rv
cgcgaucgcagugagcagcc

SEQ ID NO: 3250327 - RNA, 18 nt, Mycobacterium tuberculosis H37Rv
cgcgaucgccgacgccag

SEQ ID NO: 3250328 - RNA, 11 nt, Mycobacterium tuberculosis H37Rv
cgcgaucgcga

SEQ ID NO: 3250329 - RNA, 13 nt, Mycobacterium tuberculosis H37Rv
cgcgaucgcgccc

SEQ ID NO: 3250330 - RNA, 17 nt, Mycobacterium tuberculosis H37Rv
cgcgaucgggccgaucu

SEQ ID NO: 3250331 - RNA, 14 nt, Mycobacterium tuberculosis H37Rv
cgcgaucgggccgg

SEQ ID NO: 3250332 - RNA, 22 nt, Mycobacterium tuberculosis H37Rv
cgcgaucggggcgacgauccgc

SEQ ID NO: 3250333 - RNA, 12 nt, Mycobacterium tuberculosis H37Rv
cgcgaucggugc

SEQ ID NO: 3250334 - RNA, 19 nt, Mycobacterium tuberculosis H37Rv
cgcgaucgucacggaggcc

SEQ ID NO: 3250335 - RNA, 14 nt, Mycobacterium tuberculosis H37Rv
cgcgaucucggagc

SEQ ID NO: 3250336 - RNA, 16 nt, Mycobacterium tuberculosis H37Rv
cgcgaucucggagcgc

SEQ ID NO: 3250337 - RNA, 22 nt, Mycobacterium tuberculosis H37Rv
cgcgaucugaagguguccgcug

SEQ ID NO: 3250338 - RNA, 16 nt, Mycobacterium tuberculosis H37Rv
cgcgaucugcucgccc

SEQ ID NO: 3250339 - RNA, 18 nt, Mycobacterium tuberculosis H37Rv
cgcgaugacacaccgcgu

SEQ ID NO: 3250340 - RNA, 21 nt, Mycobacterium tuberculosis H37Rv
cgcgaugacacaccgcgucgg

SEQ ID NO: 3250341 - RNA, 24 nt, Mycobacterium tuberculosis H37Rv
cgcgaugaccgcaccgaccugagu

SEQ ID NO: 3250342 - RNA, 14 nt, Mycobacterium tuberculosis H37Rv
cgcgaugaccucgg

SEQ ID NO: 3250343 - RNA, 17 nt, Mycobacterium tuberculosis H37Rv
cgcgaugacggugccga

SEQ ID NO: 3250344 - RNA, 19 nt, Mycobacterium tuberculosis H37Rv
cgcgaugagcggcgcggca

SEQ ID NO: 3250345 - RNA, 23 nt, Mycobacterium tuberculosis H37Rv
cgcgaugauaccugcccacgcgg

SEQ ID NO: 3250346 - RNA, 19 nt, Mycobacterium tuberculosis H37Rv
cgcgaugauggcgguaccg

SEQ ID NO: 3250347 - RNA, 14 nt, Mycobacterium tuberculosis H37Rv
cgcgaugcgcacca

SEQ ID NO: 3250348 - RNA, 15 nt, Mycobacterium tuberculosis H37Rv
cgcgaugcgcaccag

SEQ ID NO: 3250349 - RNA, 14 nt, Mycobacterium tuberculosis H37Rv
cgcgauggacccaa

SEQ ID NO: 3250350 - RNA, 15 nt, Mycobacterium tuberculosis H37Rv
cgcgauggcagcgcc

SEQ ID NO: 3250351 - RNA, 18 nt, Mycobacterium tuberculosis H37Rv
cgcgauggcagcgccgau

SEQ ID NO: 3250352 - RNA, 22 nt, Mycobacterium tuberculosis H37Rv
cgcgauggccaucaucgacggu

SEQ ID NO: 3250353 - RNA, 22 nt, Mycobacterium tuberculosis H37Rv
cgcgauggccccugucaugucc

SEQ ID NO: 3250354 - RNA, 14 nt, Mycobacterium tuberculosis H37Rv
cgcgauggccgcca

SEQ ID NO: 3250355 - RNA, 18 nt, Mycobacterium tuberculosis H37Rv
cgcgauggcgguccaccg

SEQ ID NO: 3250356 - RNA, 20 nt, Mycobacterium tuberculosis H37Rv
cgcgauggcgguccaccggc

SEQ ID NO: 3250357 - RNA, 16 nt, Mycobacterium tuberculosis H37Rv
cgcgaugggagcccgg

SEQ ID NO: 3250358 - RNA, 14 nt, Mycobacterium tuberculosis H37Rv
cgcgauggugcgcc

SEQ ID NO: 3250359 - RNA, 17 nt, Mycobacterium tuberculosis H37Rv
cgcgaugguggccgcca

SEQ ID NO: 3250360 - RNA, 18 nt, Mycobacterium tuberculosis H37Rv
cgcgauggugguuccgcc

SEQ ID NO: 3250361 - RNA, 21 nt, Mycobacterium tuberculosis H37Rv
cgcgauguccucgagcaccgc

SEQ ID NO: 3250362 - RNA, 16 nt, Mycobacterium tuberculosis H37Rv
cgcgaugugcgccacc

SEQ ID NO: 3250363 - RNA, 17 nt, Mycobacterium tuberculosis H37Rv
cgcgaugugcgccaccu

SEQ ID NO: 3250364 - RNA, 21 nt, Mycobacterium tuberculosis H37Rv
cgcgauuagcaaaccgaccgu

SEQ ID NO: 3250365 - RNA, 17 nt, Mycobacterium tuberculosis H37Rv
cgcgauuccggcggcca

SEQ ID NO: 3250366 - RNA, 17 nt, Mycobacterium tuberculosis H37Rv
cgcgcaaaugccugcug

SEQ ID NO: 3250367 - RNA, 18 nt, Mycobacterium tuberculosis H37Rv
cgcgcaacccggacgaac

SEQ ID NO: 3250368 - RNA, 17 nt, Mycobacterium tuberculosis H37Rv
cgcgcaacccugccgcg

SEQ ID NO: 3250369 - RNA, 14 nt, Mycobacterium tuberculosis H37Rv
cgcgcaaccggccg

SEQ ID NO: 3250370 - RNA, 19 nt, Mycobacterium tuberculosis H37Rv
cgcgcaaccgggcggacag

SEQ ID NO: 3250371 - RNA, 22 nt, Mycobacterium tuberculosis H37Rv
cgcgcaaccuaaauugccgggc

SEQ ID NO: 3250372 - RNA, 17 nt, Mycobacterium tuberculosis H37Rv
cgcgcaacgccgccagc

SEQ ID NO: 3250373 - RNA, 14 nt, Mycobacterium tuberculosis H37Rv
cgcgcaacgggucg

SEQ ID NO: 3250374 - RNA, 18 nt, Mycobacterium tuberculosis H37Rv
cgcgcaacucgccacggu

SEQ ID NO: 3250375 - RNA, 19 nt, Mycobacterium tuberculosis H37Rv
cgcgcaagcggacccgacc

SEQ ID NO: 3250376 - RNA, 15 nt, Mycobacterium tuberculosis H37Rv
cgcgcaaggcgccgc

SEQ ID NO: 3250377 - RNA, 16 nt, Mycobacterium tuberculosis H37Rv
cgcgcaaggcgccgca

SEQ ID NO: 3250378 - RNA, 16 nt, Mycobacterium tuberculosis H37Rv
cgcgcaccaacaccag

SEQ ID NO: 3250379 - RNA, 13 nt, Mycobacterium tuberculosis H37Rv
cgcgcacccagcc

SEQ ID NO: 3250380 - RNA, 14 nt, Mycobacterium tuberculosis H37Rv
cgcgcacccagccc

SEQ ID NO: 3250381 - RNA, 15 nt, Mycobacterium tuberculosis H37Rv
cgcgcaccccggcau

SEQ ID NO: 3250382 - RNA, 14 nt, Mycobacterium tuberculosis H37Rv
cgcgccgacgccgc

SEQ ID NO: 3250383 - RNA, 17 nt, Mycobacterium tuberculosis H37Rv
cgcgccgagccagcacc

SEQ ID NO: 3250384 - RNA, 17 nt, Mycobacterium tuberculosis H37Rv
cgcgccgaguugcccgg

SEQ ID NO: 3250385 - RNA, 23 nt, Mycobacterium tuberculosis H37Rv
cgcgccgaguugcccgggucggc

SEQ ID NO: 3250386 - RNA, 14 nt, Mycobacterium tuberculosis H37Rv
cgcgccgaucagcg

SEQ ID NO: 3250387 - RNA, 17 nt, Mycobacterium tuberculosis H37Rv
cgcgccgaucggcaccg

SEQ ID NO: 3250388 - RNA, 14 nt, Mycobacterium tuberculosis H37Rv
cgcgccgcacacgu

SEQ ID NO: 3250389 - RNA, 16 nt, Mycobacterium tuberculosis H37Rv
cgcgccgcacccggga

SEQ ID NO: 3250390 - RNA, 15 nt, Mycobacterium tuberculosis H37Rv
cgcgccgcauccagc

SEQ ID NO: 3250391 - RNA, 15 nt, Mycobacterium tuberculosis H37Rv
cgcgccgccagcgcc

SEQ ID NO: 3250392 - RNA, 16 nt, Mycobacterium tuberculosis H37Rv
cgcgccgccagcgccg

SEQ ID NO: 3250393 - RNA, 16 nt, Mycobacterium tuberculosis H37Rv
cgcgccgccccgcucg

SEQ ID NO: 3250394 - RNA, 12 nt, Mycobacterium tuberculosis H37Rv
cgcgccgcccgc

SEQ ID NO: 3250395 - RNA, 21 nt, Mycobacterium tuberculosis H37Rv
cgcgccgcccgcuccuccggc

SEQ ID NO: 3250396 - RNA, 13 nt, Mycobacterium tuberculosis H37Rv
cgcgccgccgcua

SEQ ID NO: 3250397 - RNA, 14 nt, Mycobacterium tuberculosis H37Rv
cgcgccgccgcuac

SEQ ID NO: 3250398 - RNA, 12 nt, Mycobacterium tuberculosis H37Rv
cgcgccgccgga

SEQ ID NO: 3250399 - RNA, 13 nt, Mycobacterium tuberculosis H37Rv
cgcgccgccggac

SEQ ID NO: 3250400 - RNA, 13 nt, Mycobacterium tuberculosis H37Rv
cgcgccgccucgg

SEQ ID NO: 3250401 - RNA, 15 nt, Mycobacterium tuberculosis H37Rv
cgcgccgcgccgccu

SEQ ID NO: 3250402 - RNA, 15 nt, Mycobacterium tuberculosis H37Rv
cgcgccgcggcccgc

SEQ ID NO: 3250403 - RNA, 16 nt, Mycobacterium tuberculosis H37Rv
cgcgccgcugggugac

SEQ ID NO: 3250404 - RNA, 21 nt, Mycobacterium tuberculosis H37Rv
cgcgccggauacaccggcacc

SEQ ID NO: 3250405 - RNA, 24 nt, Mycobacterium tuberculosis H37Rv
cgcgccggccccgggggaagcgcc

SEQ ID NO: 3250406 - RNA, 13 nt, Mycobacterium tuberculosis H37Rv
cgcgccggccgca

SEQ ID NO: 3250407 - RNA, 16 nt, Mycobacterium tuberculosis H37Rv
cgcgccggcgacaccg

SEQ ID NO: 3250408 - RNA, 22 nt, Mycobacterium tuberculosis H37Rv
cgcgccggcggcaaagagcagc

SEQ ID NO: 3250409 - RNA, 16 nt, Mycobacterium tuberculosis H37Rv
cgcgccggcggccacc

SEQ ID NO: 3250410 - RNA, 22 nt, Mycobacterium tuberculosis H37Rv
cgcgccggcgggcgcgggcgcc

SEQ ID NO: 3250411 - RNA, 14 nt, Mycobacterium tuberculosis H37Rv
cgcgccggcgguag

SEQ ID NO: 3250412 - RNA, 13 nt, Mycobacterium tuberculosis H37Rv
cgcgccggcguug

SEQ ID NO: 3250413 - RNA, 17 nt, Mycobacterium tuberculosis H37Rv
cgcgccgguuggccagu

SEQ ID NO: 3250414 - RNA, 17 nt, Mycobacterium tuberculosis H37Rv
cgcgccguaacagccgg

SEQ ID NO: 3250415 - RNA, 17 nt, Mycobacterium tuberculosis H37Rv
cgcgccguagaccagca

SEQ ID NO: 3250416 - RNA, 16 nt, Mycobacterium tuberculosis H37Rv
cgcgccguagagccgc

SEQ ID NO: 3250417 - RNA, 17 nt, Mycobacterium tuberculosis H37Rv
cgcgccguaguucuccg

SEQ ID NO: 3250418 - RNA, 17 nt, Mycobacterium tuberculosis H37Rv
cgcgccgucggcgauga

SEQ ID NO: 3250419 - RNA, 21 nt, Mycobacterium tuberculosis H37Rv
cgcgccgucgucgaccacgac

SEQ ID NO: 3250420 - RNA, 17 nt, Mycobacterium tuberculosis H37Rv
cgcgccgucgucgagca

SEQ ID NO: 3250421 - RNA, 16 nt, Mycobacterium tuberculosis H37Rv
cgcgccgucucgaagc

SEQ ID NO: 3250422 - RNA, 16 nt, Mycobacterium tuberculosis H37Rv
cgcgccguugccgccc

SEQ ID NO: 3250423 - RNA, 22 nt, Mycobacterium tuberculosis H37Rv
cgcgccugccucaccgccgcua

SEQ ID NO: 3250424 - RNA, 23 nt, Mycobacterium tuberculosis H37Rv
cgcgccuuggcacccuccgccgg

SEQ ID NO: 3250425 - RNA, 15 nt, Mycobacterium tuberculosis H37Rv
cgcgcgaaccgcucc

SEQ ID NO: 3250426 - RNA, 18 nt, Mycobacterium tuberculosis H37Rv
cgcgcgacaacccggcgu

SEQ ID NO: 3250427 - RNA, 12 nt, Mycobacterium tuberculosis H37Rv
cgcgcgaccaug

SEQ ID NO: 3250428 - RNA, 16 nt, Mycobacterium tuberculosis H37Rv
cgcgcgaccgcgaugg

SEQ ID NO: 3250429 - RNA, 13 nt, Mycobacterium tuberculosis H37Rv
cgcgcgacgagca

SEQ ID NO: 3250430 - RNA, 13 nt, Mycobacterium tuberculosis H37Rv
cgcgcgacgccgu

SEQ ID NO: 3250431 - RNA, 14 nt, Mycobacterium tuberculosis H37Rv
cgcgcgacggacca

SEQ ID NO: 3250432 - RNA, 20 nt, Mycobacterium tuberculosis H37Rv
cgcgcgacggaccaucuccg

SEQ ID NO: 3250433 - RNA, 14 nt, Mycobacterium tuberculosis H37Rv
cgcgcgacuguaca

SEQ ID NO: 3250434 - RNA, 17 nt, Mycobacterium tuberculosis H37Rv
cgcgcgagaacacccgu

SEQ ID NO: 3250435 - RNA, 17 nt, Mycobacterium tuberculosis H37Rv
cgcgcgagccgcuccaa

SEQ ID NO: 3250436 - RNA, 13 nt, Mycobacterium tuberculosis H37Rv
cgcgcgcacggcg

SEQ ID NO: 3250437 - RNA, 14 nt, Mycobacterium tuberculosis H37Rv
cgcgcgcagagcgu

SEQ ID NO: 3250438 - RNA, 16 nt, Mycobacterium tuberculosis H37Rv
cgcgcgcagcugacgu

SEQ ID NO: 3250439 - RNA, 14 nt, Mycobacterium tuberculosis H37Rv
cgcgcgccaucgcc

SEQ ID NO: 3250440 - RNA, 20 nt, Mycobacterium tuberculosis H37Rv
cgcgcgccaucgccuccagc

SEQ ID NO: 3250441 - RNA, 13 nt, Mycobacterium tuberculosis H37Rv
cgcgcgccgcagc

SEQ ID NO: 3250442 - RNA, 18 nt, Mycobacterium tuberculosis H37Rv
cgcgcgccgcauccagcc

SEQ ID NO: 3250443 - RNA, 15 nt, Mycobacterium tuberculosis H37Rv
cgcgcgccgcgacga

SEQ ID NO: 3250444 - RNA, 14 nt, Mycobacterium tuberculosis H37Rv
cgcgcgccgcuggg

SEQ ID NO: 3250445 - RNA, 16 nt, Mycobacterium tuberculosis H37Rv
cgcgcgccgcugggug

SEQ ID NO: 3250446 - RNA, 15 nt, Mycobacterium tuberculosis H37Rv
cgcgcgccggcggua

SEQ ID NO: 3250447 - RNA, 20 nt, Mycobacterium tuberculosis H37Rv
cgcgcgcgauggacaacaag

SEQ ID NO: 3250448 - RNA, 14 nt, Mycobacterium tuberculosis H37Rv
cgcgcgcggcguag

SEQ ID NO: 3250449 - RNA, 15 nt, Mycobacterium tuberculosis H37Rv
cgcgcgcuccagaug

SEQ ID NO: 3250450 - RNA, 12 nt, Mycobacterium tuberculosis H37Rv
cgcgcgcucgag

SEQ ID NO: 3250451 - RNA, 15 nt, Mycobacterium tuberculosis H37Rv
cgcgcgcucgcgggu

SEQ ID NO: 3250452 - RNA, 17 nt, Mycobacterium tuberculosis H37Rv
cgcgcgcucgcucaccg

SEQ ID NO: 3250453 - RNA, 18 nt, Mycobacterium tuberculosis H37Rv
cgcgcgcucgcucaccgg

SEQ ID NO: 3250454 - RNA, 14 nt, Mycobacterium tuberculosis H37Rv
cgcgcgcugagccg

SEQ ID NO: 3250455 - RNA, 13 nt, Mycobacterium tuberculosis H37Rv
cgcgcgcugcgca

SEQ ID NO: 3250456 - RNA, 14 nt, Mycobacterium tuberculosis H37Rv
cgcgcgcugggccc

SEQ ID NO: 3250457 - RNA, 13 nt, Mycobacterium tuberculosis H37Rv
cgcgcgcugggcg

SEQ ID NO: 3250458 - RNA, 18 nt, Mycobacterium tuberculosis H37Rv
cgcgcgcugggcgcgcuc

SEQ ID NO: 3250459 - RNA, 19 nt, Mycobacterium tuberculosis H37Rv
cgcgcgcugggcgcgcuca

SEQ ID NO: 3250460 - RNA, 19 nt, Mycobacterium tuberculosis H37Rv
cgcgcggacacucgcgggu

SEQ ID NO: 3250461 - RNA, 16 nt, Mycobacterium tuberculosis H37Rv
cgcgcggagucaagca

SEQ ID NO: 3250462 - RNA, 15 nt, Mycobacterium tuberculosis H37Rv
cgcgcggaucggcgg

SEQ ID NO: 3250463 - RNA, 21 nt, Mycobacterium tuberculosis H37Rv
cgcgcggaucggcggccgcga

SEQ ID NO: 3250464 - RNA, 15 nt, Mycobacterium tuberculosis H37Rv
cgcgcggaucgucga

SEQ ID NO: 3250465 - RNA, 18 nt, Mycobacterium tuberculosis H37Rv
cgcgcggaucgucgaggc

SEQ ID NO: 3250466 - RNA, 19 nt, Mycobacterium tuberculosis H37Rv
cgcgcggaucgucgaggca

SEQ ID NO: 3250467 - RNA, 20 nt, Mycobacterium tuberculosis H37Rv
cgcgcggaucucaccacccg

SEQ ID NO: 3250468 - RNA, 20 nt, Mycobacterium tuberculosis H37Rv
cgcgcggauggccucggcga

SEQ ID NO: 3250469 - RNA, 13 nt, Mycobacterium tuberculosis H37Rv
cgcgcggauuucg

SEQ ID NO: 3250470 - RNA, 12 nt, Mycobacterium tuberculosis H37Rv
cgcgcggcaccg

SEQ ID NO: 3250471 - RNA, 20 nt, Mycobacterium tuberculosis H37Rv
cgcgcggcagguugcguugc

SEQ ID NO: 3250472 - RNA, 17 nt, Mycobacterium tuberculosis H37Rv
cgcgcggccagcccacu

SEQ ID NO: 3250473 - RNA, 14 nt, Mycobacterium tuberculosis H37Rv
cgcgcggccgcgcu

SEQ ID NO: 3250474 - RNA, 22 nt, Mycobacterium tuberculosis H37Rv
cgcgcggcgacagcuuggccgg

SEQ ID NO: 3250475 - RNA, 15 nt, Mycobacterium tuberculosis H37Rv
cgcgcggcgcagcac

SEQ ID NO: 3250476 - RNA, 15 nt, Mycobacterium tuberculosis H37Rv
cgcgcggcggccgcg

SEQ ID NO: 3250477 - RNA, 19 nt, Mycobacterium tuberculosis H37Rv
cgcgcgggaaguccgucgg

SEQ ID NO: 3250478 - RNA, 19 nt, Mycobacterium tuberculosis H37Rv
cgcgcgggguggcggcgcu

SEQ ID NO: 3250479 - RNA, 13 nt, Mycobacterium tuberculosis H37Rv
cgcggagggcgcc

SEQ ID NO: 3250480 - RNA, 22 nt, Mycobacterium tuberculosis H37Rv
cgcggaguucgcugacggccau

SEQ ID NO: 3250481 - RNA, 21 nt, Mycobacterium tuberculosis H37Rv
cgcggauacgggcagugaaca

SEQ ID NO: 3250482 - RNA, 18 nt, Mycobacterium tuberculosis H37Rv
cgcggauagaugacgggc

SEQ ID NO: 3250483 - RNA, 20 nt, Mycobacterium tuberculosis H37Rv
cgcggauaggccgcgcggcg

SEQ ID NO: 3250484 - RNA, 24 nt, Mycobacterium tuberculosis H37Rv
cgcggaucaaaaaccacgcgucgc

SEQ ID NO: 3250485 - RNA, 22 nt, Mycobacterium tuberculosis H37Rv
cgcggaucaccaucgccgccgc

SEQ ID NO: 3250486 - RNA, 16 nt, Mycobacterium tuberculosis H37Rv
cgcggaucagcccgcg

SEQ ID NO: 3250487 - RNA, 21 nt, Mycobacterium tuberculosis H37Rv
cgcggaucagcccgcgcagca

SEQ ID NO: 3250488 - RNA, 15 nt, Mycobacterium tuberculosis H37Rv
cgcggaucgaccgcc

SEQ ID NO: 3250489 - RNA, 22 nt, Mycobacterium tuberculosis H37Rv
cgcggaucgaccgccagcgccg

SEQ ID NO: 3250490 - RNA, 20 nt, Mycobacterium tuberculosis H37Rv
cgcggaucgcgcugaucagc

SEQ ID NO: 3250491 - RNA, 15 nt, Mycobacterium tuberculosis H37Rv
cgcggaucucaucgg

SEQ ID NO: 3250492 - RNA, 18 nt, Mycobacterium tuberculosis H37Rv
cgcggaucuguuccucgg

SEQ ID NO: 3250493 - RNA, 15 nt, Mycobacterium tuberculosis H37Rv
cgcggaugagcucgg

SEQ ID NO: 3250494 - RNA, 15 nt, Mycobacterium tuberculosis H37Rv
cgcggaugcauguca

SEQ ID NO: 3250495 - RNA, 13 nt, Mycobacterium tuberculosis H37Rv
cgcggaugcguug

SEQ ID NO: 3250496 - RNA, 16 nt, Mycobacterium tuberculosis H37Rv
cgcggauguccaggag

SEQ ID NO: 3250497 - RNA, 16 nt, Mycobacterium tuberculosis H37Rv
cgcggaugucggcauc

SEQ ID NO: 3250498 - RNA, 15 nt, Mycobacterium tuberculosis H37Rv
cgcggauuucgccgu

SEQ ID NO: 3250499 - RNA, 20 nt, Mycobacterium tuberculosis H37Rv
cgcggauuucgccgugauga

SEQ ID NO: 3250500 - RNA, 21 nt, Mycobacterium tuberculosis H37Rv
cgcggcaacgcggucugcucc

SEQ ID NO: 3250501 - RNA, 16 nt, Mycobacterium tuberculosis H37Rv
cgcggcaagcucgucc

SEQ ID NO: 3250502 - RNA, 21 nt, Mycobacterium tuberculosis H37Rv
cgcggcaauggugcgggccac

SEQ ID NO: 3250503 - RNA, 12 nt, Mycobacterium tuberculosis H37Rv
cgcggcaccacg

SEQ ID NO: 3250504 - RNA, 14 nt, Mycobacterium tuberculosis H37Rv
cgcggcaccacguc

SEQ ID NO: 3250505 - RNA, 16 nt, Mycobacterium tuberculosis H37Rv
cgcggcacccaaccag

SEQ ID NO: 3250506 - RNA, 14 nt, Mycobacterium tuberculosis H37Rv
cgcggcacccgguc

SEQ ID NO: 3250507 - RNA, 20 nt, Mycobacterium tuberculosis H37Rv
cgcggcacccggucggccau

SEQ ID NO: 3250508 - RNA, 22 nt, Mycobacterium tuberculosis H37Rv
cgcggcaccgauggcgcaccgg

SEQ ID NO: 3250509 - RNA, 13 nt, Mycobacterium tuberculosis H37Rv
cgcggcaccgccg

SEQ ID NO: 3250510 - RNA, 14 nt, Mycobacterium tuberculosis H37Rv
cgcggcaccgccga

SEQ ID NO: 3250511 - RNA, 17 nt, Mycobacterium tuberculosis H37Rv
cgcggcaccgccgagca

SEQ ID NO: 3250512 - RNA, 14 nt, Mycobacterium tuberculosis H37Rv
cgcggcacgcucca

SEQ ID NO: 3250513 - RNA, 16 nt, Mycobacterium tuberculosis H37Rv
cgcggcacgcuccagc

SEQ ID NO: 3250514 - RNA, 19 nt, Mycobacterium tuberculosis H37Rv
cgcggcacgcuccagcucg

SEQ ID NO: 3250515 - RNA, 22 nt, Mycobacterium tuberculosis H37Rv
cgcggcacgcuccagcucggcc

SEQ ID NO: 3250516 - RNA, 13 nt, Mycobacterium tuberculosis H37Rv
cgcggcagcacga

SEQ ID NO: 3250517 - RNA, 17 nt, Mycobacterium tuberculosis H37Rv
cgcggcagcauccucga

SEQ ID NO: 3250518 - RNA, 18 nt, Mycobacterium tuberculosis H37Rv
cgcggcagcauccucgac

SEQ ID NO: 3250519 - RNA, 14 nt, Mycobacterium tuberculosis H37Rv
cgcggcagccggcg

SEQ ID NO: 3250520 - RNA, 14 nt, Mycobacterium tuberculosis H37Rv
cgcggcagggccug

SEQ ID NO: 3250521 - RNA, 21 nt, Mycobacterium tuberculosis H37Rv
cgcggcagggcggugccaucg

SEQ ID NO: 3250522 - RNA, 22 nt, Mycobacterium tuberculosis H37Rv
cgcggcagguugcguugcagga

SEQ ID NO: 3250523 - RNA, 18 nt, Mycobacterium tuberculosis H37Rv
cgcggcaucccgccacac

SEQ ID NO: 3250524 - RNA, 21 nt, Mycobacterium tuberculosis H37Rv
cgcggcaucccgccacaccaa

SEQ ID NO: 3250525 - RNA, 18 nt, Mycobacterium tuberculosis H37Rv
cgcggcaucgacgcggcc

SEQ ID NO: 3250526 - RNA, 22 nt, Mycobacterium tuberculosis H37Rv
cgcggcaugcaaugcuggcggc

SEQ ID NO: 3250527 - RNA, 22 nt, Mycobacterium tuberculosis H37Rv
cgcggcauucucgagcacccgc

SEQ ID NO: 3250528 - RNA, 23 nt, Mycobacterium tuberculosis H37Rv
cgcggccaaucagcccgccggac

SEQ ID NO: 3250529 - RNA, 18 nt, Mycobacterium tuberculosis H37Rv
cgcggccaauugcgccgc

SEQ ID NO: 3250530 - RNA, 17 nt, Mycobacterium tuberculosis H37Rv
cgcggccacaaccucgu

SEQ ID NO: 3250531 - RNA, 23 nt, Mycobacterium tuberculosis H37Rv
cgcggccacaaugcggccguucg

SEQ ID NO: 3250532 - RNA, 23 nt, Mycobacterium tuberculosis H37Rv
cgcggccacaccuuggccgccgg

SEQ ID NO: 3250533 - RNA, 17 nt, Mycobacterium tuberculosis H37Rv
cgcggccacaucgccag

SEQ ID NO: 3250534 - RNA, 23 nt, Mycobacterium tuberculosis H37Rv
cgcggccacaucgccagcagcaa

SEQ ID NO: 3250535 - RNA, 21 nt, Mycobacterium tuberculosis H37Rv
cgcggccacaugaucgagcag

SEQ ID NO: 3250536 - RNA, 11 nt, Mycobacterium tuberculosis H37Rv
cgcggccacca

SEQ ID NO: 3250537 - RNA, 12 nt, Mycobacterium tuberculosis H37Rv
cgcggccaccac

SEQ ID NO: 3250538 - RNA, 15 nt, Mycobacterium tuberculosis H37Rv
cgcggccaccaccag

SEQ ID NO: 3250539 - RNA, 22 nt, Mycobacterium tuberculosis H37Rv
cgcggccaccaccaggcugacg

SEQ ID NO: 3250540 - RNA, 16 nt, Mycobacterium tuberculosis H37Rv
cgcggccaccaccgcc

SEQ ID NO: 3250541 - RNA, 15 nt, Mycobacterium tuberculosis H37Rv
cgcggccaccagauc

SEQ ID NO: 3250542 - RNA, 13 nt, Mycobacterium tuberculosis H37Rv
cgcggccacccgc

SEQ ID NO: 3250543 - RNA, 14 nt, Mycobacterium tuberculosis H37Rv
cgcggccacccgcg

SEQ ID NO: 3250544 - RNA, 19 nt, Mycobacterium tuberculosis H37Rv
cgcggccacccgcgacgau

SEQ ID NO: 3250545 - RNA, 16 nt, Mycobacterium tuberculosis H37Rv
cgcggccaccgaccgc

SEQ ID NO: 3250546 - RNA, 14 nt, Mycobacterium tuberculosis H37Rv
cgcggccaccgccg

SEQ ID NO: 3250547 - RNA, 15 nt, Mycobacterium tuberculosis H37Rv
cgcggccaccgccgc

SEQ ID NO: 3250548 - RNA, 16 nt, Mycobacterium tuberculosis H37Rv
cgcggccaccgccgcc

SEQ ID NO: 3250549 - RNA, 17 nt, Mycobacterium tuberculosis H37Rv
cgcggccaccgccgccg

SEQ ID NO: 3250550 - RNA, 22 nt, Mycobacterium tuberculosis H37Rv
cgcggccaccgccgccgccgac

SEQ ID NO: 3250551 - RNA, 15 nt, Mycobacterium tuberculosis H37Rv
cgcggccaccgccug

SEQ ID NO: 3250552 - RNA, 15 nt, Mycobacterium tuberculosis H37Rv
cgcggccacgccgau

SEQ ID NO: 3250553 - RNA, 22 nt, Mycobacterium tuberculosis H37Rv
cgcggccacggucagccaggug

SEQ ID NO: 3250554 - RNA, 15 nt, Mycobacterium tuberculosis H37Rv
cgcggccagagccgc

SEQ ID NO: 3250555 - RNA, 16 nt, Mycobacterium tuberculosis H37Rv
cgcggccagagccgcg

SEQ ID NO: 3250556 - RNA, 13 nt, Mycobacterium tuberculosis H37Rv
cgcggccagcagc

SEQ ID NO: 3250557 - RNA, 17 nt, Mycobacterium tuberculosis H37Rv
cgcggccagcagcagau

SEQ ID NO: 3250558 - RNA, 17 nt, Mycobacterium tuberculosis H37Rv
cgcggccagcccacucg

SEQ ID NO: 3250559 - RNA, 13 nt, Mycobacterium tuberculosis H37Rv
cgcggccagcggg

SEQ ID NO: 3250560 - RNA, 19 nt, Mycobacterium tuberculosis H37Rv
cgcggccauuagcagcacc

SEQ ID NO: 3250561 - RNA, 18 nt, Mycobacterium tuberculosis H37Rv
cgcggccccgacugccgc

SEQ ID NO: 3250562 - RNA, 14 nt, Mycobacterium tuberculosis H37Rv
cgcggcccgcagcg

SEQ ID NO: 3250563 - RNA, 15 nt, Mycobacterium tuberculosis H37Rv
cgcggcccgcaucgu

SEQ ID NO: 3250564 - RNA, 14 nt, Mycobacterium tuberculosis H37Rv
cgcggcccgcgaau

SEQ ID NO: 3250565 - RNA, 13 nt, Mycobacterium tuberculosis H37Rv
cgcggcccucgau

SEQ ID NO: 3250566 - RNA, 20 nt, Mycobacterium tuberculosis H37Rv
cgcggccgagggauugccgu

SEQ ID NO: 3250567 - RNA, 15 nt, Mycobacterium tuberculosis H37Rv
cgcggccgaggucgc

SEQ ID NO: 3250568 - RNA, 16 nt, Mycobacterium tuberculosis H37Rv
cgcggccgcagccagc

SEQ ID NO: 3250569 - RNA, 17 nt, Mycobacterium tuberculosis H37Rv
cgcggccgcagccagca

SEQ ID NO: 3250570 - RNA, 17 nt, Mycobacterium tuberculosis H37Rv
cgcggccgcggugacgg

SEQ ID NO: 3250571 - RNA, 15 nt, Mycobacterium tuberculosis H37Rv
cgcggccgcucacau

SEQ ID NO: 3250572 - RNA, 16 nt, Mycobacterium tuberculosis H37Rv
cgcggccggcacgacc

SEQ ID NO: 3250573 - RNA, 15 nt, Mycobacterium tuberculosis H37Rv
cgcggccggccgccc

SEQ ID NO: 3250574 - RNA, 14 nt, Mycobacterium tuberculosis H37Rv
cgcggccggccgcu

SEQ ID NO: 3250575 - RNA, 15 nt, Mycobacterium tuberculosis H37Rv
cgcgggccgcgucga

SEQ ID NO: 3250576 - RNA, 20 nt, Mycobacterium tuberculosis H37Rv
cgcgggcgaccaccgcggca

SEQ ID NO: 3250577 - RNA, 16 nt, Mycobacterium tuberculosis H37Rv
cgcgggcggaggccgc

SEQ ID NO: 3250578 - RNA, 15 nt, Mycobacterium tuberculosis H37Rv
cgcgggcggaucgcc

SEQ ID NO: 3250579 - RNA, 13 nt, Mycobacterium tuberculosis H37Rv
cgcgggcggcgcu

SEQ ID NO: 3250580 - RNA, 22 nt, Mycobacterium tuberculosis H37Rv
cgcgggcgggguaucaaccggc

SEQ ID NO: 3250581 - RNA, 21 nt, Mycobacterium tuberculosis H37Rv
cgcgggcgugccgaccagcau

SEQ ID NO: 3250582 - RNA, 13 nt, Mycobacterium tuberculosis H37Rv
cgcgggcguugcu

SEQ ID NO: 3250583 - RNA, 21 nt, Mycobacterium tuberculosis H37Rv
cgcgggcguuggccagcaggu

SEQ ID NO: 3250584 - RNA, 21 nt, Mycobacterium tuberculosis H37Rv
cgcggggaugucgaccgcgag

SEQ ID NO: 3250585 - RNA, 22 nt, Mycobacterium tuberculosis H37Rv
cgcggggcaucggugcgguucg

SEQ ID NO: 3250586 - RNA, 14 nt, Mycobacterium tuberculosis H37Rv
cgcggggccgccgc

SEQ ID NO: 3250587 - RNA, 12 nt, Mycobacterium tuberculosis H37Rv
cgcggggccggc

SEQ ID NO: 3250588 - RNA, 22 nt, Mycobacterium tuberculosis H37Rv
cgcgggggugggcgugacgggc

SEQ ID NO: 3250589 - RNA, 16 nt, Mycobacterium tuberculosis H37Rv
cgcggggugcgcgcga

SEQ ID NO: 3250590 - RNA, 14 nt, Mycobacterium tuberculosis H37Rv
cgcgggguggcggc

SEQ ID NO: 3250591 - RNA, 12 nt, Mycobacterium tuberculosis H37Rv
cgcggguaaccg

SEQ ID NO: 3250592 - RNA, 22 nt, Mycobacterium tuberculosis H37Rv
cgcggguacuuacgggucgcgg

SEQ ID NO: 3250593 - RNA, 18 nt, Mycobacterium tuberculosis H37Rv
cgcggguccagccaccga

SEQ ID NO: 3250594 - RNA, 13 nt, Mycobacterium tuberculosis H37Rv
cgcgggucggcga

SEQ ID NO: 3250595 - RNA, 14 nt, Mycobacterium tuberculosis H37Rv
cgcgggucggcgac

SEQ ID NO: 3250596 - RNA, 19 nt, Mycobacterium tuberculosis H37Rv
cgcgggucguccggcggca

SEQ ID NO: 3250597 - RNA, 15 nt, Mycobacterium tuberculosis H37Rv
cgcgggucuuggcac

SEQ ID NO: 3250598 - RNA, 22 nt, Mycobacterium tuberculosis H37Rv
cgcgggucuuggcacacagguc

SEQ ID NO: 3250599 - RNA, 15 nt, Mycobacterium tuberculosis H37Rv
cgcgggugaccaggc

SEQ ID NO: 3250600 - RNA, 20 nt, Mycobacterium tuberculosis H37Rv
cgcgggugaugacgccgucg

SEQ ID NO: 3250601 - RNA, 16 nt, Mycobacterium tuberculosis H37Rv
cgcgggugcgccggcg

SEQ ID NO: 3250602 - RNA, 23 nt, Mycobacterium tuberculosis H37Rv
cgcgggugcgcugcagcgagacc

SEQ ID NO: 3250603 - RNA, 12 nt, Mycobacterium tuberculosis H37Rv
cgcgggugcgga

SEQ ID NO: 3250604 - RNA, 17 nt, Mycobacterium tuberculosis H37Rv
cgcgggugcggacaccg

SEQ ID NO: 3250605 - RNA, 14 nt, Mycobacterium tuberculosis H37Rv
cgcggguggcgcca

SEQ ID NO: 3250606 - RNA, 18 nt, Mycobacterium tuberculosis H37Rv
cgcggguggcgccagguc

SEQ ID NO: 3250607 - RNA, 20 nt, Mycobacterium tuberculosis H37Rv
cgcggguggcgccaggucgg

SEQ ID NO: 3250608 - RNA, 20 nt, Mycobacterium tuberculosis H37Rv
cgcggguguuccacaccagg

SEQ ID NO: 3250609 - RNA, 18 nt, Mycobacterium tuberculosis H37Rv
cgcggguugucggcgacc

SEQ ID NO: 3250610 - RNA, 19 nt, Mycobacterium tuberculosis H37Rv
cgcggguuugaucuccacc

SEQ ID NO: 3250611 - RNA, 23 nt, Mycobacterium tuberculosis H37Rv
cgcggguuugaucuccaccuucu

SEQ ID NO: 3250612 - RNA, 16 nt, Mycobacterium tuberculosis H37Rv
cgcggguuugcgguag

SEQ ID NO: 3250613 - RNA, 14 nt, Mycobacterium tuberculosis H37Rv
cgcgguaaccacgc

SEQ ID NO: 3250614 - RNA, 16 nt, Mycobacterium tuberculosis H37Rv
cgcgguaaccacgcgg

SEQ ID NO: 3250615 - RNA, 19 nt, Mycobacterium tuberculosis H37Rv
cgcgguaccaucaccgcgc

SEQ ID NO: 3250616 - RNA, 21 nt, Mycobacterium tuberculosis H37Rv
cgcgguaccaucaccgcgcca

SEQ ID NO: 3250617 - RNA, 21 nt, Mycobacterium tuberculosis H37Rv
cgcgguacccaccucccgcag

SEQ ID NO: 3250618 - RNA, 14 nt, Mycobacterium tuberculosis H37Rv
cgcgguaccgcucg

SEQ ID NO: 3250619 - RNA, 16 nt, Mycobacterium tuberculosis H37Rv
cgcgguaccgcucggg

SEQ ID NO: 3250620 - RNA, 13 nt, Mycobacterium tuberculosis H37Rv
cgcgguacgccgg

SEQ ID NO: 3250621 - RNA, 17 nt, Mycobacterium tuberculosis H37Rv
cgcgguacugcgcagcg

SEQ ID NO: 3250622 - RNA, 13 nt, Mycobacterium tuberculosis H37Rv
cgcgguagcgccg

SEQ ID NO: 3250623 - RNA, 14 nt, Mycobacterium tuberculosis H37Rv
cgcgguaggcguug

SEQ ID NO: 3250624 - RNA, 19 nt, Mycobacterium tuberculosis H37Rv
cgcggucaaauccagcagc

SEQ ID NO: 3250625 - RNA, 21 nt, Mycobacterium tuberculosis H37Rv
cgcggucagccauguccgcag

SEQ ID NO: 3250626 - RNA, 13 nt, Mycobacterium tuberculosis H37Rv
cgcggucagcggg

SEQ ID NO: 3250627 - RNA, 18 nt, Mycobacterium tuberculosis H37Rv
cgcggucagcucggcagc

SEQ ID NO: 3250628 - RNA, 19 nt, Mycobacterium tuberculosis H37Rv
cgcggucaucgagcugacc

SEQ ID NO: 3250629 - RNA, 22 nt, Mycobacterium tuberculosis H37Rv
cgcggucccacggccggccgcu

SEQ ID NO: 3250630 - RNA, 15 nt, Mycobacterium tuberculosis H37Rv
cgcggucgaccugag

SEQ ID NO: 3250631 - RNA, 15 nt, Mycobacterium tuberculosis H37Rv
cgcggucgagcaggu

SEQ ID NO: 3250632 - RNA, 19 nt, Mycobacterium tuberculosis H37Rv
cgcggucgagguggcgggc

SEQ ID NO: 3250633 - RNA, 17 nt, Mycobacterium tuberculosis H37Rv
cgcggucgaucaggccg

SEQ ID NO: 3250634 - RNA, 18 nt, Mycobacterium tuberculosis H37Rv
cgcggucgauguccgcag

SEQ ID NO: 3250635 - RNA, 13 nt, Mycobacterium tuberculosis H37Rv
cgcggucgcagca

SEQ ID NO: 3250636 - RNA, 19 nt, Mycobacterium tuberculosis H37Rv
cgcggucgccaagaucggg

SEQ ID NO: 3250637 - RNA, 13 nt, Mycobacterium tuberculosis H37Rv
cgcggucgccacc

SEQ ID NO: 3250638 - RNA, 12 nt, Mycobacterium tuberculosis H37Rv
cgcggucgcgcg

SEQ ID NO: 3250639 - RNA, 13 nt, Mycobacterium tuberculosis H37Rv
cgcggucgcgcga

SEQ ID NO: 3250640 - RNA, 14 nt, Mycobacterium tuberculosis H37Rv
cgcggucgcgcgau

SEQ ID NO: 3250641 - RNA, 15 nt, Mycobacterium tuberculosis H37Rv
cgcggucgcugauga

SEQ ID NO: 3250642 - RNA, 23 nt, Mycobacterium tuberculosis H37Rv
cgcggucgcugcgaugcugauca

SEQ ID NO: 3250643 - RNA, 19 nt, Mycobacterium tuberculosis H37Rv
cgcggucggaccacccggc

SEQ ID NO: 3250644 - RNA, 20 nt, Mycobacterium tuberculosis H37Rv
cgcggucggcagcgacgccg

SEQ ID NO: 3250645 - RNA, 12 nt, Mycobacterium tuberculosis H37Rv
cgcggucggcca

SEQ ID NO: 3250646 - RNA, 13 nt, Mycobacterium tuberculosis H37Rv
cgcggucggcgac

SEQ ID NO: 3250647 - RNA, 19 nt, Mycobacterium tuberculosis H37Rv
cgcggucucagugcucgcc

SEQ ID NO: 3250648 - RNA, 17 nt, Mycobacterium tuberculosis H37Rv
cgcggucugaccgcguc

SEQ ID NO: 3250649 - RNA, 19 nt, Mycobacterium tuberculosis H37Rv
cgcggucugcgccuucgcc

SEQ ID NO: 3250650 - RNA, 17 nt, Mycobacterium tuberculosis H37Rv
cgcggucugcgcgucgc

SEQ ID NO: 3250651 - RNA, 18 nt, Mycobacterium tuberculosis H37Rv
cgcggucugcuccaggcg

SEQ ID NO: 3250652 - RNA, 22 nt, Mycobacterium tuberculosis H37Rv
cgcggucugcuccaggcgcgcc

SEQ ID NO: 3250653 - RNA, 15 nt, Mycobacterium tuberculosis H37Rv
cgcggugacgccagc

SEQ ID NO: 3250654 - RNA, 22 nt, Mycobacterium tuberculosis H37Rv
cgcggugacucggccuccgccg

SEQ ID NO: 3250655 - RNA, 22 nt, Mycobacterium tuberculosis H37Rv
cgcggugcccgcgaacgauccc

SEQ ID NO: 3250656 - RNA, 13 nt, Mycobacterium tuberculosis H37Rv
cgcggugcccguc

SEQ ID NO: 3250657 - RNA, 13 nt, Mycobacterium tuberculosis H37Rv
cgcggugccgcca

SEQ ID NO: 3250658 - RNA, 15 nt, Mycobacterium tuberculosis H37Rv
cgcggugccgccacc

SEQ ID NO: 3250659 - RNA, 18 nt, Mycobacterium tuberculosis H37Rv
cgcggugccgccaccggc

SEQ ID NO: 3250660 - RNA, 18 nt, Mycobacterium tuberculosis H37Rv
cgcggugccggccguucg

SEQ ID NO: 3250661 - RNA, 22 nt, Mycobacterium tuberculosis H37Rv
cgcggugcgcgugacgaccagc

SEQ ID NO: 3250662 - RNA, 22 nt, Mycobacterium tuberculosis H37Rv
cgcggugcggcagauacucggc

SEQ ID NO: 3250663 - RNA, 14 nt, Mycobacterium tuberculosis H37Rv
cgcgguggaccggg

SEQ ID NO: 3250664 - RNA, 20 nt, Mycobacterium tuberculosis H37Rv
cgcgguggaugcgaugcgcg

SEQ ID NO: 3250665 - RNA, 23 nt, Mycobacterium tuberculosis H37Rv
cgcgguggaugcgaugcgcgccg

SEQ ID NO: 3250666 - RNA, 17 nt, Mycobacterium tuberculosis H37Rv
cgcgguggccaacucga

SEQ ID NO: 3250667 - RNA, 21 nt, Mycobacterium tuberculosis H37Rv
cgcgguggccaacucgacauc

SEQ ID NO: 3250668 - RNA, 13 nt, Mycobacterium tuberculosis H37Rv
cgcgguggccaga

SEQ ID NO: 3250669 - RNA, 21 nt, Mycobacterium tuberculosis H37Rv
cgcgguggccagaucgaacgc

SEQ ID NO: 3250670 - RNA, 19 nt, Mycobacterium tuberculosis H37Rv
cgcgguggcggcgagcagc

SEQ ID NO: 3250671 - RNA, 19 nt, Mycobacterium tuberculosis H37Rv
cgcgucggcguuggggcuc

SEQ ID NO: 3250672 - RNA, 20 nt, Mycobacterium tuberculosis H37Rv
cgcgucggucgacuguucgg

SEQ ID NO: 3250673 - RNA, 22 nt, Mycobacterium tuberculosis H37Rv
cgcgucguagcgcucgugaccg

SEQ ID NO: 3250674 - RNA, 14 nt, Mycobacterium tuberculosis H37Rv
cgcgucgucacgau

SEQ ID NO: 3250675 - RNA, 15 nt, Mycobacterium tuberculosis H37Rv
cgcgucgucccagug

SEQ ID NO: 3250676 - RNA, 23 nt, Mycobacterium tuberculosis H37Rv
cgcgucgucgagaaucggcauuc

SEQ ID NO: 3250677 - RNA, 18 nt, Mycobacterium tuberculosis H37Rv
cgcgucgucgagucgaca

SEQ ID NO: 3250678 - RNA, 12 nt, Mycobacterium tuberculosis H37Rv
cgcgucgucggu

SEQ ID NO: 3250679 - RNA, 17 nt, Mycobacterium tuberculosis H37Rv
cgcgucgugccacuucc

SEQ ID NO: 3250680 - RNA, 23 nt, Mycobacterium tuberculosis H37Rv
cgcgucuacgucguccagcacca

SEQ ID NO: 3250681 - RNA, 13 nt, Mycobacterium tuberculosis H37Rv
cgcgucucgagcg

SEQ ID NO: 3250682 - RNA, 12 nt, Mycobacterium tuberculosis H37Rv
cgcgucucggug

SEQ ID NO: 3250683 - RNA, 19 nt, Mycobacterium tuberculosis H37Rv
cgcgucucggugcagcagc

SEQ ID NO: 3250684 - RNA, 15 nt, Mycobacterium tuberculosis H37Rv
cgcgucugcucgcca

SEQ ID NO: 3250685 - RNA, 12 nt, Mycobacterium tuberculosis H37Rv
cgcgucugggug

SEQ ID NO: 3250686 - RNA, 14 nt, Mycobacterium tuberculosis H37Rv
cgcgucugggugca

SEQ ID NO: 3250687 - RNA, 18 nt, Mycobacterium tuberculosis H37Rv
cgcgugacagugaccugg

SEQ ID NO: 3250688 - RNA, 13 nt, Mycobacterium tuberculosis H37Rv
cgcgugaccaggg

SEQ ID NO: 3250689 - RNA, 15 nt, Mycobacterium tuberculosis H37Rv
cgcgugacgaccagc

SEQ ID NO: 3250690 - RNA, 17 nt, Mycobacterium tuberculosis H37Rv
cgcgugacgaccagccc

SEQ ID NO: 3250691 - RNA, 15 nt, Mycobacterium tuberculosis H37Rv
cgcgugagcagacgc

SEQ ID NO: 3250692 - RNA, 15 nt, Mycobacterium tuberculosis H37Rv
cgcgugcaccgagcc

SEQ ID NO: 3250693 - RNA, 15 nt, Mycobacterium tuberculosis H37Rv
cgcgugcagccccaa

SEQ ID NO: 3250694 - RNA, 14 nt, Mycobacterium tuberculosis H37Rv
cgcgugcaggcugu

SEQ ID NO: 3250695 - RNA, 13 nt, Mycobacterium tuberculosis H37Rv
cgcgugccacagc

SEQ ID NO: 3250696 - RNA, 14 nt, Mycobacterium tuberculosis H37Rv
cgcgugccacagca

SEQ ID NO: 3250697 - RNA, 16 nt, Mycobacterium tuberculosis H37Rv
cgcgugccacucgaug

SEQ ID NO: 3250698 - RNA, 14 nt, Mycobacterium tuberculosis H37Rv
cgcgugccagcgcc

SEQ ID NO: 3250699 - RNA, 21 nt, Mycobacterium tuberculosis H37Rv
cgcgugccagcgccccgcggu

SEQ ID NO: 3250700 - RNA, 12 nt, Mycobacterium tuberculosis H37Rv
cgcgugccgcaa

SEQ ID NO: 3250701 - RNA, 18 nt, Mycobacterium tuberculosis H37Rv
cgcgugcgcaucccgaag

SEQ ID NO: 3250702 - RNA, 15 nt, Mycobacterium tuberculosis H37Rv
cgcgugcggcugcca

SEQ ID NO: 3250703 - RNA, 20 nt, Mycobacterium tuberculosis H37Rv
cgcgugcggcugccagugcc

SEQ ID NO: 3250704 - RNA, 17 nt, Mycobacterium tuberculosis H37Rv
cgcgugcucgagcaccu

SEQ ID NO: 3250705 - RNA, 15 nt, Mycobacterium tuberculosis H37Rv
cgcguggaucgcgcu

SEQ ID NO: 3250706 - RNA, 17 nt, Mycobacterium tuberculosis H37Rv
cgcguggcauccagcag

SEQ ID NO: 3250707 - RNA, 18 nt, Mycobacterium tuberculosis H37Rv
cgcguggccgccggcgcu

SEQ ID NO: 3250708 - RNA, 14 nt, Mycobacterium tuberculosis H37Rv
cgcguggcgcacca

SEQ ID NO: 3250709 - RNA, 20 nt, Mycobacterium tuberculosis H37Rv
cgcgugggcgugcaggcugg

SEQ ID NO: 3250710 - RNA, 16 nt, Mycobacterium tuberculosis H37Rv
cgcguggucgccccga

SEQ ID NO: 3250711 - RNA, 21 nt, Mycobacterium tuberculosis H37Rv
cgcguggugccuacaccggca

SEQ ID NO: 3250712 - RNA, 14 nt, Mycobacterium tuberculosis H37Rv
cgcguggugcugac

SEQ ID NO: 3250713 - RNA, 20 nt, Mycobacterium tuberculosis H37Rv
cgcguggugcugaccgcgcc

SEQ ID NO: 3250714 - RNA, 20 nt, Mycobacterium tuberculosis H37Rv
cgcgugguucggucgggggc

SEQ ID NO: 3250715 - RNA, 22 nt, Mycobacterium tuberculosis H37Rv
cgcguguccuuugccaccucgg

SEQ ID NO: 3250716 - RNA, 20 nt, Mycobacterium tuberculosis H37Rv
cgcgugucugggaccccgcu

SEQ ID NO: 3250717 - RNA, 15 nt, Mycobacterium tuberculosis H37Rv
cgcgugugcgucgca

SEQ ID NO: 3250718 - RNA, 18 nt, Mycobacterium tuberculosis H37Rv
cgcgugugcgucgcacga

SEQ ID NO: 3250719 - RNA, 16 nt, Mycobacterium tuberculosis H37Rv
cgcguucaggaugcca

SEQ ID NO: 3250720 - RNA, 17 nt, Mycobacterium tuberculosis H37Rv
cgcguucaggaugccag

SEQ ID NO: 3250721 - RNA, 15 nt, Mycobacterium tuberculosis H37Rv
cgcguuccgggccgg

SEQ ID NO: 3250722 - RNA, 12 nt, Mycobacterium tuberculosis H37Rv
cgcguucgcgca

SEQ ID NO: 3250723 - RNA, 13 nt, Mycobacterium tuberculosis H37Rv
cgcguucggcgcu

SEQ ID NO: 3250724 - RNA, 14 nt, Mycobacterium tuberculosis H37Rv
cgcguucucggcac

SEQ ID NO: 3250725 - RNA, 16 nt, Mycobacterium tuberculosis H37Rv
cgcguucucggcaccc

SEQ ID NO: 3250726 - RNA, 13 nt, Mycobacterium tuberculosis H37Rv
cgcguugcacagc

SEQ ID NO: 3250727 - RNA, 19 nt, Mycobacterium tuberculosis H37Rv
cgcguugcaccauucgcac

SEQ ID NO: 3250728 - RNA, 15 nt, Mycobacterium tuberculosis H37Rv
cgcguugccaaagcc

SEQ ID NO: 3250729 - RNA, 17 nt, Mycobacterium tuberculosis H37Rv
cgcguugccaaagccca

SEQ ID NO: 3250730 - RNA, 22 nt, Mycobacterium tuberculosis H37Rv
cgcguugcguaucgacccgcgc

SEQ ID NO: 3250731 - RNA, 22 nt, Mycobacterium tuberculosis H37Rv
cgcguuggacaauucgacgaac

SEQ ID NO: 3250732 - RNA, 20 nt, Mycobacterium tuberculosis H37Rv
cgcguuggcgagguugcgcc

SEQ ID NO: 3250733 - RNA, 14 nt, Mycobacterium tuberculosis H37Rv
cgcguugggcaccu

SEQ ID NO: 3250734 - RNA, 16 nt, Mycobacterium tuberculosis H37Rv
cgcguuguaggcuucc

SEQ ID NO: 3250735 - RNA, 17 nt, Mycobacterium tuberculosis H37Rv
cgcguuguccgcggcca

SEQ ID NO: 3250736 - RNA, 20 nt, Mycobacterium tuberculosis H37Rv
cgcguuguccgcggccaacg

SEQ ID NO: 3250737 - RNA, 19 nt, Mycobacterium tuberculosis H37Rv
cgcguuucgcagccgcacc

SEQ ID NO: 3250738 - RNA, 18 nt, Mycobacterium tuberculosis H37Rv
cgcguuucgucgaccgcg

SEQ ID NO: 3250739 - RNA, 19 nt, Mycobacterium tuberculosis H37Rv
cgcguuucgucgaccgcgc

SEQ ID NO: 3250740 - RNA, 17 nt, Mycobacterium tuberculosis H37Rv
cgcuaaagcccccgaca

SEQ ID NO: 3250741 - RNA, 23 nt, Mycobacterium tuberculosis H37Rv
cgcuaaagcccccgcacgcucgg

SEQ ID NO: 3250742 - RNA, 15 nt, Mycobacterium tuberculosis H37Rv
cgcuaaagcuaaacc

SEQ ID NO: 3250743 - RNA, 20 nt, Mycobacterium tuberculosis H37Rv
cgcuaacugcuuuucgacgg

SEQ ID NO: 3250744 - RNA, 20 nt, Mycobacterium tuberculosis H37Rv
cgcuaauggauccagcccga

SEQ ID NO: 3250745 - RNA, 16 nt, Mycobacterium tuberculosis H37Rv
cgcuacaccugcggcg

SEQ ID NO: 3250746 - RNA, 17 nt, Mycobacterium tuberculosis H37Rv
cgcuacaccugcggcgu

SEQ ID NO: 3250747 - RNA, 23 nt, Mycobacterium tuberculosis H37Rv
cgcuaccagcugggcgaccacuu

SEQ ID NO: 3250748 - RNA, 15 nt, Mycobacterium tuberculosis H37Rv
cgcuaccccagccgg

SEQ ID NO: 3250749 - RNA, 12 nt, Mycobacterium tuberculosis H37Rv
cgcuacccccga

SEQ ID NO: 3250750 - RNA, 15 nt, Mycobacterium tuberculosis H37Rv
cgcuacccccgaugg

SEQ ID NO: 3250751 - RNA, 12 nt, Mycobacterium tuberculosis H37Rv
cgcuacccgcgc

SEQ ID NO: 3250752 - RNA, 19 nt, Mycobacterium tuberculosis H37Rv
cgcuacccggacagggcgg

SEQ ID NO: 3250753 - RNA, 23 nt, Mycobacterium tuberculosis H37Rv
cgcuaccgaacaguaggccuccg

SEQ ID NO: 3250754 - RNA, 16 nt, Mycobacterium tuberculosis H37Rv
cgcuaccgcccgcgcc

SEQ ID NO: 3250755 - RNA, 20 nt, Mycobacterium tuberculosis H37Rv
cgcuaccgcccgcgccaccg

SEQ ID NO: 3250756 - RNA, 13 nt, Mycobacterium tuberculosis H37Rv
cgcuaccgccgga

SEQ ID NO: 3250757 - RNA, 22 nt, Mycobacterium tuberculosis H37Rv
cgcuaccgucaguagccacgcc

SEQ ID NO: 3250758 - RNA, 18 nt, Mycobacterium tuberculosis H37Rv
cgcuaccuucuuggcugc

SEQ ID NO: 3250759 - RNA, 21 nt, Mycobacterium tuberculosis H37Rv
cgcuacgcaacgggucggguc

SEQ ID NO: 3250760 - RNA, 17 nt, Mycobacterium tuberculosis H37Rv
cgcuacgcgcgcucgcu

SEQ ID NO: 3250761 - RNA, 13 nt, Mycobacterium tuberculosis H37Rv
cgcuacgcggccg

SEQ ID NO: 3250762 - RNA, 17 nt, Mycobacterium tuberculosis H37Rv
cgcuacgucgaccgacg

SEQ ID NO: 3250763 - RNA, 20 nt, Mycobacterium tuberculosis H37Rv
cgcuagccagggaucagccg

SEQ ID NO: 3250764 - RNA, 21 nt, Mycobacterium tuberculosis H37Rv
cgcuagccgacagcucaucga

SEQ ID NO: 3250765 - RNA, 23 nt, Mycobacterium tuberculosis H37Rv
cgcuagccggcucaucgcagccg

SEQ ID NO: 3250766 - RNA, 17 nt, Mycobacterium tuberculosis H37Rv
cgcuagccgggcgcgcc

SEQ ID NO: 3250767 - RNA, 15 nt, Mycobacterium tuberculosis H37Rv
cgcuagcgccgcgcu

SEQ ID NO: 3250768 - RNA, 12 nt, Mycobacterium tuberculosis H37Rv
cgcucgcggcgg

SEQ ID NO: 3250769 - RNA, 17 nt, Mycobacterium tuberculosis H37Rv
cgcucgcggcggcgcug

SEQ ID NO: 3250770 - RNA, 16 nt, Mycobacterium tuberculosis H37Rv
cgcucgcucaccggcg

SEQ ID NO: 3250771 - RNA, 13 nt, Mycobacterium tuberculosis H37Rv
cgcucggcagccg

SEQ ID NO: 3250772 - RNA, 18 nt, Mycobacterium tuberculosis H37Rv
cgcucggcagccggcuug

SEQ ID NO: 3250773 - RNA, 24 nt, Mycobacterium tuberculosis H37Rv
cgcucggcauggauacgcagcacc

SEQ ID NO: 3250774 - RNA, 18 nt, Mycobacterium tuberculosis H37Rv
cgcucggccagcaucagc

SEQ ID NO: 3250775 - RNA, 16 nt, Mycobacterium tuberculosis H37Rv
cgcucggcgcgcgggu

SEQ ID NO: 3250776 - RNA, 15 nt, Mycobacterium tuberculosis H37Rv
cgcucggcggccagc

SEQ ID NO: 3250777 - RNA, 14 nt, Mycobacterium tuberculosis H37Rv
cgcucggcguagcg

SEQ ID NO: 3250778 - RNA, 17 nt, Mycobacterium tuberculosis H37Rv
cgcucggcguccgccca

SEQ ID NO: 3250779 - RNA, 19 nt, Mycobacterium tuberculosis H37Rv
cgcucggcguccgcccagc

SEQ ID NO: 3250780 - RNA, 19 nt, Mycobacterium tuberculosis H37Rv
cgcucgggcaacgccucga

SEQ ID NO: 3250781 - RNA, 14 nt, Mycobacterium tuberculosis H37Rv
cgcucgggcccagc

SEQ ID NO: 3250782 - RNA, 17 nt, Mycobacterium tuberculosis H37Rv
cgcucgggcgagaucuu

SEQ ID NO: 3250783 - RNA, 20 nt, Mycobacterium tuberculosis H37Rv
cgcucgggggauccggcgca

SEQ ID NO: 3250784 - RNA, 18 nt, Mycobacterium tuberculosis H37Rv
cgcucgggguugcucgcg

SEQ ID NO: 3250785 - RNA, 17 nt, Mycobacterium tuberculosis H37Rv
cgcucggucgccaccgc

SEQ ID NO: 3250786 - RNA, 21 nt, Mycobacterium tuberculosis H37Rv
cgcucggucgccaccgccggc

SEQ ID NO: 3250787 - RNA, 23 nt, Mycobacterium tuberculosis H37Rv
cgcucggucgccaccgccggcag

SEQ ID NO: 3250788 - RNA, 22 nt, Mycobacterium tuberculosis H37Rv
cgcucggucuccaccaccgacg

SEQ ID NO: 3250789 - RNA, 22 nt, Mycobacterium tuberculosis H37Rv
cgcucggugcugcgccgauacg

SEQ ID NO: 3250790 - RNA, 18 nt, Mycobacterium tuberculosis H37Rv
cgcucgguucggagucac

SEQ ID NO: 3250791 - RNA, 20 nt, Mycobacterium tuberculosis H37Rv
cgcucgguuugcguccuggu

SEQ ID NO: 3250792 - RNA, 21 nt, Mycobacterium tuberculosis H37Rv
cgcucgguuugcguccuggug

SEQ ID NO: 3250793 - RNA, 16 nt, Mycobacterium tuberculosis H37Rv
cgcucguagaaccggg

SEQ ID NO: 3250794 - RNA, 19 nt, Mycobacterium tuberculosis H37Rv
cgcucguagaaucggcuca

SEQ ID NO: 3250795 - RNA, 16 nt, Mycobacterium tuberculosis H37Rv
cgcucguagacuuccu

SEQ ID NO: 3250796 - RNA, 12 nt, Mycobacterium tuberculosis H37Rv
cgcucgucgaca

SEQ ID NO: 3250797 - RNA, 15 nt, Mycobacterium tuberculosis H37Rv
cgcucgucguccggc

SEQ ID NO: 3250798 - RNA, 18 nt, Mycobacterium tuberculosis H37Rv
cgcucgugacgaucagcg

SEQ ID NO: 3250799 - RNA, 16 nt, Mycobacterium tuberculosis H37Rv
cgcucguggucgacgu

SEQ ID NO: 3250800 - RNA, 20 nt, Mycobacterium tuberculosis H37Rv
cgcucguggucgacgugauc

SEQ ID NO: 3250801 - RNA, 18 nt, Mycobacterium tuberculosis H37Rv
cgcucguuacgccgagca

SEQ ID NO: 3250802 - RNA, 13 nt, Mycobacterium tuberculosis H37Rv
cgcucguugcguu

SEQ ID NO: 3250803 - RNA, 19 nt, Mycobacterium tuberculosis H37Rv
cgcucguugcguugcauca

SEQ ID NO: 3250804 - RNA, 21 nt, Mycobacterium tuberculosis H37Rv
cgcucguugcguugcaucagc

SEQ ID NO: 3250805 - RNA, 13 nt, Mycobacterium tuberculosis H37Rv
cgcucuagcgucg

SEQ ID NO: 3250806 - RNA, 18 nt, Mycobacterium tuberculosis H37Rv
cgcucucauagcgacggc

SEQ ID NO: 3250807 - RNA, 23 nt, Mycobacterium tuberculosis H37Rv
cgcucugcgccacagcagcguug

SEQ ID NO: 3250808 - RNA, 15 nt, Mycobacterium tuberculosis H37Rv
cgcucugcggccacg

SEQ ID NO: 3250809 - RNA, 12 nt, Mycobacterium tuberculosis H37Rv
cgcucuggcucc

SEQ ID NO: 3250810 - RNA, 13 nt, Mycobacterium tuberculosis H37Rv
cgcucugugucgc

SEQ ID NO: 3250811 - RNA, 22 nt, Mycobacterium tuberculosis H37Rv
cgcucugugucgccgaucaccg

SEQ ID NO: 3250812 - RNA, 18 nt, Mycobacterium tuberculosis H37Rv
cgcucuucgauggguagc

SEQ ID NO: 3250813 - RNA, 22 nt, Mycobacterium tuberculosis H37Rv
cgcugaacgcuguaagcaugcc

SEQ ID NO: 3250814 - RNA, 14 nt, Mycobacterium tuberculosis H37Rv
cgcugaacucaacg

SEQ ID NO: 3250815 - RNA, 21 nt, Mycobacterium tuberculosis H37Rv
cgcugaagccaaaugcgcugu

SEQ ID NO: 3250816 - RNA, 16 nt, Mycobacterium tuberculosis H37Rv
cgcugaagccgcugga

SEQ ID NO: 3250817 - RNA, 17 nt, Mycobacterium tuberculosis H37Rv
cgcugaaguggcacaag

SEQ ID NO: 3250818 - RNA, 19 nt, Mycobacterium tuberculosis H37Rv
cgcugaaucaccccggcgg

SEQ ID NO: 3250819 - RNA, 14 nt, Mycobacterium tuberculosis H37Rv
cgcugacacccacg

SEQ ID NO: 3250820 - RNA, 16 nt, Mycobacterium tuberculosis H37Rv
cgcugacacccacggc

SEQ ID NO: 3250821 - RNA, 17 nt, Mycobacterium tuberculosis H37Rv
cgcugaccccggcagcg

SEQ ID NO: 3250822 - RNA, 20 nt, Mycobacterium tuberculosis H37Rv
cgcugaccguuucgaucucg

SEQ ID NO: 3250823 - RNA, 21 nt, Mycobacterium tuberculosis H37Rv
cgcugaccguuucgaucucga

SEQ ID NO: 3250824 - RNA, 22 nt, Mycobacterium tuberculosis H37Rv
cgcugaccuuguugaccaccac

SEQ ID NO: 3250825 - RNA, 19 nt, Mycobacterium tuberculosis H37Rv
cgcugaccuuuucccgcag

SEQ ID NO: 3250826 - RNA, 21 nt, Mycobacterium tuberculosis H37Rv
cgcugaccuuuucccgcaggc

SEQ ID NO: 3250827 - RNA, 17 nt, Mycobacterium tuberculosis H37Rv
cgcugacgcccuccugg

SEQ ID NO: 3250828 - RNA, 22 nt, Mycobacterium tuberculosis H37Rv
cgcugacgcccuccuggcgggu

SEQ ID NO: 3250829 - RNA, 15 nt, Mycobacterium tuberculosis H37Rv
cgcugacggccaugg

SEQ ID NO: 3250830 - RNA, 14 nt, Mycobacterium tuberculosis H37Rv
cgcugacuccugcg

SEQ ID NO: 3250831 - RNA, 20 nt, Mycobacterium tuberculosis H37Rv
cgcugagcacggcgcggcgg

SEQ ID NO: 3250832 - RNA, 22 nt, Mycobacterium tuberculosis H37Rv
cgcugagcacggcgcggcggag

SEQ ID NO: 3250833 - RNA, 16 nt, Mycobacterium tuberculosis H37Rv
cgcugagcagcgccgc

SEQ ID NO: 3250834 - RNA, 18 nt, Mycobacterium tuberculosis H37Rv
cgcugagcagcgccgcgu

SEQ ID NO: 3250835 - RNA, 22 nt, Mycobacterium tuberculosis H37Rv
cgcugagccccccgagcccgcc

SEQ ID NO: 3250836 - RNA, 18 nt, Mycobacterium tuberculosis H37Rv
cgcugagcgacugcagcg

SEQ ID NO: 3250837 - RNA, 18 nt, Mycobacterium tuberculosis H37Rv
cgcugagcgggcaacugc

SEQ ID NO: 3250838 - RNA, 20 nt, Mycobacterium tuberculosis H37Rv
cgcugagcucgaugucagcg

SEQ ID NO: 3250839 - RNA, 17 nt, Mycobacterium tuberculosis H37Rv
cgcugaggaagcggcgg

SEQ ID NO: 3250840 - RNA, 18 nt, Mycobacterium tuberculosis H37Rv
cgcugaggaagcggcggc

SEQ ID NO: 3250841 - RNA, 21 nt, Mycobacterium tuberculosis H37Rv
cgcugagguaauucgcggccc

SEQ ID NO: 3250842 - RNA, 17 nt, Mycobacterium tuberculosis H37Rv
cgcugaguccccaggug

SEQ ID NO: 3250843 - RNA, 19 nt, Mycobacterium tuberculosis H37Rv
cgcugaucagauccucgac

SEQ ID NO: 3250844 - RNA, 20 nt, Mycobacterium tuberculosis H37Rv
cgcugaucagauccucgacu

SEQ ID NO: 3250845 - RNA, 14 nt, Mycobacterium tuberculosis H37Rv
cgcugauccacgau

SEQ ID NO: 3250846 - RNA, 15 nt, Mycobacterium tuberculosis H37Rv
cgcugauccacgaua

SEQ ID NO: 3250847 - RNA, 13 nt, Mycobacterium tuberculosis H37Rv
cgcugaucucggu

SEQ ID NO: 3250848 - RNA, 17 nt, Mycobacterium tuberculosis H37Rv
cgcugaucugccgccgc

SEQ ID NO: 3250849 - RNA, 21 nt, Mycobacterium tuberculosis H37Rv
cgcugaucuuccccucggccg

SEQ ID NO: 3250850 - RNA, 20 nt, Mycobacterium tuberculosis H37Rv
cgcugaugagccgcagaugc

SEQ ID NO: 3250851 - RNA, 16 nt, Mycobacterium tuberculosis H37Rv
cgcugaugcaucccaa

SEQ ID NO: 3250852 - RNA, 16 nt, Mycobacterium tuberculosis H37Rv
cgcugauggugcugcg

SEQ ID NO: 3250853 - RNA, 21 nt, Mycobacterium tuberculosis H37Rv
cgcugcaaccgccggugccga

SEQ ID NO: 3250854 - RNA, 22 nt, Mycobacterium tuberculosis H37Rv
cgcugcaaccgccggugccgau

SEQ ID NO: 3250855 - RNA, 16 nt, Mycobacterium tuberculosis H37Rv
cgcugcacguggccac

SEQ ID NO: 3250856 - RNA, 18 nt, Mycobacterium tuberculosis H37Rv
cgcugcagacgccccuuc

SEQ ID NO: 3250857 - RNA, 22 nt, Mycobacterium tuberculosis H37Rv
cgcugcagauggaaccucggcg

SEQ ID NO: 3250858 - RNA, 20 nt, Mycobacterium tuberculosis H37Rv
cgcugcagcaggucgaugcu

SEQ ID NO: 3250859 - RNA, 19 nt, Mycobacterium tuberculosis H37Rv
cgcugcagcucacgacugg

SEQ ID NO: 3250860 - RNA, 21 nt, Mycobacterium tuberculosis H37Rv
cgcugcaggcggccgagcugg

SEQ ID NO: 3250861 - RNA, 18 nt, Mycobacterium tuberculosis H37Rv
cgcugcagugguaccggc

SEQ ID NO: 3250862 - RNA, 14 nt, Mycobacterium tuberculosis H37Rv
cgcugcauccgcag

SEQ ID NO: 3250863 - RNA, 21 nt, Mycobacterium tuberculosis H37Rv
cgcugcauccgcagcaccaag

SEQ ID NO: 3250864 - RNA, 15 nt, Mycobacterium tuberculosis H37Rv
cgcugggaggcggcg

SEQ ID NO: 3250865 - RNA, 20 nt, Mycobacterium tuberculosis H37Rv
cgcugggauguucgaucagc

SEQ ID NO: 3250866 - RNA, 16 nt, Mycobacterium tuberculosis H37Rv
cgcugggcacucggcc

SEQ ID NO: 3250867 - RNA, 15 nt, Mycobacterium tuberculosis H37Rv
cgcugggcccaggag

SEQ ID NO: 3250868 - RNA, 18 nt, Mycobacterium tuberculosis H37Rv
cgcugggcccaggagauc

SEQ ID NO: 3250869 - RNA, 16 nt, Mycobacterium tuberculosis H37Rv
cgcugggcccaucgcg

SEQ ID NO: 3250870 - RNA, 19 nt, Mycobacterium tuberculosis H37Rv
cgcugggcccgagcgcgcg

SEQ ID NO: 3250871 - RNA, 15 nt, Mycobacterium tuberculosis H37Rv
cgcuggguggcgggc

SEQ ID NO: 3250872 - RNA, 19 nt, Mycobacterium tuberculosis H37Rv
cgcugguaguguucagcuu

SEQ ID NO: 3250873 - RNA, 19 nt, Mycobacterium tuberculosis H37Rv
cgcugguauagcucacggu

SEQ ID NO: 3250874 - RNA, 14 nt, Mycobacterium tuberculosis H37Rv
cgcuggucgagcag

SEQ ID NO: 3250875 - RNA, 18 nt, Mycobacterium tuberculosis H37Rv
cgcuggucgagcagugcc

SEQ ID NO: 3250876 - RNA, 17 nt, Mycobacterium tuberculosis H37Rv
cgcuggucgaugccuuc

SEQ ID NO: 3250877 - RNA, 15 nt, Mycobacterium tuberculosis H37Rv
cgcuggucgcaaugg

SEQ ID NO: 3250878 - RNA, 16 nt, Mycobacterium tuberculosis H37Rv
cgcuggucggcggcuu

SEQ ID NO: 3250879 - RNA, 16 nt, Mycobacterium tuberculosis H37Rv
cgcuggucguggcggu

SEQ ID NO: 3250880 - RNA, 18 nt, Mycobacterium tuberculosis H37Rv
cgcuggugcgccacgcca

SEQ ID NO: 3250881 - RNA, 13 nt, Mycobacterium tuberculosis H37Rv
cgcugguggcggc

SEQ ID NO: 3250882 - RNA, 19 nt, Mycobacterium tuberculosis H37Rv
cgcuggugggaucgcagcg

SEQ ID NO: 3250883 - RNA, 19 nt, Mycobacterium tuberculosis H37Rv
cgcugguggucagcaccca

SEQ ID NO: 3250884 - RNA, 14 nt, Mycobacterium tuberculosis H37Rv
cgcugguuggcacg

SEQ ID NO: 3250885 - RNA, 18 nt, Mycobacterium tuberculosis H37Rv
cgcuguaagcaugccguu

SEQ ID NO: 3250886 - RNA, 20 nt, Mycobacterium tuberculosis H37Rv
cgcuguccacugccaccgcg

SEQ ID NO: 3250887 - RNA, 13 nt, Mycobacterium tuberculosis H37Rv
cgcuguccagguc

SEQ ID NO: 3250888 - RNA, 21 nt, Mycobacterium tuberculosis H37Rv
cgcuguccgcgugaaucccca

SEQ ID NO: 3250889 - RNA, 17 nt, Mycobacterium tuberculosis H37Rv
cgcugucgcccucgauc

SEQ ID NO: 3250890 - RNA, 17 nt, Mycobacterium tuberculosis H37Rv
cgcugugauagcgccgu

SEQ ID NO: 3250891 - RNA, 16 nt, Mycobacterium tuberculosis H37Rv
cgcugugggucgaucc

SEQ ID NO: 3250892 - RNA, 14 nt, Mycobacterium tuberculosis H37Rv
cgcuguuccucgag

SEQ ID NO: 3250893 - RNA, 15 nt, Mycobacterium tuberculosis H37Rv
cgcuguugaagccgc

SEQ ID NO: 3250894 - RNA, 15 nt, Mycobacterium tuberculosis H37Rv
cgcuguugccaucga

SEQ ID NO: 3250895 - RNA, 21 nt, Mycobacterium tuberculosis H37Rv
cgcuguugccaucgacgccgc

SEQ ID NO: 3250896 - RNA, 13 nt, Mycobacterium tuberculosis H37Rv
cgcuguuguuguc

SEQ ID NO: 3250897 - RNA, 15 nt, Mycobacterium tuberculosis H37Rv
cgcuucacgggccgu

SEQ ID NO: 3250898 - RNA, 24 nt, Mycobacterium tuberculosis H37Rv
cgcuucacgggccguccaggacgg

SEQ ID NO: 3250899 - RNA, 15 nt, Mycobacterium tuberculosis H37Rv
cgcuuccaucgccac

SEQ ID NO: 3250900 - RNA, 15 nt, Mycobacterium tuberculosis H37Rv
cgcuuccguggccca

SEQ ID NO: 3250901 - RNA, 15 nt, Mycobacterium tuberculosis H37Rv
cgcuuccucguaggc

SEQ ID NO: 3250902 - RNA, 16 nt, Mycobacterium tuberculosis H37Rv
cgcuucgccacaccau

SEQ ID NO: 3250903 - RNA, 19 nt, Mycobacterium tuberculosis H37Rv
cgcuucgccacaccaugau

SEQ ID NO: 3250904 - RNA, 18 nt, Mycobacterium tuberculosis H37Rv
cgcuucgcccggcugcgc

SEQ ID NO: 3250905 - RNA, 22 nt, Mycobacterium tuberculosis H37Rv
cgcuucggcaccgacugcuguc

SEQ ID NO: 3250906 - RNA, 21 nt, Mycobacterium tuberculosis H37Rv
cgcuucggcagcucccgccac

SEQ ID NO: 3250907 - RNA, 17 nt, Mycobacterium tuberculosis H37Rv
cgcuucggcggucgccg

SEQ ID NO: 3250908 - RNA, 22 nt, Mycobacterium tuberculosis H37Rv
cgcuucguccagcgaucccggu

SEQ ID NO: 3250909 - RNA, 23 nt, Mycobacterium tuberculosis H37Rv
cgcuucgucgccgaacagcgacg

SEQ ID NO: 3250910 - RNA, 16 nt, Mycobacterium tuberculosis H37Rv
cgcuucuuccgcgcgc

SEQ ID NO: 3250911 - RNA, 18 nt, Mycobacterium tuberculosis H37Rv
cgcuugaaagcgugaagu

SEQ ID NO: 3250912 - RNA, 15 nt, Mycobacterium tuberculosis H37Rv
cgcuugaugccggcc

SEQ ID NO: 3250913 - RNA, 13 nt, Mycobacterium tuberculosis H37Rv
cgcuugcaccagg

SEQ ID NO: 3250914 - RNA, 22 nt, Mycobacterium tuberculosis H37Rv
cgcuugcaccaggggcgcguca

SEQ ID NO: 3250915 - RNA, 18 nt, Mycobacterium tuberculosis H37Rv
cgcuugccccgccgagca

SEQ ID NO: 3250916 - RNA, 23 nt, Mycobacterium tuberculosis H37Rv
cgcuugccccgccgagcaccggg

SEQ ID NO: 3250917 - RNA, 20 nt, Mycobacterium tuberculosis H37Rv
cgcuugccccgccuuggcca

SEQ ID NO: 3250918 - RNA, 19 nt, Mycobacterium tuberculosis H37Rv
cgcuugcgaccccggcugc

SEQ ID NO: 3250919 - RNA, 18 nt, Mycobacterium tuberculosis H37Rv
cgcuugcgaucggcacuu

SEQ ID NO: 3250920 - RNA, 12 nt, Mycobacterium tuberculosis H37Rv
cgcuugcgcggc

SEQ ID NO: 3250921 - RNA, 13 nt, Mycobacterium tuberculosis H37Rv
cgcuugcgcggcu

SEQ ID NO: 3250922 - RNA, 14 nt, Mycobacterium tuberculosis H37Rv
cgcuugcggccgcg

SEQ ID NO: 3250923 - RNA, 15 nt, Mycobacterium tuberculosis H37Rv
cgcuugcucucgcag

SEQ ID NO: 3250924 - RNA, 18 nt, Mycobacterium tuberculosis H37Rv
cgcuugcucucgcagcau

SEQ ID NO: 3250925 - RNA, 23 nt, Mycobacterium tuberculosis H37Rv
cgcuugcugcauguccuccccga

SEQ ID NO: 3250926 - RNA, 18 nt, Mycobacterium tuberculosis H37Rv
cgcuugcuggguaguuca

SEQ ID NO: 3250927 - RNA, 23 nt, Mycobacterium tuberculosis H37Rv
cgcuuggagcggguccccaccgg

SEQ ID NO: 3250928 - RNA, 22 nt, Mycobacterium tuberculosis H37Rv
cgcuuggcaaucaucucccgac

SEQ ID NO: 3250929 - RNA, 20 nt, Mycobacterium tuberculosis H37Rv
cgcuuggccgcugccuucuu

SEQ ID NO: 3250930 - RNA, 19 nt, Mycobacterium tuberculosis H37Rv
cgcuuggccggauccucga

SEQ ID NO: 3250931 - RNA, 18 nt, Mycobacterium tuberculosis H37Rv
cgcuuggccuaugcugcc

SEQ ID NO: 3250932 - RNA, 16 nt, Mycobacterium tuberculosis H37Rv
cgcuuggcgugaccua

SEQ ID NO: 3250933 - RNA, 22 nt, Mycobacterium tuberculosis H37Rv
cgcuuguugaccucacgggcgc

SEQ ID NO: 3250934 - RNA, 13 nt, Mycobacterium tuberculosis H37Rv
cgcuuucuuggcg

SEQ ID NO: 3250935 - RNA, 14 nt, Mycobacterium tuberculosis H37Rv
cgcuuugcacagcg

SEQ ID NO: 3250936 - RNA, 21 nt, Mycobacterium tuberculosis H37Rv
cgcuuugggcugccguuagcu

SEQ ID NO: 3250937 - RNA, 15 nt, Mycobacterium tuberculosis H37Rv
cggaaacccggccgc

SEQ ID NO: 3250938 - RNA, 14 nt, Mycobacterium tuberculosis H37Rv
cggaaagaucucgg

SEQ ID NO: 3250939 - RNA, 18 nt, Mycobacterium tuberculosis H37Rv
cggaaagcccgucgucgg

SEQ ID NO: 3250940 - RNA, 18 nt, Mycobacterium tuberculosis H37Rv
cggaaagccuaguacgcc

SEQ ID NO: 3250941 - RNA, 21 nt, Mycobacterium tuberculosis H37Rv
cggaaaggccgcggugauggg

SEQ ID NO: 3250942 - RNA, 22 nt, Mycobacterium tuberculosis H37Rv
cggaaaggccgcggugaugggc

SEQ ID NO: 3250943 - RNA, 13 nt, Mycobacterium tuberculosis H37Rv
cggaaaucggacg

SEQ ID NO: 3250944 - RNA, 14 nt, Mycobacterium tuberculosis H37Rv
cggaaauuccaagc

SEQ ID NO: 3250945 - RNA, 20 nt, Mycobacterium tuberculosis H37Rv
cggaacaccgacgacaccag

SEQ ID NO: 3250946 - RNA, 20 nt, Mycobacterium tuberculosis H37Rv
cggaacacgaugcgcggugc

SEQ ID NO: 3250947 - RNA, 13 nt, Mycobacterium tuberculosis H37Rv
cggaacaucguca

SEQ ID NO: 3250948 - RNA, 19 nt, Mycobacterium tuberculosis H37Rv
cggaaccaguugacgaaga

SEQ ID NO: 3250949 - RNA, 18 nt, Mycobacterium tuberculosis H37Rv
cggaaccgauaccucgcc

SEQ ID NO: 3250950 - RNA, 19 nt, Mycobacterium tuberculosis H37Rv
cggaaccgauaccucgcca

SEQ ID NO: 3250951 - RNA, 13 nt, Mycobacterium tuberculosis H37Rv
cggaaccggacag

SEQ ID NO: 3250952 - RNA, 15 nt, Mycobacterium tuberculosis H37Rv
cggaaccggacagcg

SEQ ID NO: 3250953 - RNA, 13 nt, Mycobacterium tuberculosis H37Rv
cggaaccggcgug

SEQ ID NO: 3250954 - RNA, 19 nt, Mycobacterium tuberculosis H37Rv
cggaaccggcgugcagcac

SEQ ID NO: 3250955 - RNA, 16 nt, Mycobacterium tuberculosis H37Rv
cggaaccgguaucgcc

SEQ ID NO: 3250956 - RNA, 21 nt, Mycobacterium tuberculosis H37Rv
cggaaccggucagccggacca

SEQ ID NO: 3250957 - RNA, 20 nt, Mycobacterium tuberculosis H37Rv
cggaacgccgagcacgccga

SEQ ID NO: 3250958 - RNA, 19 nt, Mycobacterium tuberculosis H37Rv
cggaacgccuaacgcguag

SEQ ID NO: 3250959 - RNA, 20 nt, Mycobacterium tuberculosis H37Rv
cggaacgccuaacgcguagc

SEQ ID NO: 3250960 - RNA, 19 nt, Mycobacterium tuberculosis H37Rv
cggacgcaacucgacgcgu

SEQ ID NO: 3250961 - RNA, 22 nt, Mycobacterium tuberculosis H37Rv
cggacgcaacucgacgcguagc

SEQ ID NO: 3250962 - RNA, 21 nt, Mycobacterium tuberculosis H37Rv
cggacgccaugcccgcacgcu

SEQ ID NO: 3250963 - RNA, 22 nt, Mycobacterium tuberculosis H37Rv
cggacgccgacaaccuuggcga

SEQ ID NO: 3250964 - RNA, 17 nt, Mycobacterium tuberculosis H37Rv
cggacgcgggugccaga

SEQ ID NO: 3250965 - RNA, 22 nt, Mycobacterium tuberculosis H37Rv
cggacgcgggugccagaucggc

SEQ ID NO: 3250966 - RNA, 13 nt, Mycobacterium tuberculosis H37Rv
cggacgcugauug

SEQ ID NO: 3250967 - RNA, 23 nt, Mycobacterium tuberculosis H37Rv
cggacggagguccuacgugcugc

SEQ ID NO: 3250968 - RNA, 22 nt, Mycobacterium tuberculosis H37Rv
cggacggcguuuccuucgacga

SEQ ID NO: 3250969 - RNA, 18 nt, Mycobacterium tuberculosis H37Rv
cggacgggaugcuugguc

SEQ ID NO: 3250970 - RNA, 18 nt, Mycobacterium tuberculosis H37Rv
cggacguaggcaccccgg

SEQ ID NO: 3250971 - RNA, 15 nt, Mycobacterium tuberculosis H37Rv
cggacgugacgucgu

SEQ ID NO: 3250972 - RNA, 14 nt, Mycobacterium tuberculosis H37Rv
cggacucagcggcg

SEQ ID NO: 3250973 - RNA, 14 nt, Mycobacterium tuberculosis H37Rv
cggacucccucgau

SEQ ID NO: 3250974 - RNA, 15 nt, Mycobacterium tuberculosis H37Rv
cggacucccucgauc

SEQ ID NO: 3250975 - RNA, 20 nt, Mycobacterium tuberculosis H37Rv
cggacucggaauucggcguc

SEQ ID NO: 3250976 - RNA, 22 nt, Mycobacterium tuberculosis H37Rv
cggacucggaauucggcgucgu

SEQ ID NO: 3250977 - RNA, 22 nt, Mycobacterium tuberculosis H37Rv
cggacucguucauguagcagcg

SEQ ID NO: 3250978 - RNA, 14 nt, Mycobacterium tuberculosis H37Rv
cggacugacgucga

SEQ ID NO: 3250979 - RNA, 12 nt, Mycobacterium tuberculosis H37Rv
cggacugcagcg

SEQ ID NO: 3250980 - RNA, 15 nt, Mycobacterium tuberculosis H37Rv
cggacugcagcgcgg

SEQ ID NO: 3250981 - RNA, 18 nt, Mycobacterium tuberculosis H37Rv
cggacugcggcccgaccc

SEQ ID NO: 3250982 - RNA, 13 nt, Mycobacterium tuberculosis H37Rv
cggacuucgccgc

SEQ ID NO: 3250983 - RNA, 17 nt, Mycobacterium tuberculosis H37Rv
cggacuucgccgcccgc

SEQ ID NO: 3250984 - RNA, 17 nt, Mycobacterium tuberculosis H37Rv
cggacuugaccagagca

SEQ ID NO: 3250985 - RNA, 21 nt, Mycobacterium tuberculosis H37Rv
cggacuugcgagccguagacc

SEQ ID NO: 3250986 - RNA, 19 nt, Mycobacterium tuberculosis H37Rv
cggacuuggcggucgguuc

SEQ ID NO: 3250987 - RNA, 17 nt, Mycobacterium tuberculosis H37Rv
cggagaaaagcgcgcua

SEQ ID NO: 3250988 - RNA, 21 nt, Mycobacterium tuberculosis H37Rv
cggagaacgcgucgcgcgccu

SEQ ID NO: 3250989 - RNA, 18 nt, Mycobacterium tuberculosis H37Rv
cggagaacuugagcuccu

SEQ ID NO: 3250990 - RNA, 20 nt, Mycobacterium tuberculosis H37Rv
cggagaaggcgcgggcgacg

SEQ ID NO: 3250991 - RNA, 22 nt, Mycobacterium tuberculosis H37Rv
cggagaaguucgugagcgaacg

SEQ ID NO: 3250992 - RNA, 20 nt, Mycobacterium tuberculosis H37Rv
cggagaauuccgcuagguca

SEQ ID NO: 3250993 - RNA, 15 nt, Mycobacterium tuberculosis H37Rv
cggagacacccgcca

SEQ ID NO: 3250994 - RNA, 13 nt, Mycobacterium tuberculosis H37Rv
cggagaccagcgu

SEQ ID NO: 3250995 - RNA, 15 nt, Mycobacterium tuberculosis H37Rv
cggagaccagcgucu

SEQ ID NO: 3250996 - RNA, 14 nt, Mycobacterium tuberculosis H37Rv
cggagacgaucgcc

SEQ ID NO: 3250997 - RNA, 16 nt, Mycobacterium tuberculosis H37Rv
cggagacgaucgccag

SEQ ID NO: 3250998 - RNA, 15 nt, Mycobacterium tuberculosis H37Rv
cggagacggcggcca

SEQ ID NO: 3250999 - RNA, 19 nt, Mycobacterium tuberculosis H37Rv
cggagacggcggccauguu

SEQ ID NO: 3251000 - RNA, 19 nt, Mycobacterium tuberculosis H37Rv
cggagacuccagcaaggcc

SEQ ID NO: 3251001 - RNA, 23 nt, Mycobacterium tuberculosis H37Rv
cggagacucucugaucugagacc

SEQ ID NO: 3251002 - RNA, 14 nt, Mycobacterium tuberculosis H37Rv
cggagacugguugc

SEQ ID NO: 3251003 - RNA, 20 nt, Mycobacterium tuberculosis H37Rv
cggagagccugcucgcagcg

SEQ ID NO: 3251004 - RNA, 18 nt, Mycobacterium tuberculosis H37Rv
cggagaguaggaccucgg

SEQ ID NO: 3251005 - RNA, 18 nt, Mycobacterium tuberculosis H37Rv
cggagaucauggcgagcg

SEQ ID NO: 3251006 - RNA, 18 nt, Mycobacterium tuberculosis H37Rv
cggagaucgagaucaccu

SEQ ID NO: 3251007 - RNA, 22 nt, Mycobacterium tuberculosis H37Rv
cggagaucgucgcguagugaug

SEQ ID NO: 3251008 - RNA, 19 nt, Mycobacterium tuberculosis H37Rv
cggagaugacaaucucggc

SEQ ID NO: 3251009 - RNA, 21 nt, Mycobacterium tuberculosis H37Rv
cggagaugccauuucgucguc

SEQ ID NO: 3251010 - RNA, 19 nt, Mycobacterium tuberculosis H37Rv
cggagcaauuccacgaucg

SEQ ID NO: 3251011 - RNA, 24 nt, Mycobacterium tuberculosis H37Rv
cggagcaauuccacgaucggcuca

SEQ ID NO: 3251012 - RNA, 10 nt, Mycobacterium tuberculosis H37Rv
cggagccaga

SEQ ID NO: 3251013 - RNA, 12 nt, Mycobacterium tuberculosis H37Rv
cggagccaggac

SEQ ID NO: 3251014 - RNA, 13 nt, Mycobacterium tuberculosis H37Rv
cggagccaggacg

SEQ ID NO: 3251015 - RNA, 22 nt, Mycobacterium tuberculosis H37Rv
cggagccaggacgacgccgacg

SEQ ID NO: 3251016 - RNA, 18 nt, Mycobacterium tuberculosis H37Rv
cggagcccaaaaccgcga

SEQ ID NO: 3251017 - RNA, 19 nt, Mycobacterium tuberculosis H37Rv
cggagcccgacucuccggc

SEQ ID NO: 3251018 - RNA, 20 nt, Mycobacterium tuberculosis H37Rv
cggagcccugaccgggguga

SEQ ID NO: 3251019 - RNA, 17 nt, Mycobacterium tuberculosis H37Rv
cggagccgaacccaagg

SEQ ID NO: 3251020 - RNA, 16 nt, Mycobacterium tuberculosis H37Rv
cggagccgaugaucga

SEQ ID NO: 3251021 - RNA, 19 nt, Mycobacterium tuberculosis H37Rv
cggagccgaugaucgaaca

SEQ ID NO: 3251022 - RNA, 21 nt, Mycobacterium tuberculosis H37Rv
cggagccgaugaucgaacacg

SEQ ID NO: 3251023 - RNA, 22 nt, Mycobacterium tuberculosis H37Rv
cggagccgccaggugcucgucg

SEQ ID NO: 3251024 - RNA, 23 nt, Mycobacterium tuberculosis H37Rv
cggagccgccaggugcucgucga

SEQ ID NO: 3251025 - RNA, 20 nt, Mycobacterium tuberculosis H37Rv
cggagccgcccaagccgccg

SEQ ID NO: 3251026 - RNA, 17 nt, Mycobacterium tuberculosis H37Rv
cggagccgccgacucgg

SEQ ID NO: 3251027 - RNA, 14 nt, Mycobacterium tuberculosis H37Rv
cggagccgccgcug

SEQ ID NO: 3251028 - RNA, 18 nt, Mycobacterium tuberculosis H37Rv
cggagccgccgcuggucu

SEQ ID NO: 3251029 - RNA, 15 nt, Mycobacterium tuberculosis H37Rv
cggagccggccaccu

SEQ ID NO: 3251030 - RNA, 16 nt, Mycobacterium tuberculosis H37Rv
cggagccggccaccuc

SEQ ID NO: 3251031 - RNA, 13 nt, Mycobacterium tuberculosis H37Rv
cggagccggguga

SEQ ID NO: 3251032 - RNA, 19 nt, Mycobacterium tuberculosis H37Rv
cggagccgggugaggcggg

SEQ ID NO: 3251033 - RNA, 20 nt, Mycobacterium tuberculosis H37Rv
cggagccggugccgacggcg

SEQ ID NO: 3251034 - RNA, 12 nt, Mycobacterium tuberculosis H37Rv
cggagccgucgc

SEQ ID NO: 3251035 - RNA, 13 nt, Mycobacterium tuberculosis H37Rv
cggagcgaugcgg

SEQ ID NO: 3251036 - RNA, 16 nt, Mycobacterium tuberculosis H37Rv
cggagcgaugcgggca

SEQ ID NO: 3251037 - RNA, 15 nt, Mycobacterium tuberculosis H37Rv
cggagcggugccgac

SEQ ID NO: 3251038 - RNA, 20 nt, Mycobacterium tuberculosis H37Rv
cggagcggugccgacgguga

SEQ ID NO: 3251039 - RNA, 20 nt, Mycobacterium tuberculosis H37Rv
cggagcucaaccaccucgcc

SEQ ID NO: 3251040 - RNA, 19 nt, Mycobacterium tuberculosis H37Rv
cggagcucuugcgggcagc

SEQ ID NO: 3251041 - RNA, 15 nt, Mycobacterium tuberculosis H37Rv
cggaggaaccccgcg

SEQ ID NO: 3251042 - RNA, 15 nt, Mycobacterium tuberculosis H37Rv
cggaggcaauccgau

SEQ ID NO: 3251043 - RNA, 17 nt, Mycobacterium tuberculosis H37Rv
cggaggcaauccgaucu

SEQ ID NO: 3251044 - RNA, 19 nt, Mycobacterium tuberculosis H37Rv
cggaggccgccgcgccggu

SEQ ID NO: 3251045 - RNA, 21 nt, Mycobacterium tuberculosis H37Rv
cggaggccuccacauacgcgg

SEQ ID NO: 3251046 - RNA, 23 nt, Mycobacterium tuberculosis H37Rv
cggaggcgaccacgucggcgaac

SEQ ID NO: 3251047 - RNA, 13 nt, Mycobacterium tuberculosis H37Rv
cggaggcggacca

SEQ ID NO: 3251048 - RNA, 12 nt, Mycobacterium tuberculosis H37Rv
cggaggcggcca

SEQ ID NO: 3251049 - RNA, 15 nt, Mycobacterium tuberculosis H37Rv
cggaggcggcuccug

SEQ ID NO: 3251050 - RNA, 16 nt, Mycobacterium tuberculosis H37Rv
cggaggcugggcugag

SEQ ID NO: 3251051 - RNA, 17 nt, Mycobacterium tuberculosis H37Rv
cggaggcugggcugagg

SEQ ID NO: 3251052 - RNA, 20 nt, Mycobacterium tuberculosis H37Rv
cggaggguucggacggcugg

SEQ ID NO: 3251053 - RNA, 21 nt, Mycobacterium tuberculosis H37Rv
cggaggucggagcgggcuccg

SEQ ID NO: 3251054 - RNA, 18 nt, Mycobacterium tuberculosis H37Rv
cggaggucgggcggcgac

SEQ ID NO: 3251055 - RNA, 19 nt, Mycobacterium tuberculosis H37Rv
cggaggugggguggggagc

SEQ ID NO: 3251056 - RNA, 17 nt, Mycobacterium tuberculosis H37Rv
cggauguccgccgacgu

SEQ ID NO: 3251057 - RNA, 13 nt, Mycobacterium tuberculosis H37Rv
cggaugucgacga

SEQ ID NO: 3251058 - RNA, 18 nt, Mycobacterium tuberculosis H37Rv
cggaugucgacgagcacc

SEQ ID NO: 3251059 - RNA, 21 nt, Mycobacterium tuberculosis H37Rv
cggaugucgucgaccaggcca

SEQ ID NO: 3251060 - RNA, 22 nt, Mycobacterium tuberculosis H37Rv
cggaugucgugcgggcgcacca

SEQ ID NO: 3251061 - RNA, 22 nt, Mycobacterium tuberculosis H37Rv
cggauguggugucgaugccgau

SEQ ID NO: 3251062 - RNA, 17 nt, Mycobacterium tuberculosis H37Rv
cggauguguucuccugc

SEQ ID NO: 3251063 - RNA, 20 nt, Mycobacterium tuberculosis H37Rv
cggauguugaccggcucgau

SEQ ID NO: 3251064 - RNA, 22 nt, Mycobacterium tuberculosis H37Rv
cggauguugaccggcucgaucu

SEQ ID NO: 3251065 - RNA, 21 nt, Mycobacterium tuberculosis H37Rv
cggauucacgcacaagccucg

SEQ ID NO: 3251066 - RNA, 14 nt, Mycobacterium tuberculosis H37Rv
cggauuccagcgcg

SEQ ID NO: 3251067 - RNA, 19 nt, Mycobacterium tuberculosis H37Rv
cggauucccgcccagcagc

SEQ ID NO: 3251068 - RNA, 18 nt, Mycobacterium tuberculosis H37Rv
cggauuccggcucgucag

SEQ ID NO: 3251069 - RNA, 18 nt, Mycobacterium tuberculosis H37Rv
cggauuccucgucaccgc

SEQ ID NO: 3251070 - RNA, 14 nt, Mycobacterium tuberculosis H37Rv
cggauucgaaggca

SEQ ID NO: 3251071 - RNA, 17 nt, Mycobacterium tuberculosis H37Rv
cggauucggcugccacc

SEQ ID NO: 3251072 - RNA, 12 nt, Mycobacterium tuberculosis H37Rv
cggauucgggcg

SEQ ID NO: 3251073 - RNA, 20 nt, Mycobacterium tuberculosis H37Rv
cggauucgggcgaagcuagc

SEQ ID NO: 3251074 - RNA, 14 nt, Mycobacterium tuberculosis H37Rv
cggauucuccgccc

SEQ ID NO: 3251075 - RNA, 18 nt, Mycobacterium tuberculosis H37Rv
cggauucuucggugaaga

SEQ ID NO: 3251076 - RNA, 14 nt, Mycobacterium tuberculosis H37Rv
cggauugacgccga

SEQ ID NO: 3251077 - RNA, 13 nt, Mycobacterium tuberculosis H37Rv
cggauugcagcgc

SEQ ID NO: 3251078 - RNA, 17 nt, Mycobacterium tuberculosis H37Rv
cggauugcucgaucugu

SEQ ID NO: 3251079 - RNA, 23 nt, Mycobacterium tuberculosis H37Rv
cggauuggugggccagcagcaac

SEQ ID NO: 3251080 - RNA, 17 nt, Mycobacterium tuberculosis H37Rv
cggcaaaacacaccgaa

SEQ ID NO: 3251081 - RNA, 21 nt, Mycobacterium tuberculosis H37Rv
cggcaaaccugaguccggcac

SEQ ID NO: 3251082 - RNA, 15 nt, Mycobacterium tuberculosis H37Rv
cggcaaacgcgcagg

SEQ ID NO: 3251083 - RNA, 19 nt, Mycobacterium tuberculosis H37Rv
cggcaaacgcgcaggucag

SEQ ID NO: 3251084 - RNA, 14 nt, Mycobacterium tuberculosis H37Rv
cggcaaacuccagc

SEQ ID NO: 3251085 - RNA, 14 nt, Mycobacterium tuberculosis H37Rv
cggcaaagccgggu

SEQ ID NO: 3251086 - RNA, 12 nt, Mycobacterium tuberculosis H37Rv
cggcaaaggcgc

SEQ ID NO: 3251087 - RNA, 17 nt, Mycobacterium tuberculosis H37Rv
cggcaacaaagucgcca

SEQ ID NO: 3251088 - RNA, 14 nt, Mycobacterium tuberculosis H37Rv
cggcaacaccaccu

SEQ ID NO: 3251089 - RNA, 13 nt, Mycobacterium tuberculosis H37Rv
cggcaacaucagc

SEQ ID NO: 3251090 - RNA, 20 nt, Mycobacterium tuberculosis H37Rv
cggcaacaucgagcgccagc

SEQ ID NO: 3251091 - RNA, 19 nt, Mycobacterium tuberculosis H37Rv
cggcaacaugagcgucgcu

SEQ ID NO: 3251092 - RNA, 13 nt, Mycobacterium tuberculosis H37Rv
cggcaaccagcga

SEQ ID NO: 3251093 - RNA, 15 nt, Mycobacterium tuberculosis H37Rv
cggcaaccagcgagc

SEQ ID NO: 3251094 - RNA, 14 nt, Mycobacterium tuberculosis H37Rv
cggcaacccacacg

SEQ ID NO: 3251095 - RNA, 21 nt, Mycobacterium tuberculosis H37Rv
cggcaacgaucgacaccaggg

SEQ ID NO: 3251096 - RNA, 23 nt, Mycobacterium tuberculosis H37Rv
cggcaacgaucgacaccagggcg

SEQ ID NO: 3251097 - RNA, 17 nt, Mycobacterium tuberculosis H37Rv
cggcaacgccuccggag

SEQ ID NO: 3251098 - RNA, 17 nt, Mycobacterium tuberculosis H37Rv
cggcaacgcggucugcu

SEQ ID NO: 3251099 - RNA, 23 nt, Mycobacterium tuberculosis H37Rv
cggcaacgcggucugcuccaggc

SEQ ID NO: 3251100 - RNA, 21 nt, Mycobacterium tuberculosis H37Rv
cggcaacguuuacgaugcuca

SEQ ID NO: 3251101 - RNA, 17 nt, Mycobacterium tuberculosis H37Rv
cggcaagacgcggucga

SEQ ID NO: 3251102 - RNA, 13 nt, Mycobacterium tuberculosis H37Rv
cggcaagauccgg

SEQ ID NO: 3251103 - RNA, 17 nt, Mycobacterium tuberculosis H37Rv
cggcaagcacaccgcca

SEQ ID NO: 3251104 - RNA, 17 nt, Mycobacterium tuberculosis H37Rv
cggcaagccaaccagcc

SEQ ID NO: 3251105 - RNA, 20 nt, Mycobacterium tuberculosis H37Rv
cggcaagcgcagacacgacc

SEQ ID NO: 3251106 - RNA, 21 nt, Mycobacterium tuberculosis H37Rv
cggcaagcgcagacacgaccc

SEQ ID NO: 3251107 - RNA, 14 nt, Mycobacterium tuberculosis H37Rv
cggcaagcucgacg

SEQ ID NO: 3251108 - RNA, 18 nt, Mycobacterium tuberculosis H37Rv
cggcaaggacguggcgcu

SEQ ID NO: 3251109 - RNA, 15 nt, Mycobacterium tuberculosis H37Rv
cggcaagggcuucgg

SEQ ID NO: 3251110 - RNA, 17 nt, Mycobacterium tuberculosis H37Rv
cggcaaggucgcggcca

SEQ ID NO: 3251111 - RNA, 18 nt, Mycobacterium tuberculosis H37Rv
cggcaaggucgcggccag

SEQ ID NO: 3251112 - RNA, 14 nt, Mycobacterium tuberculosis H37Rv
cggcaagucgacgc

SEQ ID NO: 3251113 - RNA, 14 nt, Mycobacterium tuberculosis H37Rv
cggcaaguuccacg

SEQ ID NO: 3251114 - RNA, 13 nt, Mycobacterium tuberculosis H37Rv
cggcaauaccgcc

SEQ ID NO: 3251115 - RNA, 18 nt, Mycobacterium tuberculosis H37Rv
cggcaauacuccgcugac

SEQ ID NO: 3251116 - RNA, 21 nt, Mycobacterium tuberculosis H37Rv
cggcaaucgacucagcccggc

SEQ ID NO: 3251117 - RNA, 17 nt, Mycobacterium tuberculosis H37Rv
cggcaaucgggucugga

SEQ ID NO: 3251118 - RNA, 23 nt, Mycobacterium tuberculosis H37Rv
cggcaaugcacaaaaaccgaccg

SEQ ID NO: 3251119 - RNA, 15 nt, Mycobacterium tuberculosis H37Rv
cggcaauggccagca

SEQ ID NO: 3251120 - RNA, 18 nt, Mycobacterium tuberculosis H37Rv
cggcaauucgggcauggu

SEQ ID NO: 3251121 - RNA, 19 nt, Mycobacterium tuberculosis H37Rv
cggcaauucgggcaugguc

SEQ ID NO: 3251122 - RNA, 23 nt, Mycobacterium tuberculosis H37Rv
cggcacaaucggauagccgugcu

SEQ ID NO: 3251123 - RNA, 14 nt, Mycobacterium tuberculosis H37Rv
cggcacaaucggcg

SEQ ID NO: 3251124 - RNA, 15 nt, Mycobacterium tuberculosis H37Rv
cggcacaaucggcgc

SEQ ID NO: 3251125 - RNA, 16 nt, Mycobacterium tuberculosis H37Rv
cggcacacccaucacc

SEQ ID NO: 3251126 - RNA, 18 nt, Mycobacterium tuberculosis H37Rv
cggcacacccaucaccgc

SEQ ID NO: 3251127 - RNA, 19 nt, Mycobacterium tuberculosis H37Rv
cggcacacccaucaccgcc

SEQ ID NO: 3251128 - RNA, 23 nt, Mycobacterium tuberculosis H37Rv
cggcacacccaucagcccucggc

SEQ ID NO: 3251129 - RNA, 20 nt, Mycobacterium tuberculosis H37Rv
cggcacaccccgguucgacg

SEQ ID NO: 3251130 - RNA, 23 nt, Mycobacterium tuberculosis H37Rv
cggcacacccuccacagcggcca

SEQ ID NO: 3251131 - RNA, 23 nt, Mycobacterium tuberculosis H37Rv
cggcacaggcggccagcaucgcg

SEQ ID NO: 3251132 - RNA, 16 nt, Mycobacterium tuberculosis H37Rv
cggcacaucaugggcg

SEQ ID NO: 3251133 - RNA, 23 nt, Mycobacterium tuberculosis H37Rv
cggcacaucaugggcgcugccaa

SEQ ID NO: 3251134 - RNA, 21 nt, Mycobacterium tuberculosis H37Rv
cggcacauugaucgacggcca

SEQ ID NO: 3251135 - RNA, 22 nt, Mycobacterium tuberculosis H37Rv
cggcacauugaucgacggccag

SEQ ID NO: 3251136 - RNA, 22 nt, Mycobacterium tuberculosis H37Rv
cggcaccacagugaaauccgag

SEQ ID NO: 3251137 - RNA, 11 nt, Mycobacterium tuberculosis H37Rv
cggcaccacca

SEQ ID NO: 3251138 - RNA, 19 nt, Mycobacterium tuberculosis H37Rv
cggcaccaccgcgaccucg

SEQ ID NO: 3251139 - RNA, 20 nt, Mycobacterium tuberculosis H37Rv
cggcaccaccgcgaccucgc

SEQ ID NO: 3251140 - RNA, 14 nt, Mycobacterium tuberculosis H37Rv
cggcaccaccguug

SEQ ID NO: 3251141 - RNA, 17 nt, Mycobacterium tuberculosis H37Rv
cggcaccaccguugccg

SEQ ID NO: 3251142 - RNA, 14 nt, Mycobacterium tuberculosis H37Rv
cggcaccacgauca

SEQ ID NO: 3251143 - RNA, 14 nt, Mycobacterium tuberculosis H37Rv
cggcaccacgucga

SEQ ID NO: 3251144 - RNA, 14 nt, Mycobacterium tuberculosis H37Rv
cggcaccagcaccg

SEQ ID NO: 3251145 - RNA, 17 nt, Mycobacterium tuberculosis H37Rv
cggcaccagguugccga

SEQ ID NO: 3251146 - RNA, 14 nt, Mycobacterium tuberculosis H37Rv
cggcaccauagcug

SEQ ID NO: 3251147 - RNA, 22 nt, Mycobacterium tuberculosis H37Rv
cggcacccaauccggcgccagc

SEQ ID NO: 3251148 - RNA, 14 nt, Mycobacterium tuberculosis H37Rv
cggcacccaccagu

SEQ ID NO: 3251149 - RNA, 18 nt, Mycobacterium tuberculosis H37Rv
cggcacccacccguucgg

SEQ ID NO: 3251150 - RNA, 19 nt, Mycobacterium tuberculosis H37Rv
cggcacccacccguucggc

SEQ ID NO: 3251151 - RNA, 16 nt, Mycobacterium tuberculosis H37Rv
cggcacccagucggcg

SEQ ID NO: 3251152 - RNA, 14 nt, Mycobacterium tuberculosis H37Rv
cggcagcagcggug

SEQ ID NO: 3251153 - RNA, 19 nt, Mycobacterium tuberculosis H37Rv
cggcagcagcggugcagcc

SEQ ID NO: 3251154 - RNA, 23 nt, Mycobacterium tuberculosis H37Rv
cggcagcagcggugcagcccgcc

SEQ ID NO: 3251155 - RNA, 19 nt, Mycobacterium tuberculosis H37Rv
cggcagcaggacaccuacc

SEQ ID NO: 3251156 - RNA, 15 nt, Mycobacterium tuberculosis H37Rv
cggcagcauccucga

SEQ ID NO: 3251157 - RNA, 21 nt, Mycobacterium tuberculosis H37Rv
cggcagcaucggcaccccggc

SEQ ID NO: 3251158 - RNA, 13 nt, Mycobacterium tuberculosis H37Rv
cggcagcaucggu

SEQ ID NO: 3251159 - RNA, 14 nt, Mycobacterium tuberculosis H37Rv
cggcagcauggcca

SEQ ID NO: 3251160 - RNA, 12 nt, Mycobacterium tuberculosis H37Rv
cggcagccacca

SEQ ID NO: 3251161 - RNA, 17 nt, Mycobacterium tuberculosis H37Rv
cggcagccaccagcgac

SEQ ID NO: 3251162 - RNA, 20 nt, Mycobacterium tuberculosis H37Rv
cggcagccaccagcgacgac

SEQ ID NO: 3251163 - RNA, 13 nt, Mycobacterium tuberculosis H37Rv
cggcagccaccgu

SEQ ID NO: 3251164 - RNA, 21 nt, Mycobacterium tuberculosis H37Rv
cggcagccagccaccggggaa

SEQ ID NO: 3251165 - RNA, 20 nt, Mycobacterium tuberculosis H37Rv
cggcagcccaaagcgccagc

SEQ ID NO: 3251166 - RNA, 16 nt, Mycobacterium tuberculosis H37Rv
cggcagccccugccga

SEQ ID NO: 3251167 - RNA, 13 nt, Mycobacterium tuberculosis H37Rv
cggcagccggcgg

SEQ ID NO: 3251168 - RNA, 17 nt, Mycobacterium tuberculosis H37Rv
cggcagccuugaucucg

SEQ ID NO: 3251169 - RNA, 19 nt, Mycobacterium tuberculosis H37Rv
cggcagcgacgccggcccg

SEQ ID NO: 3251170 - RNA, 15 nt, Mycobacterium tuberculosis H37Rv
cggcagcgagaaccc

SEQ ID NO: 3251171 - RNA, 13 nt, Mycobacterium tuberculosis H37Rv
cggcagcgagacu

SEQ ID NO: 3251172 - RNA, 20 nt, Mycobacterium tuberculosis H37Rv
cggcagcgagacuucgacgc

SEQ ID NO: 3251173 - RNA, 18 nt, Mycobacterium tuberculosis H37Rv
cggcagcgaggccauguu

SEQ ID NO: 3251174 - RNA, 21 nt, Mycobacterium tuberculosis H37Rv
cggcagcgaucggggcgguga

SEQ ID NO: 3251175 - RNA, 22 nt, Mycobacterium tuberculosis H37Rv
cggcagcgaucggggcggugac

SEQ ID NO: 3251176 - RNA, 19 nt, Mycobacterium tuberculosis H37Rv
cggcagcgcccuuggacgc

SEQ ID NO: 3251177 - RNA, 11 nt, Mycobacterium tuberculosis H37Rv
cggcagcgcgg

SEQ ID NO: 3251178 - RNA, 18 nt, Mycobacterium tuberculosis H37Rv
cggcagcgcggaugucgg

SEQ ID NO: 3251179 - RNA, 17 nt, Mycobacterium tuberculosis H37Rv
cggcagcgcggccaauu

SEQ ID NO: 3251180 - RNA, 21 nt, Mycobacterium tuberculosis H37Rv
cggcagcggaccgcugccugc

SEQ ID NO: 3251181 - RNA, 14 nt, Mycobacterium tuberculosis H37Rv
cggcagcggcgauc

SEQ ID NO: 3251182 - RNA, 13 nt, Mycobacterium tuberculosis H37Rv
cggcagcggcgcc

SEQ ID NO: 3251183 - RNA, 15 nt, Mycobacterium tuberculosis H37Rv
cggcagcggcgcgcu

SEQ ID NO: 3251184 - RNA, 17 nt, Mycobacterium tuberculosis H37Rv
cggcagcggcgcgcugc

SEQ ID NO: 3251185 - RNA, 18 nt, Mycobacterium tuberculosis H37Rv
cggcagcggcgcgcugca

SEQ ID NO: 3251186 - RNA, 20 nt, Mycobacterium tuberculosis H37Rv
cggcagcggguuugccgggc

SEQ ID NO: 3251187 - RNA, 20 nt, Mycobacterium tuberculosis H37Rv
cggcagcguccgaaccaccu

SEQ ID NO: 3251188 - RNA, 15 nt, Mycobacterium tuberculosis H37Rv
cggcagcucccgcca

SEQ ID NO: 3251189 - RNA, 18 nt, Mycobacterium tuberculosis H37Rv
cggcagcucccgccacgu

SEQ ID NO: 3251190 - RNA, 20 nt, Mycobacterium tuberculosis H37Rv
cggcagcucccgccacgucg

SEQ ID NO: 3251191 - RNA, 14 nt, Mycobacterium tuberculosis H37Rv
cggcagcuggcgca

SEQ ID NO: 3251192 - RNA, 16 nt, Mycobacterium tuberculosis H37Rv
cggcagcuggcgcagc

SEQ ID NO: 3251193 - RNA, 13 nt, Mycobacterium tuberculosis H37Rv
cggcagcuggggc

SEQ ID NO: 3251194 - RNA, 21 nt, Mycobacterium tuberculosis H37Rv
cggcagcuggggcccggccgc

SEQ ID NO: 3251195 - RNA, 17 nt, Mycobacterium tuberculosis H37Rv
cggcagcuucucgccga

SEQ ID NO: 3251196 - RNA, 19 nt, Mycobacterium tuberculosis H37Rv
cggcagcuucucgccgacg

SEQ ID NO: 3251197 - RNA, 19 nt, Mycobacterium tuberculosis H37Rv
cggcaggaaucgggucagc

SEQ ID NO: 3251198 - RNA, 17 nt, Mycobacterium tuberculosis H37Rv
cggcaggaaugccgcgg

SEQ ID NO: 3251199 - RNA, 20 nt, Mycobacterium tuberculosis H37Rv
cggcaggauucccucgacag

SEQ ID NO: 3251200 - RNA, 15 nt, Mycobacterium tuberculosis H37Rv
cggcaggcagggcag

SEQ ID NO: 3251201 - RNA, 21 nt, Mycobacterium tuberculosis H37Rv
cggcaggcccgacggcgccca

SEQ ID NO: 3251202 - RNA, 16 nt, Mycobacterium tuberculosis H37Rv
cggcaggcggccgccg

SEQ ID NO: 3251203 - RNA, 17 nt, Mycobacterium tuberculosis H37Rv
cggcaggcggccgccgg

SEQ ID NO: 3251204 - RNA, 18 nt, Mycobacterium tuberculosis H37Rv
cggcaggcggccgccggg

SEQ ID NO: 3251205 - RNA, 20 nt, Mycobacterium tuberculosis H37Rv
cggcaggcuggcgagggcug

SEQ ID NO: 3251206 - RNA, 16 nt, Mycobacterium tuberculosis H37Rv
cggcagggcccccagu

SEQ ID NO: 3251207 - RNA, 14 nt, Mycobacterium tuberculosis H37Rv
cggcagggccugga

SEQ ID NO: 3251208 - RNA, 15 nt, Mycobacterium tuberculosis H37Rv
cggcagggccuggaa

SEQ ID NO: 3251209 - RNA, 15 nt, Mycobacterium tuberculosis H37Rv
cggcagggcggugcc

SEQ ID NO: 3251210 - RNA, 16 nt, Mycobacterium tuberculosis H37Rv
cggcagggcggugcca

SEQ ID NO: 3251211 - RNA, 16 nt, Mycobacterium tuberculosis H37Rv
cggcaggugcccaucg

SEQ ID NO: 3251212 - RNA, 22 nt, Mycobacterium tuberculosis H37Rv
cggcaggugcggcggcaucggu

SEQ ID NO: 3251213 - RNA, 15 nt, Mycobacterium tuberculosis H37Rv
cggcaggugcgguca

SEQ ID NO: 3251214 - RNA, 20 nt, Mycobacterium tuberculosis H37Rv
cggcaggugcggucaaagga

SEQ ID NO: 3251215 - RNA, 19 nt, Mycobacterium tuberculosis H37Rv
cggcagucccagcgccgca

SEQ ID NO: 3251216 - RNA, 16 nt, Mycobacterium tuberculosis H37Rv
cggcagugagucggug

SEQ ID NO: 3251217 - RNA, 18 nt, Mycobacterium tuberculosis H37Rv
cggcaguucgcggccauc

SEQ ID NO: 3251218 - RNA, 23 nt, Mycobacterium tuberculosis H37Rv
cggcaguucgcggccaucgccga

SEQ ID NO: 3251219 - RNA, 18 nt, Mycobacterium tuberculosis H37Rv
cggcauaacccuggccgg

SEQ ID NO: 3251220 - RNA, 14 nt, Mycobacterium tuberculosis H37Rv
cggcauacaacugg

SEQ ID NO: 3251221 - RNA, 20 nt, Mycobacterium tuberculosis H37Rv
cggcauaccgaacagcaccu

SEQ ID NO: 3251222 - RNA, 19 nt, Mycobacterium tuberculosis H37Rv
cggcauagcagccagcguc

SEQ ID NO: 3251223 - RNA, 14 nt, Mycobacterium tuberculosis H37Rv
cggcauagcggccc

SEQ ID NO: 3251224 - RNA, 18 nt, Mycobacterium tuberculosis H37Rv
cggcauagcggcccaucg

SEQ ID NO: 3251225 - RNA, 16 nt, Mycobacterium tuberculosis H37Rv
cggcauagcgggucag

SEQ ID NO: 3251226 - RNA, 20 nt, Mycobacterium tuberculosis H37Rv
cggcauaucgauucgggcgu

SEQ ID NO: 3251227 - RNA, 23 nt, Mycobacterium tuberculosis H37Rv
cggcauaucgauucgggcgucgg

SEQ ID NO: 3251228 - RNA, 23 nt, Mycobacterium tuberculosis H37Rv
cggcaucaacgcgggcgcuugcc

SEQ ID NO: 3251229 - RNA, 18 nt, Mycobacterium tuberculosis H37Rv
cggcauccacaccgaccg

SEQ ID NO: 3251230 - RNA, 23 nt, Mycobacterium tuberculosis H37Rv
cggcauccucugaaccugcugag

SEQ ID NO: 3251231 - RNA, 17 nt, Mycobacterium tuberculosis H37Rv
cggcauccugcacgacc

SEQ ID NO: 3251232 - RNA, 21 nt, Mycobacterium tuberculosis H37Rv
cggcaucgacgcggccaacga

SEQ ID NO: 3251233 - RNA, 17 nt, Mycobacterium tuberculosis H37Rv
cggcaucgacugccagc

SEQ ID NO: 3251234 - RNA, 20 nt, Mycobacterium tuberculosis H37Rv
cggcaucgagacgcacggcc

SEQ ID NO: 3251235 - RNA, 13 nt, Mycobacterium tuberculosis H37Rv
cggcaucgaggcc

SEQ ID NO: 3251236 - RNA, 17 nt, Mycobacterium tuberculosis H37Rv
cggcaucgaggccagca

SEQ ID NO: 3251237 - RNA, 12 nt, Mycobacterium tuberculosis H37Rv
cggcaucgauca

SEQ ID NO: 3251238 - RNA, 15 nt, Mycobacterium tuberculosis H37Rv
cggcaucgccgagcu

SEQ ID NO: 3251239 - RNA, 20 nt, Mycobacterium tuberculosis H37Rv
cggcaucgccgagguggaca

SEQ ID NO: 3251240 - RNA, 13 nt, Mycobacterium tuberculosis H37Rv
cggcaucgcgggc

SEQ ID NO: 3251241 - RNA, 18 nt, Mycobacterium tuberculosis H37Rv
cggcaucgcgggcggcgc

SEQ ID NO: 3251242 - RNA, 21 nt, Mycobacterium tuberculosis H37Rv
cggcaucggagauacgggcca

SEQ ID NO: 3251243 - RNA, 13 nt, Mycobacterium tuberculosis H37Rv
cggcaucggccac

SEQ ID NO: 3251244 - RNA, 15 nt, Mycobacterium tuberculosis H37Rv
cggcaucggccaccu

SEQ ID NO: 3251245 - RNA, 13 nt, Mycobacterium tuberculosis H37Rv
cggcaucgggggc

SEQ ID NO: 3251246 - RNA, 16 nt, Mycobacterium tuberculosis H37Rv
cggcaucggugguaac

SEQ ID NO: 3251247 - RNA, 19 nt, Mycobacterium tuberculosis H37Rv
cggcaucgucgacgauguc

SEQ ID NO: 3251248 - RNA, 15 nt, Mycobacterium tuberculosis H37Rv
cggccacgagucgca

SEQ ID NO: 3251249 - RNA, 13 nt, Mycobacterium tuberculosis H37Rv
cggccacgccgau

SEQ ID NO: 3251250 - RNA, 14 nt, Mycobacterium tuberculosis H37Rv
cggccacgccgaug

SEQ ID NO: 3251251 - RNA, 19 nt, Mycobacterium tuberculosis H37Rv
cggccacgguagaacacgu

SEQ ID NO: 3251252 - RNA, 17 nt, Mycobacterium tuberculosis H37Rv
cggccacggucagccag

SEQ ID NO: 3251253 - RNA, 21 nt, Mycobacterium tuberculosis H37Rv
cggccacggucagccaggugu

SEQ ID NO: 3251254 - RNA, 15 nt, Mycobacterium tuberculosis H37Rv
cggccacgguccggc

SEQ ID NO: 3251255 - RNA, 21 nt, Mycobacterium tuberculosis H37Rv
cggccacgguggagcgcgccu

SEQ ID NO: 3251256 - RNA, 17 nt, Mycobacterium tuberculosis H37Rv
cggccacgguggcgcaa

SEQ ID NO: 3251257 - RNA, 13 nt, Mycobacterium tuberculosis H37Rv
cggccacguuguc

SEQ ID NO: 3251258 - RNA, 19 nt, Mycobacterium tuberculosis H37Rv
cggccacugauucgcaggc

SEQ ID NO: 3251259 - RNA, 20 nt, Mycobacterium tuberculosis H37Rv
cggccacugauucgcaggcu

SEQ ID NO: 3251260 - RNA, 19 nt, Mycobacterium tuberculosis H37Rv
cggccagaaacccggcgac

SEQ ID NO: 3251261 - RNA, 12 nt, Mycobacterium tuberculosis H37Rv
cggccagacggu

SEQ ID NO: 3251262 - RNA, 16 nt, Mycobacterium tuberculosis H37Rv
cggccagacggugcag

SEQ ID NO: 3251263 - RNA, 13 nt, Mycobacterium tuberculosis H37Rv
cggccagagccgc

SEQ ID NO: 3251264 - RNA, 17 nt, Mycobacterium tuberculosis H37Rv
cggccagagccgcgcgc

SEQ ID NO: 3251265 - RNA, 21 nt, Mycobacterium tuberculosis H37Rv
cggccagauagguuccaccgg

SEQ ID NO: 3251266 - RNA, 21 nt, Mycobacterium tuberculosis H37Rv
cggccagcaagugcgggcugu

SEQ ID NO: 3251267 - RNA, 18 nt, Mycobacterium tuberculosis H37Rv
cggccagcagcagugcca

SEQ ID NO: 3251268 - RNA, 23 nt, Mycobacterium tuberculosis H37Rv
cggccagcagcagugccaccggu

SEQ ID NO: 3251269 - RNA, 14 nt, Mycobacterium tuberculosis H37Rv
cggccagcaggaug

SEQ ID NO: 3251270 - RNA, 22 nt, Mycobacterium tuberculosis H37Rv
cggccagcaggaugaugaccgc

SEQ ID NO: 3251271 - RNA, 20 nt, Mycobacterium tuberculosis H37Rv
cggccagcaucagcucgaug

SEQ ID NO: 3251272 - RNA, 18 nt, Mycobacterium tuberculosis H37Rv
cggccagcaucgcggugg

SEQ ID NO: 3251273 - RNA, 18 nt, Mycobacterium tuberculosis H37Rv
cggccagccauggcagcg

SEQ ID NO: 3251274 - RNA, 18 nt, Mycobacterium tuberculosis H37Rv
cggccagccgacgcggcg

SEQ ID NO: 3251275 - RNA, 16 nt, Mycobacterium tuberculosis H37Rv
cggccagccgcacggu

SEQ ID NO: 3251276 - RNA, 20 nt, Mycobacterium tuberculosis H37Rv
cggccagccgcacgguugcc

SEQ ID NO: 3251277 - RNA, 13 nt, Mycobacterium tuberculosis H37Rv
cggccagccgcuc

SEQ ID NO: 3251278 - RNA, 17 nt, Mycobacterium tuberculosis H37Rv
cggccagccgcuccacg

SEQ ID NO: 3251279 - RNA, 23 nt, Mycobacterium tuberculosis H37Rv
cggccagccuaccggcuacggcg

SEQ ID NO: 3251280 - RNA, 19 nt, Mycobacterium tuberculosis H37Rv
cggccagcgcaccgccgau

SEQ ID NO: 3251281 - RNA, 18 nt, Mycobacterium tuberculosis H37Rv
cggccagcgccucgguga

SEQ ID NO: 3251282 - RNA, 20 nt, Mycobacterium tuberculosis H37Rv
cggccagcgccucggugagc

SEQ ID NO: 3251283 - RNA, 15 nt, Mycobacterium tuberculosis H37Rv
cggccagcgcgcgcg

SEQ ID NO: 3251284 - RNA, 15 nt, Mycobacterium tuberculosis H37Rv
cggccagcgcggcgc

SEQ ID NO: 3251285 - RNA, 13 nt, Mycobacterium tuberculosis H37Rv
cggccagcgcguc

SEQ ID NO: 3251286 - RNA, 15 nt, Mycobacterium tuberculosis H37Rv
cggccagcgcgucgg

SEQ ID NO: 3251287 - RNA, 13 nt, Mycobacterium tuberculosis H37Rv
cggccagcggccc

SEQ ID NO: 3251288 - RNA, 17 nt, Mycobacterium tuberculosis H37Rv
cggccagcgggaacaca

SEQ ID NO: 3251289 - RNA, 21 nt, Mycobacterium tuberculosis H37Rv
cggccagcgggugaaucgaca

SEQ ID NO: 3251290 - RNA, 17 nt, Mycobacterium tuberculosis H37Rv
cggccagcgucaacagc

SEQ ID NO: 3251291 - RNA, 18 nt, Mycobacterium tuberculosis H37Rv
cggccagcgugucccaac

SEQ ID NO: 3251292 - RNA, 19 nt, Mycobacterium tuberculosis H37Rv
cggccagcgugucccaacg

SEQ ID NO: 3251293 - RNA, 20 nt, Mycobacterium tuberculosis H37Rv
cggccagcgugucccaacgc

SEQ ID NO: 3251294 - RNA, 16 nt, Mycobacterium tuberculosis H37Rv
cggccagcuccagcgc

SEQ ID NO: 3251295 - RNA, 18 nt, Mycobacterium tuberculosis H37Rv
cggccagcuccagcgccg

SEQ ID NO: 3251296 - RNA, 19 nt, Mycobacterium tuberculosis H37Rv
cggccagcuccagcgccgc

SEQ ID NO: 3251297 - RNA, 22 nt, Mycobacterium tuberculosis H37Rv
cggccagcuccucagccaccgc

SEQ ID NO: 3251298 - RNA, 18 nt, Mycobacterium tuberculosis H37Rv
cggccagcucggccagcu

SEQ ID NO: 3251299 - RNA, 14 nt, Mycobacterium tuberculosis H37Rv
cggccagcucgggc

SEQ ID NO: 3251300 - RNA, 18 nt, Mycobacterium tuberculosis H37Rv
cggccagcucgugaucuu

SEQ ID NO: 3251301 - RNA, 20 nt, Mycobacterium tuberculosis H37Rv
cggccagcugcguggcgaac

SEQ ID NO: 3251302 - RNA, 17 nt, Mycobacterium tuberculosis H37Rv
cggccagcuguucgagc

SEQ ID NO: 3251303 - RNA, 18 nt, Mycobacterium tuberculosis H37Rv
cggccagcuguucgagcc

SEQ ID NO: 3251304 - RNA, 21 nt, Mycobacterium tuberculosis H37Rv
cggccagcuguucgagccgcg

SEQ ID NO: 3251305 - RNA, 19 nt, Mycobacterium tuberculosis H37Rv
cggccagcuugcggagccg

SEQ ID NO: 3251306 - RNA, 20 nt, Mycobacterium tuberculosis H37Rv
cggccagcuugcggagccgc

SEQ ID NO: 3251307 - RNA, 21 nt, Mycobacterium tuberculosis H37Rv
cggccagcuugcggagccgcc

SEQ ID NO: 3251308 - RNA, 21 nt, Mycobacterium tuberculosis H37Rv
cggccaggaguuugaccaccu

SEQ ID NO: 3251309 - RNA, 22 nt, Mycobacterium tuberculosis H37Rv
cggccaggaguuugaccaccug

SEQ ID NO: 3251310 - RNA, 20 nt, Mycobacterium tuberculosis H37Rv
cggccaggaucaaccggccc

SEQ ID NO: 3251311 - RNA, 19 nt, Mycobacterium tuberculosis H37Rv
cggccaggaucgcuacguc

SEQ ID NO: 3251312 - RNA, 19 nt, Mycobacterium tuberculosis H37Rv
cggccaggaucuguuuggg

SEQ ID NO: 3251313 - RNA, 23 nt, Mycobacterium tuberculosis H37Rv
cggccaggaugaagacgcggguc

SEQ ID NO: 3251314 - RNA, 23 nt, Mycobacterium tuberculosis H37Rv
cggccaggaugaauuuggugaag

SEQ ID NO: 3251315 - RNA, 22 nt, Mycobacterium tuberculosis H37Rv
cggccaggaugccugccacccg

SEQ ID NO: 3251316 - RNA, 23 nt, Mycobacterium tuberculosis H37Rv
cggccaggaugccugccacccgu

SEQ ID NO: 3251317 - RNA, 12 nt, Mycobacterium tuberculosis H37Rv
cggccaggccga

SEQ ID NO: 3251318 - RNA, 15 nt, Mycobacterium tuberculosis H37Rv
cggccaggccgucgg

SEQ ID NO: 3251319 - RNA, 18 nt, Mycobacterium tuberculosis H37Rv
cggccaggccgucggcgu

SEQ ID NO: 3251320 - RNA, 16 nt, Mycobacterium tuberculosis H37Rv
cggccaggcgcgacgu

SEQ ID NO: 3251321 - RNA, 21 nt, Mycobacterium tuberculosis H37Rv
cggccaggcgcgacguagacg

SEQ ID NO: 3251322 - RNA, 12 nt, Mycobacterium tuberculosis H37Rv
cggccaggcggu

SEQ ID NO: 3251323 - RNA, 12 nt, Mycobacterium tuberculosis H37Rv
cggccaggcugc

SEQ ID NO: 3251324 - RNA, 15 nt, Mycobacterium tuberculosis H37Rv
cggccagggagcggc

SEQ ID NO: 3251325 - RNA, 17 nt, Mycobacterium tuberculosis H37Rv
cggccaggggaucaccg

SEQ ID NO: 3251326 - RNA, 16 nt, Mycobacterium tuberculosis H37Rv
cggccaggggcgcagc

SEQ ID NO: 3251327 - RNA, 20 nt, Mycobacterium tuberculosis H37Rv
cggccagguauguccgccau

SEQ ID NO: 3251328 - RNA, 18 nt, Mycobacterium tuberculosis H37Rv
cggccaggucgacaccgc

SEQ ID NO: 3251329 - RNA, 14 nt, Mycobacterium tuberculosis H37Rv
cggccaggucgacg

SEQ ID NO: 3251330 - RNA, 15 nt, Mycobacterium tuberculosis H37Rv
cggccaggucgacgg

SEQ ID NO: 3251331 - RNA, 22 nt, Mycobacterium tuberculosis H37Rv
cggccaggucgcgauagccgcc

SEQ ID NO: 3251332 - RNA, 17 nt, Mycobacterium tuberculosis H37Rv
cggccaggucggcguug

SEQ ID NO: 3251333 - RNA, 21 nt, Mycobacterium tuberculosis H37Rv
cggccaggucggcguugaucg

SEQ ID NO: 3251334 - RNA, 15 nt, Mycobacterium tuberculosis H37Rv
cggccaguacgucga

SEQ ID NO: 3251335 - RNA, 23 nt, Mycobacterium tuberculosis H37Rv
cggccagucaggaaaccggcgcg

SEQ ID NO: 3251336 - RNA, 16 nt, Mycobacterium tuberculosis H37Rv
cggccaguccaagcug

SEQ ID NO: 3251337 - RNA, 15 nt, Mycobacterium tuberculosis H37Rv
cggccaguccgggga

SEQ ID NO: 3251338 - RNA, 12 nt, Mycobacterium tuberculosis H37Rv
cggccagugaca

SEQ ID NO: 3251339 - RNA, 23 nt, Mycobacterium tuberculosis H37Rv
cggccagugacaacgcgaugccg

SEQ ID NO: 3251340 - RNA, 16 nt, Mycobacterium tuberculosis H37Rv
cggccagugcgcgcgu

SEQ ID NO: 3251341 - RNA, 18 nt, Mycobacterium tuberculosis H37Rv
cggccagugcgcgcguca

SEQ ID NO: 3251342 - RNA, 15 nt, Mycobacterium tuberculosis H37Rv
cggccagugcucgca

SEQ ID NO: 3251343 - RNA, 21 nt, Mycobacterium tuberculosis H37Rv
cggccagugucagcacgacga

SEQ ID NO: 3251344 - RNA, 15 nt, Mycobacterium tuberculosis H37Rv
cggcccggucuacgc

SEQ ID NO: 3251345 - RNA, 22 nt, Mycobacterium tuberculosis H37Rv
cggcccggucuacgccaccgag

SEQ ID NO: 3251346 - RNA, 22 nt, Mycobacterium tuberculosis H37Rv
cggcccgguugggugugcccgg

SEQ ID NO: 3251347 - RNA, 19 nt, Mycobacterium tuberculosis H37Rv
cggcccguagcugcgcagc

SEQ ID NO: 3251348 - RNA, 18 nt, Mycobacterium tuberculosis H37Rv
cggcccguuugccgguuc

SEQ ID NO: 3251349 - RNA, 17 nt, Mycobacterium tuberculosis H37Rv
cggcccuaaacaccgcg

SEQ ID NO: 3251350 - RNA, 18 nt, Mycobacterium tuberculosis H37Rv
cggcccuacgcagcgcgg

SEQ ID NO: 3251351 - RNA, 20 nt, Mycobacterium tuberculosis H37Rv
cggcccuacgcagcgcggcu

SEQ ID NO: 3251352 - RNA, 23 nt, Mycobacterium tuberculosis H37Rv
cggcccuaucuggcggccggacu

SEQ ID NO: 3251353 - RNA, 14 nt, Mycobacterium tuberculosis H37Rv
cggcccuccaccgg

SEQ ID NO: 3251354 - RNA, 24 nt, Mycobacterium tuberculosis H37Rv
cggcccucgaugccgcguagcugg

SEQ ID NO: 3251355 - RNA, 19 nt, Mycobacterium tuberculosis H37Rv
cggcccucgccuucgccgc

SEQ ID NO: 3251356 - RNA, 13 nt, Mycobacterium tuberculosis H37Rv
cggcccugccgcc

SEQ ID NO: 3251357 - RNA, 16 nt, Mycobacterium tuberculosis H37Rv
cggcccugccgccggc

SEQ ID NO: 3251358 - RNA, 20 nt, Mycobacterium tuberculosis H37Rv
cggcccugcucgccgucucg

SEQ ID NO: 3251359 - RNA, 12 nt, Mycobacterium tuberculosis H37Rv
cggcccuggaca

SEQ ID NO: 3251360 - RNA, 21 nt, Mycobacterium tuberculosis H37Rv
cggcccuggacauaccggccc

SEQ ID NO: 3251361 - RNA, 17 nt, Mycobacterium tuberculosis H37Rv
cggcccuguucggcccu

SEQ ID NO: 3251362 - RNA, 12 nt, Mycobacterium tuberculosis H37Rv
cggccgaaacgc

SEQ ID NO: 3251363 - RNA, 13 nt, Mycobacterium tuberculosis H37Rv
cggccgaaacgcc

SEQ ID NO: 3251364 - RNA, 15 nt, Mycobacterium tuberculosis H37Rv
cggccgaaacuucgc

SEQ ID NO: 3251365 - RNA, 14 nt, Mycobacterium tuberculosis H37Rv
cggccgaacaaccu

SEQ ID NO: 3251366 - RNA, 23 nt, Mycobacterium tuberculosis H37Rv
cggccgaacaaccuucgggcgcg

SEQ ID NO: 3251367 - RNA, 16 nt, Mycobacterium tuberculosis H37Rv
cggccgaacgccucgc

SEQ ID NO: 3251368 - RNA, 19 nt, Mycobacterium tuberculosis H37Rv
cggccgaacgccucgccgg

SEQ ID NO: 3251369 - RNA, 14 nt, Mycobacterium tuberculosis H37Rv
cggccgaacucgag

SEQ ID NO: 3251370 - RNA, 17 nt, Mycobacterium tuberculosis H37Rv
cggccgaaugcgccaau

SEQ ID NO: 3251371 - RNA, 14 nt, Mycobacterium tuberculosis H37Rv
cggccgacaacccg

SEQ ID NO: 3251372 - RNA, 19 nt, Mycobacterium tuberculosis H37Rv
cggccgacaacccggccgg

SEQ ID NO: 3251373 - RNA, 21 nt, Mycobacterium tuberculosis H37Rv
cggccgacaacccggccgggc

SEQ ID NO: 3251374 - RNA, 16 nt, Mycobacterium tuberculosis H37Rv
cggccgacaccgccac

SEQ ID NO: 3251375 - RNA, 14 nt, Mycobacterium tuberculosis H37Rv
cggccgacccggau

SEQ ID NO: 3251376 - RNA, 21 nt, Mycobacterium tuberculosis H37Rv
cggccgacuuggugaccccgu

SEQ ID NO: 3251377 - RNA, 13 nt, Mycobacterium tuberculosis H37Rv
cggccgagcgcac

SEQ ID NO: 3251378 - RNA, 17 nt, Mycobacterium tuberculosis H37Rv
cggccgagcgcaccgcu

SEQ ID NO: 3251379 - RNA, 20 nt, Mycobacterium tuberculosis H37Rv
cggccgagcgcaccgcugac

SEQ ID NO: 3251380 - RNA, 14 nt, Mycobacterium tuberculosis H37Rv
cggccgagcgcacu

SEQ ID NO: 3251381 - RNA, 23 nt, Mycobacterium tuberculosis H37Rv
cggccgagcguggccaauccggc

SEQ ID NO: 3251382 - RNA, 17 nt, Mycobacterium tuberculosis H37Rv
cggccgaggucacccgg

SEQ ID NO: 3251383 - RNA, 17 nt, Mycobacterium tuberculosis H37Rv
cggccgagucgauugcc

SEQ ID NO: 3251384 - RNA, 22 nt, Mycobacterium tuberculosis H37Rv
cggccgagucgauugccaccga

SEQ ID NO: 3251385 - RNA, 14 nt, Mycobacterium tuberculosis H37Rv
cggccgagugcacg

SEQ ID NO: 3251386 - RNA, 16 nt, Mycobacterium tuberculosis H37Rv
cggccgauacgaagcc

SEQ ID NO: 3251387 - RNA, 20 nt, Mycobacterium tuberculosis H37Rv
cggccgauacgaagccgccg

SEQ ID NO: 3251388 - RNA, 17 nt, Mycobacterium tuberculosis H37Rv
cggccgaucucggugac

SEQ ID NO: 3251389 - RNA, 18 nt, Mycobacterium tuberculosis H37Rv
cggccgaugcgcagugca

SEQ ID NO: 3251390 - RNA, 17 nt, Mycobacterium tuberculosis H37Rv
cggccgcaagccgcgag

SEQ ID NO: 3251391 - RNA, 22 nt, Mycobacterium tuberculosis H37Rv
cggccgcaaggcgccgauaccg

SEQ ID NO: 3251392 - RNA, 13 nt, Mycobacterium tuberculosis H37Rv
cggccgcaccagc

SEQ ID NO: 3251393 - RNA, 13 nt, Mycobacterium tuberculosis H37Rv
cggccgcacccgu

SEQ ID NO: 3251394 - RNA, 14 nt, Mycobacterium tuberculosis H37Rv
cggccgcacccguu

SEQ ID NO: 3251395 - RNA, 15 nt, Mycobacterium tuberculosis H37Rv
cggccgcacccguug

SEQ ID NO: 3251396 - RNA, 19 nt, Mycobacterium tuberculosis H37Rv
cggccgcagccagcaaguc

SEQ ID NO: 3251397 - RNA, 19 nt, Mycobacterium tuberculosis H37Rv
cggccgcagcggccagccc

SEQ ID NO: 3251398 - RNA, 13 nt, Mycobacterium tuberculosis H37Rv
cggccgcaggcga

SEQ ID NO: 3251399 - RNA, 15 nt, Mycobacterium tuberculosis H37Rv
cggccgcagugcgac

SEQ ID NO: 3251400 - RNA, 18 nt, Mycobacterium tuberculosis H37Rv
cggccgcagugcgacucu

SEQ ID NO: 3251401 - RNA, 18 nt, Mycobacterium tuberculosis H37Rv
cggccgcauccccgguac

SEQ ID NO: 3251402 - RNA, 17 nt, Mycobacterium tuberculosis H37Rv
cggccgcaucgcccaac

SEQ ID NO: 3251403 - RNA, 18 nt, Mycobacterium tuberculosis H37Rv
cggccgcauucgugacga

SEQ ID NO: 3251404 - RNA, 16 nt, Mycobacterium tuberculosis H37Rv
cggccgccagccccac

SEQ ID NO: 3251405 - RNA, 19 nt, Mycobacterium tuberculosis H37Rv
cggccgccagccccacccg

SEQ ID NO: 3251406 - RNA, 14 nt, Mycobacterium tuberculosis H37Rv
cggccgccagccgg

SEQ ID NO: 3251407 - RNA, 14 nt, Mycobacterium tuberculosis H37Rv
cggccgccagcgca

SEQ ID NO: 3251408 - RNA, 15 nt, Mycobacterium tuberculosis H37Rv
cggccgccagcgcgc

SEQ ID NO: 3251409 - RNA, 16 nt, Mycobacterium tuberculosis H37Rv
cggccgccagcgcgcc

SEQ ID NO: 3251410 - RNA, 20 nt, Mycobacterium tuberculosis H37Rv
cggccgccaguaccacuguu

SEQ ID NO: 3251411 - RNA, 20 nt, Mycobacterium tuberculosis H37Rv
cggccgccaguucggcgucg

SEQ ID NO: 3251412 - RNA, 15 nt, Mycobacterium tuberculosis H37Rv
cggccgccaucagcc

SEQ ID NO: 3251413 - RNA, 21 nt, Mycobacterium tuberculosis H37Rv
cggccgccgaaacucaccagc

SEQ ID NO: 3251414 - RNA, 14 nt, Mycobacterium tuberculosis H37Rv
cggccgccgacagg

SEQ ID NO: 3251415 - RNA, 22 nt, Mycobacterium tuberculosis H37Rv
cggccgccgaccggagccgccg

SEQ ID NO: 3251416 - RNA, 18 nt, Mycobacterium tuberculosis H37Rv
cggccgccgacuccccgc

SEQ ID NO: 3251417 - RNA, 15 nt, Mycobacterium tuberculosis H37Rv
cggccgccgagacga

SEQ ID NO: 3251418 - RNA, 19 nt, Mycobacterium tuberculosis H37Rv
cggccgccgaucugcugca

SEQ ID NO: 3251419 - RNA, 14 nt, Mycobacterium tuberculosis H37Rv
cggccgccgcggcu

SEQ ID NO: 3251420 - RNA, 15 nt, Mycobacterium tuberculosis H37Rv
cggccgccgcggcuu

SEQ ID NO: 3251421 - RNA, 23 nt, Mycobacterium tuberculosis H37Rv
cggccgccgggaaauaucucggu

SEQ ID NO: 3251422 - RNA, 16 nt, Mycobacterium tuberculosis H37Rv
cggccgccucguacgg

SEQ ID NO: 3251423 - RNA, 20 nt, Mycobacterium tuberculosis H37Rv
cggccgcgaccagcgccgca

SEQ ID NO: 3251424 - RNA, 14 nt, Mycobacterium tuberculosis H37Rv
cggccgcgacgaca

SEQ ID NO: 3251425 - RNA, 15 nt, Mycobacterium tuberculosis H37Rv
cggccgcgagacgca

SEQ ID NO: 3251426 - RNA, 12 nt, Mycobacterium tuberculosis H37Rv
cggccgcgaugg

SEQ ID NO: 3251427 - RNA, 16 nt, Mycobacterium tuberculosis H37Rv
cggccgcgccggcccc

SEQ ID NO: 3251428 - RNA, 14 nt, Mycobacterium tuberculosis H37Rv
cggccgcgccgucg

SEQ ID NO: 3251429 - RNA, 12 nt, Mycobacterium tuberculosis H37Rv
cggccgcgcgca

SEQ ID NO: 3251430 - RNA, 12 nt, Mycobacterium tuberculosis H37Rv
cggccgcgcugc

SEQ ID NO: 3251431 - RNA, 14 nt, Mycobacterium tuberculosis H37Rv
cggccgcgcugcag

SEQ ID NO: 3251432 - RNA, 16 nt, Mycobacterium tuberculosis H37Rv
cggccgcgcugcagca

SEQ ID NO: 3251433 - RNA, 14 nt, Mycobacterium tuberculosis H37Rv
cggccgcggcagcg

SEQ ID NO: 3251434 - RNA, 17 nt, Mycobacterium tuberculosis H37Rv
cggccgcggccucccgc

SEQ ID NO: 3251435 - RNA, 18 nt, Mycobacterium tuberculosis H37Rv
cggccgcggcgccuagca

SEQ ID NO: 3251436 - RNA, 15 nt, Mycobacterium tuberculosis H37Rv
cggccgcggcggccc

SEQ ID NO: 3251437 - RNA, 15 nt, Mycobacterium tuberculosis H37Rv
cggccgcggcgucgu

SEQ ID NO: 3251438 - RNA, 18 nt, Mycobacterium tuberculosis H37Rv
cggccgcgggcgcgcagg

SEQ ID NO: 3251439 - RNA, 17 nt, Mycobacterium tuberculosis H37Rv
cggccgcgggucccggc

SEQ ID NO: 3251440 - RNA, 18 nt, Mycobacterium tuberculosis H37Rv
cggccgcggucggccacc

SEQ ID NO: 3251441 - RNA, 19 nt, Mycobacterium tuberculosis H37Rv
cggccucccgggccgccgc

SEQ ID NO: 3251442 - RNA, 12 nt, Mycobacterium tuberculosis H37Rv
cggccuccucgu

SEQ ID NO: 3251443 - RNA, 21 nt, Mycobacterium tuberculosis H37Rv
cggccuccucgucgcucccgg

SEQ ID NO: 3251444 - RNA, 18 nt, Mycobacterium tuberculosis H37Rv
cggccucgaccucuucgg

SEQ ID NO: 3251445 - RNA, 14 nt, Mycobacterium tuberculosis H37Rv
cggccucgaugucg

SEQ ID NO: 3251446 - RNA, 14 nt, Mycobacterium tuberculosis H37Rv
cggccucgcugggc

SEQ ID NO: 3251447 - RNA, 18 nt, Mycobacterium tuberculosis H37Rv
cggccucggcggucgccu

SEQ ID NO: 3251448 - RNA, 23 nt, Mycobacterium tuberculosis H37Rv
cggccucgggacucccgcgcggg

SEQ ID NO: 3251449 - RNA, 17 nt, Mycobacterium tuberculosis H37Rv
cggccucgggcucaaac

SEQ ID NO: 3251450 - RNA, 17 nt, Mycobacterium tuberculosis H37Rv
cggccucgucgaguucc

SEQ ID NO: 3251451 - RNA, 17 nt, Mycobacterium tuberculosis H37Rv
cggccucguugaccggg

SEQ ID NO: 3251452 - RNA, 22 nt, Mycobacterium tuberculosis H37Rv
cggccucuagcuugacaacccu

SEQ ID NO: 3251453 - RNA, 20 nt, Mycobacterium tuberculosis H37Rv
cggccucuggaucacgucga

SEQ ID NO: 3251454 - RNA, 19 nt, Mycobacterium tuberculosis H37Rv
cggccugaccggcucgccg

SEQ ID NO: 3251455 - RNA, 17 nt, Mycobacterium tuberculosis H37Rv
cggccugagcggccauc

SEQ ID NO: 3251456 - RNA, 19 nt, Mycobacterium tuberculosis H37Rv
cggccugagcgucgucgcc

SEQ ID NO: 3251457 - RNA, 17 nt, Mycobacterium tuberculosis H37Rv
cggccugcacggcgcug

SEQ ID NO: 3251458 - RNA, 15 nt, Mycobacterium tuberculosis H37Rv
cggccugccgcucgc

SEQ ID NO: 3251459 - RNA, 18 nt, Mycobacterium tuberculosis H37Rv
cggccugcgaacacgcga

SEQ ID NO: 3251460 - RNA, 15 nt, Mycobacterium tuberculosis H37Rv
cggccugcggcaccg

SEQ ID NO: 3251461 - RNA, 18 nt, Mycobacterium tuberculosis H37Rv
cggccugcggcaccggcu

SEQ ID NO: 3251462 - RNA, 20 nt, Mycobacterium tuberculosis H37Rv
cggccugcucgaccaugccg

SEQ ID NO: 3251463 - RNA, 21 nt, Mycobacterium tuberculosis H37Rv
cggccugcucggcgaguucgg

SEQ ID NO: 3251464 - RNA, 15 nt, Mycobacterium tuberculosis H37Rv
cggccuggccaccug

SEQ ID NO: 3251465 - RNA, 17 nt, Mycobacterium tuberculosis H37Rv
cggccuggccaccuggu

SEQ ID NO: 3251466 - RNA, 18 nt, Mycobacterium tuberculosis H37Rv
cggccuggccaccugguu

SEQ ID NO: 3251467 - RNA, 17 nt, Mycobacterium tuberculosis H37Rv
cggccugggccagccgc

SEQ ID NO: 3251468 - RNA, 11 nt, Mycobacterium tuberculosis H37Rv
cggccuggggc

SEQ ID NO: 3251469 - RNA, 14 nt, Mycobacterium tuberculosis H37Rv
cggccuggggcagc

SEQ ID NO: 3251470 - RNA, 16 nt, Mycobacterium tuberculosis H37Rv
cggccuggggcagccg

SEQ ID NO: 3251471 - RNA, 17 nt, Mycobacterium tuberculosis H37Rv
cggccugguacucccgc

SEQ ID NO: 3251472 - RNA, 18 nt, Mycobacterium tuberculosis H37Rv
cggccuguucgccgucgc

SEQ ID NO: 3251473 - RNA, 19 nt, Mycobacterium tuberculosis H37Rv
cggccuguucggcggcugc

SEQ ID NO: 3251474 - RNA, 14 nt, Mycobacterium tuberculosis H37Rv
cggccuuaggugac

SEQ ID NO: 3251475 - RNA, 15 nt, Mycobacterium tuberculosis H37Rv
cggccuucagcgguc

SEQ ID NO: 3251476 - RNA, 19 nt, Mycobacterium tuberculosis H37Rv
cggccuucagcguccagga

SEQ ID NO: 3251477 - RNA, 21 nt, Mycobacterium tuberculosis H37Rv
cggccuucucgccguguucga

SEQ ID NO: 3251478 - RNA, 14 nt, Mycobacterium tuberculosis H37Rv
cggccuucuugagg

SEQ ID NO: 3251479 - RNA, 19 nt, Mycobacterium tuberculosis H37Rv
cggccuugaucaccgugcg

SEQ ID NO: 3251480 - RNA, 19 nt, Mycobacterium tuberculosis H37Rv
cggccuugaucgugcuggc

SEQ ID NO: 3251481 - RNA, 17 nt, Mycobacterium tuberculosis H37Rv
cggccuugccaccggua

SEQ ID NO: 3251482 - RNA, 18 nt, Mycobacterium tuberculosis H37Rv
cggccuugccaccgguac

SEQ ID NO: 3251483 - RNA, 13 nt, Mycobacterium tuberculosis H37Rv
cggccuugccgcc

SEQ ID NO: 3251484 - RNA, 16 nt, Mycobacterium tuberculosis H37Rv
cggccuugccgccggc

SEQ ID NO: 3251485 - RNA, 23 nt, Mycobacterium tuberculosis H37Rv
cggccuugccgggccgcgcgggc

SEQ ID NO: 3251486 - RNA, 14 nt, Mycobacterium tuberculosis H37Rv
cggccuugcgcaca

SEQ ID NO: 3251487 - RNA, 17 nt, Mycobacterium tuberculosis H37Rv
cggccuugcgcacaggc

SEQ ID NO: 3251488 - RNA, 18 nt, Mycobacterium tuberculosis H37Rv
cggccuugcgggcucucg

SEQ ID NO: 3251489 - RNA, 23 nt, Mycobacterium tuberculosis H37Rv
cggccuugcgggcucucggcguc

SEQ ID NO: 3251490 - RNA, 14 nt, Mycobacterium tuberculosis H37Rv
cggccuugcucagc

SEQ ID NO: 3251491 - RNA, 22 nt, Mycobacterium tuberculosis H37Rv
cggccuugcucagcacgccggg

SEQ ID NO: 3251492 - RNA, 23 nt, Mycobacterium tuberculosis H37Rv
cggccuugcucagcacgccgggu

SEQ ID NO: 3251493 - RNA, 22 nt, Mycobacterium tuberculosis H37Rv
cggccuuggcgacgucgcgggu

SEQ ID NO: 3251494 - RNA, 18 nt, Mycobacterium tuberculosis H37Rv
cggccuuggcggccgcga

SEQ ID NO: 3251495 - RNA, 20 nt, Mycobacterium tuberculosis H37Rv
cggccuuggcggccgcgacc

SEQ ID NO: 3251496 - RNA, 20 nt, Mycobacterium tuberculosis H37Rv
cggccuugugcucgaugcga

SEQ ID NO: 3251497 - RNA, 16 nt, Mycobacterium tuberculosis H37Rv
cggccuuuacccgggc

SEQ ID NO: 3251498 - RNA, 16 nt, Mycobacterium tuberculosis H37Rv
cggccuuuccagcacc

SEQ ID NO: 3251499 - RNA, 21 nt, Mycobacterium tuberculosis H37Rv
cggccuuuccagcaccccgau

SEQ ID NO: 3251500 - RNA, 19 nt, Mycobacterium tuberculosis H37Rv
cggccuuugucgccuucuu

SEQ ID NO: 3251501 - RNA, 15 nt, Mycobacterium tuberculosis H37Rv
cggccuuuuccgggu

SEQ ID NO: 3251502 - RNA, 20 nt, Mycobacterium tuberculosis H37Rv
cggcgaaaacaacaccaccg

SEQ ID NO: 3251503 - RNA, 21 nt, Mycobacterium tuberculosis H37Rv
cggcgaaaacaacaccaccgc

SEQ ID NO: 3251504 - RNA, 21 nt, Mycobacterium tuberculosis H37Rv
cggcgaaacucgucgauucgg

SEQ ID NO: 3251505 - RNA, 18 nt, Mycobacterium tuberculosis H37Rv
cggcgaaagcuugggcga

SEQ ID NO: 3251506 - RNA, 16 nt, Mycobacterium tuberculosis H37Rv
cggcgaaaggccaguc

SEQ ID NO: 3251507 - RNA, 20 nt, Mycobacterium tuberculosis H37Rv
cggcgaaaguccugcagugc

SEQ ID NO: 3251508 - RNA, 20 nt, Mycobacterium tuberculosis H37Rv
cggcgaaaugaagugcaccg

SEQ ID NO: 3251509 - RNA, 20 nt, Mycobacterium tuberculosis H37Rv
cggcgaacaaccacgcacgg

SEQ ID NO: 3251510 - RNA, 19 nt, Mycobacterium tuberculosis H37Rv
cggcgaacaaccgccgcuc

SEQ ID NO: 3251511 - RNA, 13 nt, Mycobacterium tuberculosis H37Rv
cggcgaacagccc

SEQ ID NO: 3251512 - RNA, 17 nt, Mycobacterium tuberculosis H37Rv
cggcgaacagccccagg

SEQ ID NO: 3251513 - RNA, 19 nt, Mycobacterium tuberculosis H37Rv
cggcgaacagccccagggu

SEQ ID NO: 3251514 - RNA, 20 nt, Mycobacterium tuberculosis H37Rv
cggcgaacagccccagggug

SEQ ID NO: 3251515 - RNA, 21 nt, Mycobacterium tuberculosis H37Rv
cggcgaacagccccagggugc

SEQ ID NO: 3251516 - RNA, 18 nt, Mycobacterium tuberculosis H37Rv
cggcgaacaucaccgucg

SEQ ID NO: 3251517 - RNA, 14 nt, Mycobacterium tuberculosis H37Rv
cggcgaaccacggc

SEQ ID NO: 3251518 - RNA, 14 nt, Mycobacterium tuberculosis H37Rv
cggcgaaccagcgc

SEQ ID NO: 3251519 - RNA, 14 nt, Mycobacterium tuberculosis H37Rv
cggcgaacccagcg

SEQ ID NO: 3251520 - RNA, 23 nt, Mycobacterium tuberculosis H37Rv
cggcgaacccagcggagccacuc

SEQ ID NO: 3251521 - RNA, 16 nt, Mycobacterium tuberculosis H37Rv
cggcgaaccccagcgc

SEQ ID NO: 3251522 - RNA, 15 nt, Mycobacterium tuberculosis H37Rv
cggcgaacccgccga

SEQ ID NO: 3251523 - RNA, 23 nt, Mycobacterium tuberculosis H37Rv
cggcgaaccuugguugccaacga

SEQ ID NO: 3251524 - RNA, 13 nt, Mycobacterium tuberculosis H37Rv
cggcgaacggauu

SEQ ID NO: 3251525 - RNA, 21 nt, Mycobacterium tuberculosis H37Rv
cggcgaacggauucccgccca

SEQ ID NO: 3251526 - RNA, 15 nt, Mycobacterium tuberculosis H37Rv
cggcgaacggcacca

SEQ ID NO: 3251527 - RNA, 15 nt, Mycobacterium tuberculosis H37Rv
cggcgaacucggcga

SEQ ID NO: 3251528 - RNA, 18 nt, Mycobacterium tuberculosis H37Rv
cggcgaacucgggcgacu

SEQ ID NO: 3251529 - RNA, 19 nt, Mycobacterium tuberculosis H37Rv
cggcgaacucuacgguggu

SEQ ID NO: 3251530 - RNA, 21 nt, Mycobacterium tuberculosis H37Rv
cggcgaacugggugcggucuc

SEQ ID NO: 3251531 - RNA, 15 nt, Mycobacterium tuberculosis H37Rv
cggcgaagaccgccg

SEQ ID NO: 3251532 - RNA, 15 nt, Mycobacterium tuberculosis H37Rv
cggcgaagccggccg

SEQ ID NO: 3251533 - RNA, 13 nt, Mycobacterium tuberculosis H37Rv
cggcgaagccggg

SEQ ID NO: 3251534 - RNA, 23 nt, Mycobacterium tuberculosis H37Rv
cggcgaaggguaagaguucgcgc

SEQ ID NO: 3251535 - RNA, 22 nt, Mycobacterium tuberculosis H37Rv
cggcgaagguaguacuugccuu

SEQ ID NO: 3251536 - RNA, 14 nt, Mycobacterium tuberculosis H37Rv
cggcgaagucacgc

SEQ ID NO: 3251537 - RNA, 23 nt, Mycobacterium tuberculosis H37Rv
cggcgagccucgcgcgccacggu

SEQ ID NO: 3251538 - RNA, 21 nt, Mycobacterium tuberculosis H37Rv
cggcgagccucuuggucaacg

SEQ ID NO: 3251539 - RNA, 19 nt, Mycobacterium tuberculosis H37Rv
cggcgagcgcaucggccaa

SEQ ID NO: 3251540 - RNA, 12 nt, Mycobacterium tuberculosis H37Rv
cggcgagcgccc

SEQ ID NO: 3251541 - RNA, 17 nt, Mycobacterium tuberculosis H37Rv
cggcgagcgcggcgacg

SEQ ID NO: 3251542 - RNA, 17 nt, Mycobacterium tuberculosis H37Rv
cggcgagcuccgaugcc

SEQ ID NO: 3251543 - RNA, 14 nt, Mycobacterium tuberculosis H37Rv
cggcgaggacgcgc

SEQ ID NO: 3251544 - RNA, 16 nt, Mycobacterium tuberculosis H37Rv
cggcgaggacggcggc

SEQ ID NO: 3251545 - RNA, 17 nt, Mycobacterium tuberculosis H37Rv
cggcgaggacggcggcc

SEQ ID NO: 3251546 - RNA, 21 nt, Mycobacterium tuberculosis H37Rv
cggcgaggacggcggccagga

SEQ ID NO: 3251547 - RNA, 15 nt, Mycobacterium tuberculosis H37Rv
cggcgaggccgaacu

SEQ ID NO: 3251548 - RNA, 14 nt, Mycobacterium tuberculosis H37Rv
cggcgagggccacg

SEQ ID NO: 3251549 - RNA, 22 nt, Mycobacterium tuberculosis H37Rv
cggcgagggcggucagcggcca

SEQ ID NO: 3251550 - RNA, 14 nt, Mycobacterium tuberculosis H37Rv
cggcgagggugagc

SEQ ID NO: 3251551 - RNA, 22 nt, Mycobacterium tuberculosis H37Rv
cggcgaggucccggccgagcgu

SEQ ID NO: 3251552 - RNA, 19 nt, Mycobacterium tuberculosis H37Rv
cggcgagugguccagccag

SEQ ID NO: 3251553 - RNA, 21 nt, Mycobacterium tuberculosis H37Rv
cggcgagugguccagccagau

SEQ ID NO: 3251554 - RNA, 20 nt, Mycobacterium tuberculosis H37Rv
cggcgaguuggccguggcga

SEQ ID NO: 3251555 - RNA, 20 nt, Mycobacterium tuberculosis H37Rv
cggcgauaacuccgcggcga

SEQ ID NO: 3251556 - RNA, 18 nt, Mycobacterium tuberculosis H37Rv
cggcgauacccaucgauc

SEQ ID NO: 3251557 - RNA, 24 nt, Mycobacterium tuberculosis H37Rv
cggcgauaccgaggaucucgcggu

SEQ ID NO: 3251558 - RNA, 14 nt, Mycobacterium tuberculosis H37Rv
cggcgauaccgguu

SEQ ID NO: 3251559 - RNA, 19 nt, Mycobacterium tuberculosis H37Rv
cggcgauauaggacgccgc

SEQ ID NO: 3251560 - RNA, 16 nt, Mycobacterium tuberculosis H37Rv
cggcgaucaacgcgca

SEQ ID NO: 3251561 - RNA, 17 nt, Mycobacterium tuberculosis H37Rv
cggcgaucaacgcgcac

SEQ ID NO: 3251562 - RNA, 21 nt, Mycobacterium tuberculosis H37Rv
cggcgaucaacgcgcacgcgu

SEQ ID NO: 3251563 - RNA, 16 nt, Mycobacterium tuberculosis H37Rv
cggcgaucaacucggg

SEQ ID NO: 3251564 - RNA, 19 nt, Mycobacterium tuberculosis H37Rv
cggcgaucaacucgggcag

SEQ ID NO: 3251565 - RNA, 18 nt, Mycobacterium tuberculosis H37Rv
cggcgaucaccgagaugg

SEQ ID NO: 3251566 - RNA, 13 nt, Mycobacterium tuberculosis H37Rv
cggcgaucaccgu

SEQ ID NO: 3251567 - RNA, 19 nt, Mycobacterium tuberculosis H37Rv
cggcgaucagcagcgccag

SEQ ID NO: 3251568 - RNA, 19 nt, Mycobacterium tuberculosis H37Rv
cggcgauccccgacgucgg

SEQ ID NO: 3251569 - RNA, 18 nt, Mycobacterium tuberculosis H37Rv
cggcgauccggucggcca

SEQ ID NO: 3251570 - RNA, 19 nt, Mycobacterium tuberculosis H37Rv
cggcgauccggucgggggc

SEQ ID NO: 3251571 - RNA, 14 nt, Mycobacterium tuberculosis H37Rv
cggcgaucgcaugg

SEQ ID NO: 3251572 - RNA, 20 nt, Mycobacterium tuberculosis H37Rv
cggcgaucgcuccgcggcgc

SEQ ID NO: 3251573 - RNA, 19 nt, Mycobacterium tuberculosis H37Rv
cggcgaucgggcgggugaa

SEQ ID NO: 3251574 - RNA, 13 nt, Mycobacterium tuberculosis H37Rv
cggcgaucgguga

SEQ ID NO: 3251575 - RNA, 15 nt, Mycobacterium tuberculosis H37Rv
cggcgaucgucucgg

SEQ ID NO: 3251576 - RNA, 17 nt, Mycobacterium tuberculosis H37Rv
cggcgaucuccggcgga

SEQ ID NO: 3251577 - RNA, 19 nt, Mycobacterium tuberculosis H37Rv
cggcgaucuccggcggauc

SEQ ID NO: 3251578 - RNA, 22 nt, Mycobacterium tuberculosis H37Rv
cggcgaucuccggcggaucugg

SEQ ID NO: 3251579 - RNA, 11 nt, Mycobacterium tuberculosis H37Rv
cggcgaucugg

SEQ ID NO: 3251580 - RNA, 13 nt, Mycobacterium tuberculosis H37Rv
cggcgaucugguc

SEQ ID NO: 3251581 - RNA, 22 nt, Mycobacterium tuberculosis H37Rv
cggcgaugaacagcgacgccau

SEQ ID NO: 3251582 - RNA, 16 nt, Mycobacterium tuberculosis H37Rv
cggcgaugaccagaug

SEQ ID NO: 3251583 - RNA, 16 nt, Mycobacterium tuberculosis H37Rv
cggcgaugauggcgcg

SEQ ID NO: 3251584 - RNA, 20 nt, Mycobacterium tuberculosis H37Rv
cggcgaugauguugagcugg

SEQ ID NO: 3251585 - RNA, 21 nt, Mycobacterium tuberculosis H37Rv
cggcgaugauguugagcugga

SEQ ID NO: 3251586 - RNA, 17 nt, Mycobacterium tuberculosis H37Rv
cggcgaugcggucggcc

SEQ ID NO: 3251587 - RNA, 19 nt, Mycobacterium tuberculosis H37Rv
cggcgaugcggucggccac

SEQ ID NO: 3251588 - RNA, 21 nt, Mycobacterium tuberculosis H37Rv
cggcgaugcggucggccacau

SEQ ID NO: 3251589 - RNA, 22 nt, Mycobacterium tuberculosis H37Rv
cggcgaugcggucggccacauc

SEQ ID NO: 3251590 - RNA, 16 nt, Mycobacterium tuberculosis H37Rv
cggcgaugcguccgcc

SEQ ID NO: 3251591 - RNA, 19 nt, Mycobacterium tuberculosis H37Rv
cggcgaugcguccgcccag

SEQ ID NO: 3251592 - RNA, 20 nt, Mycobacterium tuberculosis H37Rv
cggcgaugcuaugcaguucc

SEQ ID NO: 3251593 - RNA, 14 nt, Mycobacterium tuberculosis H37Rv
cggcgaugcugagc

SEQ ID NO: 3251594 - RNA, 13 nt, Mycobacterium tuberculosis H37Rv
cggcgauggagcg

SEQ ID NO: 3251595 - RNA, 17 nt, Mycobacterium tuberculosis H37Rv
cggcgauggagcgguag

SEQ ID NO: 3251596 - RNA, 18 nt, Mycobacterium tuberculosis H37Rv
cggcgauggccagcacgg

SEQ ID NO: 3251597 - RNA, 13 nt, Mycobacterium tuberculosis H37Rv
cggcgauggcgcg

SEQ ID NO: 3251598 - RNA, 16 nt, Mycobacterium tuberculosis H37Rv
cggcgauggcggcauc

SEQ ID NO: 3251599 - RNA, 16 nt, Mycobacterium tuberculosis H37Rv
cggcgaugguaucgcc

SEQ ID NO: 3251600 - RNA, 14 nt, Mycobacterium tuberculosis H37Rv
cggcgauggucccg

SEQ ID NO: 3251601 - RNA, 22 nt, Mycobacterium tuberculosis H37Rv
cggcgaugguugaaccagucga

SEQ ID NO: 3251602 - RNA, 12 nt, Mycobacterium tuberculosis H37Rv
cggcgaugucga

SEQ ID NO: 3251603 - RNA, 21 nt, Mycobacterium tuberculosis H37Rv
cggcgaugucgcgcauugccg

SEQ ID NO: 3251604 - RNA, 18 nt, Mycobacterium tuberculosis H37Rv
cggcgauguuggccagcg

SEQ ID NO: 3251605 - RNA, 18 nt, Mycobacterium tuberculosis H37Rv
cggcgauuaccggcacgc

SEQ ID NO: 3251606 - RNA, 15 nt, Mycobacterium tuberculosis H37Rv
cggcgauuacggcca

SEQ ID NO: 3251607 - RNA, 16 nt, Mycobacterium tuberculosis H37Rv
cggcgauuacggccag

SEQ ID NO: 3251608 - RNA, 18 nt, Mycobacterium tuberculosis H37Rv
cggcgauuccuccgguug

SEQ ID NO: 3251609 - RNA, 19 nt, Mycobacterium tuberculosis H37Rv
cggcgauuggaccgccaau

SEQ ID NO: 3251610 - RNA, 16 nt, Mycobacterium tuberculosis H37Rv
cggcgauuggcuguga

SEQ ID NO: 3251611 - RNA, 16 nt, Mycobacterium tuberculosis H37Rv
cggcgcaacucgacca

SEQ ID NO: 3251612 - RNA, 18 nt, Mycobacterium tuberculosis H37Rv
cggcgcaagcgccgcgcu

SEQ ID NO: 3251613 - RNA, 15 nt, Mycobacterium tuberculosis H37Rv
cggcgcaccaucgcg

SEQ ID NO: 3251614 - RNA, 22 nt, Mycobacterium tuberculosis H37Rv
cggcgcaccggagucgcccggu

SEQ ID NO: 3251615 - RNA, 13 nt, Mycobacterium tuberculosis H37Rv
cggcgcacgaaac

SEQ ID NO: 3251616 - RNA, 20 nt, Mycobacterium tuberculosis H37Rv
cggcgcacgaaaccgcagcg

SEQ ID NO: 3251617 - RNA, 16 nt, Mycobacterium tuberculosis H37Rv
cggcgcagcaccgucg

SEQ ID NO: 3251618 - RNA, 21 nt, Mycobacterium tuberculosis H37Rv
cggcgcagcacggcggccacg

SEQ ID NO: 3251619 - RNA, 16 nt, Mycobacterium tuberculosis H37Rv
cggcgcagcuaacccg

SEQ ID NO: 3251620 - RNA, 18 nt, Mycobacterium tuberculosis H37Rv
cggcgcaggucgcgcagu

SEQ ID NO: 3251621 - RNA, 15 nt, Mycobacterium tuberculosis H37Rv
cggcgcagguucucg

SEQ ID NO: 3251622 - RNA, 15 nt, Mycobacterium tuberculosis H37Rv
cggcgcagugguguc

SEQ ID NO: 3251623 - RNA, 19 nt, Mycobacterium tuberculosis H37Rv
cggcgcaguuggcaccagc

SEQ ID NO: 3251624 - RNA, 20 nt, Mycobacterium tuberculosis H37Rv
cggcgcaguuggcaccagcc

SEQ ID NO: 3251625 - RNA, 16 nt, Mycobacterium tuberculosis H37Rv
cggcgcaugcguaugc

SEQ ID NO: 3251626 - RNA, 19 nt, Mycobacterium tuberculosis H37Rv
cggcgcauucccuugucgg

SEQ ID NO: 3251627 - RNA, 17 nt, Mycobacterium tuberculosis H37Rv
cggcgccaauucagcgg

SEQ ID NO: 3251628 - RNA, 21 nt, Mycobacterium tuberculosis H37Rv
cggcgccaauucagcggcaac

SEQ ID NO: 3251629 - RNA, 16 nt, Mycobacterium tuberculosis H37Rv
cggcgccacccgcgcc

SEQ ID NO: 3251630 - RNA, 17 nt, Mycobacterium tuberculosis H37Rv
cggcgccacccgcgccg

SEQ ID NO: 3251631 - RNA, 13 nt, Mycobacterium tuberculosis H37Rv
cggcgccaccgag

SEQ ID NO: 3251632 - RNA, 12 nt, Mycobacterium tuberculosis H37Rv
cggcgccaccgc

SEQ ID NO: 3251633 - RNA, 21 nt, Mycobacterium tuberculosis H37Rv
cggcgccgucgcccagcguga

SEQ ID NO: 3251634 - RNA, 19 nt, Mycobacterium tuberculosis H37Rv
cggcgccgucggagccggc

SEQ ID NO: 3251635 - RNA, 17 nt, Mycobacterium tuberculosis H37Rv
cggcgccgucguugugc

SEQ ID NO: 3251636 - RNA, 21 nt, Mycobacterium tuberculosis H37Rv
cggcgccgucguugugccggu

SEQ ID NO: 3251637 - RNA, 15 nt, Mycobacterium tuberculosis H37Rv
cggcgccgugucacc

SEQ ID NO: 3251638 - RNA, 17 nt, Mycobacterium tuberculosis H37Rv
cggcgccgugucaccgg

SEQ ID NO: 3251639 - RNA, 17 nt, Mycobacterium tuberculosis H37Rv
cggcgccguugccgccg

SEQ ID NO: 3251640 - RNA, 20 nt, Mycobacterium tuberculosis H37Rv
cggcgccuaaagacucgacc

SEQ ID NO: 3251641 - RNA, 21 nt, Mycobacterium tuberculosis H37Rv
cggcgccuagcacgaagcugg

SEQ ID NO: 3251642 - RNA, 17 nt, Mycobacterium tuberculosis H37Rv
cggcgccucaucggaca

SEQ ID NO: 3251643 - RNA, 20 nt, Mycobacterium tuberculosis H37Rv
cggcgccucaucggacagcg

SEQ ID NO: 3251644 - RNA, 15 nt, Mycobacterium tuberculosis H37Rv
cggcgccuccggcac

SEQ ID NO: 3251645 - RNA, 16 nt, Mycobacterium tuberculosis H37Rv
cggcgccuccggcacc

SEQ ID NO: 3251646 - RNA, 16 nt, Mycobacterium tuberculosis H37Rv
cggcgccucggaccag

SEQ ID NO: 3251647 - RNA, 17 nt, Mycobacterium tuberculosis H37Rv
cggcgccucggaccaga

SEQ ID NO: 3251648 - RNA, 18 nt, Mycobacterium tuberculosis H37Rv
cggcgccucggaccagac

SEQ ID NO: 3251649 - RNA, 20 nt, Mycobacterium tuberculosis H37Rv
cggcgccucggaccagaccc

SEQ ID NO: 3251650 - RNA, 22 nt, Mycobacterium tuberculosis H37Rv
cggcgccugacucaucaccgau

SEQ ID NO: 3251651 - RNA, 14 nt, Mycobacterium tuberculosis H37Rv
cggcgccugcugcg

SEQ ID NO: 3251652 - RNA, 21 nt, Mycobacterium tuberculosis H37Rv
cggcgccugcugcggccaggg

SEQ ID NO: 3251653 - RNA, 16 nt, Mycobacterium tuberculosis H37Rv
cggcgccuggcggcgc

SEQ ID NO: 3251654 - RNA, 16 nt, Mycobacterium tuberculosis H37Rv
cggcgccuuggucgcc

SEQ ID NO: 3251655 - RNA, 20 nt, Mycobacterium tuberculosis H37Rv
cggcgccuuggucgccgccu

SEQ ID NO: 3251656 - RNA, 21 nt, Mycobacterium tuberculosis H37Rv
cggcgccuuggucgccgccuu

SEQ ID NO: 3251657 - RNA, 23 nt, Mycobacterium tuberculosis H37Rv
cggcgccuuggucgccgccuuac

SEQ ID NO: 3251658 - RNA, 23 nt, Mycobacterium tuberculosis H37Rv
cggcgccuuguggaaccaucccu

SEQ ID NO: 3251659 - RNA, 20 nt, Mycobacterium tuberculosis H37Rv
cggcgcgaagucuugaccgc

SEQ ID NO: 3251660 - RNA, 15 nt, Mycobacterium tuberculosis H37Rv
cggcgcgaaucacgu

SEQ ID NO: 3251661 - RNA, 17 nt, Mycobacterium tuberculosis H37Rv
cggcgcgacagccgugg

SEQ ID NO: 3251662 - RNA, 23 nt, Mycobacterium tuberculosis H37Rv
cggcgcgacagccguggcgcgac

SEQ ID NO: 3251663 - RNA, 15 nt, Mycobacterium tuberculosis H37Rv
cggcgcgaccgucug

SEQ ID NO: 3251664 - RNA, 16 nt, Mycobacterium tuberculosis H37Rv
cggcgcgagcagacac

SEQ ID NO: 3251665 - RNA, 16 nt, Mycobacterium tuberculosis H37Rv
cggcgcgagcagacgc

SEQ ID NO: 3251666 - RNA, 14 nt, Mycobacterium tuberculosis H37Rv
cggcgcgagccgca

SEQ ID NO: 3251667 - RNA, 16 nt, Mycobacterium tuberculosis H37Rv
cggcgcgagccgcacg

SEQ ID NO: 3251668 - RNA, 12 nt, Mycobacterium tuberculosis H37Rv
cggcgcgagccu

SEQ ID NO: 3251669 - RNA, 16 nt, Mycobacterium tuberculosis H37Rv
cggcgcgaggaacgcc

SEQ ID NO: 3251670 - RNA, 19 nt, Mycobacterium tuberculosis H37Rv
cggcgcgaggaggcuuaca

SEQ ID NO: 3251671 - RNA, 19 nt, Mycobacterium tuberculosis H37Rv
cggcgcgaucgacgcucgg

SEQ ID NO: 3251672 - RNA, 12 nt, Mycobacterium tuberculosis H37Rv
cggcgcgauggc

SEQ ID NO: 3251673 - RNA, 15 nt, Mycobacterium tuberculosis H37Rv
cggcgcgcaccucgg

SEQ ID NO: 3251674 - RNA, 18 nt, Mycobacterium tuberculosis H37Rv
cggcgcgcaccucggcga

SEQ ID NO: 3251675 - RNA, 21 nt, Mycobacterium tuberculosis H37Rv
cggcgcgcagcgauucgccua

SEQ ID NO: 3251676 - RNA, 20 nt, Mycobacterium tuberculosis H37Rv
cggcgcgccaaacaccccgg

SEQ ID NO: 3251677 - RNA, 12 nt, Mycobacterium tuberculosis H37Rv
cggcgcgccccg

SEQ ID NO: 3251678 - RNA, 13 nt, Mycobacterium tuberculosis H37Rv
cggcgcgccccgc

SEQ ID NO: 3251679 - RNA, 15 nt, Mycobacterium tuberculosis H37Rv
cggcgcgccccgccg

SEQ ID NO: 3251680 - RNA, 21 nt, Mycobacterium tuberculosis H37Rv
cggcgcgccgaucggcaccgu

SEQ ID NO: 3251681 - RNA, 23 nt, Mycobacterium tuberculosis H37Rv
cggcgcgccgaucggcaccgugu

SEQ ID NO: 3251682 - RNA, 14 nt, Mycobacterium tuberculosis H37Rv
cggcgcgccgcaca

SEQ ID NO: 3251683 - RNA, 19 nt, Mycobacterium tuberculosis H37Rv
cggcgcgcgcgccggcugc

SEQ ID NO: 3251684 - RNA, 17 nt, Mycobacterium tuberculosis H37Rv
cggcgcgcgcugcgcag

SEQ ID NO: 3251685 - RNA, 15 nt, Mycobacterium tuberculosis H37Rv
cggcgcgcucggccg

SEQ ID NO: 3251686 - RNA, 14 nt, Mycobacterium tuberculosis H37Rv
cggcgcgcugcacg

SEQ ID NO: 3251687 - RNA, 13 nt, Mycobacterium tuberculosis H37Rv
cggcgcggaacgc

SEQ ID NO: 3251688 - RNA, 13 nt, Mycobacterium tuberculosis H37Rv
cggcgcggagagc

SEQ ID NO: 3251689 - RNA, 22 nt, Mycobacterium tuberculosis H37Rv
cggcgcggagagccugcucgca

SEQ ID NO: 3251690 - RNA, 15 nt, Mycobacterium tuberculosis H37Rv
cggcgcggagugccc

SEQ ID NO: 3251691 - RNA, 14 nt, Mycobacterium tuberculosis H37Rv
cggcgcggccagcu

SEQ ID NO: 3251692 - RNA, 21 nt, Mycobacterium tuberculosis H37Rv
cggcgcggccggccgcucacc

SEQ ID NO: 3251693 - RNA, 16 nt, Mycobacterium tuberculosis H37Rv
cggcgcggcgggcagc

SEQ ID NO: 3251694 - RNA, 14 nt, Mycobacterium tuberculosis H37Rv
cggcgcggcugccg

SEQ ID NO: 3251695 - RNA, 23 nt, Mycobacterium tuberculosis H37Rv
cggcgcgggcacgcccucgucga

SEQ ID NO: 3251696 - RNA, 15 nt, Mycobacterium tuberculosis H37Rv
cggcgcgggccacca

SEQ ID NO: 3251697 - RNA, 17 nt, Mycobacterium tuberculosis H37Rv
cggcgcgggucacgccg

SEQ ID NO: 3251698 - RNA, 21 nt, Mycobacterium tuberculosis H37Rv
cggcgcgggucacgccgucac

SEQ ID NO: 3251699 - RNA, 16 nt, Mycobacterium tuberculosis H37Rv
cggcgcgggucggcga

SEQ ID NO: 3251700 - RNA, 20 nt, Mycobacterium tuberculosis H37Rv
cggcgcggugcgcucacugg

SEQ ID NO: 3251701 - RNA, 20 nt, Mycobacterium tuberculosis H37Rv
cggcgcgguggggcgcgccg

SEQ ID NO: 3251702 - RNA, 22 nt, Mycobacterium tuberculosis H37Rv
cggcgcgguggggcgcgccggc

SEQ ID NO: 3251703 - RNA, 24 nt, Mycobacterium tuberculosis H37Rv
cggcgcgguggggcgcgccggcua

SEQ ID NO: 3251704 - RNA, 15 nt, Mycobacterium tuberculosis H37Rv
cggcgcgguugggca

SEQ ID NO: 3251705 - RNA, 21 nt, Mycobacterium tuberculosis H37Rv
cggcgcgguuucggcgucacc

SEQ ID NO: 3251706 - RNA, 22 nt, Mycobacterium tuberculosis H37Rv
cggcgcguaguaaugcucgacg

SEQ ID NO: 3251707 - RNA, 21 nt, Mycobacterium tuberculosis H37Rv
cggcgcguccgggcucgcgcu

SEQ ID NO: 3251708 - RNA, 19 nt, Mycobacterium tuberculosis H37Rv
cggcgcguugggaccagug

SEQ ID NO: 3251709 - RNA, 16 nt, Mycobacterium tuberculosis H37Rv
cggcgcuaaaccgucg

SEQ ID NO: 3251710 - RNA, 18 nt, Mycobacterium tuberculosis H37Rv
cggcgcuagcgccgcgcu

SEQ ID NO: 3251711 - RNA, 13 nt, Mycobacterium tuberculosis H37Rv
cggcgcuccccuc

SEQ ID NO: 3251712 - RNA, 20 nt, Mycobacterium tuberculosis H37Rv
cggcgcucccgccggcagcg

SEQ ID NO: 3251713 - RNA, 22 nt, Mycobacterium tuberculosis H37Rv
cggcgcucccgccggcagcguc

SEQ ID NO: 3251714 - RNA, 15 nt, Mycobacterium tuberculosis H37Rv
cggcgcuccgccaga

SEQ ID NO: 3251715 - RNA, 13 nt, Mycobacterium tuberculosis H37Rv
cggcgcucggcca

SEQ ID NO: 3251716 - RNA, 16 nt, Mycobacterium tuberculosis H37Rv
cggcgcucggcgagcu

SEQ ID NO: 3251717 - RNA, 20 nt, Mycobacterium tuberculosis H37Rv
cggcgcucgucgaucuccuc

SEQ ID NO: 3251718 - RNA, 20 nt, Mycobacterium tuberculosis H37Rv
cggcgcucuugcucaccaga

SEQ ID NO: 3251719 - RNA, 21 nt, Mycobacterium tuberculosis H37Rv
cggcgcugacuagggucaccg

SEQ ID NO: 3251720 - RNA, 19 nt, Mycobacterium tuberculosis H37Rv
cggcgcugaucgcgcgcac

SEQ ID NO: 3251721 - RNA, 21 nt, Mycobacterium tuberculosis H37Rv
cggcgcugaucgcgcgcaccg

SEQ ID NO: 3251722 - RNA, 14 nt, Mycobacterium tuberculosis H37Rv
cggcgcugaugccg

SEQ ID NO: 3251723 - RNA, 22 nt, Mycobacterium tuberculosis H37Rv
cggcgcugcccgggcugccgcc

SEQ ID NO: 3251724 - RNA, 13 nt, Mycobacterium tuberculosis H37Rv
cggcgcugccggg

SEQ ID NO: 3251725 - RNA, 15 nt, Mycobacterium tuberculosis H37Rv
cggcgcugcgcaccg

SEQ ID NO: 3251726 - RNA, 13 nt, Mycobacterium tuberculosis H37Rv
cggcgcugcgcga

SEQ ID NO: 3251727 - RNA, 15 nt, Mycobacterium tuberculosis H37Rv
cggcgcugcgcgauc

SEQ ID NO: 3251728 - RNA, 15 nt, Mycobacterium tuberculosis H37Rv
cggcgcugcgcgcga

SEQ ID NO: 3251729 - RNA, 13 nt, Mycobacterium tuberculosis H37Rv
cggcggcggcacg

SEQ ID NO: 3251730 - RNA, 16 nt, Mycobacterium tuberculosis H37Rv
cggcggcggccaggau

SEQ ID NO: 3251731 - RNA, 13 nt, Mycobacterium tuberculosis H37Rv
cggcggcggccgc

SEQ ID NO: 3251732 - RNA, 16 nt, Mycobacterium tuberculosis H37Rv
cggcggcggccgcagc

SEQ ID NO: 3251733 - RNA, 13 nt, Mycobacterium tuberculosis H37Rv
cggcggcggcgcu

SEQ ID NO: 3251734 - RNA, 14 nt, Mycobacterium tuberculosis H37Rv
cggcggcggcgucg

SEQ ID NO: 3251735 - RNA, 22 nt, Mycobacterium tuberculosis H37Rv
cggcggcggugcgccccgcguu

SEQ ID NO: 3251736 - RNA, 14 nt, Mycobacterium tuberculosis H37Rv
cggcggcgucgacg

SEQ ID NO: 3251737 - RNA, 15 nt, Mycobacterium tuberculosis H37Rv
cggcggcgucgacgg

SEQ ID NO: 3251738 - RNA, 18 nt, Mycobacterium tuberculosis H37Rv
cggcggcgucgacggcuc

SEQ ID NO: 3251739 - RNA, 12 nt, Mycobacterium tuberculosis H37Rv
cggcggcgucgg

SEQ ID NO: 3251740 - RNA, 14 nt, Mycobacterium tuberculosis H37Rv
cggcggcgucggga

SEQ ID NO: 3251741 - RNA, 13 nt, Mycobacterium tuberculosis H37Rv
cggcggcgucuuc

SEQ ID NO: 3251742 - RNA, 14 nt, Mycobacterium tuberculosis H37Rv
cggcggcgucuucg

SEQ ID NO: 3251743 - RNA, 16 nt, Mycobacterium tuberculosis H37Rv
cggcggcgucuucguc

SEQ ID NO: 3251744 - RNA, 18 nt, Mycobacterium tuberculosis H37Rv
cggcggcuauuucgcgga

SEQ ID NO: 3251745 - RNA, 14 nt, Mycobacterium tuberculosis H37Rv
cggcggcucgggug

SEQ ID NO: 3251746 - RNA, 12 nt, Mycobacterium tuberculosis H37Rv
cggcggcugccg

SEQ ID NO: 3251747 - RNA, 14 nt, Mycobacterium tuberculosis H37Rv
cggcggcugccggu

SEQ ID NO: 3251748 - RNA, 16 nt, Mycobacterium tuberculosis H37Rv
cggcggcugucggccg

SEQ ID NO: 3251749 - RNA, 17 nt, Mycobacterium tuberculosis H37Rv
cggcggcugucggccgg

SEQ ID NO: 3251750 - RNA, 20 nt, Mycobacterium tuberculosis H37Rv
cggcggcuguggucgcugcu

SEQ ID NO: 3251751 - RNA, 19 nt, Mycobacterium tuberculosis H37Rv
cggcggcuguugcggcggc

SEQ ID NO: 3251752 - RNA, 19 nt, Mycobacterium tuberculosis H37Rv
cggcggcuucguggcggcg

SEQ ID NO: 3251753 - RNA, 20 nt, Mycobacterium tuberculosis H37Rv
cggcggcuucguggcggcgc

SEQ ID NO: 3251754 - RNA, 16 nt, Mycobacterium tuberculosis H37Rv
cggcggcuuggccgcc

SEQ ID NO: 3251755 - RNA, 22 nt, Mycobacterium tuberculosis H37Rv
cggcggcuuggccgccccggcc

SEQ ID NO: 3251756 - RNA, 18 nt, Mycobacterium tuberculosis H37Rv
cggcgggacgucgccgca

SEQ ID NO: 3251757 - RNA, 20 nt, Mycobacterium tuberculosis H37Rv
cggcgggacgucgccgcagu

SEQ ID NO: 3251758 - RNA, 14 nt, Mycobacterium tuberculosis H37Rv
cggcgggauccucg

SEQ ID NO: 3251759 - RNA, 15 nt, Mycobacterium tuberculosis H37Rv
cggcgggauccucga

SEQ ID NO: 3251760 - RNA, 21 nt, Mycobacterium tuberculosis H37Rv
cggcgggcacaccgcaccugg

SEQ ID NO: 3251761 - RNA, 22 nt, Mycobacterium tuberculosis H37Rv
cggcgggcacgcacaaguucuu

SEQ ID NO: 3251762 - RNA, 18 nt, Mycobacterium tuberculosis H37Rv
cggcgggcagauggugaa

SEQ ID NO: 3251763 - RNA, 11 nt, Mycobacterium tuberculosis H37Rv
cggcgggcagc

SEQ ID NO: 3251764 - RNA, 14 nt, Mycobacterium tuberculosis H37Rv
cggcgggcagcggg

SEQ ID NO: 3251765 - RNA, 12 nt, Mycobacterium tuberculosis H37Rv
cggcgggccacc

SEQ ID NO: 3251766 - RNA, 19 nt, Mycobacterium tuberculosis H37Rv
cggcgggcccgccggcccc

SEQ ID NO: 3251767 - RNA, 14 nt, Mycobacterium tuberculosis H37Rv
cggcgggccgcgcg

SEQ ID NO: 3251768 - RNA, 20 nt, Mycobacterium tuberculosis H37Rv
cggcgggccgcgcggcgaca

SEQ ID NO: 3251769 - RNA, 23 nt, Mycobacterium tuberculosis H37Rv
cggcgggccgcgcggcgacagcu

SEQ ID NO: 3251770 - RNA, 13 nt, Mycobacterium tuberculosis H37Rv
cggcgggccugcc

SEQ ID NO: 3251771 - RNA, 14 nt, Mycobacterium tuberculosis H37Rv
cggcgggccugccc

SEQ ID NO: 3251772 - RNA, 15 nt, Mycobacterium tuberculosis H37Rv
cggcgggccugcccg

SEQ ID NO: 3251773 - RNA, 15 nt, Mycobacterium tuberculosis H37Rv
cggcgggcgacccgu

SEQ ID NO: 3251774 - RNA, 14 nt, Mycobacterium tuberculosis H37Rv
cggcgggcgagcca

SEQ ID NO: 3251775 - RNA, 11 nt, Mycobacterium tuberculosis H37Rv
cggcgggcgau

SEQ ID NO: 3251776 - RNA, 21 nt, Mycobacterium tuberculosis H37Rv
cggcgggcgaucuuggcgaca

SEQ ID NO: 3251777 - RNA, 16 nt, Mycobacterium tuberculosis H37Rv
cggcgggcggcagcga

SEQ ID NO: 3251778 - RNA, 19 nt, Mycobacterium tuberculosis H37Rv
cggcgggcggugggcagca

SEQ ID NO: 3251779 - RNA, 17 nt, Mycobacterium tuberculosis H37Rv
cggcgggcucggucccg

SEQ ID NO: 3251780 - RNA, 18 nt, Mycobacterium tuberculosis H37Rv
cggcggggaccgcgguca

SEQ ID NO: 3251781 - RNA, 17 nt, Mycobacterium tuberculosis H37Rv
cggcgggggcggcggcu

SEQ ID NO: 3251782 - RNA, 18 nt, Mycobacterium tuberculosis H37Rv
cggcgggggcgucgccgc

SEQ ID NO: 3251783 - RNA, 22 nt, Mycobacterium tuberculosis H37Rv
cggcgggggcgucgccgccggg

SEQ ID NO: 3251784 - RNA, 23 nt, Mycobacterium tuberculosis H37Rv
cggcggggugcgcccaccgaccc

SEQ ID NO: 3251785 - RNA, 20 nt, Mycobacterium tuberculosis H37Rv
cggcgggugccgagcuggcg

SEQ ID NO: 3251786 - RNA, 17 nt, Mycobacterium tuberculosis H37Rv
cggcgguaaaccuggcu

SEQ ID NO: 3251787 - RNA, 17 nt, Mycobacterium tuberculosis H37Rv
cggcgguaacggcggua

SEQ ID NO: 3251788 - RNA, 17 nt, Mycobacterium tuberculosis H37Rv
cggcgguaagggcgggc

SEQ ID NO: 3251789 - RNA, 14 nt, Mycobacterium tuberculosis H37Rv
cggcgguaccagag

SEQ ID NO: 3251790 - RNA, 18 nt, Mycobacterium tuberculosis H37Rv
cggcgguaccgccgcggu

SEQ ID NO: 3251791 - RNA, 19 nt, Mycobacterium tuberculosis H37Rv
cggcgguagccgaccagcg

SEQ ID NO: 3251792 - RNA, 22 nt, Mycobacterium tuberculosis H37Rv
cggcgguagccgaccagcgcua

SEQ ID NO: 3251793 - RNA, 22 nt, Mycobacterium tuberculosis H37Rv
cggcgguauuuugccggauucu

SEQ ID NO: 3251794 - RNA, 16 nt, Mycobacterium tuberculosis H37Rv
cggcggucaccaccga

SEQ ID NO: 3251795 - RNA, 15 nt, Mycobacterium tuberculosis H37Rv
cggcggucagcggcu

SEQ ID NO: 3251796 - RNA, 15 nt, Mycobacterium tuberculosis H37Rv
cggcgguccgcgcga

SEQ ID NO: 3251797 - RNA, 17 nt, Mycobacterium tuberculosis H37Rv
cggcgguccggaugcgc

SEQ ID NO: 3251798 - RNA, 13 nt, Mycobacterium tuberculosis H37Rv
cggcggucgccgc

SEQ ID NO: 3251799 - RNA, 22 nt, Mycobacterium tuberculosis H37Rv
cggcggucgccuccggggugaa

SEQ ID NO: 3251800 - RNA, 15 nt, Mycobacterium tuberculosis H37Rv
cggcggucggcuggg

SEQ ID NO: 3251801 - RNA, 17 nt, Mycobacterium tuberculosis H37Rv
cggcggucggcugggcg

SEQ ID NO: 3251802 - RNA, 22 nt, Mycobacterium tuberculosis H37Rv
cggcggucguugauuucggcgg

SEQ ID NO: 3251803 - RNA, 22 nt, Mycobacterium tuberculosis H37Rv
cggcggucucgucaaccugcgc

SEQ ID NO: 3251804 - RNA, 15 nt, Mycobacterium tuberculosis H37Rv
cggcggucugcagug

SEQ ID NO: 3251805 - RNA, 12 nt, Mycobacterium tuberculosis H37Rv
cggcggucuggg

SEQ ID NO: 3251806 - RNA, 14 nt, Mycobacterium tuberculosis H37Rv
cggcggucugggug

SEQ ID NO: 3251807 - RNA, 12 nt, Mycobacterium tuberculosis H37Rv
cggcggucugua

SEQ ID NO: 3251808 - RNA, 23 nt, Mycobacterium tuberculosis H37Rv
cggcggucuguaagacagcuauc

SEQ ID NO: 3251809 - RNA, 19 nt, Mycobacterium tuberculosis H37Rv
cggcggucuuggcgcgccc

SEQ ID NO: 3251810 - RNA, 19 nt, Mycobacterium tuberculosis H37Rv
cggcggugaaaucgcacag

SEQ ID NO: 3251811 - RNA, 19 nt, Mycobacterium tuberculosis H37Rv
cggcggugaacgacggguc

SEQ ID NO: 3251812 - RNA, 15 nt, Mycobacterium tuberculosis H37Rv
cggcggugacggugc

SEQ ID NO: 3251813 - RNA, 19 nt, Mycobacterium tuberculosis H37Rv
cggcggugcagcagggcgc

SEQ ID NO: 3251814 - RNA, 19 nt, Mycobacterium tuberculosis H37Rv
cggcggugcccagcagcgc

SEQ ID NO: 3251815 - RNA, 16 nt, Mycobacterium tuberculosis H37Rv
cggcggugccgacggu

SEQ ID NO: 3251816 - RNA, 22 nt, Mycobacterium tuberculosis H37Rv
cggcggugcgcugaugacgcgg

SEQ ID NO: 3251817 - RNA, 17 nt, Mycobacterium tuberculosis H37Rv
cggcgguggccagcguc

SEQ ID NO: 3251818 - RNA, 14 nt, Mycobacterium tuberculosis H37Rv
cggcgguggccgac

SEQ ID NO: 3251819 - RNA, 19 nt, Mycobacterium tuberculosis H37Rv
cggcgguggccguuuaggc

SEQ ID NO: 3251820 - RNA, 19 nt, Mycobacterium tuberculosis H37Rv
cggcgguggcguuacgggc

SEQ ID NO: 3251821 - RNA, 12 nt, Mycobacterium tuberculosis H37Rv
cggcggugggcg

SEQ ID NO: 3251822 - RNA, 18 nt, Mycobacterium tuberculosis H37Rv
cggcggugggggcguacu

SEQ ID NO: 3251823 - RNA, 14 nt, Mycobacterium tuberculosis H37Rv
cggcggugguaccg

SEQ ID NO: 3251824 - RNA, 20 nt, Mycobacterium tuberculosis H37Rv
cggcggugguaccggcgcca

SEQ ID NO: 3251825 - RNA, 22 nt, Mycobacterium tuberculosis H37Rv
cggcgguggugucgcucgcgag

SEQ ID NO: 3251826 - RNA, 16 nt, Mycobacterium tuberculosis H37Rv
cggcuccgccagcgcc

SEQ ID NO: 3251827 - RNA, 17 nt, Mycobacterium tuberculosis H37Rv
cggcuccgccagcgccg

SEQ ID NO: 3251828 - RNA, 18 nt, Mycobacterium tuberculosis H37Rv
cggcuccgcccggcgugu

SEQ ID NO: 3251829 - RNA, 19 nt, Mycobacterium tuberculosis H37Rv
cggcuccgccguugccgcc

SEQ ID NO: 3251830 - RNA, 16 nt, Mycobacterium tuberculosis H37Rv
cggcuccggcggcagc

SEQ ID NO: 3251831 - RNA, 15 nt, Mycobacterium tuberculosis H37Rv
cggcuccgggacggu

SEQ ID NO: 3251832 - RNA, 14 nt, Mycobacterium tuberculosis H37Rv
cggcuccuccccgg

SEQ ID NO: 3251833 - RNA, 22 nt, Mycobacterium tuberculosis H37Rv
cggcuccuccccggcccgcuca

SEQ ID NO: 3251834 - RNA, 17 nt, Mycobacterium tuberculosis H37Rv
cggcucgagcucggcga

SEQ ID NO: 3251835 - RNA, 17 nt, Mycobacterium tuberculosis H37Rv
cggcucgagucgcagca

SEQ ID NO: 3251836 - RNA, 16 nt, Mycobacterium tuberculosis H37Rv
cggcucgccaccucgg

SEQ ID NO: 3251837 - RNA, 24 nt, Mycobacterium tuberculosis H37Rv
cggcucgcugaucuggggcaccac

SEQ ID NO: 3251838 - RNA, 18 nt, Mycobacterium tuberculosis H37Rv
cggcucggaaaccgcccc

SEQ ID NO: 3251839 - RNA, 15 nt, Mycobacterium tuberculosis H37Rv
cggcucggcccccga

SEQ ID NO: 3251840 - RNA, 12 nt, Mycobacterium tuberculosis H37Rv
cggcucggcgcu

SEQ ID NO: 3251841 - RNA, 15 nt, Mycobacterium tuberculosis H37Rv
cggcucggcgcugac

SEQ ID NO: 3251842 - RNA, 18 nt, Mycobacterium tuberculosis H37Rv
cggcucgguaagugccuc

SEQ ID NO: 3251843 - RNA, 23 nt, Mycobacterium tuberculosis H37Rv
cggcucgucgaugucgacgucgc

SEQ ID NO: 3251844 - RNA, 15 nt, Mycobacterium tuberculosis H37Rv
cggcucgucgcucga

SEQ ID NO: 3251845 - RNA, 16 nt, Mycobacterium tuberculosis H37Rv
cggcucguuggcaaag

SEQ ID NO: 3251846 - RNA, 23 nt, Mycobacterium tuberculosis H37Rv
cggcucucuucgcgcgcugggcg

SEQ ID NO: 3251847 - RNA, 15 nt, Mycobacterium tuberculosis H37Rv
cggcugaacggcagc

SEQ ID NO: 3251848 - RNA, 17 nt, Mycobacterium tuberculosis H37Rv
cggcugaauucggcgag

SEQ ID NO: 3251849 - RNA, 18 nt, Mycobacterium tuberculosis H37Rv
cggcugaccgacccggac

SEQ ID NO: 3251850 - RNA, 18 nt, Mycobacterium tuberculosis H37Rv
cggcugaccggggcgccc

SEQ ID NO: 3251851 - RNA, 18 nt, Mycobacterium tuberculosis H37Rv
cggcugaccucccacccc

SEQ ID NO: 3251852 - RNA, 16 nt, Mycobacterium tuberculosis H37Rv
cggcugagggcccuug

SEQ ID NO: 3251853 - RNA, 18 nt, Mycobacterium tuberculosis H37Rv
cggcugauucgagccaca

SEQ ID NO: 3251854 - RNA, 22 nt, Mycobacterium tuberculosis H37Rv
cggcugauuggcccaccgccgu

SEQ ID NO: 3251855 - RNA, 18 nt, Mycobacterium tuberculosis H37Rv
cggcugcaaccagcggca

SEQ ID NO: 3251856 - RNA, 23 nt, Mycobacterium tuberculosis H37Rv
cggcugcaaccagcggcacauca

SEQ ID NO: 3251857 - RNA, 14 nt, Mycobacterium tuberculosis H37Rv
cggcugcaccggcu

SEQ ID NO: 3251858 - RNA, 15 nt, Mycobacterium tuberculosis H37Rv
cggcugcacgcugcg

SEQ ID NO: 3251859 - RNA, 13 nt, Mycobacterium tuberculosis H37Rv
cggcugcagccga

SEQ ID NO: 3251860 - RNA, 15 nt, Mycobacterium tuberculosis H37Rv
cggcugcagccgacc

SEQ ID NO: 3251861 - RNA, 17 nt, Mycobacterium tuberculosis H37Rv
cggcugcagccgaccga

SEQ ID NO: 3251862 - RNA, 21 nt, Mycobacterium tuberculosis H37Rv
cggcugcauccuccucgucga

SEQ ID NO: 3251863 - RNA, 15 nt, Mycobacterium tuberculosis H37Rv
cggcugccacacagg

SEQ ID NO: 3251864 - RNA, 17 nt, Mycobacterium tuberculosis H37Rv
cggcugccacgcgucgg

SEQ ID NO: 3251865 - RNA, 19 nt, Mycobacterium tuberculosis H37Rv
cggcugccagcgccgccgc

SEQ ID NO: 3251866 - RNA, 22 nt, Mycobacterium tuberculosis H37Rv
cggcugccagcgccgccgccga

SEQ ID NO: 3251867 - RNA, 17 nt, Mycobacterium tuberculosis H37Rv
cggcugccagugccgcc

SEQ ID NO: 3251868 - RNA, 15 nt, Mycobacterium tuberculosis H37Rv
cggcugccaucccga

SEQ ID NO: 3251869 - RNA, 23 nt, Mycobacterium tuberculosis H37Rv
cggcugccaucccgaucccggcc

SEQ ID NO: 3251870 - RNA, 18 nt, Mycobacterium tuberculosis H37Rv
cggcugcccaucggugau

SEQ ID NO: 3251871 - RNA, 16 nt, Mycobacterium tuberculosis H37Rv
cggcugccgcaccaag

SEQ ID NO: 3251872 - RNA, 12 nt, Mycobacterium tuberculosis H37Rv
cggcugccgcgg

SEQ ID NO: 3251873 - RNA, 16 nt, Mycobacterium tuberculosis H37Rv
cggcugccgcggcugc

SEQ ID NO: 3251874 - RNA, 13 nt, Mycobacterium tuberculosis H37Rv
cggcugccgcggu

SEQ ID NO: 3251875 - RNA, 15 nt, Mycobacterium tuberculosis H37Rv
cggcugccgcggugc

SEQ ID NO: 3251876 - RNA, 14 nt, Mycobacterium tuberculosis H37Rv
cggcugccgcucga

SEQ ID NO: 3251877 - RNA, 24 nt, Mycobacterium tuberculosis H37Rv
cggcugccgucuccuggucaaccg

SEQ ID NO: 3251878 - RNA, 20 nt, Mycobacterium tuberculosis H37Rv
cggcugcgacaggacgucgg

SEQ ID NO: 3251879 - RNA, 14 nt, Mycobacterium tuberculosis H37Rv
cggcugcgccgggc

SEQ ID NO: 3251880 - RNA, 15 nt, Mycobacterium tuberculosis H37Rv
cggcugcgccgggcu

SEQ ID NO: 3251881 - RNA, 20 nt, Mycobacterium tuberculosis H37Rv
cggcugcgcuuugcacagcg

SEQ ID NO: 3251882 - RNA, 15 nt, Mycobacterium tuberculosis H37Rv
cggcugcggcgucau

SEQ ID NO: 3251883 - RNA, 19 nt, Mycobacterium tuberculosis H37Rv
cggcugcguuggcuggugc

SEQ ID NO: 3251884 - RNA, 18 nt, Mycobacterium tuberculosis H37Rv
cggcugcguuguguuccg

SEQ ID NO: 3251885 - RNA, 15 nt, Mycobacterium tuberculosis H37Rv
cggcugcugcgcggu

SEQ ID NO: 3251886 - RNA, 16 nt, Mycobacterium tuberculosis H37Rv
cggcugcugcgcggug

SEQ ID NO: 3251887 - RNA, 23 nt, Mycobacterium tuberculosis H37Rv
cggcugcuuggucgcccagccac

SEQ ID NO: 3251888 - RNA, 14 nt, Mycobacterium tuberculosis H37Rv
cggcuggcccaccu

SEQ ID NO: 3251889 - RNA, 14 nt, Mycobacterium tuberculosis H37Rv
cggcuggcccgaau

SEQ ID NO: 3251890 - RNA, 18 nt, Mycobacterium tuberculosis H37Rv
cggcuggccgcgccucgg

SEQ ID NO: 3251891 - RNA, 23 nt, Mycobacterium tuberculosis H37Rv
cggcuggcuagcagguacucgcc

SEQ ID NO: 3251892 - RNA, 14 nt, Mycobacterium tuberculosis H37Rv
cggcuggggccgcu

SEQ ID NO: 3251893 - RNA, 16 nt, Mycobacterium tuberculosis H37Rv
cggcugggggauaccg

SEQ ID NO: 3251894 - RNA, 21 nt, Mycobacterium tuberculosis H37Rv
cggcugggggauaccgcuggg

SEQ ID NO: 3251895 - RNA, 19 nt, Mycobacterium tuberculosis H37Rv
cggcuggucgcugcugcga

SEQ ID NO: 3251896 - RNA, 15 nt, Mycobacterium tuberculosis H37Rv
cggcuggucucuggc

SEQ ID NO: 3251897 - RNA, 17 nt, Mycobacterium tuberculosis H37Rv
cggcuggucucuggcgu

SEQ ID NO: 3251898 - RNA, 17 nt, Mycobacterium tuberculosis H37Rv
cggcuggugccaacugc

SEQ ID NO: 3251899 - RNA, 22 nt, Mycobacterium tuberculosis H37Rv
cggcuggugccaacugcgccgu

SEQ ID NO: 3251900 - RNA, 19 nt, Mycobacterium tuberculosis H37Rv
cggcuggugggacgcggcc

SEQ ID NO: 3251901 - RNA, 14 nt, Mycobacterium tuberculosis H37Rv
cggcugguggggga

SEQ ID NO: 3251902 - RNA, 22 nt, Mycobacterium tuberculosis H37Rv
cggcugguguccagccaggcga

SEQ ID NO: 3251903 - RNA, 22 nt, Mycobacterium tuberculosis H37Rv
cggcugguuacucaccaaccgc

SEQ ID NO: 3251904 - RNA, 16 nt, Mycobacterium tuberculosis H37Rv
cggcugucacgccugc

SEQ ID NO: 3251905 - RNA, 19 nt, Mycobacterium tuberculosis H37Rv
cggcugucgugccucucgg

SEQ ID NO: 3251906 - RNA, 23 nt, Mycobacterium tuberculosis H37Rv
cggcuguggucgcugcugccgca

SEQ ID NO: 3251907 - RNA, 14 nt, Mycobacterium tuberculosis H37Rv
cggcuguucucgcc

SEQ ID NO: 3251908 - RNA, 15 nt, Mycobacterium tuberculosis H37Rv
cggcuucaguccggc

SEQ ID NO: 3251909 - RNA, 18 nt, Mycobacterium tuberculosis H37Rv
cggcuucaguccggcccc

SEQ ID NO: 3251910 - RNA, 13 nt, Mycobacterium tuberculosis H37Rv
cggcuuccuccuc

SEQ ID NO: 3251911 - RNA, 18 nt, Mycobacterium tuberculosis H37Rv
cggcuucgacgucggcga

SEQ ID NO: 3251912 - RNA, 20 nt, Mycobacterium tuberculosis H37Rv
cggcuucgcccagagccgcu

SEQ ID NO: 3251913 - RNA, 15 nt, Mycobacterium tuberculosis H37Rv
cggcuucgccgcgcu

SEQ ID NO: 3251914 - RNA, 16 nt, Mycobacterium tuberculosis H37Rv
cggcuucgccgcgcuu

SEQ ID NO: 3251915 - RNA, 15 nt, Mycobacterium tuberculosis H37Rv
cggcuucggcagacc

SEQ ID NO: 3251916 - RNA, 14 nt, Mycobacterium tuberculosis H37Rv
cggcuucggcagcc

SEQ ID NO: 3251917 - RNA, 21 nt, Mycobacterium tuberculosis H37Rv
cggcuucggguguucgcgcgc

SEQ ID NO: 3251918 - RNA, 16 nt, Mycobacterium tuberculosis H37Rv
cggcuucguccaccgc

SEQ ID NO: 3251919 - RNA, 15 nt, Mycobacterium tuberculosis H37Rv
cggcuucgucggcca

SEQ ID NO: 3251920 - RNA, 17 nt, Mycobacterium tuberculosis H37Rv
cggcuucgucggccagc

SEQ ID NO: 3251921 - RNA, 21 nt, Mycobacterium tuberculosis H37Rv
cggcuucguggcggcgcgcgc

SEQ ID NO: 3251922 - RNA, 17 nt, Mycobacterium tuberculosis H37Rv
cgggagguacccccagc

SEQ ID NO: 3251923 - RNA, 19 nt, Mycobacterium tuberculosis H37Rv
cgggaguaagggaagcgau

SEQ ID NO: 3251924 - RNA, 22 nt, Mycobacterium tuberculosis H37Rv
cgggaguccgguagcuguggug

SEQ ID NO: 3251925 - RNA, 22 nt, Mycobacterium tuberculosis H37Rv
cgggagucgccgccgucggguu

SEQ ID NO: 3251926 - RNA, 13 nt, Mycobacterium tuberculosis H37Rv
cgggagucgucga

SEQ ID NO: 3251927 - RNA, 17 nt, Mycobacterium tuberculosis H37Rv
cgggauaacccagcacc

SEQ ID NO: 3251928 - RNA, 18 nt, Mycobacterium tuberculosis H37Rv
cgggauaacccagcacca

SEQ ID NO: 3251929 - RNA, 23 nt, Mycobacterium tuberculosis H37Rv
cgggauaacccagcaccacaacg

SEQ ID NO: 3251930 - RNA, 21 nt, Mycobacterium tuberculosis H37Rv
cgggauaccaauggacacagg

SEQ ID NO: 3251931 - RNA, 19 nt, Mycobacterium tuberculosis H37Rv
cgggauagacgaccccggu

SEQ ID NO: 3251932 - RNA, 16 nt, Mycobacterium tuberculosis H37Rv
cgggauagccguucgg

SEQ ID NO: 3251933 - RNA, 15 nt, Mycobacterium tuberculosis H37Rv
cgggauauagccggu

SEQ ID NO: 3251934 - RNA, 13 nt, Mycobacterium tuberculosis H37Rv
cgggaucagcgua

SEQ ID NO: 3251935 - RNA, 20 nt, Mycobacterium tuberculosis H37Rv
cgggaucaugaccaucgagg

SEQ ID NO: 3251936 - RNA, 21 nt, Mycobacterium tuberculosis H37Rv
cgggauccaggcccagccgag

SEQ ID NO: 3251937 - RNA, 17 nt, Mycobacterium tuberculosis H37Rv
cgggaucccgaucguga

SEQ ID NO: 3251938 - RNA, 14 nt, Mycobacterium tuberculosis H37Rv
cgggaucgacccgc

SEQ ID NO: 3251939 - RNA, 17 nt, Mycobacterium tuberculosis H37Rv
cgggaucgacgucgcgg

SEQ ID NO: 3251940 - RNA, 15 nt, Mycobacterium tuberculosis H37Rv
cgggaucgcccaggc

SEQ ID NO: 3251941 - RNA, 16 nt, Mycobacterium tuberculosis H37Rv
cgggaucgcccaggcg

SEQ ID NO: 3251942 - RNA, 16 nt, Mycobacterium tuberculosis H37Rv
cgggaucgccgagacc

SEQ ID NO: 3251943 - RNA, 21 nt, Mycobacterium tuberculosis H37Rv
cgggaucgccguccagcaaua

SEQ ID NO: 3251944 - RNA, 21 nt, Mycobacterium tuberculosis H37Rv
cgggaucgguggcggcacgca

SEQ ID NO: 3251945 - RNA, 21 nt, Mycobacterium tuberculosis H37Rv
cgggaucgucaggcccauggc

SEQ ID NO: 3251946 - RNA, 18 nt, Mycobacterium tuberculosis H37Rv
cgggaucgucggcaacca

SEQ ID NO: 3251947 - RNA, 16 nt, Mycobacterium tuberculosis H37Rv
cgggaucguuggccag

SEQ ID NO: 3251948 - RNA, 17 nt, Mycobacterium tuberculosis H37Rv
cgggaucguuggccagu

SEQ ID NO: 3251949 - RNA, 19 nt, Mycobacterium tuberculosis H37Rv
cgggaucugacccagcagc

SEQ ID NO: 3251950 - RNA, 20 nt, Mycobacterium tuberculosis H37Rv
cgggaucugagggcucggug

SEQ ID NO: 3251951 - RNA, 17 nt, Mycobacterium tuberculosis H37Rv
cgggaugaagccaccca

SEQ ID NO: 3251952 - RNA, 13 nt, Mycobacterium tuberculosis H37Rv
cgggaugaccacc

SEQ ID NO: 3251953 - RNA, 14 nt, Mycobacterium tuberculosis H37Rv
cgggaugccgccgc

SEQ ID NO: 3251954 - RNA, 22 nt, Mycobacterium tuberculosis H37Rv
cgggaugccggcgaaggccagc

SEQ ID NO: 3251955 - RNA, 21 nt, Mycobacterium tuberculosis H37Rv
cgggaugcgcguuacccaucg

SEQ ID NO: 3251956 - RNA, 14 nt, Mycobacterium tuberculosis H37Rv
cgggaugcucccua

SEQ ID NO: 3251957 - RNA, 15 nt, Mycobacterium tuberculosis H37Rv
cgggaugcucgaucc

SEQ ID NO: 3251958 - RNA, 14 nt, Mycobacterium tuberculosis H37Rv
cgggauggacacca

SEQ ID NO: 3251959 - RNA, 17 nt, Mycobacterium tuberculosis H37Rv
cgggauggacaccaccu

SEQ ID NO: 3251960 - RNA, 19 nt, Mycobacterium tuberculosis H37Rv
cgggauggacaccaccucg

SEQ ID NO: 3251961 - RNA, 13 nt, Mycobacterium tuberculosis H37Rv
cgggauggacagc

SEQ ID NO: 3251962 - RNA, 17 nt, Mycobacterium tuberculosis H37Rv
cgggauggacagcuguu

SEQ ID NO: 3251963 - RNA, 14 nt, Mycobacterium tuberculosis H37Rv
cgggauggccgccg

SEQ ID NO: 3251964 - RNA, 17 nt, Mycobacterium tuberculosis H37Rv
cgggaugguuccguuga

SEQ ID NO: 3251965 - RNA, 13 nt, Mycobacterium tuberculosis H37Rv
cgggauucggcag

SEQ ID NO: 3251966 - RNA, 22 nt, Mycobacterium tuberculosis H37Rv
cgggauugccgccaccuuggcu

SEQ ID NO: 3251967 - RNA, 13 nt, Mycobacterium tuberculosis H37Rv
cgggauugccguc

SEQ ID NO: 3251968 - RNA, 16 nt, Mycobacterium tuberculosis H37Rv
cgggauuggaggcggg

SEQ ID NO: 3251969 - RNA, 15 nt, Mycobacterium tuberculosis H37Rv
cgggauuggugaguu

SEQ ID NO: 3251970 - RNA, 19 nt, Mycobacterium tuberculosis H37Rv
cgggcaaaucaagcacagc

SEQ ID NO: 3251971 - RNA, 19 nt, Mycobacterium tuberculosis H37Rv
cgggcaaccacaucaccgg

SEQ ID NO: 3251972 - RNA, 20 nt, Mycobacterium tuberculosis H37Rv
cgggcaaccacaucaccggc

SEQ ID NO: 3251973 - RNA, 22 nt, Mycobacterium tuberculosis H37Rv
cgggcaaccacaucaccggcga

SEQ ID NO: 3251974 - RNA, 23 nt, Mycobacterium tuberculosis H37Rv
cgggcaaccacaucaccggcgau

SEQ ID NO: 3251975 - RNA, 12 nt, Mycobacterium tuberculosis H37Rv
cgggcaaccgau

SEQ ID NO: 3251976 - RNA, 16 nt, Mycobacterium tuberculosis H37Rv
cgggcaaccgaugacg

SEQ ID NO: 3251977 - RNA, 18 nt, Mycobacterium tuberculosis H37Rv
cgggcaaccgaugacgcg

SEQ ID NO: 3251978 - RNA, 20 nt, Mycobacterium tuberculosis H37Rv
cgggcaaccggagaucccgg

SEQ ID NO: 3251979 - RNA, 13 nt, Mycobacterium tuberculosis H37Rv
cgggcaaccugcc

SEQ ID NO: 3251980 - RNA, 16 nt, Mycobacterium tuberculosis H37Rv
cgggcaacgcagcacg

SEQ ID NO: 3251981 - RNA, 17 nt, Mycobacterium tuberculosis H37Rv
cgggcaacgcagcacgu

SEQ ID NO: 3251982 - RNA, 20 nt, Mycobacterium tuberculosis H37Rv
cgggcaacgccucgagcaac

SEQ ID NO: 3251983 - RNA, 23 nt, Mycobacterium tuberculosis H37Rv
cgggcaacgcgaaccggccaucg

SEQ ID NO: 3251984 - RNA, 17 nt, Mycobacterium tuberculosis H37Rv
cgggcaacucggugacg

SEQ ID NO: 3251985 - RNA, 15 nt, Mycobacterium tuberculosis H37Rv
cgggcaacugcagca

SEQ ID NO: 3251986 - RNA, 21 nt, Mycobacterium tuberculosis H37Rv
cgggcaagucgcccagccgag

SEQ ID NO: 3251987 - RNA, 22 nt, Mycobacterium tuberculosis H37Rv
cgggcaagucgcccagccgagc

SEQ ID NO: 3251988 - RNA, 21 nt, Mycobacterium tuberculosis H37Rv
cgggcaauacguagucgccga

SEQ ID NO: 3251989 - RNA, 15 nt, Mycobacterium tuberculosis H37Rv
cgggcaaucaccgcc

SEQ ID NO: 3251990 - RNA, 20 nt, Mycobacterium tuberculosis H37Rv
cgggcaaucaccgccggcgg

SEQ ID NO: 3251991 - RNA, 15 nt, Mycobacterium tuberculosis H37Rv
cgggcaaucgcucug

SEQ ID NO: 3251992 - RNA, 21 nt, Mycobacterium tuberculosis H37Rv
cgggcacaauaggcuccagcg

SEQ ID NO: 3251993 - RNA, 22 nt, Mycobacterium tuberculosis H37Rv
cgggcacaccgacgccgccagg

SEQ ID NO: 3251994 - RNA, 21 nt, Mycobacterium tuberculosis H37Rv
cgggcacaccgcaccugggcg

SEQ ID NO: 3251995 - RNA, 17 nt, Mycobacterium tuberculosis H37Rv
cgggcacaucgcacaac

SEQ ID NO: 3251996 - RNA, 13 nt, Mycobacterium tuberculosis H37Rv
cgggcaccaauac

SEQ ID NO: 3251997 - RNA, 12 nt, Mycobacterium tuberculosis H37Rv
cgggcaccgucg

SEQ ID NO: 3251998 - RNA, 13 nt, Mycobacterium tuberculosis H37Rv
cgggcaccugguc

SEQ ID NO: 3251999 - RNA, 15 nt, Mycobacterium tuberculosis H37Rv
cgggcaccuggucgg

SEQ ID NO: 3252000 - RNA, 16 nt, Mycobacterium tuberculosis H37Rv
cgggcaccuggucggc

SEQ ID NO: 3252001 - RNA, 18 nt, Mycobacterium tuberculosis H37Rv
cgggcaccuggucggccg

SEQ ID NO: 3252002 - RNA, 23 nt, Mycobacterium tuberculosis H37Rv
cgggcacgaacaucagaucgccg

SEQ ID NO: 3252003 - RNA, 13 nt, Mycobacterium tuberculosis H37Rv
cgggcacgaucgu

SEQ ID NO: 3252004 - RNA, 16 nt, Mycobacterium tuberculosis H37Rv
cgggcacgaucgucgc

SEQ ID NO: 3252005 - RNA, 22 nt, Mycobacterium tuberculosis H37Rv
cgggcacgcccucgucgaucgc

SEQ ID NO: 3252006 - RNA, 14 nt, Mycobacterium tuberculosis H37Rv
cgggcacgccgccg

SEQ ID NO: 3252007 - RNA, 22 nt, Mycobacterium tuberculosis H37Rv
cgggcacgcggcgaugauggcg

SEQ ID NO: 3252008 - RNA, 23 nt, Mycobacterium tuberculosis H37Rv
cgggcacguuuacauagaccacc

SEQ ID NO: 3252009 - RNA, 15 nt, Mycobacterium tuberculosis H37Rv
cgggcacucagcagg

SEQ ID NO: 3252010 - RNA, 20 nt, Mycobacterium tuberculosis H37Rv
cgggcacucagcaggggauc

SEQ ID NO: 3252011 - RNA, 15 nt, Mycobacterium tuberculosis H37Rv
cgggcacugugaggu

SEQ ID NO: 3252012 - RNA, 21 nt, Mycobacterium tuberculosis H37Rv
cgggcagauaugacggcagac

SEQ ID NO: 3252013 - RNA, 22 nt, Mycobacterium tuberculosis H37Rv
cgggcagcaaaaaccagcgucc

SEQ ID NO: 3252014 - RNA, 22 nt, Mycobacterium tuberculosis H37Rv
cgggcagcaacaggcccacggc

SEQ ID NO: 3252015 - RNA, 23 nt, Mycobacterium tuberculosis H37Rv
cgggcagcaacaggcccacggcg

SEQ ID NO: 3252016 - RNA, 16 nt, Mycobacterium tuberculosis H37Rv
cgggcagcacccgcgc

SEQ ID NO: 3252017 - RNA, 15 nt, Mycobacterium tuberculosis H37Rv
cgggcagcaggcgau

SEQ ID NO: 3252018 - RNA, 14 nt, Mycobacterium tuberculosis H37Rv
cgggccgcgcgcag

SEQ ID NO: 3252019 - RNA, 19 nt, Mycobacterium tuberculosis H37Rv
cgggccgcgcgcagagcgu

SEQ ID NO: 3252020 - RNA, 18 nt, Mycobacterium tuberculosis H37Rv
cgggccgcggccacaucg

SEQ ID NO: 3252021 - RNA, 19 nt, Mycobacterium tuberculosis H37Rv
cgggccgcgguacccaccu

SEQ ID NO: 3252022 - RNA, 21 nt, Mycobacterium tuberculosis H37Rv
cgggccgcgguacccaccucc

SEQ ID NO: 3252023 - RNA, 19 nt, Mycobacterium tuberculosis H37Rv
cgggccgcguagugcuccg

SEQ ID NO: 3252024 - RNA, 14 nt, Mycobacterium tuberculosis H37Rv
cgggccgcucggua

SEQ ID NO: 3252025 - RNA, 21 nt, Mycobacterium tuberculosis H37Rv
cgggccgcugugggucgaucc

SEQ ID NO: 3252026 - RNA, 23 nt, Mycobacterium tuberculosis H37Rv
cgggccggaugacgcccagggcg

SEQ ID NO: 3252027 - RNA, 15 nt, Mycobacterium tuberculosis H37Rv
cgggccggccgccgc

SEQ ID NO: 3252028 - RNA, 19 nt, Mycobacterium tuberculosis H37Rv
cgggccggcgacuguccca

SEQ ID NO: 3252029 - RNA, 19 nt, Mycobacterium tuberculosis H37Rv
cgggccggcgagcucgacg

SEQ ID NO: 3252030 - RNA, 17 nt, Mycobacterium tuberculosis H37Rv
cgggccggucggugagc

SEQ ID NO: 3252031 - RNA, 23 nt, Mycobacterium tuberculosis H37Rv
cgggccguacacaccgagcaccu

SEQ ID NO: 3252032 - RNA, 14 nt, Mycobacterium tuberculosis H37Rv
cgggccguccuccc

SEQ ID NO: 3252033 - RNA, 17 nt, Mycobacterium tuberculosis H37Rv
cgggccguguccgccgg

SEQ ID NO: 3252034 - RNA, 21 nt, Mycobacterium tuberculosis H37Rv
cgggccucaugcuaggccacc

SEQ ID NO: 3252035 - RNA, 23 nt, Mycobacterium tuberculosis H37Rv
cgggccucaugcuaggccaccgg

SEQ ID NO: 3252036 - RNA, 14 nt, Mycobacterium tuberculosis H37Rv
cgggccuccugcug

SEQ ID NO: 3252037 - RNA, 14 nt, Mycobacterium tuberculosis H37Rv
cgggccucggcgac

SEQ ID NO: 3252038 - RNA, 13 nt, Mycobacterium tuberculosis H37Rv
cgggccugaacca

SEQ ID NO: 3252039 - RNA, 12 nt, Mycobacterium tuberculosis H37Rv
cgggccugcgcg

SEQ ID NO: 3252040 - RNA, 15 nt, Mycobacterium tuberculosis H37Rv
cgggccuggccugcc

SEQ ID NO: 3252041 - RNA, 22 nt, Mycobacterium tuberculosis H37Rv
cgggccuggccugcccagcacc

SEQ ID NO: 3252042 - RNA, 23 nt, Mycobacterium tuberculosis H37Rv
cgggccugggacggcggcagucg

SEQ ID NO: 3252043 - RNA, 16 nt, Mycobacterium tuberculosis H37Rv
cgggccugguggauga

SEQ ID NO: 3252044 - RNA, 16 nt, Mycobacterium tuberculosis H37Rv
cgggccuucagcucac

SEQ ID NO: 3252045 - RNA, 15 nt, Mycobacterium tuberculosis H37Rv
cgggccuucgccacu

SEQ ID NO: 3252046 - RNA, 16 nt, Mycobacterium tuberculosis H37Rv
cgggccuugcgcgcgc

SEQ ID NO: 3252047 - RNA, 21 nt, Mycobacterium tuberculosis H37Rv
cgggccuuguucuuggccacc

SEQ ID NO: 3252048 - RNA, 23 nt, Mycobacterium tuberculosis H37Rv
cgggccuuguucuuggccacccc

SEQ ID NO: 3252049 - RNA, 17 nt, Mycobacterium tuberculosis H37Rv
cgggcgaaacgcccggg

SEQ ID NO: 3252050 - RNA, 22 nt, Mycobacterium tuberculosis H37Rv
cgggcgaccugcggacccaccg

SEQ ID NO: 3252051 - RNA, 23 nt, Mycobacterium tuberculosis H37Rv
cgggcgaccugcggacccaccgc

SEQ ID NO: 3252052 - RNA, 14 nt, Mycobacterium tuberculosis H37Rv
cgggcgacgguuuc

SEQ ID NO: 3252053 - RNA, 20 nt, Mycobacterium tuberculosis H37Rv
cgggcgagaacccacgcaug

SEQ ID NO: 3252054 - RNA, 12 nt, Mycobacterium tuberculosis H37Rv
cgggcgagaucu

SEQ ID NO: 3252055 - RNA, 21 nt, Mycobacterium tuberculosis H37Rv
cgggcgagaucuuuucaccac

SEQ ID NO: 3252056 - RNA, 15 nt, Mycobacterium tuberculosis H37Rv
cgggcgagcucgucg

SEQ ID NO: 3252057 - RNA, 19 nt, Mycobacterium tuberculosis H37Rv
cgggcgagcucgucgagcg

SEQ ID NO: 3252058 - RNA, 19 nt, Mycobacterium tuberculosis H37Rv
cgggcgaguacaggcgcag

SEQ ID NO: 3252059 - RNA, 17 nt, Mycobacterium tuberculosis H37Rv
cgggcgaucgccugggc

SEQ ID NO: 3252060 - RNA, 22 nt, Mycobacterium tuberculosis H37Rv
cgggcgaucucgauguacagcg

SEQ ID NO: 3252061 - RNA, 16 nt, Mycobacterium tuberculosis H37Rv
cgggcgaucucggcga

SEQ ID NO: 3252062 - RNA, 17 nt, Mycobacterium tuberculosis H37Rv
cgggcgaucucggcgag

SEQ ID NO: 3252063 - RNA, 19 nt, Mycobacterium tuberculosis H37Rv
cgggcgaucucggcgagca

SEQ ID NO: 3252064 - RNA, 16 nt, Mycobacterium tuberculosis H37Rv
cgggcgaucuuggcga

SEQ ID NO: 3252065 - RNA, 17 nt, Mycobacterium tuberculosis H37Rv
cgggcgaucuuggcgac

SEQ ID NO: 3252066 - RNA, 12 nt, Mycobacterium tuberculosis H37Rv
cgggcgaugacc

SEQ ID NO: 3252067 - RNA, 16 nt, Mycobacterium tuberculosis H37Rv
cgggcgaugacccgga

SEQ ID NO: 3252068 - RNA, 16 nt, Mycobacterium tuberculosis H37Rv
cgggcgaugagcgcga

SEQ ID NO: 3252069 - RNA, 13 nt, Mycobacterium tuberculosis H37Rv
cgggcgaugcugg

SEQ ID NO: 3252070 - RNA, 16 nt, Mycobacterium tuberculosis H37Rv
cgggcgaugcugggcg

SEQ ID NO: 3252071 - RNA, 16 nt, Mycobacterium tuberculosis H37Rv
cgggcgauggccaguu

SEQ ID NO: 3252072 - RNA, 20 nt, Mycobacterium tuberculosis H37Rv
cgggcgcaacgagagcggcu

SEQ ID NO: 3252073 - RNA, 14 nt, Mycobacterium tuberculosis H37Rv
cgggcgcaagcagc

SEQ ID NO: 3252074 - RNA, 19 nt, Mycobacterium tuberculosis H37Rv
cgggcgcaagcagcccggg

SEQ ID NO: 3252075 - RNA, 20 nt, Mycobacterium tuberculosis H37Rv
cgggcgcaagcagcccgggu

SEQ ID NO: 3252076 - RNA, 13 nt, Mycobacterium tuberculosis H37Rv
cgggcgcaccagg

SEQ ID NO: 3252077 - RNA, 15 nt, Mycobacterium tuberculosis H37Rv
cgggcgcaccaggga

SEQ ID NO: 3252078 - RNA, 23 nt, Mycobacterium tuberculosis H37Rv
cgggcgcaccagggagccguuca

SEQ ID NO: 3252079 - RNA, 16 nt, Mycobacterium tuberculosis H37Rv
cgggcgcacgcccgca

SEQ ID NO: 3252080 - RNA, 22 nt, Mycobacterium tuberculosis H37Rv
cgggcgccaacgggcugccccu

SEQ ID NO: 3252081 - RNA, 14 nt, Mycobacterium tuberculosis H37Rv
cgggcgcccaugcu

SEQ ID NO: 3252082 - RNA, 19 nt, Mycobacterium tuberculosis H37Rv
cgggcgcccaugcugacac

SEQ ID NO: 3252083 - RNA, 20 nt, Mycobacterium tuberculosis H37Rv
cgggcgcccuuaagccggcg

SEQ ID NO: 3252084 - RNA, 15 nt, Mycobacterium tuberculosis H37Rv
cgggcgccgaucacg

SEQ ID NO: 3252085 - RNA, 16 nt, Mycobacterium tuberculosis H37Rv
cgggcgccgcagcgcu

SEQ ID NO: 3252086 - RNA, 22 nt, Mycobacterium tuberculosis H37Rv
cgggcgccggaacgagcggccg

SEQ ID NO: 3252087 - RNA, 19 nt, Mycobacterium tuberculosis H37Rv
cgggcgccuuccaggcggg

SEQ ID NO: 3252088 - RNA, 17 nt, Mycobacterium tuberculosis H37Rv
cgggcgccuuggucgcc

SEQ ID NO: 3252089 - RNA, 19 nt, Mycobacterium tuberculosis H37Rv
cgggcgccuuggucgccgc

SEQ ID NO: 3252090 - RNA, 21 nt, Mycobacterium tuberculosis H37Rv
cgggcgccuuggucgccgccu

SEQ ID NO: 3252091 - RNA, 22 nt, Mycobacterium tuberculosis H37Rv
cgggcgccuuggucgccgccuu

SEQ ID NO: 3252092 - RNA, 20 nt, Mycobacterium tuberculosis H37Rv
cgggcgccuuggucgccgcu

SEQ ID NO: 3252093 - RNA, 14 nt, Mycobacterium tuberculosis H37Rv
cgggcgcgaaaccg

SEQ ID NO: 3252094 - RNA, 22 nt, Mycobacterium tuberculosis H37Rv
cgggcgcgaggacgcugaucca

SEQ ID NO: 3252095 - RNA, 20 nt, Mycobacterium tuberculosis H37Rv
cgggcgcgccggccaugccu

SEQ ID NO: 3252096 - RNA, 14 nt, Mycobacterium tuberculosis H37Rv
cgggcgcgcguagc

SEQ ID NO: 3252097 - RNA, 15 nt, Mycobacterium tuberculosis H37Rv
cgggcgcgcugccca

SEQ ID NO: 3252098 - RNA, 22 nt, Mycobacterium tuberculosis H37Rv
cgggcgcgcuuuccucaccagc

SEQ ID NO: 3252099 - RNA, 18 nt, Mycobacterium tuberculosis H37Rv
cgggcgcgggcgccggga

SEQ ID NO: 3252100 - RNA, 12 nt, Mycobacterium tuberculosis H37Rv
cgggcgcggggc

SEQ ID NO: 3252101 - RNA, 21 nt, Mycobacterium tuberculosis H37Rv
cgggcgcggguggcgccaguu

SEQ ID NO: 3252102 - RNA, 21 nt, Mycobacterium tuberculosis H37Rv
cgggcgcgguucgucggcgag

SEQ ID NO: 3252103 - RNA, 22 nt, Mycobacterium tuberculosis H37Rv
cgggcgcguccucgccgcacgc

SEQ ID NO: 3252104 - RNA, 13 nt, Mycobacterium tuberculosis H37Rv
cgggcgcgucggc

SEQ ID NO: 3252105 - RNA, 17 nt, Mycobacterium tuberculosis H37Rv
cgggcgcgucggcguug

SEQ ID NO: 3252106 - RNA, 12 nt, Mycobacterium tuberculosis H37Rv
cgggcgcguugc

SEQ ID NO: 3252107 - RNA, 13 nt, Mycobacterium tuberculosis H37Rv
cgggcgcuggacg

SEQ ID NO: 3252108 - RNA, 16 nt, Mycobacterium tuberculosis H37Rv
cgggcgcuggacggcg

SEQ ID NO: 3252109 - RNA, 18 nt, Mycobacterium tuberculosis H37Rv
cgggcgcuguagucgcgc

SEQ ID NO: 3252110 - RNA, 21 nt, Mycobacterium tuberculosis H37Rv
cgggcgcuguagucgcgccuc

SEQ ID NO: 3252111 - RNA, 19 nt, Mycobacterium tuberculosis H37Rv
cgggcggaaaagaacccgg

SEQ ID NO: 3252112 - RNA, 15 nt, Mycobacterium tuberculosis H37Rv
cgggcggaaacaagc

SEQ ID NO: 3252113 - RNA, 18 nt, Mycobacterium tuberculosis H37Rv
cgggcggaacgccggcac

SEQ ID NO: 3252114 - RNA, 17 nt, Mycobacterium tuberculosis H37Rv
cgggcuuggcgucgacg

SEQ ID NO: 3252115 - RNA, 16 nt, Mycobacterium tuberculosis H37Rv
cggggaaaccggccag

SEQ ID NO: 3252116 - RNA, 20 nt, Mycobacterium tuberculosis H37Rv
cggggaacguccgcgccgag

SEQ ID NO: 3252117 - RNA, 22 nt, Mycobacterium tuberculosis H37Rv
cggggaacgugacccccagcag

SEQ ID NO: 3252118 - RNA, 19 nt, Mycobacterium tuberculosis H37Rv
cggggaagacgaccgugcu

SEQ ID NO: 3252119 - RNA, 17 nt, Mycobacterium tuberculosis H37Rv
cggggaagcccggcaga

SEQ ID NO: 3252120 - RNA, 18 nt, Mycobacterium tuberculosis H37Rv
cggggaagcccggcagau

SEQ ID NO: 3252121 - RNA, 22 nt, Mycobacterium tuberculosis H37Rv
cggggaagcccggcagaugcag

SEQ ID NO: 3252122 - RNA, 18 nt, Mycobacterium tuberculosis H37Rv
cggggaaggggcucagcg

SEQ ID NO: 3252123 - RNA, 14 nt, Mycobacterium tuberculosis H37Rv
cggggaccacgccg

SEQ ID NO: 3252124 - RNA, 16 nt, Mycobacterium tuberculosis H37Rv
cggggaccucggcgau

SEQ ID NO: 3252125 - RNA, 13 nt, Mycobacterium tuberculosis H37Rv
cggggacgcgccc

SEQ ID NO: 3252126 - RNA, 19 nt, Mycobacterium tuberculosis H37Rv
cggggagcugcggcggcca

SEQ ID NO: 3252127 - RNA, 21 nt, Mycobacterium tuberculosis H37Rv
cggggaggucaaaaucagggu

SEQ ID NO: 3252128 - RNA, 15 nt, Mycobacterium tuberculosis H37Rv
cggggaggucgagcu

SEQ ID NO: 3252129 - RNA, 18 nt, Mycobacterium tuberculosis H37Rv
cggggaguucgcgcagca

SEQ ID NO: 3252130 - RNA, 18 nt, Mycobacterium tuberculosis H37Rv
cggggauaccggucagca

SEQ ID NO: 3252131 - RNA, 20 nt, Mycobacterium tuberculosis H37Rv
cggggauaccggucagcacc

SEQ ID NO: 3252132 - RNA, 14 nt, Mycobacterium tuberculosis H37Rv
cggggauccgguaa

SEQ ID NO: 3252133 - RNA, 18 nt, Mycobacterium tuberculosis H37Rv
cggggauguccgcggcca

SEQ ID NO: 3252134 - RNA, 23 nt, Mycobacterium tuberculosis H37Rv
cggggauucgucgugcgggcggg

SEQ ID NO: 3252135 - RNA, 17 nt, Mycobacterium tuberculosis H37Rv
cggggcaaaggagccgu

SEQ ID NO: 3252136 - RNA, 14 nt, Mycobacterium tuberculosis H37Rv
cggggcaacgauca

SEQ ID NO: 3252137 - RNA, 13 nt, Mycobacterium tuberculosis H37Rv
cggggcccacacc

SEQ ID NO: 3252138 - RNA, 23 nt, Mycobacterium tuberculosis H37Rv
cggggcccacaccgaguugauga

SEQ ID NO: 3252139 - RNA, 18 nt, Mycobacterium tuberculosis H37Rv
cggggccccaugccgacc

SEQ ID NO: 3252140 - RNA, 15 nt, Mycobacterium tuberculosis H37Rv
cggggccgcaaccau

SEQ ID NO: 3252141 - RNA, 14 nt, Mycobacterium tuberculosis H37Rv
cggggccgccagcu

SEQ ID NO: 3252142 - RNA, 21 nt, Mycobacterium tuberculosis H37Rv
cggggccgccgucgccuccgc

SEQ ID NO: 3252143 - RNA, 22 nt, Mycobacterium tuberculosis H37Rv
cggggccgccgucgccuccgcu

SEQ ID NO: 3252144 - RNA, 10 nt, Mycobacterium tuberculosis H37Rv
cggggccggu

SEQ ID NO: 3252145 - RNA, 19 nt, Mycobacterium tuberculosis H37Rv
cggggccgucggcaauacu

SEQ ID NO: 3252146 - RNA, 20 nt, Mycobacterium tuberculosis H37Rv
cggggccgucgucggucacc

SEQ ID NO: 3252147 - RNA, 23 nt, Mycobacterium tuberculosis H37Rv
cggggccgucgucggucaccgac

SEQ ID NO: 3252148 - RNA, 21 nt, Mycobacterium tuberculosis H37Rv
cggggcgaagcuugacguugc

SEQ ID NO: 3252149 - RNA, 12 nt, Mycobacterium tuberculosis H37Rv
cggggcgacgau

SEQ ID NO: 3252150 - RNA, 21 nt, Mycobacterium tuberculosis H37Rv
cggggcgacgauccgcacgau

SEQ ID NO: 3252151 - RNA, 13 nt, Mycobacterium tuberculosis H37Rv
cggggcgaucccc

SEQ ID NO: 3252152 - RNA, 17 nt, Mycobacterium tuberculosis H37Rv
cggggcgauccccagca

SEQ ID NO: 3252153 - RNA, 19 nt, Mycobacterium tuberculosis H37Rv
cggggcgauccccagcacc

SEQ ID NO: 3252154 - RNA, 18 nt, Mycobacterium tuberculosis H37Rv
cggggcgcccggccaggu

SEQ ID NO: 3252155 - RNA, 20 nt, Mycobacterium tuberculosis H37Rv
cggggcgcucgcgcgcuggg

SEQ ID NO: 3252156 - RNA, 16 nt, Mycobacterium tuberculosis H37Rv
cggggcgcugcagcuc

SEQ ID NO: 3252157 - RNA, 21 nt, Mycobacterium tuberculosis H37Rv
cggggcgcugcagcucacgac

SEQ ID NO: 3252158 - RNA, 22 nt, Mycobacterium tuberculosis H37Rv
cggggcgcugcagcucacgacu

SEQ ID NO: 3252159 - RNA, 16 nt, Mycobacterium tuberculosis H37Rv
cggggcuaugaccugc

SEQ ID NO: 3252160 - RNA, 23 nt, Mycobacterium tuberculosis H37Rv
cggggcucaagucucccggccgc

SEQ ID NO: 3252161 - RNA, 13 nt, Mycobacterium tuberculosis H37Rv
cggggcugaccgc

SEQ ID NO: 3252162 - RNA, 11 nt, Mycobacterium tuberculosis H37Rv
cggggcugccg

SEQ ID NO: 3252163 - RNA, 17 nt, Mycobacterium tuberculosis H37Rv
cggggcugccgaacagc

SEQ ID NO: 3252164 - RNA, 15 nt, Mycobacterium tuberculosis H37Rv
cggggcugccgccgu

SEQ ID NO: 3252165 - RNA, 21 nt, Mycobacterium tuberculosis H37Rv
cggggcuucaucuggcgccgu

SEQ ID NO: 3252166 - RNA, 16 nt, Mycobacterium tuberculosis H37Rv
cggggcuuggcgacgu

SEQ ID NO: 3252167 - RNA, 17 nt, Mycobacterium tuberculosis H37Rv
cggggcuuggcgacguc

SEQ ID NO: 3252168 - RNA, 12 nt, Mycobacterium tuberculosis H37Rv
cgggggaagcgc

SEQ ID NO: 3252169 - RNA, 17 nt, Mycobacterium tuberculosis H37Rv
cgggggaccccgccagc

SEQ ID NO: 3252170 - RNA, 20 nt, Mycobacterium tuberculosis H37Rv
cgggggaccccgccagccgg

SEQ ID NO: 3252171 - RNA, 18 nt, Mycobacterium tuberculosis H37Rv
cgggggagcgaacggcgc

SEQ ID NO: 3252172 - RNA, 19 nt, Mycobacterium tuberculosis H37Rv
cgggggagcgaacggcgca

SEQ ID NO: 3252173 - RNA, 22 nt, Mycobacterium tuberculosis H37Rv
cgggggagcgaacggcgcaguu

SEQ ID NO: 3252174 - RNA, 19 nt, Mycobacterium tuberculosis H37Rv
cgggggauccggcgcagcg

SEQ ID NO: 3252175 - RNA, 18 nt, Mycobacterium tuberculosis H37Rv
cgggggaucucgagccgc

SEQ ID NO: 3252176 - RNA, 20 nt, Mycobacterium tuberculosis H37Rv
cgggggauuucgcgucugcu

SEQ ID NO: 3252177 - RNA, 15 nt, Mycobacterium tuberculosis H37Rv
cgggggccagcguca

SEQ ID NO: 3252178 - RNA, 21 nt, Mycobacterium tuberculosis H37Rv
cgggggccgaccagucgacgu

SEQ ID NO: 3252179 - RNA, 16 nt, Mycobacterium tuberculosis H37Rv
cgggggccgagccgac

SEQ ID NO: 3252180 - RNA, 13 nt, Mycobacterium tuberculosis H37Rv
cgggggcgucgcc

SEQ ID NO: 3252181 - RNA, 20 nt, Mycobacterium tuberculosis H37Rv
cgggggcuguccaccgaggc

SEQ ID NO: 3252182 - RNA, 18 nt, Mycobacterium tuberculosis H37Rv
cgggggcuuaugcgacug

SEQ ID NO: 3252183 - RNA, 19 nt, Mycobacterium tuberculosis H37Rv
cgggggcuuaugcgucugc

SEQ ID NO: 3252184 - RNA, 20 nt, Mycobacterium tuberculosis H37Rv
cgggggcuuaugcgucugcu

SEQ ID NO: 3252185 - RNA, 22 nt, Mycobacterium tuberculosis H37Rv
cgggggcuuuuacgucugcucg

SEQ ID NO: 3252186 - RNA, 15 nt, Mycobacterium tuberculosis H37Rv
cggggggauccagca

SEQ ID NO: 3252187 - RNA, 20 nt, Mycobacterium tuberculosis H37Rv
cggggggauccagcaggccg

SEQ ID NO: 3252188 - RNA, 14 nt, Mycobacterium tuberculosis H37Rv
cggggggccggacu

SEQ ID NO: 3252189 - RNA, 22 nt, Mycobacterium tuberculosis H37Rv
cggggggccggacugaagccgc

SEQ ID NO: 3252190 - RNA, 13 nt, Mycobacterium tuberculosis H37Rv
cggggggccucgu

SEQ ID NO: 3252191 - RNA, 16 nt, Mycobacterium tuberculosis H37Rv
cggggggcgucgccgu

SEQ ID NO: 3252192 - RNA, 15 nt, Mycobacterium tuberculosis H37Rv
cggggggcugcugcu

SEQ ID NO: 3252193 - RNA, 16 nt, Mycobacterium tuberculosis H37Rv
cggggguacgucaccg

SEQ ID NO: 3252194 - RNA, 19 nt, Mycobacterium tuberculosis H37Rv
cggggguacgucaccgggu

SEQ ID NO: 3252195 - RNA, 18 nt, Mycobacterium tuberculosis H37Rv
cgggggucgggcgugucg

SEQ ID NO: 3252196 - RNA, 21 nt, Mycobacterium tuberculosis H37Rv
cgggguacagacacgcgcgcu

SEQ ID NO: 3252197 - RNA, 17 nt, Mycobacterium tuberculosis H37Rv
cgggguacccgguggca

SEQ ID NO: 3252198 - RNA, 15 nt, Mycobacterium tuberculosis H37Rv
cgggguaggcccagc

SEQ ID NO: 3252199 - RNA, 20 nt, Mycobacterium tuberculosis H37Rv
cgggguaucgacccuccagc

SEQ ID NO: 3252200 - RNA, 18 nt, Mycobacterium tuberculosis H37Rv
cggggucagauccaggac

SEQ ID NO: 3252201 - RNA, 14 nt, Mycobacterium tuberculosis H37Rv
cgggguccagcggg

SEQ ID NO: 3252202 - RNA, 18 nt, Mycobacterium tuberculosis H37Rv
cgggguccaucggggccg

SEQ ID NO: 3252203 - RNA, 21 nt, Mycobacterium tuberculosis H37Rv
cgggguccaucggggccgucg

SEQ ID NO: 3252204 - RNA, 23 nt, Mycobacterium tuberculosis H37Rv
cggggucgaacaugauccgccgg

SEQ ID NO: 3252205 - RNA, 17 nt, Mycobacterium tuberculosis H37Rv
cggggucgccggcaccg

SEQ ID NO: 3252206 - RNA, 21 nt, Mycobacterium tuberculosis H37Rv
cggggucgcggaucucaucgg

SEQ ID NO: 3252207 - RNA, 23 nt, Mycobacterium tuberculosis H37Rv
cggggucggccugcggcaccggc

SEQ ID NO: 3252208 - RNA, 19 nt, Mycobacterium tuberculosis H37Rv
cggggucuugacggcgcca

SEQ ID NO: 3252209 - RNA, 19 nt, Mycobacterium tuberculosis H37Rv
cggggugaaaaucgccauc

SEQ ID NO: 3252210 - RNA, 15 nt, Mycobacterium tuberculosis H37Rv
cgggucguucuccgc

SEQ ID NO: 3252211 - RNA, 17 nt, Mycobacterium tuberculosis H37Rv
cgggucuccggcgcacc

SEQ ID NO: 3252212 - RNA, 17 nt, Mycobacterium tuberculosis H37Rv
cgggucucgccgaccuu

SEQ ID NO: 3252213 - RNA, 14 nt, Mycobacterium tuberculosis H37Rv
cgggucucggugcg

SEQ ID NO: 3252214 - RNA, 12 nt, Mycobacterium tuberculosis H37Rv
cgggucugggug

SEQ ID NO: 3252215 - RNA, 18 nt, Mycobacterium tuberculosis H37Rv
cgggucuuggcacacagg

SEQ ID NO: 3252216 - RNA, 23 nt, Mycobacterium tuberculosis H37Rv
cgggugacccgugcggccacggu

SEQ ID NO: 3252217 - RNA, 15 nt, Mycobacterium tuberculosis H37Rv
cgggugacucgggca

SEQ ID NO: 3252218 - RNA, 19 nt, Mycobacterium tuberculosis H37Rv
cgggugacucgggcacggg

SEQ ID NO: 3252219 - RNA, 19 nt, Mycobacterium tuberculosis H37Rv
cgggugagcaccacgugcg

SEQ ID NO: 3252220 - RNA, 18 nt, Mycobacterium tuberculosis H37Rv
cgggugagcacccagcgg

SEQ ID NO: 3252221 - RNA, 21 nt, Mycobacterium tuberculosis H37Rv
cgggugaguaacacgugggug

SEQ ID NO: 3252222 - RNA, 17 nt, Mycobacterium tuberculosis H37Rv
cgggugaguucggcgua

SEQ ID NO: 3252223 - RNA, 11 nt, Mycobacterium tuberculosis H37Rv
cgggugaucuu

SEQ ID NO: 3252224 - RNA, 18 nt, Mycobacterium tuberculosis H37Rv
cgggugaucuuggcgccc

SEQ ID NO: 3252225 - RNA, 23 nt, Mycobacterium tuberculosis H37Rv
cgggugaugacgccgucggcgcg

SEQ ID NO: 3252226 - RNA, 17 nt, Mycobacterium tuberculosis H37Rv
cgggugcaacggcguug

SEQ ID NO: 3252227 - RNA, 12 nt, Mycobacterium tuberculosis H37Rv
cgggugcaccgg

SEQ ID NO: 3252228 - RNA, 13 nt, Mycobacterium tuberculosis H37Rv
cgggugcaggcga

SEQ ID NO: 3252229 - RNA, 23 nt, Mycobacterium tuberculosis H37Rv
cgggugcaggcgaguuaggccgc

SEQ ID NO: 3252230 - RNA, 14 nt, Mycobacterium tuberculosis H37Rv
cgggugccagcccg

SEQ ID NO: 3252231 - RNA, 18 nt, Mycobacterium tuberculosis H37Rv
cgggugccgacgucggca

SEQ ID NO: 3252232 - RNA, 15 nt, Mycobacterium tuberculosis H37Rv
cgggugccgagcugg

SEQ ID NO: 3252233 - RNA, 18 nt, Mycobacterium tuberculosis H37Rv
cgggugccgagcuggcga

SEQ ID NO: 3252234 - RNA, 23 nt, Mycobacterium tuberculosis H37Rv
cgggugccgcgccguagagccgc

SEQ ID NO: 3252235 - RNA, 21 nt, Mycobacterium tuberculosis H37Rv
cgggugcgacgcgaccgcgau

SEQ ID NO: 3252236 - RNA, 15 nt, Mycobacterium tuberculosis H37Rv
cgggugcgacggcgu

SEQ ID NO: 3252237 - RNA, 17 nt, Mycobacterium tuberculosis H37Rv
cgggugcgacggcguug

SEQ ID NO: 3252238 - RNA, 15 nt, Mycobacterium tuberculosis H37Rv
cgggugcgcccggcc

SEQ ID NO: 3252239 - RNA, 22 nt, Mycobacterium tuberculosis H37Rv
cgggugcgccguugccgccguc

SEQ ID NO: 3252240 - RNA, 14 nt, Mycobacterium tuberculosis H37Rv
cgggugcgcugcga

SEQ ID NO: 3252241 - RNA, 21 nt, Mycobacterium tuberculosis H37Rv
cgggugcgggccgaacacacc

SEQ ID NO: 3252242 - RNA, 19 nt, Mycobacterium tuberculosis H37Rv
cgggugcgggcgugguaac

SEQ ID NO: 3252243 - RNA, 23 nt, Mycobacterium tuberculosis H37Rv
cgggugcuacuggguggguagcu

SEQ ID NO: 3252244 - RNA, 17 nt, Mycobacterium tuberculosis H37Rv
cgggugcuggucaacag

SEQ ID NO: 3252245 - RNA, 22 nt, Mycobacterium tuberculosis H37Rv
cggguggacaccugcugcaccg

SEQ ID NO: 3252246 - RNA, 19 nt, Mycobacterium tuberculosis H37Rv
cggguggaguuggcugccg

SEQ ID NO: 3252247 - RNA, 21 nt, Mycobacterium tuberculosis H37Rv
cggguggaucuucaccucgau

SEQ ID NO: 3252248 - RNA, 22 nt, Mycobacterium tuberculosis H37Rv
cggguggaucuucaccucgaug

SEQ ID NO: 3252249 - RNA, 16 nt, Mycobacterium tuberculosis H37Rv
cggguggcagcggcga

SEQ ID NO: 3252250 - RNA, 19 nt, Mycobacterium tuberculosis H37Rv
cggguggcagcggcgaucg

SEQ ID NO: 3252251 - RNA, 18 nt, Mycobacterium tuberculosis H37Rv
cggguggccacgcccagg

SEQ ID NO: 3252252 - RNA, 17 nt, Mycobacterium tuberculosis H37Rv
cggguggcgaggcagca

SEQ ID NO: 3252253 - RNA, 16 nt, Mycobacterium tuberculosis H37Rv
cggguggcgccagguc

SEQ ID NO: 3252254 - RNA, 15 nt, Mycobacterium tuberculosis H37Rv
cggguggcgccaguu

SEQ ID NO: 3252255 - RNA, 18 nt, Mycobacterium tuberculosis H37Rv
cggguggcgccaguucgg

SEQ ID NO: 3252256 - RNA, 19 nt, Mycobacterium tuberculosis H37Rv
cggguggcgccaguucggc

SEQ ID NO: 3252257 - RNA, 13 nt, Mycobacterium tuberculosis H37Rv
cggguggcucggg

SEQ ID NO: 3252258 - RNA, 21 nt, Mycobacterium tuberculosis H37Rv
cggguggcuuccggggugaca

SEQ ID NO: 3252259 - RNA, 21 nt, Mycobacterium tuberculosis H37Rv
cgggugggagcagccgaaccg

SEQ ID NO: 3252260 - RNA, 19 nt, Mycobacterium tuberculosis H37Rv
cggguggggaucacgauca

SEQ ID NO: 3252261 - RNA, 18 nt, Mycobacterium tuberculosis H37Rv
cgggugggucguucaccg

SEQ ID NO: 3252262 - RNA, 23 nt, Mycobacterium tuberculosis H37Rv
cggguggugaaguagucggcgcc

SEQ ID NO: 3252263 - RNA, 16 nt, Mycobacterium tuberculosis H37Rv
cggguggugccagguc

SEQ ID NO: 3252264 - RNA, 23 nt, Mycobacterium tuberculosis H37Rv
cgggugguucaccucggcgacga

SEQ ID NO: 3252265 - RNA, 18 nt, Mycobacterium tuberculosis H37Rv
cgggugguuguucggcca

SEQ ID NO: 3252266 - RNA, 13 nt, Mycobacterium tuberculosis H37Rv
cgggugucgggcg

SEQ ID NO: 3252267 - RNA, 16 nt, Mycobacterium tuberculosis H37Rv
cgggugugacgcgcgc

SEQ ID NO: 3252268 - RNA, 14 nt, Mycobacterium tuberculosis H37Rv
cggguguggucacc

SEQ ID NO: 3252269 - RNA, 16 nt, Mycobacterium tuberculosis H37Rv
cggguguuaucggucg

SEQ ID NO: 3252270 - RNA, 17 nt, Mycobacterium tuberculosis H37Rv
cggguguuccacaccag

SEQ ID NO: 3252271 - RNA, 22 nt, Mycobacterium tuberculosis H37Rv
cggguguuccacaccaggccga

SEQ ID NO: 3252272 - RNA, 24 nt, Mycobacterium tuberculosis H37Rv
cggguguuggggaucgcaccgugg

SEQ ID NO: 3252273 - RNA, 20 nt, Mycobacterium tuberculosis H37Rv
cggguucacuuccgggcagc

SEQ ID NO: 3252274 - RNA, 23 nt, Mycobacterium tuberculosis H37Rv
cggguucacuuccgggcagcugg

SEQ ID NO: 3252275 - RNA, 17 nt, Mycobacterium tuberculosis H37Rv
cggguuccauguccggc

SEQ ID NO: 3252276 - RNA, 20 nt, Mycobacterium tuberculosis H37Rv
cggguuccgaucucaagggc

SEQ ID NO: 3252277 - RNA, 20 nt, Mycobacterium tuberculosis H37Rv
cggguucgacguugaucgcc

SEQ ID NO: 3252278 - RNA, 20 nt, Mycobacterium tuberculosis H37Rv
cggguucgccggauccgauc

SEQ ID NO: 3252279 - RNA, 15 nt, Mycobacterium tuberculosis H37Rv
cggguugagccgccg

SEQ ID NO: 3252280 - RNA, 15 nt, Mycobacterium tuberculosis H37Rv
cggguugcagcagca

SEQ ID NO: 3252281 - RNA, 13 nt, Mycobacterium tuberculosis H37Rv
cggguugcccugg

SEQ ID NO: 3252282 - RNA, 14 nt, Mycobacterium tuberculosis H37Rv
cggguugcgacgaa

SEQ ID NO: 3252283 - RNA, 17 nt, Mycobacterium tuberculosis H37Rv
cggguuggaagccgcac

SEQ ID NO: 3252284 - RNA, 14 nt, Mycobacterium tuberculosis H37Rv
cggguuggccaccu

SEQ ID NO: 3252285 - RNA, 18 nt, Mycobacterium tuberculosis H37Rv
cggguuggccgggcuggc

SEQ ID NO: 3252286 - RNA, 15 nt, Mycobacterium tuberculosis H37Rv
cggguuggcgacgau

SEQ ID NO: 3252287 - RNA, 19 nt, Mycobacterium tuberculosis H37Rv
cggguuggcgccggccagu

SEQ ID NO: 3252288 - RNA, 14 nt, Mycobacterium tuberculosis H37Rv
cggguuggcgucgc

SEQ ID NO: 3252289 - RNA, 23 nt, Mycobacterium tuberculosis H37Rv
cggguugggcaucaggccgcgcg

SEQ ID NO: 3252290 - RNA, 20 nt, Mycobacterium tuberculosis H37Rv
cggguuggugggucggggcg

SEQ ID NO: 3252291 - RNA, 17 nt, Mycobacterium tuberculosis H37Rv
cggguuugaucagcucg

SEQ ID NO: 3252292 - RNA, 14 nt, Mycobacterium tuberculosis H37Rv
cggguuugaucucc

SEQ ID NO: 3252293 - RNA, 14 nt, Mycobacterium tuberculosis H37Rv
cgguaaaccacucg

SEQ ID NO: 3252294 - RNA, 20 nt, Mycobacterium tuberculosis H37Rv
cgguaaagcucaccacaucg

SEQ ID NO: 3252295 - RNA, 15 nt, Mycobacterium tuberculosis H37Rv
cgguaaccacgcgga

SEQ ID NO: 3252296 - RNA, 13 nt, Mycobacterium tuberculosis H37Rv
cgguaagcgaaac

SEQ ID NO: 3252297 - RNA, 17 nt, Mycobacterium tuberculosis H37Rv
cgguaauacaggugcag

SEQ ID NO: 3252298 - RNA, 13 nt, Mycobacterium tuberculosis H37Rv
cgguacaucgacc

SEQ ID NO: 3252299 - RNA, 15 nt, Mycobacterium tuberculosis H37Rv
cgguacaucgaccac

SEQ ID NO: 3252300 - RNA, 17 nt, Mycobacterium tuberculosis H37Rv
cgguaccaaccugcgcg

SEQ ID NO: 3252301 - RNA, 15 nt, Mycobacterium tuberculosis H37Rv
cgguaccaccggcac

SEQ ID NO: 3252302 - RNA, 18 nt, Mycobacterium tuberculosis H37Rv
cgguaccaucaccgcgcc

SEQ ID NO: 3252303 - RNA, 24 nt, Mycobacterium tuberculosis H37Rv
cgguaccaucaccgcgccagccuc

SEQ ID NO: 3252304 - RNA, 21 nt, Mycobacterium tuberculosis H37Rv
cgguacccaccucccgcagcc

SEQ ID NO: 3252305 - RNA, 17 nt, Mycobacterium tuberculosis H37Rv
cgguaccccagcgcugu

SEQ ID NO: 3252306 - RNA, 13 nt, Mycobacterium tuberculosis H37Rv
cgguccagcagcu

SEQ ID NO: 3252307 - RNA, 15 nt, Mycobacterium tuberculosis H37Rv
cgguccagccaccgc

SEQ ID NO: 3252308 - RNA, 16 nt, Mycobacterium tuberculosis H37Rv
cgguccagccaccgcc

SEQ ID NO: 3252309 - RNA, 20 nt, Mycobacterium tuberculosis H37Rv
cgguccagccgguccagacc

SEQ ID NO: 3252310 - RNA, 15 nt, Mycobacterium tuberculosis H37Rv
cgguccagcgccggc

SEQ ID NO: 3252311 - RNA, 18 nt, Mycobacterium tuberculosis H37Rv
cgguccaggccggcaccc

SEQ ID NO: 3252312 - RNA, 16 nt, Mycobacterium tuberculosis H37Rv
cgguccagggccuguu

SEQ ID NO: 3252313 - RNA, 21 nt, Mycobacterium tuberculosis H37Rv
cgguccagguucuucuccacc

SEQ ID NO: 3252314 - RNA, 12 nt, Mycobacterium tuberculosis H37Rv
cgguccaucagc

SEQ ID NO: 3252315 - RNA, 17 nt, Mycobacterium tuberculosis H37Rv
cgguccaucagcacggu

SEQ ID NO: 3252316 - RNA, 16 nt, Mycobacterium tuberculosis H37Rv
cgguccaucccgagcu

SEQ ID NO: 3252317 - RNA, 20 nt, Mycobacterium tuberculosis H37Rv
cgguccaucccgagcuccgc

SEQ ID NO: 3252318 - RNA, 16 nt, Mycobacterium tuberculosis H37Rv
cggucccacggccggc

SEQ ID NO: 3252319 - RNA, 15 nt, Mycobacterium tuberculosis H37Rv
cggucccacucgucg

SEQ ID NO: 3252320 - RNA, 22 nt, Mycobacterium tuberculosis H37Rv
cggucccaugugcccgcacccg

SEQ ID NO: 3252321 - RNA, 23 nt, Mycobacterium tuberculosis H37Rv
cggucccaugugcccgcacccgc

SEQ ID NO: 3252322 - RNA, 22 nt, Mycobacterium tuberculosis H37Rv
cgguccccaggucguaggcgcu

SEQ ID NO: 3252323 - RNA, 19 nt, Mycobacterium tuberculosis H37Rv
cgguccccccguugccgcc

SEQ ID NO: 3252324 - RNA, 18 nt, Mycobacterium tuberculosis H37Rv
cgguccccgccggcgggu

SEQ ID NO: 3252325 - RNA, 16 nt, Mycobacterium tuberculosis H37Rv
cggucccgcauauccg

SEQ ID NO: 3252326 - RNA, 19 nt, Mycobacterium tuberculosis H37Rv
cggucccggcacgucgacc

SEQ ID NO: 3252327 - RNA, 21 nt, Mycobacterium tuberculosis H37Rv
cggucccuuuguggggccggg

SEQ ID NO: 3252328 - RNA, 23 nt, Mycobacterium tuberculosis H37Rv
cgguccgagcggcaucggucacc

SEQ ID NO: 3252329 - RNA, 19 nt, Mycobacterium tuberculosis H37Rv
cgguccgauucgugcgguc

SEQ ID NO: 3252330 - RNA, 18 nt, Mycobacterium tuberculosis H37Rv
cgguccgccacggcgggc

SEQ ID NO: 3252331 - RNA, 16 nt, Mycobacterium tuberculosis H37Rv
cgguccgccgcagacc

SEQ ID NO: 3252332 - RNA, 22 nt, Mycobacterium tuberculosis H37Rv
cgguccggauugaagucgucgg

SEQ ID NO: 3252333 - RNA, 16 nt, Mycobacterium tuberculosis H37Rv
cgguccggcccaccag

SEQ ID NO: 3252334 - RNA, 17 nt, Mycobacterium tuberculosis H37Rv
cgguccggcccaccagc

SEQ ID NO: 3252335 - RNA, 15 nt, Mycobacterium tuberculosis H37Rv
cgguccggcccgggg

SEQ ID NO: 3252336 - RNA, 22 nt, Mycobacterium tuberculosis H37Rv
cgguccgguacucguccgcggg

SEQ ID NO: 3252337 - RNA, 18 nt, Mycobacterium tuberculosis H37Rv
cgguccgucaccaccgcc

SEQ ID NO: 3252338 - RNA, 17 nt, Mycobacterium tuberculosis H37Rv
cgguccguucgcgccgu

SEQ ID NO: 3252339 - RNA, 16 nt, Mycobacterium tuberculosis H37Rv
cgguccucgagccgau

SEQ ID NO: 3252340 - RNA, 13 nt, Mycobacterium tuberculosis H37Rv
cgguccucgaucg

SEQ ID NO: 3252341 - RNA, 13 nt, Mycobacterium tuberculosis H37Rv
cgguccucgucgg

SEQ ID NO: 3252342 - RNA, 14 nt, Mycobacterium tuberculosis H37Rv
cgguccugcucgca

SEQ ID NO: 3252343 - RNA, 21 nt, Mycobacterium tuberculosis H37Rv
cgguccugguguagccgagca

SEQ ID NO: 3252344 - RNA, 14 nt, Mycobacterium tuberculosis H37Rv
cgguccuugccgua

SEQ ID NO: 3252345 - RNA, 23 nt, Mycobacterium tuberculosis H37Rv
cggucgaagcuggcacgcagagc

SEQ ID NO: 3252346 - RNA, 23 nt, Mycobacterium tuberculosis H37Rv
cggucgaauucuguugugccgca

SEQ ID NO: 3252347 - RNA, 21 nt, Mycobacterium tuberculosis H37Rv
cggucgaccaauuggucgagu

SEQ ID NO: 3252348 - RNA, 13 nt, Mycobacterium tuberculosis H37Rv
cggucgaccgugc

SEQ ID NO: 3252349 - RNA, 15 nt, Mycobacterium tuberculosis H37Rv
cggucgaccugagcc

SEQ ID NO: 3252350 - RNA, 15 nt, Mycobacterium tuberculosis H37Rv
cggucgacgaucucg

SEQ ID NO: 3252351 - RNA, 13 nt, Mycobacterium tuberculosis H37Rv
cggucgacuccag

SEQ ID NO: 3252352 - RNA, 14 nt, Mycobacterium tuberculosis H37Rv
cggucgacuccagc

SEQ ID NO: 3252353 - RNA, 19 nt, Mycobacterium tuberculosis H37Rv
cggucgacuccagcaccag

SEQ ID NO: 3252354 - RNA, 22 nt, Mycobacterium tuberculosis H37Rv
cggucgacuccagcaccagcac

SEQ ID NO: 3252355 - RNA, 20 nt, Mycobacterium tuberculosis H37Rv
cggucgagccagcggagcag

SEQ ID NO: 3252356 - RNA, 22 nt, Mycobacterium tuberculosis H37Rv
cggucgaggcccucgcgcgcgu

SEQ ID NO: 3252357 - RNA, 21 nt, Mycobacterium tuberculosis H37Rv
cggucgagguggcgggcgaug

SEQ ID NO: 3252358 - RNA, 17 nt, Mycobacterium tuberculosis H37Rv
cggucgaguagccguag

SEQ ID NO: 3252359 - RNA, 21 nt, Mycobacterium tuberculosis H37Rv
cggucgaguauugcaggaaau

SEQ ID NO: 3252360 - RNA, 18 nt, Mycobacterium tuberculosis H37Rv
cggucgaucacacggucc

SEQ ID NO: 3252361 - RNA, 12 nt, Mycobacterium tuberculosis H37Rv
cggucgaugacc

SEQ ID NO: 3252362 - RNA, 14 nt, Mycobacterium tuberculosis H37Rv
cggucgaugaccuc

SEQ ID NO: 3252363 - RNA, 21 nt, Mycobacterium tuberculosis H37Rv
cggucgauguccgcagcaccg

SEQ ID NO: 3252364 - RNA, 15 nt, Mycobacterium tuberculosis H37Rv
cggucgcagcagacc

SEQ ID NO: 3252365 - RNA, 19 nt, Mycobacterium tuberculosis H37Rv
cggucgcagcagaccacaa

SEQ ID NO: 3252366 - RNA, 16 nt, Mycobacterium tuberculosis H37Rv
cggucgcauggucgac

SEQ ID NO: 3252367 - RNA, 20 nt, Mycobacterium tuberculosis H37Rv
cggucgcauggucgacgaac

SEQ ID NO: 3252368 - RNA, 20 nt, Mycobacterium tuberculosis H37Rv
cggucgccaagaucgggugg

SEQ ID NO: 3252369 - RNA, 13 nt, Mycobacterium tuberculosis H37Rv
cggucgccaccgc

SEQ ID NO: 3252370 - RNA, 18 nt, Mycobacterium tuberculosis H37Rv
cggucgccaccgccggca

SEQ ID NO: 3252371 - RNA, 14 nt, Mycobacterium tuberculosis H37Rv
cggucgccaccgug

SEQ ID NO: 3252372 - RNA, 20 nt, Mycobacterium tuberculosis H37Rv
cggucgcccgcuaccaacgc

SEQ ID NO: 3252373 - RNA, 17 nt, Mycobacterium tuberculosis H37Rv
cggucgccgaccacucg

SEQ ID NO: 3252374 - RNA, 13 nt, Mycobacterium tuberculosis H37Rv
cggucgccgcgcg

SEQ ID NO: 3252375 - RNA, 14 nt, Mycobacterium tuberculosis H37Rv
cggucgccgcgcgu

SEQ ID NO: 3252376 - RNA, 18 nt, Mycobacterium tuberculosis H37Rv
cggucgccgggacgauac

SEQ ID NO: 3252377 - RNA, 20 nt, Mycobacterium tuberculosis H37Rv
cggucgccggucaucgccga

SEQ ID NO: 3252378 - RNA, 21 nt, Mycobacterium tuberculosis H37Rv
cggucgccggucaucgccgaa

SEQ ID NO: 3252379 - RNA, 20 nt, Mycobacterium tuberculosis H37Rv
cggucgccgugaugcugguc

SEQ ID NO: 3252380 - RNA, 24 nt, Mycobacterium tuberculosis H37Rv
cggucgccucaccggcgcgagcag

SEQ ID NO: 3252381 - RNA, 22 nt, Mycobacterium tuberculosis H37Rv
cggucgccucgcuaacucccca

SEQ ID NO: 3252382 - RNA, 23 nt, Mycobacterium tuberculosis H37Rv
cggucgccuggaagaucacgcgu

SEQ ID NO: 3252383 - RNA, 15 nt, Mycobacterium tuberculosis H37Rv
cggucgcggcugaca

SEQ ID NO: 3252384 - RNA, 16 nt, Mycobacterium tuberculosis H37Rv
cggucgcggcugacaa

SEQ ID NO: 3252385 - RNA, 17 nt, Mycobacterium tuberculosis H37Rv
cggucgcguaccggugg

SEQ ID NO: 3252386 - RNA, 22 nt, Mycobacterium tuberculosis H37Rv
cggucgcguaccgguggaaacc

SEQ ID NO: 3252387 - RNA, 19 nt, Mycobacterium tuberculosis H37Rv
cggucgcucgacgaccacg

SEQ ID NO: 3252388 - RNA, 15 nt, Mycobacterium tuberculosis H37Rv
cggucgcuugcuguc

SEQ ID NO: 3252389 - RNA, 15 nt, Mycobacterium tuberculosis H37Rv
cggucggacggccau

SEQ ID NO: 3252390 - RNA, 22 nt, Mycobacterium tuberculosis H37Rv
cggucggacggccaucgccagc

SEQ ID NO: 3252391 - RNA, 22 nt, Mycobacterium tuberculosis H37Rv
cggucggagcggugccgacggu

SEQ ID NO: 3252392 - RNA, 15 nt, Mycobacterium tuberculosis H37Rv
cggucggcaccaggu

SEQ ID NO: 3252393 - RNA, 15 nt, Mycobacterium tuberculosis H37Rv
cggucggcagcgacg

SEQ ID NO: 3252394 - RNA, 15 nt, Mycobacterium tuberculosis H37Rv
cggucggcagcuggg

SEQ ID NO: 3252395 - RNA, 19 nt, Mycobacterium tuberculosis H37Rv
cggucggcagcuucucgcc

SEQ ID NO: 3252396 - RNA, 15 nt, Mycobacterium tuberculosis H37Rv
cggucggccaccaac

SEQ ID NO: 3252397 - RNA, 16 nt, Mycobacterium tuberculosis H37Rv
cggucggccaggccgu

SEQ ID NO: 3252398 - RNA, 20 nt, Mycobacterium tuberculosis H37Rv
cggucggccauccaccgcag

SEQ ID NO: 3252399 - RNA, 23 nt, Mycobacterium tuberculosis H37Rv
cggucggccauugcccgggcggg

SEQ ID NO: 3252400 - RNA, 23 nt, Mycobacterium tuberculosis H37Rv
cggucggccugcgaacacgcgau

SEQ ID NO: 3252401 - RNA, 22 nt, Mycobacterium tuberculosis H37Rv
cggucggcgaccaccagcgccg

SEQ ID NO: 3252402 - RNA, 22 nt, Mycobacterium tuberculosis H37Rv
cggugaucagguaagcgaacgg

SEQ ID NO: 3252403 - RNA, 20 nt, Mycobacterium tuberculosis H37Rv
cggugauccaacuggccgcg

SEQ ID NO: 3252404 - RNA, 23 nt, Mycobacterium tuberculosis H37Rv
cggugaucgauccggcuccaccc

SEQ ID NO: 3252405 - RNA, 19 nt, Mycobacterium tuberculosis H37Rv
cggugaucgccggcuucgc

SEQ ID NO: 3252406 - RNA, 18 nt, Mycobacterium tuberculosis H37Rv
cggugaucucgcgcuccc

SEQ ID NO: 3252407 - RNA, 20 nt, Mycobacterium tuberculosis H37Rv
cggugaucuugccggccagc

SEQ ID NO: 3252408 - RNA, 22 nt, Mycobacterium tuberculosis H37Rv
cggugaucuugccggccagcag

SEQ ID NO: 3252409 - RNA, 20 nt, Mycobacterium tuberculosis H37Rv
cggugaugaacgacauccgg

SEQ ID NO: 3252410 - RNA, 22 nt, Mycobacterium tuberculosis H37Rv
cggugaugacguagucgucuuc

SEQ ID NO: 3252411 - RNA, 21 nt, Mycobacterium tuberculosis H37Rv
cggugaugaucgcgccgggcu

SEQ ID NO: 3252412 - RNA, 18 nt, Mycobacterium tuberculosis H37Rv
cggugaugcccagcgccg

SEQ ID NO: 3252413 - RNA, 18 nt, Mycobacterium tuberculosis H37Rv
cggugauggccgaccagc

SEQ ID NO: 3252414 - RNA, 23 nt, Mycobacterium tuberculosis H37Rv
cggugauggccgaccagccgauc

SEQ ID NO: 3252415 - RNA, 24 nt, Mycobacterium tuberculosis H37Rv
cggugauggccgaccagccgauca

SEQ ID NO: 3252416 - RNA, 21 nt, Mycobacterium tuberculosis H37Rv
cggugaugggggagccgguga

SEQ ID NO: 3252417 - RNA, 16 nt, Mycobacterium tuberculosis H37Rv
cggugauggucaccgu

SEQ ID NO: 3252418 - RNA, 14 nt, Mycobacterium tuberculosis H37Rv
cggugauggucagc

SEQ ID NO: 3252419 - RNA, 20 nt, Mycobacterium tuberculosis H37Rv
cggugauggugugcagcagc

SEQ ID NO: 3252420 - RNA, 14 nt, Mycobacterium tuberculosis H37Rv
cggugaugguuacc

SEQ ID NO: 3252421 - RNA, 20 nt, Mycobacterium tuberculosis H37Rv
cggugauguagggcugcucc

SEQ ID NO: 3252422 - RNA, 17 nt, Mycobacterium tuberculosis H37Rv
cggugauuccagccgga

SEQ ID NO: 3252423 - RNA, 12 nt, Mycobacterium tuberculosis H37Rv
cggugauugaca

SEQ ID NO: 3252424 - RNA, 15 nt, Mycobacterium tuberculosis H37Rv
cggugauugacaaca

SEQ ID NO: 3252425 - RNA, 20 nt, Mycobacterium tuberculosis H37Rv
cggugcacaaaauacuccgc

SEQ ID NO: 3252426 - RNA, 21 nt, Mycobacterium tuberculosis H37Rv
cggugcacaacgcccaccacg

SEQ ID NO: 3252427 - RNA, 13 nt, Mycobacterium tuberculosis H37Rv
cggugcacaccgu

SEQ ID NO: 3252428 - RNA, 20 nt, Mycobacterium tuberculosis H37Rv
cggugcacacugaccccgcc

SEQ ID NO: 3252429 - RNA, 12 nt, Mycobacterium tuberculosis H37Rv
cggugcaccagg

SEQ ID NO: 3252430 - RNA, 18 nt, Mycobacterium tuberculosis H37Rv
cggugcacgagcggacag

SEQ ID NO: 3252431 - RNA, 16 nt, Mycobacterium tuberculosis H37Rv
cggugcagaucggcuc

SEQ ID NO: 3252432 - RNA, 22 nt, Mycobacterium tuberculosis H37Rv
cggugcagcacgugugcgggca

SEQ ID NO: 3252433 - RNA, 14 nt, Mycobacterium tuberculosis H37Rv
cggugcagcccgcc

SEQ ID NO: 3252434 - RNA, 16 nt, Mycobacterium tuberculosis H37Rv
cggugcagcuccccgc

SEQ ID NO: 3252435 - RNA, 20 nt, Mycobacterium tuberculosis H37Rv
cggugcaggaccagaacucg

SEQ ID NO: 3252436 - RNA, 12 nt, Mycobacterium tuberculosis H37Rv
cggugcaggauu

SEQ ID NO: 3252437 - RNA, 20 nt, Mycobacterium tuberculosis H37Rv
cggugcaggucguccaucgc

SEQ ID NO: 3252438 - RNA, 15 nt, Mycobacterium tuberculosis H37Rv
cggugccaccacgcu

SEQ ID NO: 3252439 - RNA, 22 nt, Mycobacterium tuberculosis H37Rv
cggugccaccacgcuccccagc

SEQ ID NO: 3252440 - RNA, 21 nt, Mycobacterium tuberculosis H37Rv
cggugccaccagugagcccgc

SEQ ID NO: 3252441 - RNA, 22 nt, Mycobacterium tuberculosis H37Rv
cggugccacccuugccgccggu

SEQ ID NO: 3252442 - RNA, 12 nt, Mycobacterium tuberculosis H37Rv
cggugccaccga

SEQ ID NO: 3252443 - RNA, 12 nt, Mycobacterium tuberculosis H37Rv
cggugccaccgg

SEQ ID NO: 3252444 - RNA, 14 nt, Mycobacterium tuberculosis H37Rv
cggugccaccggcu

SEQ ID NO: 3252445 - RNA, 23 nt, Mycobacterium tuberculosis H37Rv
cggugccacggugacccuggugg

SEQ ID NO: 3252446 - RNA, 19 nt, Mycobacterium tuberculosis H37Rv
cggugccacguucgcgggc

SEQ ID NO: 3252447 - RNA, 14 nt, Mycobacterium tuberculosis H37Rv
cggugccagcacca

SEQ ID NO: 3252448 - RNA, 23 nt, Mycobacterium tuberculosis H37Rv
cggugccagcaccacgucgacga

SEQ ID NO: 3252449 - RNA, 17 nt, Mycobacterium tuberculosis H37Rv
cggugccagcacuccac

SEQ ID NO: 3252450 - RNA, 15 nt, Mycobacterium tuberculosis H37Rv
cggugccaguacucg

SEQ ID NO: 3252451 - RNA, 17 nt, Mycobacterium tuberculosis H37Rv
cggugcccagcagcgcg

SEQ ID NO: 3252452 - RNA, 15 nt, Mycobacterium tuberculosis H37Rv
cggugcccagggcga

SEQ ID NO: 3252453 - RNA, 13 nt, Mycobacterium tuberculosis H37Rv
cggugcccaucgg

SEQ ID NO: 3252454 - RNA, 14 nt, Mycobacterium tuberculosis H37Rv
cggugcccgcacca

SEQ ID NO: 3252455 - RNA, 16 nt, Mycobacterium tuberculosis H37Rv
cggugcccgcaccaca

SEQ ID NO: 3252456 - RNA, 20 nt, Mycobacterium tuberculosis H37Rv
cggugcccgcaccacaccgu

SEQ ID NO: 3252457 - RNA, 18 nt, Mycobacterium tuberculosis H37Rv
cggugcccgcggugacga

SEQ ID NO: 3252458 - RNA, 21 nt, Mycobacterium tuberculosis H37Rv
cggugcccugccggcagcggc

SEQ ID NO: 3252459 - RNA, 22 nt, Mycobacterium tuberculosis H37Rv
cggugcccugccggcagcggcg

SEQ ID NO: 3252460 - RNA, 23 nt, Mycobacterium tuberculosis H37Rv
cggugccgaacgaggaaccgucg

SEQ ID NO: 3252461 - RNA, 15 nt, Mycobacterium tuberculosis H37Rv
cggugccgaccgcgu

SEQ ID NO: 3252462 - RNA, 13 nt, Mycobacterium tuberculosis H37Rv
cggugccgaccgg

SEQ ID NO: 3252463 - RNA, 18 nt, Mycobacterium tuberculosis H37Rv
cggugccgacggugaugg

SEQ ID NO: 3252464 - RNA, 17 nt, Mycobacterium tuberculosis H37Rv
cggugccgagaucccag

SEQ ID NO: 3252465 - RNA, 16 nt, Mycobacterium tuberculosis H37Rv
cggugccgccaccggc

SEQ ID NO: 3252466 - RNA, 18 nt, Mycobacterium tuberculosis H37Rv
cggugccgccaucgccgc

SEQ ID NO: 3252467 - RNA, 17 nt, Mycobacterium tuberculosis H37Rv
cggugccgccauugacg

SEQ ID NO: 3252468 - RNA, 12 nt, Mycobacterium tuberculosis H37Rv
cggugccgccga

SEQ ID NO: 3252469 - RNA, 18 nt, Mycobacterium tuberculosis H37Rv
cggugccgccgauaccgc

SEQ ID NO: 3252470 - RNA, 21 nt, Mycobacterium tuberculosis H37Rv
cggugccgccgauaccgccgg

SEQ ID NO: 3252471 - RNA, 14 nt, Mycobacterium tuberculosis H37Rv
cggugccgccgccg

SEQ ID NO: 3252472 - RNA, 16 nt, Mycobacterium tuberculosis H37Rv
cggugccgccgccggc

SEQ ID NO: 3252473 - RNA, 22 nt, Mycobacterium tuberculosis H37Rv
cggugccgccgccggcgccgga

SEQ ID NO: 3252474 - RNA, 19 nt, Mycobacterium tuberculosis H37Rv
cggugccgccgcggccacc

SEQ ID NO: 3252475 - RNA, 20 nt, Mycobacterium tuberculosis H37Rv
cggugccgccgcggccacca

SEQ ID NO: 3252476 - RNA, 20 nt, Mycobacterium tuberculosis H37Rv
cggugccgccgggugcaacg

SEQ ID NO: 3252477 - RNA, 15 nt, Mycobacterium tuberculosis H37Rv
cggugccgccgucga

SEQ ID NO: 3252478 - RNA, 16 nt, Mycobacterium tuberculosis H37Rv
cggugccgccgucgau

SEQ ID NO: 3252479 - RNA, 23 nt, Mycobacterium tuberculosis H37Rv
cggugccgccguucccaccacca

SEQ ID NO: 3252480 - RNA, 20 nt, Mycobacterium tuberculosis H37Rv
cggugccgccuccgccugcc

SEQ ID NO: 3252481 - RNA, 23 nt, Mycobacterium tuberculosis H37Rv
cggugccgccuccgccugcccca

SEQ ID NO: 3252482 - RNA, 16 nt, Mycobacterium tuberculosis H37Rv
cggugccgccugcgcc

SEQ ID NO: 3252483 - RNA, 18 nt, Mycobacterium tuberculosis H37Rv
cggugccgccugcgccgc

SEQ ID NO: 3252484 - RNA, 18 nt, Mycobacterium tuberculosis H37Rv
cggugccggaaacgccag

SEQ ID NO: 3252485 - RNA, 18 nt, Mycobacterium tuberculosis H37Rv
cggugccggcacccgagu

SEQ ID NO: 3252486 - RNA, 14 nt, Mycobacterium tuberculosis H37Rv
cggugccggcggug

SEQ ID NO: 3252487 - RNA, 18 nt, Mycobacterium tuberculosis H37Rv
cggugccggggcugccgc

SEQ ID NO: 3252488 - RNA, 23 nt, Mycobacterium tuberculosis H37Rv
cggugccggggcugccgccguug

SEQ ID NO: 3252489 - RNA, 12 nt, Mycobacterium tuberculosis H37Rv
cggugccgucga

SEQ ID NO: 3252490 - RNA, 21 nt, Mycobacterium tuberculosis H37Rv
cggugccguuggagccgccac

SEQ ID NO: 3252491 - RNA, 17 nt, Mycobacterium tuberculosis H37Rv
cggugcgauaccgacac

SEQ ID NO: 3252492 - RNA, 13 nt, Mycobacterium tuberculosis H37Rv
cggugcgaucagg

SEQ ID NO: 3252493 - RNA, 17 nt, Mycobacterium tuberculosis H37Rv
cggugcgauccugacca

SEQ ID NO: 3252494 - RNA, 16 nt, Mycobacterium tuberculosis H37Rv
cggugcgcauccgucg

SEQ ID NO: 3252495 - RNA, 20 nt, Mycobacterium tuberculosis H37Rv
cggugcgcauggacaacagc

SEQ ID NO: 3252496 - RNA, 14 nt, Mycobacterium tuberculosis H37Rv
cggugcgccacgac

SEQ ID NO: 3252497 - RNA, 21 nt, Mycobacterium tuberculosis H37Rv
cggugcgccagaucaccgucg

SEQ ID NO: 3252498 - RNA, 19 nt, Mycobacterium tuberculosis H37Rv
cgguggucguaggugacga

SEQ ID NO: 3252499 - RNA, 21 nt, Mycobacterium tuberculosis H37Rv
cgguggucucgacggcgccgc

SEQ ID NO: 3252500 - RNA, 17 nt, Mycobacterium tuberculosis H37Rv
cgguggucugcgcggug

SEQ ID NO: 3252501 - RNA, 21 nt, Mycobacterium tuberculosis H37Rv
cgguggucuuggcccggcggu

SEQ ID NO: 3252502 - RNA, 17 nt, Mycobacterium tuberculosis H37Rv
cgguggugaccgcgggc

SEQ ID NO: 3252503 - RNA, 14 nt, Mycobacterium tuberculosis H37Rv
cgguggugaggauc

SEQ ID NO: 3252504 - RNA, 19 nt, Mycobacterium tuberculosis H37Rv
cgguggugauugacggugc

SEQ ID NO: 3252505 - RNA, 21 nt, Mycobacterium tuberculosis H37Rv
cgguggugccgcggccaccgc

SEQ ID NO: 3252506 - RNA, 14 nt, Mycobacterium tuberculosis H37Rv
cgguggugcggccc

SEQ ID NO: 3252507 - RNA, 17 nt, Mycobacterium tuberculosis H37Rv
cgguggugcggucuccg

SEQ ID NO: 3252508 - RNA, 13 nt, Mycobacterium tuberculosis H37Rv
cgguggugcugcc

SEQ ID NO: 3252509 - RNA, 14 nt, Mycobacterium tuberculosis H37Rv
cgguggugcugccg

SEQ ID NO: 3252510 - RNA, 14 nt, Mycobacterium tuberculosis H37Rv
cgguggugggccgu

SEQ ID NO: 3252511 - RNA, 21 nt, Mycobacterium tuberculosis H37Rv
cgguggugggcgggaucgacu

SEQ ID NO: 3252512 - RNA, 19 nt, Mycobacterium tuberculosis H37Rv
cggugguuagguggcuggc

SEQ ID NO: 3252513 - RNA, 16 nt, Mycobacterium tuberculosis H37Rv
cggugguuccggcugg

SEQ ID NO: 3252514 - RNA, 21 nt, Mycobacterium tuberculosis H37Rv
cggugguuuucccgucgccgc

SEQ ID NO: 3252515 - RNA, 19 nt, Mycobacterium tuberculosis H37Rv
cgguguaauugccgacgcu

SEQ ID NO: 3252516 - RNA, 17 nt, Mycobacterium tuberculosis H37Rv
cgguguacgcgaacccu

SEQ ID NO: 3252517 - RNA, 17 nt, Mycobacterium tuberculosis H37Rv
cgguguagcagcgccag

SEQ ID NO: 3252518 - RNA, 19 nt, Mycobacterium tuberculosis H37Rv
cgguguagcccagccgggu

SEQ ID NO: 3252519 - RNA, 18 nt, Mycobacterium tuberculosis H37Rv
cgguguagcguucccaca

SEQ ID NO: 3252520 - RNA, 13 nt, Mycobacterium tuberculosis H37Rv
cgguguauccgac

SEQ ID NO: 3252521 - RNA, 20 nt, Mycobacterium tuberculosis H37Rv
cgguguauccgacgucggug

SEQ ID NO: 3252522 - RNA, 17 nt, Mycobacterium tuberculosis H37Rv
cgguguauccgacuggc

SEQ ID NO: 3252523 - RNA, 21 nt, Mycobacterium tuberculosis H37Rv
cgguguauccgacuggccccg

SEQ ID NO: 3252524 - RNA, 15 nt, Mycobacterium tuberculosis H37Rv
cggugucagccgucg

SEQ ID NO: 3252525 - RNA, 14 nt, Mycobacterium tuberculosis H37Rv
cggugucgacgggg

SEQ ID NO: 3252526 - RNA, 22 nt, Mycobacterium tuberculosis H37Rv
cggugucgacguucaucuucac

SEQ ID NO: 3252527 - RNA, 15 nt, Mycobacterium tuberculosis H37Rv
cggugucgccacccg

SEQ ID NO: 3252528 - RNA, 17 nt, Mycobacterium tuberculosis H37Rv
cggugucgcgaucgcgg

SEQ ID NO: 3252529 - RNA, 15 nt, Mycobacterium tuberculosis H37Rv
cggugucgcgaugcu

SEQ ID NO: 3252530 - RNA, 18 nt, Mycobacterium tuberculosis H37Rv
cggugucgcgcgaccugg

SEQ ID NO: 3252531 - RNA, 20 nt, Mycobacterium tuberculosis H37Rv
cggugucgucaucggggccu

SEQ ID NO: 3252532 - RNA, 15 nt, Mycobacterium tuberculosis H37Rv
cggugucgucgacca

SEQ ID NO: 3252533 - RNA, 16 nt, Mycobacterium tuberculosis H37Rv
cggugucguucggcga

SEQ ID NO: 3252534 - RNA, 15 nt, Mycobacterium tuberculosis H37Rv
cggugucucgcccac

SEQ ID NO: 3252535 - RNA, 20 nt, Mycobacterium tuberculosis H37Rv
cggugucugcaaagucgggg

SEQ ID NO: 3252536 - RNA, 13 nt, Mycobacterium tuberculosis H37Rv
cggugucugggug

SEQ ID NO: 3252537 - RNA, 15 nt, Mycobacterium tuberculosis H37Rv
cggugugcacggcga

SEQ ID NO: 3252538 - RNA, 21 nt, Mycobacterium tuberculosis H37Rv
cggugugcaucgacucacgga

SEQ ID NO: 3252539 - RNA, 18 nt, Mycobacterium tuberculosis H37Rv
cggugugccagugcugca

SEQ ID NO: 3252540 - RNA, 21 nt, Mycobacterium tuberculosis H37Rv
cggugugccagugcugcaccg

SEQ ID NO: 3252541 - RNA, 14 nt, Mycobacterium tuberculosis H37Rv
cggugugcggcgca

SEQ ID NO: 3252542 - RNA, 18 nt, Mycobacterium tuberculosis H37Rv
cggugugcggcgcaugca

SEQ ID NO: 3252543 - RNA, 17 nt, Mycobacterium tuberculosis H37Rv
cggugugcuugcucggg

SEQ ID NO: 3252544 - RNA, 23 nt, Mycobacterium tuberculosis H37Rv
cgguguggacuucagcaggccca

SEQ ID NO: 3252545 - RNA, 12 nt, Mycobacterium tuberculosis H37Rv
cgguguggcacc

SEQ ID NO: 3252546 - RNA, 13 nt, Mycobacterium tuberculosis H37Rv
cgguguggcaccg

SEQ ID NO: 3252547 - RNA, 19 nt, Mycobacterium tuberculosis H37Rv
cggugugugcaagccgaac

SEQ ID NO: 3252548 - RNA, 23 nt, Mycobacterium tuberculosis H37Rv
cgguguguuccaacuccugcagc

SEQ ID NO: 3252549 - RNA, 13 nt, Mycobacterium tuberculosis H37Rv
cgguguguucggc

SEQ ID NO: 3252550 - RNA, 15 nt, Mycobacterium tuberculosis H37Rv
cgguguugagaucgc

SEQ ID NO: 3252551 - RNA, 22 nt, Mycobacterium tuberculosis H37Rv
cgguguugagcgaacccgcguu

SEQ ID NO: 3252552 - RNA, 20 nt, Mycobacterium tuberculosis H37Rv
cgguguugccggagacgucg

SEQ ID NO: 3252553 - RNA, 13 nt, Mycobacterium tuberculosis H37Rv
cgguguugcuccc

SEQ ID NO: 3252554 - RNA, 18 nt, Mycobacterium tuberculosis H37Rv
cgguguugcucgccgucg

SEQ ID NO: 3252555 - RNA, 19 nt, Mycobacterium tuberculosis H37Rv
cgguguugcucgccgucgu

SEQ ID NO: 3252556 - RNA, 15 nt, Mycobacterium tuberculosis H37Rv
cgguguuggacacuc

SEQ ID NO: 3252557 - RNA, 18 nt, Mycobacterium tuberculosis H37Rv
cgguguuuccgaaacccg

SEQ ID NO: 3252558 - RNA, 22 nt, Mycobacterium tuberculosis H37Rv
cgguguuucgacguaaugcgcu

SEQ ID NO: 3252559 - RNA, 17 nt, Mycobacterium tuberculosis H37Rv
cgguguuuggccgccga

SEQ ID NO: 3252560 - RNA, 13 nt, Mycobacterium tuberculosis H37Rv
cgguuaaggugcg

SEQ ID NO: 3252561 - RNA, 17 nt, Mycobacterium tuberculosis H37Rv
cgguuaaggugcgaucc

SEQ ID NO: 3252562 - RNA, 19 nt, Mycobacterium tuberculosis H37Rv
cgguuaccucaccgaaaga

SEQ ID NO: 3252563 - RNA, 20 nt, Mycobacterium tuberculosis H37Rv
cgguuagggcacgucgagcg

SEQ ID NO: 3252564 - RNA, 21 nt, Mycobacterium tuberculosis H37Rv
cgguuagggcacgucgagcgu

SEQ ID NO: 3252565 - RNA, 22 nt, Mycobacterium tuberculosis H37Rv
cgguucagccacgcagcacggc

SEQ ID NO: 3252566 - RNA, 19 nt, Mycobacterium tuberculosis H37Rv
cgguucauccacuccgcca

SEQ ID NO: 3252567 - RNA, 14 nt, Mycobacterium tuberculosis H37Rv
cgguuccacgcugc

SEQ ID NO: 3252568 - RNA, 15 nt, Mycobacterium tuberculosis H37Rv
cgguuccgauagccg

SEQ ID NO: 3252569 - RNA, 15 nt, Mycobacterium tuberculosis H37Rv
cgguuccgccggccc

SEQ ID NO: 3252570 - RNA, 16 nt, Mycobacterium tuberculosis H37Rv
cgguuccgccggcccc

SEQ ID NO: 3252571 - RNA, 17 nt, Mycobacterium tuberculosis H37Rv
cgguuccgccggcccca

SEQ ID NO: 3252572 - RNA, 16 nt, Mycobacterium tuberculosis H37Rv
cgguuccggccggcuc

SEQ ID NO: 3252573 - RNA, 16 nt, Mycobacterium tuberculosis H37Rv
cgguuccggucggguu

SEQ ID NO: 3252574 - RNA, 14 nt, Mycobacterium tuberculosis H37Rv
cgguuccucagcgg

SEQ ID NO: 3252575 - RNA, 19 nt, Mycobacterium tuberculosis H37Rv
cgguucgacccccgcaucg

SEQ ID NO: 3252576 - RNA, 22 nt, Mycobacterium tuberculosis H37Rv
cgguucgaugacaggcuuggca

SEQ ID NO: 3252577 - RNA, 22 nt, Mycobacterium tuberculosis H37Rv
cgguucgcccgaggcgagacgc

SEQ ID NO: 3252578 - RNA, 19 nt, Mycobacterium tuberculosis H37Rv
cgguucggcgaucuccggc

SEQ ID NO: 3252579 - RNA, 23 nt, Mycobacterium tuberculosis H37Rv
cgguucgucgaacggaucucggu

SEQ ID NO: 3252580 - RNA, 21 nt, Mycobacterium tuberculosis H37Rv
cgguucuguuccagaaggccg

SEQ ID NO: 3252581 - RNA, 14 nt, Mycobacterium tuberculosis H37Rv
cgguugaacgaccu

SEQ ID NO: 3252582 - RNA, 14 nt, Mycobacterium tuberculosis H37Rv
cgguugacacccgg

SEQ ID NO: 3252583 - RNA, 12 nt, Mycobacterium tuberculosis H37Rv
cgguugacccuc

SEQ ID NO: 3252584 - RNA, 17 nt, Mycobacterium tuberculosis H37Rv
cgguugacgccgguccc

SEQ ID NO: 3252585 - RNA, 20 nt, Mycobacterium tuberculosis H37Rv
cgguugaucgcguagcuggc

SEQ ID NO: 3252586 - RNA, 14 nt, Mycobacterium tuberculosis H37Rv
cgguugaucggcca

SEQ ID NO: 3252587 - RNA, 15 nt, Mycobacterium tuberculosis H37Rv
cgguugaucggccac

SEQ ID NO: 3252588 - RNA, 15 nt, Mycobacterium tuberculosis H37Rv
cgguugaugcaucca

SEQ ID NO: 3252589 - RNA, 21 nt, Mycobacterium tuberculosis H37Rv
cgguugaugcauccagaagua

SEQ ID NO: 3252590 - RNA, 22 nt, Mycobacterium tuberculosis H37Rv
cgguugaugcggccgcggcagc

SEQ ID NO: 3252591 - RNA, 19 nt, Mycobacterium tuberculosis H37Rv
cgguugaugguccgccaga

SEQ ID NO: 3252592 - RNA, 14 nt, Mycobacterium tuberculosis H37Rv
cgguugauucgugc

SEQ ID NO: 3252593 - RNA, 17 nt, Mycobacterium tuberculosis H37Rv
cgguugauugugcccag

SEQ ID NO: 3252594 - RNA, 18 nt, Mycobacterium tuberculosis H37Rv
cguagaaggcgauuugcu

SEQ ID NO: 3252595 - RNA, 21 nt, Mycobacterium tuberculosis H37Rv
cguagaaucggcucagcaacg

SEQ ID NO: 3252596 - RNA, 14 nt, Mycobacterium tuberculosis H37Rv
cguagacaccuucg

SEQ ID NO: 3252597 - RNA, 14 nt, Mycobacterium tuberculosis H37Rv
cguagaccagcagg

SEQ ID NO: 3252598 - RNA, 15 nt, Mycobacterium tuberculosis H37Rv
cguagaccuucuuga

SEQ ID NO: 3252599 - RNA, 15 nt, Mycobacterium tuberculosis H37Rv
cguagacgccgagca

SEQ ID NO: 3252600 - RNA, 16 nt, Mycobacterium tuberculosis H37Rv
cguagacggggugagc

SEQ ID NO: 3252601 - RNA, 19 nt, Mycobacterium tuberculosis H37Rv
cguagacgguccggucgcu

SEQ ID NO: 3252602 - RNA, 14 nt, Mycobacterium tuberculosis H37Rv
cguagacuugcugc

SEQ ID NO: 3252603 - RNA, 13 nt, Mycobacterium tuberculosis H37Rv
cguagagcagcag

SEQ ID NO: 3252604 - RNA, 17 nt, Mycobacterium tuberculosis H37Rv
cguagagcaugccgccc

SEQ ID NO: 3252605 - RNA, 19 nt, Mycobacterium tuberculosis H37Rv
cguagagcaugccgcccgc

SEQ ID NO: 3252606 - RNA, 22 nt, Mycobacterium tuberculosis H37Rv
cguagagcuggugcgggacgcc

SEQ ID NO: 3252607 - RNA, 17 nt, Mycobacterium tuberculosis H37Rv
cguagaguguccccggc

SEQ ID NO: 3252608 - RNA, 15 nt, Mycobacterium tuberculosis H37Rv
cguagaucaucagcg

SEQ ID NO: 3252609 - RNA, 17 nt, Mycobacterium tuberculosis H37Rv
cguagaugguggucacc

SEQ ID NO: 3252610 - RNA, 17 nt, Mycobacterium tuberculosis H37Rv
cguagcaacccaggauu

SEQ ID NO: 3252611 - RNA, 16 nt, Mycobacterium tuberculosis H37Rv
cguagcacaccggugg

SEQ ID NO: 3252612 - RNA, 14 nt, Mycobacterium tuberculosis H37Rv
cguagcaccacauc

SEQ ID NO: 3252613 - RNA, 12 nt, Mycobacterium tuberculosis H37Rv
cguagccagcag

SEQ ID NO: 3252614 - RNA, 14 nt, Mycobacterium tuberculosis H37Rv
cguagccagcagcg

SEQ ID NO: 3252615 - RNA, 16 nt, Mycobacterium tuberculosis H37Rv
cguagccagcagcggc

SEQ ID NO: 3252616 - RNA, 13 nt, Mycobacterium tuberculosis H37Rv
cguagccagcagg

SEQ ID NO: 3252617 - RNA, 18 nt, Mycobacterium tuberculosis H37Rv
cguagcccacccgggugg

SEQ ID NO: 3252618 - RNA, 19 nt, Mycobacterium tuberculosis H37Rv
cguagcccacccggguggg

SEQ ID NO: 3252619 - RNA, 16 nt, Mycobacterium tuberculosis H37Rv
cguagcccacgacgaa

SEQ ID NO: 3252620 - RNA, 12 nt, Mycobacterium tuberculosis H37Rv
cguagcccaggu

SEQ ID NO: 3252621 - RNA, 16 nt, Mycobacterium tuberculosis H37Rv
cguagcccaugccgau

SEQ ID NO: 3252622 - RNA, 15 nt, Mycobacterium tuberculosis H37Rv
cguagcccugcucag

SEQ ID NO: 3252623 - RNA, 15 nt, Mycobacterium tuberculosis H37Rv
cguagccgccgucgc

SEQ ID NO: 3252624 - RNA, 20 nt, Mycobacterium tuberculosis H37Rv
cguagcgaagugcgcgcugg

SEQ ID NO: 3252625 - RNA, 19 nt, Mycobacterium tuberculosis H37Rv
cguagcgaccgcggucgcu

SEQ ID NO: 3252626 - RNA, 12 nt, Mycobacterium tuberculosis H37Rv
cguagcgcagcg

SEQ ID NO: 3252627 - RNA, 17 nt, Mycobacterium tuberculosis H37Rv
cguagcgcggccgauac

SEQ ID NO: 3252628 - RNA, 15 nt, Mycobacterium tuberculosis H37Rv
cguagcgggggagcg

SEQ ID NO: 3252629 - RNA, 18 nt, Mycobacterium tuberculosis H37Rv
cguagcgggucagcucga

SEQ ID NO: 3252630 - RNA, 14 nt, Mycobacterium tuberculosis H37Rv
cguagcggucccgc

SEQ ID NO: 3252631 - RNA, 15 nt, Mycobacterium tuberculosis H37Rv
cguagcucgcggggc

SEQ ID NO: 3252632 - RNA, 18 nt, Mycobacterium tuberculosis H37Rv
cguagcucgcggggcgca

SEQ ID NO: 3252633 - RNA, 15 nt, Mycobacterium tuberculosis H37Rv
cguagcugcgcagcg

SEQ ID NO: 3252634 - RNA, 18 nt, Mycobacterium tuberculosis H37Rv
cguagcuggccagguugc

SEQ ID NO: 3252635 - RNA, 19 nt, Mycobacterium tuberculosis H37Rv
cguagcuggcgaucugguc

SEQ ID NO: 3252636 - RNA, 18 nt, Mycobacterium tuberculosis H37Rv
cguaggacaccaccgugg

SEQ ID NO: 3252637 - RNA, 16 nt, Mycobacterium tuberculosis H37Rv
cguaggcaggaucgcc

SEQ ID NO: 3252638 - RNA, 22 nt, Mycobacterium tuberculosis H37Rv
cguaggcaggaucgccugagcg

SEQ ID NO: 3252639 - RNA, 13 nt, Mycobacterium tuberculosis H37Rv
cguaggcgaugag

SEQ ID NO: 3252640 - RNA, 16 nt, Mycobacterium tuberculosis H37Rv
cguaggcgauggcggc

SEQ ID NO: 3252641 - RNA, 22 nt, Mycobacterium tuberculosis H37Rv
cguaggcgcuaggaacgccacc

SEQ ID NO: 3252642 - RNA, 17 nt, Mycobacterium tuberculosis H37Rv
cguaggcggcgacccgc

SEQ ID NO: 3252643 - RNA, 14 nt, Mycobacterium tuberculosis H37Rv
cguaggcggcggcc

SEQ ID NO: 3252644 - RNA, 20 nt, Mycobacterium tuberculosis H37Rv
cguaggcguacaccagggug

SEQ ID NO: 3252645 - RNA, 20 nt, Mycobacterium tuberculosis H37Rv
cguagggcagcgccaggccg

SEQ ID NO: 3252646 - RNA, 20 nt, Mycobacterium tuberculosis H37Rv
cguaggugccgaagaugacc

SEQ ID NO: 3252647 - RNA, 14 nt, Mycobacterium tuberculosis H37Rv
cguagguggccagc

SEQ ID NO: 3252648 - RNA, 17 nt, Mycobacterium tuberculosis H37Rv
cguagguggccagcgcg

SEQ ID NO: 3252649 - RNA, 18 nt, Mycobacterium tuberculosis H37Rv
cguagguggccagcgcgg

SEQ ID NO: 3252650 - RNA, 15 nt, Mycobacterium tuberculosis H37Rv
cguaguaggcgccgc

SEQ ID NO: 3252651 - RNA, 16 nt, Mycobacterium tuberculosis H37Rv
cguaguaguggccgcc

SEQ ID NO: 3252652 - RNA, 18 nt, Mycobacterium tuberculosis H37Rv
cguaguaguggccgccac

SEQ ID NO: 3252653 - RNA, 20 nt, Mycobacterium tuberculosis H37Rv
cguagucaaccaagcgugcc

SEQ ID NO: 3252654 - RNA, 16 nt, Mycobacterium tuberculosis H37Rv
cguagucccacugcca

SEQ ID NO: 3252655 - RNA, 15 nt, Mycobacterium tuberculosis H37Rv
cguagucgcugucgg

SEQ ID NO: 3252656 - RNA, 21 nt, Mycobacterium tuberculosis H37Rv
cguagucggcgaugcgcacca

SEQ ID NO: 3252657 - RNA, 18 nt, Mycobacterium tuberculosis H37Rv
cguagucggcggugcaga

SEQ ID NO: 3252658 - RNA, 21 nt, Mycobacterium tuberculosis H37Rv
cguagucgucuucgucauggc

SEQ ID NO: 3252659 - RNA, 14 nt, Mycobacterium tuberculosis H37Rv
cguagugcgcgcca

SEQ ID NO: 3252660 - RNA, 16 nt, Mycobacterium tuberculosis H37Rv
cguagugcucgccggc

SEQ ID NO: 3252661 - RNA, 17 nt, Mycobacterium tuberculosis H37Rv
cguagugcucgccggca

SEQ ID NO: 3252662 - RNA, 16 nt, Mycobacterium tuberculosis H37Rv
cguaguggaagccgac

SEQ ID NO: 3252663 - RNA, 16 nt, Mycobacterium tuberculosis H37Rv
cguauaccgcacccug

SEQ ID NO: 3252664 - RNA, 23 nt, Mycobacterium tuberculosis H37Rv
cguauaggucagaauugugugca

SEQ ID NO: 3252665 - RNA, 20 nt, Mycobacterium tuberculosis H37Rv
cguaucacgguugccgcgau

SEQ ID NO: 3252666 - RNA, 23 nt, Mycobacterium tuberculosis H37Rv
cguaucacgguugccgcgaucgg

SEQ ID NO: 3252667 - RNA, 14 nt, Mycobacterium tuberculosis H37Rv
cguauccacggucg

SEQ ID NO: 3252668 - RNA, 12 nt, Mycobacterium tuberculosis H37Rv
cguauccaggcg

SEQ ID NO: 3252669 - RNA, 13 nt, Mycobacterium tuberculosis H37Rv
cguaucccagaua

SEQ ID NO: 3252670 - RNA, 14 nt, Mycobacterium tuberculosis H37Rv
cguaucgccucgag

SEQ ID NO: 3252671 - RNA, 15 nt, Mycobacterium tuberculosis H37Rv
cguaucggggcacca

SEQ ID NO: 3252672 - RNA, 20 nt, Mycobacterium tuberculosis H37Rv
cguaucggguuucgaucuuc

SEQ ID NO: 3252673 - RNA, 21 nt, Mycobacterium tuberculosis H37Rv
cguaucggguuucgaucuucu

SEQ ID NO: 3252674 - RNA, 17 nt, Mycobacterium tuberculosis H37Rv
cguaugccgccaaccgc

SEQ ID NO: 3252675 - RNA, 19 nt, Mycobacterium tuberculosis H37Rv
cguaugccguggccgccau

SEQ ID NO: 3252676 - RNA, 14 nt, Mycobacterium tuberculosis H37Rv
cguauggacgagga

SEQ ID NO: 3252677 - RNA, 16 nt, Mycobacterium tuberculosis H37Rv
cguauucggccgcgag

SEQ ID NO: 3252678 - RNA, 17 nt, Mycobacterium tuberculosis H37Rv
cguauugauacugcccg

SEQ ID NO: 3252679 - RNA, 15 nt, Mycobacterium tuberculosis H37Rv
cguauugccaaagcc

SEQ ID NO: 3252680 - RNA, 15 nt, Mycobacterium tuberculosis H37Rv
cguauugcggccugu

SEQ ID NO: 3252681 - RNA, 15 nt, Mycobacterium tuberculosis H37Rv
cguauuggacgcugc

SEQ ID NO: 3252682 - RNA, 21 nt, Mycobacterium tuberculosis H37Rv
cgucaaacccagcgacgcggc

SEQ ID NO: 3252683 - RNA, 17 nt, Mycobacterium tuberculosis H37Rv
cgucaaacccgacaucg

SEQ ID NO: 3252684 - RNA, 16 nt, Mycobacterium tuberculosis H37Rv
cgucaaccacggccgc

SEQ ID NO: 3252685 - RNA, 17 nt, Mycobacterium tuberculosis H37Rv
cgucaaccacggccgcc

SEQ ID NO: 3252686 - RNA, 18 nt, Mycobacterium tuberculosis H37Rv
cgucaaccgaucggucgu

SEQ ID NO: 3252687 - RNA, 19 nt, Mycobacterium tuberculosis H37Rv
cgucaaccgaucggucguc

SEQ ID NO: 3252688 - RNA, 15 nt, Mycobacterium tuberculosis H37Rv
cgucaaccugcugca

SEQ ID NO: 3252689 - RNA, 19 nt, Mycobacterium tuberculosis H37Rv
cgucaagccacacccggcg

SEQ ID NO: 3252690 - RNA, 15 nt, Mycobacterium tuberculosis H37Rv
cgucaaggaaggcgu

SEQ ID NO: 3252691 - RNA, 15 nt, Mycobacterium tuberculosis H37Rv
cguccaagccggcca

SEQ ID NO: 3252692 - RNA, 16 nt, Mycobacterium tuberculosis H37Rv
cguccaagccggcugc

SEQ ID NO: 3252693 - RNA, 21 nt, Mycobacterium tuberculosis H37Rv
cguccaagccguagaccaggc

SEQ ID NO: 3252694 - RNA, 16 nt, Mycobacterium tuberculosis H37Rv
cguccaauagcugaca

SEQ ID NO: 3252695 - RNA, 23 nt, Mycobacterium tuberculosis H37Rv
cguccaauuggcgucgucggcgg

SEQ ID NO: 3252696 - RNA, 22 nt, Mycobacterium tuberculosis H37Rv
cguccaccacaccugcggcugc

SEQ ID NO: 3252697 - RNA, 15 nt, Mycobacterium tuberculosis H37Rv
cguccaccagccggu

SEQ ID NO: 3252698 - RNA, 16 nt, Mycobacterium tuberculosis H37Rv
cguccacccacgauca

SEQ ID NO: 3252699 - RNA, 22 nt, Mycobacterium tuberculosis H37Rv
cguccacccacgaucagcagcg

SEQ ID NO: 3252700 - RNA, 13 nt, Mycobacterium tuberculosis H37Rv
cguccaccgccga

SEQ ID NO: 3252701 - RNA, 19 nt, Mycobacterium tuberculosis H37Rv
cguccacgaccccggcggu

SEQ ID NO: 3252702 - RNA, 21 nt, Mycobacterium tuberculosis H37Rv
cguccacgaccccggcgguac

SEQ ID NO: 3252703 - RNA, 14 nt, Mycobacterium tuberculosis H37Rv
cguccacgcugacc

SEQ ID NO: 3252704 - RNA, 22 nt, Mycobacterium tuberculosis H37Rv
cguccacgugagugccggcgug

SEQ ID NO: 3252705 - RNA, 19 nt, Mycobacterium tuberculosis H37Rv
cguccagacgccacugcca

SEQ ID NO: 3252706 - RNA, 21 nt, Mycobacterium tuberculosis H37Rv
cguccagacgccacugccagc

SEQ ID NO: 3252707 - RNA, 18 nt, Mycobacterium tuberculosis H37Rv
cguccagcagcucggggc

SEQ ID NO: 3252708 - RNA, 12 nt, Mycobacterium tuberculosis H37Rv
cguccagcagga

SEQ ID NO: 3252709 - RNA, 17 nt, Mycobacterium tuberculosis H37Rv
cguccagcccagaucca

SEQ ID NO: 3252710 - RNA, 23 nt, Mycobacterium tuberculosis H37Rv
cguccagcccagauccagcaacg

SEQ ID NO: 3252711 - RNA, 16 nt, Mycobacterium tuberculosis H37Rv
cguccagccguggcgg

SEQ ID NO: 3252712 - RNA, 12 nt, Mycobacterium tuberculosis H37Rv
cguccagcgagc

SEQ ID NO: 3252713 - RNA, 19 nt, Mycobacterium tuberculosis H37Rv
cguccagcgaucccgguga

SEQ ID NO: 3252714 - RNA, 16 nt, Mycobacterium tuberculosis H37Rv
cguccagcgccgcggc

SEQ ID NO: 3252715 - RNA, 18 nt, Mycobacterium tuberculosis H37Rv
cguccagcgccgcggccc

SEQ ID NO: 3252716 - RNA, 22 nt, Mycobacterium tuberculosis H37Rv
cguccagggcgacgagaucugc

SEQ ID NO: 3252717 - RNA, 15 nt, Mycobacterium tuberculosis H37Rv
cguccaggucaugcc

SEQ ID NO: 3252718 - RNA, 15 nt, Mycobacterium tuberculosis H37Rv
cguccaguggcagcc

SEQ ID NO: 3252719 - RNA, 18 nt, Mycobacterium tuberculosis H37Rv
cguccaguggcagccagc

SEQ ID NO: 3252720 - RNA, 14 nt, Mycobacterium tuberculosis H37Rv
cguccaucaccggc

SEQ ID NO: 3252721 - RNA, 10 nt, Mycobacterium tuberculosis H37Rv
cguccaucag

SEQ ID NO: 3252722 - RNA, 16 nt, Mycobacterium tuberculosis H37Rv
cguccaucgccaccgc

SEQ ID NO: 3252723 - RNA, 19 nt, Mycobacterium tuberculosis H37Rv
cguccaucgccaccgcguc

SEQ ID NO: 3252724 - RNA, 22 nt, Mycobacterium tuberculosis H37Rv
cguccaucgcgucgucuucuuc

SEQ ID NO: 3252725 - RNA, 21 nt, Mycobacterium tuberculosis H37Rv
cguccaucucggaccacaucu

SEQ ID NO: 3252726 - RNA, 21 nt, Mycobacterium tuberculosis H37Rv
cgucccacagguuugcgccgc

SEQ ID NO: 3252727 - RNA, 14 nt, Mycobacterium tuberculosis H37Rv
cgucccagagaauc

SEQ ID NO: 3252728 - RNA, 13 nt, Mycobacterium tuberculosis H37Rv
cgucccagcgccg

SEQ ID NO: 3252729 - RNA, 14 nt, Mycobacterium tuberculosis H37Rv
cgucccagcgccgc

SEQ ID NO: 3252730 - RNA, 15 nt, Mycobacterium tuberculosis H37Rv
cgucccagcgccgca

SEQ ID NO: 3252731 - RNA, 22 nt, Mycobacterium tuberculosis H37Rv
cgucccagcgcgguguagagcg

SEQ ID NO: 3252732 - RNA, 20 nt, Mycobacterium tuberculosis H37Rv
cgucccagcgguagccgagc

SEQ ID NO: 3252733 - RNA, 14 nt, Mycobacterium tuberculosis H37Rv
cgucccaggacucc

SEQ ID NO: 3252734 - RNA, 18 nt, Mycobacterium tuberculosis H37Rv
cguccccaccgacgccga

SEQ ID NO: 3252735 - RNA, 20 nt, Mycobacterium tuberculosis H37Rv
cguccccaccgacgccgaua

SEQ ID NO: 3252736 - RNA, 13 nt, Mycobacterium tuberculosis H37Rv
cguccccagaccg

SEQ ID NO: 3252737 - RNA, 15 nt, Mycobacterium tuberculosis H37Rv
cguccccagaccggc

SEQ ID NO: 3252738 - RNA, 15 nt, Mycobacterium tuberculosis H37Rv
cguccccgacgucag

SEQ ID NO: 3252739 - RNA, 12 nt, Mycobacterium tuberculosis H37Rv
cguccccgcagc

SEQ ID NO: 3252740 - RNA, 13 nt, Mycobacterium tuberculosis H37Rv
cguccccggccga

SEQ ID NO: 3252741 - RNA, 17 nt, Mycobacterium tuberculosis H37Rv
cguccccggcguccgac

SEQ ID NO: 3252742 - RNA, 18 nt, Mycobacterium tuberculosis H37Rv
cgucccgaaacgccgggu

SEQ ID NO: 3252743 - RNA, 18 nt, Mycobacterium tuberculosis H37Rv
cgucccgauacggccggc

SEQ ID NO: 3252744 - RNA, 19 nt, Mycobacterium tuberculosis H37Rv
cgucccgauacggccggcc

SEQ ID NO: 3252745 - RNA, 22 nt, Mycobacterium tuberculosis H37Rv
cgucccgauggcgguggggcug

SEQ ID NO: 3252746 - RNA, 24 nt, Mycobacterium tuberculosis H37Rv
cgucccgcauaccuaacgagccgu

SEQ ID NO: 3252747 - RNA, 12 nt, Mycobacterium tuberculosis H37Rv
cgucccgcccgg

SEQ ID NO: 3252748 - RNA, 16 nt, Mycobacterium tuberculosis H37Rv
cgucccgccggccccg

SEQ ID NO: 3252749 - RNA, 20 nt, Mycobacterium tuberculosis H37Rv
cgucccgcgagcagcccggc

SEQ ID NO: 3252750 - RNA, 13 nt, Mycobacterium tuberculosis H37Rv
cgucccgcggcgc

SEQ ID NO: 3252751 - RNA, 18 nt, Mycobacterium tuberculosis H37Rv
cgucccggacaauuccgc

SEQ ID NO: 3252752 - RNA, 17 nt, Mycobacterium tuberculosis H37Rv
cgucccggcgaccgggu

SEQ ID NO: 3252753 - RNA, 22 nt, Mycobacterium tuberculosis H37Rv
cgucccggcgaccggguccggc

SEQ ID NO: 3252754 - RNA, 19 nt, Mycobacterium tuberculosis H37Rv
cgucccggcggucagcggc

SEQ ID NO: 3252755 - RNA, 14 nt, Mycobacterium tuberculosis H37Rv
cgucccggcucgag

SEQ ID NO: 3252756 - RNA, 21 nt, Mycobacterium tuberculosis H37Rv
cgucccgguugacgccggucc

SEQ ID NO: 3252757 - RNA, 20 nt, Mycobacterium tuberculosis H37Rv
cguccgacaacgacugcguu

SEQ ID NO: 3252758 - RNA, 13 nt, Mycobacterium tuberculosis H37Rv
cguccgaccaggg

SEQ ID NO: 3252759 - RNA, 14 nt, Mycobacterium tuberculosis H37Rv
cguccgaccgauaa

SEQ ID NO: 3252760 - RNA, 22 nt, Mycobacterium tuberculosis H37Rv
cguccgaccgauaacacccggg

SEQ ID NO: 3252761 - RNA, 14 nt, Mycobacterium tuberculosis H37Rv
cguccgaccgguac

SEQ ID NO: 3252762 - RNA, 19 nt, Mycobacterium tuberculosis H37Rv
cguccgaccgguacccgua

SEQ ID NO: 3252763 - RNA, 15 nt, Mycobacterium tuberculosis H37Rv
cguccgaucgguguc

SEQ ID NO: 3252764 - RNA, 14 nt, Mycobacterium tuberculosis H37Rv
cguccgcaccggcg

SEQ ID NO: 3252765 - RNA, 15 nt, Mycobacterium tuberculosis H37Rv
cguccgcaccggcgg

SEQ ID NO: 3252766 - RNA, 20 nt, Mycobacterium tuberculosis H37Rv
cguccgcaccggcggcgccg

SEQ ID NO: 3252767 - RNA, 12 nt, Mycobacterium tuberculosis H37Rv
cguccgcccagc

SEQ ID NO: 3252768 - RNA, 14 nt, Mycobacterium tuberculosis H37Rv
cguccgcccagcac

SEQ ID NO: 3252769 - RNA, 15 nt, Mycobacterium tuberculosis H37Rv
cguccgcccagccgc

SEQ ID NO: 3252770 - RNA, 21 nt, Mycobacterium tuberculosis H37Rv
cguccgcccagccgcagcacc

SEQ ID NO: 3252771 - RNA, 16 nt, Mycobacterium tuberculosis H37Rv
cguccgccgcagcgca

SEQ ID NO: 3252772 - RNA, 13 nt, Mycobacterium tuberculosis H37Rv
cguccgccggcga

SEQ ID NO: 3252773 - RNA, 16 nt, Mycobacterium tuberculosis H37Rv
cguccgcgccgagccc

SEQ ID NO: 3252774 - RNA, 18 nt, Mycobacterium tuberculosis H37Rv
cguccgcgggggaccgcc

SEQ ID NO: 3252775 - RNA, 17 nt, Mycobacterium tuberculosis H37Rv
cguccggagaauuccgc

SEQ ID NO: 3252776 - RNA, 24 nt, Mycobacterium tuberculosis H37Rv
cguccggagaauuccgcuagguca

SEQ ID NO: 3252777 - RNA, 23 nt, Mycobacterium tuberculosis H37Rv
cguccggagccccugucaacgcc

SEQ ID NO: 3252778 - RNA, 16 nt, Mycobacterium tuberculosis H37Rv
cguccggaucggucgg

SEQ ID NO: 3252779 - RNA, 18 nt, Mycobacterium tuberculosis H37Rv
cguccggaucggucggca

SEQ ID NO: 3252780 - RNA, 20 nt, Mycobacterium tuberculosis H37Rv
cguccggccgggcccuccac

SEQ ID NO: 3252781 - RNA, 14 nt, Mycobacterium tuberculosis H37Rv
cguccggcgccugc

SEQ ID NO: 3252782 - RNA, 13 nt, Mycobacterium tuberculosis H37Rv
cguccggcuuggc

SEQ ID NO: 3252783 - RNA, 14 nt, Mycobacterium tuberculosis H37Rv
cguccgggucacca

SEQ ID NO: 3252784 - RNA, 23 nt, Mycobacterium tuberculosis H37Rv
cguccggucgccucaccggcgcg

SEQ ID NO: 3252785 - RNA, 16 nt, Mycobacterium tuberculosis H37Rv
cguccggugcuggucc

SEQ ID NO: 3252786 - RNA, 19 nt, Mycobacterium tuberculosis H37Rv
cguccgguggaccgccgau

SEQ ID NO: 3252787 - RNA, 16 nt, Mycobacterium tuberculosis H37Rv
cgucgagguucucccg

SEQ ID NO: 3252788 - RNA, 21 nt, Mycobacterium tuberculosis H37Rv
cgucgagguuuuucgaugggu

SEQ ID NO: 3252789 - RNA, 14 nt, Mycobacterium tuberculosis H37Rv
cgucgagucgacgg

SEQ ID NO: 3252790 - RNA, 21 nt, Mycobacterium tuberculosis H37Rv
cgucgagucgccgaggacgcc

SEQ ID NO: 3252791 - RNA, 19 nt, Mycobacterium tuberculosis H37Rv
cgucgagugccgccaccgc

SEQ ID NO: 3252792 - RNA, 17 nt, Mycobacterium tuberculosis H37Rv
cgucgaguuccggccgg

SEQ ID NO: 3252793 - RNA, 15 nt, Mycobacterium tuberculosis H37Rv
cgucgaguuggccau

SEQ ID NO: 3252794 - RNA, 18 nt, Mycobacterium tuberculosis H37Rv
cgucgaguuuugcggcca

SEQ ID NO: 3252795 - RNA, 19 nt, Mycobacterium tuberculosis H37Rv
cgucgaguuuugcggccag

SEQ ID NO: 3252796 - RNA, 16 nt, Mycobacterium tuberculosis H37Rv
cgucgauagucgccgu

SEQ ID NO: 3252797 - RNA, 14 nt, Mycobacterium tuberculosis H37Rv
cgucgauaucgcga

SEQ ID NO: 3252798 - RNA, 19 nt, Mycobacterium tuberculosis H37Rv
cgucgaucaacaacagccg

SEQ ID NO: 3252799 - RNA, 23 nt, Mycobacterium tuberculosis H37Rv
cgucgaucacgugguccaaccgg

SEQ ID NO: 3252800 - RNA, 23 nt, Mycobacterium tuberculosis H37Rv
cgucgaucagaacgugacggucc

SEQ ID NO: 3252801 - RNA, 18 nt, Mycobacterium tuberculosis H37Rv
cgucgaucagcggcagca

SEQ ID NO: 3252802 - RNA, 14 nt, Mycobacterium tuberculosis H37Rv
cgucgaucggcuug

SEQ ID NO: 3252803 - RNA, 16 nt, Mycobacterium tuberculosis H37Rv
cgucgaucucggcgca

SEQ ID NO: 3252804 - RNA, 17 nt, Mycobacterium tuberculosis H37Rv
cgucgaucucggcgcag

SEQ ID NO: 3252805 - RNA, 14 nt, Mycobacterium tuberculosis H37Rv
cgucgaugccggug

SEQ ID NO: 3252806 - RNA, 19 nt, Mycobacterium tuberculosis H37Rv
cgucgaugcgcgucucgag

SEQ ID NO: 3252807 - RNA, 13 nt, Mycobacterium tuberculosis H37Rv
cgucgauggccac

SEQ ID NO: 3252808 - RNA, 17 nt, Mycobacterium tuberculosis H37Rv
cgucgauggucuccgga

SEQ ID NO: 3252809 - RNA, 15 nt, Mycobacterium tuberculosis H37Rv
cgucgaugucauccg

SEQ ID NO: 3252810 - RNA, 23 nt, Mycobacterium tuberculosis H37Rv
cgucgauguccccggcggcagca

SEQ ID NO: 3252811 - RNA, 18 nt, Mycobacterium tuberculosis H37Rv
cgucgaugucgacgucgc

SEQ ID NO: 3252812 - RNA, 15 nt, Mycobacterium tuberculosis H37Rv
cgucgaugucgccgc

SEQ ID NO: 3252813 - RNA, 19 nt, Mycobacterium tuberculosis H37Rv
cgucgaugucguuggccac

SEQ ID NO: 3252814 - RNA, 15 nt, Mycobacterium tuberculosis H37Rv
cgucgauuucgacga

SEQ ID NO: 3252815 - RNA, 14 nt, Mycobacterium tuberculosis H37Rv
cgucgcaacggccc

SEQ ID NO: 3252816 - RNA, 19 nt, Mycobacterium tuberculosis H37Rv
cgucgcaacguguccgcag

SEQ ID NO: 3252817 - RNA, 20 nt, Mycobacterium tuberculosis H37Rv
cgucgcaaggcccgcaccgc

SEQ ID NO: 3252818 - RNA, 20 nt, Mycobacterium tuberculosis H37Rv
cgucgcacccagggcguugg

SEQ ID NO: 3252819 - RNA, 13 nt, Mycobacterium tuberculosis H37Rv
cgucgcagugcaa

SEQ ID NO: 3252820 - RNA, 17 nt, Mycobacterium tuberculosis H37Rv
cgucgcauacgcccacu

SEQ ID NO: 3252821 - RNA, 18 nt, Mycobacterium tuberculosis H37Rv
cgucgcaucaccagggug

SEQ ID NO: 3252822 - RNA, 14 nt, Mycobacterium tuberculosis H37Rv
cgucgccaccagag

SEQ ID NO: 3252823 - RNA, 20 nt, Mycobacterium tuberculosis H37Rv
cgucgccaccagagucaaca

SEQ ID NO: 3252824 - RNA, 14 nt, Mycobacterium tuberculosis H37Rv
cgucgccaccaucg

SEQ ID NO: 3252825 - RNA, 16 nt, Mycobacterium tuberculosis H37Rv
cgucgccaccgguacc

SEQ ID NO: 3252826 - RNA, 21 nt, Mycobacterium tuberculosis H37Rv
cgucgccaccgguaccgauca

SEQ ID NO: 3252827 - RNA, 20 nt, Mycobacterium tuberculosis H37Rv
cgucgccagauagguccgau

SEQ ID NO: 3252828 - RNA, 17 nt, Mycobacterium tuberculosis H37Rv
cgucgccagggccgccg

SEQ ID NO: 3252829 - RNA, 18 nt, Mycobacterium tuberculosis H37Rv
cgucgccagggccgccga

SEQ ID NO: 3252830 - RNA, 22 nt, Mycobacterium tuberculosis H37Rv
cgucgccagggccgccgaagcu

SEQ ID NO: 3252831 - RNA, 18 nt, Mycobacterium tuberculosis H37Rv
cgucgccauuccaucgcg

SEQ ID NO: 3252832 - RNA, 15 nt, Mycobacterium tuberculosis H37Rv
cgucgcccagggugu

SEQ ID NO: 3252833 - RNA, 15 nt, Mycobacterium tuberculosis H37Rv
cgucgcccagugcgc

SEQ ID NO: 3252834 - RNA, 21 nt, Mycobacterium tuberculosis H37Rv
cgucgcccagugcgcaaccca

SEQ ID NO: 3252835 - RNA, 13 nt, Mycobacterium tuberculosis H37Rv
cgucgccccacca

SEQ ID NO: 3252836 - RNA, 20 nt, Mycobacterium tuberculosis H37Rv
cgucgcccgcauugaucucg

SEQ ID NO: 3252837 - RNA, 22 nt, Mycobacterium tuberculosis H37Rv
cgucgcccugacacaacaccgg

SEQ ID NO: 3252838 - RNA, 21 nt, Mycobacterium tuberculosis H37Rv
cgucgcccuuagggucgccgc

SEQ ID NO: 3252839 - RNA, 22 nt, Mycobacterium tuberculosis H37Rv
cgucgcccuuagggucgccgca

SEQ ID NO: 3252840 - RNA, 15 nt, Mycobacterium tuberculosis H37Rv
cgucgccgaacagcg

SEQ ID NO: 3252841 - RNA, 13 nt, Mycobacterium tuberculosis H37Rv
cgucgccgaccgu

SEQ ID NO: 3252842 - RNA, 18 nt, Mycobacterium tuberculosis H37Rv
cgucgccgaccgucacug

SEQ ID NO: 3252843 - RNA, 17 nt, Mycobacterium tuberculosis H37Rv
cgucgccgacgccggug

SEQ ID NO: 3252844 - RNA, 13 nt, Mycobacterium tuberculosis H37Rv
cgucgccgccauu

SEQ ID NO: 3252845 - RNA, 16 nt, Mycobacterium tuberculosis H37Rv
cgucgccgccauugcc

SEQ ID NO: 3252846 - RNA, 13 nt, Mycobacterium tuberculosis H37Rv
cgucgccgcccgu

SEQ ID NO: 3252847 - RNA, 11 nt, Mycobacterium tuberculosis H37Rv
cgucgccgccg

SEQ ID NO: 3252848 - RNA, 13 nt, Mycobacterium tuberculosis H37Rv
cgucgccgccgcu

SEQ ID NO: 3252849 - RNA, 16 nt, Mycobacterium tuberculosis H37Rv
cgucgccgccggcgcc

SEQ ID NO: 3252850 - RNA, 17 nt, Mycobacterium tuberculosis H37Rv
cgucgccgccgggcagu

SEQ ID NO: 3252851 - RNA, 16 nt, Mycobacterium tuberculosis H37Rv
cgucgccgccgguccc

SEQ ID NO: 3252852 - RNA, 15 nt, Mycobacterium tuberculosis H37Rv
cgucgccgccgguga

SEQ ID NO: 3252853 - RNA, 12 nt, Mycobacterium tuberculosis H37Rv
cgucgccgccgu

SEQ ID NO: 3252854 - RNA, 14 nt, Mycobacterium tuberculosis H37Rv
cgucgccgccguua

SEQ ID NO: 3252855 - RNA, 15 nt, Mycobacterium tuberculosis H37Rv
cgucgccgcggcggc

SEQ ID NO: 3252856 - RNA, 21 nt, Mycobacterium tuberculosis H37Rv
cgucgccgcggcggcagcggc

SEQ ID NO: 3252857 - RNA, 19 nt, Mycobacterium tuberculosis H37Rv
cgucgccggauagcgcagc

SEQ ID NO: 3252858 - RNA, 15 nt, Mycobacterium tuberculosis H37Rv
cgucgccggccccgc

SEQ ID NO: 3252859 - RNA, 19 nt, Mycobacterium tuberculosis H37Rv
cgucgccggccccgccggc

SEQ ID NO: 3252860 - RNA, 14 nt, Mycobacterium tuberculosis H37Rv
cgucgccggccuug

SEQ ID NO: 3252861 - RNA, 14 nt, Mycobacterium tuberculosis H37Rv
cgucgccggcggcg

SEQ ID NO: 3252862 - RNA, 17 nt, Mycobacterium tuberculosis H37Rv
cgucgccggcggcggug

SEQ ID NO: 3252863 - RNA, 19 nt, Mycobacterium tuberculosis H37Rv
cgucgccgggcggcggugc

SEQ ID NO: 3252864 - RNA, 20 nt, Mycobacterium tuberculosis H37Rv
cgucgccggucaggccgccg

SEQ ID NO: 3252865 - RNA, 21 nt, Mycobacterium tuberculosis H37Rv
cgucgccggucaggccgccgc

SEQ ID NO: 3252866 - RNA, 16 nt, Mycobacterium tuberculosis H37Rv
cgucgccggugacgac

SEQ ID NO: 3252867 - RNA, 14 nt, Mycobacterium tuberculosis H37Rv
cgucgccgguggca

SEQ ID NO: 3252868 - RNA, 22 nt, Mycobacterium tuberculosis H37Rv
cgucgccguacaaccacccacc

SEQ ID NO: 3252869 - RNA, 18 nt, Mycobacterium tuberculosis H37Rv
cgucgccgucggugccgc

SEQ ID NO: 3252870 - RNA, 20 nt, Mycobacterium tuberculosis H37Rv
cgucgccgucggugccgccg

SEQ ID NO: 3252871 - RNA, 14 nt, Mycobacterium tuberculosis H37Rv
cgucgccgugcugu

SEQ ID NO: 3252872 - RNA, 14 nt, Mycobacterium tuberculosis H37Rv
cgucgccguugggu

SEQ ID NO: 3252873 - RNA, 16 nt, Mycobacterium tuberculosis H37Rv
cgucgccucgauaucg

SEQ ID NO: 3252874 - RNA, 19 nt, Mycobacterium tuberculosis H37Rv
cgucgccuucggguucggu

SEQ ID NO: 3252875 - RNA, 21 nt, Mycobacterium tuberculosis H37Rv
cgucgcgacgacguagauggu

SEQ ID NO: 3252876 - RNA, 13 nt, Mycobacterium tuberculosis H37Rv
cgucgcgacgucg

SEQ ID NO: 3252877 - RNA, 18 nt, Mycobacterium tuberculosis H37Rv
cgucgcgacgucggccgu

SEQ ID NO: 3252878 - RNA, 19 nt, Mycobacterium tuberculosis H37Rv
cgucgcgauccacuccggc

SEQ ID NO: 3252879 - RNA, 18 nt, Mycobacterium tuberculosis H37Rv
cgucgcgauugccgcggu

SEQ ID NO: 3252880 - RNA, 19 nt, Mycobacterium tuberculosis H37Rv
cgucgcgauugccgcgguu

SEQ ID NO: 3252881 - RNA, 17 nt, Mycobacterium tuberculosis H37Rv
cgucgcgcaucgccucc

SEQ ID NO: 3252882 - RNA, 23 nt, Mycobacterium tuberculosis H37Rv
cgucgcgcaucgccuccucgacg

SEQ ID NO: 3252883 - RNA, 16 nt, Mycobacterium tuberculosis H37Rv
cgucggucaucgguug

SEQ ID NO: 3252884 - RNA, 19 nt, Mycobacterium tuberculosis H37Rv
cgucggucaugucggccac

SEQ ID NO: 3252885 - RNA, 20 nt, Mycobacterium tuberculosis H37Rv
cgucggucaugucggccacc

SEQ ID NO: 3252886 - RNA, 23 nt, Mycobacterium tuberculosis H37Rv
cgucggucgacuguucgggaugc

SEQ ID NO: 3252887 - RNA, 13 nt, Mycobacterium tuberculosis H37Rv
cgucggucgccgg

SEQ ID NO: 3252888 - RNA, 23 nt, Mycobacterium tuberculosis H37Rv
cgucggucgccgguggccuagca

SEQ ID NO: 3252889 - RNA, 20 nt, Mycobacterium tuberculosis H37Rv
cgucggugaacgcgucguug

SEQ ID NO: 3252890 - RNA, 22 nt, Mycobacterium tuberculosis H37Rv
cgucggugaaguagugcucgca

SEQ ID NO: 3252891 - RNA, 15 nt, Mycobacterium tuberculosis H37Rv
cgucggugaaugccg

SEQ ID NO: 3252892 - RNA, 21 nt, Mycobacterium tuberculosis H37Rv
cgucggugaccucggcgacca

SEQ ID NO: 3252893 - RNA, 18 nt, Mycobacterium tuberculosis H37Rv
cgucggugagcugcgcca

SEQ ID NO: 3252894 - RNA, 13 nt, Mycobacterium tuberculosis H37Rv
cgucggugccacc

SEQ ID NO: 3252895 - RNA, 14 nt, Mycobacterium tuberculosis H37Rv
cgucggugccacca

SEQ ID NO: 3252896 - RNA, 15 nt, Mycobacterium tuberculosis H37Rv
cgucggugccaccac

SEQ ID NO: 3252897 - RNA, 21 nt, Mycobacterium tuberculosis H37Rv
cgucggugcgcgcggcgacca

SEQ ID NO: 3252898 - RNA, 17 nt, Mycobacterium tuberculosis H37Rv
cgucgguggcagcggug

SEQ ID NO: 3252899 - RNA, 20 nt, Mycobacterium tuberculosis H37Rv
cgucggugggcgugacguag

SEQ ID NO: 3252900 - RNA, 22 nt, Mycobacterium tuberculosis H37Rv
cgucggugggcgugacguagug

SEQ ID NO: 3252901 - RNA, 18 nt, Mycobacterium tuberculosis H37Rv
cgucgguguaacccuggc

SEQ ID NO: 3252902 - RNA, 14 nt, Mycobacterium tuberculosis H37Rv
cgucggugugccag

SEQ ID NO: 3252903 - RNA, 21 nt, Mycobacterium tuberculosis H37Rv
cgucgguuccgggcgcgugga

SEQ ID NO: 3252904 - RNA, 22 nt, Mycobacterium tuberculosis H37Rv
cgucgguuccgggcgcguggaa

SEQ ID NO: 3252905 - RNA, 18 nt, Mycobacterium tuberculosis H37Rv
cgucgguugccacgccgc

SEQ ID NO: 3252906 - RNA, 23 nt, Mycobacterium tuberculosis H37Rv
cgucguacacgccaugguaugac

SEQ ID NO: 3252907 - RNA, 14 nt, Mycobacterium tuberculosis H37Rv
cgucguacaugggc

SEQ ID NO: 3252908 - RNA, 18 nt, Mycobacterium tuberculosis H37Rv
cgucguacucgaccgcga

SEQ ID NO: 3252909 - RNA, 14 nt, Mycobacterium tuberculosis H37Rv
cgucguacucggcg

SEQ ID NO: 3252910 - RNA, 17 nt, Mycobacterium tuberculosis H37Rv
cgucguacucggcggcc

SEQ ID NO: 3252911 - RNA, 22 nt, Mycobacterium tuberculosis H37Rv
cgucguagguggccggcuugca

SEQ ID NO: 3252912 - RNA, 18 nt, Mycobacterium tuberculosis H37Rv
cgucguaguacagcgcga

SEQ ID NO: 3252913 - RNA, 22 nt, Mycobacterium tuberculosis H37Rv
cgucgucaaguccuucacugcg

SEQ ID NO: 3252914 - RNA, 22 nt, Mycobacterium tuberculosis H37Rv
cgucgucaccuucaccggguga

SEQ ID NO: 3252915 - RNA, 17 nt, Mycobacterium tuberculosis H37Rv
cgucgucacgaucgugc

SEQ ID NO: 3252916 - RNA, 14 nt, Mycobacterium tuberculosis H37Rv
cgucgucagccacc

SEQ ID NO: 3252917 - RNA, 14 nt, Mycobacterium tuberculosis H37Rv
cgucgucagccagg

SEQ ID NO: 3252918 - RNA, 16 nt, Mycobacterium tuberculosis H37Rv
cgucgucagguggcca

SEQ ID NO: 3252919 - RNA, 13 nt, Mycobacterium tuberculosis H37Rv
cgucgucaucgag

SEQ ID NO: 3252920 - RNA, 15 nt, Mycobacterium tuberculosis H37Rv
cgucgucaucgagcg

SEQ ID NO: 3252921 - RNA, 14 nt, Mycobacterium tuberculosis H37Rv
cgucguccagacgc

SEQ ID NO: 3252922 - RNA, 22 nt, Mycobacterium tuberculosis H37Rv
cgucguccagacgccacugcca

SEQ ID NO: 3252923 - RNA, 19 nt, Mycobacterium tuberculosis H37Rv
cgucguccagggcgacgag

SEQ ID NO: 3252924 - RNA, 18 nt, Mycobacterium tuberculosis H37Rv
cgucguccgccgcagcgc

SEQ ID NO: 3252925 - RNA, 12 nt, Mycobacterium tuberculosis H37Rv
cgucgucgacca

SEQ ID NO: 3252926 - RNA, 14 nt, Mycobacterium tuberculosis H37Rv
cgucgucgacgaca

SEQ ID NO: 3252927 - RNA, 16 nt, Mycobacterium tuberculosis H37Rv
cgucgucgagcaccac

SEQ ID NO: 3252928 - RNA, 22 nt, Mycobacterium tuberculosis H37Rv
cgucgucgagcaccacccgggc

SEQ ID NO: 3252929 - RNA, 12 nt, Mycobacterium tuberculosis H37Rv
cgucgucgaucg

SEQ ID NO: 3252930 - RNA, 21 nt, Mycobacterium tuberculosis H37Rv
cgucgucgcccaggcgugucg

SEQ ID NO: 3252931 - RNA, 23 nt, Mycobacterium tuberculosis H37Rv
cgucgucgccgccgaaaaccucg

SEQ ID NO: 3252932 - RNA, 14 nt, Mycobacterium tuberculosis H37Rv
cgucgucgcgggaa

SEQ ID NO: 3252933 - RNA, 14 nt, Mycobacterium tuberculosis H37Rv
cgucgucgcugaau

SEQ ID NO: 3252934 - RNA, 14 nt, Mycobacterium tuberculosis H37Rv
cgucgucggcguag

SEQ ID NO: 3252935 - RNA, 13 nt, Mycobacterium tuberculosis H37Rv
cgucgucgguaau

SEQ ID NO: 3252936 - RNA, 15 nt, Mycobacterium tuberculosis H37Rv
cgucgucggugauca

SEQ ID NO: 3252937 - RNA, 15 nt, Mycobacterium tuberculosis H37Rv
cgucgucgucccagg

SEQ ID NO: 3252938 - RNA, 18 nt, Mycobacterium tuberculosis H37Rv
cgucgucgucgacggccu

SEQ ID NO: 3252939 - RNA, 17 nt, Mycobacterium tuberculosis H37Rv
cgucgucgucggcagcg

SEQ ID NO: 3252940 - RNA, 13 nt, Mycobacterium tuberculosis H37Rv
cgucgucgugcac

SEQ ID NO: 3252941 - RNA, 14 nt, Mycobacterium tuberculosis H37Rv
cgucgucgugcacg

SEQ ID NO: 3252942 - RNA, 15 nt, Mycobacterium tuberculosis H37Rv
cgucgucguugagca

SEQ ID NO: 3252943 - RNA, 16 nt, Mycobacterium tuberculosis H37Rv
cgucgugaugggucac

SEQ ID NO: 3252944 - RNA, 20 nt, Mycobacterium tuberculosis H37Rv
cgucgugaugucaacguguc

SEQ ID NO: 3252945 - RNA, 17 nt, Mycobacterium tuberculosis H37Rv
cgucgugcacggcggcc

SEQ ID NO: 3252946 - RNA, 20 nt, Mycobacterium tuberculosis H37Rv
cgucgugcauaagcccgcga

SEQ ID NO: 3252947 - RNA, 14 nt, Mycobacterium tuberculosis H37Rv
cgucgugccaccgu

SEQ ID NO: 3252948 - RNA, 16 nt, Mycobacterium tuberculosis H37Rv
cgucgugcgauucaca

SEQ ID NO: 3252949 - RNA, 18 nt, Mycobacterium tuberculosis H37Rv
cgucgugcgcggccggca

SEQ ID NO: 3252950 - RNA, 15 nt, Mycobacterium tuberculosis H37Rv
cgucguggaucuucg

SEQ ID NO: 3252951 - RNA, 14 nt, Mycobacterium tuberculosis H37Rv
cgucguggcgcucg

SEQ ID NO: 3252952 - RNA, 21 nt, Mycobacterium tuberculosis H37Rv
cgucguggcgcucggcgagca

SEQ ID NO: 3252953 - RNA, 17 nt, Mycobacterium tuberculosis H37Rv
cgucguggggacuggca

SEQ ID NO: 3252954 - RNA, 15 nt, Mycobacterium tuberculosis H37Rv
cgucguggucggcga

SEQ ID NO: 3252955 - RNA, 18 nt, Mycobacterium tuberculosis H37Rv
cgucgugguggccacgga

SEQ ID NO: 3252956 - RNA, 14 nt, Mycobacterium tuberculosis H37Rv
cgucgugucgccgc

SEQ ID NO: 3252957 - RNA, 21 nt, Mycobacterium tuberculosis H37Rv
cgucgugucgccgccguugcc

SEQ ID NO: 3252958 - RNA, 16 nt, Mycobacterium tuberculosis H37Rv
cgucguguuggccggg

SEQ ID NO: 3252959 - RNA, 20 nt, Mycobacterium tuberculosis H37Rv
cgucguucaaugucguugcc

SEQ ID NO: 3252960 - RNA, 20 nt, Mycobacterium tuberculosis H37Rv
cgucguugagcaucaccgua

SEQ ID NO: 3252961 - RNA, 13 nt, Mycobacterium tuberculosis H37Rv
cgucguugaggaa

SEQ ID NO: 3252962 - RNA, 16 nt, Mycobacterium tuberculosis H37Rv
cgucguugaggaagcc

SEQ ID NO: 3252963 - RNA, 18 nt, Mycobacterium tuberculosis H37Rv
cgucguugccggcgacca

SEQ ID NO: 3252964 - RNA, 15 nt, Mycobacterium tuberculosis H37Rv
cgucguugcucgguc

SEQ ID NO: 3252965 - RNA, 21 nt, Mycobacterium tuberculosis H37Rv
cgucguugugccggucgauga

SEQ ID NO: 3252966 - RNA, 20 nt, Mycobacterium tuberculosis H37Rv
cgucguuuucagagccgggc

SEQ ID NO: 3252967 - RNA, 21 nt, Mycobacterium tuberculosis H37Rv
cgucuacgucguccagcacca

SEQ ID NO: 3252968 - RNA, 20 nt, Mycobacterium tuberculosis H37Rv
cgucuagcccgccauccgcc

SEQ ID NO: 3252969 - RNA, 20 nt, Mycobacterium tuberculosis H37Rv
cgucuccacuuucugcgguc

SEQ ID NO: 3252970 - RNA, 20 nt, Mycobacterium tuberculosis H37Rv
cgucuccggcgccaccgccg

SEQ ID NO: 3252971 - RNA, 17 nt, Mycobacterium tuberculosis H37Rv
cgucuccuugagcuucu

SEQ ID NO: 3252972 - RNA, 22 nt, Mycobacterium tuberculosis H37Rv
cgucucgacaguggcgacggac

SEQ ID NO: 3252973 - RNA, 13 nt, Mycobacterium tuberculosis H37Rv
cgucucgaucacc

SEQ ID NO: 3252974 - RNA, 11 nt, Mycobacterium tuberculosis H37Rv
cgucucgauga

SEQ ID NO: 3252975 - RNA, 14 nt, Mycobacterium tuberculosis H37Rv
cgucucgcaccgcg

SEQ ID NO: 3252976 - RNA, 17 nt, Mycobacterium tuberculosis H37Rv
cgucucgcagcaacggc

SEQ ID NO: 3252977 - RNA, 18 nt, Mycobacterium tuberculosis H37Rv
cgucucgcccccucuagc

SEQ ID NO: 3252978 - RNA, 15 nt, Mycobacterium tuberculosis H37Rv
cgucucgccgcgcac

SEQ ID NO: 3252979 - RNA, 17 nt, Mycobacterium tuberculosis H37Rv
cgugaucuucggcgauc

SEQ ID NO: 3252980 - RNA, 17 nt, Mycobacterium tuberculosis H37Rv
cgugaugcguucggccg

SEQ ID NO: 3252981 - RNA, 20 nt, Mycobacterium tuberculosis H37Rv
cgugauggugacuucggugg

SEQ ID NO: 3252982 - RNA, 20 nt, Mycobacterium tuberculosis H37Rv
cgugauguggucggacagcg

SEQ ID NO: 3252983 - RNA, 15 nt, Mycobacterium tuberculosis H37Rv
cgugcaaccacggcg

SEQ ID NO: 3252984 - RNA, 20 nt, Mycobacterium tuberculosis H37Rv
cgugcacaggcaucguccgc

SEQ ID NO: 3252985 - RNA, 14 nt, Mycobacterium tuberculosis H37Rv
cgugcacaggucag

SEQ ID NO: 3252986 - RNA, 19 nt, Mycobacterium tuberculosis H37Rv
cgugcacaggucagcgcug

SEQ ID NO: 3252987 - RNA, 12 nt, Mycobacterium tuberculosis H37Rv
cgugcaccagcu

SEQ ID NO: 3252988 - RNA, 15 nt, Mycobacterium tuberculosis H37Rv
cgugcaccagcucac

SEQ ID NO: 3252989 - RNA, 21 nt, Mycobacterium tuberculosis H37Rv
cgugcaccagguugcaaccuu

SEQ ID NO: 3252990 - RNA, 18 nt, Mycobacterium tuberculosis H37Rv
cgugcaccucgucccagc

SEQ ID NO: 3252991 - RNA, 16 nt, Mycobacterium tuberculosis H37Rv
cgugcacgaucgcggu

SEQ ID NO: 3252992 - RNA, 22 nt, Mycobacterium tuberculosis H37Rv
cgugcacgcacagcccgaugcc

SEQ ID NO: 3252993 - RNA, 20 nt, Mycobacterium tuberculosis H37Rv
cgugcagaauccguucgacg

SEQ ID NO: 3252994 - RNA, 23 nt, Mycobacterium tuberculosis H37Rv
cgugcagcacuuccaagccgacc

SEQ ID NO: 3252995 - RNA, 18 nt, Mycobacterium tuberculosis H37Rv
cgugcagccauugacggu

SEQ ID NO: 3252996 - RNA, 20 nt, Mycobacterium tuberculosis H37Rv
cgugcagcggcgggcgauga

SEQ ID NO: 3252997 - RNA, 14 nt, Mycobacterium tuberculosis H37Rv
cgugcagcucgguc

SEQ ID NO: 3252998 - RNA, 16 nt, Mycobacterium tuberculosis H37Rv
cgugcaggaacaccca

SEQ ID NO: 3252999 - RNA, 17 nt, Mycobacterium tuberculosis H37Rv
cgugcaggaacacccau

SEQ ID NO: 3253000 - RNA, 18 nt, Mycobacterium tuberculosis H37Rv
cgugcaggaccagcaccg

SEQ ID NO: 3253001 - RNA, 19 nt, Mycobacterium tuberculosis H37Rv
cgugcaggaccagcaccgc

SEQ ID NO: 3253002 - RNA, 17 nt, Mycobacterium tuberculosis H37Rv
cgugcaggaucggcuug

SEQ ID NO: 3253003 - RNA, 13 nt, Mycobacterium tuberculosis H37Rv
cgugcaggcgacg

SEQ ID NO: 3253004 - RNA, 15 nt, Mycobacterium tuberculosis H37Rv
cgugcaggcgacggc

SEQ ID NO: 3253005 - RNA, 24 nt, Mycobacterium tuberculosis H37Rv
cgugcaggcgcaagguggcaugcg

SEQ ID NO: 3253006 - RNA, 23 nt, Mycobacterium tuberculosis H37Rv
cgugcaggcugguuucggccgca

SEQ ID NO: 3253007 - RNA, 19 nt, Mycobacterium tuberculosis H37Rv
cgugcaucgcgauuccggc

SEQ ID NO: 3253008 - RNA, 14 nt, Mycobacterium tuberculosis H37Rv
cgugcaucugugag

SEQ ID NO: 3253009 - RNA, 23 nt, Mycobacterium tuberculosis H37Rv
cgugcaucugugagauaccgacg

SEQ ID NO: 3253010 - RNA, 22 nt, Mycobacterium tuberculosis H37Rv
cgugcaugggacauccagaucg

SEQ ID NO: 3253011 - RNA, 14 nt, Mycobacterium tuberculosis H37Rv
cgugccacagcucg

SEQ ID NO: 3253012 - RNA, 17 nt, Mycobacterium tuberculosis H37Rv
cgugccacagcucgccg

SEQ ID NO: 3253013 - RNA, 19 nt, Mycobacterium tuberculosis H37Rv
cgugccacagcucgccgug

SEQ ID NO: 3253014 - RNA, 13 nt, Mycobacterium tuberculosis H37Rv
cgugccacucgau

SEQ ID NO: 3253015 - RNA, 13 nt, Mycobacterium tuberculosis H37Rv
cgugccagcgccc

SEQ ID NO: 3253016 - RNA, 17 nt, Mycobacterium tuberculosis H37Rv
cgugcccaagcucaggg

SEQ ID NO: 3253017 - RNA, 22 nt, Mycobacterium tuberculosis H37Rv
cgugcccaagcucagggugggc

SEQ ID NO: 3253018 - RNA, 15 nt, Mycobacterium tuberculosis H37Rv
cgugccccggcggua

SEQ ID NO: 3253019 - RNA, 18 nt, Mycobacterium tuberculosis H37Rv
cgugccccgggcccaggu

SEQ ID NO: 3253020 - RNA, 12 nt, Mycobacterium tuberculosis H37Rv
cgugcccgacca

SEQ ID NO: 3253021 - RNA, 17 nt, Mycobacterium tuberculosis H37Rv
cgugcccugggugaugg

SEQ ID NO: 3253022 - RNA, 16 nt, Mycobacterium tuberculosis H37Rv
cgugccgaaaaucgca

SEQ ID NO: 3253023 - RNA, 20 nt, Mycobacterium tuberculosis H37Rv
cgugccgaaaaucgcagcca

SEQ ID NO: 3253024 - RNA, 23 nt, Mycobacterium tuberculosis H37Rv
cgugccgaacagggaggucgccg

SEQ ID NO: 3253025 - RNA, 15 nt, Mycobacterium tuberculosis H37Rv
cgugccgaccaccag

SEQ ID NO: 3253026 - RNA, 18 nt, Mycobacterium tuberculosis H37Rv
cgugccgaccaccagcau

SEQ ID NO: 3253027 - RNA, 20 nt, Mycobacterium tuberculosis H37Rv
cgugccgaccaccagcaucg

SEQ ID NO: 3253028 - RNA, 13 nt, Mycobacterium tuberculosis H37Rv
cgugccgaccagc

SEQ ID NO: 3253029 - RNA, 23 nt, Mycobacterium tuberculosis H37Rv
cgugccgagcuucagcgcgcugc

SEQ ID NO: 3253030 - RNA, 18 nt, Mycobacterium tuberculosis H37Rv
cgugccgaugccggcgag

SEQ ID NO: 3253031 - RNA, 14 nt, Mycobacterium tuberculosis H37Rv
cgugccgcacagcg

SEQ ID NO: 3253032 - RNA, 15 nt, Mycobacterium tuberculosis H37Rv
cgugccgcacagcgg

SEQ ID NO: 3253033 - RNA, 12 nt, Mycobacterium tuberculosis H37Rv
cgugccgcagcg

SEQ ID NO: 3253034 - RNA, 14 nt, Mycobacterium tuberculosis H37Rv
cgugccgcagcggc

SEQ ID NO: 3253035 - RNA, 16 nt, Mycobacterium tuberculosis H37Rv
cgugccgcccggucgg

SEQ ID NO: 3253036 - RNA, 18 nt, Mycobacterium tuberculosis H37Rv
cgugccgcccucaccgcc

SEQ ID NO: 3253037 - RNA, 21 nt, Mycobacterium tuberculosis H37Rv
cgugccgccgaugccgccggc

SEQ ID NO: 3253038 - RNA, 13 nt, Mycobacterium tuberculosis H37Rv
cgugccgccgcag

SEQ ID NO: 3253039 - RNA, 13 nt, Mycobacterium tuberculosis H37Rv
cgugccggcguug

SEQ ID NO: 3253040 - RNA, 14 nt, Mycobacterium tuberculosis H37Rv
cgugccgggaccgg

SEQ ID NO: 3253041 - RNA, 15 nt, Mycobacterium tuberculosis H37Rv
cgugccgggaccggu

SEQ ID NO: 3253042 - RNA, 14 nt, Mycobacterium tuberculosis H37Rv
cgugccgggccaga

SEQ ID NO: 3253043 - RNA, 22 nt, Mycobacterium tuberculosis H37Rv
cgugccgggccauucaccgcgc

SEQ ID NO: 3253044 - RNA, 16 nt, Mycobacterium tuberculosis H37Rv
cgugccgggcgacggu

SEQ ID NO: 3253045 - RNA, 17 nt, Mycobacterium tuberculosis H37Rv
cgugccggggcugccga

SEQ ID NO: 3253046 - RNA, 18 nt, Mycobacterium tuberculosis H37Rv
cgugccggggcugccgaa

SEQ ID NO: 3253047 - RNA, 22 nt, Mycobacterium tuberculosis H37Rv
cgugccgguggcgccgccgcca

SEQ ID NO: 3253048 - RNA, 18 nt, Mycobacterium tuberculosis H37Rv
cgugccgucgccuccagc

SEQ ID NO: 3253049 - RNA, 15 nt, Mycobacterium tuberculosis H37Rv
cgugccgucggcgug

SEQ ID NO: 3253050 - RNA, 20 nt, Mycobacterium tuberculosis H37Rv
cgugccgucggcgugcagca

SEQ ID NO: 3253051 - RNA, 21 nt, Mycobacterium tuberculosis H37Rv
cgugccgucggcgugcagcag

SEQ ID NO: 3253052 - RNA, 21 nt, Mycobacterium tuberculosis H37Rv
cgugccucgaggacggcguag

SEQ ID NO: 3253053 - RNA, 22 nt, Mycobacterium tuberculosis H37Rv
cgugccucggacaaagccgucg

SEQ ID NO: 3253054 - RNA, 17 nt, Mycobacterium tuberculosis H37Rv
cgugccucucgggggcc

SEQ ID NO: 3253055 - RNA, 19 nt, Mycobacterium tuberculosis H37Rv
cgugccuggccggugcgca

SEQ ID NO: 3253056 - RNA, 17 nt, Mycobacterium tuberculosis H37Rv
cgugccuuccucgccgg

SEQ ID NO: 3253057 - RNA, 18 nt, Mycobacterium tuberculosis H37Rv
cgugcgaaucgagacggc

SEQ ID NO: 3253058 - RNA, 20 nt, Mycobacterium tuberculosis H37Rv
cgugcgacgauaucgggagc

SEQ ID NO: 3253059 - RNA, 17 nt, Mycobacterium tuberculosis H37Rv
cgugcgagggcacggcg

SEQ ID NO: 3253060 - RNA, 20 nt, Mycobacterium tuberculosis H37Rv
cgugcgauuuugugucugcu

SEQ ID NO: 3253061 - RNA, 22 nt, Mycobacterium tuberculosis H37Rv
cgugcgauuuugugucugcucg

SEQ ID NO: 3253062 - RNA, 14 nt, Mycobacterium tuberculosis H37Rv
cgugcgcaucgucg

SEQ ID NO: 3253063 - RNA, 23 nt, Mycobacterium tuberculosis H37Rv
cgugcgccacuagcccugagcga

SEQ ID NO: 3253064 - RNA, 20 nt, Mycobacterium tuberculosis H37Rv
cgugcgccggggacacagcg

SEQ ID NO: 3253065 - RNA, 13 nt, Mycobacterium tuberculosis H37Rv
cgugcgcgcgcag

SEQ ID NO: 3253066 - RNA, 14 nt, Mycobacterium tuberculosis H37Rv
cgugcgcgcgcagc

SEQ ID NO: 3253067 - RNA, 19 nt, Mycobacterium tuberculosis H37Rv
cgugcgcgcgcagcugacg

SEQ ID NO: 3253068 - RNA, 18 nt, Mycobacterium tuberculosis H37Rv
cgugcgcggccggcacga

SEQ ID NO: 3253069 - RNA, 20 nt, Mycobacterium tuberculosis H37Rv
cgugcggaucgcgcugcggg

SEQ ID NO: 3253070 - RNA, 15 nt, Mycobacterium tuberculosis H37Rv
cgugcggccacgguu

SEQ ID NO: 3253071 - RNA, 14 nt, Mycobacterium tuberculosis H37Rv
cgugcggcggccca

SEQ ID NO: 3253072 - RNA, 12 nt, Mycobacterium tuberculosis H37Rv
cgugcggcggcu

SEQ ID NO: 3253073 - RNA, 14 nt, Mycobacterium tuberculosis H37Rv
cgugcggcggcugc

SEQ ID NO: 3253074 - RNA, 12 nt, Mycobacterium tuberculosis H37Rv
cgugcgggccgg

SEQ ID NO: 3253075 - RNA, 16 nt, Mycobacterium tuberculosis H37Rv
cgugguagcgccucgu

SEQ ID NO: 3253076 - RNA, 17 nt, Mycobacterium tuberculosis H37Rv
cgugguagcgccucgug

SEQ ID NO: 3253077 - RNA, 21 nt, Mycobacterium tuberculosis H37Rv
cgugguauccgccguucucgc

SEQ ID NO: 3253078 - RNA, 14 nt, Mycobacterium tuberculosis H37Rv
cguggucaguugug

SEQ ID NO: 3253079 - RNA, 20 nt, Mycobacterium tuberculosis H37Rv
cguggucgacggggcggucg

SEQ ID NO: 3253080 - RNA, 20 nt, Mycobacterium tuberculosis H37Rv
cguggucgacgugaucgcgg

SEQ ID NO: 3253081 - RNA, 13 nt, Mycobacterium tuberculosis H37Rv
cguggucgagcag

SEQ ID NO: 3253082 - RNA, 22 nt, Mycobacterium tuberculosis H37Rv
cguggucggagcgggugcgggc

SEQ ID NO: 3253083 - RNA, 13 nt, Mycobacterium tuberculosis H37Rv
cguggucggcaaa

SEQ ID NO: 3253084 - RNA, 14 nt, Mycobacterium tuberculosis H37Rv
cguggucggccacc

SEQ ID NO: 3253085 - RNA, 15 nt, Mycobacterium tuberculosis H37Rv
cguggucggccaccc

SEQ ID NO: 3253086 - RNA, 17 nt, Mycobacterium tuberculosis H37Rv
cguggucgugggugagc

SEQ ID NO: 3253087 - RNA, 18 nt, Mycobacterium tuberculosis H37Rv
cguggugagccucggcga

SEQ ID NO: 3253088 - RNA, 20 nt, Mycobacterium tuberculosis H37Rv
cguggugauccggucuccgc

SEQ ID NO: 3253089 - RNA, 18 nt, Mycobacterium tuberculosis H37Rv
cguggugcugaccgcgcc

SEQ ID NO: 3253090 - RNA, 19 nt, Mycobacterium tuberculosis H37Rv
cgugguggacgcagaguca

SEQ ID NO: 3253091 - RNA, 14 nt, Mycobacterium tuberculosis H37Rv
cgugguguacccgc

SEQ ID NO: 3253092 - RNA, 21 nt, Mycobacterium tuberculosis H37Rv
cgugguguaucgacggcggcc

SEQ ID NO: 3253093 - RNA, 14 nt, Mycobacterium tuberculosis H37Rv
cguggugucucggc

SEQ ID NO: 3253094 - RNA, 17 nt, Mycobacterium tuberculosis H37Rv
cgugguuccggcgugca

SEQ ID NO: 3253095 - RNA, 20 nt, Mycobacterium tuberculosis H37Rv
cgugguuccggcgugcagca

SEQ ID NO: 3253096 - RNA, 16 nt, Mycobacterium tuberculosis H37Rv
cgugguucggcgucga

SEQ ID NO: 3253097 - RNA, 19 nt, Mycobacterium tuberculosis H37Rv
cgugguuguaccagccgaa

SEQ ID NO: 3253098 - RNA, 20 nt, Mycobacterium tuberculosis H37Rv
cgugguuuugucgacguucg

SEQ ID NO: 3253099 - RNA, 17 nt, Mycobacterium tuberculosis H37Rv
cguguaaccccaggcgc

SEQ ID NO: 3253100 - RNA, 21 nt, Mycobacterium tuberculosis H37Rv
cguguaaccccaggcgcugcc

SEQ ID NO: 3253101 - RNA, 15 nt, Mycobacterium tuberculosis H37Rv
cguguaacgccgacu

SEQ ID NO: 3253102 - RNA, 20 nt, Mycobacterium tuberculosis H37Rv
cguguaacgccgacuccccc

SEQ ID NO: 3253103 - RNA, 16 nt, Mycobacterium tuberculosis H37Rv
cguguaccagcccagc

SEQ ID NO: 3253104 - RNA, 20 nt, Mycobacterium tuberculosis H37Rv
cguguaccagcccagcggcu

SEQ ID NO: 3253105 - RNA, 12 nt, Mycobacterium tuberculosis H37Rv
cguguaccuguc

SEQ ID NO: 3253106 - RNA, 21 nt, Mycobacterium tuberculosis H37Rv
cguguagccugcggcggucau

SEQ ID NO: 3253107 - RNA, 16 nt, Mycobacterium tuberculosis H37Rv
cguguagcugcggguc

SEQ ID NO: 3253108 - RNA, 22 nt, Mycobacterium tuberculosis H37Rv
cguguaggcaaccuuuggccgc

SEQ ID NO: 3253109 - RNA, 21 nt, Mycobacterium tuberculosis H37Rv
cgugucacccaauggagccgc

SEQ ID NO: 3253110 - RNA, 12 nt, Mycobacterium tuberculosis H37Rv
cgugucaccggg

SEQ ID NO: 3253111 - RNA, 22 nt, Mycobacterium tuberculosis H37Rv
cgugucaugcucaccgaggaac

SEQ ID NO: 3253112 - RNA, 13 nt, Mycobacterium tuberculosis H37Rv
cguguccagcaug

SEQ ID NO: 3253113 - RNA, 22 nt, Mycobacterium tuberculosis H37Rv
cguguccagcaugcccgccauc

SEQ ID NO: 3253114 - RNA, 22 nt, Mycobacterium tuberculosis H37Rv
cguguccgccggauagcaccgg

SEQ ID NO: 3253115 - RNA, 12 nt, Mycobacterium tuberculosis H37Rv
cguguccgccgu

SEQ ID NO: 3253116 - RNA, 18 nt, Mycobacterium tuberculosis H37Rv
cguguccuuugccaccuc

SEQ ID NO: 3253117 - RNA, 16 nt, Mycobacterium tuberculosis H37Rv
cgugucgagcgccgca

SEQ ID NO: 3253118 - RNA, 20 nt, Mycobacterium tuberculosis H37Rv
cgugucgagcgccgcaguga

SEQ ID NO: 3253119 - RNA, 20 nt, Mycobacterium tuberculosis H37Rv
cgugucgccgauaucgguga

SEQ ID NO: 3253120 - RNA, 22 nt, Mycobacterium tuberculosis H37Rv
cgugucgccgccaccagcgcac

SEQ ID NO: 3253121 - RNA, 16 nt, Mycobacterium tuberculosis H37Rv
cgugucgcugcggcgc

SEQ ID NO: 3253122 - RNA, 16 nt, Mycobacterium tuberculosis H37Rv
cgugucuugucgcgca

SEQ ID NO: 3253123 - RNA, 19 nt, Mycobacterium tuberculosis H37Rv
cgugucuugucgcgcagca

SEQ ID NO: 3253124 - RNA, 21 nt, Mycobacterium tuberculosis H37Rv
cgugugaggccuucgccgacu

SEQ ID NO: 3253125 - RNA, 20 nt, Mycobacterium tuberculosis H37Rv
cgugugcaccaucaucaccu

SEQ ID NO: 3253126 - RNA, 16 nt, Mycobacterium tuberculosis H37Rv
cgugugccacggggca

SEQ ID NO: 3253127 - RNA, 19 nt, Mycobacterium tuberculosis H37Rv
cgugugcucgaaggaccgg

SEQ ID NO: 3253128 - RNA, 14 nt, Mycobacterium tuberculosis H37Rv
cguguggagcucgc

SEQ ID NO: 3253129 - RNA, 20 nt, Mycobacterium tuberculosis H37Rv
cguguggagcucgcggcgca

SEQ ID NO: 3253130 - RNA, 15 nt, Mycobacterium tuberculosis H37Rv
cguguggcagaugug

SEQ ID NO: 3253131 - RNA, 18 nt, Mycobacterium tuberculosis H37Rv
cguguggugugucaccgg

SEQ ID NO: 3253132 - RNA, 22 nt, Mycobacterium tuberculosis H37Rv
cgugugugcgauccagggccga

SEQ ID NO: 3253133 - RNA, 16 nt, Mycobacterium tuberculosis H37Rv
cgugugugcggcggua

SEQ ID NO: 3253134 - RNA, 22 nt, Mycobacterium tuberculosis H37Rv
cguguucgaccaucaucucggu

SEQ ID NO: 3253135 - RNA, 17 nt, Mycobacterium tuberculosis H37Rv
cguguucgacggcaagc

SEQ ID NO: 3253136 - RNA, 16 nt, Mycobacterium tuberculosis H37Rv
cguguucugaucggug

SEQ ID NO: 3253137 - RNA, 17 nt, Mycobacterium tuberculosis H37Rv
cguguucugaucggugg

SEQ ID NO: 3253138 - RNA, 12 nt, Mycobacterium tuberculosis H37Rv
cguguugaagaa

SEQ ID NO: 3253139 - RNA, 17 nt, Mycobacterium tuberculosis H37Rv
cguguuguugaagcccg

SEQ ID NO: 3253140 - RNA, 20 nt, Mycobacterium tuberculosis H37Rv
cguuaacugcgccuaacccc

SEQ ID NO: 3253141 - RNA, 21 nt, Mycobacterium tuberculosis H37Rv
cguuaaucaaggugaucagca

SEQ ID NO: 3253142 - RNA, 20 nt, Mycobacterium tuberculosis H37Rv
cguuaccaccgucaccgccg

SEQ ID NO: 3253143 - RNA, 12 nt, Mycobacterium tuberculosis H37Rv
cguuaccgagcc

SEQ ID NO: 3253144 - RNA, 12 nt, Mycobacterium tuberculosis H37Rv
cguuaccgccaa

SEQ ID NO: 3253145 - RNA, 20 nt, Mycobacterium tuberculosis H37Rv
cguuaccggacccgcugauc

SEQ ID NO: 3253146 - RNA, 18 nt, Mycobacterium tuberculosis H37Rv
cguuacgcucgcgggcca

SEQ ID NO: 3253147 - RNA, 21 nt, Mycobacterium tuberculosis H37Rv
cguuagaguaggccaccacug

SEQ ID NO: 3253148 - RNA, 21 nt, Mycobacterium tuberculosis H37Rv
cguuagccaggucgauaccgg

SEQ ID NO: 3253149 - RNA, 19 nt, Mycobacterium tuberculosis H37Rv
cguuagcguagcccgaguu

SEQ ID NO: 3253150 - RNA, 14 nt, Mycobacterium tuberculosis H37Rv
cguuaggucacucc

SEQ ID NO: 3253151 - RNA, 18 nt, Mycobacterium tuberculosis H37Rv
cguucaacaccgccgacc

SEQ ID NO: 3253152 - RNA, 17 nt, Mycobacterium tuberculosis H37Rv
cguucaccgcagcgggu

SEQ ID NO: 3253153 - RNA, 23 nt, Mycobacterium tuberculosis H37Rv
cguucacgccagucccacugggc

SEQ ID NO: 3253154 - RNA, 14 nt, Mycobacterium tuberculosis H37Rv
cguucacuggucuc

SEQ ID NO: 3253155 - RNA, 13 nt, Mycobacterium tuberculosis H37Rv
cguucagcgacca

SEQ ID NO: 3253156 - RNA, 21 nt, Mycobacterium tuberculosis H37Rv
cguucagguguugacgccaac

SEQ ID NO: 3253157 - RNA, 18 nt, Mycobacterium tuberculosis H37Rv
cguucaucauccacaccg

SEQ ID NO: 3253158 - RNA, 16 nt, Mycobacterium tuberculosis H37Rv
cguucaugaucggcag

SEQ ID NO: 3253159 - RNA, 19 nt, Mycobacterium tuberculosis H37Rv
cguucauguagcagcgcgg

SEQ ID NO: 3253160 - RNA, 21 nt, Mycobacterium tuberculosis H37Rv
cguucauguagcagcgcggcu

SEQ ID NO: 3253161 - RNA, 23 nt, Mycobacterium tuberculosis H37Rv
cguuccacgagucgucguccgac

SEQ ID NO: 3253162 - RNA, 21 nt, Mycobacterium tuberculosis H37Rv
cguuccagcaguacaccgccc

SEQ ID NO: 3253163 - RNA, 19 nt, Mycobacterium tuberculosis H37Rv
cguuccaucacggaccagg

SEQ ID NO: 3253164 - RNA, 22 nt, Mycobacterium tuberculosis H37Rv
cguuccaucagggccuuggcgg

SEQ ID NO: 3253165 - RNA, 16 nt, Mycobacterium tuberculosis H37Rv
cguuccaucgccgacg

SEQ ID NO: 3253166 - RNA, 17 nt, Mycobacterium tuberculosis H37Rv
cguucccaucccucggu

SEQ ID NO: 3253167 - RNA, 13 nt, Mycobacterium tuberculosis H37Rv
cguucccgccggc

SEQ ID NO: 3253168 - RNA, 15 nt, Mycobacterium tuberculosis H37Rv
cguucccgccggccc

SEQ ID NO: 3253169 - RNA, 16 nt, Mycobacterium tuberculosis H37Rv
cguucccgccggcccc

SEQ ID NO: 3253170 - RNA, 15 nt, Mycobacterium tuberculosis H37Rv
cguucccgccggcuc

SEQ ID NO: 3253171 - RNA, 22 nt, Mycobacterium tuberculosis H37Rv
cguugccgccggugccacccuu

SEQ ID NO: 3253172 - RNA, 20 nt, Mycobacterium tuberculosis H37Rv
cguugccgccgucgccgccg

SEQ ID NO: 3253173 - RNA, 14 nt, Mycobacterium tuberculosis H37Rv
cguugccgccguug

SEQ ID NO: 3253174 - RNA, 23 nt, Mycobacterium tuberculosis H37Rv
cguugccgccguugccgccguua

SEQ ID NO: 3253175 - RNA, 15 nt, Mycobacterium tuberculosis H37Rv
cguugccggcuuggc

SEQ ID NO: 3253176 - RNA, 17 nt, Mycobacterium tuberculosis H37Rv
cguugccggugccgccg

SEQ ID NO: 3253177 - RNA, 18 nt, Mycobacterium tuberculosis H37Rv
cguugccggugccgccgc

SEQ ID NO: 3253178 - RNA, 22 nt, Mycobacterium tuberculosis H37Rv
cguugccgucgucgccgucggu

SEQ ID NO: 3253179 - RNA, 21 nt, Mycobacterium tuberculosis H37Rv
cguugccguuggugccgccug

SEQ ID NO: 3253180 - RNA, 17 nt, Mycobacterium tuberculosis H37Rv
cguugcgcugcgcgacg

SEQ ID NO: 3253181 - RNA, 21 nt, Mycobacterium tuberculosis H37Rv
cguugcggaaucagcacccca

SEQ ID NO: 3253182 - RNA, 15 nt, Mycobacterium tuberculosis H37Rv
cguugcggcaacagc

SEQ ID NO: 3253183 - RNA, 18 nt, Mycobacterium tuberculosis H37Rv
cguugcguagcaggucga

SEQ ID NO: 3253184 - RNA, 19 nt, Mycobacterium tuberculosis H37Rv
cguugcucccacggcaccc

SEQ ID NO: 3253185 - RNA, 20 nt, Mycobacterium tuberculosis H37Rv
cguugcugaugucgccggug

SEQ ID NO: 3253186 - RNA, 17 nt, Mycobacterium tuberculosis H37Rv
cguugcugcgcagcggc

SEQ ID NO: 3253187 - RNA, 16 nt, Mycobacterium tuberculosis H37Rv
cguugcuggcggccag

SEQ ID NO: 3253188 - RNA, 14 nt, Mycobacterium tuberculosis H37Rv
cguugcuggcuggg

SEQ ID NO: 3253189 - RNA, 15 nt, Mycobacterium tuberculosis H37Rv
cguuggacggcaccg

SEQ ID NO: 3253190 - RNA, 18 nt, Mycobacterium tuberculosis H37Rv
cguuggagccgccaccga

SEQ ID NO: 3253191 - RNA, 23 nt, Mycobacterium tuberculosis H37Rv
cguuggcaaugaccccggcguug

SEQ ID NO: 3253192 - RNA, 22 nt, Mycobacterium tuberculosis H37Rv
cguuggcaccgggugcgacggc

SEQ ID NO: 3253193 - RNA, 13 nt, Mycobacterium tuberculosis H37Rv
cguuggcagcccu

SEQ ID NO: 3253194 - RNA, 16 nt, Mycobacterium tuberculosis H37Rv
cguuggcaucggcgga

SEQ ID NO: 3253195 - RNA, 13 nt, Mycobacterium tuberculosis H37Rv
cguuggccagcag

SEQ ID NO: 3253196 - RNA, 14 nt, Mycobacterium tuberculosis H37Rv
cguuggccagcagg

SEQ ID NO: 3253197 - RNA, 18 nt, Mycobacterium tuberculosis H37Rv
cguuggcgaacugguagc

SEQ ID NO: 3253198 - RNA, 16 nt, Mycobacterium tuberculosis H37Rv
cguuggcgccaccagu

SEQ ID NO: 3253199 - RNA, 20 nt, Mycobacterium tuberculosis H37Rv
cguuggcgccaccagucacg

SEQ ID NO: 3253200 - RNA, 21 nt, Mycobacterium tuberculosis H37Rv
cguuggcgccggccaacaggu

SEQ ID NO: 3253201 - RNA, 18 nt, Mycobacterium tuberculosis H37Rv
cguuggcggccagcgcac

SEQ ID NO: 3253202 - RNA, 21 nt, Mycobacterium tuberculosis H37Rv
cguuggcggcggucggcuggg

SEQ ID NO: 3253203 - RNA, 22 nt, Mycobacterium tuberculosis H37Rv
cguuggcgguagacaccccacc

SEQ ID NO: 3253204 - RNA, 17 nt, Mycobacterium tuberculosis H37Rv
cguuggcuucuucgguc

SEQ ID NO: 3253205 - RNA, 14 nt, Mycobacterium tuberculosis H37Rv
cguugggaaacauc

SEQ ID NO: 3253206 - RNA, 16 nt, Mycobacterium tuberculosis H37Rv
cguugggaccagugcg

SEQ ID NO: 3253207 - RNA, 17 nt, Mycobacterium tuberculosis H37Rv
cguugggaucccagcgc

SEQ ID NO: 3253208 - RNA, 20 nt, Mycobacterium tuberculosis H37Rv
cguugggcaugucgccgaac

SEQ ID NO: 3253209 - RNA, 18 nt, Mycobacterium tuberculosis H37Rv
cguugggccaccggcgcc

SEQ ID NO: 3253210 - RNA, 14 nt, Mycobacterium tuberculosis H37Rv
cguugggccgcgcc

SEQ ID NO: 3253211 - RNA, 19 nt, Mycobacterium tuberculosis H37Rv
cguugggcguacucggcgc

SEQ ID NO: 3253212 - RNA, 21 nt, Mycobacterium tuberculosis H37Rv
cguuggucagcguggacgccc

SEQ ID NO: 3253213 - RNA, 15 nt, Mycobacterium tuberculosis H37Rv
cguuggugcagacca

SEQ ID NO: 3253214 - RNA, 17 nt, Mycobacterium tuberculosis H37Rv
cguuggugcagucggug

SEQ ID NO: 3253215 - RNA, 22 nt, Mycobacterium tuberculosis H37Rv
cguugguggucggcccuccacc

SEQ ID NO: 3253216 - RNA, 21 nt, Mycobacterium tuberculosis H37Rv
cguugguugcguccgccgaac

SEQ ID NO: 3253217 - RNA, 11 nt, Mycobacterium tuberculosis H37Rv
cguugguuggu

SEQ ID NO: 3253218 - RNA, 16 nt, Mycobacterium tuberculosis H37Rv
cguuguaggcuuccag

SEQ ID NO: 3253219 - RNA, 17 nt, Mycobacterium tuberculosis H37Rv
cguuguaugcguuacgc

SEQ ID NO: 3253220 - RNA, 20 nt, Mycobacterium tuberculosis H37Rv
cguuguaugcguuacgccgc

SEQ ID NO: 3253221 - RNA, 19 nt, Mycobacterium tuberculosis H37Rv
cguuguaugcugcgcgccg

SEQ ID NO: 3253222 - RNA, 20 nt, Mycobacterium tuberculosis H37Rv
cguugucagcgaacggccag

SEQ ID NO: 3253223 - RNA, 13 nt, Mycobacterium tuberculosis H37Rv
cguuguccaccgc

SEQ ID NO: 3253224 - RNA, 17 nt, Mycobacterium tuberculosis H37Rv
cguuguccaccgccacc

SEQ ID NO: 3253225 - RNA, 16 nt, Mycobacterium tuberculosis H37Rv
cguuguccagaacggc

SEQ ID NO: 3253226 - RNA, 16 nt, Mycobacterium tuberculosis H37Rv
cguugucggcuggacg

SEQ ID NO: 3253227 - RNA, 19 nt, Mycobacterium tuberculosis H37Rv
cguugucgggcaacacgau

SEQ ID NO: 3253228 - RNA, 15 nt, Mycobacterium tuberculosis H37Rv
cguugugcagcgcgu

SEQ ID NO: 3253229 - RNA, 21 nt, Mycobacterium tuberculosis H37Rv
cguugugcgccuugaccacag

SEQ ID NO: 3253230 - RNA, 16 nt, Mycobacterium tuberculosis H37Rv
cguugugucaccggcg

SEQ ID NO: 3253231 - RNA, 21 nt, Mycobacterium tuberculosis H37Rv
cguuguuggauccggccacca

SEQ ID NO: 3253232 - RNA, 19 nt, Mycobacterium tuberculosis H37Rv
cguuuacggcccggcaccc

SEQ ID NO: 3253233 - RNA, 15 nt, Mycobacterium tuberculosis H37Rv
cguuuaucagcaaga

SEQ ID NO: 3253234 - RNA, 15 nt, Mycobacterium tuberculosis H37Rv
cguuuccgccgccgc

SEQ ID NO: 3253235 - RNA, 17 nt, Mycobacterium tuberculosis H37Rv
cguuuccgccgccgcca

SEQ ID NO: 3253236 - RNA, 19 nt, Mycobacterium tuberculosis H37Rv
cguuucgaaccgcacggug

SEQ ID NO: 3253237 - RNA, 16 nt, Mycobacterium tuberculosis H37Rv
cguuucgccagccggc

SEQ ID NO: 3253238 - RNA, 16 nt, Mycobacterium tuberculosis H37Rv
cguuucgccggcgcgc

SEQ ID NO: 3253239 - RNA, 18 nt, Mycobacterium tuberculosis H37Rv
cguuucgcgaugugcgcc

SEQ ID NO: 3253240 - RNA, 22 nt, Mycobacterium tuberculosis H37Rv
cguuucgcgaugugcgccaccu

SEQ ID NO: 3253241 - RNA, 22 nt, Mycobacterium tuberculosis H37Rv
cguuucggcgggcgccucggug

SEQ ID NO: 3253242 - RNA, 18 nt, Mycobacterium tuberculosis H37Rv
cguuugagcggccaccgu

SEQ ID NO: 3253243 - RNA, 14 nt, Mycobacterium tuberculosis H37Rv
cguuugccggccca

SEQ ID NO: 3253244 - RNA, 16 nt, Mycobacterium tuberculosis H37Rv
cguuugcgaagcccac

SEQ ID NO: 3253245 - RNA, 12 nt, Mycobacterium tuberculosis H37Rv
cguuuggacggg

SEQ ID NO: 3253246 - RNA, 15 nt, Mycobacterium tuberculosis H37Rv
cguuuggcgccgccg

SEQ ID NO: 3253247 - RNA, 15 nt, Mycobacterium tuberculosis H37Rv
cguuuggcugccgaa

SEQ ID NO: 3253248 - RNA, 18 nt, Mycobacterium tuberculosis H37Rv
cguuuggugugauacagc

SEQ ID NO: 3253249 - RNA, 14 nt, Mycobacterium tuberculosis H37Rv
cguuuuccagccga

SEQ ID NO: 3253250 - RNA, 16 nt, Mycobacterium tuberculosis H37Rv
cguuuucgucacccca

SEQ ID NO: 3253251 - RNA, 15 nt, Mycobacterium tuberculosis H37Rv
cguuuugcggcccgg

SEQ ID NO: 3253252 - RNA, 18 nt, Mycobacterium tuberculosis H37Rv
cuaaaccagccaccacca

SEQ ID NO: 3253253 - RNA, 22 nt, Mycobacterium tuberculosis H37Rv
cuaaagcgugucgaugcgggcu

SEQ ID NO: 3253254 - RNA, 23 nt, Mycobacterium tuberculosis H37Rv
cuaaaucuggccgauuuaguggg

SEQ ID NO: 3253255 - RNA, 14 nt, Mycobacterium tuberculosis H37Rv
cuaacaacaccacc

SEQ ID NO: 3253256 - RNA, 16 nt, Mycobacterium tuberculosis H37Rv
cuaacaacaccaccag

SEQ ID NO: 3253257 - RNA, 19 nt, Mycobacterium tuberculosis H37Rv
cuaacaacaccaccagcac

SEQ ID NO: 3253258 - RNA, 20 nt, Mycobacterium tuberculosis H37Rv
cuaacaacaccaccagcacg

SEQ ID NO: 3253259 - RNA, 17 nt, Mycobacterium tuberculosis H37Rv
cuaacaccgcaggcaca

SEQ ID NO: 3253260 - RNA, 19 nt, Mycobacterium tuberculosis H37Rv
cuaacacuagcccgguauc

SEQ ID NO: 3253261 - RNA, 20 nt, Mycobacterium tuberculosis H37Rv
cuaaccacuguuucugagcg

SEQ ID NO: 3253262 - RNA, 18 nt, Mycobacterium tuberculosis H37Rv
cuaaccccggcucgacgc

SEQ ID NO: 3253263 - RNA, 20 nt, Mycobacterium tuberculosis H37Rv
cuaacccgcaccuacccugc

SEQ ID NO: 3253264 - RNA, 13 nt, Mycobacterium tuberculosis H37Rv
cuaacccugcccu

SEQ ID NO: 3253265 - RNA, 23 nt, Mycobacterium tuberculosis H37Rv
cuaaccgcuuggugugauacaac

SEQ ID NO: 3253266 - RNA, 15 nt, Mycobacterium tuberculosis H37Rv
cuaacggcagccacc

SEQ ID NO: 3253267 - RNA, 13 nt, Mycobacterium tuberculosis H37Rv
cuaggucagcggg

SEQ ID NO: 3253268 - RNA, 14 nt, Mycobacterium tuberculosis H37Rv
cuaggucagcgggc

SEQ ID NO: 3253269 - RNA, 19 nt, Mycobacterium tuberculosis H37Rv
cuagguccgaacuugacga

SEQ ID NO: 3253270 - RNA, 17 nt, Mycobacterium tuberculosis H37Rv
cuaggucgcgcugaagg

SEQ ID NO: 3253271 - RNA, 19 nt, Mycobacterium tuberculosis H37Rv
cuaggugacgccgccagca

SEQ ID NO: 3253272 - RNA, 11 nt, Mycobacterium tuberculosis H37Rv
cuagguucagu

SEQ ID NO: 3253273 - RNA, 16 nt, Mycobacterium tuberculosis H37Rv
cuaguccggcacugcg

SEQ ID NO: 3253274 - RNA, 18 nt, Mycobacterium tuberculosis H37Rv
cuagucgugccgcgucgg

SEQ ID NO: 3253275 - RNA, 16 nt, Mycobacterium tuberculosis H37Rv
cuaguucgagcugcca

SEQ ID NO: 3253276 - RNA, 19 nt, Mycobacterium tuberculosis H37Rv
cuaguucgagcugccaggc

SEQ ID NO: 3253277 - RNA, 12 nt, Mycobacterium tuberculosis H37Rv
cuaguucggcgu

SEQ ID NO: 3253278 - RNA, 16 nt, Mycobacterium tuberculosis H37Rv
cuaguugacgcagccc

SEQ ID NO: 3253279 - RNA, 20 nt, Mycobacterium tuberculosis H37Rv
cuaguugggugggugcagca

SEQ ID NO: 3253280 - RNA, 18 nt, Mycobacterium tuberculosis H37Rv
cuauacgcaacaggccaa

SEQ ID NO: 3253281 - RNA, 15 nt, Mycobacterium tuberculosis H37Rv
cuauccggcggccag

SEQ ID NO: 3253282 - RNA, 14 nt, Mycobacterium tuberculosis H37Rv
cuaucgacaacaug

SEQ ID NO: 3253283 - RNA, 23 nt, Mycobacterium tuberculosis H37Rv
cuaucgaggaggcggucgaucag

SEQ ID NO: 3253284 - RNA, 14 nt, Mycobacterium tuberculosis H37Rv
cuaucgccgcgcgu

SEQ ID NO: 3253285 - RNA, 16 nt, Mycobacterium tuberculosis H37Rv
cuaucggccgccggau

SEQ ID NO: 3253286 - RNA, 23 nt, Mycobacterium tuberculosis H37Rv
cuaucguugugcggacaucaccg

SEQ ID NO: 3253287 - RNA, 17 nt, Mycobacterium tuberculosis H37Rv
cuaucuccaugcucgag

SEQ ID NO: 3253288 - RNA, 15 nt, Mycobacterium tuberculosis H37Rv
cuaucucgcucgacg

SEQ ID NO: 3253289 - RNA, 16 nt, Mycobacterium tuberculosis H37Rv
cuaugcguccaggcga

SEQ ID NO: 3253290 - RNA, 13 nt, Mycobacterium tuberculosis H37Rv
cuaugcuggcagc

SEQ ID NO: 3253291 - RNA, 15 nt, Mycobacterium tuberculosis H37Rv
cuaugcuggcagcuc

SEQ ID NO: 3253292 - RNA, 19 nt, Mycobacterium tuberculosis H37Rv
cuauggcgccgcggcuggg

SEQ ID NO: 3253293 - RNA, 22 nt, Mycobacterium tuberculosis H37Rv
cuauggcggcuucgacgucggc

SEQ ID NO: 3253294 - RNA, 17 nt, Mycobacterium tuberculosis H37Rv
cuauggucaaccgcgcc

SEQ ID NO: 3253295 - RNA, 14 nt, Mycobacterium tuberculosis H37Rv
cuauggugccggug

SEQ ID NO: 3253296 - RNA, 18 nt, Mycobacterium tuberculosis H37Rv
cuaugucauagcgcacca

SEQ ID NO: 3253297 - RNA, 23 nt, Mycobacterium tuberculosis H37Rv
cuauuccgaauuaccuugcgguu

SEQ ID NO: 3253298 - RNA, 16 nt, Mycobacterium tuberculosis H37Rv
cuauuccgcggcacgc

SEQ ID NO: 3253299 - RNA, 21 nt, Mycobacterium tuberculosis H37Rv
cuauuucgcggauuucucgcc

SEQ ID NO: 3253300 - RNA, 13 nt, Mycobacterium tuberculosis H37Rv
cucaaccagcaga

SEQ ID NO: 3253301 - RNA, 20 nt, Mycobacterium tuberculosis H37Rv
cucaaccagcagacgccgua

SEQ ID NO: 3253302 - RNA, 24 nt, Mycobacterium tuberculosis H37Rv
cucaaccagcagacgccguagccg

SEQ ID NO: 3253303 - RNA, 18 nt, Mycobacterium tuberculosis H37Rv
cucaacccgugcgacuuc

SEQ ID NO: 3253304 - RNA, 16 nt, Mycobacterium tuberculosis H37Rv
cucaacgacaccauag

SEQ ID NO: 3253305 - RNA, 18 nt, Mycobacterium tuberculosis H37Rv
cucaacgacaccauaggc

SEQ ID NO: 3253306 - RNA, 12 nt, Mycobacterium tuberculosis H37Rv
cucaacgaucgc

SEQ ID NO: 3253307 - RNA, 16 nt, Mycobacterium tuberculosis H37Rv
cucaacgaucgcgccg

SEQ ID NO: 3253308 - RNA, 14 nt, Mycobacterium tuberculosis H37Rv
cucaagcgaagagc

SEQ ID NO: 3253309 - RNA, 15 nt, Mycobacterium tuberculosis H37Rv
cucaaggacgcaccg

SEQ ID NO: 3253310 - RNA, 19 nt, Mycobacterium tuberculosis H37Rv
cucaagggacacccgcuuu

SEQ ID NO: 3253311 - RNA, 20 nt, Mycobacterium tuberculosis H37Rv
cucaagggcaucaaccaacu

SEQ ID NO: 3253312 - RNA, 18 nt, Mycobacterium tuberculosis H37Rv
cucaaguugggcguucag

SEQ ID NO: 3253313 - RNA, 16 nt, Mycobacterium tuberculosis H37Rv
cucacauccugguuga

SEQ ID NO: 3253314 - RNA, 15 nt, Mycobacterium tuberculosis H37Rv
cucacaugcccggac

SEQ ID NO: 3253315 - RNA, 16 nt, Mycobacterium tuberculosis H37Rv
cucacauuggccaggu

SEQ ID NO: 3253316 - RNA, 12 nt, Mycobacterium tuberculosis H37Rv
cucaccaccaga

SEQ ID NO: 3253317 - RNA, 18 nt, Mycobacterium tuberculosis H37Rv
cucaccacgucgaccgaa

SEQ ID NO: 3253318 - RNA, 20 nt, Mycobacterium tuberculosis H37Rv
cucaccagacgcugccaagc

SEQ ID NO: 3253319 - RNA, 17 nt, Mycobacterium tuberculosis H37Rv
cucaccagccgucagcg

SEQ ID NO: 3253320 - RNA, 19 nt, Mycobacterium tuberculosis H37Rv
cucaccagccgucagcgcg

SEQ ID NO: 3253321 - RNA, 12 nt, Mycobacterium tuberculosis H37Rv
cucaccagucag

SEQ ID NO: 3253322 - RNA, 13 nt, Mycobacterium tuberculosis H37Rv
cucacccacauga

SEQ ID NO: 3253323 - RNA, 16 nt, Mycobacterium tuberculosis H37Rv
cucacccgggcagccu

SEQ ID NO: 3253324 - RNA, 17 nt, Mycobacterium tuberculosis H37Rv
cucacccgggcagccug

SEQ ID NO: 3253325 - RNA, 23 nt, Mycobacterium tuberculosis H37Rv
cucaccgaacgcgaugcgccauu

SEQ ID NO: 3253326 - RNA, 22 nt, Mycobacterium tuberculosis H37Rv
cucaccgcacaccugcgcggcg

SEQ ID NO: 3253327 - RNA, 13 nt, Mycobacterium tuberculosis H37Rv
cucaccgccgcua

SEQ ID NO: 3253328 - RNA, 13 nt, Mycobacterium tuberculosis H37Rv
cucaccggcuggu

SEQ ID NO: 3253329 - RNA, 16 nt, Mycobacterium tuberculosis H37Rv
cucaccucaugaucuc

SEQ ID NO: 3253330 - RNA, 22 nt, Mycobacterium tuberculosis H37Rv
cucaccucggcuuugccgcugu

SEQ ID NO: 3253331 - RNA, 19 nt, Mycobacterium tuberculosis H37Rv
cucacgaagaccgcgucgg

SEQ ID NO: 3253332 - RNA, 13 nt, Mycobacterium tuberculosis H37Rv
cucacgacgccgu

SEQ ID NO: 3253333 - RNA, 19 nt, Mycobacterium tuberculosis H37Rv
cucacgacuggcgcccagc

SEQ ID NO: 3253334 - RNA, 17 nt, Mycobacterium tuberculosis H37Rv
cucacgagcggcggugg

SEQ ID NO: 3253335 - RNA, 20 nt, Mycobacterium tuberculosis H37Rv
cucacgaggcacaaucaccg

SEQ ID NO: 3253336 - RNA, 13 nt, Mycobacterium tuberculosis H37Rv
cucacgaucaccc

SEQ ID NO: 3253337 - RNA, 14 nt, Mycobacterium tuberculosis H37Rv
cucacgcagcgcca

SEQ ID NO: 3253338 - RNA, 22 nt, Mycobacterium tuberculosis H37Rv
cucacgcaggaaaaccccggcc

SEQ ID NO: 3253339 - RNA, 19 nt, Mycobacterium tuberculosis H37Rv
cucacgccaaguccgcuca

SEQ ID NO: 3253340 - RNA, 19 nt, Mycobacterium tuberculosis H37Rv
cucacgcgggucguuacca

SEQ ID NO: 3253341 - RNA, 17 nt, Mycobacterium tuberculosis H37Rv
cucacggcauccgcuca

SEQ ID NO: 3253342 - RNA, 17 nt, Mycobacterium tuberculosis H37Rv
cucacgggugcuggcag

SEQ ID NO: 3253343 - RNA, 19 nt, Mycobacterium tuberculosis H37Rv
cucacgggugcuggcagga

SEQ ID NO: 3253344 - RNA, 21 nt, Mycobacterium tuberculosis H37Rv
cucacguggacugaccucguc

SEQ ID NO: 3253345 - RNA, 22 nt, Mycobacterium tuberculosis H37Rv
cucacguggacugaccucguca

SEQ ID NO: 3253346 - RNA, 19 nt, Mycobacterium tuberculosis H37Rv
cucacguugugagccacgc

SEQ ID NO: 3253347 - RNA, 18 nt, Mycobacterium tuberculosis H37Rv
cucacuggugacccugau

SEQ ID NO: 3253348 - RNA, 22 nt, Mycobacterium tuberculosis H37Rv
cucacugugguaggccggggcg

SEQ ID NO: 3253349 - RNA, 14 nt, Mycobacterium tuberculosis H37Rv
cucagcaccgcugg

SEQ ID NO: 3253350 - RNA, 20 nt, Mycobacterium tuberculosis H37Rv
cucagcacgcguucaacgaa

SEQ ID NO: 3253351 - RNA, 22 nt, Mycobacterium tuberculosis H37Rv
cucagccaccgcggucagcucg

SEQ ID NO: 3253352 - RNA, 16 nt, Mycobacterium tuberculosis H37Rv
cucagcccggccagcc

SEQ ID NO: 3253353 - RNA, 18 nt, Mycobacterium tuberculosis H37Rv
cucagcccgucagccgau

SEQ ID NO: 3253354 - RNA, 18 nt, Mycobacterium tuberculosis H37Rv
cucagccgcgccgggucc

SEQ ID NO: 3253355 - RNA, 14 nt, Mycobacterium tuberculosis H37Rv
cucagccggcggcu

SEQ ID NO: 3253356 - RNA, 12 nt, Mycobacterium tuberculosis H37Rv
cucagccguccg

SEQ ID NO: 3253357 - RNA, 19 nt, Mycobacterium tuberculosis H37Rv
cucagccguccgggcggcc

SEQ ID NO: 3253358 - RNA, 16 nt, Mycobacterium tuberculosis H37Rv
cucagccgugcccagg

SEQ ID NO: 3253359 - RNA, 20 nt, Mycobacterium tuberculosis H37Rv
cucagccguucgcagcugau

SEQ ID NO: 3253360 - RNA, 13 nt, Mycobacterium tuberculosis H37Rv
cucagcgacagcu

SEQ ID NO: 3253361 - RNA, 14 nt, Mycobacterium tuberculosis H37Rv
cucagcgaugcuca

SEQ ID NO: 3253362 - RNA, 13 nt, Mycobacterium tuberculosis H37Rv
cucagcgcgcgcc

SEQ ID NO: 3253363 - RNA, 17 nt, Mycobacterium tuberculosis H37Rv
cucagcggcgaccgcau

SEQ ID NO: 3253364 - RNA, 18 nt, Mycobacterium tuberculosis H37Rv
cuccagcugcgcgggcga

SEQ ID NO: 3253365 - RNA, 23 nt, Mycobacterium tuberculosis H37Rv
cuccagcuugccgaccugcgcga

SEQ ID NO: 3253366 - RNA, 13 nt, Mycobacterium tuberculosis H37Rv
cuccaggcccggc

SEQ ID NO: 3253367 - RNA, 17 nt, Mycobacterium tuberculosis H37Rv
cuccaggccuaguccgg

SEQ ID NO: 3253368 - RNA, 20 nt, Mycobacterium tuberculosis H37Rv
cuccaggccuaguccggcac

SEQ ID NO: 3253369 - RNA, 14 nt, Mycobacterium tuberculosis H37Rv
cuccaggcgcgccg

SEQ ID NO: 3253370 - RNA, 22 nt, Mycobacterium tuberculosis H37Rv
cuccaggcugaaaccuugcggc

SEQ ID NO: 3253371 - RNA, 17 nt, Mycobacterium tuberculosis H37Rv
cuccaggggcuggugcu

SEQ ID NO: 3253372 - RNA, 22 nt, Mycobacterium tuberculosis H37Rv
cuccagguccacauccagggug

SEQ ID NO: 3253373 - RNA, 13 nt, Mycobacterium tuberculosis H37Rv
cuccaggucgaca

SEQ ID NO: 3253374 - RNA, 22 nt, Mycobacterium tuberculosis H37Rv
cuccaggucgcauucugcugcc

SEQ ID NO: 3253375 - RNA, 23 nt, Mycobacterium tuberculosis H37Rv
cuccaggucgcauucugcugcca

SEQ ID NO: 3253376 - RNA, 20 nt, Mycobacterium tuberculosis H37Rv
cuccaguccuaucagugagc

SEQ ID NO: 3253377 - RNA, 12 nt, Mycobacterium tuberculosis H37Rv
cuccagugcggc

SEQ ID NO: 3253378 - RNA, 20 nt, Mycobacterium tuberculosis H37Rv
cuccagugcggccuuggcga

SEQ ID NO: 3253379 - RNA, 22 nt, Mycobacterium tuberculosis H37Rv
cuccaguucgccguugucgucg

SEQ ID NO: 3253380 - RNA, 18 nt, Mycobacterium tuberculosis H37Rv
cuccaucaaccgcgcugu

SEQ ID NO: 3253381 - RNA, 13 nt, Mycobacterium tuberculosis H37Rv
cuccaucagcgcg

SEQ ID NO: 3253382 - RNA, 16 nt, Mycobacterium tuberculosis H37Rv
cuccaucagcgcgacc

SEQ ID NO: 3253383 - RNA, 18 nt, Mycobacterium tuberculosis H37Rv
cuccaucagcgcgaccga

SEQ ID NO: 3253384 - RNA, 14 nt, Mycobacterium tuberculosis H37Rv
cuccaugaagggcc

SEQ ID NO: 3253385 - RNA, 19 nt, Mycobacterium tuberculosis H37Rv
cuccaugaaucgcgcuuca

SEQ ID NO: 3253386 - RNA, 15 nt, Mycobacterium tuberculosis H37Rv
cuccaugcccuguuc

SEQ ID NO: 3253387 - RNA, 16 nt, Mycobacterium tuberculosis H37Rv
cuccauggcauugcuc

SEQ ID NO: 3253388 - RNA, 18 nt, Mycobacterium tuberculosis H37Rv
cuccauggccugauucca

SEQ ID NO: 3253389 - RNA, 22 nt, Mycobacterium tuberculosis H37Rv
cucccacagguagaccgucucc

SEQ ID NO: 3253390 - RNA, 14 nt, Mycobacterium tuberculosis H37Rv
cucccacgcuucgg

SEQ ID NO: 3253391 - RNA, 11 nt, Mycobacterium tuberculosis H37Rv
cucccagccca

SEQ ID NO: 3253392 - RNA, 18 nt, Mycobacterium tuberculosis H37Rv
cucccaggccgccgccag

SEQ ID NO: 3253393 - RNA, 20 nt, Mycobacterium tuberculosis H37Rv
cucccagggcucggcggccc

SEQ ID NO: 3253394 - RNA, 13 nt, Mycobacterium tuberculosis H37Rv
cucccagugagca

SEQ ID NO: 3253395 - RNA, 21 nt, Mycobacterium tuberculosis H37Rv
cucccagugagcaugcgacgu

SEQ ID NO: 3253396 - RNA, 20 nt, Mycobacterium tuberculosis H37Rv
cucccauucccaacacagcc

SEQ ID NO: 3253397 - RNA, 12 nt, Mycobacterium tuberculosis H37Rv
cucccccacaca

SEQ ID NO: 3253398 - RNA, 18 nt, Mycobacterium tuberculosis H37Rv
cucccccggcuccgcaac

SEQ ID NO: 3253399 - RNA, 21 nt, Mycobacterium tuberculosis H37Rv
cuccccgaccgaaccgucagc

SEQ ID NO: 3253400 - RNA, 17 nt, Mycobacterium tuberculosis H37Rv
cuccccgaccgcgcccg

SEQ ID NO: 3253401 - RNA, 17 nt, Mycobacterium tuberculosis H37Rv
cuccccgaucagcaccg

SEQ ID NO: 3253402 - RNA, 18 nt, Mycobacterium tuberculosis H37Rv
cuccccgaucagcaccga

SEQ ID NO: 3253403 - RNA, 19 nt, Mycobacterium tuberculosis H37Rv
cuccccgaucagcaccgac

SEQ ID NO: 3253404 - RNA, 13 nt, Mycobacterium tuberculosis H37Rv
cuccccgccggaa

SEQ ID NO: 3253405 - RNA, 17 nt, Mycobacterium tuberculosis H37Rv
cuccccggucgccgcgu

SEQ ID NO: 3253406 - RNA, 15 nt, Mycobacterium tuberculosis H37Rv
cuccccguccugcca

SEQ ID NO: 3253407 - RNA, 16 nt, Mycobacterium tuberculosis H37Rv
cuccccguccugccag

SEQ ID NO: 3253408 - RNA, 17 nt, Mycobacterium tuberculosis H37Rv
cucccgaaaagcgccuc

SEQ ID NO: 3253409 - RNA, 14 nt, Mycobacterium tuberculosis H37Rv
cucccgaccgccga

SEQ ID NO: 3253410 - RNA, 13 nt, Mycobacterium tuberculosis H37Rv
cucccgagccaca

SEQ ID NO: 3253411 - RNA, 15 nt, Mycobacterium tuberculosis H37Rv
cucccgagccacaaa

SEQ ID NO: 3253412 - RNA, 21 nt, Mycobacterium tuberculosis H37Rv
cucccgcaaugcgagcgcgcc

SEQ ID NO: 3253413 - RNA, 16 nt, Mycobacterium tuberculosis H37Rv
cucccgccacugcugg

SEQ ID NO: 3253414 - RNA, 18 nt, Mycobacterium tuberculosis H37Rv
cucccgccggcagcgucg

SEQ ID NO: 3253415 - RNA, 19 nt, Mycobacterium tuberculosis H37Rv
cucccgcgaucgcgacacg

SEQ ID NO: 3253416 - RNA, 13 nt, Mycobacterium tuberculosis H37Rv
cucccgcgccggc

SEQ ID NO: 3253417 - RNA, 14 nt, Mycobacterium tuberculosis H37Rv
cucccgcgccggcg

SEQ ID NO: 3253418 - RNA, 14 nt, Mycobacterium tuberculosis H37Rv
cucccgcgcgggcg

SEQ ID NO: 3253419 - RNA, 20 nt, Mycobacterium tuberculosis H37Rv
cucccgcgcuuggcuccaca

SEQ ID NO: 3253420 - RNA, 21 nt, Mycobacterium tuberculosis H37Rv
cucccgcggcgccacccgcgc

SEQ ID NO: 3253421 - RNA, 14 nt, Mycobacterium tuberculosis H37Rv
cucccggccgcacc

SEQ ID NO: 3253422 - RNA, 18 nt, Mycobacterium tuberculosis H37Rv
cucccgggcgagccgugc

SEQ ID NO: 3253423 - RNA, 19 nt, Mycobacterium tuberculosis H37Rv
cucccgguugggguggcgg

SEQ ID NO: 3253424 - RNA, 22 nt, Mycobacterium tuberculosis H37Rv
cucccgguugggguggcggugc

SEQ ID NO: 3253425 - RNA, 13 nt, Mycobacterium tuberculosis H37Rv
cucccguacgccg

SEQ ID NO: 3253426 - RNA, 13 nt, Mycobacterium tuberculosis H37Rv
cucccgugcuggc

SEQ ID NO: 3253427 - RNA, 23 nt, Mycobacterium tuberculosis H37Rv
cucccguuuggcugucugcccgc

SEQ ID NO: 3253428 - RNA, 21 nt, Mycobacterium tuberculosis H37Rv
cucccucgaucacggcggccc

SEQ ID NO: 3253429 - RNA, 17 nt, Mycobacterium tuberculosis H37Rv
cucccucuacacccgga

SEQ ID NO: 3253430 - RNA, 18 nt, Mycobacterium tuberculosis H37Rv
cucccucuagcgcccgaa

SEQ ID NO: 3253431 - RNA, 22 nt, Mycobacterium tuberculosis H37Rv
cucccuggcccccgguaccgcc

SEQ ID NO: 3253432 - RNA, 12 nt, Mycobacterium tuberculosis H37Rv
cucccugggcgu

SEQ ID NO: 3253433 - RNA, 18 nt, Mycobacterium tuberculosis H37Rv
cuccgaaucugccggccg

SEQ ID NO: 3253434 - RNA, 14 nt, Mycobacterium tuberculosis H37Rv
cuccgacggccgcg

SEQ ID NO: 3253435 - RNA, 14 nt, Mycobacterium tuberculosis H37Rv
cuccgacgggcgaa

SEQ ID NO: 3253436 - RNA, 20 nt, Mycobacterium tuberculosis H37Rv
cuccgacgggggucgggcgu

SEQ ID NO: 3253437 - RNA, 22 nt, Mycobacterium tuberculosis H37Rv
cuccgacucgauauaacccggc

SEQ ID NO: 3253438 - RNA, 23 nt, Mycobacterium tuberculosis H37Rv
cuccgaugaccagggucugcuca

SEQ ID NO: 3253439 - RNA, 23 nt, Mycobacterium tuberculosis H37Rv
cuccgaugugccgauuggccugc

SEQ ID NO: 3253440 - RNA, 18 nt, Mycobacterium tuberculosis H37Rv
cuccgauuccgaacuggu

SEQ ID NO: 3253441 - RNA, 12 nt, Mycobacterium tuberculosis H37Rv
cuccgcagcuau

SEQ ID NO: 3253442 - RNA, 16 nt, Mycobacterium tuberculosis H37Rv
cuccgccaaggaggcc

SEQ ID NO: 3253443 - RNA, 13 nt, Mycobacterium tuberculosis H37Rv
cuccgccaccauc

SEQ ID NO: 3253444 - RNA, 20 nt, Mycobacterium tuberculosis H37Rv
cuccgccagaauugccggcg

SEQ ID NO: 3253445 - RNA, 16 nt, Mycobacterium tuberculosis H37Rv
cuccgccagcgccgcc

SEQ ID NO: 3253446 - RNA, 21 nt, Mycobacterium tuberculosis H37Rv
cuccgccgagcagacgcagaa

SEQ ID NO: 3253447 - RNA, 17 nt, Mycobacterium tuberculosis H37Rv
cuccgccgaggaaacca

SEQ ID NO: 3253448 - RNA, 21 nt, Mycobacterium tuberculosis H37Rv
cuccgccgcgaucuccuuggc

SEQ ID NO: 3253449 - RNA, 12 nt, Mycobacterium tuberculosis H37Rv
cuccgccggcac

SEQ ID NO: 3253450 - RNA, 12 nt, Mycobacterium tuberculosis H37Rv
cuccgccgguca

SEQ ID NO: 3253451 - RNA, 21 nt, Mycobacterium tuberculosis H37Rv
cuccgccggucccgcgugcca

SEQ ID NO: 3253452 - RNA, 16 nt, Mycobacterium tuberculosis H37Rv
cuccgccgucgccacc

SEQ ID NO: 3253453 - RNA, 15 nt, Mycobacterium tuberculosis H37Rv
cuccgccgucgccgc

SEQ ID NO: 3253454 - RNA, 19 nt, Mycobacterium tuberculosis H37Rv
cuccgccguugacgccguu

SEQ ID NO: 3253455 - RNA, 14 nt, Mycobacterium tuberculosis H37Rv
cuccgccugccgcu

SEQ ID NO: 3253456 - RNA, 15 nt, Mycobacterium tuberculosis H37Rv
cuccgcgaucaccga

SEQ ID NO: 3253457 - RNA, 20 nt, Mycobacterium tuberculosis H37Rv
cuccgcggcgaaccagcgcg

SEQ ID NO: 3253458 - RNA, 15 nt, Mycobacterium tuberculosis H37Rv
cuccgcggcgcagca

SEQ ID NO: 3253459 - RNA, 19 nt, Mycobacterium tuberculosis H37Rv
cuccgcggcgcagcacggc

SEQ ID NO: 3253460 - RNA, 16 nt, Mycobacterium tuberculosis H37Rv
cucgaccagacgcugc

SEQ ID NO: 3253461 - RNA, 20 nt, Mycobacterium tuberculosis H37Rv
cucgaccaggaacggcucgg

SEQ ID NO: 3253462 - RNA, 16 nt, Mycobacterium tuberculosis H37Rv
cucgaccaggaccggc

SEQ ID NO: 3253463 - RNA, 20 nt, Mycobacterium tuberculosis H37Rv
cucgacccggcgcagcaacg

SEQ ID NO: 3253464 - RNA, 22 nt, Mycobacterium tuberculosis H37Rv
cucgaccgccagcccggugaug

SEQ ID NO: 3253465 - RNA, 22 nt, Mycobacterium tuberculosis H37Rv
cucgaccgcgagcaugaugucc

SEQ ID NO: 3253466 - RNA, 12 nt, Mycobacterium tuberculosis H37Rv
cucgaccgcguc

SEQ ID NO: 3253467 - RNA, 16 nt, Mycobacterium tuberculosis H37Rv
cucgaccgucaccgga

SEQ ID NO: 3253468 - RNA, 17 nt, Mycobacterium tuberculosis H37Rv
cucgaccgucaccggaa

SEQ ID NO: 3253469 - RNA, 17 nt, Mycobacterium tuberculosis H37Rv
cucgaccucagacagcu

SEQ ID NO: 3253470 - RNA, 17 nt, Mycobacterium tuberculosis H37Rv
cucgaccugacugguca

SEQ ID NO: 3253471 - RNA, 16 nt, Mycobacterium tuberculosis H37Rv
cucgaccugaggcacc

SEQ ID NO: 3253472 - RNA, 16 nt, Mycobacterium tuberculosis H37Rv
cucgacgaauaccggg

SEQ ID NO: 3253473 - RNA, 16 nt, Mycobacterium tuberculosis H37Rv
cucgacgacgggcgcc

SEQ ID NO: 3253474 - RNA, 20 nt, Mycobacterium tuberculosis H37Rv
cucgacgaggagccucgacc

SEQ ID NO: 3253475 - RNA, 16 nt, Mycobacterium tuberculosis H37Rv
cucgacgaggccacgg

SEQ ID NO: 3253476 - RNA, 15 nt, Mycobacterium tuberculosis H37Rv
cucgacgaucagcac

SEQ ID NO: 3253477 - RNA, 18 nt, Mycobacterium tuberculosis H37Rv
cucgacgaucugcagcac

SEQ ID NO: 3253478 - RNA, 19 nt, Mycobacterium tuberculosis H37Rv
cucgacgaucugcagcacu

SEQ ID NO: 3253479 - RNA, 14 nt, Mycobacterium tuberculosis H37Rv
cucgacgcccgcca

SEQ ID NO: 3253480 - RNA, 16 nt, Mycobacterium tuberculosis H37Rv
cucgacggcccgccgu

SEQ ID NO: 3253481 - RNA, 18 nt, Mycobacterium tuberculosis H37Rv
cucgacggcccgccgucc

SEQ ID NO: 3253482 - RNA, 12 nt, Mycobacterium tuberculosis H37Rv
cucgacggcucc

SEQ ID NO: 3253483 - RNA, 14 nt, Mycobacterium tuberculosis H37Rv
cucgacggucaucg

SEQ ID NO: 3253484 - RNA, 16 nt, Mycobacterium tuberculosis H37Rv
cucgacguacagcgcg

SEQ ID NO: 3253485 - RNA, 17 nt, Mycobacterium tuberculosis H37Rv
cucgacguaggccaggu

SEQ ID NO: 3253486 - RNA, 17 nt, Mycobacterium tuberculosis H37Rv
cucgacgucgagcacgu

SEQ ID NO: 3253487 - RNA, 18 nt, Mycobacterium tuberculosis H37Rv
cucgacgucgucgucgac

SEQ ID NO: 3253488 - RNA, 20 nt, Mycobacterium tuberculosis H37Rv
cucgacgucgucgucgacgg

SEQ ID NO: 3253489 - RNA, 18 nt, Mycobacterium tuberculosis H37Rv
cucgagacggucgaucac

SEQ ID NO: 3253490 - RNA, 15 nt, Mycobacterium tuberculosis H37Rv
cucgagaguggccuc

SEQ ID NO: 3253491 - RNA, 17 nt, Mycobacterium tuberculosis H37Rv
cucgagcaagaucaccu

SEQ ID NO: 3253492 - RNA, 20 nt, Mycobacterium tuberculosis H37Rv
cucgagcaagaucaccuucg

SEQ ID NO: 3253493 - RNA, 11 nt, Mycobacterium tuberculosis H37Rv
cucgagcagga

SEQ ID NO: 3253494 - RNA, 20 nt, Mycobacterium tuberculosis H37Rv
cucgagcaggcgcaccaggc

SEQ ID NO: 3253495 - RNA, 15 nt, Mycobacterium tuberculosis H37Rv
cucgagcaugcccag

SEQ ID NO: 3253496 - RNA, 16 nt, Mycobacterium tuberculosis H37Rv
cucgagcaugcccagc

SEQ ID NO: 3253497 - RNA, 21 nt, Mycobacterium tuberculosis H37Rv
cucgagcccucguuaucgacc

SEQ ID NO: 3253498 - RNA, 13 nt, Mycobacterium tuberculosis H37Rv
cucgagcugcugg

SEQ ID NO: 3253499 - RNA, 19 nt, Mycobacterium tuberculosis H37Rv
cucgagcugcuggcgcgcc

SEQ ID NO: 3253500 - RNA, 16 nt, Mycobacterium tuberculosis H37Rv
cucgagcuugccgucg

SEQ ID NO: 3253501 - RNA, 14 nt, Mycobacterium tuberculosis H37Rv
cucgaggaccugcu

SEQ ID NO: 3253502 - RNA, 20 nt, Mycobacterium tuberculosis H37Rv
cucgaggucgagcgccgcgg

SEQ ID NO: 3253503 - RNA, 18 nt, Mycobacterium tuberculosis H37Rv
cucgagguguagcccucc

SEQ ID NO: 3253504 - RNA, 14 nt, Mycobacterium tuberculosis H37Rv
cucgaguaucucgg

SEQ ID NO: 3253505 - RNA, 20 nt, Mycobacterium tuberculosis H37Rv
cucgaguccguacuugccac

SEQ ID NO: 3253506 - RNA, 14 nt, Mycobacterium tuberculosis H37Rv
cucgagucgcagca

SEQ ID NO: 3253507 - RNA, 16 nt, Mycobacterium tuberculosis H37Rv
cucgagucgcagcacg

SEQ ID NO: 3253508 - RNA, 21 nt, Mycobacterium tuberculosis H37Rv
cucgaguggaucauguucggc

SEQ ID NO: 3253509 - RNA, 20 nt, Mycobacterium tuberculosis H37Rv
cucgaguucgaccggcggga

SEQ ID NO: 3253510 - RNA, 16 nt, Mycobacterium tuberculosis H37Rv
cucgaguugcucgaca

SEQ ID NO: 3253511 - RNA, 23 nt, Mycobacterium tuberculosis H37Rv
cucgauaucguuggcgaccaccg

SEQ ID NO: 3253512 - RNA, 16 nt, Mycobacterium tuberculosis H37Rv
cucgaucacggcggcc

SEQ ID NO: 3253513 - RNA, 19 nt, Mycobacterium tuberculosis H37Rv
cucgaucacggcggccccg

SEQ ID NO: 3253514 - RNA, 16 nt, Mycobacterium tuberculosis H37Rv
cucgaucagcgccgga

SEQ ID NO: 3253515 - RNA, 24 nt, Mycobacterium tuberculosis H37Rv
cucgaucagguuggugcucagcgg

SEQ ID NO: 3253516 - RNA, 23 nt, Mycobacterium tuberculosis H37Rv
cucgaucaucaugucggcgcagg

SEQ ID NO: 3253517 - RNA, 15 nt, Mycobacterium tuberculosis H37Rv
cucgauccacugccg

SEQ ID NO: 3253518 - RNA, 24 nt, Mycobacterium tuberculosis H37Rv
cucgauccacugccgcgcgcccgc

SEQ ID NO: 3253519 - RNA, 14 nt, Mycobacterium tuberculosis H37Rv
cucgaucgccugag

SEQ ID NO: 3253520 - RNA, 22 nt, Mycobacterium tuberculosis H37Rv
cucgaucgccugagacucgcuc

SEQ ID NO: 3253521 - RNA, 17 nt, Mycobacterium tuberculosis H37Rv
cucgaucgcguucugca

SEQ ID NO: 3253522 - RNA, 15 nt, Mycobacterium tuberculosis H37Rv
cucgaucggcagcca

SEQ ID NO: 3253523 - RNA, 12 nt, Mycobacterium tuberculosis H37Rv
cucgaucgucga

SEQ ID NO: 3253524 - RNA, 13 nt, Mycobacterium tuberculosis H37Rv
cucgaucgucgac

SEQ ID NO: 3253525 - RNA, 17 nt, Mycobacterium tuberculosis H37Rv
cucgaucuugggccacg

SEQ ID NO: 3253526 - RNA, 23 nt, Mycobacterium tuberculosis H37Rv
cucgaugaugucgagcacaccgu

SEQ ID NO: 3253527 - RNA, 18 nt, Mycobacterium tuberculosis H37Rv
cucgauggaccgccaggg

SEQ ID NO: 3253528 - RNA, 23 nt, Mycobacterium tuberculosis H37Rv
cucgauggauccaaccgugcucu

SEQ ID NO: 3253529 - RNA, 13 nt, Mycobacterium tuberculosis H37Rv
cucgauggccagg

SEQ ID NO: 3253530 - RNA, 16 nt, Mycobacterium tuberculosis H37Rv
cucgauggcggccacc

SEQ ID NO: 3253531 - RNA, 17 nt, Mycobacterium tuberculosis H37Rv
cucgauggcggccacca

SEQ ID NO: 3253532 - RNA, 19 nt, Mycobacterium tuberculosis H37Rv
cucgauggcggccaccagc

SEQ ID NO: 3253533 - RNA, 20 nt, Mycobacterium tuberculosis H37Rv
cucgauggcguagggcuguc

SEQ ID NO: 3253534 - RNA, 23 nt, Mycobacterium tuberculosis H37Rv
cucgauggucauccagccagcaa

SEQ ID NO: 3253535 - RNA, 16 nt, Mycobacterium tuberculosis H37Rv
cucgaugucagcggcc

SEQ ID NO: 3253536 - RNA, 17 nt, Mycobacterium tuberculosis H37Rv
cucgaugucagcggccg

SEQ ID NO: 3253537 - RNA, 17 nt, Mycobacterium tuberculosis H37Rv
cucgaugucgcggucgc

SEQ ID NO: 3253538 - RNA, 22 nt, Mycobacterium tuberculosis H37Rv
cucgauucccggcgcgguggcc

SEQ ID NO: 3253539 - RNA, 16 nt, Mycobacterium tuberculosis H37Rv
cucgauuguggccagc

SEQ ID NO: 3253540 - RNA, 16 nt, Mycobacterium tuberculosis H37Rv
cucgcacagcaccacg

SEQ ID NO: 3253541 - RNA, 14 nt, Mycobacterium tuberculosis H37Rv
cucgcaccaccacg

SEQ ID NO: 3253542 - RNA, 17 nt, Mycobacterium tuberculosis H37Rv
cucgcacccgcucggcg

SEQ ID NO: 3253543 - RNA, 15 nt, Mycobacterium tuberculosis H37Rv
cucgcacucguugcc

SEQ ID NO: 3253544 - RNA, 13 nt, Mycobacterium tuberculosis H37Rv
cucgcagccacgc

SEQ ID NO: 3253545 - RNA, 18 nt, Mycobacterium tuberculosis H37Rv
cucgcaggcgcagauucc

SEQ ID NO: 3253546 - RNA, 23 nt, Mycobacterium tuberculosis H37Rv
cucgcaguucaucgggcaccaac

SEQ ID NO: 3253547 - RNA, 21 nt, Mycobacterium tuberculosis H37Rv
cucgcauaugccgccggcagc

SEQ ID NO: 3253548 - RNA, 19 nt, Mycobacterium tuberculosis H37Rv
cucgcauguucuccacgcc

SEQ ID NO: 3253549 - RNA, 20 nt, Mycobacterium tuberculosis H37Rv
cucgccacacucccgcgccc

SEQ ID NO: 3253550 - RNA, 18 nt, Mycobacterium tuberculosis H37Rv
cucgccacauuucaccac

SEQ ID NO: 3253551 - RNA, 11 nt, Mycobacterium tuberculosis H37Rv
cucgccagagu

SEQ ID NO: 3253552 - RNA, 16 nt, Mycobacterium tuberculosis H37Rv
cucgccaggcaagcca

SEQ ID NO: 3253553 - RNA, 19 nt, Mycobacterium tuberculosis H37Rv
cucgccaggcaagccagca

SEQ ID NO: 3253554 - RNA, 18 nt, Mycobacterium tuberculosis H37Rv
cucgccagggucgcgagc

SEQ ID NO: 3253555 - RNA, 14 nt, Mycobacterium tuberculosis H37Rv
cucgcccaagcgca

SEQ ID NO: 3253556 - RNA, 15 nt, Mycobacterium tuberculosis H37Rv
cucggaucgccaggc

SEQ ID NO: 3253557 - RNA, 16 nt, Mycobacterium tuberculosis H37Rv
cucggaucgccaggcc

SEQ ID NO: 3253558 - RNA, 21 nt, Mycobacterium tuberculosis H37Rv
cucggcaaccugcgaccaggc

SEQ ID NO: 3253559 - RNA, 12 nt, Mycobacterium tuberculosis H37Rv
cucggcaccaca

SEQ ID NO: 3253560 - RNA, 22 nt, Mycobacterium tuberculosis H37Rv
cucggcacggucgcccgaucgg

SEQ ID NO: 3253561 - RNA, 18 nt, Mycobacterium tuberculosis H37Rv
cucggcaggaaggacauc

SEQ ID NO: 3253562 - RNA, 19 nt, Mycobacterium tuberculosis H37Rv
cucggcaggaaggacaucg

SEQ ID NO: 3253563 - RNA, 11 nt, Mycobacterium tuberculosis H37Rv
cucggcaggcc

SEQ ID NO: 3253564 - RNA, 22 nt, Mycobacterium tuberculosis H37Rv
cucggcaggcccggaggguucg

SEQ ID NO: 3253565 - RNA, 15 nt, Mycobacterium tuberculosis H37Rv
cucggcauccaggcu

SEQ ID NO: 3253566 - RNA, 22 nt, Mycobacterium tuberculosis H37Rv
cucggcaugagucgaaccaggu

SEQ ID NO: 3253567 - RNA, 16 nt, Mycobacterium tuberculosis H37Rv
cucggcaugcucgaca

SEQ ID NO: 3253568 - RNA, 12 nt, Mycobacterium tuberculosis H37Rv
cucggccacgaa

SEQ ID NO: 3253569 - RNA, 13 nt, Mycobacterium tuberculosis H37Rv
cucggccagcacg

SEQ ID NO: 3253570 - RNA, 13 nt, Mycobacterium tuberculosis H37Rv
cucggccagccag

SEQ ID NO: 3253571 - RNA, 22 nt, Mycobacterium tuberculosis H37Rv
cucggccagcgauucacgggug

SEQ ID NO: 3253572 - RNA, 20 nt, Mycobacterium tuberculosis H37Rv
cucggccagcgucagcuguu

SEQ ID NO: 3253573 - RNA, 13 nt, Mycobacterium tuberculosis H37Rv
cucggccaggaug

SEQ ID NO: 3253574 - RNA, 17 nt, Mycobacterium tuberculosis H37Rv
cucggccaucagaaccu

SEQ ID NO: 3253575 - RNA, 18 nt, Mycobacterium tuberculosis H37Rv
cucggcccggcaggacuu

SEQ ID NO: 3253576 - RNA, 14 nt, Mycobacterium tuberculosis H37Rv
cucggcccggguga

SEQ ID NO: 3253577 - RNA, 18 nt, Mycobacterium tuberculosis H37Rv
cucggccgaggaccagag

SEQ ID NO: 3253578 - RNA, 13 nt, Mycobacterium tuberculosis H37Rv
cucggccgccagc

SEQ ID NO: 3253579 - RNA, 20 nt, Mycobacterium tuberculosis H37Rv
cucggccgccagccccaccc

SEQ ID NO: 3253580 - RNA, 14 nt, Mycobacterium tuberculosis H37Rv
cucggccgugaccg

SEQ ID NO: 3253581 - RNA, 17 nt, Mycobacterium tuberculosis H37Rv
cucggccgugaccgagc

SEQ ID NO: 3253582 - RNA, 13 nt, Mycobacterium tuberculosis H37Rv
cucggccugguca

SEQ ID NO: 3253583 - RNA, 16 nt, Mycobacterium tuberculosis H37Rv
cucggccuguucggcg

SEQ ID NO: 3253584 - RNA, 13 nt, Mycobacterium tuberculosis H37Rv
cucggcgaccgac

SEQ ID NO: 3253585 - RNA, 21 nt, Mycobacterium tuberculosis H37Rv
cucggcgaccugccggaccgc

SEQ ID NO: 3253586 - RNA, 18 nt, Mycobacterium tuberculosis H37Rv
cucggcgaccugcucgcu

SEQ ID NO: 3253587 - RNA, 14 nt, Mycobacterium tuberculosis H37Rv
cucggcgaccuggc

SEQ ID NO: 3253588 - RNA, 22 nt, Mycobacterium tuberculosis H37Rv
cucggcgacugcgucggcggcu

SEQ ID NO: 3253589 - RNA, 22 nt, Mycobacterium tuberculosis H37Rv
cucggcgagcaacacgagcgca

SEQ ID NO: 3253590 - RNA, 16 nt, Mycobacterium tuberculosis H37Rv
cucggcgagcaccacc

SEQ ID NO: 3253591 - RNA, 19 nt, Mycobacterium tuberculosis H37Rv
cucggcgagcaccacccca

SEQ ID NO: 3253592 - RNA, 21 nt, Mycobacterium tuberculosis H37Rv
cucggcgagcaccaccccagc

SEQ ID NO: 3253593 - RNA, 23 nt, Mycobacterium tuberculosis H37Rv
cucggcgagcaccaccccagcgg

SEQ ID NO: 3253594 - RNA, 15 nt, Mycobacterium tuberculosis H37Rv
cucggcgagcaccgu

SEQ ID NO: 3253595 - RNA, 15 nt, Mycobacterium tuberculosis H37Rv
cucggcgagcacguc

SEQ ID NO: 3253596 - RNA, 13 nt, Mycobacterium tuberculosis H37Rv
cucggcgagccgc

SEQ ID NO: 3253597 - RNA, 14 nt, Mycobacterium tuberculosis H37Rv
cucggcgagcucag

SEQ ID NO: 3253598 - RNA, 17 nt, Mycobacterium tuberculosis H37Rv
cucggcgagcucaguga

SEQ ID NO: 3253599 - RNA, 22 nt, Mycobacterium tuberculosis H37Rv
cucggcgaggaacuggaccggu

SEQ ID NO: 3253600 - RNA, 16 nt, Mycobacterium tuberculosis H37Rv
cucggcgaggucagag

SEQ ID NO: 3253601 - RNA, 20 nt, Mycobacterium tuberculosis H37Rv
cucggcgaguucggcagcgg

SEQ ID NO: 3253602 - RNA, 16 nt, Mycobacterium tuberculosis H37Rv
cucggcgaucaagccu

SEQ ID NO: 3253603 - RNA, 17 nt, Mycobacterium tuberculosis H37Rv
cucggcgaucucgucgc

SEQ ID NO: 3253604 - RNA, 14 nt, Mycobacterium tuberculosis H37Rv
cucggcgaugcuga

SEQ ID NO: 3253605 - RNA, 22 nt, Mycobacterium tuberculosis H37Rv
cucggcgcagcacauccugcag

SEQ ID NO: 3253606 - RNA, 21 nt, Mycobacterium tuberculosis H37Rv
cucggcgccacggugucgcga

SEQ ID NO: 3253607 - RNA, 18 nt, Mycobacterium tuberculosis H37Rv
cucggcgcccagcucguc

SEQ ID NO: 3253608 - RNA, 13 nt, Mycobacterium tuberculosis H37Rv
cucggcgccgaac

SEQ ID NO: 3253609 - RNA, 22 nt, Mycobacterium tuberculosis H37Rv
cucggcgccgucggagccggcc

SEQ ID NO: 3253610 - RNA, 17 nt, Mycobacterium tuberculosis H37Rv
cucggcgccguuuggcc

SEQ ID NO: 3253611 - RNA, 18 nt, Mycobacterium tuberculosis H37Rv
cucggcgcgcgacgagca

SEQ ID NO: 3253612 - RNA, 17 nt, Mycobacterium tuberculosis H37Rv
cucggcgcugcgcaccg

SEQ ID NO: 3253613 - RNA, 19 nt, Mycobacterium tuberculosis H37Rv
cucggcgcugcgcaccgcc

SEQ ID NO: 3253614 - RNA, 14 nt, Mycobacterium tuberculosis H37Rv
cucggcggaagacc

SEQ ID NO: 3253615 - RNA, 15 nt, Mycobacterium tuberculosis H37Rv
cucggcggagaaaag

SEQ ID NO: 3253616 - RNA, 14 nt, Mycobacterium tuberculosis H37Rv
cucggcggccacca

SEQ ID NO: 3253617 - RNA, 21 nt, Mycobacterium tuberculosis H37Rv
cucggcggccaccucgaaugc

SEQ ID NO: 3253618 - RNA, 15 nt, Mycobacterium tuberculosis H37Rv
cucggcggccagcgc

SEQ ID NO: 3253619 - RNA, 14 nt, Mycobacterium tuberculosis H37Rv
cucggcggccagcu

SEQ ID NO: 3253620 - RNA, 17 nt, Mycobacterium tuberculosis H37Rv
cucggcggccagcuccc

SEQ ID NO: 3253621 - RNA, 19 nt, Mycobacterium tuberculosis H37Rv
cucggcggccagcucggcc

SEQ ID NO: 3253622 - RNA, 14 nt, Mycobacterium tuberculosis H37Rv
cucggcggcccggc

SEQ ID NO: 3253623 - RNA, 19 nt, Mycobacterium tuberculosis H37Rv
cucggcggcccggccgaac

SEQ ID NO: 3253624 - RNA, 17 nt, Mycobacterium tuberculosis H37Rv
cucggcggccgcgugcu

SEQ ID NO: 3253625 - RNA, 21 nt, Mycobacterium tuberculosis H37Rv
cucggcggccucgcugcucag

SEQ ID NO: 3253626 - RNA, 21 nt, Mycobacterium tuberculosis H37Rv
cucggcggccuuaggugacca

SEQ ID NO: 3253627 - RNA, 20 nt, Mycobacterium tuberculosis H37Rv
cucggcggcgcggucgaagc

SEQ ID NO: 3253628 - RNA, 21 nt, Mycobacterium tuberculosis H37Rv
cucggcggcggcacgcugacc

SEQ ID NO: 3253629 - RNA, 16 nt, Mycobacterium tuberculosis H37Rv
cucggcgggauccucg

SEQ ID NO: 3253630 - RNA, 17 nt, Mycobacterium tuberculosis H37Rv
cucggcgguaaaugccu

SEQ ID NO: 3253631 - RNA, 21 nt, Mycobacterium tuberculosis H37Rv
cucggcgguaaaugccugccc

SEQ ID NO: 3253632 - RNA, 24 nt, Mycobacterium tuberculosis H37Rv
cucggcgguaaaugccugcccacc

SEQ ID NO: 3253633 - RNA, 17 nt, Mycobacterium tuberculosis H37Rv
cucggcggucgggagau

SEQ ID NO: 3253634 - RNA, 21 nt, Mycobacterium tuberculosis H37Rv
cucggcgguggcggugcugcu

SEQ ID NO: 3253635 - RNA, 20 nt, Mycobacterium tuberculosis H37Rv
cucggcguacucgugcaccg

SEQ ID NO: 3253636 - RNA, 18 nt, Mycobacterium tuberculosis H37Rv
cucggcguccgcccagca

SEQ ID NO: 3253637 - RNA, 18 nt, Mycobacterium tuberculosis H37Rv
cucggcgucgaguucggu

SEQ ID NO: 3253638 - RNA, 19 nt, Mycobacterium tuberculosis H37Rv
cucggcguguccgccgaac

SEQ ID NO: 3253639 - RNA, 14 nt, Mycobacterium tuberculosis H37Rv
cucggcguugauga

SEQ ID NO: 3253640 - RNA, 19 nt, Mycobacterium tuberculosis H37Rv
cucggcguuuucggugagc

SEQ ID NO: 3253641 - RNA, 20 nt, Mycobacterium tuberculosis H37Rv
cucggcuagguagucgacga

SEQ ID NO: 3253642 - RNA, 15 nt, Mycobacterium tuberculosis H37Rv
cucggcugcucgacg

SEQ ID NO: 3253643 - RNA, 19 nt, Mycobacterium tuberculosis H37Rv
cucggcuuggccggcggua

SEQ ID NO: 3253644 - RNA, 17 nt, Mycobacterium tuberculosis H37Rv
cucggcuuugccgcugu

SEQ ID NO: 3253645 - RNA, 19 nt, Mycobacterium tuberculosis H37Rv
cucgggacucccgcgcggg

SEQ ID NO: 3253646 - RNA, 18 nt, Mycobacterium tuberculosis H37Rv
cucgggacugcgcggcuu

SEQ ID NO: 3253647 - RNA, 19 nt, Mycobacterium tuberculosis H37Rv
cucgggcaacgccucgagc

SEQ ID NO: 3253648 - RNA, 22 nt, Mycobacterium tuberculosis H37Rv
cucgggcaccuggucggccgca

SEQ ID NO: 3253649 - RNA, 22 nt, Mycobacterium tuberculosis H37Rv
cucgggcagcgcggccagugcu

SEQ ID NO: 3253650 - RNA, 16 nt, Mycobacterium tuberculosis H37Rv
cucgggcagcgucacc

SEQ ID NO: 3253651 - RNA, 16 nt, Mycobacterium tuberculosis H37Rv
cucgggcaggccccac

SEQ ID NO: 3253652 - RNA, 15 nt, Mycobacterium tuberculosis H37Rv
cucgucguccggcca

SEQ ID NO: 3253653 - RNA, 19 nt, Mycobacterium tuberculosis H37Rv
cucgucguccggccacggu

SEQ ID NO: 3253654 - RNA, 19 nt, Mycobacterium tuberculosis H37Rv
cucgucgucgauccagccc

SEQ ID NO: 3253655 - RNA, 20 nt, Mycobacterium tuberculosis H37Rv
cucgucgucgauccagccca

SEQ ID NO: 3253656 - RNA, 21 nt, Mycobacterium tuberculosis H37Rv
cucgugacagcggcgaucucu

SEQ ID NO: 3253657 - RNA, 18 nt, Mycobacterium tuberculosis H37Rv
cucgugagccccagcgac

SEQ ID NO: 3253658 - RNA, 17 nt, Mycobacterium tuberculosis H37Rv
cucgugaucuucggcga

SEQ ID NO: 3253659 - RNA, 20 nt, Mycobacterium tuberculosis H37Rv
cucgugaucuucggcgaucg

SEQ ID NO: 3253660 - RNA, 21 nt, Mycobacterium tuberculosis H37Rv
cucgugcacgcacagcccgau

SEQ ID NO: 3253661 - RNA, 14 nt, Mycobacterium tuberculosis H37Rv
cucgugcacgcuga

SEQ ID NO: 3253662 - RNA, 18 nt, Mycobacterium tuberculosis H37Rv
cucgugcacgcugagccg

SEQ ID NO: 3253663 - RNA, 18 nt, Mycobacterium tuberculosis H37Rv
cucgugcaggaccagcac

SEQ ID NO: 3253664 - RNA, 22 nt, Mycobacterium tuberculosis H37Rv
cucgugcaggaccagcaccgcc

SEQ ID NO: 3253665 - RNA, 23 nt, Mycobacterium tuberculosis H37Rv
cucgugcgugggcgcggcgccag

SEQ ID NO: 3253666 - RNA, 16 nt, Mycobacterium tuberculosis H37Rv
cucguggaucugccuc

SEQ ID NO: 3253667 - RNA, 16 nt, Mycobacterium tuberculosis H37Rv
cucguggauggccgcc

SEQ ID NO: 3253668 - RNA, 14 nt, Mycobacterium tuberculosis H37Rv
cucgugggcgacga

SEQ ID NO: 3253669 - RNA, 18 nt, Mycobacterium tuberculosis H37Rv
cucguguaccggagcggu

SEQ ID NO: 3253670 - RNA, 23 nt, Mycobacterium tuberculosis H37Rv
cucguguaggagcuggcugacga

SEQ ID NO: 3253671 - RNA, 19 nt, Mycobacterium tuberculosis H37Rv
cucguguccggggaccucg

SEQ ID NO: 3253672 - RNA, 22 nt, Mycobacterium tuberculosis H37Rv
cucguguccggggaccucggcg

SEQ ID NO: 3253673 - RNA, 19 nt, Mycobacterium tuberculosis H37Rv
cucguguuguugaagcccg

SEQ ID NO: 3253674 - RNA, 20 nt, Mycobacterium tuberculosis H37Rv
cucguguuguugaagcccga

SEQ ID NO: 3253675 - RNA, 24 nt, Mycobacterium tuberculosis H37Rv
cucguucagcgucgacugaacggu

SEQ ID NO: 3253676 - RNA, 23 nt, Mycobacterium tuberculosis H37Rv
cucguugaccgggucgccgauga

SEQ ID NO: 3253677 - RNA, 22 nt, Mycobacterium tuberculosis H37Rv
cucguugagcagcuggaccacc

SEQ ID NO: 3253678 - RNA, 20 nt, Mycobacterium tuberculosis H37Rv
cucguugaugaaggucagca

SEQ ID NO: 3253679 - RNA, 15 nt, Mycobacterium tuberculosis H37Rv
cucguugccgaccau

SEQ ID NO: 3253680 - RNA, 22 nt, Mycobacterium tuberculosis H37Rv
cucguugcguugcaucagcacg

SEQ ID NO: 3253681 - RNA, 20 nt, Mycobacterium tuberculosis H37Rv
cucguugcuggcggccagca

SEQ ID NO: 3253682 - RNA, 17 nt, Mycobacterium tuberculosis H37Rv
cucuacacccggacugc

SEQ ID NO: 3253683 - RNA, 17 nt, Mycobacterium tuberculosis H37Rv
cucuaccagccgccccg

SEQ ID NO: 3253684 - RNA, 15 nt, Mycobacterium tuberculosis H37Rv
cucuacucgcggccg

SEQ ID NO: 3253685 - RNA, 18 nt, Mycobacterium tuberculosis H37Rv
cucuagauauggaccgcc

SEQ ID NO: 3253686 - RNA, 15 nt, Mycobacterium tuberculosis H37Rv
cucuagcaaagccag

SEQ ID NO: 3253687 - RNA, 17 nt, Mycobacterium tuberculosis H37Rv
cucuagcucgaacaggu

SEQ ID NO: 3253688 - RNA, 20 nt, Mycobacterium tuberculosis H37Rv
cucuaucagacgauucggcg

SEQ ID NO: 3253689 - RNA, 14 nt, Mycobacterium tuberculosis H37Rv
cucuaugcgggcag

SEQ ID NO: 3253690 - RNA, 16 nt, Mycobacterium tuberculosis H37Rv
cucucacggcgguagc

SEQ ID NO: 3253691 - RNA, 14 nt, Mycobacterium tuberculosis H37Rv
cucuccggcauccu

SEQ ID NO: 3253692 - RNA, 19 nt, Mycobacterium tuberculosis H37Rv
cucuccguccucgucccag

SEQ ID NO: 3253693 - RNA, 18 nt, Mycobacterium tuberculosis H37Rv
cucuccuggaaaggacgg

SEQ ID NO: 3253694 - RNA, 23 nt, Mycobacterium tuberculosis H37Rv
cucuccuggaaaggacggccggc

SEQ ID NO: 3253695 - RNA, 14 nt, Mycobacterium tuberculosis H37Rv
cucucgcucgugca

SEQ ID NO: 3253696 - RNA, 16 nt, Mycobacterium tuberculosis H37Rv
cucucggcacccggca

SEQ ID NO: 3253697 - RNA, 17 nt, Mycobacterium tuberculosis H37Rv
cucucggcacccggcag

SEQ ID NO: 3253698 - RNA, 17 nt, Mycobacterium tuberculosis H37Rv
cucucggucaguuccuc

SEQ ID NO: 3253699 - RNA, 18 nt, Mycobacterium tuberculosis H37Rv
cucucggucaguuccucu

SEQ ID NO: 3253700 - RNA, 17 nt, Mycobacterium tuberculosis H37Rv
cucucggucugcaugcg

SEQ ID NO: 3253701 - RNA, 18 nt, Mycobacterium tuberculosis H37Rv
cucucguggauggccgcc

SEQ ID NO: 3253702 - RNA, 14 nt, Mycobacterium tuberculosis H37Rv
cucucugcgccagg

SEQ ID NO: 3253703 - RNA, 15 nt, Mycobacterium tuberculosis H37Rv
cucucugcgccaggc

SEQ ID NO: 3253704 - RNA, 23 nt, Mycobacterium tuberculosis H37Rv
cucucugucgcguuguggcugaa

SEQ ID NO: 3253705 - RNA, 16 nt, Mycobacterium tuberculosis H37Rv
cucucuuugagcaggu

SEQ ID NO: 3253706 - RNA, 17 nt, Mycobacterium tuberculosis H37Rv
cucugaccagccggucu

SEQ ID NO: 3253707 - RNA, 19 nt, Mycobacterium tuberculosis H37Rv
cucugagcgggcgggccug

SEQ ID NO: 3253708 - RNA, 20 nt, Mycobacterium tuberculosis H37Rv
cucugagcgggcgggccugc

SEQ ID NO: 3253709 - RNA, 13 nt, Mycobacterium tuberculosis H37Rv
cucugcaaugccu

SEQ ID NO: 3253710 - RNA, 22 nt, Mycobacterium tuberculosis H37Rv
cucugcgagcguggacuugagu

SEQ ID NO: 3253711 - RNA, 15 nt, Mycobacterium tuberculosis H37Rv
cucugcgccacagca

SEQ ID NO: 3253712 - RNA, 14 nt, Mycobacterium tuberculosis H37Rv
cucugcgccaggcg

SEQ ID NO: 3253713 - RNA, 15 nt, Mycobacterium tuberculosis H37Rv
cucugcguccagcaa

SEQ ID NO: 3253714 - RNA, 16 nt, Mycobacterium tuberculosis H37Rv
cucugcgucugcucac

SEQ ID NO: 3253715 - RNA, 23 nt, Mycobacterium tuberculosis H37Rv
cucuggcgagggcuaccggcgcc

SEQ ID NO: 3253716 - RNA, 20 nt, Mycobacterium tuberculosis H37Rv
cucuggugacggugaagccg

SEQ ID NO: 3253717 - RNA, 21 nt, Mycobacterium tuberculosis H37Rv
cucugguuuuacacaccagcg

SEQ ID NO: 3253718 - RNA, 16 nt, Mycobacterium tuberculosis H37Rv
cucugucgcguugugg

SEQ ID NO: 3253719 - RNA, 14 nt, Mycobacterium tuberculosis H37Rv
cucugucuucagcu

SEQ ID NO: 3253720 - RNA, 19 nt, Mycobacterium tuberculosis H37Rv
cucugucuucagcugcgga

SEQ ID NO: 3253721 - RNA, 15 nt, Mycobacterium tuberculosis H37Rv
cucuguuguggucag

SEQ ID NO: 3253722 - RNA, 16 nt, Mycobacterium tuberculosis H37Rv
cucuucagcaagccaa

SEQ ID NO: 3253723 - RNA, 12 nt, Mycobacterium tuberculosis H37Rv
cucuucaggccc

SEQ ID NO: 3253724 - RNA, 14 nt, Mycobacterium tuberculosis H37Rv
cucuuccauuaggc

SEQ ID NO: 3253725 - RNA, 20 nt, Mycobacterium tuberculosis H37Rv
cucuucgaucuguuccugca

SEQ ID NO: 3253726 - RNA, 13 nt, Mycobacterium tuberculosis H37Rv
cucuucgcgcgcu

SEQ ID NO: 3253727 - RNA, 23 nt, Mycobacterium tuberculosis H37Rv
cucuucgcgcgcugggcgcgcuc

SEQ ID NO: 3253728 - RNA, 13 nt, Mycobacterium tuberculosis H37Rv
cucuucggcacca

SEQ ID NO: 3253729 - RNA, 17 nt, Mycobacterium tuberculosis H37Rv
cucuucgggugcagcca

SEQ ID NO: 3253730 - RNA, 14 nt, Mycobacterium tuberculosis H37Rv
cucuugcaaccugg

SEQ ID NO: 3253731 - RNA, 14 nt, Mycobacterium tuberculosis H37Rv
cucuugcgggcagc

SEQ ID NO: 3253732 - RNA, 21 nt, Mycobacterium tuberculosis H37Rv
cucuugcgggcagccgcccgc

SEQ ID NO: 3253733 - RNA, 23 nt, Mycobacterium tuberculosis H37Rv
cugaaaccuugcggcagaccaag

SEQ ID NO: 3253734 - RNA, 19 nt, Mycobacterium tuberculosis H37Rv
cugaaacgcuuggcccugg

SEQ ID NO: 3253735 - RNA, 17 nt, Mycobacterium tuberculosis H37Rv
cugaaacguccuugaac

SEQ ID NO: 3253736 - RNA, 18 nt, Mycobacterium tuberculosis H37Rv
cugaaauaagggccggcg

SEQ ID NO: 3253737 - RNA, 16 nt, Mycobacterium tuberculosis H37Rv
cugaacaccgugggcg

SEQ ID NO: 3253738 - RNA, 20 nt, Mycobacterium tuberculosis H37Rv
cugaacacgaauccggccac

SEQ ID NO: 3253739 - RNA, 19 nt, Mycobacterium tuberculosis H37Rv
cugaacaguugcacaccgg

SEQ ID NO: 3253740 - RNA, 20 nt, Mycobacterium tuberculosis H37Rv
cugaacaguugcacaccggc

SEQ ID NO: 3253741 - RNA, 21 nt, Mycobacterium tuberculosis H37Rv
cugaacauacgaaacaugcgc

SEQ ID NO: 3253742 - RNA, 18 nt, Mycobacterium tuberculosis H37Rv
cugaacauuccggcaccu

SEQ ID NO: 3253743 - RNA, 19 nt, Mycobacterium tuberculosis H37Rv
cugaacauuccggcaccuc

SEQ ID NO: 3253744 - RNA, 17 nt, Mycobacterium tuberculosis H37Rv
cugaaccgcugggacaa

SEQ ID NO: 3253745 - RNA, 21 nt, Mycobacterium tuberculosis H37Rv
cugaacgaaaugcacgccggg

SEQ ID NO: 3253746 - RNA, 16 nt, Mycobacterium tuberculosis H37Rv
cugaacgguuucuuuc

SEQ ID NO: 3253747 - RNA, 23 nt, Mycobacterium tuberculosis H37Rv
cugaacgguuucuuucggcagcg

SEQ ID NO: 3253748 - RNA, 22 nt, Mycobacterium tuberculosis H37Rv
cugagccgcgaaaucaccgcug

SEQ ID NO: 3253749 - RNA, 23 nt, Mycobacterium tuberculosis H37Rv
cugagccgcgaaaucaccgcuga

SEQ ID NO: 3253750 - RNA, 20 nt, Mycobacterium tuberculosis H37Rv
cugagccgcucaucgauccc

SEQ ID NO: 3253751 - RNA, 21 nt, Mycobacterium tuberculosis H37Rv
cugagccgggguacccggugg

SEQ ID NO: 3253752 - RNA, 17 nt, Mycobacterium tuberculosis H37Rv
cugagccggugcacucg

SEQ ID NO: 3253753 - RNA, 21 nt, Mycobacterium tuberculosis H37Rv
cugagcgaagugucgcugcaa

SEQ ID NO: 3253754 - RNA, 16 nt, Mycobacterium tuberculosis H37Rv
cugagcgacugcagcg

SEQ ID NO: 3253755 - RNA, 21 nt, Mycobacterium tuberculosis H37Rv
cugagcgagcucccgggcgcu

SEQ ID NO: 3253756 - RNA, 16 nt, Mycobacterium tuberculosis H37Rv
cugagcgccggcaucg

SEQ ID NO: 3253757 - RNA, 16 nt, Mycobacterium tuberculosis H37Rv
cugagcgcggguggca

SEQ ID NO: 3253758 - RNA, 17 nt, Mycobacterium tuberculosis H37Rv
cugagcggccucgggac

SEQ ID NO: 3253759 - RNA, 23 nt, Mycobacterium tuberculosis H37Rv
cugagcggccucgggacucccgc

SEQ ID NO: 3253760 - RNA, 20 nt, Mycobacterium tuberculosis H37Rv
cugagcgggcaacugcagca

SEQ ID NO: 3253761 - RNA, 18 nt, Mycobacterium tuberculosis H37Rv
cugagcgggcgggccugc

SEQ ID NO: 3253762 - RNA, 17 nt, Mycobacterium tuberculosis H37Rv
cugagcguccgacaacg

SEQ ID NO: 3253763 - RNA, 22 nt, Mycobacterium tuberculosis H37Rv
cugagcguccgacaacgacugc

SEQ ID NO: 3253764 - RNA, 19 nt, Mycobacterium tuberculosis H37Rv
cugagcgucgucgccggcg

SEQ ID NO: 3253765 - RNA, 18 nt, Mycobacterium tuberculosis H37Rv
cugagcugcucgccggcc

SEQ ID NO: 3253766 - RNA, 11 nt, Mycobacterium tuberculosis H37Rv
cugagcuucca

SEQ ID NO: 3253767 - RNA, 14 nt, Mycobacterium tuberculosis H37Rv
cugaggaacgccgg

SEQ ID NO: 3253768 - RNA, 13 nt, Mycobacterium tuberculosis H37Rv
cugaggagaccac

SEQ ID NO: 3253769 - RNA, 17 nt, Mycobacterium tuberculosis H37Rv
cugaggcaccucggccu

SEQ ID NO: 3253770 - RNA, 20 nt, Mycobacterium tuberculosis H37Rv
cugagggcccuuggccuucu

SEQ ID NO: 3253771 - RNA, 22 nt, Mycobacterium tuberculosis H37Rv
cugagguaggacucacgcagcg

SEQ ID NO: 3253772 - RNA, 22 nt, Mycobacterium tuberculosis H37Rv
cugaguccccaggugggcagca

SEQ ID NO: 3253773 - RNA, 23 nt, Mycobacterium tuberculosis H37Rv
cugaguccccaggugggcagcag

SEQ ID NO: 3253774 - RNA, 15 nt, Mycobacterium tuberculosis H37Rv
cugagucgguucagc

SEQ ID NO: 3253775 - RNA, 19 nt, Mycobacterium tuberculosis H37Rv
cugagucgguucagccacg

SEQ ID NO: 3253776 - RNA, 22 nt, Mycobacterium tuberculosis H37Rv
cugagucgguucagccacgcag

SEQ ID NO: 3253777 - RNA, 18 nt, Mycobacterium tuberculosis H37Rv
cugagucugauggccucg

SEQ ID NO: 3253778 - RNA, 21 nt, Mycobacterium tuberculosis H37Rv
cugagucugauggccucgcga

SEQ ID NO: 3253779 - RNA, 13 nt, Mycobacterium tuberculosis H37Rv
cugaguucggugc

SEQ ID NO: 3253780 - RNA, 19 nt, Mycobacterium tuberculosis H37Rv
cugauaaagcccggcggca

SEQ ID NO: 3253781 - RNA, 16 nt, Mycobacterium tuberculosis H37Rv
cugauaccaauccggc

SEQ ID NO: 3253782 - RNA, 19 nt, Mycobacterium tuberculosis H37Rv
cugauagacccuggggucc

SEQ ID NO: 3253783 - RNA, 19 nt, Mycobacterium tuberculosis H37Rv
cugauaugggggcucuuca

SEQ ID NO: 3253784 - RNA, 18 nt, Mycobacterium tuberculosis H37Rv
cugaucaagugccagcgu

SEQ ID NO: 3253785 - RNA, 22 nt, Mycobacterium tuberculosis H37Rv
cugaucaagugccagcguggug

SEQ ID NO: 3253786 - RNA, 14 nt, Mycobacterium tuberculosis H37Rv
cugaucagagcguu

SEQ ID NO: 3253787 - RNA, 15 nt, Mycobacterium tuberculosis H37Rv
cugaucaggccacac

SEQ ID NO: 3253788 - RNA, 16 nt, Mycobacterium tuberculosis H37Rv
cugaucccggccaggc

SEQ ID NO: 3253789 - RNA, 16 nt, Mycobacterium tuberculosis H37Rv
cugauccgccugccga

SEQ ID NO: 3253790 - RNA, 22 nt, Mycobacterium tuberculosis H37Rv
cugauccgccugccgacggcau

SEQ ID NO: 3253791 - RNA, 20 nt, Mycobacterium tuberculosis H37Rv
cugaucgaccgccuccucga

SEQ ID NO: 3253792 - RNA, 17 nt, Mycobacterium tuberculosis H37Rv
cugaucgagcgccagcg

SEQ ID NO: 3253793 - RNA, 14 nt, Mycobacterium tuberculosis H37Rv
cugaucgcgaagcg

SEQ ID NO: 3253794 - RNA, 17 nt, Mycobacterium tuberculosis H37Rv
cugaucgcgaagcguuc

SEQ ID NO: 3253795 - RNA, 15 nt, Mycobacterium tuberculosis H37Rv
cugaucgcgcgcacc

SEQ ID NO: 3253796 - RNA, 15 nt, Mycobacterium tuberculosis H37Rv
cugaucggcgcggcc

SEQ ID NO: 3253797 - RNA, 15 nt, Mycobacterium tuberculosis H37Rv
cugaucggcuucuuc

SEQ ID NO: 3253798 - RNA, 22 nt, Mycobacterium tuberculosis H37Rv
cugaucgugaacacgucgcggu

SEQ ID NO: 3253799 - RNA, 14 nt, Mycobacterium tuberculosis H37Rv
cugaucugagaccu

SEQ ID NO: 3253800 - RNA, 21 nt, Mycobacterium tuberculosis H37Rv
cugaucugagaccucagccgg

SEQ ID NO: 3253801 - RNA, 16 nt, Mycobacterium tuberculosis H37Rv
cugaucuggggcacca

SEQ ID NO: 3253802 - RNA, 19 nt, Mycobacterium tuberculosis H37Rv
cugaucuugccgccgcgcc

SEQ ID NO: 3253803 - RNA, 23 nt, Mycobacterium tuberculosis H37Rv
cugaucuuggagaagguuucccg

SEQ ID NO: 3253804 - RNA, 18 nt, Mycobacterium tuberculosis H37Rv
cugaucuuggcccgggcc

SEQ ID NO: 3253805 - RNA, 17 nt, Mycobacterium tuberculosis H37Rv
cugaugaaccacggcag

SEQ ID NO: 3253806 - RNA, 23 nt, Mycobacterium tuberculosis H37Rv
cugaugcguugauacgcgucgau

SEQ ID NO: 3253807 - RNA, 22 nt, Mycobacterium tuberculosis H37Rv
cugaugggccgguuccucagcg

SEQ ID NO: 3253808 - RNA, 17 nt, Mycobacterium tuberculosis H37Rv
cugaugggcgaauugca

SEQ ID NO: 3253809 - RNA, 13 nt, Mycobacterium tuberculosis H37Rv
cugaugggucagg

SEQ ID NO: 3253810 - RNA, 20 nt, Mycobacterium tuberculosis H37Rv
cugaugguguacacgucgcg

SEQ ID NO: 3253811 - RNA, 17 nt, Mycobacterium tuberculosis H37Rv
cugaugucgccgguguc

SEQ ID NO: 3253812 - RNA, 17 nt, Mycobacterium tuberculosis H37Rv
cugauuaccgacaccgu

SEQ ID NO: 3253813 - RNA, 21 nt, Mycobacterium tuberculosis H37Rv
cugauuccacugggccugcca

SEQ ID NO: 3253814 - RNA, 13 nt, Mycobacterium tuberculosis H37Rv
cugauucgcaggc

SEQ ID NO: 3253815 - RNA, 21 nt, Mycobacterium tuberculosis H37Rv
cugauucgcaggcucagcugg

SEQ ID NO: 3253816 - RNA, 14 nt, Mycobacterium tuberculosis H37Rv
cugauugaagcccc

SEQ ID NO: 3253817 - RNA, 16 nt, Mycobacterium tuberculosis H37Rv
cugauuggcccaccgc

SEQ ID NO: 3253818 - RNA, 19 nt, Mycobacterium tuberculosis H37Rv
cugauuggcccaccgccgu

SEQ ID NO: 3253819 - RNA, 21 nt, Mycobacterium tuberculosis H37Rv
cugauuguguuccaccagcgc

SEQ ID NO: 3253820 - RNA, 19 nt, Mycobacterium tuberculosis H37Rv
cugcaacgucacucccugg

SEQ ID NO: 3253821 - RNA, 20 nt, Mycobacterium tuberculosis H37Rv
cugcaacgucacucccuggc

SEQ ID NO: 3253822 - RNA, 18 nt, Mycobacterium tuberculosis H37Rv
cugcaacucuucccauuu

SEQ ID NO: 3253823 - RNA, 18 nt, Mycobacterium tuberculosis H37Rv
cugcaagaaccacugcau

SEQ ID NO: 3253824 - RNA, 23 nt, Mycobacterium tuberculosis H37Rv
cugcaagacaaagccgucgacgc

SEQ ID NO: 3253825 - RNA, 21 nt, Mycobacterium tuberculosis H37Rv
cugcaaggaauuccggcugcu

SEQ ID NO: 3253826 - RNA, 22 nt, Mycobacterium tuberculosis H37Rv
cugcaaggaauuccggcugcuu

SEQ ID NO: 3253827 - RNA, 12 nt, Mycobacterium tuberculosis H37Rv
cugcacaccacc

SEQ ID NO: 3253828 - RNA, 16 nt, Mycobacterium tuberculosis H37Rv
cugcacaccaccgccg

SEQ ID NO: 3253829 - RNA, 13 nt, Mycobacterium tuberculosis H37Rv
cugcacacugccg

SEQ ID NO: 3253830 - RNA, 13 nt, Mycobacterium tuberculosis H37Rv
cugcacagcagcg

SEQ ID NO: 3253831 - RNA, 21 nt, Mycobacterium tuberculosis H37Rv
cugcacagcagcgucaucagg

SEQ ID NO: 3253832 - RNA, 17 nt, Mycobacterium tuberculosis H37Rv
cugcacauucagcgccg

SEQ ID NO: 3253833 - RNA, 18 nt, Mycobacterium tuberculosis H37Rv
cugcacccaggcaucggu

SEQ ID NO: 3253834 - RNA, 19 nt, Mycobacterium tuberculosis H37Rv
cugcacccgacccgaugcg

SEQ ID NO: 3253835 - RNA, 14 nt, Mycobacterium tuberculosis H37Rv
cugcaccgauucgg

SEQ ID NO: 3253836 - RNA, 17 nt, Mycobacterium tuberculosis H37Rv
cugcaccgauucgggcu

SEQ ID NO: 3253837 - RNA, 15 nt, Mycobacterium tuberculosis H37Rv
cugcaccgucacguc

SEQ ID NO: 3253838 - RNA, 19 nt, Mycobacterium tuberculosis H37Rv
cugcaccgucagcccgacg

SEQ ID NO: 3253839 - RNA, 16 nt, Mycobacterium tuberculosis H37Rv
cugcaccguuuccggc

SEQ ID NO: 3253840 - RNA, 21 nt, Mycobacterium tuberculosis H37Rv
cugcaccguuuccggcgcucc

SEQ ID NO: 3253841 - RNA, 16 nt, Mycobacterium tuberculosis H37Rv
cugcaccuggcgcagc

SEQ ID NO: 3253842 - RNA, 15 nt, Mycobacterium tuberculosis H37Rv
cugcacgccggcgcu

SEQ ID NO: 3253843 - RNA, 15 nt, Mycobacterium tuberculosis H37Rv
cugccgacucaucgg

SEQ ID NO: 3253844 - RNA, 18 nt, Mycobacterium tuberculosis H37Rv
cugccgacucaucggccg

SEQ ID NO: 3253845 - RNA, 19 nt, Mycobacterium tuberculosis H37Rv
cugccgacucaucggccgc

SEQ ID NO: 3253846 - RNA, 22 nt, Mycobacterium tuberculosis H37Rv
cugccgauagggauggcgaugg

SEQ ID NO: 3253847 - RNA, 19 nt, Mycobacterium tuberculosis H37Rv
cugccgaucaauggcaacg

SEQ ID NO: 3253848 - RNA, 20 nt, Mycobacterium tuberculosis H37Rv
cugccgcacacgcgugcacg

SEQ ID NO: 3253849 - RNA, 16 nt, Mycobacterium tuberculosis H37Rv
cugccgcacccccucc

SEQ ID NO: 3253850 - RNA, 13 nt, Mycobacterium tuberculosis H37Rv
cugccgcacccgg

SEQ ID NO: 3253851 - RNA, 15 nt, Mycobacterium tuberculosis H37Rv
cugccgcacccgguc

SEQ ID NO: 3253852 - RNA, 21 nt, Mycobacterium tuberculosis H37Rv
cugccgcaccggugcucgucg

SEQ ID NO: 3253853 - RNA, 14 nt, Mycobacterium tuberculosis H37Rv
cugccgcagugaca

SEQ ID NO: 3253854 - RNA, 19 nt, Mycobacterium tuberculosis H37Rv
cugccgcaguucaucgaga

SEQ ID NO: 3253855 - RNA, 19 nt, Mycobacterium tuberculosis H37Rv
cugccgcaugcgcuccggc

SEQ ID NO: 3253856 - RNA, 15 nt, Mycobacterium tuberculosis H37Rv
cugccgccaggcucg

SEQ ID NO: 3253857 - RNA, 17 nt, Mycobacterium tuberculosis H37Rv
cugccgccaggcucgag

SEQ ID NO: 3253858 - RNA, 15 nt, Mycobacterium tuberculosis H37Rv
cugccgcccuugccg

SEQ ID NO: 3253859 - RNA, 15 nt, Mycobacterium tuberculosis H37Rv
cugccgccgagcugg

SEQ ID NO: 3253860 - RNA, 16 nt, Mycobacterium tuberculosis H37Rv
cugccgccgagcuggc

SEQ ID NO: 3253861 - RNA, 21 nt, Mycobacterium tuberculosis H37Rv
cugccgccgcggccacaaccu

SEQ ID NO: 3253862 - RNA, 19 nt, Mycobacterium tuberculosis H37Rv
cugccgccgcuccaugaca

SEQ ID NO: 3253863 - RNA, 13 nt, Mycobacterium tuberculosis H37Rv
cugccgccggccc

SEQ ID NO: 3253864 - RNA, 18 nt, Mycobacterium tuberculosis H37Rv
cugccgccggccccgccg

SEQ ID NO: 3253865 - RNA, 16 nt, Mycobacterium tuberculosis H37Rv
cugccgccggugccgc

SEQ ID NO: 3253866 - RNA, 20 nt, Mycobacterium tuberculosis H37Rv
cugccgccggugccgccauu

SEQ ID NO: 3253867 - RNA, 14 nt, Mycobacterium tuberculosis H37Rv
cugccgcgaugagc

SEQ ID NO: 3253868 - RNA, 17 nt, Mycobacterium tuberculosis H37Rv
cugccgcgaugagcggc

SEQ ID NO: 3253869 - RNA, 13 nt, Mycobacterium tuberculosis H37Rv
cugccgcgcggcg

SEQ ID NO: 3253870 - RNA, 17 nt, Mycobacterium tuberculosis H37Rv
cugccgcggcugccauc

SEQ ID NO: 3253871 - RNA, 21 nt, Mycobacterium tuberculosis H37Rv
cugccgcgggcagcguguaac

SEQ ID NO: 3253872 - RNA, 19 nt, Mycobacterium tuberculosis H37Rv
cugccgcggugccaaccgc

SEQ ID NO: 3253873 - RNA, 13 nt, Mycobacterium tuberculosis H37Rv
cugccgcucgacc

SEQ ID NO: 3253874 - RNA, 20 nt, Mycobacterium tuberculosis H37Rv
cugccgcucgaccccgcgcu

SEQ ID NO: 3253875 - RNA, 14 nt, Mycobacterium tuberculosis H37Rv
cugccgcucgccgg

SEQ ID NO: 3253876 - RNA, 23 nt, Mycobacterium tuberculosis H37Rv
cugccgcugccgaagcggccacc

SEQ ID NO: 3253877 - RNA, 15 nt, Mycobacterium tuberculosis H37Rv
cugccgcugcgccgu

SEQ ID NO: 3253878 - RNA, 18 nt, Mycobacterium tuberculosis H37Rv
cugccggacuaccgccgg

SEQ ID NO: 3253879 - RNA, 13 nt, Mycobacterium tuberculosis H37Rv
cugccggagacac

SEQ ID NO: 3253880 - RNA, 17 nt, Mycobacterium tuberculosis H37Rv
cugccggagacacccgc

SEQ ID NO: 3253881 - RNA, 15 nt, Mycobacterium tuberculosis H37Rv
cugccggcacgcaug

SEQ ID NO: 3253882 - RNA, 15 nt, Mycobacterium tuberculosis H37Rv
cugccggcagcgucc

SEQ ID NO: 3253883 - RNA, 18 nt, Mycobacterium tuberculosis H37Rv
cugccggccgcguaaacc

SEQ ID NO: 3253884 - RNA, 16 nt, Mycobacterium tuberculosis H37Rv
cugccggccggcgggc

SEQ ID NO: 3253885 - RNA, 20 nt, Mycobacterium tuberculosis H37Rv
cugccggccggcgggccugc

SEQ ID NO: 3253886 - RNA, 22 nt, Mycobacterium tuberculosis H37Rv
cugccggccggcgggccugccc

SEQ ID NO: 3253887 - RNA, 13 nt, Mycobacterium tuberculosis H37Rv
cugccggcugaca

SEQ ID NO: 3253888 - RNA, 12 nt, Mycobacterium tuberculosis H37Rv
cugccgggaggg

SEQ ID NO: 3253889 - RNA, 13 nt, Mycobacterium tuberculosis H37Rv
cugccgggcgcgc

SEQ ID NO: 3253890 - RNA, 20 nt, Mycobacterium tuberculosis H37Rv
cugccgggcgcgcguagccg

SEQ ID NO: 3253891 - RNA, 16 nt, Mycobacterium tuberculosis H37Rv
cugccgggggcccgac

SEQ ID NO: 3253892 - RNA, 19 nt, Mycobacterium tuberculosis H37Rv
cugccgggugggcaagcug

SEQ ID NO: 3253893 - RNA, 20 nt, Mycobacterium tuberculosis H37Rv
cugccgguagcacagcagca

SEQ ID NO: 3253894 - RNA, 21 nt, Mycobacterium tuberculosis H37Rv
cugccgguagcacagcagcaa

SEQ ID NO: 3253895 - RNA, 17 nt, Mycobacterium tuberculosis H37Rv
cugccggucgaugucgg

SEQ ID NO: 3253896 - RNA, 19 nt, Mycobacterium tuberculosis H37Rv
cugccgucagccguucggc

SEQ ID NO: 3253897 - RNA, 16 nt, Mycobacterium tuberculosis H37Rv
cugccgucgcugcccc

SEQ ID NO: 3253898 - RNA, 13 nt, Mycobacterium tuberculosis H37Rv
cugccgucggugc

SEQ ID NO: 3253899 - RNA, 12 nt, Mycobacterium tuberculosis H37Rv
cugccguucggg

SEQ ID NO: 3253900 - RNA, 15 nt, Mycobacterium tuberculosis H37Rv
cugccucaaaccgga

SEQ ID NO: 3253901 - RNA, 13 nt, Mycobacterium tuberculosis H37Rv
cugccucaccgcc

SEQ ID NO: 3253902 - RNA, 16 nt, Mycobacterium tuberculosis H37Rv
cugccucaccgccgcu

SEQ ID NO: 3253903 - RNA, 17 nt, Mycobacterium tuberculosis H37Rv
cugccucaccgccgcua

SEQ ID NO: 3253904 - RNA, 17 nt, Mycobacterium tuberculosis H37Rv
cugccuccggaaggcuc

SEQ ID NO: 3253905 - RNA, 21 nt, Mycobacterium tuberculosis H37Rv
cugccucggcgagccgcucgc

SEQ ID NO: 3253906 - RNA, 18 nt, Mycobacterium tuberculosis H37Rv
cugccucucagcacgguu

SEQ ID NO: 3253907 - RNA, 14 nt, Mycobacterium tuberculosis H37Rv
cugccucucgaccu

SEQ ID NO: 3253908 - RNA, 21 nt, Mycobacterium tuberculosis H37Rv
cugccuggccgggaccgcccc

SEQ ID NO: 3253909 - RNA, 19 nt, Mycobacterium tuberculosis H37Rv
cugccuuacacgccuggcu

SEQ ID NO: 3253910 - RNA, 21 nt, Mycobacterium tuberculosis H37Rv
cugccuucuuugccggcgccu

SEQ ID NO: 3253911 - RNA, 18 nt, Mycobacterium tuberculosis H37Rv
cugccuuggccggcuugu

SEQ ID NO: 3253912 - RNA, 17 nt, Mycobacterium tuberculosis H37Rv
cugccuugggaccgcgc

SEQ ID NO: 3253913 - RNA, 15 nt, Mycobacterium tuberculosis H37Rv
cugcgaaacgccacc

SEQ ID NO: 3253914 - RNA, 16 nt, Mycobacterium tuberculosis H37Rv
cugcgaaacgccaccg

SEQ ID NO: 3253915 - RNA, 15 nt, Mycobacterium tuberculosis H37Rv
cugcgaaacgcuggc

SEQ ID NO: 3253916 - RNA, 18 nt, Mycobacterium tuberculosis H37Rv
cugcgaacacgcgaugac

SEQ ID NO: 3253917 - RNA, 23 nt, Mycobacterium tuberculosis H37Rv
cugcgaagaguccuuaaacgucg

SEQ ID NO: 3253918 - RNA, 16 nt, Mycobacterium tuberculosis H37Rv
cugcgacaagaccggc

SEQ ID NO: 3253919 - RNA, 15 nt, Mycobacterium tuberculosis H37Rv
cugcgacacaacggg

SEQ ID NO: 3253920 - RNA, 21 nt, Mycobacterium tuberculosis H37Rv
cugcgacaggacgucggcgaa

SEQ ID NO: 3253921 - RNA, 22 nt, Mycobacterium tuberculosis H37Rv
cugcgaccaggcgcggcgacaa

SEQ ID NO: 3253922 - RNA, 16 nt, Mycobacterium tuberculosis H37Rv
cugcgaccgucccggc

SEQ ID NO: 3253923 - RNA, 18 nt, Mycobacterium tuberculosis H37Rv
cugcgaccgucccggccu

SEQ ID NO: 3253924 - RNA, 22 nt, Mycobacterium tuberculosis H37Rv
cugcgaccgucccggccucgau

SEQ ID NO: 3253925 - RNA, 17 nt, Mycobacterium tuberculosis H37Rv
cugcgacgagcccaccg

SEQ ID NO: 3253926 - RNA, 18 nt, Mycobacterium tuberculosis H37Rv
cugcgacgagcccaccgu

SEQ ID NO: 3253927 - RNA, 16 nt, Mycobacterium tuberculosis H37Rv
cugcgaucgcgagcga

SEQ ID NO: 3253928 - RNA, 14 nt, Mycobacterium tuberculosis H37Rv
cugcgauuuucggc

SEQ ID NO: 3253929 - RNA, 17 nt, Mycobacterium tuberculosis H37Rv
cugcgcaacaccaucag

SEQ ID NO: 3253930 - RNA, 23 nt, Mycobacterium tuberculosis H37Rv
cugcgcaacaccgugcaccagcu

SEQ ID NO: 3253931 - RNA, 19 nt, Mycobacterium tuberculosis H37Rv
cugcgcaccgccgcgcgac

SEQ ID NO: 3253932 - RNA, 20 nt, Mycobacterium tuberculosis H37Rv
cugcgcaccugggucgacga

SEQ ID NO: 3253933 - RNA, 14 nt, Mycobacterium tuberculosis H37Rv
cugcgcagccgccu

SEQ ID NO: 3253934 - RNA, 18 nt, Mycobacterium tuberculosis H37Rv
cugcgcagccgccucaau

SEQ ID NO: 3253935 - RNA, 14 nt, Mycobacterium tuberculosis H37Rv
cugcgcagcgcaac

SEQ ID NO: 3253936 - RNA, 18 nt, Mycobacterium tuberculosis H37Rv
cugcgcagcgcaacaucg

SEQ ID NO: 3253937 - RNA, 15 nt, Mycobacterium tuberculosis H37Rv
cugcgcagcgccugc

SEQ ID NO: 3253938 - RNA, 22 nt, Mycobacterium tuberculosis H37Rv
cugcgcagcgccugcggcagca

SEQ ID NO: 3253939 - RNA, 16 nt, Mycobacterium tuberculosis H37Rv
cugcggcgucguucga

SEQ ID NO: 3253940 - RNA, 18 nt, Mycobacterium tuberculosis H37Rv
cugcggcgucguugagga

SEQ ID NO: 3253941 - RNA, 16 nt, Mycobacterium tuberculosis H37Rv
cugcggcucagaaccc

SEQ ID NO: 3253942 - RNA, 20 nt, Mycobacterium tuberculosis H37Rv
cugcggcuccggcggcagcg

SEQ ID NO: 3253943 - RNA, 12 nt, Mycobacterium tuberculosis H37Rv
cugcggcucgcu

SEQ ID NO: 3253944 - RNA, 18 nt, Mycobacterium tuberculosis H37Rv
cugcggcucgcugaucug

SEQ ID NO: 3253945 - RNA, 19 nt, Mycobacterium tuberculosis H37Rv
cugcggcuuggccaucacg

SEQ ID NO: 3253946 - RNA, 22 nt, Mycobacterium tuberculosis H37Rv
cugcgggaaguugcccagguga

SEQ ID NO: 3253947 - RNA, 15 nt, Mycobacterium tuberculosis H37Rv
cugcgggaggcagcg

SEQ ID NO: 3253948 - RNA, 14 nt, Mycobacterium tuberculosis H37Rv
cugcgggccgagau

SEQ ID NO: 3253949 - RNA, 21 nt, Mycobacterium tuberculosis H37Rv
cugcggggugagugaccacgc

SEQ ID NO: 3253950 - RNA, 21 nt, Mycobacterium tuberculosis H37Rv
cugcggguagauguucacgcc

SEQ ID NO: 3253951 - RNA, 23 nt, Mycobacterium tuberculosis H37Rv
cugcggguaggugacgacgucgu

SEQ ID NO: 3253952 - RNA, 17 nt, Mycobacterium tuberculosis H37Rv
cugcgggucagcgccga

SEQ ID NO: 3253953 - RNA, 14 nt, Mycobacterium tuberculosis H37Rv
cugcgggucggcca

SEQ ID NO: 3253954 - RNA, 15 nt, Mycobacterium tuberculosis H37Rv
cugcgggucggccau

SEQ ID NO: 3253955 - RNA, 19 nt, Mycobacterium tuberculosis H37Rv
cugcgggugauugagcuca

SEQ ID NO: 3253956 - RNA, 23 nt, Mycobacterium tuberculosis H37Rv
cugcggguucacuuccgggcagc

SEQ ID NO: 3253957 - RNA, 15 nt, Mycobacterium tuberculosis H37Rv
cugcggguucgccga

SEQ ID NO: 3253958 - RNA, 17 nt, Mycobacterium tuberculosis H37Rv
cugcggucaauguggcg

SEQ ID NO: 3253959 - RNA, 18 nt, Mycobacterium tuberculosis H37Rv
cugcggucaucgccucgg

SEQ ID NO: 3253960 - RNA, 14 nt, Mycobacterium tuberculosis H37Rv
cugcggucgcccag

SEQ ID NO: 3253961 - RNA, 16 nt, Mycobacterium tuberculosis H37Rv
cugcggucgcccaggc

SEQ ID NO: 3253962 - RNA, 17 nt, Mycobacterium tuberculosis H37Rv
cugcggucgcggcugac

SEQ ID NO: 3253963 - RNA, 20 nt, Mycobacterium tuberculosis H37Rv
cugcggugcaggauucggcg

SEQ ID NO: 3253964 - RNA, 15 nt, Mycobacterium tuberculosis H37Rv
cugcggugccacggu

SEQ ID NO: 3253965 - RNA, 13 nt, Mycobacterium tuberculosis H37Rv
cugcggugcgggc

SEQ ID NO: 3253966 - RNA, 15 nt, Mycobacterium tuberculosis H37Rv
cugcggugcgggcuu

SEQ ID NO: 3253967 - RNA, 16 nt, Mycobacterium tuberculosis H37Rv
cugcgguugaguugca

SEQ ID NO: 3253968 - RNA, 18 nt, Mycobacterium tuberculosis H37Rv
cugcguccaccggacggg

SEQ ID NO: 3253969 - RNA, 22 nt, Mycobacterium tuberculosis H37Rv
cugcguccagcaaaugcggcgc

SEQ ID NO: 3253970 - RNA, 15 nt, Mycobacterium tuberculosis H37Rv
cugcgucggcggcuu

SEQ ID NO: 3253971 - RNA, 18 nt, Mycobacterium tuberculosis H37Rv
cugcgucgucugcagacc

SEQ ID NO: 3253972 - RNA, 14 nt, Mycobacterium tuberculosis H37Rv
cugcgucucgauga

SEQ ID NO: 3253973 - RNA, 15 nt, Mycobacterium tuberculosis H37Rv
cugcgucucgaugag

SEQ ID NO: 3253974 - RNA, 13 nt, Mycobacterium tuberculosis H37Rv
cugcgucugcucg

SEQ ID NO: 3253975 - RNA, 18 nt, Mycobacterium tuberculosis H37Rv
cugcgucugcucgcgcag

SEQ ID NO: 3253976 - RNA, 23 nt, Mycobacterium tuberculosis H37Rv
cugcgucugcucgcgcagggauc

SEQ ID NO: 3253977 - RNA, 18 nt, Mycobacterium tuberculosis H37Rv
cugcgucugcucggcgcu

SEQ ID NO: 3253978 - RNA, 17 nt, Mycobacterium tuberculosis H37Rv
cugcguggcgggcugca

SEQ ID NO: 3253979 - RNA, 19 nt, Mycobacterium tuberculosis H37Rv
cugcguugcggcaacagcg

SEQ ID NO: 3253980 - RNA, 22 nt, Mycobacterium tuberculosis H37Rv
cugcguugggaucccagcgcag

SEQ ID NO: 3253981 - RNA, 14 nt, Mycobacterium tuberculosis H37Rv
cugcuacucugcaa

SEQ ID NO: 3253982 - RNA, 23 nt, Mycobacterium tuberculosis H37Rv
cugcuagcagcagcccgacagug

SEQ ID NO: 3253983 - RNA, 16 nt, Mycobacterium tuberculosis H37Rv
cugcuagcccggcggc

SEQ ID NO: 3253984 - RNA, 21 nt, Mycobacterium tuberculosis H37Rv
cugcuagcuuggcggccagcg

SEQ ID NO: 3253985 - RNA, 16 nt, Mycobacterium tuberculosis H37Rv
cugcuaguggucugcu

SEQ ID NO: 3253986 - RNA, 20 nt, Mycobacterium tuberculosis H37Rv
cugcuauugguugaggaggu

SEQ ID NO: 3253987 - RNA, 19 nt, Mycobacterium tuberculosis H37Rv
cugcucacgcagcagugcg

SEQ ID NO: 3253988 - RNA, 14 nt, Mycobacterium tuberculosis H37Rv
cugcucacgcgguc

SEQ ID NO: 3253989 - RNA, 13 nt, Mycobacterium tuberculosis H37Rv
cugcucagggcgc

SEQ ID NO: 3253990 - RNA, 20 nt, Mycobacterium tuberculosis H37Rv
cugcucauccaccucgaugg

SEQ ID NO: 3253991 - RNA, 19 nt, Mycobacterium tuberculosis H37Rv
cugcuccaccgucgaacca

SEQ ID NO: 3253992 - RNA, 13 nt, Mycobacterium tuberculosis H37Rv
cugcuccaggcgc

SEQ ID NO: 3253993 - RNA, 14 nt, Mycobacterium tuberculosis H37Rv
cugcuccaggcgcg

SEQ ID NO: 3253994 - RNA, 19 nt, Mycobacterium tuberculosis H37Rv
cugcuccaggcgcgccgca

SEQ ID NO: 3253995 - RNA, 14 nt, Mycobacterium tuberculosis H37Rv
cugcuccgcgccgc

SEQ ID NO: 3253996 - RNA, 15 nt, Mycobacterium tuberculosis H37Rv
cugcuccgcgccgcu

SEQ ID NO: 3253997 - RNA, 15 nt, Mycobacterium tuberculosis H37Rv
cugcuccgcugucac

SEQ ID NO: 3253998 - RNA, 20 nt, Mycobacterium tuberculosis H37Rv
cugcuccucgcgggcggcgu

SEQ ID NO: 3253999 - RNA, 13 nt, Mycobacterium tuberculosis H37Rv
cugcuccucgguc

SEQ ID NO: 3254000 - RNA, 11 nt, Mycobacterium tuberculosis H37Rv
cugcuccugga

SEQ ID NO: 3254001 - RNA, 15 nt, Mycobacterium tuberculosis H37Rv
cugcucgccagccgg

SEQ ID NO: 3254002 - RNA, 15 nt, Mycobacterium tuberculosis H37Rv
cugcucgccaggcaa

SEQ ID NO: 3254003 - RNA, 23 nt, Mycobacterium tuberculosis H37Rv
cugcucgccccaugucaagcgau

SEQ ID NO: 3254004 - RNA, 16 nt, Mycobacterium tuberculosis H37Rv
cugcucgccgucucgg

SEQ ID NO: 3254005 - RNA, 17 nt, Mycobacterium tuberculosis H37Rv
cugcucgccguggugga

SEQ ID NO: 3254006 - RNA, 15 nt, Mycobacterium tuberculosis H37Rv
cugcucgcgcccgcu

SEQ ID NO: 3254007 - RNA, 13 nt, Mycobacterium tuberculosis H37Rv
cugcucgcgccgc

SEQ ID NO: 3254008 - RNA, 16 nt, Mycobacterium tuberculosis H37Rv
cugcucgcuggugaac

SEQ ID NO: 3254009 - RNA, 15 nt, Mycobacterium tuberculosis H37Rv
cugcucggccuggau

SEQ ID NO: 3254010 - RNA, 12 nt, Mycobacterium tuberculosis H37Rv
cugcucggcgcu

SEQ ID NO: 3254011 - RNA, 21 nt, Mycobacterium tuberculosis H37Rv
cugcucggcggugccgcggcu

SEQ ID NO: 3254012 - RNA, 12 nt, Mycobacterium tuberculosis H37Rv
cugcucggcgua

SEQ ID NO: 3254013 - RNA, 22 nt, Mycobacterium tuberculosis H37Rv
cugcucggucaggcggcuggcc

SEQ ID NO: 3254014 - RNA, 18 nt, Mycobacterium tuberculosis H37Rv
cugcucgucgagccgacc

SEQ ID NO: 3254015 - RNA, 14 nt, Mycobacterium tuberculosis H37Rv
cugcucgucggcca

SEQ ID NO: 3254016 - RNA, 17 nt, Mycobacterium tuberculosis H37Rv
cugcucgucuuggcggc

SEQ ID NO: 3254017 - RNA, 18 nt, Mycobacterium tuberculosis H37Rv
cugcucgucuuggcggcg

SEQ ID NO: 3254018 - RNA, 23 nt, Mycobacterium tuberculosis H37Rv
cugcucuggacggucauccggcc

SEQ ID NO: 3254019 - RNA, 19 nt, Mycobacterium tuberculosis H37Rv
cugcucuuuuagccacaau

SEQ ID NO: 3254020 - RNA, 19 nt, Mycobacterium tuberculosis H37Rv
cugcugaaauccuagggug

SEQ ID NO: 3254021 - RNA, 13 nt, Mycobacterium tuberculosis H37Rv
cugcugaacaacc

SEQ ID NO: 3254022 - RNA, 15 nt, Mycobacterium tuberculosis H37Rv
cugcugaacaaccag

SEQ ID NO: 3254023 - RNA, 18 nt, Mycobacterium tuberculosis H37Rv
cugcugaccaugaccggg

SEQ ID NO: 3254024 - RNA, 17 nt, Mycobacterium tuberculosis H37Rv
cugcugaccugcauggg

SEQ ID NO: 3254025 - RNA, 19 nt, Mycobacterium tuberculosis H37Rv
cugcugagccgucggcgcc

SEQ ID NO: 3254026 - RNA, 13 nt, Mycobacterium tuberculosis H37Rv
cugcugagcugcu

SEQ ID NO: 3254027 - RNA, 17 nt, Mycobacterium tuberculosis H37Rv
cugcugagcugcucgcc

SEQ ID NO: 3254028 - RNA, 19 nt, Mycobacterium tuberculosis H37Rv
cugcugcacaucgcaucca

SEQ ID NO: 3254029 - RNA, 16 nt, Mycobacterium tuberculosis H37Rv
cugcugcagcgaugcg

SEQ ID NO: 3254030 - RNA, 14 nt, Mycobacterium tuberculosis H37Rv
cugcugccagccga

SEQ ID NO: 3254031 - RNA, 15 nt, Mycobacterium tuberculosis H37Rv
cugcugccagccugg

SEQ ID NO: 3254032 - RNA, 18 nt, Mycobacterium tuberculosis H37Rv
cugcugccauugccgaug

SEQ ID NO: 3254033 - RNA, 19 nt, Mycobacterium tuberculosis H37Rv
cugcugccgcaccggugcu

SEQ ID NO: 3254034 - RNA, 16 nt, Mycobacterium tuberculosis H37Rv
cugcugccguggcggc

SEQ ID NO: 3254035 - RNA, 19 nt, Mycobacterium tuberculosis H37Rv
cugcugccguggcggcagc

SEQ ID NO: 3254036 - RNA, 21 nt, Mycobacterium tuberculosis H37Rv
cuggccagguugccgucggcc

SEQ ID NO: 3254037 - RNA, 13 nt, Mycobacterium tuberculosis H37Rv
cuggccaguccga

SEQ ID NO: 3254038 - RNA, 13 nt, Mycobacterium tuberculosis H37Rv
cuggcccaauugc

SEQ ID NO: 3254039 - RNA, 18 nt, Mycobacterium tuberculosis H37Rv
cuggcccaauugcgccga

SEQ ID NO: 3254040 - RNA, 20 nt, Mycobacterium tuberculosis H37Rv
cuggcccaccuccucgccgg

SEQ ID NO: 3254041 - RNA, 19 nt, Mycobacterium tuberculosis H37Rv
cuggcccaucuugaccaau

SEQ ID NO: 3254042 - RNA, 20 nt, Mycobacterium tuberculosis H37Rv
cuggcccccgguaccgcccg

SEQ ID NO: 3254043 - RNA, 24 nt, Mycobacterium tuberculosis H37Rv
cuggccccgccagcggcagcggcg

SEQ ID NO: 3254044 - RNA, 15 nt, Mycobacterium tuberculosis H37Rv
cuggccccgguggug

SEQ ID NO: 3254045 - RNA, 18 nt, Mycobacterium tuberculosis H37Rv
cuggcccgauaaaugccg

SEQ ID NO: 3254046 - RNA, 21 nt, Mycobacterium tuberculosis H37Rv
cuggcccgcacgaaccggucg

SEQ ID NO: 3254047 - RNA, 14 nt, Mycobacterium tuberculosis H37Rv
cuggcccgcaugcc

SEQ ID NO: 3254048 - RNA, 18 nt, Mycobacterium tuberculosis H37Rv
cuggcccgccacgauguc

SEQ ID NO: 3254049 - RNA, 22 nt, Mycobacterium tuberculosis H37Rv
cuggcccggacaugcgggcagc

SEQ ID NO: 3254050 - RNA, 20 nt, Mycobacterium tuberculosis H37Rv
cuggcccggcuacgacggcg

SEQ ID NO: 3254051 - RNA, 15 nt, Mycobacterium tuberculosis H37Rv
cuggcccgucggcgu

SEQ ID NO: 3254052 - RNA, 22 nt, Mycobacterium tuberculosis H37Rv
cuggcccuuguuggccugcaac

SEQ ID NO: 3254053 - RNA, 14 nt, Mycobacterium tuberculosis H37Rv
cuggccgaaccggu

SEQ ID NO: 3254054 - RNA, 21 nt, Mycobacterium tuberculosis H37Rv
cuggccgaaccgguagucgcc

SEQ ID NO: 3254055 - RNA, 14 nt, Mycobacterium tuberculosis H37Rv
cuggccgaagaacu

SEQ ID NO: 3254056 - RNA, 14 nt, Mycobacterium tuberculosis H37Rv
cuggccgacucgag

SEQ ID NO: 3254057 - RNA, 22 nt, Mycobacterium tuberculosis H37Rv
cuggccgccagauuggcgcugc

SEQ ID NO: 3254058 - RNA, 14 nt, Mycobacterium tuberculosis H37Rv
cuggccgcccggcg

SEQ ID NO: 3254059 - RNA, 15 nt, Mycobacterium tuberculosis H37Rv
cuggccgccgcgcac

SEQ ID NO: 3254060 - RNA, 11 nt, Mycobacterium tuberculosis H37Rv
cuggccgcgau

SEQ ID NO: 3254061 - RNA, 12 nt, Mycobacterium tuberculosis H37Rv
cuggccgcgccu

SEQ ID NO: 3254062 - RNA, 23 nt, Mycobacterium tuberculosis H37Rv
cuggccgcuauccaggccgucag

SEQ ID NO: 3254063 - RNA, 14 nt, Mycobacterium tuberculosis H37Rv
cuggccgggaccgc

SEQ ID NO: 3254064 - RNA, 21 nt, Mycobacterium tuberculosis H37Rv
cuggccgggaccgccccggcc

SEQ ID NO: 3254065 - RNA, 20 nt, Mycobacterium tuberculosis H37Rv
cuggccggguuccagcggca

SEQ ID NO: 3254066 - RNA, 18 nt, Mycobacterium tuberculosis H37Rv
cuggccgguucgcccgag

SEQ ID NO: 3254067 - RNA, 23 nt, Mycobacterium tuberculosis H37Rv
cuggccguccuaccgaugaacca

SEQ ID NO: 3254068 - RNA, 20 nt, Mycobacterium tuberculosis H37Rv
cuggccguuguucuugucgg

SEQ ID NO: 3254069 - RNA, 12 nt, Mycobacterium tuberculosis H37Rv
cuggccuccagc

SEQ ID NO: 3254070 - RNA, 15 nt, Mycobacterium tuberculosis H37Rv
cuggccuccagcuug

SEQ ID NO: 3254071 - RNA, 22 nt, Mycobacterium tuberculosis H37Rv
cuggccugauuguugagccacg

SEQ ID NO: 3254072 - RNA, 15 nt, Mycobacterium tuberculosis H37Rv
cuggccugcggcagg

SEQ ID NO: 3254073 - RNA, 20 nt, Mycobacterium tuberculosis H37Rv
cuggccuuggcaguccagcc

SEQ ID NO: 3254074 - RNA, 17 nt, Mycobacterium tuberculosis H37Rv
cuggccuuugagcgcgg

SEQ ID NO: 3254075 - RNA, 22 nt, Mycobacterium tuberculosis H37Rv
cuggccuuugagcgcggccacc

SEQ ID NO: 3254076 - RNA, 23 nt, Mycobacterium tuberculosis H37Rv
cuggccuuugagcgcggccacca

SEQ ID NO: 3254077 - RNA, 15 nt, Mycobacterium tuberculosis H37Rv
cuggcgaaccagagu

SEQ ID NO: 3254078 - RNA, 23 nt, Mycobacterium tuberculosis H37Rv
cuggcgaaccagaguucggccag

SEQ ID NO: 3254079 - RNA, 17 nt, Mycobacterium tuberculosis H37Rv
cuggcgaacucgcgcag

SEQ ID NO: 3254080 - RNA, 16 nt, Mycobacterium tuberculosis H37Rv
cuggcgaaggacaaca

SEQ ID NO: 3254081 - RNA, 19 nt, Mycobacterium tuberculosis H37Rv
cuggcgaaugcgggccucc

SEQ ID NO: 3254082 - RNA, 21 nt, Mycobacterium tuberculosis H37Rv
cuggcgaaugcgggccuccug

SEQ ID NO: 3254083 - RNA, 19 nt, Mycobacterium tuberculosis H37Rv
cuggcgacaucucggucag

SEQ ID NO: 3254084 - RNA, 22 nt, Mycobacterium tuberculosis H37Rv
cuggcgacgacgacaccgcgca

SEQ ID NO: 3254085 - RNA, 20 nt, Mycobacterium tuberculosis H37Rv
cuggcgacucgugucugccu

SEQ ID NO: 3254086 - RNA, 19 nt, Mycobacterium tuberculosis H37Rv
cuggcgauacagcgacagg

SEQ ID NO: 3254087 - RNA, 17 nt, Mycobacterium tuberculosis H37Rv
cuggcgaucgcgacgau

SEQ ID NO: 3254088 - RNA, 19 nt, Mycobacterium tuberculosis H37Rv
cuggcgaucucuaccagcc

SEQ ID NO: 3254089 - RNA, 19 nt, Mycobacterium tuberculosis H37Rv
cuggcgaucuggucggcgg

SEQ ID NO: 3254090 - RNA, 17 nt, Mycobacterium tuberculosis H37Rv
cuggcgaugacgaucgc

SEQ ID NO: 3254091 - RNA, 21 nt, Mycobacterium tuberculosis H37Rv
cuggcgauggccguccgaccg

SEQ ID NO: 3254092 - RNA, 15 nt, Mycobacterium tuberculosis H37Rv
cuggcgcagcgccuc

SEQ ID NO: 3254093 - RNA, 21 nt, Mycobacterium tuberculosis H37Rv
cuggcgcagcgccucgguaaa

SEQ ID NO: 3254094 - RNA, 15 nt, Mycobacterium tuberculosis H37Rv
cuggcgcccccgcca

SEQ ID NO: 3254095 - RNA, 19 nt, Mycobacterium tuberculosis H37Rv
cuggcgcccgggucccggc

SEQ ID NO: 3254096 - RNA, 18 nt, Mycobacterium tuberculosis H37Rv
cuggcgcccuugccggcg

SEQ ID NO: 3254097 - RNA, 21 nt, Mycobacterium tuberculosis H37Rv
cuggcgccgaaguagccgacc

SEQ ID NO: 3254098 - RNA, 21 nt, Mycobacterium tuberculosis H37Rv
cuggcgccggugccgccgggu

SEQ ID NO: 3254099 - RNA, 15 nt, Mycobacterium tuberculosis H37Rv
cuggcgcgccaccgu

SEQ ID NO: 3254100 - RNA, 21 nt, Mycobacterium tuberculosis H37Rv
cuggcgcgccugugccaccgc

SEQ ID NO: 3254101 - RNA, 14 nt, Mycobacterium tuberculosis H37Rv
cuggcgcugcuggc

SEQ ID NO: 3254102 - RNA, 15 nt, Mycobacterium tuberculosis H37Rv
cuggcgcugcuggca

SEQ ID NO: 3254103 - RNA, 19 nt, Mycobacterium tuberculosis H37Rv
cuggcgcugcuggcagacc

SEQ ID NO: 3254104 - RNA, 19 nt, Mycobacterium tuberculosis H37Rv
cuggcgcuuugggcugccg

SEQ ID NO: 3254105 - RNA, 20 nt, Mycobacterium tuberculosis H37Rv
cuggcgcuuugggcugccgu

SEQ ID NO: 3254106 - RNA, 11 nt, Mycobacterium tuberculosis H37Rv
cuggcggaugg

SEQ ID NO: 3254107 - RNA, 14 nt, Mycobacterium tuberculosis H37Rv
cuggcggauggccg

SEQ ID NO: 3254108 - RNA, 16 nt, Mycobacterium tuberculosis H37Rv
cuggcggauggccgcc

SEQ ID NO: 3254109 - RNA, 18 nt, Mycobacterium tuberculosis H37Rv
cuggcggauggccgccuu

SEQ ID NO: 3254110 - RNA, 15 nt, Mycobacterium tuberculosis H37Rv
cuggcggcgccgcag

SEQ ID NO: 3254111 - RNA, 13 nt, Mycobacterium tuberculosis H37Rv
cuggcggcgcgac

SEQ ID NO: 3254112 - RNA, 23 nt, Mycobacterium tuberculosis H37Rv
cuggcggcgugcuuaacacaugc

SEQ ID NO: 3254113 - RNA, 18 nt, Mycobacterium tuberculosis H37Rv
cuggcggcugcagccgac

SEQ ID NO: 3254114 - RNA, 22 nt, Mycobacterium tuberculosis H37Rv
cuggcggguuggucccgaugac

SEQ ID NO: 3254115 - RNA, 15 nt, Mycobacterium tuberculosis H37Rv
cuggcggugccggcg

SEQ ID NO: 3254116 - RNA, 18 nt, Mycobacterium tuberculosis H37Rv
cuggcguagugcucgccg

SEQ ID NO: 3254117 - RNA, 20 nt, Mycobacterium tuberculosis H37Rv
cuggcguagugcucgccggc

SEQ ID NO: 3254118 - RNA, 22 nt, Mycobacterium tuberculosis H37Rv
cuggcguagugcucgccggcac

SEQ ID NO: 3254119 - RNA, 23 nt, Mycobacterium tuberculosis H37Rv
cuggcgucaccgcggguggaugu

SEQ ID NO: 3254120 - RNA, 14 nt, Mycobacterium tuberculosis H37Rv
cuggcgucgaugcc

SEQ ID NO: 3254121 - RNA, 15 nt, Mycobacterium tuberculosis H37Rv
cuggcgucgaugucg

SEQ ID NO: 3254122 - RNA, 17 nt, Mycobacterium tuberculosis H37Rv
cuggcgucgucuucggu

SEQ ID NO: 3254123 - RNA, 19 nt, Mycobacterium tuberculosis H37Rv
cuggcgucgucuucgguua

SEQ ID NO: 3254124 - RNA, 15 nt, Mycobacterium tuberculosis H37Rv
cuggcgugucgccgc

SEQ ID NO: 3254125 - RNA, 18 nt, Mycobacterium tuberculosis H37Rv
cuggcgugucgccgccac

SEQ ID NO: 3254126 - RNA, 12 nt, Mycobacterium tuberculosis H37Rv
cuggcguucagc

SEQ ID NO: 3254127 - RNA, 15 nt, Mycobacterium tuberculosis H37Rv
cuggcguugccaccg

SEQ ID NO: 3254128 - RNA, 22 nt, Mycobacterium tuberculosis H37Rv
cuggcguugcugaugucgccgg

SEQ ID NO: 3254129 - RNA, 19 nt, Mycobacterium tuberculosis H37Rv
cuggcguuguugacgauca

SEQ ID NO: 3254130 - RNA, 15 nt, Mycobacterium tuberculosis H37Rv
cuggcuacgccuccu

SEQ ID NO: 3254131 - RNA, 17 nt, Mycobacterium tuberculosis H37Rv
cuggcuacgggccgcgg

SEQ ID NO: 3254132 - RNA, 16 nt, Mycobacterium tuberculosis H37Rv
cuggucgaccaucggu

SEQ ID NO: 3254133 - RNA, 16 nt, Mycobacterium tuberculosis H37Rv
cuggucgaccggcguu

SEQ ID NO: 3254134 - RNA, 17 nt, Mycobacterium tuberculosis H37Rv
cuggucgaccggcguug

SEQ ID NO: 3254135 - RNA, 20 nt, Mycobacterium tuberculosis H37Rv
cuggucgacgaaucugcggu

SEQ ID NO: 3254136 - RNA, 15 nt, Mycobacterium tuberculosis H37Rv
cuggucgagcacgcu

SEQ ID NO: 3254137 - RNA, 22 nt, Mycobacterium tuberculosis H37Rv
cuggucgagcacgcugcugcgg

SEQ ID NO: 3254138 - RNA, 22 nt, Mycobacterium tuberculosis H37Rv
cuggucgauggcguacagcacc

SEQ ID NO: 3254139 - RNA, 14 nt, Mycobacterium tuberculosis H37Rv
cuggucgcaauggu

SEQ ID NO: 3254140 - RNA, 16 nt, Mycobacterium tuberculosis H37Rv
cuggucgcgcagcucc

SEQ ID NO: 3254141 - RNA, 22 nt, Mycobacterium tuberculosis H37Rv
cuggucgcguaccaacaggaug

SEQ ID NO: 3254142 - RNA, 18 nt, Mycobacterium tuberculosis H37Rv
cuggucgcguccacccac

SEQ ID NO: 3254143 - RNA, 20 nt, Mycobacterium tuberculosis H37Rv
cuggucgcuggugcacggcu

SEQ ID NO: 3254144 - RNA, 24 nt, Mycobacterium tuberculosis H37Rv
cuggucggccaggucgagcaccgg

SEQ ID NO: 3254145 - RNA, 18 nt, Mycobacterium tuberculosis H37Rv
cuggucggcuaccgccga

SEQ ID NO: 3254146 - RNA, 19 nt, Mycobacterium tuberculosis H37Rv
cuggucggcuaccgccgac

SEQ ID NO: 3254147 - RNA, 23 nt, Mycobacterium tuberculosis H37Rv
cuggucggugggcuugccgcgca

SEQ ID NO: 3254148 - RNA, 14 nt, Mycobacterium tuberculosis H37Rv
cuggucgugccgcc

SEQ ID NO: 3254149 - RNA, 18 nt, Mycobacterium tuberculosis H37Rv
cuggucgugccgccgucg

SEQ ID NO: 3254150 - RNA, 17 nt, Mycobacterium tuberculosis H37Rv
cuggucgugggccacca

SEQ ID NO: 3254151 - RNA, 20 nt, Mycobacterium tuberculosis H37Rv
cuggucgugggccaccaccu

SEQ ID NO: 3254152 - RNA, 15 nt, Mycobacterium tuberculosis H37Rv
cuggucuugacucca

SEQ ID NO: 3254153 - RNA, 19 nt, Mycobacterium tuberculosis H37Rv
cuggugaucagcucaguga

SEQ ID NO: 3254154 - RNA, 19 nt, Mycobacterium tuberculosis H37Rv
cuggugaucugcugggcaa

SEQ ID NO: 3254155 - RNA, 23 nt, Mycobacterium tuberculosis H37Rv
cuggugcagaauucggcgcgaca

SEQ ID NO: 3254156 - RNA, 21 nt, Mycobacterium tuberculosis H37Rv
cuggugcccgacccgccgaug

SEQ ID NO: 3254157 - RNA, 23 nt, Mycobacterium tuberculosis H37Rv
cuggugcccgacccgccgaugau

SEQ ID NO: 3254158 - RNA, 15 nt, Mycobacterium tuberculosis H37Rv
cuggugccuuaccac

SEQ ID NO: 3254159 - RNA, 22 nt, Mycobacterium tuberculosis H37Rv
cuggugccuuaccaccgucucc

SEQ ID NO: 3254160 - RNA, 18 nt, Mycobacterium tuberculosis H37Rv
cuggugcgccacgccacc

SEQ ID NO: 3254161 - RNA, 19 nt, Mycobacterium tuberculosis H37Rv
cuggugcgcggagggcgcc

SEQ ID NO: 3254162 - RNA, 14 nt, Mycobacterium tuberculosis H37Rv
cuggugcgggacgc

SEQ ID NO: 3254163 - RNA, 16 nt, Mycobacterium tuberculosis H37Rv
cuggugcguagcccac

SEQ ID NO: 3254164 - RNA, 19 nt, Mycobacterium tuberculosis H37Rv
cuggugcguagcccacccg

SEQ ID NO: 3254165 - RNA, 16 nt, Mycobacterium tuberculosis H37Rv
cugguggcagcgcacc

SEQ ID NO: 3254166 - RNA, 23 nt, Mycobacterium tuberculosis H37Rv
cugguggcgcugaagccgacgau

SEQ ID NO: 3254167 - RNA, 19 nt, Mycobacterium tuberculosis H37Rv
cugguggcggcacuggccc

SEQ ID NO: 3254168 - RNA, 20 nt, Mycobacterium tuberculosis H37Rv
cugguggcggcacuggcccc

SEQ ID NO: 3254169 - RNA, 14 nt, Mycobacterium tuberculosis H37Rv
cuggugggccaucg

SEQ ID NO: 3254170 - RNA, 18 nt, Mycobacterium tuberculosis H37Rv
cuggugggccaucgucag

SEQ ID NO: 3254171 - RNA, 15 nt, Mycobacterium tuberculosis H37Rv
cugguggucagcacc

SEQ ID NO: 3254172 - RNA, 20 nt, Mycobacterium tuberculosis H37Rv
cugguguagaccgaaauggu

SEQ ID NO: 3254173 - RNA, 17 nt, Mycobacterium tuberculosis H37Rv
cugguguagccgagcac

SEQ ID NO: 3254174 - RNA, 19 nt, Mycobacterium tuberculosis H37Rv
cugguguccaccgcaaagg

SEQ ID NO: 3254175 - RNA, 13 nt, Mycobacterium tuberculosis H37Rv
cuggugucgaucg

SEQ ID NO: 3254176 - RNA, 20 nt, Mycobacterium tuberculosis H37Rv
cuggugugacgauccccauu

SEQ ID NO: 3254177 - RNA, 20 nt, Mycobacterium tuberculosis H37Rv
cuggugugccgcguugccgg

SEQ ID NO: 3254178 - RNA, 16 nt, Mycobacterium tuberculosis H37Rv
cugguguuucaggcag

SEQ ID NO: 3254179 - RNA, 20 nt, Mycobacterium tuberculosis H37Rv
cugguuaccgaaggucauca

SEQ ID NO: 3254180 - RNA, 16 nt, Mycobacterium tuberculosis H37Rv
cugguucagccauucu

SEQ ID NO: 3254181 - RNA, 17 nt, Mycobacterium tuberculosis H37Rv
cugguucggguuggaga

SEQ ID NO: 3254182 - RNA, 22 nt, Mycobacterium tuberculosis H37Rv
cugguugaacauguccagugcc

SEQ ID NO: 3254183 - RNA, 18 nt, Mycobacterium tuberculosis H37Rv
cugguuggcuucucccgc

SEQ ID NO: 3254184 - RNA, 18 nt, Mycobacterium tuberculosis H37Rv
cugguugggagcuacggu

SEQ ID NO: 3254185 - RNA, 18 nt, Mycobacterium tuberculosis H37Rv
cugguugggccagcuccu

SEQ ID NO: 3254186 - RNA, 19 nt, Mycobacterium tuberculosis H37Rv
cugguugggccagcuccug

SEQ ID NO: 3254187 - RNA, 21 nt, Mycobacterium tuberculosis H37Rv
cugguugggggucgggcucgg

SEQ ID NO: 3254188 - RNA, 20 nt, Mycobacterium tuberculosis H37Rv
cuguacaacgacacgccgca

SEQ ID NO: 3254189 - RNA, 19 nt, Mycobacterium tuberculosis H37Rv
cuguacauacucugcgaca

SEQ ID NO: 3254190 - RNA, 14 nt, Mycobacterium tuberculosis H37Rv
cuguaccgggcgac

SEQ ID NO: 3254191 - RNA, 17 nt, Mycobacterium tuberculosis H37Rv
cuguacggaucaggccc

SEQ ID NO: 3254192 - RNA, 22 nt, Mycobacterium tuberculosis H37Rv
cuguacggaucaggcccgggcg

SEQ ID NO: 3254193 - RNA, 12 nt, Mycobacterium tuberculosis H37Rv
cuguagcgaaug

SEQ ID NO: 3254194 - RNA, 21 nt, Mycobacterium tuberculosis H37Rv
cuguagcgaaugaucuugcca

SEQ ID NO: 3254195 - RNA, 22 nt, Mycobacterium tuberculosis H37Rv
cuguagcgaaugaucuugccac

SEQ ID NO: 3254196 - RNA, 15 nt, Mycobacterium tuberculosis H37Rv
cuguagcgucgcacc

SEQ ID NO: 3254197 - RNA, 15 nt, Mycobacterium tuberculosis H37Rv
cuguaggcgaccaga

SEQ ID NO: 3254198 - RNA, 13 nt, Mycobacterium tuberculosis H37Rv
cuguaggcgauca

SEQ ID NO: 3254199 - RNA, 19 nt, Mycobacterium tuberculosis H37Rv
cuguagggccggugacuca

SEQ ID NO: 3254200 - RNA, 22 nt, Mycobacterium tuberculosis H37Rv
cuguagucccucaucaccucuc

SEQ ID NO: 3254201 - RNA, 18 nt, Mycobacterium tuberculosis H37Rv
cugucaagcgggcuggcg

SEQ ID NO: 3254202 - RNA, 14 nt, Mycobacterium tuberculosis H37Rv
cugucacgccugcc

SEQ ID NO: 3254203 - RNA, 19 nt, Mycobacterium tuberculosis H37Rv
cugucacgccugccaccgg

SEQ ID NO: 3254204 - RNA, 17 nt, Mycobacterium tuberculosis H37Rv
cugucagcgauccucgc

SEQ ID NO: 3254205 - RNA, 17 nt, Mycobacterium tuberculosis H37Rv
cugucauguccugggcc

SEQ ID NO: 3254206 - RNA, 15 nt, Mycobacterium tuberculosis H37Rv
cugucauugcugccc

SEQ ID NO: 3254207 - RNA, 22 nt, Mycobacterium tuberculosis H37Rv
cuguccaccgaggccugacuga

SEQ ID NO: 3254208 - RNA, 21 nt, Mycobacterium tuberculosis H37Rv
cuguccaccgaugccacaucg

SEQ ID NO: 3254209 - RNA, 16 nt, Mycobacterium tuberculosis H37Rv
cuguccacguccagcc

SEQ ID NO: 3254210 - RNA, 18 nt, Mycobacterium tuberculosis H37Rv
cuguccacugccaccgcg

SEQ ID NO: 3254211 - RNA, 23 nt, Mycobacterium tuberculosis H37Rv
cuguccaggucugggcuuugcag

SEQ ID NO: 3254212 - RNA, 17 nt, Mycobacterium tuberculosis H37Rv
cugucccaccagguacg

SEQ ID NO: 3254213 - RNA, 15 nt, Mycobacterium tuberculosis H37Rv
cugucccagcccggc

SEQ ID NO: 3254214 - RNA, 17 nt, Mycobacterium tuberculosis H37Rv
cugucccagcccggccc

SEQ ID NO: 3254215 - RNA, 16 nt, Mycobacterium tuberculosis H37Rv
cugucccgcacccggc

SEQ ID NO: 3254216 - RNA, 20 nt, Mycobacterium tuberculosis H37Rv
cugucccugcaguccacuga

SEQ ID NO: 3254217 - RNA, 17 nt, Mycobacterium tuberculosis H37Rv
cuguccgaaccgacguu

SEQ ID NO: 3254218 - RNA, 20 nt, Mycobacterium tuberculosis H37Rv
cuguccgaccucgccgcgcg

SEQ ID NO: 3254219 - RNA, 23 nt, Mycobacterium tuberculosis H37Rv
cuguccgggcuguuggccaccaa

SEQ ID NO: 3254220 - RNA, 21 nt, Mycobacterium tuberculosis H37Rv
cuguccggguagcggcgccgc

SEQ ID NO: 3254221 - RNA, 13 nt, Mycobacterium tuberculosis H37Rv
cuguccgguggaa

SEQ ID NO: 3254222 - RNA, 14 nt, Mycobacterium tuberculosis H37Rv
cuguccugccagaa

SEQ ID NO: 3254223 - RNA, 15 nt, Mycobacterium tuberculosis H37Rv
cugucgaagauccag

SEQ ID NO: 3254224 - RNA, 14 nt, Mycobacterium tuberculosis H37Rv
cugucgaccgccac

SEQ ID NO: 3254225 - RNA, 22 nt, Mycobacterium tuberculosis H37Rv
cugucgaccgccacguaauucc

SEQ ID NO: 3254226 - RNA, 15 nt, Mycobacterium tuberculosis H37Rv
cugucgacgucggca

SEQ ID NO: 3254227 - RNA, 13 nt, Mycobacterium tuberculosis H37Rv
cuucaccacccug

SEQ ID NO: 3254228 - RNA, 15 nt, Mycobacterium tuberculosis H37Rv
cuucaccacccuguu

SEQ ID NO: 3254229 - RNA, 13 nt, Mycobacterium tuberculosis H37Rv
cuucaccacgccg

SEQ ID NO: 3254230 - RNA, 15 nt, Mycobacterium tuberculosis H37Rv
cuucaccacgccgua

SEQ ID NO: 3254231 - RNA, 14 nt, Mycobacterium tuberculosis H37Rv
cuucaccagcugcg

SEQ ID NO: 3254232 - RNA, 15 nt, Mycobacterium tuberculosis H37Rv
cuucacccaacggug

SEQ ID NO: 3254233 - RNA, 12 nt, Mycobacterium tuberculosis H37Rv
cuucaccgccgu

SEQ ID NO: 3254234 - RNA, 14 nt, Mycobacterium tuberculosis H37Rv
cuucaccgccuugg

SEQ ID NO: 3254235 - RNA, 13 nt, Mycobacterium tuberculosis H37Rv
cuucaccuggaag

SEQ ID NO: 3254236 - RNA, 24 nt, Mycobacterium tuberculosis H37Rv
cuucaccuggaaggucagcgcccu

SEQ ID NO: 3254237 - RNA, 20 nt, Mycobacterium tuberculosis H37Rv
cuucacgcuggccuccagcu

SEQ ID NO: 3254238 - RNA, 18 nt, Mycobacterium tuberculosis H37Rv
cuucacgggccguccagg

SEQ ID NO: 3254239 - RNA, 19 nt, Mycobacterium tuberculosis H37Rv
cuucacgggccguccagga

SEQ ID NO: 3254240 - RNA, 20 nt, Mycobacterium tuberculosis H37Rv
cuucacuaauaggcacuaga

SEQ ID NO: 3254241 - RNA, 21 nt, Mycobacterium tuberculosis H37Rv
cuucacuaauaggcacuagac

SEQ ID NO: 3254242 - RNA, 20 nt, Mycobacterium tuberculosis H37Rv
cuucacuguugcccuuggga

SEQ ID NO: 3254243 - RNA, 21 nt, Mycobacterium tuberculosis H37Rv
cuucagcacgcgggagaucuc

SEQ ID NO: 3254244 - RNA, 13 nt, Mycobacterium tuberculosis H37Rv
cuucagcaggccc

SEQ ID NO: 3254245 - RNA, 14 nt, Mycobacterium tuberculosis H37Rv
cuucagccagucca

SEQ ID NO: 3254246 - RNA, 13 nt, Mycobacterium tuberculosis H37Rv
cuucagcgcggca

SEQ ID NO: 3254247 - RNA, 17 nt, Mycobacterium tuberculosis H37Rv
cuucagcguccugguga

SEQ ID NO: 3254248 - RNA, 16 nt, Mycobacterium tuberculosis H37Rv
cuucaggcaccggaug

SEQ ID NO: 3254249 - RNA, 17 nt, Mycobacterium tuberculosis H37Rv
cuucaggcaucaccgga

SEQ ID NO: 3254250 - RNA, 18 nt, Mycobacterium tuberculosis H37Rv
cuucaggcccucgggacu

SEQ ID NO: 3254251 - RNA, 16 nt, Mycobacterium tuberculosis H37Rv
cuucaggcgccacugc

SEQ ID NO: 3254252 - RNA, 17 nt, Mycobacterium tuberculosis H37Rv
cuucaggcgccacugcu

SEQ ID NO: 3254253 - RNA, 14 nt, Mycobacterium tuberculosis H37Rv
cuucagguccaccg

SEQ ID NO: 3254254 - RNA, 17 nt, Mycobacterium tuberculosis H37Rv
cuucaguccggcccccc

SEQ ID NO: 3254255 - RNA, 17 nt, Mycobacterium tuberculosis H37Rv
cuucaucaacgacacca

SEQ ID NO: 3254256 - RNA, 19 nt, Mycobacterium tuberculosis H37Rv
cuucaucaacgacaccaga

SEQ ID NO: 3254257 - RNA, 17 nt, Mycobacterium tuberculosis H37Rv
cuucaucgccucgagga

SEQ ID NO: 3254258 - RNA, 20 nt, Mycobacterium tuberculosis H37Rv
cuucaucgccucgaggacca

SEQ ID NO: 3254259 - RNA, 23 nt, Mycobacterium tuberculosis H37Rv
cuucaucuucgaggucugguaga

SEQ ID NO: 3254260 - RNA, 15 nt, Mycobacterium tuberculosis H37Rv
cuuccaacaccaacg

SEQ ID NO: 3254261 - RNA, 20 nt, Mycobacterium tuberculosis H37Rv
cuuccaacucggcggccagc

SEQ ID NO: 3254262 - RNA, 23 nt, Mycobacterium tuberculosis H37Rv
cuuccaauugauaggccccgagg

SEQ ID NO: 3254263 - RNA, 19 nt, Mycobacterium tuberculosis H37Rv
cuuccagccacagcccggc

SEQ ID NO: 3254264 - RNA, 13 nt, Mycobacterium tuberculosis H37Rv
cuuccauaacgac

SEQ ID NO: 3254265 - RNA, 13 nt, Mycobacterium tuberculosis H37Rv
cuuccaucgccac

SEQ ID NO: 3254266 - RNA, 18 nt, Mycobacterium tuberculosis H37Rv
cuuccauuucggaacgcc

SEQ ID NO: 3254267 - RNA, 21 nt, Mycobacterium tuberculosis H37Rv
cuucccaguagaucgccucga

SEQ ID NO: 3254268 - RNA, 17 nt, Mycobacterium tuberculosis H37Rv
cuucccauuucggcaaa

SEQ ID NO: 3254269 - RNA, 12 nt, Mycobacterium tuberculosis H37Rv
cuucccuccaga

SEQ ID NO: 3254270 - RNA, 23 nt, Mycobacterium tuberculosis H37Rv
cuucccuccagauaccaccgccg

SEQ ID NO: 3254271 - RNA, 16 nt, Mycobacterium tuberculosis H37Rv
cuuccgacgaccaggu

SEQ ID NO: 3254272 - RNA, 14 nt, Mycobacterium tuberculosis H37Rv
cuuccgcagcgcca

SEQ ID NO: 3254273 - RNA, 23 nt, Mycobacterium tuberculosis H37Rv
cuuccgcgacgcucgcugcagca

SEQ ID NO: 3254274 - RNA, 23 nt, Mycobacterium tuberculosis H37Rv
cuuccgcgcgcagaugagcgcgg

SEQ ID NO: 3254275 - RNA, 19 nt, Mycobacterium tuberculosis H37Rv
cuuccggaacaaaggcuug

SEQ ID NO: 3254276 - RNA, 14 nt, Mycobacterium tuberculosis H37Rv
cuuccggcgcgacc

SEQ ID NO: 3254277 - RNA, 15 nt, Mycobacterium tuberculosis H37Rv
cuuccguggcccaac

SEQ ID NO: 3254278 - RNA, 19 nt, Mycobacterium tuberculosis H37Rv
cuuccucggauugcagcgc

SEQ ID NO: 3254279 - RNA, 16 nt, Mycobacterium tuberculosis H37Rv
cuuccucggccacccg

SEQ ID NO: 3254280 - RNA, 17 nt, Mycobacterium tuberculosis H37Rv
cuuccucggccacccgc

SEQ ID NO: 3254281 - RNA, 21 nt, Mycobacterium tuberculosis H37Rv
cuuccucguaggcguacacca

SEQ ID NO: 3254282 - RNA, 22 nt, Mycobacterium tuberculosis H37Rv
cuuccugaggguuuccaagucg

SEQ ID NO: 3254283 - RNA, 21 nt, Mycobacterium tuberculosis H37Rv
cuuccugauuucaacggucaa

SEQ ID NO: 3254284 - RNA, 19 nt, Mycobacterium tuberculosis H37Rv
cuuccuggguuggcaucca

SEQ ID NO: 3254285 - RNA, 21 nt, Mycobacterium tuberculosis H37Rv
cuucgaaccguuucgccggcg

SEQ ID NO: 3254286 - RNA, 14 nt, Mycobacterium tuberculosis H37Rv
cuucgacagcggcg

SEQ ID NO: 3254287 - RNA, 22 nt, Mycobacterium tuberculosis H37Rv
cuucgaccaucaccacggccgc

SEQ ID NO: 3254288 - RNA, 17 nt, Mycobacterium tuberculosis H37Rv
cuucgacgcggcgaccg

SEQ ID NO: 3254289 - RNA, 18 nt, Mycobacterium tuberculosis H37Rv
cuucgacgcggcgaccgu

SEQ ID NO: 3254290 - RNA, 16 nt, Mycobacterium tuberculosis H37Rv
cuucgacgcuuccugg

SEQ ID NO: 3254291 - RNA, 14 nt, Mycobacterium tuberculosis H37Rv
cuucgacggcggcc

SEQ ID NO: 3254292 - RNA, 15 nt, Mycobacterium tuberculosis H37Rv
cuucgacguugcgga

SEQ ID NO: 3254293 - RNA, 12 nt, Mycobacterium tuberculosis H37Rv
cuucgagcaccg

SEQ ID NO: 3254294 - RNA, 15 nt, Mycobacterium tuberculosis H37Rv
cuucgagccggcggc

SEQ ID NO: 3254295 - RNA, 18 nt, Mycobacterium tuberculosis H37Rv
cuucgaguuuggcgacga

SEQ ID NO: 3254296 - RNA, 18 nt, Mycobacterium tuberculosis H37Rv
cuucgaguuuggugucga

SEQ ID NO: 3254297 - RNA, 16 nt, Mycobacterium tuberculosis H37Rv
cuucgauaccgaccga

SEQ ID NO: 3254298 - RNA, 16 nt, Mycobacterium tuberculosis H37Rv
cuucgaucagcggcag

SEQ ID NO: 3254299 - RNA, 20 nt, Mycobacterium tuberculosis H37Rv
cuucgaucaucgaccuggcc

SEQ ID NO: 3254300 - RNA, 22 nt, Mycobacterium tuberculosis H37Rv
cuucgaucaucgaccuggccac

SEQ ID NO: 3254301 - RNA, 19 nt, Mycobacterium tuberculosis H37Rv
cuucgaucuccaggcccgg

SEQ ID NO: 3254302 - RNA, 23 nt, Mycobacterium tuberculosis H37Rv
cuucgauggccaugguggagauu

SEQ ID NO: 3254303 - RNA, 19 nt, Mycobacterium tuberculosis H37Rv
cuucgccaacugcggcagg

SEQ ID NO: 3254304 - RNA, 13 nt, Mycobacterium tuberculosis H37Rv
cuucgccagcggc

SEQ ID NO: 3254305 - RNA, 23 nt, Mycobacterium tuberculosis H37Rv
cuucgcccagagccgcugcggca

SEQ ID NO: 3254306 - RNA, 18 nt, Mycobacterium tuberculosis H37Rv
cuucgcccggcugcgccg

SEQ ID NO: 3254307 - RNA, 21 nt, Mycobacterium tuberculosis H37Rv
cuucgcccggcugcgccgggc

SEQ ID NO: 3254308 - RNA, 16 nt, Mycobacterium tuberculosis H37Rv
cuucgcccuugccgca

SEQ ID NO: 3254309 - RNA, 15 nt, Mycobacterium tuberculosis H37Rv
cuucgccgcccgcag

SEQ ID NO: 3254310 - RNA, 20 nt, Mycobacterium tuberculosis H37Rv
cuucgccgcccgcagggccg

SEQ ID NO: 3254311 - RNA, 20 nt, Mycobacterium tuberculosis H37Rv
cuucgccgcgcagccuucuc

SEQ ID NO: 3254312 - RNA, 16 nt, Mycobacterium tuberculosis H37Rv
cuucgccggcgccagc

SEQ ID NO: 3254313 - RNA, 22 nt, Mycobacterium tuberculosis H37Rv
cuucgccggcgccagcagaucu

SEQ ID NO: 3254314 - RNA, 22 nt, Mycobacterium tuberculosis H37Rv
cuucgcgaagaacgacgccacc

SEQ ID NO: 3254315 - RNA, 18 nt, Mycobacterium tuberculosis H37Rv
cuucgcgcagccggucag

SEQ ID NO: 3254316 - RNA, 16 nt, Mycobacterium tuberculosis H37Rv
cuucgcgcgcugggcg

SEQ ID NO: 3254317 - RNA, 17 nt, Mycobacterium tuberculosis H37Rv
cuucgcggcggucguug

SEQ ID NO: 3254318 - RNA, 20 nt, Mycobacterium tuberculosis H37Rv
cuucgcggugugcggcagcc

SEQ ID NO: 3254319 - RNA, 21 nt, Mycobacterium tuberculosis H37Rv
cuucgcggugugcggcagccc

SEQ ID NO: 3254320 - RNA, 22 nt, Mycobacterium tuberculosis H37Rv
cuucgcggugugcggcagcccg

SEQ ID NO: 3254321 - RNA, 21 nt, Mycobacterium tuberculosis H37Rv
cuucgcgguuggcggcgaugg

SEQ ID NO: 3254322 - RNA, 19 nt, Mycobacterium tuberculosis H37Rv
cuucgcuauggcggcuucg

SEQ ID NO: 3254323 - RNA, 12 nt, Mycobacterium tuberculosis H37Rv
cuugcagcgccc

SEQ ID NO: 3254324 - RNA, 14 nt, Mycobacterium tuberculosis H37Rv
cuugcagcgcguuc

SEQ ID NO: 3254325 - RNA, 17 nt, Mycobacterium tuberculosis H37Rv
cuugcaggcgucccagc

SEQ ID NO: 3254326 - RNA, 18 nt, Mycobacterium tuberculosis H37Rv
cuugcaggcgucccagcc

SEQ ID NO: 3254327 - RNA, 21 nt, Mycobacterium tuberculosis H37Rv
cuugcaguaacuucaccggcu

SEQ ID NO: 3254328 - RNA, 15 nt, Mycobacterium tuberculosis H37Rv
cuugcagugagguca

SEQ ID NO: 3254329 - RNA, 22 nt, Mycobacterium tuberculosis H37Rv
cuugccaaucgccgucagcacc

SEQ ID NO: 3254330 - RNA, 23 nt, Mycobacterium tuberculosis H37Rv
cuugccaaucgccgucagcaccg

SEQ ID NO: 3254331 - RNA, 23 nt, Mycobacterium tuberculosis H37Rv
cuugccacggcgauuccuccggu

SEQ ID NO: 3254332 - RNA, 15 nt, Mycobacterium tuberculosis H37Rv
cuugccacuccagga

SEQ ID NO: 3254333 - RNA, 14 nt, Mycobacterium tuberculosis H37Rv
cuugcccagcgaca

SEQ ID NO: 3254334 - RNA, 16 nt, Mycobacterium tuberculosis H37Rv
cuugcccagcgacaug

SEQ ID NO: 3254335 - RNA, 12 nt, Mycobacterium tuberculosis H37Rv
cuugccccgccg

SEQ ID NO: 3254336 - RNA, 22 nt, Mycobacterium tuberculosis H37Rv
cuugccccgccgagcaccgggc

SEQ ID NO: 3254337 - RNA, 20 nt, Mycobacterium tuberculosis H37Rv
cuugccccgccuuggccacc

SEQ ID NO: 3254338 - RNA, 13 nt, Mycobacterium tuberculosis H37Rv
cuugcccgacggc

SEQ ID NO: 3254339 - RNA, 23 nt, Mycobacterium tuberculosis H37Rv
cuugcccgagcccagccgggcac

SEQ ID NO: 3254340 - RNA, 16 nt, Mycobacterium tuberculosis H37Rv
cuugcccgcgcagcac

SEQ ID NO: 3254341 - RNA, 14 nt, Mycobacterium tuberculosis H37Rv
cuugccgaccccgg

SEQ ID NO: 3254342 - RNA, 16 nt, Mycobacterium tuberculosis H37Rv
cuugccgaccggucag

SEQ ID NO: 3254343 - RNA, 13 nt, Mycobacterium tuberculosis H37Rv
cuugccgauuccg

SEQ ID NO: 3254344 - RNA, 18 nt, Mycobacterium tuberculosis H37Rv
cuugccgccauuccagcc

SEQ ID NO: 3254345 - RNA, 18 nt, Mycobacterium tuberculosis H37Rv
cuugccgcccgcuccgcc

SEQ ID NO: 3254346 - RNA, 19 nt, Mycobacterium tuberculosis H37Rv
cuugccgccggccccgccg

SEQ ID NO: 3254347 - RNA, 17 nt, Mycobacterium tuberculosis H37Rv
cuugccgccguugauga

SEQ ID NO: 3254348 - RNA, 16 nt, Mycobacterium tuberculosis H37Rv
cuugccgccuuggccc

SEQ ID NO: 3254349 - RNA, 17 nt, Mycobacterium tuberculosis H37Rv
cuugccggguuugauca

SEQ ID NO: 3254350 - RNA, 21 nt, Mycobacterium tuberculosis H37Rv
cuugccggguuugaucagcuc

SEQ ID NO: 3254351 - RNA, 23 nt, Mycobacterium tuberculosis H37Rv
cuugccggguuugaucagcucgg

SEQ ID NO: 3254352 - RNA, 15 nt, Mycobacterium tuberculosis H37Rv
cuugccgucgcugac

SEQ ID NO: 3254353 - RNA, 16 nt, Mycobacterium tuberculosis H37Rv
cuugccgucgcugacg

SEQ ID NO: 3254354 - RNA, 23 nt, Mycobacterium tuberculosis H37Rv
cuugccgucgcugacgcccuccu

SEQ ID NO: 3254355 - RNA, 15 nt, Mycobacterium tuberculosis H37Rv
cuugccuagccgcag

SEQ ID NO: 3254356 - RNA, 12 nt, Mycobacterium tuberculosis H37Rv
cuugccuccggc

SEQ ID NO: 3254357 - RNA, 19 nt, Mycobacterium tuberculosis H37Rv
cuugccuccggcgccgccc

SEQ ID NO: 3254358 - RNA, 21 nt, Mycobacterium tuberculosis H37Rv
cuugcgaucggcacuuagccc

SEQ ID NO: 3254359 - RNA, 14 nt, Mycobacterium tuberculosis H37Rv
cuugcgcagcaccg

SEQ ID NO: 3254360 - RNA, 18 nt, Mycobacterium tuberculosis H37Rv
cuugcgcagccgcagccg

SEQ ID NO: 3254361 - RNA, 22 nt, Mycobacterium tuberculosis H37Rv
cuugcgccgcccaugccuccag

SEQ ID NO: 3254362 - RNA, 23 nt, Mycobacterium tuberculosis H37Rv
cuugcgccggaugacaccgaccg

SEQ ID NO: 3254363 - RNA, 21 nt, Mycobacterium tuberculosis H37Rv
cuugcgcgcaggugcugggcg

SEQ ID NO: 3254364 - RNA, 14 nt, Mycobacterium tuberculosis H37Rv
cuugcggagccgcc

SEQ ID NO: 3254365 - RNA, 15 nt, Mycobacterium tuberculosis H37Rv
cuugcggagccgccg

SEQ ID NO: 3254366 - RNA, 22 nt, Mycobacterium tuberculosis H37Rv
cuugcggcacaacagaauucga

SEQ ID NO: 3254367 - RNA, 19 nt, Mycobacterium tuberculosis H37Rv
cuugcggcacccagucggc

SEQ ID NO: 3254368 - RNA, 22 nt, Mycobacterium tuberculosis H37Rv
cuugcggcacccagucggcgcc

SEQ ID NO: 3254369 - RNA, 14 nt, Mycobacterium tuberculosis H37Rv
cuugcggccgggcg

SEQ ID NO: 3254370 - RNA, 21 nt, Mycobacterium tuberculosis H37Rv
cuugcggcgugaugucuacca

SEQ ID NO: 3254371 - RNA, 20 nt, Mycobacterium tuberculosis H37Rv
cuugcgguucggacacacag

SEQ ID NO: 3254372 - RNA, 15 nt, Mycobacterium tuberculosis H37Rv
cuugcguagcucacg

SEQ ID NO: 3254373 - RNA, 17 nt, Mycobacterium tuberculosis H37Rv
cuugcgucaucggcuca

SEQ ID NO: 3254374 - RNA, 19 nt, Mycobacterium tuberculosis H37Rv
cuugcgucgcggacggugc

SEQ ID NO: 3254375 - RNA, 16 nt, Mycobacterium tuberculosis H37Rv
cuugcguggcguuggu

SEQ ID NO: 3254376 - RNA, 14 nt, Mycobacterium tuberculosis H37Rv
cuugcucagccggc

SEQ ID NO: 3254377 - RNA, 15 nt, Mycobacterium tuberculosis H37Rv
cuugcucagccggcc

SEQ ID NO: 3254378 - RNA, 13 nt, Mycobacterium tuberculosis H37Rv
cuugcugcuccuu

SEQ ID NO: 3254379 - RNA, 14 nt, Mycobacterium tuberculosis H37Rv
cuuggaaggcgcgc

SEQ ID NO: 3254380 - RNA, 12 nt, Mycobacterium tuberculosis H37Rv
cuuggaccagcg

SEQ ID NO: 3254381 - RNA, 18 nt, Mycobacterium tuberculosis H37Rv
cuuggacccugcgccgcc

SEQ ID NO: 3254382 - RNA, 19 nt, Mycobacterium tuberculosis H37Rv
cuuggacccugcgccgcca

SEQ ID NO: 3254383 - RNA, 19 nt, Mycobacterium tuberculosis H37Rv
cuuggacgacccgggccgg

SEQ ID NO: 3254384 - RNA, 23 nt, Mycobacterium tuberculosis H37Rv
cuuggacgugguguaucgacggc

SEQ ID NO: 3254385 - RNA, 16 nt, Mycobacterium tuberculosis H37Rv
cuuggacucaucggcg

SEQ ID NO: 3254386 - RNA, 19 nt, Mycobacterium tuberculosis H37Rv
cuuggacugucccaccagg

SEQ ID NO: 3254387 - RNA, 16 nt, Mycobacterium tuberculosis H37Rv
cuuggauccggccgcc

SEQ ID NO: 3254388 - RNA, 21 nt, Mycobacterium tuberculosis H37Rv
cuuggaucgucgcuguggcuu

SEQ ID NO: 3254389 - RNA, 14 nt, Mycobacterium tuberculosis H37Rv
cuuggcaagccaag

SEQ ID NO: 3254390 - RNA, 13 nt, Mycobacterium tuberculosis H37Rv
cuuggcagcccag

SEQ ID NO: 3254391 - RNA, 14 nt, Mycobacterium tuberculosis H37Rv
cuuggccaccaucg

SEQ ID NO: 3254392 - RNA, 18 nt, Mycobacterium tuberculosis H37Rv
cuuggccagacccaccac

SEQ ID NO: 3254393 - RNA, 11 nt, Mycobacterium tuberculosis H37Rv
cuuggccagca

SEQ ID NO: 3254394 - RNA, 21 nt, Mycobacterium tuberculosis H37Rv
cuuggccagcagcagcgcuuc

SEQ ID NO: 3254395 - RNA, 17 nt, Mycobacterium tuberculosis H37Rv
cuuggccaugcugguca

SEQ ID NO: 3254396 - RNA, 18 nt, Mycobacterium tuberculosis H37Rv
cuuggccgcugccuucuu

SEQ ID NO: 3254397 - RNA, 21 nt, Mycobacterium tuberculosis H37Rv
cuuggccggcgguaagcccag

SEQ ID NO: 3254398 - RNA, 15 nt, Mycobacterium tuberculosis H37Rv
cuuggccguucggcg

SEQ ID NO: 3254399 - RNA, 15 nt, Mycobacterium tuberculosis H37Rv
cuuggccucagccac

SEQ ID NO: 3254400 - RNA, 16 nt, Mycobacterium tuberculosis H37Rv
cuuggccucagccacc

SEQ ID NO: 3254401 - RNA, 16 nt, Mycobacterium tuberculosis H37Rv
cuuggcgaucucaccu

SEQ ID NO: 3254402 - RNA, 18 nt, Mycobacterium tuberculosis H37Rv
cuuggcgcggcacccggu

SEQ ID NO: 3254403 - RNA, 19 nt, Mycobacterium tuberculosis H37Rv
cuuggcgcgguccuccaga

SEQ ID NO: 3254404 - RNA, 23 nt, Mycobacterium tuberculosis H37Rv
cuuggcggccaacggcuccgggc

SEQ ID NO: 3254405 - RNA, 17 nt, Mycobacterium tuberculosis H37Rv
cuuggcggccuuugucg

SEQ ID NO: 3254406 - RNA, 18 nt, Mycobacterium tuberculosis H37Rv
cuuggcggccuuugucgc

SEQ ID NO: 3254407 - RNA, 13 nt, Mycobacterium tuberculosis H37Rv
cuuggcggcggca

SEQ ID NO: 3254408 - RNA, 16 nt, Mycobacterium tuberculosis H37Rv
cuuggcgggaccguga

SEQ ID NO: 3254409 - RNA, 21 nt, Mycobacterium tuberculosis H37Rv
cuuggcgggagccuugguagc

SEQ ID NO: 3254410 - RNA, 17 nt, Mycobacterium tuberculosis H37Rv
cuuggcgguggcccgau

SEQ ID NO: 3254411 - RNA, 22 nt, Mycobacterium tuberculosis H37Rv
cuuggcgucgacacccaccaac

SEQ ID NO: 3254412 - RNA, 15 nt, Mycobacterium tuberculosis H37Rv
cuuggcguugaccag

SEQ ID NO: 3254413 - RNA, 16 nt, Mycobacterium tuberculosis H37Rv
cuuggcugccuccauc

SEQ ID NO: 3254414 - RNA, 22 nt, Mycobacterium tuberculosis H37Rv
cuuggcugugauguuguucagc

SEQ ID NO: 3254415 - RNA, 14 nt, Mycobacterium tuberculosis H37Rv
cuugggaaacccgg

SEQ ID NO: 3254416 - RNA, 17 nt, Mycobacterium tuberculosis H37Rv
cuugggaccgacuugcc

SEQ ID NO: 3254417 - RNA, 14 nt, Mycobacterium tuberculosis H37Rv
cuugggaccgcgcc

SEQ ID NO: 3254418 - RNA, 12 nt, Mycobacterium tuberculosis H37Rv
cuugggccaggc

SEQ ID NO: 3254419 - RNA, 12 nt, Mycobacterium tuberculosis H37Rv
cuugggccggug

SEQ ID NO: 3254420 - RNA, 16 nt, Mycobacterium tuberculosis H37Rv
cuugggccugggccgc

SEQ ID NO: 3254421 - RNA, 20 nt, Mycobacterium tuberculosis H37Rv
cuugggcgacgcggcgccgc

SEQ ID NO: 3254422 - RNA, 22 nt, Mycobacterium tuberculosis H37Rv
cuugggcgacgcggcgccgcca

SEQ ID NO: 3254423 - RNA, 16 nt, Mycobacterium tuberculosis H37Rv
cuugggcgaucgucag

SEQ ID NO: 3254424 - RNA, 21 nt, Mycobacterium tuberculosis H37Rv
cuugggcggcacuggauccgg

SEQ ID NO: 3254425 - RNA, 17 nt, Mycobacterium tuberculosis H37Rv
cuugggcggugucgucg

SEQ ID NO: 3254426 - RNA, 23 nt, Mycobacterium tuberculosis H37Rv
cuugggcgucgucuugaccgcuu

SEQ ID NO: 3254427 - RNA, 12 nt, Mycobacterium tuberculosis H37Rv
cuugggcuucga

SEQ ID NO: 3254428 - RNA, 17 nt, Mycobacterium tuberculosis H37Rv
cuugggcuugcgccgga

SEQ ID NO: 3254429 - RNA, 21 nt, Mycobacterium tuberculosis H37Rv
cuuggggcguuguugggcgag

SEQ ID NO: 3254430 - RNA, 14 nt, Mycobacterium tuberculosis H37Rv
cuugggucuccgga

SEQ ID NO: 3254431 - RNA, 21 nt, Mycobacterium tuberculosis H37Rv
cuuggguggcgccguugucgg

SEQ ID NO: 3254432 - RNA, 23 nt, Mycobacterium tuberculosis H37Rv
cuuggguggcgccguugucggcg

SEQ ID NO: 3254433 - RNA, 18 nt, Mycobacterium tuberculosis H37Rv
cuuggguugauuggcccc

SEQ ID NO: 3254434 - RNA, 16 nt, Mycobacterium tuberculosis H37Rv
cuugguagccggccgc

SEQ ID NO: 3254435 - RNA, 14 nt, Mycobacterium tuberculosis H37Rv
cuuggucaccuucu

SEQ ID NO: 3254436 - RNA, 19 nt, Mycobacterium tuberculosis H37Rv
cuuggucaccuucuuggcg

SEQ ID NO: 3254437 - RNA, 23 nt, Mycobacterium tuberculosis H37Rv
cuuggucaggcuggaggugaacu

SEQ ID NO: 3254438 - RNA, 22 nt, Mycobacterium tuberculosis H37Rv
cuuggucgccgccuucuuggcg

SEQ ID NO: 3254439 - RNA, 13 nt, Mycobacterium tuberculosis H37Rv
cuuggucgccgcu

SEQ ID NO: 3254440 - RNA, 17 nt, Mycobacterium tuberculosis H37Rv
cuuggucuugaacccga

SEQ ID NO: 3254441 - RNA, 22 nt, Mycobacterium tuberculosis H37Rv
cuuggugaccugacgcucgguc

SEQ ID NO: 3254442 - RNA, 21 nt, Mycobacterium tuberculosis H37Rv
cuuggugcccaaggcagaccc

SEQ ID NO: 3254443 - RNA, 22 nt, Mycobacterium tuberculosis H37Rv
cuuggugcgcgucagccgcacc

SEQ ID NO: 3254444 - RNA, 13 nt, Mycobacterium tuberculosis H37Rv
cuugguggccacc

SEQ ID NO: 3254445 - RNA, 23 nt, Mycobacterium tuberculosis H37Rv
cuugguggcguggcccucggcga

SEQ ID NO: 3254446 - RNA, 20 nt, Mycobacterium tuberculosis H37Rv
cuugguuagccgcggcccgc

SEQ ID NO: 3254447 - RNA, 17 nt, Mycobacterium tuberculosis H37Rv
cuuguaaacgaagaacu

SEQ ID NO: 3254448 - RNA, 16 nt, Mycobacterium tuberculosis H37Rv
cuugucaaaggugcac

SEQ ID NO: 3254449 - RNA, 18 nt, Mycobacterium tuberculosis H37Rv
cuugucaaaggugcacug

SEQ ID NO: 3254450 - RNA, 14 nt, Mycobacterium tuberculosis H37Rv
cuuguccaccgugc

SEQ ID NO: 3254451 - RNA, 14 nt, Mycobacterium tuberculosis H37Rv
cuuguccagggugg

SEQ ID NO: 3254452 - RNA, 18 nt, Mycobacterium tuberculosis H37Rv
cuuguccaucacauccac

SEQ ID NO: 3254453 - RNA, 24 nt, Mycobacterium tuberculosis H37Rv
cuuguccaucacauccacgcacuc

SEQ ID NO: 3254454 - RNA, 14 nt, Mycobacterium tuberculosis H37Rv
cuuguccggcccgu

SEQ ID NO: 3254455 - RNA, 22 nt, Mycobacterium tuberculosis H37Rv
cuuguccggugguggcgacccc

SEQ ID NO: 3254456 - RNA, 15 nt, Mycobacterium tuberculosis H37Rv
cuugucgaccacgac

SEQ ID NO: 3254457 - RNA, 14 nt, Mycobacterium tuberculosis H37Rv
cuugucgccggcau

SEQ ID NO: 3254458 - RNA, 22 nt, Mycobacterium tuberculosis H37Rv
cuugucgccggcauacaccgug

SEQ ID NO: 3254459 - RNA, 23 nt, Mycobacterium tuberculosis H37Rv
cuugucgccggcauacaccguga

SEQ ID NO: 3254460 - RNA, 23 nt, Mycobacterium tuberculosis H37Rv
cuugucgcggugcggcagauacu

SEQ ID NO: 3254461 - RNA, 15 nt, Mycobacterium tuberculosis H37Rv
cuugucgcguucggc

SEQ ID NO: 3254462 - RNA, 14 nt, Mycobacterium tuberculosis H37Rv
cuugucggccccgg

SEQ ID NO: 3254463 - RNA, 23 nt, Mycobacterium tuberculosis H37Rv
cuugucgggcaccgguuugacgu

SEQ ID NO: 3254464 - RNA, 16 nt, Mycobacterium tuberculosis H37Rv
cuugucggggugcaca

SEQ ID NO: 3254465 - RNA, 19 nt, Mycobacterium tuberculosis H37Rv
cuugugcccaauagccgga

SEQ ID NO: 3254466 - RNA, 15 nt, Mycobacterium tuberculosis H37Rv
cuugugccccgagcu

SEQ ID NO: 3254467 - RNA, 14 nt, Mycobacterium tuberculosis H37Rv
cuuguggaaaucgg

SEQ ID NO: 3254468 - RNA, 18 nt, Mycobacterium tuberculosis H37Rv
cuuguggacccgccaggg

SEQ ID NO: 3254469 - RNA, 20 nt, Mycobacterium tuberculosis H37Rv
cuugugggcgacggcgauga

SEQ ID NO: 3254470 - RNA, 14 nt, Mycobacterium tuberculosis H37Rv
cuuguggucugcca

SEQ ID NO: 3254471 - RNA, 18 nt, Mycobacterium tuberculosis H37Rv
cuuguggugagcggaauc

SEQ ID NO: 3254472 - RNA, 18 nt, Mycobacterium tuberculosis H37Rv
cuuguucaucaucugguc

SEQ ID NO: 3254473 - RNA, 13 nt, Mycobacterium tuberculosis H37Rv
cuuguuccagcgc

SEQ ID NO: 3254474 - RNA, 14 nt, Mycobacterium tuberculosis H37Rv
cuuguucuuggcca

SEQ ID NO: 3254475 - RNA, 17 nt, Mycobacterium tuberculosis H37Rv
cuuguucuuggccaccc

SEQ ID NO: 3254476 - RNA, 15 nt, Mycobacterium tuberculosis H37Rv
cuuguugucgugcaa

SEQ ID NO: 3254477 - RNA, 14 nt, Mycobacterium tuberculosis H37Rv
cuuguuguggugga

SEQ ID NO: 3254478 - RNA, 14 nt, Mycobacterium tuberculosis H37Rv
cuuuaaaccccugg

SEQ ID NO: 3254479 - RNA, 17 nt, Mycobacterium tuberculosis H37Rv
cuuuagugucugcucgc

SEQ ID NO: 3254480 - RNA, 20 nt, Mycobacterium tuberculosis H37Rv
cuuucacaagccccgcgcgu

SEQ ID NO: 3254481 - RNA, 14 nt, Mycobacterium tuberculosis H37Rv
cuuucagcaggaga

SEQ ID NO: 3254482 - RNA, 19 nt, Mycobacterium tuberculosis H37Rv
cuuucccguugcugagcgu

SEQ ID NO: 3254483 - RNA, 16 nt, Mycobacterium tuberculosis H37Rv
cuuuccggccgccugc

SEQ ID NO: 3254484 - RNA, 20 nt, Mycobacterium tuberculosis H37Rv
cuuucgcgccgcgaggcacc

SEQ ID NO: 3254485 - RNA, 22 nt, Mycobacterium tuberculosis H37Rv
cuuucggcagacccgagcgcuc

SEQ ID NO: 3254486 - RNA, 18 nt, Mycobacterium tuberculosis H37Rv
cuuucggguccgacagcc

SEQ ID NO: 3254487 - RNA, 17 nt, Mycobacterium tuberculosis H37Rv
cuuucugcgcgugggca

SEQ ID NO: 3254488 - RNA, 14 nt, Mycobacterium tuberculosis H37Rv
cuuucugcggucaa

SEQ ID NO: 3254489 - RNA, 19 nt, Mycobacterium tuberculosis H37Rv
cuuugacaccggucggcag

SEQ ID NO: 3254490 - RNA, 18 nt, Mycobacterium tuberculosis H37Rv
cuuugacgcccggcaccc

SEQ ID NO: 3254491 - RNA, 20 nt, Mycobacterium tuberculosis H37Rv
cuuugacgcccggcaccccu

SEQ ID NO: 3254492 - RNA, 19 nt, Mycobacterium tuberculosis H37Rv
cuuugacgcccucggcgac

SEQ ID NO: 3254493 - RNA, 18 nt, Mycobacterium tuberculosis H37Rv
cuuugagcgcggccacca

SEQ ID NO: 3254494 - RNA, 14 nt, Mycobacterium tuberculosis H37Rv
cuuugaucgcccgg

SEQ ID NO: 3254495 - RNA, 16 nt, Mycobacterium tuberculosis H37Rv
cuuugcacagcggcau

SEQ ID NO: 3254496 - RNA, 13 nt, Mycobacterium tuberculosis H37Rv
cuuugcccgccgc

SEQ ID NO: 3254497 - RNA, 19 nt, Mycobacterium tuberculosis H37Rv
cuuugcccgccgcgucacc

SEQ ID NO: 3254498 - RNA, 18 nt, Mycobacterium tuberculosis H37Rv
cuuugcgguaagccggcg

SEQ ID NO: 3254499 - RNA, 14 nt, Mycobacterium tuberculosis H37Rv
cuuugcguucccau

SEQ ID NO: 3254500 - RNA, 23 nt, Mycobacterium tuberculosis H37Rv
cuuugcguucccaucccucggug

SEQ ID NO: 3254501 - RNA, 18 nt, Mycobacterium tuberculosis H37Rv
cuuuggaguuugauucca

SEQ ID NO: 3254502 - RNA, 13 nt, Mycobacterium tuberculosis H37Rv
cuuugggcugccg

SEQ ID NO: 3254503 - RNA, 17 nt, Mycobacterium tuberculosis H37Rv
cuuuggguccgggcggc

SEQ ID NO: 3254504 - RNA, 18 nt, Mycobacterium tuberculosis H37Rv
cuuugguacccagcgcgg

SEQ ID NO: 3254505 - RNA, 20 nt, Mycobacterium tuberculosis H37Rv
cuuugguacccagcgcggcc

SEQ ID NO: 3254506 - RNA, 17 nt, Mycobacterium tuberculosis H37Rv
cuuugucacgcaccgcg

SEQ ID NO: 3254507 - RNA, 15 nt, Mycobacterium tuberculosis H37Rv
cuuuuacgucugcuc

SEQ ID NO: 3254508 - RNA, 16 nt, Mycobacterium tuberculosis H37Rv
cuuuugcgcccagcac

SEQ ID NO: 3254509 - RNA, 15 nt, Mycobacterium tuberculosis H37Rv
gaaaaacaccagcga

SEQ ID NO: 3254510 - RNA, 20 nt, Mycobacterium tuberculosis H37Rv
gaaaaagaccgacagcggca

SEQ ID NO: 3254511 - RNA, 22 nt, Mycobacterium tuberculosis H37Rv
gaaaaagaccgacagcggcacc

SEQ ID NO: 3254512 - RNA, 18 nt, Mycobacterium tuberculosis H37Rv
gaaaaagggcuuccaggg

SEQ ID NO: 3254513 - RNA, 21 nt, Mycobacterium tuberculosis H37Rv
gaaaacauguuccacccggug

SEQ ID NO: 3254514 - RNA, 14 nt, Mycobacterium tuberculosis H37Rv
gaaaacauugcggc

SEQ ID NO: 3254515 - RNA, 21 nt, Mycobacterium tuberculosis H37Rv
gaaauuccggcgcggccggcc

SEQ ID NO: 3254516 - RNA, 16 nt, Mycobacterium tuberculosis H37Rv
gaaauuccgggccugg

SEQ ID NO: 3254517 - RNA, 18 nt, Mycobacterium tuberculosis H37Rv
gaaauuccgggccuggcc

SEQ ID NO: 3254518 - RNA, 15 nt, Mycobacterium tuberculosis H37Rv
gaaauucgcggcggu

SEQ ID NO: 3254519 - RNA, 12 nt, Mycobacterium tuberculosis H37Rv
gaaauugacgug

SEQ ID NO: 3254520 - RNA, 13 nt, Mycobacterium tuberculosis H37Rv
gaaauugagccgg

SEQ ID NO: 3254521 - RNA, 18 nt, Mycobacterium tuberculosis H37Rv
gaaauugaugaucugcag

SEQ ID NO: 3254522 - RNA, 14 nt, Mycobacterium tuberculosis H37Rv
gaaauugccgccgc

SEQ ID NO: 3254523 - RNA, 21 nt, Mycobacterium tuberculosis H37Rv
gaaauugcuuggccgcgcagg

SEQ ID NO: 3254524 - RNA, 22 nt, Mycobacterium tuberculosis H37Rv
gaaauugcuuggccgcgcaggc

SEQ ID NO: 3254525 - RNA, 18 nt, Mycobacterium tuberculosis H37Rv
gaaauugggcgauucugc

SEQ ID NO: 3254526 - RNA, 14 nt, Mycobacterium tuberculosis H37Rv
gaacaaaugccggu

SEQ ID NO: 3254527 - RNA, 16 nt, Mycobacterium tuberculosis H37Rv
gaacaacggcgcggca

SEQ ID NO: 3254528 - RNA, 22 nt, Mycobacterium tuberculosis H37Rv
gaacaacggcgcggcaagggcu

SEQ ID NO: 3254529 - RNA, 21 nt, Mycobacterium tuberculosis H37Rv
gaacaacggcguaaucgggaa

SEQ ID NO: 3254530 - RNA, 20 nt, Mycobacterium tuberculosis H37Rv
gaacaagauucgcucaccac

SEQ ID NO: 3254531 - RNA, 16 nt, Mycobacterium tuberculosis H37Rv
gaacaauucacgcacc

SEQ ID NO: 3254532 - RNA, 16 nt, Mycobacterium tuberculosis H37Rv
gaacacaccgggcggg

SEQ ID NO: 3254533 - RNA, 13 nt, Mycobacterium tuberculosis H37Rv
gaacaccacaccg

SEQ ID NO: 3254534 - RNA, 14 nt, Mycobacterium tuberculosis H37Rv
gaacaccaccaggc

SEQ ID NO: 3254535 - RNA, 13 nt, Mycobacterium tuberculosis H37Rv
gaacaccaccgcc

SEQ ID NO: 3254536 - RNA, 18 nt, Mycobacterium tuberculosis H37Rv
gaacaccagauggcucuc

SEQ ID NO: 3254537 - RNA, 13 nt, Mycobacterium tuberculosis H37Rv
gaacaccagcgcg

SEQ ID NO: 3254538 - RNA, 15 nt, Mycobacterium tuberculosis H37Rv
gaacaccaugaucag

SEQ ID NO: 3254539 - RNA, 15 nt, Mycobacterium tuberculosis H37Rv
gaacaccgaggcgac

SEQ ID NO: 3254540 - RNA, 23 nt, Mycobacterium tuberculosis H37Rv
gaacaccgaggcgaccggaccga

SEQ ID NO: 3254541 - RNA, 15 nt, Mycobacterium tuberculosis H37Rv
gaacaccgcccggcc

SEQ ID NO: 3254542 - RNA, 16 nt, Mycobacterium tuberculosis H37Rv
gaacaccgccgcgucg

SEQ ID NO: 3254543 - RNA, 16 nt, Mycobacterium tuberculosis H37Rv
gaacaccggccaggcc

SEQ ID NO: 3254544 - RNA, 19 nt, Mycobacterium tuberculosis H37Rv
gaacaccggcgccucaucg

SEQ ID NO: 3254545 - RNA, 17 nt, Mycobacterium tuberculosis H37Rv
gaacaccuugggcagcu

SEQ ID NO: 3254546 - RNA, 17 nt, Mycobacterium tuberculosis H37Rv
gaacacgucgacaccga

SEQ ID NO: 3254547 - RNA, 15 nt, Mycobacterium tuberculosis H37Rv
gaacacgucgggaug

SEQ ID NO: 3254548 - RNA, 22 nt, Mycobacterium tuberculosis H37Rv
gaacacguugacucgucgcauc

SEQ ID NO: 3254549 - RNA, 19 nt, Mycobacterium tuberculosis H37Rv
gaacagcaccgaacccgcc

SEQ ID NO: 3254550 - RNA, 21 nt, Mycobacterium tuberculosis H37Rv
gaacagcaccgaacccgccac

SEQ ID NO: 3254551 - RNA, 13 nt, Mycobacterium tuberculosis H37Rv
gaacagcaccgcc

SEQ ID NO: 3254552 - RNA, 15 nt, Mycobacterium tuberculosis H37Rv
gaacagcagguuggc

SEQ ID NO: 3254553 - RNA, 13 nt, Mycobacterium tuberculosis H37Rv
gaacagccccagg

SEQ ID NO: 3254554 - RNA, 14 nt, Mycobacterium tuberculosis H37Rv
gaacagccccaggg

SEQ ID NO: 3254555 - RNA, 17 nt, Mycobacterium tuberculosis H37Rv
gaacagcgaaccgccgg

SEQ ID NO: 3254556 - RNA, 16 nt, Mycobacterium tuberculosis H37Rv
gaacagcgaaccggcu

SEQ ID NO: 3254557 - RNA, 18 nt, Mycobacterium tuberculosis H37Rv
gaacagcgaaccggcugg

SEQ ID NO: 3254558 - RNA, 23 nt, Mycobacterium tuberculosis H37Rv
gaacagcgcgucggagccgggca

SEQ ID NO: 3254559 - RNA, 17 nt, Mycobacterium tuberculosis H37Rv
gaacagcucgaucagcc

SEQ ID NO: 3254560 - RNA, 16 nt, Mycobacterium tuberculosis H37Rv
gaacagcucguuggcg

SEQ ID NO: 3254561 - RNA, 20 nt, Mycobacterium tuberculosis H37Rv
gaacaggcaaaguacgcccu

SEQ ID NO: 3254562 - RNA, 13 nt, Mycobacterium tuberculosis H37Rv
gaacaggccggcc

SEQ ID NO: 3254563 - RNA, 15 nt, Mycobacterium tuberculosis H37Rv
gaacagggacuccca

SEQ ID NO: 3254564 - RNA, 17 nt, Mycobacterium tuberculosis H37Rv
gaacagggaggucgccg

SEQ ID NO: 3254565 - RNA, 20 nt, Mycobacterium tuberculosis H37Rv
gaacagggugguggcggugu

SEQ ID NO: 3254566 - RNA, 15 nt, Mycobacterium tuberculosis H37Rv
gaacaguaucgccgg

SEQ ID NO: 3254567 - RNA, 14 nt, Mycobacterium tuberculosis H37Rv
gaacagucgcagcc

SEQ ID NO: 3254568 - RNA, 15 nt, Mycobacterium tuberculosis H37Rv
gaacagugccucgcg

SEQ ID NO: 3254569 - RNA, 16 nt, Mycobacterium tuberculosis H37Rv
gaacagugccucgcgu

SEQ ID NO: 3254570 - RNA, 23 nt, Mycobacterium tuberculosis H37Rv
gaacagugccucgcguucgcugg

SEQ ID NO: 3254571 - RNA, 22 nt, Mycobacterium tuberculosis H37Rv
gaacaguucgacauaaccggcc

SEQ ID NO: 3254572 - RNA, 19 nt, Mycobacterium tuberculosis H37Rv
gaacaguugcggcuggcgc

SEQ ID NO: 3254573 - RNA, 20 nt, Mycobacterium tuberculosis H37Rv
gaacaguuucggcaugucgg

SEQ ID NO: 3254574 - RNA, 12 nt, Mycobacterium tuberculosis H37Rv
gaacaucaccgg

SEQ ID NO: 3254575 - RNA, 20 nt, Mycobacterium tuberculosis H37Rv
gaacaucaccucgaugccgc

SEQ ID NO: 3254576 - RNA, 16 nt, Mycobacterium tuberculosis H37Rv
gaacaucagaucgccg

SEQ ID NO: 3254577 - RNA, 21 nt, Mycobacterium tuberculosis H37Rv
gaacaucaucggguccacguc

SEQ ID NO: 3254578 - RNA, 19 nt, Mycobacterium tuberculosis H37Rv
gaacaucgccagcgccggc

SEQ ID NO: 3254579 - RNA, 22 nt, Mycobacterium tuberculosis H37Rv
gaacaucgccagcgccggccag

SEQ ID NO: 3254580 - RNA, 14 nt, Mycobacterium tuberculosis H37Rv
gaacaucuggcgac

SEQ ID NO: 3254581 - RNA, 13 nt, Mycobacterium tuberculosis H37Rv
gaacaugcucacg

SEQ ID NO: 3254582 - RNA, 16 nt, Mycobacterium tuberculosis H37Rv
gaacaugcucacgauc

SEQ ID NO: 3254583 - RNA, 18 nt, Mycobacterium tuberculosis H37Rv
gaacauguccagugccgu

SEQ ID NO: 3254584 - RNA, 12 nt, Mycobacterium tuberculosis H37Rv
gaaccaaucgca

SEQ ID NO: 3254585 - RNA, 16 nt, Mycobacterium tuberculosis H37Rv
gaaccaccaccggcaa

SEQ ID NO: 3254586 - RNA, 14 nt, Mycobacterium tuberculosis H37Rv
gaaccaccagcacg

SEQ ID NO: 3254587 - RNA, 19 nt, Mycobacterium tuberculosis H37Rv
gaaccaccagcacggcgau

SEQ ID NO: 3254588 - RNA, 18 nt, Mycobacterium tuberculosis H37Rv
gaaccacccaccggccac

SEQ ID NO: 3254589 - RNA, 20 nt, Mycobacterium tuberculosis H37Rv
gaaccaccgcguuggccaca

SEQ ID NO: 3254590 - RNA, 15 nt, Mycobacterium tuberculosis H37Rv
gaaccacgccaucga

SEQ ID NO: 3254591 - RNA, 22 nt, Mycobacterium tuberculosis H37Rv
gaaccacgcgcccgcaccaccg

SEQ ID NO: 3254592 - RNA, 14 nt, Mycobacterium tuberculosis H37Rv
gaaccacggcagcc

SEQ ID NO: 3254593 - RNA, 15 nt, Mycobacterium tuberculosis H37Rv
gaaccacggcaggca

SEQ ID NO: 3254594 - RNA, 21 nt, Mycobacterium tuberculosis H37Rv
gaaccacucggugauguaggg

SEQ ID NO: 3254595 - RNA, 20 nt, Mycobacterium tuberculosis H37Rv
gaaccagaggucacgcagca

SEQ ID NO: 3254596 - RNA, 23 nt, Mycobacterium tuberculosis H37Rv
gaaccagaggucacgcagcaccc

SEQ ID NO: 3254597 - RNA, 15 nt, Mycobacterium tuberculosis H37Rv
gaaccagcggucggc

SEQ ID NO: 3254598 - RNA, 21 nt, Mycobacterium tuberculosis H37Rv
gaaccagcuugcgccgcagcg

SEQ ID NO: 3254599 - RNA, 16 nt, Mycobacterium tuberculosis H37Rv
gaaccaguccucgacg

SEQ ID NO: 3254600 - RNA, 14 nt, Mycobacterium tuberculosis H37Rv
gaaccagucgaccc

SEQ ID NO: 3254601 - RNA, 17 nt, Mycobacterium tuberculosis H37Rv
gaaccagucgacccagc

SEQ ID NO: 3254602 - RNA, 17 nt, Mycobacterium tuberculosis H37Rv
gaacccacgcaugcacg

SEQ ID NO: 3254603 - RNA, 14 nt, Mycobacterium tuberculosis H37Rv
gaacccacugcccg

SEQ ID NO: 3254604 - RNA, 13 nt, Mycobacterium tuberculosis H37Rv
gaacccaggcaca

SEQ ID NO: 3254605 - RNA, 14 nt, Mycobacterium tuberculosis H37Rv
gaaccccauaauca

SEQ ID NO: 3254606 - RNA, 21 nt, Mycobacterium tuberculosis H37Rv
gaacccccagcugcagggcgu

SEQ ID NO: 3254607 - RNA, 12 nt, Mycobacterium tuberculosis H37Rv
gaacccccgccg

SEQ ID NO: 3254608 - RNA, 13 nt, Mycobacterium tuberculosis H37Rv
gaacccccucgcg

SEQ ID NO: 3254609 - RNA, 17 nt, Mycobacterium tuberculosis H37Rv
gaaccccgaccgcuggu

SEQ ID NO: 3254610 - RNA, 16 nt, Mycobacterium tuberculosis H37Rv
gaaccccgggcggcgc

SEQ ID NO: 3254611 - RNA, 16 nt, Mycobacterium tuberculosis H37Rv
gaacccgagccgccgu

SEQ ID NO: 3254612 - RNA, 23 nt, Mycobacterium tuberculosis H37Rv
gaacggcucgggaacuucgccga

SEQ ID NO: 3254613 - RNA, 22 nt, Mycobacterium tuberculosis H37Rv
gaacggcuugcgauuggcuggg

SEQ ID NO: 3254614 - RNA, 23 nt, Mycobacterium tuberculosis H37Rv
gaacggcuuggcgucggccggca

SEQ ID NO: 3254615 - RNA, 14 nt, Mycobacterium tuberculosis H37Rv
gaacgggaucgacc

SEQ ID NO: 3254616 - RNA, 21 nt, Mycobacterium tuberculosis H37Rv
gaacgggaucgacccgcccau

SEQ ID NO: 3254617 - RNA, 19 nt, Mycobacterium tuberculosis H37Rv
gaacgggcuuccgacauga

SEQ ID NO: 3254618 - RNA, 15 nt, Mycobacterium tuberculosis H37Rv
gaacggggugagcca

SEQ ID NO: 3254619 - RNA, 14 nt, Mycobacterium tuberculosis H37Rv
gaacgggucgacgu

SEQ ID NO: 3254620 - RNA, 18 nt, Mycobacterium tuberculosis H37Rv
gaacgggucggcgaccac

SEQ ID NO: 3254621 - RNA, 19 nt, Mycobacterium tuberculosis H37Rv
gaacgggucgggacgcugc

SEQ ID NO: 3254622 - RNA, 14 nt, Mycobacterium tuberculosis H37Rv
gaacguagcgccca

SEQ ID NO: 3254623 - RNA, 14 nt, Mycobacterium tuberculosis H37Rv
gaacgucaccaucg

SEQ ID NO: 3254624 - RNA, 19 nt, Mycobacterium tuberculosis H37Rv
gaacgucacguggucggcc

SEQ ID NO: 3254625 - RNA, 14 nt, Mycobacterium tuberculosis H37Rv
gaacgucacugcga

SEQ ID NO: 3254626 - RNA, 22 nt, Mycobacterium tuberculosis H37Rv
gaacgucauacccagcucgucg

SEQ ID NO: 3254627 - RNA, 19 nt, Mycobacterium tuberculosis H37Rv
gaacguccagccguggcgg

SEQ ID NO: 3254628 - RNA, 23 nt, Mycobacterium tuberculosis H37Rv
gaacguccagccguggcggcggg

SEQ ID NO: 3254629 - RNA, 15 nt, Mycobacterium tuberculosis H37Rv
gaacguccgcgccga

SEQ ID NO: 3254630 - RNA, 18 nt, Mycobacterium tuberculosis H37Rv
gaacguccgcgccgagcc

SEQ ID NO: 3254631 - RNA, 17 nt, Mycobacterium tuberculosis H37Rv
gaacgucgcggccagca

SEQ ID NO: 3254632 - RNA, 19 nt, Mycobacterium tuberculosis H37Rv
gaacgugaacucacggcgg

SEQ ID NO: 3254633 - RNA, 23 nt, Mycobacterium tuberculosis H37Rv
gaacgugacccccagcagggugu

SEQ ID NO: 3254634 - RNA, 13 nt, Mycobacterium tuberculosis H37Rv
gaacgugacgguc

SEQ ID NO: 3254635 - RNA, 20 nt, Mycobacterium tuberculosis H37Rv
gaacgugaugcggucgcgga

SEQ ID NO: 3254636 - RNA, 18 nt, Mycobacterium tuberculosis H37Rv
gaacgugcaaccacggcg

SEQ ID NO: 3254637 - RNA, 23 nt, Mycobacterium tuberculosis H37Rv
gaacgugcaaccacggcggcauc

SEQ ID NO: 3254638 - RNA, 20 nt, Mycobacterium tuberculosis H37Rv
gaacgugccuuccucgccgg

SEQ ID NO: 3254639 - RNA, 24 nt, Mycobacterium tuberculosis H37Rv
gaacguucuuaaacgggcucuucg

SEQ ID NO: 3254640 - RNA, 17 nt, Mycobacterium tuberculosis H37Rv
gaacuacccgccagcaa

SEQ ID NO: 3254641 - RNA, 18 nt, Mycobacterium tuberculosis H37Rv
gaacucaacaccagcaag

SEQ ID NO: 3254642 - RNA, 15 nt, Mycobacterium tuberculosis H37Rv
gaacucaccgccaug

SEQ ID NO: 3254643 - RNA, 14 nt, Mycobacterium tuberculosis H37Rv
gaacucccacugcc

SEQ ID NO: 3254644 - RNA, 18 nt, Mycobacterium tuberculosis H37Rv
gaacuccccggucgccgc

SEQ ID NO: 3254645 - RNA, 17 nt, Mycobacterium tuberculosis H37Rv
gaacuccgcggaaccca

SEQ ID NO: 3254646 - RNA, 18 nt, Mycobacterium tuberculosis H37Rv
gaacuccgcggaacccag

SEQ ID NO: 3254647 - RNA, 15 nt, Mycobacterium tuberculosis H37Rv
gaacuccggguggcg

SEQ ID NO: 3254648 - RNA, 16 nt, Mycobacterium tuberculosis H37Rv
gaacucgaccaccgcc

SEQ ID NO: 3254649 - RNA, 20 nt, Mycobacterium tuberculosis H37Rv
gaacucgaguugcucgacac

SEQ ID NO: 3254650 - RNA, 18 nt, Mycobacterium tuberculosis H37Rv
gaacucgcgccgagccag

SEQ ID NO: 3254651 - RNA, 17 nt, Mycobacterium tuberculosis H37Rv
gaacucgcguaucccgu

SEQ ID NO: 3254652 - RNA, 19 nt, Mycobacterium tuberculosis H37Rv
gaacucggcgucguggugg

SEQ ID NO: 3254653 - RNA, 14 nt, Mycobacterium tuberculosis H37Rv
gaacucguccugac

SEQ ID NO: 3254654 - RNA, 21 nt, Mycobacterium tuberculosis H37Rv
gaacucgugacagcggcgauc

SEQ ID NO: 3254655 - RNA, 19 nt, Mycobacterium tuberculosis H37Rv
gaacucguugaagaauccg

SEQ ID NO: 3254656 - RNA, 16 nt, Mycobacterium tuberculosis H37Rv
gaacucuggugacggu

SEQ ID NO: 3254657 - RNA, 20 nt, Mycobacterium tuberculosis H37Rv
gaacugacguuaccgccgca

SEQ ID NO: 3254658 - RNA, 20 nt, Mycobacterium tuberculosis H37Rv
gaacugcaucauggccguga

SEQ ID NO: 3254659 - RNA, 11 nt, Mycobacterium tuberculosis H37Rv
gaacugcgcaa

SEQ ID NO: 3254660 - RNA, 22 nt, Mycobacterium tuberculosis H37Rv
gaacugcgcaacaccgugcacc

SEQ ID NO: 3254661 - RNA, 16 nt, Mycobacterium tuberculosis H37Rv
gaacugggccucagac

SEQ ID NO: 3254662 - RNA, 18 nt, Mycobacterium tuberculosis H37Rv
gaacugggucggcacggg

SEQ ID NO: 3254663 - RNA, 18 nt, Mycobacterium tuberculosis H37Rv
gaacuggucgacgccgag

SEQ ID NO: 3254664 - RNA, 21 nt, Mycobacterium tuberculosis H37Rv
gaacuggucucggcugagacg

SEQ ID NO: 3254665 - RNA, 16 nt, Mycobacterium tuberculosis H37Rv
gaacuucagcggcggg

SEQ ID NO: 3254666 - RNA, 13 nt, Mycobacterium tuberculosis H37Rv
gaacuucgccgaa

SEQ ID NO: 3254667 - RNA, 19 nt, Mycobacterium tuberculosis H37Rv
gaagaaaccgcagucgcgg

SEQ ID NO: 3254668 - RNA, 12 nt, Mycobacterium tuberculosis H37Rv
gaagaacaacau

SEQ ID NO: 3254669 - RNA, 17 nt, Mycobacterium tuberculosis H37Rv
gaagaacucggcgucgu

SEQ ID NO: 3254670 - RNA, 18 nt, Mycobacterium tuberculosis H37Rv
gaagaacucggcgucgug

SEQ ID NO: 3254671 - RNA, 14 nt, Mycobacterium tuberculosis H37Rv
gaagaacucggugc

SEQ ID NO: 3254672 - RNA, 22 nt, Mycobacterium tuberculosis H37Rv
gaagaacucggugcccccaccc

SEQ ID NO: 3254673 - RNA, 17 nt, Mycobacterium tuberculosis H37Rv
gaagaagaugaucgcga

SEQ ID NO: 3254674 - RNA, 15 nt, Mycobacterium tuberculosis H37Rv
gaagaagccgaagca

SEQ ID NO: 3254675 - RNA, 22 nt, Mycobacterium tuberculosis H37Rv
gaagaaggcgagaagcgucgcu

SEQ ID NO: 3254676 - RNA, 20 nt, Mycobacterium tuberculosis H37Rv
gaagaaguacaucugccggu

SEQ ID NO: 3254677 - RNA, 15 nt, Mycobacterium tuberculosis H37Rv
gaagaagugcucaca

SEQ ID NO: 3254678 - RNA, 12 nt, Mycobacterium tuberculosis H37Rv
gaagaauccggc

SEQ ID NO: 3254679 - RNA, 23 nt, Mycobacterium tuberculosis H37Rv
gaagaauggacugaacaccaaau

SEQ ID NO: 3254680 - RNA, 12 nt, Mycobacterium tuberculosis H37Rv
gaagacaccagg

SEQ ID NO: 3254681 - RNA, 17 nt, Mycobacterium tuberculosis H37Rv
gaagaccaggccgguga

SEQ ID NO: 3254682 - RNA, 15 nt, Mycobacterium tuberculosis H37Rv
gaagaccgccgggau

SEQ ID NO: 3254683 - RNA, 16 nt, Mycobacterium tuberculosis H37Rv
gaagaccggaucgccu

SEQ ID NO: 3254684 - RNA, 20 nt, Mycobacterium tuberculosis H37Rv
gaagaccgggucguagccga

SEQ ID NO: 3254685 - RNA, 21 nt, Mycobacterium tuberculosis H37Rv
gaagaccucgucgcgucgcca

SEQ ID NO: 3254686 - RNA, 23 nt, Mycobacterium tuberculosis H37Rv
gaagaccucgucgcgucgccaga

SEQ ID NO: 3254687 - RNA, 18 nt, Mycobacterium tuberculosis H37Rv
gaagaccuggccugcggc

SEQ ID NO: 3254688 - RNA, 21 nt, Mycobacterium tuberculosis H37Rv
gaagacgccggcgaugccggu

SEQ ID NO: 3254689 - RNA, 19 nt, Mycobacterium tuberculosis H37Rv
gaagacggcaagucuggcg

SEQ ID NO: 3254690 - RNA, 14 nt, Mycobacterium tuberculosis H37Rv
gaagacggccaccg

SEQ ID NO: 3254691 - RNA, 16 nt, Mycobacterium tuberculosis H37Rv
gaagacggccaccggg

SEQ ID NO: 3254692 - RNA, 23 nt, Mycobacterium tuberculosis H37Rv
gaagacggccaccggggucaccu

SEQ ID NO: 3254693 - RNA, 15 nt, Mycobacterium tuberculosis H37Rv
gaagacuagcugcua

SEQ ID NO: 3254694 - RNA, 22 nt, Mycobacterium tuberculosis H37Rv
gaagacuuagcgggugccagcc

SEQ ID NO: 3254695 - RNA, 18 nt, Mycobacterium tuberculosis H37Rv
gaagagcggagccggcgc

SEQ ID NO: 3254696 - RNA, 17 nt, Mycobacterium tuberculosis H37Rv
gaagaguccuuaaacgu

SEQ ID NO: 3254697 - RNA, 23 nt, Mycobacterium tuberculosis H37Rv
gaagaguguccccccgcgcagau

SEQ ID NO: 3254698 - RNA, 19 nt, Mycobacterium tuberculosis H37Rv
gaagaucaccucccgcggc

SEQ ID NO: 3254699 - RNA, 21 nt, Mycobacterium tuberculosis H37Rv
gaagauccagcgcaccggcgu

SEQ ID NO: 3254700 - RNA, 18 nt, Mycobacterium tuberculosis H37Rv
gaagaucgagccgacccg

SEQ ID NO: 3254701 - RNA, 13 nt, Mycobacterium tuberculosis H37Rv
gaagaugcccuuc

SEQ ID NO: 3254702 - RNA, 20 nt, Mycobacterium tuberculosis H37Rv
gaagaugccugcuagcagca

SEQ ID NO: 3254703 - RNA, 21 nt, Mycobacterium tuberculosis H37Rv
gaagaugccugcuagcagcag

SEQ ID NO: 3254704 - RNA, 19 nt, Mycobacterium tuberculosis H37Rv
gaagaugucuuccugcgcc

SEQ ID NO: 3254705 - RNA, 22 nt, Mycobacterium tuberculosis H37Rv
gaagaugucuuccugcgccggu

SEQ ID NO: 3254706 - RNA, 18 nt, Mycobacterium tuberculosis H37Rv
gaagcaagggcgaugguc

SEQ ID NO: 3254707 - RNA, 15 nt, Mycobacterium tuberculosis H37Rv
gaagucgcagcgagg

SEQ ID NO: 3254708 - RNA, 17 nt, Mycobacterium tuberculosis H37Rv
gaagugacccgaaccgc

SEQ ID NO: 3254709 - RNA, 17 nt, Mycobacterium tuberculosis H37Rv
gaagugcacccggaucu

SEQ ID NO: 3254710 - RNA, 15 nt, Mycobacterium tuberculosis H37Rv
gaagugcgcgcugga

SEQ ID NO: 3254711 - RNA, 18 nt, Mycobacterium tuberculosis H37Rv
gaaguggcgucagugcag

SEQ ID NO: 3254712 - RNA, 15 nt, Mycobacterium tuberculosis H37Rv
gaagugucgcugcaa

SEQ ID NO: 3254713 - RNA, 17 nt, Mycobacterium tuberculosis H37Rv
gaagugucgcugcaacc

SEQ ID NO: 3254714 - RNA, 13 nt, Mycobacterium tuberculosis H37Rv
gaaguuccagccg

SEQ ID NO: 3254715 - RNA, 22 nt, Mycobacterium tuberculosis H37Rv
gaaguucggguagccgggaacg

SEQ ID NO: 3254716 - RNA, 21 nt, Mycobacterium tuberculosis H37Rv
gaaguucgucgguugccacgc

SEQ ID NO: 3254717 - RNA, 21 nt, Mycobacterium tuberculosis H37Rv
gaaguucuccucgugcagcac

SEQ ID NO: 3254718 - RNA, 16 nt, Mycobacterium tuberculosis H37Rv
gaaguucucggugcgc

SEQ ID NO: 3254719 - RNA, 13 nt, Mycobacterium tuberculosis H37Rv
gaaguugaagaag

SEQ ID NO: 3254720 - RNA, 15 nt, Mycobacterium tuberculosis H37Rv
gaaguugaagaagcc

SEQ ID NO: 3254721 - RNA, 16 nt, Mycobacterium tuberculosis H37Rv
gaaguugacaccaggg

SEQ ID NO: 3254722 - RNA, 13 nt, Mycobacterium tuberculosis H37Rv
gaaguugaucuug

SEQ ID NO: 3254723 - RNA, 15 nt, Mycobacterium tuberculosis H37Rv
gaaguugccggucag

SEQ ID NO: 3254724 - RNA, 20 nt, Mycobacterium tuberculosis H37Rv
gaaguuggcgaagcccgaca

SEQ ID NO: 3254725 - RNA, 14 nt, Mycobacterium tuberculosis H37Rv
gaaguuggcugagc

SEQ ID NO: 3254726 - RNA, 22 nt, Mycobacterium tuberculosis H37Rv
gaaguugugcgcacucuuuccu

SEQ ID NO: 3254727 - RNA, 16 nt, Mycobacterium tuberculosis H37Rv
gaaguuuuggaagccc

SEQ ID NO: 3254728 - RNA, 19 nt, Mycobacterium tuberculosis H37Rv
gaauaccacaccgugacca

SEQ ID NO: 3254729 - RNA, 18 nt, Mycobacterium tuberculosis H37Rv
gaauacccgcuggcccgc

SEQ ID NO: 3254730 - RNA, 17 nt, Mycobacterium tuberculosis H37Rv
gaauacgaggacgacga

SEQ ID NO: 3254731 - RNA, 22 nt, Mycobacterium tuberculosis H37Rv
gaauacugaucuuggcccgggc

SEQ ID NO: 3254732 - RNA, 22 nt, Mycobacterium tuberculosis H37Rv
gaauagguccggaagcggcguu

SEQ ID NO: 3254733 - RNA, 21 nt, Mycobacterium tuberculosis H37Rv
gaaucaccccggcggccaucc

SEQ ID NO: 3254734 - RNA, 13 nt, Mycobacterium tuberculosis H37Rv
gaaucaccggcaa

SEQ ID NO: 3254735 - RNA, 20 nt, Mycobacterium tuberculosis H37Rv
gaaucaccuugcuccacauc

SEQ ID NO: 3254736 - RNA, 18 nt, Mycobacterium tuberculosis H37Rv
gaaucacguggaccacgg

SEQ ID NO: 3254737 - RNA, 21 nt, Mycobacterium tuberculosis H37Rv
gaaucagcaccccauggccac

SEQ ID NO: 3254738 - RNA, 13 nt, Mycobacterium tuberculosis H37Rv
gaaucagcagcag

SEQ ID NO: 3254739 - RNA, 21 nt, Mycobacterium tuberculosis H37Rv
gaaucagcagcagcgugacca

SEQ ID NO: 3254740 - RNA, 13 nt, Mycobacterium tuberculosis H37Rv
gaaucccaacucc

SEQ ID NO: 3254741 - RNA, 17 nt, Mycobacterium tuberculosis H37Rv
gaaucccaacuccucca

SEQ ID NO: 3254742 - RNA, 19 nt, Mycobacterium tuberculosis H37Rv
gaaucccacagcaggagaa

SEQ ID NO: 3254743 - RNA, 13 nt, Mycobacterium tuberculosis H37Rv
gaaucccaucggg

SEQ ID NO: 3254744 - RNA, 19 nt, Mycobacterium tuberculosis H37Rv
gaauccccccugucgccga

SEQ ID NO: 3254745 - RNA, 20 nt, Mycobacterium tuberculosis H37Rv
gaaucccccggacggcaggc

SEQ ID NO: 3254746 - RNA, 23 nt, Mycobacterium tuberculosis H37Rv
gaaucccccggacggcaggcugg

SEQ ID NO: 3254747 - RNA, 16 nt, Mycobacterium tuberculosis H37Rv
gaauccccgcggcggu

SEQ ID NO: 3254748 - RNA, 21 nt, Mycobacterium tuberculosis H37Rv
gaaucccgagucugcgagcag

SEQ ID NO: 3254749 - RNA, 17 nt, Mycobacterium tuberculosis H37Rv
gaauccgacgucgacga

SEQ ID NO: 3254750 - RNA, 17 nt, Mycobacterium tuberculosis H37Rv
gaauccgauagcccggu

SEQ ID NO: 3254751 - RNA, 17 nt, Mycobacterium tuberculosis H37Rv
gaauccgcucgaggugg

SEQ ID NO: 3254752 - RNA, 19 nt, Mycobacterium tuberculosis H37Rv
gaauccgcucgaggugguc

SEQ ID NO: 3254753 - RNA, 20 nt, Mycobacterium tuberculosis H37Rv
gaauccggcaaccaccggcc

SEQ ID NO: 3254754 - RNA, 15 nt, Mycobacterium tuberculosis H37Rv
gaauccgggaagccg

SEQ ID NO: 3254755 - RNA, 15 nt, Mycobacterium tuberculosis H37Rv
gaauccguucgacga

SEQ ID NO: 3254756 - RNA, 12 nt, Mycobacterium tuberculosis H37Rv
gaauccugcgcu

SEQ ID NO: 3254757 - RNA, 16 nt, Mycobacterium tuberculosis H37Rv
gaaucgacuccggaug

SEQ ID NO: 3254758 - RNA, 16 nt, Mycobacterium tuberculosis H37Rv
gaaucgcacgacgcga

SEQ ID NO: 3254759 - RNA, 15 nt, Mycobacterium tuberculosis H37Rv
gaaucgcaucggcgg

SEQ ID NO: 3254760 - RNA, 19 nt, Mycobacterium tuberculosis H37Rv
gaaucgcccauuucggcac

SEQ ID NO: 3254761 - RNA, 11 nt, Mycobacterium tuberculosis H37Rv
gaaucgcccgg

SEQ ID NO: 3254762 - RNA, 15 nt, Mycobacterium tuberculosis H37Rv
gaaucgccggcggcc

SEQ ID NO: 3254763 - RNA, 17 nt, Mycobacterium tuberculosis H37Rv
gaaucgccuaccggccu

SEQ ID NO: 3254764 - RNA, 16 nt, Mycobacterium tuberculosis H37Rv
gaaucgcgcuucaggc

SEQ ID NO: 3254765 - RNA, 16 nt, Mycobacterium tuberculosis H37Rv
gaaucgcugccgccga

SEQ ID NO: 3254766 - RNA, 17 nt, Mycobacterium tuberculosis H37Rv
gaaucggcccgugccac

SEQ ID NO: 3254767 - RNA, 17 nt, Mycobacterium tuberculosis H37Rv
gaaucgguuucgaccug

SEQ ID NO: 3254768 - RNA, 17 nt, Mycobacterium tuberculosis H37Rv
gaaucgucggcgcggcu

SEQ ID NO: 3254769 - RNA, 15 nt, Mycobacterium tuberculosis H37Rv
gaaucgugcggcgac

SEQ ID NO: 3254770 - RNA, 16 nt, Mycobacterium tuberculosis H37Rv
gaaucguucucggucc

SEQ ID NO: 3254771 - RNA, 19 nt, Mycobacterium tuberculosis H37Rv
gaaucguuggcgaucgcga

SEQ ID NO: 3254772 - RNA, 15 nt, Mycobacterium tuberculosis H37Rv
gaaucuccaaguagc

SEQ ID NO: 3254773 - RNA, 22 nt, Mycobacterium tuberculosis H37Rv
gaaucugaaaaagcaucaaagc

SEQ ID NO: 3254774 - RNA, 13 nt, Mycobacterium tuberculosis H37Rv
gaaucugccucuc

SEQ ID NO: 3254775 - RNA, 17 nt, Mycobacterium tuberculosis H37Rv
gaaucuucugagacugc

SEQ ID NO: 3254776 - RNA, 13 nt, Mycobacterium tuberculosis H37Rv
gaaugaaggcacc

SEQ ID NO: 3254777 - RNA, 17 nt, Mycobacterium tuberculosis H37Rv
gaaugaccuugcccugc

SEQ ID NO: 3254778 - RNA, 19 nt, Mycobacterium tuberculosis H37Rv
gaaugaccuugcccugcgu

SEQ ID NO: 3254779 - RNA, 14 nt, Mycobacterium tuberculosis H37Rv
gaaugagcacgagc

SEQ ID NO: 3254780 - RNA, 17 nt, Mycobacterium tuberculosis H37Rv
gaaugaucggcguccuu

SEQ ID NO: 3254781 - RNA, 19 nt, Mycobacterium tuberculosis H37Rv
gaaugaucguuccgauccg

SEQ ID NO: 3254782 - RNA, 20 nt, Mycobacterium tuberculosis H37Rv
gaaugaucguuccgauccgg

SEQ ID NO: 3254783 - RNA, 17 nt, Mycobacterium tuberculosis H37Rv
gaaugccaccucgacgc

SEQ ID NO: 3254784 - RNA, 17 nt, Mycobacterium tuberculosis H37Rv
gaaugccgucgccggau

SEQ ID NO: 3254785 - RNA, 22 nt, Mycobacterium tuberculosis H37Rv
gaaugccgucgccggucaggcc

SEQ ID NO: 3254786 - RNA, 15 nt, Mycobacterium tuberculosis H37Rv
gaaugccuggcccgu

SEQ ID NO: 3254787 - RNA, 17 nt, Mycobacterium tuberculosis H37Rv
gaaugccuggcccgucg

SEQ ID NO: 3254788 - RNA, 18 nt, Mycobacterium tuberculosis H37Rv
gaaugcgggucugcgguc

SEQ ID NO: 3254789 - RNA, 18 nt, Mycobacterium tuberculosis H37Rv
gaaugcgguccucgaucg

SEQ ID NO: 3254790 - RNA, 20 nt, Mycobacterium tuberculosis H37Rv
gaaugcgguccucgaucggu

SEQ ID NO: 3254791 - RNA, 14 nt, Mycobacterium tuberculosis H37Rv
gaaugcugggcccg

SEQ ID NO: 3254792 - RNA, 18 nt, Mycobacterium tuberculosis H37Rv
gaaugcugggcccgccag

SEQ ID NO: 3254793 - RNA, 18 nt, Mycobacterium tuberculosis H37Rv
gaaugcuugcgcagcacc

SEQ ID NO: 3254794 - RNA, 20 nt, Mycobacterium tuberculosis H37Rv
gaauggcaacacaccgaaca

SEQ ID NO: 3254795 - RNA, 16 nt, Mycobacterium tuberculosis H37Rv
gaauggcagcacgacc

SEQ ID NO: 3254796 - RNA, 15 nt, Mycobacterium tuberculosis H37Rv
gaauggccgccgcag

SEQ ID NO: 3254797 - RNA, 16 nt, Mycobacterium tuberculosis H37Rv
gaauggccgccgcagc

SEQ ID NO: 3254798 - RNA, 17 nt, Mycobacterium tuberculosis H37Rv
gaauggccgccgcagcu

SEQ ID NO: 3254799 - RNA, 13 nt, Mycobacterium tuberculosis H37Rv
gaauggccgccuu

SEQ ID NO: 3254800 - RNA, 20 nt, Mycobacterium tuberculosis H37Rv
gaaugggggcuggucgccgu

SEQ ID NO: 3254801 - RNA, 14 nt, Mycobacterium tuberculosis H37Rv
gaauguccggcauc

SEQ ID NO: 3254802 - RNA, 22 nt, Mycobacterium tuberculosis H37Rv
gaaugucgaaacccacguacgc

SEQ ID NO: 3254803 - RNA, 17 nt, Mycobacterium tuberculosis H37Rv
gaaugucguugagaagc

SEQ ID NO: 3254804 - RNA, 14 nt, Mycobacterium tuberculosis H37Rv
gacaccggucggca

SEQ ID NO: 3254805 - RNA, 15 nt, Mycobacterium tuberculosis H37Rv
gacaccggucggcag

SEQ ID NO: 3254806 - RNA, 17 nt, Mycobacterium tuberculosis H37Rv
gacaccggucggcagcu

SEQ ID NO: 3254807 - RNA, 22 nt, Mycobacterium tuberculosis H37Rv
gacaccggugcgaccaacacgg

SEQ ID NO: 3254808 - RNA, 17 nt, Mycobacterium tuberculosis H37Rv
gacaccgugaccgccgc

SEQ ID NO: 3254809 - RNA, 19 nt, Mycobacterium tuberculosis H37Rv
gacaccguggaucggcagc

SEQ ID NO: 3254810 - RNA, 20 nt, Mycobacterium tuberculosis H37Rv
gacaccguggaucggcagcc

SEQ ID NO: 3254811 - RNA, 14 nt, Mycobacterium tuberculosis H37Rv
gacaccuaccgaga

SEQ ID NO: 3254812 - RNA, 18 nt, Mycobacterium tuberculosis H37Rv
gacaccuaccgagaucac

SEQ ID NO: 3254813 - RNA, 21 nt, Mycobacterium tuberculosis H37Rv
gacaccuaccgagaucaccgc

SEQ ID NO: 3254814 - RNA, 22 nt, Mycobacterium tuberculosis H37Rv
gacacgaucgcgucggcuaccu

SEQ ID NO: 3254815 - RNA, 19 nt, Mycobacterium tuberculosis H37Rv
gacacgcccuaacccugcc

SEQ ID NO: 3254816 - RNA, 22 nt, Mycobacterium tuberculosis H37Rv
gacacgccgaacgugcgguggc

SEQ ID NO: 3254817 - RNA, 11 nt, Mycobacterium tuberculosis H37Rv
gacacgccgau

SEQ ID NO: 3254818 - RNA, 12 nt, Mycobacterium tuberculosis H37Rv
gacacgccgaug

SEQ ID NO: 3254819 - RNA, 22 nt, Mycobacterium tuberculosis H37Rv
gacacgccgauucgccgucgug

SEQ ID NO: 3254820 - RNA, 15 nt, Mycobacterium tuberculosis H37Rv
gacacgcgcugcguc

SEQ ID NO: 3254821 - RNA, 19 nt, Mycobacterium tuberculosis H37Rv
gacacgcgcugcgucgucg

SEQ ID NO: 3254822 - RNA, 18 nt, Mycobacterium tuberculosis H37Rv
gacacgcugcaggcggcc

SEQ ID NO: 3254823 - RNA, 15 nt, Mycobacterium tuberculosis H37Rv
gacacggugaucuuc

SEQ ID NO: 3254824 - RNA, 22 nt, Mycobacterium tuberculosis H37Rv
gacacgucgcgccaggcgcgau

SEQ ID NO: 3254825 - RNA, 18 nt, Mycobacterium tuberculosis H37Rv
gacacguugacgaugugc

SEQ ID NO: 3254826 - RNA, 23 nt, Mycobacterium tuberculosis H37Rv
gacacguuucacguggucggcau

SEQ ID NO: 3254827 - RNA, 23 nt, Mycobacterium tuberculosis H37Rv
gacacucccgggugcgacgcgac

SEQ ID NO: 3254828 - RNA, 14 nt, Mycobacterium tuberculosis H37Rv
gacacugcagugau

SEQ ID NO: 3254829 - RNA, 19 nt, Mycobacterium tuberculosis H37Rv
gacacugcgaaggaccaga

SEQ ID NO: 3254830 - RNA, 16 nt, Mycobacterium tuberculosis H37Rv
gacacugggaucccga

SEQ ID NO: 3254831 - RNA, 14 nt, Mycobacterium tuberculosis H37Rv
gacacugugcgccu

SEQ ID NO: 3254832 - RNA, 19 nt, Mycobacterium tuberculosis H37Rv
gacacuugaagugugacaa

SEQ ID NO: 3254833 - RNA, 12 nt, Mycobacterium tuberculosis H37Rv
gacagacacagc

SEQ ID NO: 3254834 - RNA, 14 nt, Mycobacterium tuberculosis H37Rv
gacagacagcaccg

SEQ ID NO: 3254835 - RNA, 19 nt, Mycobacterium tuberculosis H37Rv
gacagacaucgcgacgauc

SEQ ID NO: 3254836 - RNA, 20 nt, Mycobacterium tuberculosis H37Rv
gacagacccccagacaaaga

SEQ ID NO: 3254837 - RNA, 19 nt, Mycobacterium tuberculosis H37Rv
gacagauagacuagccgau

SEQ ID NO: 3254838 - RNA, 17 nt, Mycobacterium tuberculosis H37Rv
gacagaucaacgcgaac

SEQ ID NO: 3254839 - RNA, 13 nt, Mycobacterium tuberculosis H37Rv
gacagaugcaucc

SEQ ID NO: 3254840 - RNA, 15 nt, Mycobacterium tuberculosis H37Rv
gacagaugcauccag

SEQ ID NO: 3254841 - RNA, 16 nt, Mycobacterium tuberculosis H37Rv
gacagaugcauccagc

SEQ ID NO: 3254842 - RNA, 19 nt, Mycobacterium tuberculosis H37Rv
gacagaugugguaccagcc

SEQ ID NO: 3254843 - RNA, 20 nt, Mycobacterium tuberculosis H37Rv
gacagaugugguaccagccc

SEQ ID NO: 3254844 - RNA, 23 nt, Mycobacterium tuberculosis H37Rv
gacagaugugguaccagcccgcc

SEQ ID NO: 3254845 - RNA, 20 nt, Mycobacterium tuberculosis H37Rv
gacagcacccaaugccaccg

SEQ ID NO: 3254846 - RNA, 16 nt, Mycobacterium tuberculosis H37Rv
gacagcagccggaucu

SEQ ID NO: 3254847 - RNA, 13 nt, Mycobacterium tuberculosis H37Rv
gacagcaucacga

SEQ ID NO: 3254848 - RNA, 14 nt, Mycobacterium tuberculosis H37Rv
gacagcaucacgcc

SEQ ID NO: 3254849 - RNA, 19 nt, Mycobacterium tuberculosis H37Rv
gacagcaucacgcccacga

SEQ ID NO: 3254850 - RNA, 21 nt, Mycobacterium tuberculosis H37Rv
gacagcaucacgcccacgaua

SEQ ID NO: 3254851 - RNA, 16 nt, Mycobacterium tuberculosis H37Rv
gacagccacgcacaau

SEQ ID NO: 3254852 - RNA, 19 nt, Mycobacterium tuberculosis H37Rv
gacagccaguguugcagug

SEQ ID NO: 3254853 - RNA, 16 nt, Mycobacterium tuberculosis H37Rv
gacagcccacgagugc

SEQ ID NO: 3254854 - RNA, 16 nt, Mycobacterium tuberculosis H37Rv
gacagccccaucacca

SEQ ID NO: 3254855 - RNA, 17 nt, Mycobacterium tuberculosis H37Rv
gacagccccaucaccac

SEQ ID NO: 3254856 - RNA, 19 nt, Mycobacterium tuberculosis H37Rv
gacagccccaucaccaccg

SEQ ID NO: 3254857 - RNA, 19 nt, Mycobacterium tuberculosis H37Rv
gacagccccgccgcccucc

SEQ ID NO: 3254858 - RNA, 14 nt, Mycobacterium tuberculosis H37Rv
gacagccccgcggc

SEQ ID NO: 3254859 - RNA, 15 nt, Mycobacterium tuberculosis H37Rv
gacagccccgcggcc

SEQ ID NO: 3254860 - RNA, 18 nt, Mycobacterium tuberculosis H37Rv
gacagccccgcggccagc

SEQ ID NO: 3254861 - RNA, 19 nt, Mycobacterium tuberculosis H37Rv
gacagcccgaacgaggcgc

SEQ ID NO: 3254862 - RNA, 18 nt, Mycobacterium tuberculosis H37Rv
gacagcccuaucagccga

SEQ ID NO: 3254863 - RNA, 13 nt, Mycobacterium tuberculosis H37Rv
gacagcgcaucca

SEQ ID NO: 3254864 - RNA, 20 nt, Mycobacterium tuberculosis H37Rv
gacagcgccaugcccucggc

SEQ ID NO: 3254865 - RNA, 17 nt, Mycobacterium tuberculosis H37Rv
gacagcgccuuguuggc

SEQ ID NO: 3254866 - RNA, 21 nt, Mycobacterium tuberculosis H37Rv
gacagcgcgcaaagacaccga

SEQ ID NO: 3254867 - RNA, 15 nt, Mycobacterium tuberculosis H37Rv
gacagcgcggcgguc

SEQ ID NO: 3254868 - RNA, 17 nt, Mycobacterium tuberculosis H37Rv
gacagcggcaccggggu

SEQ ID NO: 3254869 - RNA, 12 nt, Mycobacterium tuberculosis H37Rv
gacagcggcgac

SEQ ID NO: 3254870 - RNA, 18 nt, Mycobacterium tuberculosis H37Rv
gacagcggcgacaugauc

SEQ ID NO: 3254871 - RNA, 22 nt, Mycobacterium tuberculosis H37Rv
gacagcgucucgccgggaaaca

SEQ ID NO: 3254872 - RNA, 20 nt, Mycobacterium tuberculosis H37Rv
gacagcuaucccaggggcac

SEQ ID NO: 3254873 - RNA, 20 nt, Mycobacterium tuberculosis H37Rv
gacagcuccuuggcuaacac

SEQ ID NO: 3254874 - RNA, 13 nt, Mycobacterium tuberculosis H37Rv
gacagcugcgggu

SEQ ID NO: 3254875 - RNA, 21 nt, Mycobacterium tuberculosis H37Rv
gacagcugguugugcugggga

SEQ ID NO: 3254876 - RNA, 18 nt, Mycobacterium tuberculosis H37Rv
gacagcuuucuuggcggg

SEQ ID NO: 3254877 - RNA, 17 nt, Mycobacterium tuberculosis H37Rv
gacaggaucgugguagg

SEQ ID NO: 3254878 - RNA, 21 nt, Mycobacterium tuberculosis H37Rv
gacaggaucgugguagggcau

SEQ ID NO: 3254879 - RNA, 18 nt, Mycobacterium tuberculosis H37Rv
gacaggccggccaccagu

SEQ ID NO: 3254880 - RNA, 20 nt, Mycobacterium tuberculosis H37Rv
gacaggccggccaccagucc

SEQ ID NO: 3254881 - RNA, 14 nt, Mycobacterium tuberculosis H37Rv
gacaggcggcggcc

SEQ ID NO: 3254882 - RNA, 21 nt, Mycobacterium tuberculosis H37Rv
gacaggcuuggcaugcggauc

SEQ ID NO: 3254883 - RNA, 13 nt, Mycobacterium tuberculosis H37Rv
gacagggcggcga

SEQ ID NO: 3254884 - RNA, 14 nt, Mycobacterium tuberculosis H37Rv
gacagggcggcgag

SEQ ID NO: 3254885 - RNA, 20 nt, Mycobacterium tuberculosis H37Rv
gacagguagucgccggucag

SEQ ID NO: 3254886 - RNA, 22 nt, Mycobacterium tuberculosis H37Rv
gacaggucgcccaacaccgcgc

SEQ ID NO: 3254887 - RNA, 23 nt, Mycobacterium tuberculosis H37Rv
gacaggucgcccaacaccgcgcc

SEQ ID NO: 3254888 - RNA, 18 nt, Mycobacterium tuberculosis H37Rv
gacaggucgggcagcacu

SEQ ID NO: 3254889 - RNA, 22 nt, Mycobacterium tuberculosis H37Rv
gacaggucggggcgucguucgc

SEQ ID NO: 3254890 - RNA, 18 nt, Mycobacterium tuberculosis H37Rv
gacaggugccagaccagg

SEQ ID NO: 3254891 - RNA, 18 nt, Mycobacterium tuberculosis H37Rv
gacaggugcuaggaggag

SEQ ID NO: 3254892 - RNA, 15 nt, Mycobacterium tuberculosis H37Rv
gacagucaacagggc

SEQ ID NO: 3254893 - RNA, 17 nt, Mycobacterium tuberculosis H37Rv
gacagucaacagggcca

SEQ ID NO: 3254894 - RNA, 20 nt, Mycobacterium tuberculosis H37Rv
gacaguucguuaccacauac

SEQ ID NO: 3254895 - RNA, 22 nt, Mycobacterium tuberculosis H37Rv
gacaguuuuuccgugccgacca

SEQ ID NO: 3254896 - RNA, 23 nt, Mycobacterium tuberculosis H37Rv
gacaucaccaccgcacgggaucg

SEQ ID NO: 3254897 - RNA, 13 nt, Mycobacterium tuberculosis H37Rv
gacaucaccgaac

SEQ ID NO: 3254898 - RNA, 18 nt, Mycobacterium tuberculosis H37Rv
gacaucaccgaacggcga

SEQ ID NO: 3254899 - RNA, 20 nt, Mycobacterium tuberculosis H37Rv
gacaucacgaaggcguucgc

SEQ ID NO: 3254900 - RNA, 21 nt, Mycobacterium tuberculosis H37Rv
gaccagcaaccaccccagggc

SEQ ID NO: 3254901 - RNA, 23 nt, Mycobacterium tuberculosis H37Rv
gaccagcaaccaccccagggcaa

SEQ ID NO: 3254902 - RNA, 21 nt, Mycobacterium tuberculosis H37Rv
gaccagcaccagaaccggugc

SEQ ID NO: 3254903 - RNA, 13 nt, Mycobacterium tuberculosis H37Rv
gaccagcaccgcc

SEQ ID NO: 3254904 - RNA, 19 nt, Mycobacterium tuberculosis H37Rv
gaccagcagauccaggcgu

SEQ ID NO: 3254905 - RNA, 21 nt, Mycobacterium tuberculosis H37Rv
gaccagcaggcccuggccacc

SEQ ID NO: 3254906 - RNA, 19 nt, Mycobacterium tuberculosis H37Rv
gaccagccgaucaucaccg

SEQ ID NO: 3254907 - RNA, 14 nt, Mycobacterium tuberculosis H37Rv
gaccagccggucuu

SEQ ID NO: 3254908 - RNA, 18 nt, Mycobacterium tuberculosis H37Rv
gaccagccguggugguug

SEQ ID NO: 3254909 - RNA, 19 nt, Mycobacterium tuberculosis H37Rv
gaccagcgccccggcgcgu

SEQ ID NO: 3254910 - RNA, 23 nt, Mycobacterium tuberculosis H37Rv
gaccagcgccccggcgcguucca

SEQ ID NO: 3254911 - RNA, 13 nt, Mycobacterium tuberculosis H37Rv
gaccagcgcggca

SEQ ID NO: 3254912 - RNA, 14 nt, Mycobacterium tuberculosis H37Rv
gaccagcgcggcac

SEQ ID NO: 3254913 - RNA, 11 nt, Mycobacterium tuberculosis H37Rv
gaccagcggcg

SEQ ID NO: 3254914 - RNA, 14 nt, Mycobacterium tuberculosis H37Rv
gaccagcguccagc

SEQ ID NO: 3254915 - RNA, 15 nt, Mycobacterium tuberculosis H37Rv
gaccagcguccagcc

SEQ ID NO: 3254916 - RNA, 22 nt, Mycobacterium tuberculosis H37Rv
gaccagcguccagccgcccucg

SEQ ID NO: 3254917 - RNA, 23 nt, Mycobacterium tuberculosis H37Rv
gaccagcgucuucagguccaccg

SEQ ID NO: 3254918 - RNA, 21 nt, Mycobacterium tuberculosis H37Rv
gaccagcuugaccgaccacgc

SEQ ID NO: 3254919 - RNA, 20 nt, Mycobacterium tuberculosis H37Rv
gaccaggaacggcucggccg

SEQ ID NO: 3254920 - RNA, 22 nt, Mycobacterium tuberculosis H37Rv
gaccaggaaugucuccaguagc

SEQ ID NO: 3254921 - RNA, 13 nt, Mycobacterium tuberculosis H37Rv
gaccaggaccacc

SEQ ID NO: 3254922 - RNA, 14 nt, Mycobacterium tuberculosis H37Rv
gaccaggccagagc

SEQ ID NO: 3254923 - RNA, 19 nt, Mycobacterium tuberculosis H37Rv
gaccaggccagagccgccc

SEQ ID NO: 3254924 - RNA, 19 nt, Mycobacterium tuberculosis H37Rv
gaccaggccgcgcgcaccg

SEQ ID NO: 3254925 - RNA, 17 nt, Mycobacterium tuberculosis H37Rv
gaccagggaucgauuug

SEQ ID NO: 3254926 - RNA, 14 nt, Mycobacterium tuberculosis H37Rv
gaccagggcagcgg

SEQ ID NO: 3254927 - RNA, 22 nt, Mycobacterium tuberculosis H37Rv
gaccagggcggugcucuucggc

SEQ ID NO: 3254928 - RNA, 15 nt, Mycobacterium tuberculosis H37Rv
gaccagggucugcuc

SEQ ID NO: 3254929 - RNA, 15 nt, Mycobacterium tuberculosis H37Rv
gaccagguaauggug

SEQ ID NO: 3254930 - RNA, 22 nt, Mycobacterium tuberculosis H37Rv
gaccagguagaccaggugcagc

SEQ ID NO: 3254931 - RNA, 14 nt, Mycobacterium tuberculosis H37Rv
gaccaggucgguca

SEQ ID NO: 3254932 - RNA, 14 nt, Mycobacterium tuberculosis H37Rv
gaccaggucugcgg

SEQ ID NO: 3254933 - RNA, 17 nt, Mycobacterium tuberculosis H37Rv
gaccaggugcagcacca

SEQ ID NO: 3254934 - RNA, 18 nt, Mycobacterium tuberculosis H37Rv
gaccagugaccgcagucc

SEQ ID NO: 3254935 - RNA, 23 nt, Mycobacterium tuberculosis H37Rv
gaccagugaucagcgcaucgccg

SEQ ID NO: 3254936 - RNA, 22 nt, Mycobacterium tuberculosis H37Rv
gaccauagccugcgccgacccg

SEQ ID NO: 3254937 - RNA, 20 nt, Mycobacterium tuberculosis H37Rv
gaccauagucgccgucgugc

SEQ ID NO: 3254938 - RNA, 21 nt, Mycobacterium tuberculosis H37Rv
gaccauauuggcgcggccgaa

SEQ ID NO: 3254939 - RNA, 21 nt, Mycobacterium tuberculosis H37Rv
gaccaucaccacggccgccga

SEQ ID NO: 3254940 - RNA, 16 nt, Mycobacterium tuberculosis H37Rv
gaccaucccgccgauc

SEQ ID NO: 3254941 - RNA, 22 nt, Mycobacterium tuberculosis H37Rv
gaccaucguguacuggucugga

SEQ ID NO: 3254942 - RNA, 14 nt, Mycobacterium tuberculosis H37Rv
gaccaugaccgggc

SEQ ID NO: 3254943 - RNA, 17 nt, Mycobacterium tuberculosis H37Rv
gaccaugaugaccggca

SEQ ID NO: 3254944 - RNA, 20 nt, Mycobacterium tuberculosis H37Rv
gaccaugaugccuaccgggc

SEQ ID NO: 3254945 - RNA, 15 nt, Mycobacterium tuberculosis H37Rv
gacccaacgcagauc

SEQ ID NO: 3254946 - RNA, 17 nt, Mycobacterium tuberculosis H37Rv
gacccaagucgccgagg

SEQ ID NO: 3254947 - RNA, 18 nt, Mycobacterium tuberculosis H37Rv
gacccacaucaggucggc

SEQ ID NO: 3254948 - RNA, 17 nt, Mycobacterium tuberculosis H37Rv
gacccacauuccguagc

SEQ ID NO: 3254949 - RNA, 16 nt, Mycobacterium tuberculosis H37Rv
gacccaccaccgcaac

SEQ ID NO: 3254950 - RNA, 19 nt, Mycobacterium tuberculosis H37Rv
gacccacccgcaccgccgg

SEQ ID NO: 3254951 - RNA, 20 nt, Mycobacterium tuberculosis H37Rv
gacccaccgccccggcggcg

SEQ ID NO: 3254952 - RNA, 22 nt, Mycobacterium tuberculosis H37Rv
gacccaccgccccggcggcggc

SEQ ID NO: 3254953 - RNA, 14 nt, Mycobacterium tuberculosis H37Rv
gacccaccgucacc

SEQ ID NO: 3254954 - RNA, 18 nt, Mycobacterium tuberculosis H37Rv
gacccaccgucacccccg

SEQ ID NO: 3254955 - RNA, 18 nt, Mycobacterium tuberculosis H37Rv
gacccacgagagcgcugu

SEQ ID NO: 3254956 - RNA, 20 nt, Mycobacterium tuberculosis H37Rv
gacccacucggggacggcga

SEQ ID NO: 3254957 - RNA, 14 nt, Mycobacterium tuberculosis H37Rv
gacccagaccggcu

SEQ ID NO: 3254958 - RNA, 21 nt, Mycobacterium tuberculosis H37Rv
gacccagauggcucgaagcug

SEQ ID NO: 3254959 - RNA, 21 nt, Mycobacterium tuberculosis H37Rv
gacccagccagcagcggcgag

SEQ ID NO: 3254960 - RNA, 18 nt, Mycobacterium tuberculosis H37Rv
gacccagcgcgcgguggc

SEQ ID NO: 3254961 - RNA, 20 nt, Mycobacterium tuberculosis H37Rv
gacccagcucgucgacgucg

SEQ ID NO: 3254962 - RNA, 15 nt, Mycobacterium tuberculosis H37Rv
gacccauacgaacuc

SEQ ID NO: 3254963 - RNA, 15 nt, Mycobacterium tuberculosis H37Rv
gacccaucaccagcg

SEQ ID NO: 3254964 - RNA, 18 nt, Mycobacterium tuberculosis H37Rv
gacccaucaccagcggcu

SEQ ID NO: 3254965 - RNA, 22 nt, Mycobacterium tuberculosis H37Rv
gacccaucaccagcggcugcag

SEQ ID NO: 3254966 - RNA, 18 nt, Mycobacterium tuberculosis H37Rv
gacccaucaugguccggg

SEQ ID NO: 3254967 - RNA, 17 nt, Mycobacterium tuberculosis H37Rv
gacccaucucgucgucg

SEQ ID NO: 3254968 - RNA, 23 nt, Mycobacterium tuberculosis H37Rv
gacccaugagcccgugacauucu

SEQ ID NO: 3254969 - RNA, 13 nt, Mycobacterium tuberculosis H37Rv
gacccauggucac

SEQ ID NO: 3254970 - RNA, 18 nt, Mycobacterium tuberculosis H37Rv
gacccauggucaccagcu

SEQ ID NO: 3254971 - RNA, 21 nt, Mycobacterium tuberculosis H37Rv
gacccauucucggccggcggc

SEQ ID NO: 3254972 - RNA, 23 nt, Mycobacterium tuberculosis H37Rv
gacccauucucggccggcggcgc

SEQ ID NO: 3254973 - RNA, 22 nt, Mycobacterium tuberculosis H37Rv
gaccccaggcgcucaucaccca

SEQ ID NO: 3254974 - RNA, 14 nt, Mycobacterium tuberculosis H37Rv
gacccccagcaggg

SEQ ID NO: 3254975 - RNA, 13 nt, Mycobacterium tuberculosis H37Rv
gacccccagcgcc

SEQ ID NO: 3254976 - RNA, 23 nt, Mycobacterium tuberculosis H37Rv
gaccccccuucgguguccgacgc

SEQ ID NO: 3254977 - RNA, 21 nt, Mycobacterium tuberculosis H37Rv
gacccccgaucaggccgacgu

SEQ ID NO: 3254978 - RNA, 17 nt, Mycobacterium tuberculosis H37Rv
gacccccugccacagcg

SEQ ID NO: 3254979 - RNA, 19 nt, Mycobacterium tuberculosis H37Rv
gacccccugccacagcgac

SEQ ID NO: 3254980 - RNA, 21 nt, Mycobacterium tuberculosis H37Rv
gaccccgacgaugcgcacucc

SEQ ID NO: 3254981 - RNA, 17 nt, Mycobacterium tuberculosis H37Rv
gaccccgagaccaacgc

SEQ ID NO: 3254982 - RNA, 13 nt, Mycobacterium tuberculosis H37Rv
gaccccgccagcc

SEQ ID NO: 3254983 - RNA, 15 nt, Mycobacterium tuberculosis H37Rv
gaccccgccgaacgg

SEQ ID NO: 3254984 - RNA, 18 nt, Mycobacterium tuberculosis H37Rv
gaccccggaaugcccgag

SEQ ID NO: 3254985 - RNA, 20 nt, Mycobacterium tuberculosis H37Rv
gaccccggaaugcccgagca

SEQ ID NO: 3254986 - RNA, 14 nt, Mycobacterium tuberculosis H37Rv
gaccccggcagcgc

SEQ ID NO: 3254987 - RNA, 16 nt, Mycobacterium tuberculosis H37Rv
gaccccggcagcgccc

SEQ ID NO: 3254988 - RNA, 16 nt, Mycobacterium tuberculosis H37Rv
gaccccggcgguaccg

SEQ ID NO: 3254989 - RNA, 19 nt, Mycobacterium tuberculosis H37Rv
gaccccggcguugccgccg

SEQ ID NO: 3254990 - RNA, 20 nt, Mycobacterium tuberculosis H37Rv
gaccccggcguugccgccgu

SEQ ID NO: 3254991 - RNA, 22 nt, Mycobacterium tuberculosis H37Rv
gaccccggcguugccgccguug

SEQ ID NO: 3254992 - RNA, 13 nt, Mycobacterium tuberculosis H37Rv
gaccccggugguc

SEQ ID NO: 3254993 - RNA, 17 nt, Mycobacterium tuberculosis H37Rv
gaccccgguggucuggu

SEQ ID NO: 3254994 - RNA, 16 nt, Mycobacterium tuberculosis H37Rv
gaccccguaggcgccg

SEQ ID NO: 3254995 - RNA, 19 nt, Mycobacterium tuberculosis H37Rv
gaccgccaccccgcuugga

SEQ ID NO: 3254996 - RNA, 16 nt, Mycobacterium tuberculosis H37Rv
gaccgccaccgccagc

SEQ ID NO: 3254997 - RNA, 18 nt, Mycobacterium tuberculosis H37Rv
gaccgccaccgccagcgu

SEQ ID NO: 3254998 - RNA, 21 nt, Mycobacterium tuberculosis H37Rv
gaccgccaccgccagcgucga

SEQ ID NO: 3254999 - RNA, 22 nt, Mycobacterium tuberculosis H37Rv
gaccgccaccgucauggcgggu

SEQ ID NO: 3255000 - RNA, 20 nt, Mycobacterium tuberculosis H37Rv
gaccgccacguaauucccca

SEQ ID NO: 3255001 - RNA, 14 nt, Mycobacterium tuberculosis H37Rv
gaccgccagcagca

SEQ ID NO: 3255002 - RNA, 13 nt, Mycobacterium tuberculosis H37Rv
gaccgccagggcu

SEQ ID NO: 3255003 - RNA, 19 nt, Mycobacterium tuberculosis H37Rv
gaccgccagggcuugccgg

SEQ ID NO: 3255004 - RNA, 14 nt, Mycobacterium tuberculosis H37Rv
gaccgccaucgcca

SEQ ID NO: 3255005 - RNA, 18 nt, Mycobacterium tuberculosis H37Rv
gaccgccauuucgcccga

SEQ ID NO: 3255006 - RNA, 19 nt, Mycobacterium tuberculosis H37Rv
gaccgcccgagucucgucg

SEQ ID NO: 3255007 - RNA, 16 nt, Mycobacterium tuberculosis H37Rv
gaccgcccgcaccccc

SEQ ID NO: 3255008 - RNA, 18 nt, Mycobacterium tuberculosis H37Rv
gaccgccgaagaagguga

SEQ ID NO: 3255009 - RNA, 16 nt, Mycobacterium tuberculosis H37Rv
gaccgccgacaccacg

SEQ ID NO: 3255010 - RNA, 19 nt, Mycobacterium tuberculosis H37Rv
gaccgccgacaccacggcg

SEQ ID NO: 3255011 - RNA, 17 nt, Mycobacterium tuberculosis H37Rv
gaccgccgacgccguug

SEQ ID NO: 3255012 - RNA, 23 nt, Mycobacterium tuberculosis H37Rv
gaccgccgauacuucaucggcac

SEQ ID NO: 3255013 - RNA, 16 nt, Mycobacterium tuberculosis H37Rv
gaccgccgcgagcaga

SEQ ID NO: 3255014 - RNA, 18 nt, Mycobacterium tuberculosis H37Rv
gaccgccgcuaccccagc

SEQ ID NO: 3255015 - RNA, 14 nt, Mycobacterium tuberculosis H37Rv
gaccgccuccucga

SEQ ID NO: 3255016 - RNA, 22 nt, Mycobacterium tuberculosis H37Rv
gaccgccuccucgauagcggcg

SEQ ID NO: 3255017 - RNA, 13 nt, Mycobacterium tuberculosis H37Rv
gaccgccucgccg

SEQ ID NO: 3255018 - RNA, 14 nt, Mycobacterium tuberculosis H37Rv
gaccgccugcaaca

SEQ ID NO: 3255019 - RNA, 16 nt, Mycobacterium tuberculosis H37Rv
gaccgccugcaacacg

SEQ ID NO: 3255020 - RNA, 19 nt, Mycobacterium tuberculosis H37Rv
gaccgccugcaacacgcga

SEQ ID NO: 3255021 - RNA, 12 nt, Mycobacterium tuberculosis H37Rv
gaccgcgaccgc

SEQ ID NO: 3255022 - RNA, 13 nt, Mycobacterium tuberculosis H37Rv
gaccgcgacggca

SEQ ID NO: 3255023 - RNA, 23 nt, Mycobacterium tuberculosis H37Rv
gaccgcgacggcgccggcaucgg

SEQ ID NO: 3255024 - RNA, 20 nt, Mycobacterium tuberculosis H37Rv
gaccgcgagcaucugggguc

SEQ ID NO: 3255025 - RNA, 12 nt, Mycobacterium tuberculosis H37Rv
gaccgcgagggc

SEQ ID NO: 3255026 - RNA, 17 nt, Mycobacterium tuberculosis H37Rv
gaccgcgauccccacga

SEQ ID NO: 3255027 - RNA, 16 nt, Mycobacterium tuberculosis H37Rv
gaccgcgaucgccgac

SEQ ID NO: 3255028 - RNA, 20 nt, Mycobacterium tuberculosis H37Rv
gaccgcgaugaucgcaucga

SEQ ID NO: 3255029 - RNA, 18 nt, Mycobacterium tuberculosis H37Rv
gaccgcgaugggauaccg

SEQ ID NO: 3255030 - RNA, 19 nt, Mycobacterium tuberculosis H37Rv
gaccgcgcacggcuggcgu

SEQ ID NO: 3255031 - RNA, 17 nt, Mycobacterium tuberculosis H37Rv
gaccgcgccgaucacca

SEQ ID NO: 3255032 - RNA, 14 nt, Mycobacterium tuberculosis H37Rv
gaccgcggccuugg

SEQ ID NO: 3255033 - RNA, 17 nt, Mycobacterium tuberculosis H37Rv
gaccgcggcgcguccgg

SEQ ID NO: 3255034 - RNA, 13 nt, Mycobacterium tuberculosis H37Rv
gaccgcggcguua

SEQ ID NO: 3255035 - RNA, 22 nt, Mycobacterium tuberculosis H37Rv
gaccgcggcguuaagguacccg

SEQ ID NO: 3255036 - RNA, 16 nt, Mycobacterium tuberculosis H37Rv
gaccgcgggccgacgc

SEQ ID NO: 3255037 - RNA, 18 nt, Mycobacterium tuberculosis H37Rv
gaccgcgggcgccuucca

SEQ ID NO: 3255038 - RNA, 20 nt, Mycobacterium tuberculosis H37Rv
gaccgcgggcuccccgcaca

SEQ ID NO: 3255039 - RNA, 23 nt, Mycobacterium tuberculosis H37Rv
gaccgcgggcuccccgcacaucc

SEQ ID NO: 3255040 - RNA, 15 nt, Mycobacterium tuberculosis H37Rv
gaccgcgggucgugc

SEQ ID NO: 3255041 - RNA, 19 nt, Mycobacterium tuberculosis H37Rv
gaccgcgggucgugccagc

SEQ ID NO: 3255042 - RNA, 19 nt, Mycobacterium tuberculosis H37Rv
gaccgcggucauggcgacg

SEQ ID NO: 3255043 - RNA, 19 nt, Mycobacterium tuberculosis H37Rv
gaccgcggugacucggccu

SEQ ID NO: 3255044 - RNA, 23 nt, Mycobacterium tuberculosis H37Rv
gaccgcggugacucggccuccgc

SEQ ID NO: 3255045 - RNA, 19 nt, Mycobacterium tuberculosis H37Rv
gaccgcguaaaggccuugg

SEQ ID NO: 3255046 - RNA, 16 nt, Mycobacterium tuberculosis H37Rv
gaccgcgucggcggcc

SEQ ID NO: 3255047 - RNA, 17 nt, Mycobacterium tuberculosis H37Rv
gaccgcgucgucccagu

SEQ ID NO: 3255048 - RNA, 22 nt, Mycobacterium tuberculosis H37Rv
gaccgcgugcucgagcaccucg

SEQ ID NO: 3255049 - RNA, 19 nt, Mycobacterium tuberculosis H37Rv
gaccgcguggucggcgaac

SEQ ID NO: 3255050 - RNA, 20 nt, Mycobacterium tuberculosis H37Rv
gaccgcguuccgggccggcg

SEQ ID NO: 3255051 - RNA, 21 nt, Mycobacterium tuberculosis H37Rv
gaccgcguuccgggccggcga

SEQ ID NO: 3255052 - RNA, 23 nt, Mycobacterium tuberculosis H37Rv
gaccgcguuccgggccggcgagc

SEQ ID NO: 3255053 - RNA, 20 nt, Mycobacterium tuberculosis H37Rv
gaccgcguuguccgcggcca

SEQ ID NO: 3255054 - RNA, 12 nt, Mycobacterium tuberculosis H37Rv
gaccgcuaccag

SEQ ID NO: 3255055 - RNA, 15 nt, Mycobacterium tuberculosis H37Rv
gaccgcuaccagcug

SEQ ID NO: 3255056 - RNA, 19 nt, Mycobacterium tuberculosis H37Rv
gaccgcuaccagcugggcg

SEQ ID NO: 3255057 - RNA, 18 nt, Mycobacterium tuberculosis H37Rv
gaccgcuaugaugccgcc

SEQ ID NO: 3255058 - RNA, 19 nt, Mycobacterium tuberculosis H37Rv
gaccgcucgaugucccgag

SEQ ID NO: 3255059 - RNA, 15 nt, Mycobacterium tuberculosis H37Rv
gaccgcucggaguug

SEQ ID NO: 3255060 - RNA, 21 nt, Mycobacterium tuberculosis H37Rv
gaccgcucugcggccacgccg

SEQ ID NO: 3255061 - RNA, 22 nt, Mycobacterium tuberculosis H37Rv
gaccgcucugcggccacgccga

SEQ ID NO: 3255062 - RNA, 13 nt, Mycobacterium tuberculosis H37Rv
gaccgcugcccag

SEQ ID NO: 3255063 - RNA, 14 nt, Mycobacterium tuberculosis H37Rv
gaccgcugcccagu

SEQ ID NO: 3255064 - RNA, 18 nt, Mycobacterium tuberculosis H37Rv
gaccggaaaccacagcgc

SEQ ID NO: 3255065 - RNA, 19 nt, Mycobacterium tuberculosis H37Rv
gaccggaaaccacagcgcc

SEQ ID NO: 3255066 - RNA, 18 nt, Mycobacterium tuberculosis H37Rv
gaccggaacguuccugca

SEQ ID NO: 3255067 - RNA, 23 nt, Mycobacterium tuberculosis H37Rv
gaccggacaaacaucgcacccac

SEQ ID NO: 3255068 - RNA, 19 nt, Mycobacterium tuberculosis H37Rv
gaccggagccgccggacga

SEQ ID NO: 3255069 - RNA, 20 nt, Mycobacterium tuberculosis H37Rv
gaccggaucugacggcgccg

SEQ ID NO: 3255070 - RNA, 16 nt, Mycobacterium tuberculosis H37Rv
gaccggcaccggccgg

SEQ ID NO: 3255071 - RNA, 13 nt, Mycobacterium tuberculosis H37Rv
gaccggcagcgau

SEQ ID NO: 3255072 - RNA, 14 nt, Mycobacterium tuberculosis H37Rv
gaccggcaucgauc

SEQ ID NO: 3255073 - RNA, 14 nt, Mycobacterium tuberculosis H37Rv
gaccggccacgacc

SEQ ID NO: 3255074 - RNA, 20 nt, Mycobacterium tuberculosis H37Rv
gaccggcccgcauccgcacc

SEQ ID NO: 3255075 - RNA, 13 nt, Mycobacterium tuberculosis H37Rv
gaccggccgacgu

SEQ ID NO: 3255076 - RNA, 18 nt, Mycobacterium tuberculosis H37Rv
gaccggcgaccggcgagc

SEQ ID NO: 3255077 - RNA, 23 nt, Mycobacterium tuberculosis H37Rv
gaccggcgggacgucgccgcagu

SEQ ID NO: 3255078 - RNA, 13 nt, Mycobacterium tuberculosis H37Rv
gaccggcgggcag

SEQ ID NO: 3255079 - RNA, 17 nt, Mycobacterium tuberculosis H37Rv
gaccggcguaaccggca

SEQ ID NO: 3255080 - RNA, 13 nt, Mycobacterium tuberculosis H37Rv
gaccggcgucggc

SEQ ID NO: 3255081 - RNA, 17 nt, Mycobacterium tuberculosis H37Rv
gaccggcuugccgccgu

SEQ ID NO: 3255082 - RNA, 15 nt, Mycobacterium tuberculosis H37Rv
gaccgggaggcggcg

SEQ ID NO: 3255083 - RNA, 16 nt, Mycobacterium tuberculosis H37Rv
gaccgggccgcacggu

SEQ ID NO: 3255084 - RNA, 17 nt, Mycobacterium tuberculosis H37Rv
gaccgggcucuggccag

SEQ ID NO: 3255085 - RNA, 14 nt, Mycobacterium tuberculosis H37Rv
gaccgggcuggcca

SEQ ID NO: 3255086 - RNA, 19 nt, Mycobacterium tuberculosis H37Rv
gaccggggacagcccuucg

SEQ ID NO: 3255087 - RNA, 21 nt, Mycobacterium tuberculosis H37Rv
gaccggggcgcccggccaggu

SEQ ID NO: 3255088 - RNA, 16 nt, Mycobacterium tuberculosis H37Rv
gaccggggcuuggguu

SEQ ID NO: 3255089 - RNA, 17 nt, Mycobacterium tuberculosis H37Rv
gaccgggucgaugacgc

SEQ ID NO: 3255090 - RNA, 18 nt, Mycobacterium tuberculosis H37Rv
gaccgggucgcaaccgcc

SEQ ID NO: 3255091 - RNA, 21 nt, Mycobacterium tuberculosis H37Rv
gaccuucucgucggccagugc

SEQ ID NO: 3255092 - RNA, 23 nt, Mycobacterium tuberculosis H37Rv
gaccuucuugacacccaccucgc

SEQ ID NO: 3255093 - RNA, 20 nt, Mycobacterium tuberculosis H37Rv
gaccuugagcacuccgucgu

SEQ ID NO: 3255094 - RNA, 19 nt, Mycobacterium tuberculosis H37Rv
gaccuugaucgagcagggu

SEQ ID NO: 3255095 - RNA, 15 nt, Mycobacterium tuberculosis H37Rv
gaccuuggccgugcc

SEQ ID NO: 3255096 - RNA, 17 nt, Mycobacterium tuberculosis H37Rv
gaccuuggugcccagca

SEQ ID NO: 3255097 - RNA, 18 nt, Mycobacterium tuberculosis H37Rv
gaccuuguugaccaccac

SEQ ID NO: 3255098 - RNA, 22 nt, Mycobacterium tuberculosis H37Rv
gaccuuuucccgcaggcucacc

SEQ ID NO: 3255099 - RNA, 21 nt, Mycobacterium tuberculosis H37Rv
gaccuuuugcggcaagcgcac

SEQ ID NO: 3255100 - RNA, 18 nt, Mycobacterium tuberculosis H37Rv
gacgaaaaaaucgugcgg

SEQ ID NO: 3255101 - RNA, 18 nt, Mycobacterium tuberculosis H37Rv
gacgaaauccgccgggcg

SEQ ID NO: 3255102 - RNA, 15 nt, Mycobacterium tuberculosis H37Rv
gacgaaaucggcggc

SEQ ID NO: 3255103 - RNA, 18 nt, Mycobacterium tuberculosis H37Rv
gacgaacaacgcgacgaa

SEQ ID NO: 3255104 - RNA, 14 nt, Mycobacterium tuberculosis H37Rv
gacgaacaccagcg

SEQ ID NO: 3255105 - RNA, 22 nt, Mycobacterium tuberculosis H37Rv
gacgaaccccauaaucacaucg

SEQ ID NO: 3255106 - RNA, 15 nt, Mycobacterium tuberculosis H37Rv
gacgaacgaaccgcc

SEQ ID NO: 3255107 - RNA, 17 nt, Mycobacterium tuberculosis H37Rv
gacgaacgaccaggcgc

SEQ ID NO: 3255108 - RNA, 13 nt, Mycobacterium tuberculosis H37Rv
gacgaacgccguc

SEQ ID NO: 3255109 - RNA, 14 nt, Mycobacterium tuberculosis H37Rv
gacgaacgccgucg

SEQ ID NO: 3255110 - RNA, 15 nt, Mycobacterium tuberculosis H37Rv
gacgaacgccgucga

SEQ ID NO: 3255111 - RNA, 15 nt, Mycobacterium tuberculosis H37Rv
gacgaacgcugucgu

SEQ ID NO: 3255112 - RNA, 15 nt, Mycobacterium tuberculosis H37Rv
gacgaacucgccguc

SEQ ID NO: 3255113 - RNA, 14 nt, Mycobacterium tuberculosis H37Rv
gacgaacugcagcc

SEQ ID NO: 3255114 - RNA, 14 nt, Mycobacterium tuberculosis H37Rv
gacgaacuggucuc

SEQ ID NO: 3255115 - RNA, 14 nt, Mycobacterium tuberculosis H37Rv
gacgaagaagaacu

SEQ ID NO: 3255116 - RNA, 23 nt, Mycobacterium tuberculosis H37Rv
gacgaagaucgcgugccacagca

SEQ ID NO: 3255117 - RNA, 19 nt, Mycobacterium tuberculosis H37Rv
gacgaaggucuccggcaag

SEQ ID NO: 3255118 - RNA, 12 nt, Mycobacterium tuberculosis H37Rv
gacgaaucccgc

SEQ ID NO: 3255119 - RNA, 13 nt, Mycobacterium tuberculosis H37Rv
gacgaaugcagca

SEQ ID NO: 3255120 - RNA, 19 nt, Mycobacterium tuberculosis H37Rv
gacgaauugguugcccuug

SEQ ID NO: 3255121 - RNA, 15 nt, Mycobacterium tuberculosis H37Rv
gacgacaaacggcga

SEQ ID NO: 3255122 - RNA, 14 nt, Mycobacterium tuberculosis H37Rv
gacgacaacaggcc

SEQ ID NO: 3255123 - RNA, 16 nt, Mycobacterium tuberculosis H37Rv
gacgacaacaggccgu

SEQ ID NO: 3255124 - RNA, 18 nt, Mycobacterium tuberculosis H37Rv
gacgacaacaggccgucg

SEQ ID NO: 3255125 - RNA, 17 nt, Mycobacterium tuberculosis H37Rv
gacgacaaccggccaga

SEQ ID NO: 3255126 - RNA, 15 nt, Mycobacterium tuberculosis H37Rv
gacgacaccagagcg

SEQ ID NO: 3255127 - RNA, 22 nt, Mycobacterium tuberculosis H37Rv
gacgaccauacuaauggcgcca

SEQ ID NO: 3255128 - RNA, 23 nt, Mycobacterium tuberculosis H37Rv
gacgaccauacuaauggcgccac

SEQ ID NO: 3255129 - RNA, 19 nt, Mycobacterium tuberculosis H37Rv
gacgaccaugccgaucggc

SEQ ID NO: 3255130 - RNA, 11 nt, Mycobacterium tuberculosis H37Rv
gacgacccggg

SEQ ID NO: 3255131 - RNA, 22 nt, Mycobacterium tuberculosis H37Rv
gacgaccgccugcaacacgcga

SEQ ID NO: 3255132 - RNA, 14 nt, Mycobacterium tuberculosis H37Rv
gacgaccgcgcggc

SEQ ID NO: 3255133 - RNA, 15 nt, Mycobacterium tuberculosis H37Rv
gacgaccgcgcggca

SEQ ID NO: 3255134 - RNA, 17 nt, Mycobacterium tuberculosis H37Rv
gacgaccgcgcggcacu

SEQ ID NO: 3255135 - RNA, 15 nt, Mycobacterium tuberculosis H37Rv
gacgaccgucggcuc

SEQ ID NO: 3255136 - RNA, 23 nt, Mycobacterium tuberculosis H37Rv
gacgaccuugguguggggcggcu

SEQ ID NO: 3255137 - RNA, 16 nt, Mycobacterium tuberculosis H37Rv
gacgacgacaccgcgc

SEQ ID NO: 3255138 - RNA, 16 nt, Mycobacterium tuberculosis H37Rv
gacgacgagggcggga

SEQ ID NO: 3255139 - RNA, 20 nt, Mycobacterium tuberculosis H37Rv
gacgacgccgacgaugacgc

SEQ ID NO: 3255140 - RNA, 13 nt, Mycobacterium tuberculosis H37Rv
gacgacgccgucg

SEQ ID NO: 3255141 - RNA, 22 nt, Mycobacterium tuberculosis H37Rv
gacgacggcauuucagcgcgcc

SEQ ID NO: 3255142 - RNA, 15 nt, Mycobacterium tuberculosis H37Rv
gacgacgggcgccaa

SEQ ID NO: 3255143 - RNA, 15 nt, Mycobacterium tuberculosis H37Rv
gacgacgggguuggg

SEQ ID NO: 3255144 - RNA, 20 nt, Mycobacterium tuberculosis H37Rv
gacgacggguuggcgucgcu

SEQ ID NO: 3255145 - RNA, 19 nt, Mycobacterium tuberculosis H37Rv
gacgacguagauggugguc

SEQ ID NO: 3255146 - RNA, 22 nt, Mycobacterium tuberculosis H37Rv
gacgacguagaugguggucacc

SEQ ID NO: 3255147 - RNA, 19 nt, Mycobacterium tuberculosis H37Rv
gacgacgucgccgccgcgg

SEQ ID NO: 3255148 - RNA, 16 nt, Mycobacterium tuberculosis H37Rv
gacgacguggcugcgu

SEQ ID NO: 3255149 - RNA, 15 nt, Mycobacterium tuberculosis H37Rv
gacgacugggcgccc

SEQ ID NO: 3255150 - RNA, 15 nt, Mycobacterium tuberculosis H37Rv
gacgagacggcagga

SEQ ID NO: 3255151 - RNA, 16 nt, Mycobacterium tuberculosis H37Rv
gacgagauugccgggc

SEQ ID NO: 3255152 - RNA, 21 nt, Mycobacterium tuberculosis H37Rv
gacgagauugccgggccgccg

SEQ ID NO: 3255153 - RNA, 15 nt, Mycobacterium tuberculosis H37Rv
gacgagcacaagauc

SEQ ID NO: 3255154 - RNA, 19 nt, Mycobacterium tuberculosis H37Rv
gacgagcacaugcucgacg

SEQ ID NO: 3255155 - RNA, 20 nt, Mycobacterium tuberculosis H37Rv
gacgagcacaugcucgacgc

SEQ ID NO: 3255156 - RNA, 14 nt, Mycobacterium tuberculosis H37Rv
gacgagcaccgcgc

SEQ ID NO: 3255157 - RNA, 14 nt, Mycobacterium tuberculosis H37Rv
gacgagcacgccga

SEQ ID NO: 3255158 - RNA, 21 nt, Mycobacterium tuberculosis H37Rv
gacgagcagcuagcccggcag

SEQ ID NO: 3255159 - RNA, 20 nt, Mycobacterium tuberculosis H37Rv
gacgagccacggcuucgccg

SEQ ID NO: 3255160 - RNA, 13 nt, Mycobacterium tuberculosis H37Rv
gacgagccgacca

SEQ ID NO: 3255161 - RNA, 15 nt, Mycobacterium tuberculosis H37Rv
gacgagccgaccacc

SEQ ID NO: 3255162 - RNA, 16 nt, Mycobacterium tuberculosis H37Rv
gacgagccgagccucg

SEQ ID NO: 3255163 - RNA, 19 nt, Mycobacterium tuberculosis H37Rv
gacgagcgucagauccggc

SEQ ID NO: 3255164 - RNA, 19 nt, Mycobacterium tuberculosis H37Rv
gacgaggaugucgaugacc

SEQ ID NO: 3255165 - RNA, 20 nt, Mycobacterium tuberculosis H37Rv
gacgaggcaaugcgagcacc

SEQ ID NO: 3255166 - RNA, 14 nt, Mycobacterium tuberculosis H37Rv
gacgagucgccgcg

SEQ ID NO: 3255167 - RNA, 14 nt, Mycobacterium tuberculosis H37Rv
gacgaucaagcugg

SEQ ID NO: 3255168 - RNA, 18 nt, Mycobacterium tuberculosis H37Rv
gacgaucaccccgccaug

SEQ ID NO: 3255169 - RNA, 15 nt, Mycobacterium tuberculosis H37Rv
gacgauccacggcga

SEQ ID NO: 3255170 - RNA, 20 nt, Mycobacterium tuberculosis H37Rv
gacgauccagucugggacac

SEQ ID NO: 3255171 - RNA, 12 nt, Mycobacterium tuberculosis H37Rv
gacgaucgacgc

SEQ ID NO: 3255172 - RNA, 18 nt, Mycobacterium tuberculosis H37Rv
gacgaucgagcugacgau

SEQ ID NO: 3255173 - RNA, 12 nt, Mycobacterium tuberculosis H37Rv
gacgaucgccag

SEQ ID NO: 3255174 - RNA, 15 nt, Mycobacterium tuberculosis H37Rv
gacgaucgccaggcc

SEQ ID NO: 3255175 - RNA, 15 nt, Mycobacterium tuberculosis H37Rv
gacgaucgcggcggg

SEQ ID NO: 3255176 - RNA, 16 nt, Mycobacterium tuberculosis H37Rv
gacgaucgcggcgggc

SEQ ID NO: 3255177 - RNA, 15 nt, Mycobacterium tuberculosis H37Rv
gacgaucggcggcgc

SEQ ID NO: 3255178 - RNA, 23 nt, Mycobacterium tuberculosis H37Rv
gacgaucuccacccgccggccgu

SEQ ID NO: 3255179 - RNA, 15 nt, Mycobacterium tuberculosis H37Rv
gacgaucugcagcac

SEQ ID NO: 3255180 - RNA, 16 nt, Mycobacterium tuberculosis H37Rv
gacgaugaaccgggca

SEQ ID NO: 3255181 - RNA, 21 nt, Mycobacterium tuberculosis H37Rv
gacgaugacagacaucgcgac

SEQ ID NO: 3255182 - RNA, 15 nt, Mycobacterium tuberculosis H37Rv
gacgaugcaggugac

SEQ ID NO: 3255183 - RNA, 17 nt, Mycobacterium tuberculosis H37Rv
gacgaugccucggcggc

SEQ ID NO: 3255184 - RNA, 21 nt, Mycobacterium tuberculosis H37Rv
gacgauggcaagggccgacgu

SEQ ID NO: 3255185 - RNA, 16 nt, Mycobacterium tuberculosis H37Rv
gacgaugucggucgga

SEQ ID NO: 3255186 - RNA, 23 nt, Mycobacterium tuberculosis H37Rv
gacgaugucggucggaucggcgc

SEQ ID NO: 3255187 - RNA, 12 nt, Mycobacterium tuberculosis H37Rv
gacgggccgucg

SEQ ID NO: 3255188 - RNA, 22 nt, Mycobacterium tuberculosis H37Rv
gacgggcgcguccucgccgcac

SEQ ID NO: 3255189 - RNA, 13 nt, Mycobacterium tuberculosis H37Rv
gacgggcucggca

SEQ ID NO: 3255190 - RNA, 16 nt, Mycobacterium tuberculosis H37Rv
gacggggcaaaggagc

SEQ ID NO: 3255191 - RNA, 21 nt, Mycobacterium tuberculosis H37Rv
gacggggcaaaggagccguug

SEQ ID NO: 3255192 - RNA, 21 nt, Mycobacterium tuberculosis H37Rv
gacggggcgagcaugccguug

SEQ ID NO: 3255193 - RNA, 17 nt, Mycobacterium tuberculosis H37Rv
gacggggucgcgaugcu

SEQ ID NO: 3255194 - RNA, 17 nt, Mycobacterium tuberculosis H37Rv
gacggggugagccgacc

SEQ ID NO: 3255195 - RNA, 23 nt, Mycobacterium tuberculosis H37Rv
gacgggguuguggucgaguugaa

SEQ ID NO: 3255196 - RNA, 22 nt, Mycobacterium tuberculosis H37Rv
gacggguagcguacucccccga

SEQ ID NO: 3255197 - RNA, 23 nt, Mycobacterium tuberculosis H37Rv
gacggguccgggccaaugccguu

SEQ ID NO: 3255198 - RNA, 17 nt, Mycobacterium tuberculosis H37Rv
gacgggucgccgccauc

SEQ ID NO: 3255199 - RNA, 15 nt, Mycobacterium tuberculosis H37Rv
gacgggucgcggugu

SEQ ID NO: 3255200 - RNA, 15 nt, Mycobacterium tuberculosis H37Rv
gacgggucggcgccg

SEQ ID NO: 3255201 - RNA, 22 nt, Mycobacterium tuberculosis H37Rv
gacgggucguucuccgcgccgc

SEQ ID NO: 3255202 - RNA, 17 nt, Mycobacterium tuberculosis H37Rv
gacgggucucgcgagcg

SEQ ID NO: 3255203 - RNA, 16 nt, Mycobacterium tuberculosis H37Rv
gacgggugcgggccga

SEQ ID NO: 3255204 - RNA, 16 nt, Mycobacterium tuberculosis H37Rv
gacggguggcccgacc

SEQ ID NO: 3255205 - RNA, 18 nt, Mycobacterium tuberculosis H37Rv
gacgguaaaugucgaaca

SEQ ID NO: 3255206 - RNA, 13 nt, Mycobacterium tuberculosis H37Rv
gacgguacgccag

SEQ ID NO: 3255207 - RNA, 17 nt, Mycobacterium tuberculosis H37Rv
gacggucaaggugcgcc

SEQ ID NO: 3255208 - RNA, 14 nt, Mycobacterium tuberculosis H37Rv
gacggucacggugg

SEQ ID NO: 3255209 - RNA, 12 nt, Mycobacterium tuberculosis H37Rv
gacggucagccg

SEQ ID NO: 3255210 - RNA, 14 nt, Mycobacterium tuberculosis H37Rv
gacggucagccgcg

SEQ ID NO: 3255211 - RNA, 14 nt, Mycobacterium tuberculosis H37Rv
gacggucauccggc

SEQ ID NO: 3255212 - RNA, 15 nt, Mycobacterium tuberculosis H37Rv
gacggucccggcacg

SEQ ID NO: 3255213 - RNA, 23 nt, Mycobacterium tuberculosis H37Rv
gacgguccgcuacggcguccaag

SEQ ID NO: 3255214 - RNA, 13 nt, Mycobacterium tuberculosis H37Rv
gacgguccguucg

SEQ ID NO: 3255215 - RNA, 13 nt, Mycobacterium tuberculosis H37Rv
gacggucgccgug

SEQ ID NO: 3255216 - RNA, 17 nt, Mycobacterium tuberculosis H37Rv
gacggucgucgaucacg

SEQ ID NO: 3255217 - RNA, 18 nt, Mycobacterium tuberculosis H37Rv
gacggugaaaccggccuu

SEQ ID NO: 3255218 - RNA, 17 nt, Mycobacterium tuberculosis H37Rv
gacggugaagccgagcg

SEQ ID NO: 3255219 - RNA, 17 nt, Mycobacterium tuberculosis H37Rv
gacggugaagccguuug

SEQ ID NO: 3255220 - RNA, 15 nt, Mycobacterium tuberculosis H37Rv
gacggugaccgggag

SEQ ID NO: 3255221 - RNA, 17 nt, Mycobacterium tuberculosis H37Rv
gacggugcaggaccaga

SEQ ID NO: 3255222 - RNA, 13 nt, Mycobacterium tuberculosis H37Rv
gacggugccgucg

SEQ ID NO: 3255223 - RNA, 16 nt, Mycobacterium tuberculosis H37Rv
gacgguggcgcugauc

SEQ ID NO: 3255224 - RNA, 22 nt, Mycobacterium tuberculosis H37Rv
gacgguggcgcugauccggucg

SEQ ID NO: 3255225 - RNA, 19 nt, Mycobacterium tuberculosis H37Rv
gacgguggggucgccgucg

SEQ ID NO: 3255226 - RNA, 17 nt, Mycobacterium tuberculosis H37Rv
gacgguggugaucacgu

SEQ ID NO: 3255227 - RNA, 21 nt, Mycobacterium tuberculosis H37Rv
gacgguguugcucgccgucgu

SEQ ID NO: 3255228 - RNA, 20 nt, Mycobacterium tuberculosis H37Rv
gacgguguugguggcggggu

SEQ ID NO: 3255229 - RNA, 15 nt, Mycobacterium tuberculosis H37Rv
gacgguucggucggg

SEQ ID NO: 3255230 - RNA, 18 nt, Mycobacterium tuberculosis H37Rv
gacgguugccccggcgac

SEQ ID NO: 3255231 - RNA, 18 nt, Mycobacterium tuberculosis H37Rv
gacgguugguccgccguc

SEQ ID NO: 3255232 - RNA, 22 nt, Mycobacterium tuberculosis H37Rv
gacgguugguccgccgucgacc

SEQ ID NO: 3255233 - RNA, 16 nt, Mycobacterium tuberculosis H37Rv
gacgguuucgaccacc

SEQ ID NO: 3255234 - RNA, 20 nt, Mycobacterium tuberculosis H37Rv
gacgguuugcagcgggauca

SEQ ID NO: 3255235 - RNA, 20 nt, Mycobacterium tuberculosis H37Rv
gacguagaagucgaucgccg

SEQ ID NO: 3255236 - RNA, 11 nt, Mycobacterium tuberculosis H37Rv
gacguagacga

SEQ ID NO: 3255237 - RNA, 16 nt, Mycobacterium tuberculosis H37Rv
gacguagacgacgucg

SEQ ID NO: 3255238 - RNA, 11 nt, Mycobacterium tuberculosis H37Rv
gacguagacgg

SEQ ID NO: 3255239 - RNA, 14 nt, Mycobacterium tuberculosis H37Rv
gacguaggccaggu

SEQ ID NO: 3255240 - RNA, 20 nt, Mycobacterium tuberculosis H37Rv
gacguaggcgcugaagauca

SEQ ID NO: 3255241 - RNA, 15 nt, Mycobacterium tuberculosis H37Rv
gacguaggcggcggc

SEQ ID NO: 3255242 - RNA, 18 nt, Mycobacterium tuberculosis H37Rv
gacguagggcagcgccag

SEQ ID NO: 3255243 - RNA, 21 nt, Mycobacterium tuberculosis H37Rv
gacguaguugccggcuucggc

SEQ ID NO: 3255244 - RNA, 16 nt, Mycobacterium tuberculosis H37Rv
gacguauagaccaggu

SEQ ID NO: 3255245 - RNA, 12 nt, Mycobacterium tuberculosis H37Rv
gacguaucgccg

SEQ ID NO: 3255246 - RNA, 19 nt, Mycobacterium tuberculosis H37Rv
gacguaucgccgcgggcga

SEQ ID NO: 3255247 - RNA, 23 nt, Mycobacterium tuberculosis H37Rv
gacgucaaacgcaaagacagcgc

SEQ ID NO: 3255248 - RNA, 19 nt, Mycobacterium tuberculosis H37Rv
gacgucaaacgggagcgac

SEQ ID NO: 3255249 - RNA, 15 nt, Mycobacterium tuberculosis H37Rv
gacgucaccguucuu

SEQ ID NO: 3255250 - RNA, 16 nt, Mycobacterium tuberculosis H37Rv
gacgucaccguucuug

SEQ ID NO: 3255251 - RNA, 13 nt, Mycobacterium tuberculosis H37Rv
gacgucaggcuga

SEQ ID NO: 3255252 - RNA, 18 nt, Mycobacterium tuberculosis H37Rv
gacgucaucgucggcgga

SEQ ID NO: 3255253 - RNA, 20 nt, Mycobacterium tuberculosis H37Rv
gacguccagggccacgaucu

SEQ ID NO: 3255254 - RNA, 13 nt, Mycobacterium tuberculosis H37Rv
gacguccaucccg

SEQ ID NO: 3255255 - RNA, 19 nt, Mycobacterium tuberculosis H37Rv
gacguccgcggucgcagca

SEQ ID NO: 3255256 - RNA, 22 nt, Mycobacterium tuberculosis H37Rv
gacguccgcggucgcagcagac

SEQ ID NO: 3255257 - RNA, 15 nt, Mycobacterium tuberculosis H37Rv
gacguccugggcccg

SEQ ID NO: 3255258 - RNA, 21 nt, Mycobacterium tuberculosis H37Rv
gacguccugggcccgaaucgc

SEQ ID NO: 3255259 - RNA, 20 nt, Mycobacterium tuberculosis H37Rv
gacgucgaacuucagcggcg

SEQ ID NO: 3255260 - RNA, 18 nt, Mycobacterium tuberculosis H37Rv
gacgucgauuucggcgac

SEQ ID NO: 3255261 - RNA, 18 nt, Mycobacterium tuberculosis H37Rv
gacgucgcaauaugccac

SEQ ID NO: 3255262 - RNA, 23 nt, Mycobacterium tuberculosis H37Rv
gacgucgcuagaucccaguccga

SEQ ID NO: 3255263 - RNA, 16 nt, Mycobacterium tuberculosis H37Rv
gacgucggccgcaucg

SEQ ID NO: 3255264 - RNA, 16 nt, Mycobacterium tuberculosis H37Rv
gacgucggcgaccagg

SEQ ID NO: 3255265 - RNA, 20 nt, Mycobacterium tuberculosis H37Rv
gacgucggugaacgcgucgu

SEQ ID NO: 3255266 - RNA, 16 nt, Mycobacterium tuberculosis H37Rv
gacgucggugaccucg

SEQ ID NO: 3255267 - RNA, 21 nt, Mycobacterium tuberculosis H37Rv
gacgucggugaccucggcgac

SEQ ID NO: 3255268 - RNA, 20 nt, Mycobacterium tuberculosis H37Rv
gacgucguagacaccuucga

SEQ ID NO: 3255269 - RNA, 24 nt, Mycobacterium tuberculosis H37Rv
gacgucguauucccaggauucagc

SEQ ID NO: 3255270 - RNA, 23 nt, Mycobacterium tuberculosis H37Rv
gacgucgucggugcgccacgacc

SEQ ID NO: 3255271 - RNA, 17 nt, Mycobacterium tuberculosis H37Rv
gacgucgucgucgacgg

SEQ ID NO: 3255272 - RNA, 19 nt, Mycobacterium tuberculosis H37Rv
gacgucgucgucgacggcc

SEQ ID NO: 3255273 - RNA, 15 nt, Mycobacterium tuberculosis H37Rv
gacgucguuacugga

SEQ ID NO: 3255274 - RNA, 22 nt, Mycobacterium tuberculosis H37Rv
gacgucguucuuugucgggauc

SEQ ID NO: 3255275 - RNA, 21 nt, Mycobacterium tuberculosis H37Rv
gacgucguugccguccaccga

SEQ ID NO: 3255276 - RNA, 20 nt, Mycobacterium tuberculosis H37Rv
gacgucucgcaugcucacga

SEQ ID NO: 3255277 - RNA, 15 nt, Mycobacterium tuberculosis H37Rv
gacgucugccaggcg

SEQ ID NO: 3255278 - RNA, 23 nt, Mycobacterium tuberculosis H37Rv
gacgucuucgggcucguccagca

SEQ ID NO: 3255279 - RNA, 19 nt, Mycobacterium tuberculosis H37Rv
gacgucuuggaacacggcc

SEQ ID NO: 3255280 - RNA, 17 nt, Mycobacterium tuberculosis H37Rv
gacgugaagaugcccuu

SEQ ID NO: 3255281 - RNA, 15 nt, Mycobacterium tuberculosis H37Rv
gacgugaaugguggu

SEQ ID NO: 3255282 - RNA, 22 nt, Mycobacterium tuberculosis H37Rv
gacgugagggucaugucgauca

SEQ ID NO: 3255283 - RNA, 16 nt, Mycobacterium tuberculosis H37Rv
gacuggcaccgccagc

SEQ ID NO: 3255284 - RNA, 15 nt, Mycobacterium tuberculosis H37Rv
gacuggcaggccggc

SEQ ID NO: 3255285 - RNA, 20 nt, Mycobacterium tuberculosis H37Rv
gacuggcaggccggcgucga

SEQ ID NO: 3255286 - RNA, 23 nt, Mycobacterium tuberculosis H37Rv
gacuggccgcccggcgagcaggg

SEQ ID NO: 3255287 - RNA, 16 nt, Mycobacterium tuberculosis H37Rv
gacuggccguuucggc

SEQ ID NO: 3255288 - RNA, 15 nt, Mycobacterium tuberculosis H37Rv
gacuggcgcccagcc

SEQ ID NO: 3255289 - RNA, 19 nt, Mycobacterium tuberculosis H37Rv
gacuggcgcccagccggaa

SEQ ID NO: 3255290 - RNA, 20 nt, Mycobacterium tuberculosis H37Rv
gacuggcgugaacguucuuc

SEQ ID NO: 3255291 - RNA, 19 nt, Mycobacterium tuberculosis H37Rv
gacuggggcacgccaugga

SEQ ID NO: 3255292 - RNA, 17 nt, Mycobacterium tuberculosis H37Rv
gacugggugcgcggccg

SEQ ID NO: 3255293 - RNA, 12 nt, Mycobacterium tuberculosis H37Rv
gacugguggucg

SEQ ID NO: 3255294 - RNA, 18 nt, Mycobacterium tuberculosis H37Rv
gacuguacaccgacacgc

SEQ ID NO: 3255295 - RNA, 15 nt, Mycobacterium tuberculosis H37Rv
gacugucccagcucc

SEQ ID NO: 3255296 - RNA, 20 nt, Mycobacterium tuberculosis H37Rv
gacugugaaucucacgacgc

SEQ ID NO: 3255297 - RNA, 22 nt, Mycobacterium tuberculosis H37Rv
gacugugaaucugacgacgcga

SEQ ID NO: 3255298 - RNA, 17 nt, Mycobacterium tuberculosis H37Rv
gacugugcgccgcagcc

SEQ ID NO: 3255299 - RNA, 23 nt, Mycobacterium tuberculosis H37Rv
gacuguucgggaugcagcuguaa

SEQ ID NO: 3255300 - RNA, 15 nt, Mycobacterium tuberculosis H37Rv
gacuuauccggccag

SEQ ID NO: 3255301 - RNA, 17 nt, Mycobacterium tuberculosis H37Rv
gacuucagcauggugga

SEQ ID NO: 3255302 - RNA, 18 nt, Mycobacterium tuberculosis H37Rv
gacuuccgcgucgccggc

SEQ ID NO: 3255303 - RNA, 22 nt, Mycobacterium tuberculosis H37Rv
gacuucggaaaggucggccugc

SEQ ID NO: 3255304 - RNA, 18 nt, Mycobacterium tuberculosis H37Rv
gacuucggggucaccggc

SEQ ID NO: 3255305 - RNA, 22 nt, Mycobacterium tuberculosis H37Rv
gacuucgucaaccaccaggagc

SEQ ID NO: 3255306 - RNA, 17 nt, Mycobacterium tuberculosis H37Rv
gacuugcacgucggcug

SEQ ID NO: 3255307 - RNA, 18 nt, Mycobacterium tuberculosis H37Rv
gacuugcaggcgucccag

SEQ ID NO: 3255308 - RNA, 17 nt, Mycobacterium tuberculosis H37Rv
gacuugcgacccgucga

SEQ ID NO: 3255309 - RNA, 15 nt, Mycobacterium tuberculosis H37Rv
gacuugcgcgcggca

SEQ ID NO: 3255310 - RNA, 21 nt, Mycobacterium tuberculosis H37Rv
gacuugcugcuccuucucgcg

SEQ ID NO: 3255311 - RNA, 14 nt, Mycobacterium tuberculosis H37Rv
gacuugcuggcccg

SEQ ID NO: 3255312 - RNA, 16 nt, Mycobacterium tuberculosis H37Rv
gacuuggcaucgcgag

SEQ ID NO: 3255313 - RNA, 16 nt, Mycobacterium tuberculosis H37Rv
gacuuggccaugcugg

SEQ ID NO: 3255314 - RNA, 18 nt, Mycobacterium tuberculosis H37Rv
gacuuguccaucacaucc

SEQ ID NO: 3255315 - RNA, 19 nt, Mycobacterium tuberculosis H37Rv
gacuuguccaucacaucca

SEQ ID NO: 3255316 - RNA, 15 nt, Mycobacterium tuberculosis H37Rv
gacuugugccacuuc

SEQ ID NO: 3255317 - RNA, 17 nt, Mycobacterium tuberculosis H37Rv
gacuuugggucggcgau

SEQ ID NO: 3255318 - RNA, 18 nt, Mycobacterium tuberculosis H37Rv
gagaaacccgaaguagaa

SEQ ID NO: 3255319 - RNA, 16 nt, Mycobacterium tuberculosis H37Rv
gagaacacccgugccu

SEQ ID NO: 3255320 - RNA, 13 nt, Mycobacterium tuberculosis H37Rv
gagaacgaugucc

SEQ ID NO: 3255321 - RNA, 16 nt, Mycobacterium tuberculosis H37Rv
gagaacgcccgaguga

SEQ ID NO: 3255322 - RNA, 15 nt, Mycobacterium tuberculosis H37Rv
gagaacguagggugg

SEQ ID NO: 3255323 - RNA, 20 nt, Mycobacterium tuberculosis H37Rv
gagaacucaauaguguguuu

SEQ ID NO: 3255324 - RNA, 19 nt, Mycobacterium tuberculosis H37Rv
gagaacuccgggaccaggc

SEQ ID NO: 3255325 - RNA, 17 nt, Mycobacterium tuberculosis H37Rv
gagaacucugcgagaug

SEQ ID NO: 3255326 - RNA, 15 nt, Mycobacterium tuberculosis H37Rv
gagaacuugagcucc

SEQ ID NO: 3255327 - RNA, 16 nt, Mycobacterium tuberculosis H37Rv
gagaacuugagcuccu

SEQ ID NO: 3255328 - RNA, 15 nt, Mycobacterium tuberculosis H37Rv
gagaagaagcccagg

SEQ ID NO: 3255329 - RNA, 17 nt, Mycobacterium tuberculosis H37Rv
gagaagcgucacagucc

SEQ ID NO: 3255330 - RNA, 19 nt, Mycobacterium tuberculosis H37Rv
gagaaggugcugcgcgggu

SEQ ID NO: 3255331 - RNA, 17 nt, Mycobacterium tuberculosis H37Rv
gagaagguuucccgcuu

SEQ ID NO: 3255332 - RNA, 18 nt, Mycobacterium tuberculosis H37Rv
gagaagucgcagcgagga

SEQ ID NO: 3255333 - RNA, 19 nt, Mycobacterium tuberculosis H37Rv
gagaaugcugacggugcag

SEQ ID NO: 3255334 - RNA, 14 nt, Mycobacterium tuberculosis H37Rv
gagaauuccccagc

SEQ ID NO: 3255335 - RNA, 16 nt, Mycobacterium tuberculosis H37Rv
gagacaaaggugccga

SEQ ID NO: 3255336 - RNA, 23 nt, Mycobacterium tuberculosis H37Rv
gagacacccgccaggccgcgcga

SEQ ID NO: 3255337 - RNA, 21 nt, Mycobacterium tuberculosis H37Rv
gagacagcgccaugcccucgg

SEQ ID NO: 3255338 - RNA, 19 nt, Mycobacterium tuberculosis H37Rv
gagacaugucgcugccgcc

SEQ ID NO: 3255339 - RNA, 19 nt, Mycobacterium tuberculosis H37Rv
gagaccaacgcgcaggccg

SEQ ID NO: 3255340 - RNA, 23 nt, Mycobacterium tuberculosis H37Rv
gagaccagguucucggucgguac

SEQ ID NO: 3255341 - RNA, 17 nt, Mycobacterium tuberculosis H37Rv
gagaccgcggccggccg

SEQ ID NO: 3255342 - RNA, 14 nt, Mycobacterium tuberculosis H37Rv
gagaccggccgggu

SEQ ID NO: 3255343 - RNA, 20 nt, Mycobacterium tuberculosis H37Rv
gagaccggccgggugaacca

SEQ ID NO: 3255344 - RNA, 23 nt, Mycobacterium tuberculosis H37Rv
gagacgaccuccucgaugaccgg

SEQ ID NO: 3255345 - RNA, 12 nt, Mycobacterium tuberculosis H37Rv
gagacgaucauc

SEQ ID NO: 3255346 - RNA, 19 nt, Mycobacterium tuberculosis H37Rv
gagacgaucaucucgucgu

SEQ ID NO: 3255347 - RNA, 13 nt, Mycobacterium tuberculosis H37Rv
gagacgaucgcca

SEQ ID NO: 3255348 - RNA, 15 nt, Mycobacterium tuberculosis H37Rv
gagacgaucgccagg

SEQ ID NO: 3255349 - RNA, 22 nt, Mycobacterium tuberculosis H37Rv
gagacgcaugucgggccaggcg

SEQ ID NO: 3255350 - RNA, 22 nt, Mycobacterium tuberculosis H37Rv
gagacgccgucgacgucgaugg

SEQ ID NO: 3255351 - RNA, 16 nt, Mycobacterium tuberculosis H37Rv
gagacgcuccaguggc

SEQ ID NO: 3255352 - RNA, 22 nt, Mycobacterium tuberculosis H37Rv
gagacgcuuuccgccgcaccgg

SEQ ID NO: 3255353 - RNA, 21 nt, Mycobacterium tuberculosis H37Rv
gagacgguguugcucgccguc

SEQ ID NO: 3255354 - RNA, 24 nt, Mycobacterium tuberculosis H37Rv
gagacgucuucgggcucguccagc

SEQ ID NO: 3255355 - RNA, 15 nt, Mycobacterium tuberculosis H37Rv
gagacguuuugcggc

SEQ ID NO: 3255356 - RNA, 14 nt, Mycobacterium tuberculosis H37Rv
gagacucgcucgga

SEQ ID NO: 3255357 - RNA, 12 nt, Mycobacterium tuberculosis H37Rv
gagacugccgcc

SEQ ID NO: 3255358 - RNA, 15 nt, Mycobacterium tuberculosis H37Rv
gagacugccgccgcu

SEQ ID NO: 3255359 - RNA, 16 nt, Mycobacterium tuberculosis H37Rv
gagagauggucgggcg

SEQ ID NO: 3255360 - RNA, 14 nt, Mycobacterium tuberculosis H37Rv
gagagcagccagcc

SEQ ID NO: 3255361 - RNA, 19 nt, Mycobacterium tuberculosis H37Rv
gagagccccgaccagcaga

SEQ ID NO: 3255362 - RNA, 20 nt, Mycobacterium tuberculosis H37Rv
gagagccccgaccagcagac

SEQ ID NO: 3255363 - RNA, 20 nt, Mycobacterium tuberculosis H37Rv
gagagccggcggcgaccaga

SEQ ID NO: 3255364 - RNA, 13 nt, Mycobacterium tuberculosis H37Rv
gagagccucggcc

SEQ ID NO: 3255365 - RNA, 14 nt, Mycobacterium tuberculosis H37Rv
gagagccucggcca

SEQ ID NO: 3255366 - RNA, 15 nt, Mycobacterium tuberculosis H37Rv
gagagccucggccau

SEQ ID NO: 3255367 - RNA, 22 nt, Mycobacterium tuberculosis H37Rv
gagagcgcggagacgaugccgu

SEQ ID NO: 3255368 - RNA, 21 nt, Mycobacterium tuberculosis H37Rv
gagaggccaagauggcgcgcu

SEQ ID NO: 3255369 - RNA, 15 nt, Mycobacterium tuberculosis H37Rv
gagaggcggugcagc

SEQ ID NO: 3255370 - RNA, 15 nt, Mycobacterium tuberculosis H37Rv
gagaggugcugcacc

SEQ ID NO: 3255371 - RNA, 13 nt, Mycobacterium tuberculosis H37Rv
gagaguggccucg

SEQ ID NO: 3255372 - RNA, 20 nt, Mycobacterium tuberculosis H37Rv
gagauaccgaccaucgggac

SEQ ID NO: 3255373 - RNA, 22 nt, Mycobacterium tuberculosis H37Rv
gagauaccgacgcgcucggcga

SEQ ID NO: 3255374 - RNA, 15 nt, Mycobacterium tuberculosis H37Rv
gagauacgggccacc

SEQ ID NO: 3255375 - RNA, 20 nt, Mycobacterium tuberculosis H37Rv
gagauagcaacgaagccggc

SEQ ID NO: 3255376 - RNA, 22 nt, Mycobacterium tuberculosis H37Rv
gagauagcaacgaagccggcgc

SEQ ID NO: 3255377 - RNA, 22 nt, Mycobacterium tuberculosis H37Rv
gagauagucggccggcggucgc

SEQ ID NO: 3255378 - RNA, 15 nt, Mycobacterium tuberculosis H37Rv
gagaucaccgccacc

SEQ ID NO: 3255379 - RNA, 16 nt, Mycobacterium tuberculosis H37Rv
gagccacggcuucgcc

SEQ ID NO: 3255380 - RNA, 17 nt, Mycobacterium tuberculosis H37Rv
gagccagaaugcaagca

SEQ ID NO: 3255381 - RNA, 22 nt, Mycobacterium tuberculosis H37Rv
gagccaggacgacgccgacgau

SEQ ID NO: 3255382 - RNA, 10 nt, Mycobacterium tuberculosis H37Rv
gagccaggga

SEQ ID NO: 3255383 - RNA, 17 nt, Mycobacterium tuberculosis H37Rv
gagccagggaggggccg

SEQ ID NO: 3255384 - RNA, 18 nt, Mycobacterium tuberculosis H37Rv
gagccaugccgcucggca

SEQ ID NO: 3255385 - RNA, 13 nt, Mycobacterium tuberculosis H37Rv
gagcccaccuggg

SEQ ID NO: 3255386 - RNA, 19 nt, Mycobacterium tuberculosis H37Rv
gagccccagcgacgucgca

SEQ ID NO: 3255387 - RNA, 14 nt, Mycobacterium tuberculosis H37Rv
gagccccgaccagc

SEQ ID NO: 3255388 - RNA, 17 nt, Mycobacterium tuberculosis H37Rv
gagccccgaccagcaga

SEQ ID NO: 3255389 - RNA, 15 nt, Mycobacterium tuberculosis H37Rv
gagccccgacugcug

SEQ ID NO: 3255390 - RNA, 17 nt, Mycobacterium tuberculosis H37Rv
gagcccgacucuccggc

SEQ ID NO: 3255391 - RNA, 12 nt, Mycobacterium tuberculosis H37Rv
gagcccgccagc

SEQ ID NO: 3255392 - RNA, 15 nt, Mycobacterium tuberculosis H37Rv
gagcccgccagcgcc

SEQ ID NO: 3255393 - RNA, 17 nt, Mycobacterium tuberculosis H37Rv
gagcccgccgcgaccac

SEQ ID NO: 3255394 - RNA, 16 nt, Mycobacterium tuberculosis H37Rv
gagcccgcgaucacca

SEQ ID NO: 3255395 - RNA, 16 nt, Mycobacterium tuberculosis H37Rv
gagcccgcugcgccgg

SEQ ID NO: 3255396 - RNA, 22 nt, Mycobacterium tuberculosis H37Rv
gagcccggcggcccgauagauc

SEQ ID NO: 3255397 - RNA, 22 nt, Mycobacterium tuberculosis H37Rv
gagcccggucccuuuguggggc

SEQ ID NO: 3255398 - RNA, 15 nt, Mycobacterium tuberculosis H37Rv
gagcccggucgcucg

SEQ ID NO: 3255399 - RNA, 12 nt, Mycobacterium tuberculosis H37Rv
gagcccggugcu

SEQ ID NO: 3255400 - RNA, 21 nt, Mycobacterium tuberculosis H37Rv
gagcccgucagcuccccgucg

SEQ ID NO: 3255401 - RNA, 20 nt, Mycobacterium tuberculosis H37Rv
gagcccucguuaucgaccgc

SEQ ID NO: 3255402 - RNA, 19 nt, Mycobacterium tuberculosis H37Rv
gagccgacaacgacgucgc

SEQ ID NO: 3255403 - RNA, 16 nt, Mycobacterium tuberculosis H37Rv
gagccgacccgcccga

SEQ ID NO: 3255404 - RNA, 17 nt, Mycobacterium tuberculosis H37Rv
gagccgacggcggcggc

SEQ ID NO: 3255405 - RNA, 18 nt, Mycobacterium tuberculosis H37Rv
gagccgagccagcuccgg

SEQ ID NO: 3255406 - RNA, 13 nt, Mycobacterium tuberculosis H37Rv
gagccgagccgau

SEQ ID NO: 3255407 - RNA, 16 nt, Mycobacterium tuberculosis H37Rv
gagccgagccucgcuc

SEQ ID NO: 3255408 - RNA, 18 nt, Mycobacterium tuberculosis H37Rv
gagccgaggaauacucuc

SEQ ID NO: 3255409 - RNA, 15 nt, Mycobacterium tuberculosis H37Rv
gagccgaggcgggaa

SEQ ID NO: 3255410 - RNA, 18 nt, Mycobacterium tuberculosis H37Rv
gagccgaggugcugcaca

SEQ ID NO: 3255411 - RNA, 13 nt, Mycobacterium tuberculosis H37Rv
gagccgaucgccc

SEQ ID NO: 3255412 - RNA, 14 nt, Mycobacterium tuberculosis H37Rv
gagccgaucgcccg

SEQ ID NO: 3255413 - RNA, 11 nt, Mycobacterium tuberculosis H37Rv
gagccgcagcc

SEQ ID NO: 3255414 - RNA, 14 nt, Mycobacterium tuberculosis H37Rv
gagccgcccaagcc

SEQ ID NO: 3255415 - RNA, 13 nt, Mycobacterium tuberculosis H37Rv
gagccgccgcgac

SEQ ID NO: 3255416 - RNA, 16 nt, Mycobacterium tuberculosis H37Rv
gagccgccgcgacggc

SEQ ID NO: 3255417 - RNA, 19 nt, Mycobacterium tuberculosis H37Rv
gagccgcgaaaucaccgcu

SEQ ID NO: 3255418 - RNA, 15 nt, Mycobacterium tuberculosis H37Rv
gagccgcggucggcg

SEQ ID NO: 3255419 - RNA, 21 nt, Mycobacterium tuberculosis H37Rv
gagccgcggucggcgugcagg

SEQ ID NO: 3255420 - RNA, 22 nt, Mycobacterium tuberculosis H37Rv
gagccgcguucgcgcaaaugcc

SEQ ID NO: 3255421 - RNA, 23 nt, Mycobacterium tuberculosis H37Rv
gagccgcuacguuacgccgagau

SEQ ID NO: 3255422 - RNA, 17 nt, Mycobacterium tuberculosis H37Rv
gagccgcuaggacggcg

SEQ ID NO: 3255423 - RNA, 22 nt, Mycobacterium tuberculosis H37Rv
gagccgcucggcguagcgagcg

SEQ ID NO: 3255424 - RNA, 16 nt, Mycobacterium tuberculosis H37Rv
gagccgcucuagcguc

SEQ ID NO: 3255425 - RNA, 16 nt, Mycobacterium tuberculosis H37Rv
gagccgcuuucccggc

SEQ ID NO: 3255426 - RNA, 22 nt, Mycobacterium tuberculosis H37Rv
gagccggaacagugccaccuga

SEQ ID NO: 3255427 - RNA, 18 nt, Mycobacterium tuberculosis H37Rv
gagccggacguucuggau

SEQ ID NO: 3255428 - RNA, 21 nt, Mycobacterium tuberculosis H37Rv
gagccggcccugcucgccguc

SEQ ID NO: 3255429 - RNA, 14 nt, Mycobacterium tuberculosis H37Rv
gagccggccgugau

SEQ ID NO: 3255430 - RNA, 12 nt, Mycobacterium tuberculosis H37Rv
gagccggcggcc

SEQ ID NO: 3255431 - RNA, 18 nt, Mycobacterium tuberculosis H37Rv
gagccggcggcgaccaga

SEQ ID NO: 3255432 - RNA, 14 nt, Mycobacterium tuberculosis H37Rv
gagccgggcaacca

SEQ ID NO: 3255433 - RNA, 16 nt, Mycobacterium tuberculosis H37Rv
gagccgggcaaccagc

SEQ ID NO: 3255434 - RNA, 18 nt, Mycobacterium tuberculosis H37Rv
gagccgggcaaccagcag

SEQ ID NO: 3255435 - RNA, 19 nt, Mycobacterium tuberculosis H37Rv
gagccgggcaaccagcagc

SEQ ID NO: 3255436 - RNA, 17 nt, Mycobacterium tuberculosis H37Rv
gagccgggccguccggg

SEQ ID NO: 3255437 - RNA, 18 nt, Mycobacterium tuberculosis H37Rv
gagccgggcuggccgacu

SEQ ID NO: 3255438 - RNA, 16 nt, Mycobacterium tuberculosis H37Rv
gagccggugccgcggu

SEQ ID NO: 3255439 - RNA, 14 nt, Mycobacterium tuberculosis H37Rv
gagccgguggcccg

SEQ ID NO: 3255440 - RNA, 20 nt, Mycobacterium tuberculosis H37Rv
gagccgguggcccgccggca

SEQ ID NO: 3255441 - RNA, 15 nt, Mycobacterium tuberculosis H37Rv
gagccggugggugac

SEQ ID NO: 3255442 - RNA, 17 nt, Mycobacterium tuberculosis H37Rv
gagccguagugucggcg

SEQ ID NO: 3255443 - RNA, 20 nt, Mycobacterium tuberculosis H37Rv
gagccguagugucggcgucu

SEQ ID NO: 3255444 - RNA, 20 nt, Mycobacterium tuberculosis H37Rv
gagccguccaauuccgcaga

SEQ ID NO: 3255445 - RNA, 23 nt, Mycobacterium tuberculosis H37Rv
gagccgucgucgagccggaacag

SEQ ID NO: 3255446 - RNA, 13 nt, Mycobacterium tuberculosis H37Rv
gagccgugccagc

SEQ ID NO: 3255447 - RNA, 14 nt, Mycobacterium tuberculosis H37Rv
gagccgugccagca

SEQ ID NO: 3255448 - RNA, 17 nt, Mycobacterium tuberculosis H37Rv
gagccgugccgccagca

SEQ ID NO: 3255449 - RNA, 20 nt, Mycobacterium tuberculosis H37Rv
gagccgugccgccagcaacc

SEQ ID NO: 3255450 - RNA, 13 nt, Mycobacterium tuberculosis H37Rv
gagccgugccucg

SEQ ID NO: 3255451 - RNA, 14 nt, Mycobacterium tuberculosis H37Rv
gagccuccauggcc

SEQ ID NO: 3255452 - RNA, 21 nt, Mycobacterium tuberculosis H37Rv
gagccucgcgcgccacggugu

SEQ ID NO: 3255453 - RNA, 20 nt, Mycobacterium tuberculosis H37Rv
gagccucggccaucugcucg

SEQ ID NO: 3255454 - RNA, 10 nt, Mycobacterium tuberculosis H37Rv
gagccuuggu

SEQ ID NO: 3255455 - RNA, 14 nt, Mycobacterium tuberculosis H37Rv
gagcgaacccccgc

SEQ ID NO: 3255456 - RNA, 18 nt, Mycobacterium tuberculosis H37Rv
gagcgaacccuucgcggu

SEQ ID NO: 3255457 - RNA, 19 nt, Mycobacterium tuberculosis H37Rv
gagcgaaccgaagccgucg

SEQ ID NO: 3255458 - RNA, 13 nt, Mycobacterium tuberculosis H37Rv
gagcgaacggcgc

SEQ ID NO: 3255459 - RNA, 14 nt, Mycobacterium tuberculosis H37Rv
gagcgacccccagc

SEQ ID NO: 3255460 - RNA, 17 nt, Mycobacterium tuberculosis H37Rv
gagcgacccccagcgcc

SEQ ID NO: 3255461 - RNA, 19 nt, Mycobacterium tuberculosis H37Rv
gagcgaccgcgagggccag

SEQ ID NO: 3255462 - RNA, 21 nt, Mycobacterium tuberculosis H37Rv
gagcgaccgcgagggccagca

SEQ ID NO: 3255463 - RNA, 16 nt, Mycobacterium tuberculosis H37Rv
gagcgacugcagcggc

SEQ ID NO: 3255464 - RNA, 19 nt, Mycobacterium tuberculosis H37Rv
gagcgacugcagcggcgca

SEQ ID NO: 3255465 - RNA, 18 nt, Mycobacterium tuberculosis H37Rv
gagcgagaaucacgguca

SEQ ID NO: 3255466 - RNA, 14 nt, Mycobacterium tuberculosis H37Rv
gagcgagccaacuc

SEQ ID NO: 3255467 - RNA, 19 nt, Mycobacterium tuberculosis H37Rv
gagcgagcucccgggcgcu

SEQ ID NO: 3255468 - RNA, 22 nt, Mycobacterium tuberculosis H37Rv
gagcgaggcucccccaccaggg

SEQ ID NO: 3255469 - RNA, 18 nt, Mycobacterium tuberculosis H37Rv
gagcgauacgucgucagc

SEQ ID NO: 3255470 - RNA, 20 nt, Mycobacterium tuberculosis H37Rv
gagcgauacgucgucagcca

SEQ ID NO: 3255471 - RNA, 15 nt, Mycobacterium tuberculosis H37Rv
gagcgaugcgaccga

SEQ ID NO: 3255472 - RNA, 23 nt, Mycobacterium tuberculosis H37Rv
gagcgcaaccagcaaugccgacu

SEQ ID NO: 3255473 - RNA, 15 nt, Mycobacterium tuberculosis H37Rv
gagcgcaaucgacca

SEQ ID NO: 3255474 - RNA, 21 nt, Mycobacterium tuberculosis H37Rv
gagcgcaaucgaccacgacgu

SEQ ID NO: 3255475 - RNA, 14 nt, Mycobacterium tuberculosis H37Rv
gagcgcaccacggc

SEQ ID NO: 3255476 - RNA, 16 nt, Mycobacterium tuberculosis H37Rv
gagcugacgccgagcu

SEQ ID NO: 3255477 - RNA, 19 nt, Mycobacterium tuberculosis H37Rv
gagcugagcggccagcauc

SEQ ID NO: 3255478 - RNA, 21 nt, Mycobacterium tuberculosis H37Rv
gagcugauccggguggcguca

SEQ ID NO: 3255479 - RNA, 22 nt, Mycobacterium tuberculosis H37Rv
gagcugauuguguuccaccagc

SEQ ID NO: 3255480 - RNA, 16 nt, Mycobacterium tuberculosis H37Rv
gagcugccaacgcccg

SEQ ID NO: 3255481 - RNA, 21 nt, Mycobacterium tuberculosis H37Rv
gagcugccgagcggucaacga

SEQ ID NO: 3255482 - RNA, 14 nt, Mycobacterium tuberculosis H37Rv
gagcugcggcggcc

SEQ ID NO: 3255483 - RNA, 12 nt, Mycobacterium tuberculosis H37Rv
gagcugcucgcc

SEQ ID NO: 3255484 - RNA, 15 nt, Mycobacterium tuberculosis H37Rv
gagcugcucgccggc

SEQ ID NO: 3255485 - RNA, 19 nt, Mycobacterium tuberculosis H37Rv
gagcugcuggcgcgccugu

SEQ ID NO: 3255486 - RNA, 15 nt, Mycobacterium tuberculosis H37Rv
gagcuggaccuccga

SEQ ID NO: 3255487 - RNA, 14 nt, Mycobacterium tuberculosis H37Rv
gagcuggcgaccug

SEQ ID NO: 3255488 - RNA, 22 nt, Mycobacterium tuberculosis H37Rv
gagcuggcgaccuggucgcugg

SEQ ID NO: 3255489 - RNA, 22 nt, Mycobacterium tuberculosis H37Rv
gagcuggcgcgcgggguggcgg

SEQ ID NO: 3255490 - RNA, 17 nt, Mycobacterium tuberculosis H37Rv
gagcuggcugacgauuu

SEQ ID NO: 3255491 - RNA, 16 nt, Mycobacterium tuberculosis H37Rv
gagcugguugacggcg

SEQ ID NO: 3255492 - RNA, 19 nt, Mycobacterium tuberculosis H37Rv
gagcuguggucacccgugu

SEQ ID NO: 3255493 - RNA, 17 nt, Mycobacterium tuberculosis H37Rv
gagcuuccgcgcgcaga

SEQ ID NO: 3255494 - RNA, 12 nt, Mycobacterium tuberculosis H37Rv
gagcuucgccgc

SEQ ID NO: 3255495 - RNA, 20 nt, Mycobacterium tuberculosis H37Rv
gagcuuggccagcagcagcg

SEQ ID NO: 3255496 - RNA, 16 nt, Mycobacterium tuberculosis H37Rv
gagcuugggccggugc

SEQ ID NO: 3255497 - RNA, 15 nt, Mycobacterium tuberculosis H37Rv
gagcuuggucgccgg

SEQ ID NO: 3255498 - RNA, 18 nt, Mycobacterium tuberculosis H37Rv
gagcuugguggccaccac

SEQ ID NO: 3255499 - RNA, 19 nt, Mycobacterium tuberculosis H37Rv
gagcuugguggccaccacg

SEQ ID NO: 3255500 - RNA, 21 nt, Mycobacterium tuberculosis H37Rv
gagcuugguggccaccacggc

SEQ ID NO: 3255501 - RNA, 23 nt, Mycobacterium tuberculosis H37Rv
gagcuugguggccaccacggcgc

SEQ ID NO: 3255502 - RNA, 15 nt, Mycobacterium tuberculosis H37Rv
gagcuuuaucugcau

SEQ ID NO: 3255503 - RNA, 20 nt, Mycobacterium tuberculosis H37Rv
gagcuuuuugcgucuguucg

SEQ ID NO: 3255504 - RNA, 21 nt, Mycobacterium tuberculosis H37Rv
gaggaacuugcauccggccca

SEQ ID NO: 3255505 - RNA, 22 nt, Mycobacterium tuberculosis H37Rv
gaggaacuugcauccggcccac

SEQ ID NO: 3255506 - RNA, 14 nt, Mycobacterium tuberculosis H37Rv
gaggaagcggcggc

SEQ ID NO: 3255507 - RNA, 23 nt, Mycobacterium tuberculosis H37Rv
gaggaaggugugcgucuccagcu

SEQ ID NO: 3255508 - RNA, 23 nt, Mycobacterium tuberculosis H37Rv
gaggaauacagcuugaucgccga

SEQ ID NO: 3255509 - RNA, 15 nt, Mycobacterium tuberculosis H37Rv
gaggaaucguucggg

SEQ ID NO: 3255510 - RNA, 16 nt, Mycobacterium tuberculosis H37Rv
gaggaauucgaucugg

SEQ ID NO: 3255511 - RNA, 20 nt, Mycobacterium tuberculosis H37Rv
gaggacccgugcacgaucgc

SEQ ID NO: 3255512 - RNA, 22 nt, Mycobacterium tuberculosis H37Rv
gaggacccgugcacgaucgcgg

SEQ ID NO: 3255513 - RNA, 20 nt, Mycobacterium tuberculosis H37Rv
gaggaccucgucaccgguca

SEQ ID NO: 3255514 - RNA, 13 nt, Mycobacterium tuberculosis H37Rv
gaggacgacgauc

SEQ ID NO: 3255515 - RNA, 13 nt, Mycobacterium tuberculosis H37Rv
gaggacgcugauc

SEQ ID NO: 3255516 - RNA, 12 nt, Mycobacterium tuberculosis H37Rv
gaggacggcggc

SEQ ID NO: 3255517 - RNA, 13 nt, Mycobacterium tuberculosis H37Rv
gaggacggcggcc

SEQ ID NO: 3255518 - RNA, 15 nt, Mycobacterium tuberculosis H37Rv
gaggacggcggccag

SEQ ID NO: 3255519 - RNA, 18 nt, Mycobacterium tuberculosis H37Rv
gaggacggcuugagccgc

SEQ ID NO: 3255520 - RNA, 15 nt, Mycobacterium tuberculosis H37Rv
gaggacuggaaagca

SEQ ID NO: 3255521 - RNA, 12 nt, Mycobacterium tuberculosis H37Rv
gaggacuugcac

SEQ ID NO: 3255522 - RNA, 14 nt, Mycobacterium tuberculosis H37Rv
gaggaggcggucga

SEQ ID NO: 3255523 - RNA, 16 nt, Mycobacterium tuberculosis H37Rv
gaggagggccgcgauc

SEQ ID NO: 3255524 - RNA, 20 nt, Mycobacterium tuberculosis H37Rv
gaggauaucgccgagaacca

SEQ ID NO: 3255525 - RNA, 21 nt, Mycobacterium tuberculosis H37Rv
gaggaugacgacggugaccgg

SEQ ID NO: 3255526 - RNA, 20 nt, Mycobacterium tuberculosis H37Rv
gaggaugucgagcccgucga

SEQ ID NO: 3255527 - RNA, 16 nt, Mycobacterium tuberculosis H37Rv
gaggauuugguggcug

SEQ ID NO: 3255528 - RNA, 17 nt, Mycobacterium tuberculosis H37Rv
gaggcaauccgaucugg

SEQ ID NO: 3255529 - RNA, 15 nt, Mycobacterium tuberculosis H37Rv
gaggcacaaucaccg

SEQ ID NO: 3255530 - RNA, 17 nt, Mycobacterium tuberculosis H37Rv
gaggcacaaucaccgcc

SEQ ID NO: 3255531 - RNA, 19 nt, Mycobacterium tuberculosis H37Rv
gaggcacccgugccgccga

SEQ ID NO: 3255532 - RNA, 20 nt, Mycobacterium tuberculosis H37Rv
gaggcaggccucggcgccgc

SEQ ID NO: 3255533 - RNA, 19 nt, Mycobacterium tuberculosis H37Rv
gaggcagucguugaugcuu

SEQ ID NO: 3255534 - RNA, 15 nt, Mycobacterium tuberculosis H37Rv
gaggcauucucccgg

SEQ ID NO: 3255535 - RNA, 16 nt, Mycobacterium tuberculosis H37Rv
gaggccaaccacagcc

SEQ ID NO: 3255536 - RNA, 15 nt, Mycobacterium tuberculosis H37Rv
gaggccaacccugcg

SEQ ID NO: 3255537 - RNA, 21 nt, Mycobacterium tuberculosis H37Rv
gaggccaaguugcagcgggcc

SEQ ID NO: 3255538 - RNA, 13 nt, Mycobacterium tuberculosis H37Rv
gaggccaccgcga

SEQ ID NO: 3255539 - RNA, 14 nt, Mycobacterium tuberculosis H37Rv
gaggccacgccagc

SEQ ID NO: 3255540 - RNA, 13 nt, Mycobacterium tuberculosis H37Rv
gaggccaucaucc

SEQ ID NO: 3255541 - RNA, 12 nt, Mycobacterium tuberculosis H37Rv
gaggccccccgc

SEQ ID NO: 3255542 - RNA, 14 nt, Mycobacterium tuberculosis H37Rv
gaggccccccgcgc

SEQ ID NO: 3255543 - RNA, 13 nt, Mycobacterium tuberculosis H37Rv
gaggccgaccucg

SEQ ID NO: 3255544 - RNA, 13 nt, Mycobacterium tuberculosis H37Rv
gaggccgccguug

SEQ ID NO: 3255545 - RNA, 15 nt, Mycobacterium tuberculosis H37Rv
gaggccgcugccagg

SEQ ID NO: 3255546 - RNA, 17 nt, Mycobacterium tuberculosis H37Rv
gaggccgcugccagggu

SEQ ID NO: 3255547 - RNA, 14 nt, Mycobacterium tuberculosis H37Rv
gaggccggugaacg

SEQ ID NO: 3255548 - RNA, 17 nt, Mycobacterium tuberculosis H37Rv
gaggccuaccaggcgcg

SEQ ID NO: 3255549 - RNA, 20 nt, Mycobacterium tuberculosis H37Rv
gaggccuaccaggcgcggcc

SEQ ID NO: 3255550 - RNA, 15 nt, Mycobacterium tuberculosis H37Rv
gaggccucggccagc

SEQ ID NO: 3255551 - RNA, 16 nt, Mycobacterium tuberculosis H37Rv
gaggccuucgccgacu

SEQ ID NO: 3255552 - RNA, 15 nt, Mycobacterium tuberculosis H37Rv
gaggcgaccggacga

SEQ ID NO: 3255553 - RNA, 17 nt, Mycobacterium tuberculosis H37Rv
gaggcgacgucguucuu

SEQ ID NO: 3255554 - RNA, 13 nt, Mycobacterium tuberculosis H37Rv
gaggcgaucaccg

SEQ ID NO: 3255555 - RNA, 14 nt, Mycobacterium tuberculosis H37Rv
gaggcgaucaccgc

SEQ ID NO: 3255556 - RNA, 19 nt, Mycobacterium tuberculosis H37Rv
gaggcgaucaccgcgccgg

SEQ ID NO: 3255557 - RNA, 21 nt, Mycobacterium tuberculosis H37Rv
gaggcgcaagaaugccgccga

SEQ ID NO: 3255558 - RNA, 22 nt, Mycobacterium tuberculosis H37Rv
gaggcgcaccuccugcgagugc

SEQ ID NO: 3255559 - RNA, 13 nt, Mycobacterium tuberculosis H37Rv
gaggcgcggucga

SEQ ID NO: 3255560 - RNA, 19 nt, Mycobacterium tuberculosis H37Rv
gaggcggcgccgcacccac

SEQ ID NO: 3255561 - RNA, 24 nt, Mycobacterium tuberculosis H37Rv
gaggcggucgaucauggcggcagc

SEQ ID NO: 3255562 - RNA, 21 nt, Mycobacterium tuberculosis H37Rv
gaggcggugacgaagccgacc

SEQ ID NO: 3255563 - RNA, 20 nt, Mycobacterium tuberculosis H37Rv
gaggcguaccagcuggccac

SEQ ID NO: 3255564 - RNA, 21 nt, Mycobacterium tuberculosis H37Rv
gaggcuaggcguuugguguga

SEQ ID NO: 3255565 - RNA, 15 nt, Mycobacterium tuberculosis H37Rv
gaggcucgggccgca

SEQ ID NO: 3255566 - RNA, 19 nt, Mycobacterium tuberculosis H37Rv
gaggcugggcugagggugg

SEQ ID NO: 3255567 - RNA, 21 nt, Mycobacterium tuberculosis H37Rv
gaggcugugccccagggcagu

SEQ ID NO: 3255568 - RNA, 23 nt, Mycobacterium tuberculosis H37Rv
gaggcugugccccagggcagugc

SEQ ID NO: 3255569 - RNA, 17 nt, Mycobacterium tuberculosis H37Rv
gaggcuuacaugcccug

SEQ ID NO: 3255570 - RNA, 14 nt, Mycobacterium tuberculosis H37Rv
gagggaaucuccgg

SEQ ID NO: 3255571 - RNA, 14 nt, Mycobacterium tuberculosis H37Rv
gagggagcgccgca

SEQ ID NO: 3255572 - RNA, 14 nt, Mycobacterium tuberculosis H37Rv
gagucgucggcaug

SEQ ID NO: 3255573 - RNA, 20 nt, Mycobacterium tuberculosis H37Rv
gagucguuuggcgccgccga

SEQ ID NO: 3255574 - RNA, 15 nt, Mycobacterium tuberculosis H37Rv
gagucucgucgggua

SEQ ID NO: 3255575 - RNA, 19 nt, Mycobacterium tuberculosis H37Rv
gagucugauggccucgcga

SEQ ID NO: 3255576 - RNA, 13 nt, Mycobacterium tuberculosis H37Rv
gagugaauccggc

SEQ ID NO: 3255577 - RNA, 20 nt, Mycobacterium tuberculosis H37Rv
gagugagcucagcaaguucg

SEQ ID NO: 3255578 - RNA, 17 nt, Mycobacterium tuberculosis H37Rv
gagugauucggcgacga

SEQ ID NO: 3255579 - RNA, 18 nt, Mycobacterium tuberculosis H37Rv
gagugcacagacacggca

SEQ ID NO: 3255580 - RNA, 12 nt, Mycobacterium tuberculosis H37Rv
gagugcagcacg

SEQ ID NO: 3255581 - RNA, 17 nt, Mycobacterium tuberculosis H37Rv
gagugcagcacgaucca

SEQ ID NO: 3255582 - RNA, 14 nt, Mycobacterium tuberculosis H37Rv
gagugccgccgucg

SEQ ID NO: 3255583 - RNA, 15 nt, Mycobacterium tuberculosis H37Rv
gagugccucgaccug

SEQ ID NO: 3255584 - RNA, 14 nt, Mycobacterium tuberculosis H37Rv
gagugcgccggcug

SEQ ID NO: 3255585 - RNA, 19 nt, Mycobacterium tuberculosis H37Rv
gagugcggacuucgccgcc

SEQ ID NO: 3255586 - RNA, 22 nt, Mycobacterium tuberculosis H37Rv
gagugcggcguauugcggccug

SEQ ID NO: 3255587 - RNA, 20 nt, Mycobacterium tuberculosis H37Rv
gagugcguugacucugcguc

SEQ ID NO: 3255588 - RNA, 22 nt, Mycobacterium tuberculosis H37Rv
gaguggaugcgccgcacggcga

SEQ ID NO: 3255589 - RNA, 21 nt, Mycobacterium tuberculosis H37Rv
gaguggcgauuucggcgccug

SEQ ID NO: 3255590 - RNA, 15 nt, Mycobacterium tuberculosis H37Rv
gagugucacugggcc

SEQ ID NO: 3255591 - RNA, 23 nt, Mycobacterium tuberculosis H37Rv
gagugucccgaugguggccgcgc

SEQ ID NO: 3255592 - RNA, 16 nt, Mycobacterium tuberculosis H37Rv
gagugucuuagccagc

SEQ ID NO: 3255593 - RNA, 20 nt, Mycobacterium tuberculosis H37Rv
gagugucuuagccagcagca

SEQ ID NO: 3255594 - RNA, 23 nt, Mycobacterium tuberculosis H37Rv
gagugucuuagccagcagcacau

SEQ ID NO: 3255595 - RNA, 20 nt, Mycobacterium tuberculosis H37Rv
gagugugaaucgcacgacgc

SEQ ID NO: 3255596 - RNA, 18 nt, Mycobacterium tuberculosis H37Rv
gaguucccgaaacccgau

SEQ ID NO: 3255597 - RNA, 22 nt, Mycobacterium tuberculosis H37Rv
gaguuccggucgacuccagcac

SEQ ID NO: 3255598 - RNA, 17 nt, Mycobacterium tuberculosis H37Rv
gaguucggccaccaacc

SEQ ID NO: 3255599 - RNA, 12 nt, Mycobacterium tuberculosis H37Rv
gaguugaagaag

SEQ ID NO: 3255600 - RNA, 15 nt, Mycobacterium tuberculosis H37Rv
gaguugaagaagccc

SEQ ID NO: 3255601 - RNA, 20 nt, Mycobacterium tuberculosis H37Rv
gaguugaagaagcccgacga

SEQ ID NO: 3255602 - RNA, 22 nt, Mycobacterium tuberculosis H37Rv
gaguugaagaaucccgggcucu

SEQ ID NO: 3255603 - RNA, 21 nt, Mycobacterium tuberculosis H37Rv
gaguugaugaagauggcgcgc

SEQ ID NO: 3255604 - RNA, 19 nt, Mycobacterium tuberculosis H37Rv
gaguugcccgggucggccg

SEQ ID NO: 3255605 - RNA, 15 nt, Mycobacterium tuberculosis H37Rv
gaguugccgggucga

SEQ ID NO: 3255606 - RNA, 17 nt, Mycobacterium tuberculosis H37Rv
gaguugccgggucgauu

SEQ ID NO: 3255607 - RNA, 16 nt, Mycobacterium tuberculosis H37Rv
gaguugcuugcagggc

SEQ ID NO: 3255608 - RNA, 21 nt, Mycobacterium tuberculosis H37Rv
gaguuggucguggcugugcgg

SEQ ID NO: 3255609 - RNA, 22 nt, Mycobacterium tuberculosis H37Rv
gaguuggucguggcugugcggg

SEQ ID NO: 3255610 - RNA, 19 nt, Mycobacterium tuberculosis H37Rv
gaguugguguuauugaugc

SEQ ID NO: 3255611 - RNA, 18 nt, Mycobacterium tuberculosis H37Rv
gaguuugaccaccugguu

SEQ ID NO: 3255612 - RNA, 19 nt, Mycobacterium tuberculosis H37Rv
gaguuugauuucgcacgga

SEQ ID NO: 3255613 - RNA, 22 nt, Mycobacterium tuberculosis H37Rv
gauaacccaaccgcgccaccuc

SEQ ID NO: 3255614 - RNA, 13 nt, Mycobacterium tuberculosis H37Rv
gauaacccagcac

SEQ ID NO: 3255615 - RNA, 17 nt, Mycobacterium tuberculosis H37Rv
gauaacccagcaccaca

SEQ ID NO: 3255616 - RNA, 16 nt, Mycobacterium tuberculosis H37Rv
gauaacuccgcggcga

SEQ ID NO: 3255617 - RNA, 21 nt, Mycobacterium tuberculosis H37Rv
gauaaggcaaggcauccaacg

SEQ ID NO: 3255618 - RNA, 16 nt, Mycobacterium tuberculosis H37Rv
gauaaucguuuucggc

SEQ ID NO: 3255619 - RNA, 19 nt, Mycobacterium tuberculosis H37Rv
gauaaugaucucggcaagg

SEQ ID NO: 3255620 - RNA, 16 nt, Mycobacterium tuberculosis H37Rv
gauaauucaacagcac

SEQ ID NO: 3255621 - RNA, 18 nt, Mycobacterium tuberculosis H37Rv
gauacagcacauccagcc

SEQ ID NO: 3255622 - RNA, 16 nt, Mycobacterium tuberculosis H37Rv
gauacagcgccagggg

SEQ ID NO: 3255623 - RNA, 19 nt, Mycobacterium tuberculosis H37Rv
gauacagcgccaggggugu

SEQ ID NO: 3255624 - RNA, 14 nt, Mycobacterium tuberculosis H37Rv
gauacagucgaccg

SEQ ID NO: 3255625 - RNA, 19 nt, Mycobacterium tuberculosis H37Rv
gauacccgcguaccacggu

SEQ ID NO: 3255626 - RNA, 15 nt, Mycobacterium tuberculosis H37Rv
gauaccgaccaucgg

SEQ ID NO: 3255627 - RNA, 20 nt, Mycobacterium tuberculosis H37Rv
gauaccgacgcgcucggcga

SEQ ID NO: 3255628 - RNA, 14 nt, Mycobacterium tuberculosis H37Rv
gauaccgccggccc

SEQ ID NO: 3255629 - RNA, 13 nt, Mycobacterium tuberculosis H37Rv
gauaccgcgauga

SEQ ID NO: 3255630 - RNA, 17 nt, Mycobacterium tuberculosis H37Rv
gauacgcacccgcugaa

SEQ ID NO: 3255631 - RNA, 16 nt, Mycobacterium tuberculosis H37Rv
gauacgcgucgaucaa

SEQ ID NO: 3255632 - RNA, 18 nt, Mycobacterium tuberculosis H37Rv
gauacggccaccaggugc

SEQ ID NO: 3255633 - RNA, 17 nt, Mycobacterium tuberculosis H37Rv
gauacggugcgacgauc

SEQ ID NO: 3255634 - RNA, 14 nt, Mycobacterium tuberculosis H37Rv
gauacucgucgucg

SEQ ID NO: 3255635 - RNA, 22 nt, Mycobacterium tuberculosis H37Rv
gauacucgucgucggcaggcag

SEQ ID NO: 3255636 - RNA, 19 nt, Mycobacterium tuberculosis H37Rv
gauagaacguagcgcccac

SEQ ID NO: 3255637 - RNA, 16 nt, Mycobacterium tuberculosis H37Rv
gauagacuagccgauc

SEQ ID NO: 3255638 - RNA, 16 nt, Mycobacterium tuberculosis H37Rv
gauagccaccgacgac

SEQ ID NO: 3255639 - RNA, 12 nt, Mycobacterium tuberculosis H37Rv
gauagccgacca

SEQ ID NO: 3255640 - RNA, 18 nt, Mycobacterium tuberculosis H37Rv
gauagccgaccagguaga

SEQ ID NO: 3255641 - RNA, 16 nt, Mycobacterium tuberculosis H37Rv
gauagcggcccgauca

SEQ ID NO: 3255642 - RNA, 18 nt, Mycobacterium tuberculosis H37Rv
gauagcggcgcagcguga

SEQ ID NO: 3255643 - RNA, 16 nt, Mycobacterium tuberculosis H37Rv
gauaggccgcgcggcg

SEQ ID NO: 3255644 - RNA, 15 nt, Mycobacterium tuberculosis H37Rv
gauaggccguggucg

SEQ ID NO: 3255645 - RNA, 17 nt, Mycobacterium tuberculosis H37Rv
gauagucauucgcuccg

SEQ ID NO: 3255646 - RNA, 23 nt, Mycobacterium tuberculosis H37Rv
gauagugcuccacguccggcgga

SEQ ID NO: 3255647 - RNA, 20 nt, Mycobacterium tuberculosis H37Rv
gauaguugccgaggcggaug

SEQ ID NO: 3255648 - RNA, 16 nt, Mycobacterium tuberculosis H37Rv
gauaguuuagucccac

SEQ ID NO: 3255649 - RNA, 17 nt, Mycobacterium tuberculosis H37Rv
gauauagggcuccucgu

SEQ ID NO: 3255650 - RNA, 21 nt, Mycobacterium tuberculosis H37Rv
gauauccgugaauggcagcac

SEQ ID NO: 3255651 - RNA, 19 nt, Mycobacterium tuberculosis H37Rv
gauaucggcggcuuggccg

SEQ ID NO: 3255652 - RNA, 17 nt, Mycobacterium tuberculosis H37Rv
gauauggguugccagcg

SEQ ID NO: 3255653 - RNA, 17 nt, Mycobacterium tuberculosis H37Rv
gauauggucaccaagac

SEQ ID NO: 3255654 - RNA, 12 nt, Mycobacterium tuberculosis H37Rv
gauauugccauc

SEQ ID NO: 3255655 - RNA, 14 nt, Mycobacterium tuberculosis H37Rv
gauauugccugcca

SEQ ID NO: 3255656 - RNA, 16 nt, Mycobacterium tuberculosis H37Rv
gaucaaacuaccgaac

SEQ ID NO: 3255657 - RNA, 23 nt, Mycobacterium tuberculosis H37Rv
gaucaacaccaacgacagcgacg

SEQ ID NO: 3255658 - RNA, 14 nt, Mycobacterium tuberculosis H37Rv
gaucaaccccccgg

SEQ ID NO: 3255659 - RNA, 13 nt, Mycobacterium tuberculosis H37Rv
gaucaaccggguc

SEQ ID NO: 3255660 - RNA, 19 nt, Mycobacterium tuberculosis H37Rv
gaucaacggaacaucguca

SEQ ID NO: 3255661 - RNA, 13 nt, Mycobacterium tuberculosis H37Rv
gaucaacgugcgc

SEQ ID NO: 3255662 - RNA, 21 nt, Mycobacterium tuberculosis H37Rv
gaucaaggaccgcucugcggc

SEQ ID NO: 3255663 - RNA, 16 nt, Mycobacterium tuberculosis H37Rv
gaucaauccgcccuug

SEQ ID NO: 3255664 - RNA, 13 nt, Mycobacterium tuberculosis H37Rv
gaucaaugcgaug

SEQ ID NO: 3255665 - RNA, 16 nt, Mycobacterium tuberculosis H37Rv
gaucacacccacgucg

SEQ ID NO: 3255666 - RNA, 17 nt, Mycobacterium tuberculosis H37Rv
gaucacacccacgucga

SEQ ID NO: 3255667 - RNA, 16 nt, Mycobacterium tuberculosis H37Rv
gaucacaucguuguca

SEQ ID NO: 3255668 - RNA, 14 nt, Mycobacterium tuberculosis H37Rv
gaucccacgaaucc

SEQ ID NO: 3255669 - RNA, 16 nt, Mycobacterium tuberculosis H37Rv
gaucccacggcgggcg

SEQ ID NO: 3255670 - RNA, 19 nt, Mycobacterium tuberculosis H37Rv
gaucccagcgcagcggacg

SEQ ID NO: 3255671 - RNA, 18 nt, Mycobacterium tuberculosis H37Rv
gauccccaacacccggcu

SEQ ID NO: 3255672 - RNA, 16 nt, Mycobacterium tuberculosis H37Rv
gauccccagcaccacg

SEQ ID NO: 3255673 - RNA, 20 nt, Mycobacterium tuberculosis H37Rv
gauccccaggccgcuugccc

SEQ ID NO: 3255674 - RNA, 15 nt, Mycobacterium tuberculosis H37Rv
gaucccgaaccguuc

SEQ ID NO: 3255675 - RNA, 22 nt, Mycobacterium tuberculosis H37Rv
gaucccgccgaucgaaccgcug

SEQ ID NO: 3255676 - RNA, 13 nt, Mycobacterium tuberculosis H37Rv
gaucccggccagc

SEQ ID NO: 3255677 - RNA, 20 nt, Mycobacterium tuberculosis H37Rv
gaucccggccgggucgagug

SEQ ID NO: 3255678 - RNA, 11 nt, Mycobacterium tuberculosis H37Rv
gaucccggcgg

SEQ ID NO: 3255679 - RNA, 22 nt, Mycobacterium tuberculosis H37Rv
gaucccggucuagcuggguagc

SEQ ID NO: 3255680 - RNA, 21 nt, Mycobacterium tuberculosis H37Rv
gaucccggucuuuaauccagc

SEQ ID NO: 3255681 - RNA, 15 nt, Mycobacterium tuberculosis H37Rv
gaucccguagccgug

SEQ ID NO: 3255682 - RNA, 15 nt, Mycobacterium tuberculosis H37Rv
gaucccgucgggcac

SEQ ID NO: 3255683 - RNA, 20 nt, Mycobacterium tuberculosis H37Rv
gaucccguucggggccccgc

SEQ ID NO: 3255684 - RNA, 16 nt, Mycobacterium tuberculosis H37Rv
gaucccugugccagca

SEQ ID NO: 3255685 - RNA, 21 nt, Mycobacterium tuberculosis H37Rv
gaucccuugucgaaguacugg

SEQ ID NO: 3255686 - RNA, 22 nt, Mycobacterium tuberculosis H37Rv
gauccgauacagugcgcggauc

SEQ ID NO: 3255687 - RNA, 20 nt, Mycobacterium tuberculosis H37Rv
gauccgcacccggccgcgca

SEQ ID NO: 3255688 - RNA, 23 nt, Mycobacterium tuberculosis H37Rv
gauccgcacccggccgcgcaccc

SEQ ID NO: 3255689 - RNA, 14 nt, Mycobacterium tuberculosis H37Rv
gauccgccugccga

SEQ ID NO: 3255690 - RNA, 16 nt, Mycobacterium tuberculosis H37Rv
gauccgcgcuuggucc

SEQ ID NO: 3255691 - RNA, 20 nt, Mycobacterium tuberculosis H37Rv
gauccgcggcguuccccgag

SEQ ID NO: 3255692 - RNA, 18 nt, Mycobacterium tuberculosis H37Rv
gauccgcuagccccgauc

SEQ ID NO: 3255693 - RNA, 21 nt, Mycobacterium tuberculosis H37Rv
gauccggaggcggcuccugag

SEQ ID NO: 3255694 - RNA, 18 nt, Mycobacterium tuberculosis H37Rv
gauccggcagcagccggc

SEQ ID NO: 3255695 - RNA, 13 nt, Mycobacterium tuberculosis H37Rv
gauccggcggcag

SEQ ID NO: 3255696 - RNA, 15 nt, Mycobacterium tuberculosis H37Rv
gauccggcuccaccc

SEQ ID NO: 3255697 - RNA, 13 nt, Mycobacterium tuberculosis H37Rv
gauccgggcgccg

SEQ ID NO: 3255698 - RNA, 15 nt, Mycobacterium tuberculosis H37Rv
gauccggucggccag

SEQ ID NO: 3255699 - RNA, 16 nt, Mycobacterium tuberculosis H37Rv
gauccggucggccagc

SEQ ID NO: 3255700 - RNA, 18 nt, Mycobacterium tuberculosis H37Rv
gauccggucggccaggcc

SEQ ID NO: 3255701 - RNA, 16 nt, Mycobacterium tuberculosis H37Rv
gauccggucgggggcg

SEQ ID NO: 3255702 - RNA, 13 nt, Mycobacterium tuberculosis H37Rv
gauccgguggugg

SEQ ID NO: 3255703 - RNA, 15 nt, Mycobacterium tuberculosis H37Rv
gauccgugucgcaga

SEQ ID NO: 3255704 - RNA, 17 nt, Mycobacterium tuberculosis H37Rv
gauccucgccggguacg

SEQ ID NO: 3255705 - RNA, 15 nt, Mycobacterium tuberculosis H37Rv
gauccugaccagcca

SEQ ID NO: 3255706 - RNA, 14 nt, Mycobacterium tuberculosis H37Rv
gaucgacacccgcu

SEQ ID NO: 3255707 - RNA, 17 nt, Mycobacterium tuberculosis H37Rv
gaucgacacccgcucgg

SEQ ID NO: 3255708 - RNA, 19 nt, Mycobacterium tuberculosis H37Rv
gaucgacacccgcucggcc

SEQ ID NO: 3255709 - RNA, 18 nt, Mycobacterium tuberculosis H37Rv
gaucgaccaauucgaccg

SEQ ID NO: 3255710 - RNA, 13 nt, Mycobacterium tuberculosis H37Rv
gaucgacccgguc

SEQ ID NO: 3255711 - RNA, 16 nt, Mycobacterium tuberculosis H37Rv
gaucgaccgccagcgc

SEQ ID NO: 3255712 - RNA, 22 nt, Mycobacterium tuberculosis H37Rv
gaucgacgccgccacccggcgg

SEQ ID NO: 3255713 - RNA, 15 nt, Mycobacterium tuberculosis H37Rv
gaucgacgcucggcu

SEQ ID NO: 3255714 - RNA, 12 nt, Mycobacterium tuberculosis H37Rv
gaucgacuccgg

SEQ ID NO: 3255715 - RNA, 15 nt, Mycobacterium tuberculosis H37Rv
gaucgacuucggugg

SEQ ID NO: 3255716 - RNA, 14 nt, Mycobacterium tuberculosis H37Rv
gaucgagaucaccu

SEQ ID NO: 3255717 - RNA, 17 nt, Mycobacterium tuberculosis H37Rv
gaucgagcagggugacc

SEQ ID NO: 3255718 - RNA, 19 nt, Mycobacterium tuberculosis H37Rv
gaucgagcaguuccagcuc

SEQ ID NO: 3255719 - RNA, 23 nt, Mycobacterium tuberculosis H37Rv
gaucgaggaguuggugcagcgac

SEQ ID NO: 3255720 - RNA, 19 nt, Mycobacterium tuberculosis H37Rv
gaucgagggggacgcugau

SEQ ID NO: 3255721 - RNA, 20 nt, Mycobacterium tuberculosis H37Rv
gaucgagggggacgcugauc

SEQ ID NO: 3255722 - RNA, 17 nt, Mycobacterium tuberculosis H37Rv
gaucgaguuccgcaucg

SEQ ID NO: 3255723 - RNA, 22 nt, Mycobacterium tuberculosis H37Rv
gaucgauccggcuccaccccca

SEQ ID NO: 3255724 - RNA, 23 nt, Mycobacterium tuberculosis H37Rv
gaucgauccggcuccacccccac

SEQ ID NO: 3255725 - RNA, 20 nt, Mycobacterium tuberculosis H37Rv
gaucgaucugcgggcggguc

SEQ ID NO: 3255726 - RNA, 19 nt, Mycobacterium tuberculosis H37Rv
gaucgauucgucgcggauc

SEQ ID NO: 3255727 - RNA, 23 nt, Mycobacterium tuberculosis H37Rv
gaucgauucgucgcggaucagcc

SEQ ID NO: 3255728 - RNA, 17 nt, Mycobacterium tuberculosis H37Rv
gaucgcaagcgcggcga

SEQ ID NO: 3255729 - RNA, 21 nt, Mycobacterium tuberculosis H37Rv
gaucgcacaccaacaccgcgg

SEQ ID NO: 3255730 - RNA, 19 nt, Mycobacterium tuberculosis H37Rv
gaucgcagggaucaccccg

SEQ ID NO: 3255731 - RNA, 14 nt, Mycobacterium tuberculosis H37Rv
gaucgcagugggca

SEQ ID NO: 3255732 - RNA, 13 nt, Mycobacterium tuberculosis H37Rv
gaucgcaucgacg

SEQ ID NO: 3255733 - RNA, 18 nt, Mycobacterium tuberculosis H37Rv
gaucgcaucgacgugcgc

SEQ ID NO: 3255734 - RNA, 12 nt, Mycobacterium tuberculosis H37Rv
gaucgccaccgg

SEQ ID NO: 3255735 - RNA, 15 nt, Mycobacterium tuberculosis H37Rv
gaucgccaccgguac

SEQ ID NO: 3255736 - RNA, 17 nt, Mycobacterium tuberculosis H37Rv
gaucgccaccgguaccg

SEQ ID NO: 3255737 - RNA, 17 nt, Mycobacterium tuberculosis H37Rv
gaucgccacuaccauca

SEQ ID NO: 3255738 - RNA, 16 nt, Mycobacterium tuberculosis H37Rv
gaucgccccagccaug

SEQ ID NO: 3255739 - RNA, 17 nt, Mycobacterium tuberculosis H37Rv
gaucgcccugacaccca

SEQ ID NO: 3255740 - RNA, 20 nt, Mycobacterium tuberculosis H37Rv
gaucgcccugacacccaucg

SEQ ID NO: 3255741 - RNA, 16 nt, Mycobacterium tuberculosis H37Rv
gaucgccgaaucggca

SEQ ID NO: 3255742 - RNA, 22 nt, Mycobacterium tuberculosis H37Rv
gaucgccgacaauggcagcgag

SEQ ID NO: 3255743 - RNA, 15 nt, Mycobacterium tuberculosis H37Rv
gaucgccgaggcagc

SEQ ID NO: 3255744 - RNA, 22 nt, Mycobacterium tuberculosis H37Rv
gaucgccgaguccggcgagcuc

SEQ ID NO: 3255745 - RNA, 12 nt, Mycobacterium tuberculosis H37Rv
gaucgccgcgaa

SEQ ID NO: 3255746 - RNA, 15 nt, Mycobacterium tuberculosis H37Rv
gaucgccggcuucgc

SEQ ID NO: 3255747 - RNA, 13 nt, Mycobacterium tuberculosis H37Rv
gaucgccucgacg

SEQ ID NO: 3255748 - RNA, 14 nt, Mycobacterium tuberculosis H37Rv
gaucgccucgacgc

SEQ ID NO: 3255749 - RNA, 21 nt, Mycobacterium tuberculosis H37Rv
gaucgccucggacacggcagc

SEQ ID NO: 3255750 - RNA, 14 nt, Mycobacterium tuberculosis H37Rv
gaucgccugagacu

SEQ ID NO: 3255751 - RNA, 17 nt, Mycobacterium tuberculosis H37Rv
gaucgcgaacaucgcca

SEQ ID NO: 3255752 - RNA, 21 nt, Mycobacterium tuberculosis H37Rv
gaucgcgaacaucgccagcgc

SEQ ID NO: 3255753 - RNA, 15 nt, Mycobacterium tuberculosis H37Rv
gaucgcgaacuucca

SEQ ID NO: 3255754 - RNA, 15 nt, Mycobacterium tuberculosis H37Rv
gaucgcgacccgauc

SEQ ID NO: 3255755 - RNA, 21 nt, Mycobacterium tuberculosis H37Rv
gaucgcgacccgaucgcgcca

SEQ ID NO: 3255756 - RNA, 19 nt, Mycobacterium tuberculosis H37Rv
gaucgcgagcgagccaacu

SEQ ID NO: 3255757 - RNA, 14 nt, Mycobacterium tuberculosis H37Rv
gaucgcgccgggcu

SEQ ID NO: 3255758 - RNA, 12 nt, Mycobacterium tuberculosis H37Rv
gaucgcgccguc

SEQ ID NO: 3255759 - RNA, 18 nt, Mycobacterium tuberculosis H37Rv
gaucgcgccgucggcgau

SEQ ID NO: 3255760 - RNA, 13 nt, Mycobacterium tuberculosis H37Rv
gaucgcgccuauc

SEQ ID NO: 3255761 - RNA, 16 nt, Mycobacterium tuberculosis H37Rv
gaucgcggcggccucc

SEQ ID NO: 3255762 - RNA, 17 nt, Mycobacterium tuberculosis H37Rv
gaucgcggcggcgaucc

SEQ ID NO: 3255763 - RNA, 15 nt, Mycobacterium tuberculosis H37Rv
gaucgcggcggcgug

SEQ ID NO: 3255764 - RNA, 23 nt, Mycobacterium tuberculosis H37Rv
gaucgcggucaaauccagcagcc

SEQ ID NO: 3255765 - RNA, 15 nt, Mycobacterium tuberculosis H37Rv
gaucucaccuggagc

SEQ ID NO: 3255766 - RNA, 21 nt, Mycobacterium tuberculosis H37Rv
gaucucaucgggccacagcaa

SEQ ID NO: 3255767 - RNA, 19 nt, Mycobacterium tuberculosis H37Rv
gaucuccaccuucuggucc

SEQ ID NO: 3255768 - RNA, 23 nt, Mycobacterium tuberculosis H37Rv
gaucuccaccuucugguccagca

SEQ ID NO: 3255769 - RNA, 22 nt, Mycobacterium tuberculosis H37Rv
gaucucccagugagcaugcgac

SEQ ID NO: 3255770 - RNA, 12 nt, Mycobacterium tuberculosis H37Rv
gaucuccuccug

SEQ ID NO: 3255771 - RNA, 15 nt, Mycobacterium tuberculosis H37Rv
gaucucgaccagcgc

SEQ ID NO: 3255772 - RNA, 16 nt, Mycobacterium tuberculosis H37Rv
gaucucgaccagcgcc

SEQ ID NO: 3255773 - RNA, 23 nt, Mycobacterium tuberculosis H37Rv
gaucucgaccguauugaccagcg

SEQ ID NO: 3255774 - RNA, 22 nt, Mycobacterium tuberculosis H37Rv
gaucucgagcaggcgcaccagg

SEQ ID NO: 3255775 - RNA, 16 nt, Mycobacterium tuberculosis H37Rv
gaucucgaucgacccg

SEQ ID NO: 3255776 - RNA, 21 nt, Mycobacterium tuberculosis H37Rv
gaucucggcgagcaccacccc

SEQ ID NO: 3255777 - RNA, 18 nt, Mycobacterium tuberculosis H37Rv
gaucucggucuccacgcc

SEQ ID NO: 3255778 - RNA, 16 nt, Mycobacterium tuberculosis H37Rv
gaucucguagccgccg

SEQ ID NO: 3255779 - RNA, 17 nt, Mycobacterium tuberculosis H37Rv
gaucucguagccgccgu

SEQ ID NO: 3255780 - RNA, 20 nt, Mycobacterium tuberculosis H37Rv
gaucucguggaucugccucu

SEQ ID NO: 3255781 - RNA, 17 nt, Mycobacterium tuberculosis H37Rv
gaucugacggcgccguc

SEQ ID NO: 3255782 - RNA, 21 nt, Mycobacterium tuberculosis H37Rv
gaucugagaccucagccggcg

SEQ ID NO: 3255783 - RNA, 19 nt, Mycobacterium tuberculosis H37Rv
gaucugcagcacucggugu

SEQ ID NO: 3255784 - RNA, 21 nt, Mycobacterium tuberculosis H37Rv
gaucugccgccgcggccacaa

SEQ ID NO: 3255785 - RNA, 13 nt, Mycobacterium tuberculosis H37Rv
gaucugccucucg

SEQ ID NO: 3255786 - RNA, 17 nt, Mycobacterium tuberculosis H37Rv
gaucugcgccaggggca

SEQ ID NO: 3255787 - RNA, 23 nt, Mycobacterium tuberculosis H37Rv
gaucugcgccaucacaucggccu

SEQ ID NO: 3255788 - RNA, 22 nt, Mycobacterium tuberculosis H37Rv
gaucugcgcggcccgcuguggg

SEQ ID NO: 3255789 - RNA, 22 nt, Mycobacterium tuberculosis H37Rv
gaucugcgcgucaggccagcgc

SEQ ID NO: 3255790 - RNA, 15 nt, Mycobacterium tuberculosis H37Rv
gaucugcuccucggu

SEQ ID NO: 3255791 - RNA, 17 nt, Mycobacterium tuberculosis H37Rv
gaucugcuccucgguca

SEQ ID NO: 3255792 - RNA, 14 nt, Mycobacterium tuberculosis H37Rv
gaucugcucgccga

SEQ ID NO: 3255793 - RNA, 12 nt, Mycobacterium tuberculosis H37Rv
gaucugcugcga

SEQ ID NO: 3255794 - RNA, 20 nt, Mycobacterium tuberculosis H37Rv
gaucugcugugucguacccg

SEQ ID NO: 3255795 - RNA, 23 nt, Mycobacterium tuberculosis H37Rv
gaucuggccuuggcaguccagcc

SEQ ID NO: 3255796 - RNA, 14 nt, Mycobacterium tuberculosis H37Rv
gaucuggcgcagca

SEQ ID NO: 3255797 - RNA, 20 nt, Mycobacterium tuberculosis H37Rv
gaucuggcggauggccgccu

SEQ ID NO: 3255798 - RNA, 17 nt, Mycobacterium tuberculosis H37Rv
gaucuggcuccggccag

SEQ ID NO: 3255799 - RNA, 17 nt, Mycobacterium tuberculosis H37Rv
gaucugggcugcggccg

SEQ ID NO: 3255800 - RNA, 20 nt, Mycobacterium tuberculosis H37Rv
gaucugggcugcggccgcga

SEQ ID NO: 3255801 - RNA, 15 nt, Mycobacterium tuberculosis H37Rv
gaucugggcuggcag

SEQ ID NO: 3255802 - RNA, 23 nt, Mycobacterium tuberculosis H37Rv
gaucuggguaagggacaccagcu

SEQ ID NO: 3255803 - RNA, 15 nt, Mycobacterium tuberculosis H37Rv
gaucugguccagugg

SEQ ID NO: 3255804 - RNA, 16 nt, Mycobacterium tuberculosis H37Rv
gaucuggucggcggcc

SEQ ID NO: 3255805 - RNA, 19 nt, Mycobacterium tuberculosis H37Rv
gaucuguuccucggugacu

SEQ ID NO: 3255806 - RNA, 14 nt, Mycobacterium tuberculosis H37Rv
gaucuuaggcacuc

SEQ ID NO: 3255807 - RNA, 18 nt, Mycobacterium tuberculosis H37Rv
gaucuucgacaggccacc

SEQ ID NO: 3255808 - RNA, 20 nt, Mycobacterium tuberculosis H37Rv
gaucuucgacaggccaccgc

SEQ ID NO: 3255809 - RNA, 23 nt, Mycobacterium tuberculosis H37Rv
gaucuucgcgcuguacugcccca

SEQ ID NO: 3255810 - RNA, 15 nt, Mycobacterium tuberculosis H37Rv
gaucuucggccgcac

SEQ ID NO: 3255811 - RNA, 16 nt, Mycobacterium tuberculosis H37Rv
gaucuucugccuuggc

SEQ ID NO: 3255812 - RNA, 18 nt, Mycobacterium tuberculosis H37Rv
gaucuugacggucgccgu

SEQ ID NO: 3255813 - RNA, 12 nt, Mycobacterium tuberculosis H37Rv
gaucuugccgcc

SEQ ID NO: 3255814 - RNA, 15 nt, Mycobacterium tuberculosis H37Rv
gaucuugccggccag

SEQ ID NO: 3255815 - RNA, 11 nt, Mycobacterium tuberculosis H37Rv
gaucuuggcca

SEQ ID NO: 3255816 - RNA, 13 nt, Mycobacterium tuberculosis H37Rv
gaucuuggccacc

SEQ ID NO: 3255817 - RNA, 16 nt, Mycobacterium tuberculosis H37Rv
gaucuugugccaggcg

SEQ ID NO: 3255818 - RNA, 14 nt, Mycobacterium tuberculosis H37Rv
gaugaaacgccguc

SEQ ID NO: 3255819 - RNA, 15 nt, Mycobacterium tuberculosis H37Rv
gaugaacaccggcgc

SEQ ID NO: 3255820 - RNA, 19 nt, Mycobacterium tuberculosis H37Rv
gaugaacaguuucggcaug

SEQ ID NO: 3255821 - RNA, 20 nt, Mycobacterium tuberculosis H37Rv
gaugaaccacggcaggcagg

SEQ ID NO: 3255822 - RNA, 18 nt, Mycobacterium tuberculosis H37Rv
gaugaacggaaucuuguu

SEQ ID NO: 3255823 - RNA, 14 nt, Mycobacterium tuberculosis H37Rv
gaugaagcgcgguu

SEQ ID NO: 3255824 - RNA, 12 nt, Mycobacterium tuberculosis H37Rv
gaugaagcuggu

SEQ ID NO: 3255825 - RNA, 18 nt, Mycobacterium tuberculosis H37Rv
gaugacaccgaccggguc

SEQ ID NO: 3255826 - RNA, 21 nt, Mycobacterium tuberculosis H37Rv
gaugacaggcuuggcaugcgg

SEQ ID NO: 3255827 - RNA, 17 nt, Mycobacterium tuberculosis H37Rv
gaugacauccuugacgc

SEQ ID NO: 3255828 - RNA, 14 nt, Mycobacterium tuberculosis H37Rv
gaugaccaccgguu

SEQ ID NO: 3255829 - RNA, 19 nt, Mycobacterium tuberculosis H37Rv
gaugaccagggucugcuca

SEQ ID NO: 3255830 - RNA, 17 nt, Mycobacterium tuberculosis H37Rv
gaugaccaggucgguca

SEQ ID NO: 3255831 - RNA, 18 nt, Mycobacterium tuberculosis H37Rv
gaugaccaugaugaccgg

SEQ ID NO: 3255832 - RNA, 16 nt, Mycobacterium tuberculosis H37Rv
gaugacccacugcagg

SEQ ID NO: 3255833 - RNA, 17 nt, Mycobacterium tuberculosis H37Rv
gaugacccacugcaggc

SEQ ID NO: 3255834 - RNA, 13 nt, Mycobacterium tuberculosis H37Rv
gaugaccgccauc

SEQ ID NO: 3255835 - RNA, 12 nt, Mycobacterium tuberculosis H37Rv
gaugaccgcgcg

SEQ ID NO: 3255836 - RNA, 14 nt, Mycobacterium tuberculosis H37Rv
gaugaccgucgcac

SEQ ID NO: 3255837 - RNA, 17 nt, Mycobacterium tuberculosis H37Rv
gaugaccuucccgucga

SEQ ID NO: 3255838 - RNA, 16 nt, Mycobacterium tuberculosis H37Rv
gaugaccuugcccacc

SEQ ID NO: 3255839 - RNA, 17 nt, Mycobacterium tuberculosis H37Rv
gaugaccuugcccacca

SEQ ID NO: 3255840 - RNA, 19 nt, Mycobacterium tuberculosis H37Rv
gaugaccuuggccgugccc

SEQ ID NO: 3255841 - RNA, 21 nt, Mycobacterium tuberculosis H37Rv
gaugacgaacaagaaaagcag

SEQ ID NO: 3255842 - RNA, 20 nt, Mycobacterium tuberculosis H37Rv
gaugacgacgccgucggaca

SEQ ID NO: 3255843 - RNA, 18 nt, Mycobacterium tuberculosis H37Rv
gaugacgaucgcguccgc

SEQ ID NO: 3255844 - RNA, 17 nt, Mycobacterium tuberculosis H37Rv
gaugacgccgucggcgc

SEQ ID NO: 3255845 - RNA, 14 nt, Mycobacterium tuberculosis H37Rv
gaugacggugccga

SEQ ID NO: 3255846 - RNA, 18 nt, Mycobacterium tuberculosis H37Rv
gaugacguugcagccggc

SEQ ID NO: 3255847 - RNA, 21 nt, Mycobacterium tuberculosis H37Rv
gaugacguugcagccggcaua

SEQ ID NO: 3255848 - RNA, 19 nt, Mycobacterium tuberculosis H37Rv
gaugagcaugcccagcgca

SEQ ID NO: 3255849 - RNA, 20 nt, Mycobacterium tuberculosis H37Rv
gaugagcaugcccagcgcac

SEQ ID NO: 3255850 - RNA, 13 nt, Mycobacterium tuberculosis H37Rv
gaugagcgaggcu

SEQ ID NO: 3255851 - RNA, 14 nt, Mycobacterium tuberculosis H37Rv
gaugagcgcggcga

SEQ ID NO: 3255852 - RNA, 17 nt, Mycobacterium tuberculosis H37Rv
gaugagcgcuucgaggu

SEQ ID NO: 3255853 - RNA, 13 nt, Mycobacterium tuberculosis H37Rv
gaugagcgguacc

SEQ ID NO: 3255854 - RNA, 20 nt, Mycobacterium tuberculosis H37Rv
gaugagcucguagaggucau

SEQ ID NO: 3255855 - RNA, 14 nt, Mycobacterium tuberculosis H37Rv
gaugagcucguuca

SEQ ID NO: 3255856 - RNA, 21 nt, Mycobacterium tuberculosis H37Rv
gaugagggugcucgucaccaa

SEQ ID NO: 3255857 - RNA, 22 nt, Mycobacterium tuberculosis H37Rv
gaugagugacgguccguucgau

SEQ ID NO: 3255858 - RNA, 14 nt, Mycobacterium tuberculosis H37Rv
gaugaucagcgagg

SEQ ID NO: 3255859 - RNA, 22 nt, Mycobacterium tuberculosis H37Rv
gaugaucaugaacgccagcagc

SEQ ID NO: 3255860 - RNA, 23 nt, Mycobacterium tuberculosis H37Rv
gaugaucaugaacgccagcagcg

SEQ ID NO: 3255861 - RNA, 14 nt, Mycobacterium tuberculosis H37Rv
gaugcgugccgacc

SEQ ID NO: 3255862 - RNA, 18 nt, Mycobacterium tuberculosis H37Rv
gaugcgugccgacccgcu

SEQ ID NO: 3255863 - RNA, 15 nt, Mycobacterium tuberculosis H37Rv
gaugcgugguuggcc

SEQ ID NO: 3255864 - RNA, 24 nt, Mycobacterium tuberculosis H37Rv
gaugcguuccgcgacagcggcguc

SEQ ID NO: 3255865 - RNA, 12 nt, Mycobacterium tuberculosis H37Rv
gaugcguucggc

SEQ ID NO: 3255866 - RNA, 16 nt, Mycobacterium tuberculosis H37Rv
gaugcguucgggcucc

SEQ ID NO: 3255867 - RNA, 23 nt, Mycobacterium tuberculosis H37Rv
gaugcguucgggcuccagcagcg

SEQ ID NO: 3255868 - RNA, 22 nt, Mycobacterium tuberculosis H37Rv
gaugcugagcgccaggccgcac

SEQ ID NO: 3255869 - RNA, 23 nt, Mycobacterium tuberculosis H37Rv
gaugcuggcaaaguaucgcagca

SEQ ID NO: 3255870 - RNA, 13 nt, Mycobacterium tuberculosis H37Rv
gaugcuucccgga

SEQ ID NO: 3255871 - RNA, 15 nt, Mycobacterium tuberculosis H37Rv
gaugcuucccggaug

SEQ ID NO: 3255872 - RNA, 18 nt, Mycobacterium tuberculosis H37Rv
gauggaaggcggccaggu

SEQ ID NO: 3255873 - RNA, 14 nt, Mycobacterium tuberculosis H37Rv
gauggacaccaccu

SEQ ID NO: 3255874 - RNA, 14 nt, Mycobacterium tuberculosis H37Rv
gauggacaccagcc

SEQ ID NO: 3255875 - RNA, 17 nt, Mycobacterium tuberculosis H37Rv
gauggaccgcacugaca

SEQ ID NO: 3255876 - RNA, 21 nt, Mycobacterium tuberculosis H37Rv
gauggaccgccagggcuugcc

SEQ ID NO: 3255877 - RNA, 15 nt, Mycobacterium tuberculosis H37Rv
gauggauuggcguca

SEQ ID NO: 3255878 - RNA, 23 nt, Mycobacterium tuberculosis H37Rv
gauggcaagggccgacgucguug

SEQ ID NO: 3255879 - RNA, 12 nt, Mycobacterium tuberculosis H37Rv
gauggcaccacc

SEQ ID NO: 3255880 - RNA, 22 nt, Mycobacterium tuberculosis H37Rv
gauggcaccacuacaucgauca

SEQ ID NO: 3255881 - RNA, 14 nt, Mycobacterium tuberculosis H37Rv
gauggcaucggcca

SEQ ID NO: 3255882 - RNA, 15 nt, Mycobacterium tuberculosis H37Rv
gauggccagcgcggc

SEQ ID NO: 3255883 - RNA, 16 nt, Mycobacterium tuberculosis H37Rv
gauggccagcgcggcg

SEQ ID NO: 3255884 - RNA, 19 nt, Mycobacterium tuberculosis H37Rv
gauggccagcgcggcgucg

SEQ ID NO: 3255885 - RNA, 12 nt, Mycobacterium tuberculosis H37Rv
gauggccaggcc

SEQ ID NO: 3255886 - RNA, 13 nt, Mycobacterium tuberculosis H37Rv
gauggccaucagc

SEQ ID NO: 3255887 - RNA, 21 nt, Mycobacterium tuberculosis H37Rv
gauggcccggcucacagcaca

SEQ ID NO: 3255888 - RNA, 21 nt, Mycobacterium tuberculosis H37Rv
gauggccgccaguucuucggg

SEQ ID NO: 3255889 - RNA, 23 nt, Mycobacterium tuberculosis H37Rv
gauggccgccgcgaggaugcuga

SEQ ID NO: 3255890 - RNA, 15 nt, Mycobacterium tuberculosis H37Rv
gauggccgucagcca

SEQ ID NO: 3255891 - RNA, 14 nt, Mycobacterium tuberculosis H37Rv
gauggccucggcga

SEQ ID NO: 3255892 - RNA, 15 nt, Mycobacterium tuberculosis H37Rv
gauggccugaucuuu

SEQ ID NO: 3255893 - RNA, 18 nt, Mycobacterium tuberculosis H37Rv
gauggcgaaccucaccug

SEQ ID NO: 3255894 - RNA, 18 nt, Mycobacterium tuberculosis H37Rv
gauggcgauacgcgcguc

SEQ ID NO: 3255895 - RNA, 22 nt, Mycobacterium tuberculosis H37Rv
gauggcgauacgcgcgucgggu

SEQ ID NO: 3255896 - RNA, 20 nt, Mycobacterium tuberculosis H37Rv
gauggcgauggcaggggcga

SEQ ID NO: 3255897 - RNA, 14 nt, Mycobacterium tuberculosis H37Rv
gauggcgcccugcg

SEQ ID NO: 3255898 - RNA, 12 nt, Mycobacterium tuberculosis H37Rv
gauggcgcgauc

SEQ ID NO: 3255899 - RNA, 19 nt, Mycobacterium tuberculosis H37Rv
gauggcgcgaucggugccg

SEQ ID NO: 3255900 - RNA, 14 nt, Mycobacterium tuberculosis H37Rv
gauggcgcgcaacg

SEQ ID NO: 3255901 - RNA, 14 nt, Mycobacterium tuberculosis H37Rv
gauggcgcugcacc

SEQ ID NO: 3255902 - RNA, 17 nt, Mycobacterium tuberculosis H37Rv
gauggcgcugcaccgua

SEQ ID NO: 3255903 - RNA, 16 nt, Mycobacterium tuberculosis H37Rv
gauggcggcgacccgu

SEQ ID NO: 3255904 - RNA, 15 nt, Mycobacterium tuberculosis H37Rv
gauggcggcgcguuc

SEQ ID NO: 3255905 - RNA, 12 nt, Mycobacterium tuberculosis H37Rv
gauggcgguggc

SEQ ID NO: 3255906 - RNA, 15 nt, Mycobacterium tuberculosis H37Rv
gauggcgguggcgag

SEQ ID NO: 3255907 - RNA, 16 nt, Mycobacterium tuberculosis H37Rv
gauggcguccaucucg

SEQ ID NO: 3255908 - RNA, 14 nt, Mycobacterium tuberculosis H37Rv
gauggcgucggcca

SEQ ID NO: 3255909 - RNA, 15 nt, Mycobacterium tuberculosis H37Rv
gauggcgucggccag

SEQ ID NO: 3255910 - RNA, 17 nt, Mycobacterium tuberculosis H37Rv
gauggcgucggccagga

SEQ ID NO: 3255911 - RNA, 22 nt, Mycobacterium tuberculosis H37Rv
gauggcucacaugcccgcaccg

SEQ ID NO: 3255912 - RNA, 13 nt, Mycobacterium tuberculosis H37Rv
gauggcucgccga

SEQ ID NO: 3255913 - RNA, 14 nt, Mycobacterium tuberculosis H37Rv
gauggcuuggacca

SEQ ID NO: 3255914 - RNA, 22 nt, Mycobacterium tuberculosis H37Rv
gaugggaaccgaaucggcaccg

SEQ ID NO: 3255915 - RNA, 13 nt, Mycobacterium tuberculosis H37Rv
gaugggaaucagu

SEQ ID NO: 3255916 - RNA, 20 nt, Mycobacterium tuberculosis H37Rv
gaugggaccuugaucgagca

SEQ ID NO: 3255917 - RNA, 23 nt, Mycobacterium tuberculosis H37Rv
gaugggaccuugaucgagcaggg

SEQ ID NO: 3255918 - RNA, 12 nt, Mycobacterium tuberculosis H37Rv
gaugggccaggc

SEQ ID NO: 3255919 - RNA, 13 nt, Mycobacterium tuberculosis H37Rv
gaugggccaggcg

SEQ ID NO: 3255920 - RNA, 15 nt, Mycobacterium tuberculosis H37Rv
gaugggccaggcgcc

SEQ ID NO: 3255921 - RNA, 20 nt, Mycobacterium tuberculosis H37Rv
gaugggcccagcggccgcga

SEQ ID NO: 3255922 - RNA, 18 nt, Mycobacterium tuberculosis H37Rv
gaugggccgguuccucag

SEQ ID NO: 3255923 - RNA, 19 nt, Mycobacterium tuberculosis H37Rv
gaugggggagccggugacg

SEQ ID NO: 3255924 - RNA, 18 nt, Mycobacterium tuberculosis H37Rv
gauggguacccgaucacu

SEQ ID NO: 3255925 - RNA, 18 nt, Mycobacterium tuberculosis H37Rv
gaugggucaggccgacgu

SEQ ID NO: 3255926 - RNA, 14 nt, Mycobacterium tuberculosis H37Rv
gaugggugacggug

SEQ ID NO: 3255927 - RNA, 23 nt, Mycobacterium tuberculosis H37Rv
gaugguaccgccacuggcgcuga

SEQ ID NO: 3255928 - RNA, 17 nt, Mycobacterium tuberculosis H37Rv
gaugguagucgcgaccg

SEQ ID NO: 3255929 - RNA, 17 nt, Mycobacterium tuberculosis H37Rv
gaugguaugcccgccgu

SEQ ID NO: 3255930 - RNA, 19 nt, Mycobacterium tuberculosis H37Rv
gauggucaccgucugcacc

SEQ ID NO: 3255931 - RNA, 14 nt, Mycobacterium tuberculosis H37Rv
gauggucauccagc

SEQ ID NO: 3255932 - RNA, 20 nt, Mycobacterium tuberculosis H37Rv
gauggucauccagccagcaa

SEQ ID NO: 3255933 - RNA, 21 nt, Mycobacterium tuberculosis H37Rv
gauggucauccagccagcaag

SEQ ID NO: 3255934 - RNA, 21 nt, Mycobacterium tuberculosis H37Rv
gauggucgugaucuucugccu

SEQ ID NO: 3255935 - RNA, 23 nt, Mycobacterium tuberculosis H37Rv
gauggucucccggcugaugccug

SEQ ID NO: 3255936 - RNA, 17 nt, Mycobacterium tuberculosis H37Rv
gauggucuccucgguca

SEQ ID NO: 3255937 - RNA, 17 nt, Mycobacterium tuberculosis H37Rv
gauggugaccagcaggc

SEQ ID NO: 3255938 - RNA, 23 nt, Mycobacterium tuberculosis H37Rv
gauggugaugggggagccgguga

SEQ ID NO: 3255939 - RNA, 18 nt, Mycobacterium tuberculosis H37Rv
gauggugccgacccgccg

SEQ ID NO: 3255940 - RNA, 21 nt, Mycobacterium tuberculosis H37Rv
gaugguggccgccaccuccca

SEQ ID NO: 3255941 - RNA, 16 nt, Mycobacterium tuberculosis H37Rv
gaugguggucaccacc

SEQ ID NO: 3255942 - RNA, 17 nt, Mycobacterium tuberculosis H37Rv
gaugguggucaccacca

SEQ ID NO: 3255943 - RNA, 18 nt, Mycobacterium tuberculosis H37Rv
gaugguggugccaaccug

SEQ ID NO: 3255944 - RNA, 20 nt, Mycobacterium tuberculosis H37Rv
gaugguggugccaaccuggg

SEQ ID NO: 3255945 - RNA, 13 nt, Mycobacterium tuberculosis H37Rv
gaugguggugccg

SEQ ID NO: 3255946 - RNA, 17 nt, Mycobacterium tuberculosis H37Rv
gaugguguacugcugcu

SEQ ID NO: 3255947 - RNA, 14 nt, Mycobacterium tuberculosis H37Rv
gauggugugcagca

SEQ ID NO: 3255948 - RNA, 16 nt, Mycobacterium tuberculosis H37Rv
gauggugugcccgcac

SEQ ID NO: 3255949 - RNA, 18 nt, Mycobacterium tuberculosis H37Rv
gauggugugcccgcaccg

SEQ ID NO: 3255950 - RNA, 20 nt, Mycobacterium tuberculosis H37Rv
gaugguuauccccuggccaa

SEQ ID NO: 3255951 - RNA, 22 nt, Mycobacterium tuberculosis H37Rv
gaugguucaugaacaucggccg

SEQ ID NO: 3255952 - RNA, 16 nt, Mycobacterium tuberculosis H37Rv
gaugguuggaucgcca

SEQ ID NO: 3255953 - RNA, 23 nt, Mycobacterium tuberculosis H37Rv
gauguaaccguagcccugcucag

SEQ ID NO: 3255954 - RNA, 17 nt, Mycobacterium tuberculosis H37Rv
gauguacagcgggaucc

SEQ ID NO: 3255955 - RNA, 15 nt, Mycobacterium tuberculosis H37Rv
gauguagcggcguuc

SEQ ID NO: 3255956 - RNA, 13 nt, Mycobacterium tuberculosis H37Rv
gauguaguuggcg

SEQ ID NO: 3255957 - RNA, 22 nt, Mycobacterium tuberculosis H37Rv
gauugguggcccgggccaccgg

SEQ ID NO: 3255958 - RNA, 16 nt, Mycobacterium tuberculosis H37Rv
gauugugcagcgaaau

SEQ ID NO: 3255959 - RNA, 20 nt, Mycobacterium tuberculosis H37Rv
gauuuauugagucggcuggu

SEQ ID NO: 3255960 - RNA, 14 nt, Mycobacterium tuberculosis H37Rv
gauuucccagcgca

SEQ ID NO: 3255961 - RNA, 20 nt, Mycobacterium tuberculosis H37Rv
gauuucccagcgcagugccu

SEQ ID NO: 3255962 - RNA, 17 nt, Mycobacterium tuberculosis H37Rv
gauuuccucugggcugu

SEQ ID NO: 3255963 - RNA, 20 nt, Mycobacterium tuberculosis H37Rv
gauuucgccggaacgcacgc

SEQ ID NO: 3255964 - RNA, 18 nt, Mycobacterium tuberculosis H37Rv
gauuucgcgucugcucgc

SEQ ID NO: 3255965 - RNA, 20 nt, Mycobacterium tuberculosis H37Rv
gauuucgugucgcugcggcg

SEQ ID NO: 3255966 - RNA, 15 nt, Mycobacterium tuberculosis H37Rv
gauuuggaucggcug

SEQ ID NO: 3255967 - RNA, 18 nt, Mycobacterium tuberculosis H37Rv
gauuuggccgucaucucc

SEQ ID NO: 3255968 - RNA, 20 nt, Mycobacterium tuberculosis H37Rv
gauuuucucggugcuggcga

SEQ ID NO: 3255969 - RNA, 21 nt, Mycobacterium tuberculosis H37Rv
gcaaaaacgcugccgccguuc

SEQ ID NO: 3255970 - RNA, 13 nt, Mycobacterium tuberculosis H37Rv
gcaaaacacaccg

SEQ ID NO: 3255971 - RNA, 18 nt, Mycobacterium tuberculosis H37Rv
gcaaaagugcgaguagga

SEQ ID NO: 3255972 - RNA, 20 nt, Mycobacterium tuberculosis H37Rv
gcaaaaucgcccaauucggc

SEQ ID NO: 3255973 - RNA, 23 nt, Mycobacterium tuberculosis H37Rv
gcaaacagauucggugccagcag

SEQ ID NO: 3255974 - RNA, 16 nt, Mycobacterium tuberculosis H37Rv
gcaaacauccacccgc

SEQ ID NO: 3255975 - RNA, 19 nt, Mycobacterium tuberculosis H37Rv
gcaaacauccacccgcggu

SEQ ID NO: 3255976 - RNA, 21 nt, Mycobacterium tuberculosis H37Rv
gcaaacauccacccgcgguga

SEQ ID NO: 3255977 - RNA, 15 nt, Mycobacterium tuberculosis H37Rv
gcaaacaucgcaggc

SEQ ID NO: 3255978 - RNA, 20 nt, Mycobacterium tuberculosis H37Rv
gcaaaccacccgcaacacau

SEQ ID NO: 3255979 - RNA, 13 nt, Mycobacterium tuberculosis H37Rv
gcaaaccccggac

SEQ ID NO: 3255980 - RNA, 18 nt, Mycobacterium tuberculosis H37Rv
gcaaaccccggaccaucg

SEQ ID NO: 3255981 - RNA, 18 nt, Mycobacterium tuberculosis H37Rv
gcaaacguaccgucaugg

SEQ ID NO: 3255982 - RNA, 22 nt, Mycobacterium tuberculosis H37Rv
gcaaacuccagcuugccgaccu

SEQ ID NO: 3255983 - RNA, 20 nt, Mycobacterium tuberculosis H37Rv
gcaaacuucgcgcacgcccu

SEQ ID NO: 3255984 - RNA, 15 nt, Mycobacterium tuberculosis H37Rv
gcaaagacagcgcgg

SEQ ID NO: 3255985 - RNA, 13 nt, Mycobacterium tuberculosis H37Rv
gcaaagcagcgca

SEQ ID NO: 3255986 - RNA, 21 nt, Mycobacterium tuberculosis H37Rv
gcaaagccagcgcagccaggc

SEQ ID NO: 3255987 - RNA, 12 nt, Mycobacterium tuberculosis H37Rv
gcaaaggcgcuc

SEQ ID NO: 3255988 - RNA, 19 nt, Mycobacterium tuberculosis H37Rv
gcaaagucgggggucgcac

SEQ ID NO: 3255989 - RNA, 12 nt, Mycobacterium tuberculosis H37Rv
gcaaaucaagca

SEQ ID NO: 3255990 - RNA, 13 nt, Mycobacterium tuberculosis H37Rv
gcaaaugcggcgc

SEQ ID NO: 3255991 - RNA, 19 nt, Mycobacterium tuberculosis H37Rv
gcaacaaagguaccgcugg

SEQ ID NO: 3255992 - RNA, 15 nt, Mycobacterium tuberculosis H37Rv
gcaacaaagucgcca

SEQ ID NO: 3255993 - RNA, 18 nt, Mycobacterium tuberculosis H37Rv
gcaacaacgucugcagcc

SEQ ID NO: 3255994 - RNA, 21 nt, Mycobacterium tuberculosis H37Rv
gcaacaacgucugcagccucg

SEQ ID NO: 3255995 - RNA, 14 nt, Mycobacterium tuberculosis H37Rv
gcaacacaccgaac

SEQ ID NO: 3255996 - RNA, 22 nt, Mycobacterium tuberculosis H37Rv
gcaacacaccgcggaaggccag

SEQ ID NO: 3255997 - RNA, 12 nt, Mycobacterium tuberculosis H37Rv
gcaacacagcug

SEQ ID NO: 3255998 - RNA, 12 nt, Mycobacterium tuberculosis H37Rv
gcaacaccaccu

SEQ ID NO: 3255999 - RNA, 21 nt, Mycobacterium tuberculosis H37Rv
gcaacaccaccucgacgagca

SEQ ID NO: 3256000 - RNA, 20 nt, Mycobacterium tuberculosis H37Rv
gcaacaccagggccuccacc

SEQ ID NO: 3256001 - RNA, 14 nt, Mycobacterium tuberculosis H37Rv
gcaacaccgcaccg

SEQ ID NO: 3256002 - RNA, 21 nt, Mycobacterium tuberculosis H37Rv
gcaacaccgucggcagcagcg

SEQ ID NO: 3256003 - RNA, 17 nt, Mycobacterium tuberculosis H37Rv
gcaacacgggcgccgga

SEQ ID NO: 3256004 - RNA, 17 nt, Mycobacterium tuberculosis H37Rv
gcaacacgucggguugc

SEQ ID NO: 3256005 - RNA, 15 nt, Mycobacterium tuberculosis H37Rv
gcaacacucauuccc

SEQ ID NO: 3256006 - RNA, 13 nt, Mycobacterium tuberculosis H37Rv
gcaacagcaacgg

SEQ ID NO: 3256007 - RNA, 12 nt, Mycobacterium tuberculosis H37Rv
gcaacagcacca

SEQ ID NO: 3256008 - RNA, 12 nt, Mycobacterium tuberculosis H37Rv
gcaacagcgcca

SEQ ID NO: 3256009 - RNA, 21 nt, Mycobacterium tuberculosis H37Rv
gcaacagcgcgguguucgcgg

SEQ ID NO: 3256010 - RNA, 23 nt, Mycobacterium tuberculosis H37Rv
gcaacaggccaacuuggcggcca

SEQ ID NO: 3256011 - RNA, 16 nt, Mycobacterium tuberculosis H37Rv
gcaacaggcccacggc

SEQ ID NO: 3256012 - RNA, 19 nt, Mycobacterium tuberculosis H37Rv
gcaacaggcccacggcgac

SEQ ID NO: 3256013 - RNA, 17 nt, Mycobacterium tuberculosis H37Rv
gcaacaguucacgccgg

SEQ ID NO: 3256014 - RNA, 15 nt, Mycobacterium tuberculosis H37Rv
gcaacaucagcagga

SEQ ID NO: 3256015 - RNA, 21 nt, Mycobacterium tuberculosis H37Rv
gcaacaucgaauaugacugcg

SEQ ID NO: 3256016 - RNA, 16 nt, Mycobacterium tuberculosis H37Rv
gcaacaucgagcgcca

SEQ ID NO: 3256017 - RNA, 20 nt, Mycobacterium tuberculosis H37Rv
gcaaccaauaggugucgacg

SEQ ID NO: 3256018 - RNA, 19 nt, Mycobacterium tuberculosis H37Rv
gcaaccaccucgugggcca

SEQ ID NO: 3256019 - RNA, 18 nt, Mycobacterium tuberculosis H37Rv
gcaaccacgccccgaucg

SEQ ID NO: 3256020 - RNA, 22 nt, Mycobacterium tuberculosis H37Rv
gcaaccacgccccgaucgguga

SEQ ID NO: 3256021 - RNA, 17 nt, Mycobacterium tuberculosis H37Rv
gcaaccacggcggcauc

SEQ ID NO: 3256022 - RNA, 14 nt, Mycobacterium tuberculosis H37Rv
gcaaccacguccgc

SEQ ID NO: 3256023 - RNA, 15 nt, Mycobacterium tuberculosis H37Rv
gcaaccacguccgca

SEQ ID NO: 3256024 - RNA, 17 nt, Mycobacterium tuberculosis H37Rv
gcaaccagcaaugccga

SEQ ID NO: 3256025 - RNA, 19 nt, Mycobacterium tuberculosis H37Rv
gcaaccagcgagcccagcu

SEQ ID NO: 3256026 - RNA, 23 nt, Mycobacterium tuberculosis H37Rv
gcaaccaggaugguugcgacggc

SEQ ID NO: 3256027 - RNA, 16 nt, Mycobacterium tuberculosis H37Rv
gcaacccacacgcccu

SEQ ID NO: 3256028 - RNA, 20 nt, Mycobacterium tuberculosis H37Rv
gcaacccagccgcgccagcu

SEQ ID NO: 3256029 - RNA, 23 nt, Mycobacterium tuberculosis H37Rv
gcaacccgccguugccaccggug

SEQ ID NO: 3256030 - RNA, 11 nt, Mycobacterium tuberculosis H37Rv
gcaacccgguc

SEQ ID NO: 3256031 - RNA, 13 nt, Mycobacterium tuberculosis H37Rv
gcaacccggucgg

SEQ ID NO: 3256032 - RNA, 17 nt, Mycobacterium tuberculosis H37Rv
gcaacccggugauggug

SEQ ID NO: 3256033 - RNA, 21 nt, Mycobacterium tuberculosis H37Rv
gcaacccugcccggcccgccc

SEQ ID NO: 3256034 - RNA, 17 nt, Mycobacterium tuberculosis H37Rv
gcaacccugcggugcag

SEQ ID NO: 3256035 - RNA, 20 nt, Mycobacterium tuberculosis H37Rv
gcaaccgaccgggccgcacg

SEQ ID NO: 3256036 - RNA, 16 nt, Mycobacterium tuberculosis H37Rv
gcaaccgccccuuccc

SEQ ID NO: 3256037 - RNA, 15 nt, Mycobacterium tuberculosis H37Rv
gcaaccgccgccauu

SEQ ID NO: 3256038 - RNA, 16 nt, Mycobacterium tuberculosis H37Rv
gcaaccgcgcgcgaca

SEQ ID NO: 3256039 - RNA, 15 nt, Mycobacterium tuberculosis H37Rv
gcaaccgcucggcga

SEQ ID NO: 3256040 - RNA, 16 nt, Mycobacterium tuberculosis H37Rv
gcaaccgcucggcgau

SEQ ID NO: 3256041 - RNA, 19 nt, Mycobacterium tuberculosis H37Rv
gcaaccggauuucgucggg

SEQ ID NO: 3256042 - RNA, 15 nt, Mycobacterium tuberculosis H37Rv
gcaaccggcgugucg

SEQ ID NO: 3256043 - RNA, 21 nt, Mycobacterium tuberculosis H37Rv
gcaaccgggaggccaccgcga

SEQ ID NO: 3256044 - RNA, 14 nt, Mycobacterium tuberculosis H37Rv
gcaaccggucagcc

SEQ ID NO: 3256045 - RNA, 20 nt, Mycobacterium tuberculosis H37Rv
gcaaccugccgggccacggc

SEQ ID NO: 3256046 - RNA, 18 nt, Mycobacterium tuberculosis H37Rv
gcaaccuguuccagcgug

SEQ ID NO: 3256047 - RNA, 16 nt, Mycobacterium tuberculosis H37Rv
gcaaccuuuggccgcu

SEQ ID NO: 3256048 - RNA, 14 nt, Mycobacterium tuberculosis H37Rv
gcaacgaagccggc

SEQ ID NO: 3256049 - RNA, 15 nt, Mycobacterium tuberculosis H37Rv
gcaacgaagccggcg

SEQ ID NO: 3256050 - RNA, 20 nt, Mycobacterium tuberculosis H37Rv
gcaacgaagccggcgccggc

SEQ ID NO: 3256051 - RNA, 18 nt, Mycobacterium tuberculosis H37Rv
gcaacgaauagguucccu

SEQ ID NO: 3256052 - RNA, 21 nt, Mycobacterium tuberculosis H37Rv
gcaacgacauccagaugccca

SEQ ID NO: 3256053 - RNA, 16 nt, Mycobacterium tuberculosis H37Rv
gcaaguucgucgggau

SEQ ID NO: 3256054 - RNA, 19 nt, Mycobacterium tuberculosis H37Rv
gcaaguugagcagcuuggu

SEQ ID NO: 3256055 - RNA, 18 nt, Mycobacterium tuberculosis H37Rv
gcaauacccgagcguccg

SEQ ID NO: 3256056 - RNA, 22 nt, Mycobacterium tuberculosis H37Rv
gcaauacggcggcgccgcccaa

SEQ ID NO: 3256057 - RNA, 19 nt, Mycobacterium tuberculosis H37Rv
gcaauacguagucgccgau

SEQ ID NO: 3256058 - RNA, 14 nt, Mycobacterium tuberculosis H37Rv
gcaauagaccgcag

SEQ ID NO: 3256059 - RNA, 19 nt, Mycobacterium tuberculosis H37Rv
gcaauauccuccagcaggu

SEQ ID NO: 3256060 - RNA, 20 nt, Mycobacterium tuberculosis H37Rv
gcaaucaucucccgaccgcc

SEQ ID NO: 3256061 - RNA, 22 nt, Mycobacterium tuberculosis H37Rv
gcaaucaucucccgaccgccga

SEQ ID NO: 3256062 - RNA, 22 nt, Mycobacterium tuberculosis H37Rv
gcaaucaugucagcgcugagcc

SEQ ID NO: 3256063 - RNA, 21 nt, Mycobacterium tuberculosis H37Rv
gcaauccaaggcucagcagcg

SEQ ID NO: 3256064 - RNA, 20 nt, Mycobacterium tuberculosis H37Rv
gcaauccccuggaaagggcc

SEQ ID NO: 3256065 - RNA, 11 nt, Mycobacterium tuberculosis H37Rv
gcaauccgcaa

SEQ ID NO: 3256066 - RNA, 14 nt, Mycobacterium tuberculosis H37Rv
gcaaucgaccacga

SEQ ID NO: 3256067 - RNA, 20 nt, Mycobacterium tuberculosis H37Rv
gcaaucgcgggcgauggcca

SEQ ID NO: 3256068 - RNA, 21 nt, Mycobacterium tuberculosis H37Rv
gcaaucgcucugugucgccga

SEQ ID NO: 3256069 - RNA, 22 nt, Mycobacterium tuberculosis H37Rv
gcaaucgcucugugucgccgau

SEQ ID NO: 3256070 - RNA, 15 nt, Mycobacterium tuberculosis H37Rv
gcaaucggcggcacc

SEQ ID NO: 3256071 - RNA, 21 nt, Mycobacterium tuberculosis H37Rv
gcaaucucccgaaucgugcgg

SEQ ID NO: 3256072 - RNA, 16 nt, Mycobacterium tuberculosis H37Rv
gcaaugaccugcagcg

SEQ ID NO: 3256073 - RNA, 21 nt, Mycobacterium tuberculosis H37Rv
gcaaugaccugcagcgcaucc

SEQ ID NO: 3256074 - RNA, 12 nt, Mycobacterium tuberculosis H37Rv
gcaaugaccugg

SEQ ID NO: 3256075 - RNA, 23 nt, Mycobacterium tuberculosis H37Rv
gcaaugaccuggccgcccgcugc

SEQ ID NO: 3256076 - RNA, 13 nt, Mycobacterium tuberculosis H37Rv
gcaaugacggccu

SEQ ID NO: 3256077 - RNA, 15 nt, Mycobacterium tuberculosis H37Rv
gcaaugacggccugc

SEQ ID NO: 3256078 - RNA, 17 nt, Mycobacterium tuberculosis H37Rv
gcaaugacgucgucggc

SEQ ID NO: 3256079 - RNA, 15 nt, Mycobacterium tuberculosis H37Rv
gcaaugcccgaccgg

SEQ ID NO: 3256080 - RNA, 20 nt, Mycobacterium tuberculosis H37Rv
gcaaugcggcccggguggcc

SEQ ID NO: 3256081 - RNA, 23 nt, Mycobacterium tuberculosis H37Rv
gcaaugcuccuaucugccgguac

SEQ ID NO: 3256082 - RNA, 15 nt, Mycobacterium tuberculosis H37Rv
gcaaugcuuccagca

SEQ ID NO: 3256083 - RNA, 15 nt, Mycobacterium tuberculosis H37Rv
gcaauggccagcacc

SEQ ID NO: 3256084 - RNA, 13 nt, Mycobacterium tuberculosis H37Rv
gcaauggcgcggu

SEQ ID NO: 3256085 - RNA, 13 nt, Mycobacterium tuberculosis H37Rv
gcaauggcggccu

SEQ ID NO: 3256086 - RNA, 16 nt, Mycobacterium tuberculosis H37Rv
gcaauggcggccuugc

SEQ ID NO: 3256087 - RNA, 22 nt, Mycobacterium tuberculosis H37Rv
gcaaugucggcagggcccccag

SEQ ID NO: 3256088 - RNA, 17 nt, Mycobacterium tuberculosis H37Rv
gcaauuccacgaucggc

SEQ ID NO: 3256089 - RNA, 19 nt, Mycobacterium tuberculosis H37Rv
gcaauuccguuaggcucca

SEQ ID NO: 3256090 - RNA, 14 nt, Mycobacterium tuberculosis H37Rv
gcaauugccugcgc

SEQ ID NO: 3256091 - RNA, 20 nt, Mycobacterium tuberculosis H37Rv
gcaauugcucguagcccagg

SEQ ID NO: 3256092 - RNA, 12 nt, Mycobacterium tuberculosis H37Rv
gcaauuugccgu

SEQ ID NO: 3256093 - RNA, 18 nt, Mycobacterium tuberculosis H37Rv
gcacaaacauacgccacc

SEQ ID NO: 3256094 - RNA, 23 nt, Mycobacterium tuberculosis H37Rv
gcacaaacgggcgugggccgcug

SEQ ID NO: 3256095 - RNA, 17 nt, Mycobacterium tuberculosis H37Rv
gcacaacccgucgagcc

SEQ ID NO: 3256096 - RNA, 17 nt, Mycobacterium tuberculosis H37Rv
gcacaaccgcugcugcu

SEQ ID NO: 3256097 - RNA, 17 nt, Mycobacterium tuberculosis H37Rv
gcacaacgcgacgccgc

SEQ ID NO: 3256098 - RNA, 18 nt, Mycobacterium tuberculosis H37Rv
gcacaacgcgacgccgcu

SEQ ID NO: 3256099 - RNA, 13 nt, Mycobacterium tuberculosis H37Rv
gcacaagcccagc

SEQ ID NO: 3256100 - RNA, 13 nt, Mycobacterium tuberculosis H37Rv
gcacaaggcguga

SEQ ID NO: 3256101 - RNA, 22 nt, Mycobacterium tuberculosis H37Rv
gcacaaguucuucgacagcgcg

SEQ ID NO: 3256102 - RNA, 19 nt, Mycobacterium tuberculosis H37Rv
gcacaauacggucagcaga

SEQ ID NO: 3256103 - RNA, 21 nt, Mycobacterium tuberculosis H37Rv
gcacaauacggucagcagacu

SEQ ID NO: 3256104 - RNA, 20 nt, Mycobacterium tuberculosis H37Rv
gcacaaucggauagccgugc

SEQ ID NO: 3256105 - RNA, 13 nt, Mycobacterium tuberculosis H37Rv
gcacacagaccgu

SEQ ID NO: 3256106 - RNA, 19 nt, Mycobacterium tuberculosis H37Rv
gcacaccaaccgagcgccc

SEQ ID NO: 3256107 - RNA, 11 nt, Mycobacterium tuberculosis H37Rv
gcacaccaccg

SEQ ID NO: 3256108 - RNA, 15 nt, Mycobacterium tuberculosis H37Rv
gcacacccaucaccg

SEQ ID NO: 3256109 - RNA, 16 nt, Mycobacterium tuberculosis H37Rv
gcacacccaucaccgc

SEQ ID NO: 3256110 - RNA, 18 nt, Mycobacterium tuberculosis H37Rv
gcacaccccgguucgacg

SEQ ID NO: 3256111 - RNA, 16 nt, Mycobacterium tuberculosis H37Rv
gcacacccgguuggcc

SEQ ID NO: 3256112 - RNA, 18 nt, Mycobacterium tuberculosis H37Rv
gcacaccgacagcaccca

SEQ ID NO: 3256113 - RNA, 17 nt, Mycobacterium tuberculosis H37Rv
gcacaccgacgccgcca

SEQ ID NO: 3256114 - RNA, 18 nt, Mycobacterium tuberculosis H37Rv
gcacaccgaggucgccaa

SEQ ID NO: 3256115 - RNA, 12 nt, Mycobacterium tuberculosis H37Rv
gcacaccgaucg

SEQ ID NO: 3256116 - RNA, 21 nt, Mycobacterium tuberculosis H37Rv
gcacaccgaucggcaaaccgu

SEQ ID NO: 3256117 - RNA, 15 nt, Mycobacterium tuberculosis H37Rv
gcacaccgccagcgg

SEQ ID NO: 3256118 - RNA, 23 nt, Mycobacterium tuberculosis H37Rv
gcacaccggcacugcccagcaga

SEQ ID NO: 3256119 - RNA, 15 nt, Mycobacterium tuberculosis H37Rv
gcacaccgggcacca

SEQ ID NO: 3256120 - RNA, 15 nt, Mycobacterium tuberculosis H37Rv
gcacaccgucgacga

SEQ ID NO: 3256121 - RNA, 12 nt, Mycobacterium tuberculosis H37Rv
gcacaccgucgc

SEQ ID NO: 3256122 - RNA, 14 nt, Mycobacterium tuberculosis H37Rv
gcacaccgucgucg

SEQ ID NO: 3256123 - RNA, 15 nt, Mycobacterium tuberculosis H37Rv
gcacaccugcgcggc

SEQ ID NO: 3256124 - RNA, 13 nt, Mycobacterium tuberculosis H37Rv
gcacacggccuug

SEQ ID NO: 3256125 - RNA, 14 nt, Mycobacterium tuberculosis H37Rv
gcacacggccuugc

SEQ ID NO: 3256126 - RNA, 14 nt, Mycobacterium tuberculosis H37Rv
gcacacguccggcg

SEQ ID NO: 3256127 - RNA, 16 nt, Mycobacterium tuberculosis H37Rv
gcacacguccggcgau

SEQ ID NO: 3256128 - RNA, 20 nt, Mycobacterium tuberculosis H37Rv
gcacacguccggcgaugacc

SEQ ID NO: 3256129 - RNA, 22 nt, Mycobacterium tuberculosis H37Rv
gcacacuaccgccgcgaccgcg

SEQ ID NO: 3256130 - RNA, 20 nt, Mycobacterium tuberculosis H37Rv
gcacacuccuagccaacgag

SEQ ID NO: 3256131 - RNA, 16 nt, Mycobacterium tuberculosis H37Rv
gcacacugaccccgcc

SEQ ID NO: 3256132 - RNA, 12 nt, Mycobacterium tuberculosis H37Rv
gcacacugccgc

SEQ ID NO: 3256133 - RNA, 22 nt, Mycobacterium tuberculosis H37Rv
gcacacugucgauuugaucgac

SEQ ID NO: 3256134 - RNA, 17 nt, Mycobacterium tuberculosis H37Rv
gcacagacacggcagcu

SEQ ID NO: 3256135 - RNA, 15 nt, Mycobacterium tuberculosis H37Rv
gcacagcaccacauc

SEQ ID NO: 3256136 - RNA, 19 nt, Mycobacterium tuberculosis H37Rv
gcacagcaccacgugcgag

SEQ ID NO: 3256137 - RNA, 14 nt, Mycobacterium tuberculosis H37Rv
gcacagcagcaacg

SEQ ID NO: 3256138 - RNA, 21 nt, Mycobacterium tuberculosis H37Rv
gcacagcagcaacgcggugcc

SEQ ID NO: 3256139 - RNA, 18 nt, Mycobacterium tuberculosis H37Rv
gcacagcagcgguugaug

SEQ ID NO: 3256140 - RNA, 14 nt, Mycobacterium tuberculosis H37Rv
gcacagcagugaac

SEQ ID NO: 3256141 - RNA, 17 nt, Mycobacterium tuberculosis H37Rv
gcacagccauggugggc

SEQ ID NO: 3256142 - RNA, 15 nt, Mycobacterium tuberculosis H37Rv
gcacagcccggcgac

SEQ ID NO: 3256143 - RNA, 21 nt, Mycobacterium tuberculosis H37Rv
gcacagcccggcgacgacccg

SEQ ID NO: 3256144 - RNA, 21 nt, Mycobacterium tuberculosis H37Rv
gcacagccgcuuggcgcggcc

SEQ ID NO: 3256145 - RNA, 15 nt, Mycobacterium tuberculosis H37Rv
gcacagcgaccaucg

SEQ ID NO: 3256146 - RNA, 20 nt, Mycobacterium tuberculosis H37Rv
gcacagcgaccaucgccgac

SEQ ID NO: 3256147 - RNA, 15 nt, Mycobacterium tuberculosis H37Rv
gcacagcgacgagau

SEQ ID NO: 3256148 - RNA, 14 nt, Mycobacterium tuberculosis H37Rv
gcacagcgcagccu

SEQ ID NO: 3256149 - RNA, 16 nt, Mycobacterium tuberculosis H37Rv
gcacccaacuccauca

SEQ ID NO: 3256150 - RNA, 21 nt, Mycobacterium tuberculosis H37Rv
gcacccaacuccaucagcgcg

SEQ ID NO: 3256151 - RNA, 21 nt, Mycobacterium tuberculosis H37Rv
gcacccaauccggcgccagca

SEQ ID NO: 3256152 - RNA, 14 nt, Mycobacterium tuberculosis H37Rv
gcacccaaugccac

SEQ ID NO: 3256153 - RNA, 21 nt, Mycobacterium tuberculosis H37Rv
gcacccaaugccaccgcggcc

SEQ ID NO: 3256154 - RNA, 17 nt, Mycobacterium tuberculosis H37Rv
gcacccacaucagccgc

SEQ ID NO: 3256155 - RNA, 23 nt, Mycobacterium tuberculosis H37Rv
gcacccacaucagccgcaccagu

SEQ ID NO: 3256156 - RNA, 18 nt, Mycobacterium tuberculosis H37Rv
gcacccaccagugcaucg

SEQ ID NO: 3256157 - RNA, 20 nt, Mycobacterium tuberculosis H37Rv
gcacccaccgaagcgaacgg

SEQ ID NO: 3256158 - RNA, 19 nt, Mycobacterium tuberculosis H37Rv
gcacccacuuuucgguggc

SEQ ID NO: 3256159 - RNA, 14 nt, Mycobacterium tuberculosis H37Rv
gcacccagaccgcc

SEQ ID NO: 3256160 - RNA, 16 nt, Mycobacterium tuberculosis H37Rv
gcacccagacgauggc

SEQ ID NO: 3256161 - RNA, 17 nt, Mycobacterium tuberculosis H37Rv
gcacccagacgauggcc

SEQ ID NO: 3256162 - RNA, 19 nt, Mycobacterium tuberculosis H37Rv
gcacccagacgauggccag

SEQ ID NO: 3256163 - RNA, 21 nt, Mycobacterium tuberculosis H37Rv
gcacccagggcguuggcggcu

SEQ ID NO: 3256164 - RNA, 17 nt, Mycobacterium tuberculosis H37Rv
gcacccagucggcgccg

SEQ ID NO: 3256165 - RNA, 18 nt, Mycobacterium tuberculosis H37Rv
gcacccagucggcgccgc

SEQ ID NO: 3256166 - RNA, 13 nt, Mycobacterium tuberculosis H37Rv
gcaccccacggcc

SEQ ID NO: 3256167 - RNA, 14 nt, Mycobacterium tuberculosis H37Rv
gcacccccgucgcc

SEQ ID NO: 3256168 - RNA, 16 nt, Mycobacterium tuberculosis H37Rv
gcacccccgucgccac

SEQ ID NO: 3256169 - RNA, 13 nt, Mycobacterium tuberculosis H37Rv
gcacccccugcac

SEQ ID NO: 3256170 - RNA, 20 nt, Mycobacterium tuberculosis H37Rv
gcaccccgaccaccagagcg

SEQ ID NO: 3256171 - RNA, 16 nt, Mycobacterium tuberculosis H37Rv
gcaccccgaucuggcg

SEQ ID NO: 3256172 - RNA, 16 nt, Mycobacterium tuberculosis H37Rv
gcaccccgccgccugc

SEQ ID NO: 3256173 - RNA, 15 nt, Mycobacterium tuberculosis H37Rv
gcaccccggccgcgc

SEQ ID NO: 3256174 - RNA, 21 nt, Mycobacterium tuberculosis H37Rv
gcaccccggugcccgcgguga

SEQ ID NO: 3256175 - RNA, 19 nt, Mycobacterium tuberculosis H37Rv
gcacccgaauuugucggcg

SEQ ID NO: 3256176 - RNA, 20 nt, Mycobacterium tuberculosis H37Rv
gcacccgaauuugucggcga

SEQ ID NO: 3256177 - RNA, 23 nt, Mycobacterium tuberculosis H37Rv
gcacccgaauuugucggcgaagc

SEQ ID NO: 3256178 - RNA, 15 nt, Mycobacterium tuberculosis H37Rv
gcacccgacucgucg

SEQ ID NO: 3256179 - RNA, 18 nt, Mycobacterium tuberculosis H37Rv
gcacccgagccgcacagc

SEQ ID NO: 3256180 - RNA, 22 nt, Mycobacterium tuberculosis H37Rv
gcacccgaguuauagaagccga

SEQ ID NO: 3256181 - RNA, 23 nt, Mycobacterium tuberculosis H37Rv
gcacccgaguuauagaagccgac

SEQ ID NO: 3256182 - RNA, 23 nt, Mycobacterium tuberculosis H37Rv
gcacccgauaguucuggcccgca

SEQ ID NO: 3256183 - RNA, 15 nt, Mycobacterium tuberculosis H37Rv
gcacccgcacggccu

SEQ ID NO: 3256184 - RNA, 17 nt, Mycobacterium tuberculosis H37Rv
gcacccgcacggccucc

SEQ ID NO: 3256185 - RNA, 14 nt, Mycobacterium tuberculosis H37Rv
gcacccgcacggug

SEQ ID NO: 3256186 - RNA, 22 nt, Mycobacterium tuberculosis H37Rv
gcacccgcgccaguaacgccca

SEQ ID NO: 3256187 - RNA, 18 nt, Mycobacterium tuberculosis H37Rv
gcacccgcuccagcucgg

SEQ ID NO: 3256188 - RNA, 20 nt, Mycobacterium tuberculosis H37Rv
gcacccgcuccagcucggcg

SEQ ID NO: 3256189 - RNA, 14 nt, Mycobacterium tuberculosis H37Rv
gcacccgcucggcc

SEQ ID NO: 3256190 - RNA, 17 nt, Mycobacterium tuberculosis H37Rv
gcacccgcucggcgcgc

SEQ ID NO: 3256191 - RNA, 21 nt, Mycobacterium tuberculosis H37Rv
gcacccgcucggcgcgcgggu

SEQ ID NO: 3256192 - RNA, 12 nt, Mycobacterium tuberculosis H37Rv
gcacccgcucgu

SEQ ID NO: 3256193 - RNA, 15 nt, Mycobacterium tuberculosis H37Rv
gcacccgcuggcggu

SEQ ID NO: 3256194 - RNA, 16 nt, Mycobacterium tuberculosis H37Rv
gcacccgcuggcggua

SEQ ID NO: 3256195 - RNA, 13 nt, Mycobacterium tuberculosis H37Rv
gcacccgcugguc

SEQ ID NO: 3256196 - RNA, 16 nt, Mycobacterium tuberculosis H37Rv
gcacccgcuggucgag

SEQ ID NO: 3256197 - RNA, 24 nt, Mycobacterium tuberculosis H37Rv
gcacccgcuggucgagcagugccu

SEQ ID NO: 3256198 - RNA, 23 nt, Mycobacterium tuberculosis H37Rv
gcacccggcagagcacgcgcggc

SEQ ID NO: 3256199 - RNA, 13 nt, Mycobacterium tuberculosis H37Rv
gcacccggccacc

SEQ ID NO: 3256200 - RNA, 22 nt, Mycobacterium tuberculosis H37Rv
gcacccggcgauuggaccgcca

SEQ ID NO: 3256201 - RNA, 21 nt, Mycobacterium tuberculosis H37Rv
gcacccggcuguucucgccga

SEQ ID NO: 3256202 - RNA, 22 nt, Mycobacterium tuberculosis H37Rv
gcacccggcuguucucgccgaa

SEQ ID NO: 3256203 - RNA, 21 nt, Mycobacterium tuberculosis H37Rv
gcacccggcuucgccgcgcuu

SEQ ID NO: 3256204 - RNA, 15 nt, Mycobacterium tuberculosis H37Rv
gcacccgggccacgu

SEQ ID NO: 3256205 - RNA, 18 nt, Mycobacterium tuberculosis H37Rv
gcacccgggccacgucga

SEQ ID NO: 3256206 - RNA, 22 nt, Mycobacterium tuberculosis H37Rv
gcacccgggccacgucgagcac

SEQ ID NO: 3256207 - RNA, 20 nt, Mycobacterium tuberculosis H37Rv
gcacccggggggccucguug

SEQ ID NO: 3256208 - RNA, 13 nt, Mycobacterium tuberculosis H37Rv
gcacccggggugc

SEQ ID NO: 3256209 - RNA, 19 nt, Mycobacterium tuberculosis H37Rv
gcacccggggugcccggcc

SEQ ID NO: 3256210 - RNA, 23 nt, Mycobacterium tuberculosis H37Rv
gcacccggggugcccggccgcca

SEQ ID NO: 3256211 - RNA, 14 nt, Mycobacterium tuberculosis H37Rv
gcacccggucggcc

SEQ ID NO: 3256212 - RNA, 21 nt, Mycobacterium tuberculosis H37Rv
gcacccgguugugcgcgcgcc

SEQ ID NO: 3256213 - RNA, 20 nt, Mycobacterium tuberculosis H37Rv
gcacccgucacaagcugaca

SEQ ID NO: 3256214 - RNA, 15 nt, Mycobacterium tuberculosis H37Rv
gcacccgugccgccg

SEQ ID NO: 3256215 - RNA, 23 nt, Mycobacterium tuberculosis H37Rv
gcacccgugccgccgaugccgcc

SEQ ID NO: 3256216 - RNA, 18 nt, Mycobacterium tuberculosis H37Rv
gcacccguugcgacaccu

SEQ ID NO: 3256217 - RNA, 13 nt, Mycobacterium tuberculosis H37Rv
gcacccucaggca

SEQ ID NO: 3256218 - RNA, 23 nt, Mycobacterium tuberculosis H37Rv
gcacccucaggcaaucgcgggcg

SEQ ID NO: 3256219 - RNA, 15 nt, Mycobacterium tuberculosis H37Rv
gcacccugcgcggcg

SEQ ID NO: 3256220 - RNA, 14 nt, Mycobacterium tuberculosis H37Rv
gcacccugcggcac

SEQ ID NO: 3256221 - RNA, 14 nt, Mycobacterium tuberculosis H37Rv
gcacccugcgggcc

SEQ ID NO: 3256222 - RNA, 16 nt, Mycobacterium tuberculosis H37Rv
gcacccugcgugcggc

SEQ ID NO: 3256223 - RNA, 22 nt, Mycobacterium tuberculosis H37Rv
gcacccuggguauccaccgcga

SEQ ID NO: 3256224 - RNA, 16 nt, Mycobacterium tuberculosis H37Rv
gcacccuugccgauuc

SEQ ID NO: 3256225 - RNA, 17 nt, Mycobacterium tuberculosis H37Rv
gcacccuugccgauucc

SEQ ID NO: 3256226 - RNA, 19 nt, Mycobacterium tuberculosis H37Rv
gcacccuugccgauuccgg

SEQ ID NO: 3256227 - RNA, 23 nt, Mycobacterium tuberculosis H37Rv
gcacccuugccgauuccggcguu

SEQ ID NO: 3256228 - RNA, 18 nt, Mycobacterium tuberculosis H37Rv
gcaccgaaaaacaccagc

SEQ ID NO: 3256229 - RNA, 19 nt, Mycobacterium tuberculosis H37Rv
gcaccgaaaccaugccgcc

SEQ ID NO: 3256230 - RNA, 16 nt, Mycobacterium tuberculosis H37Rv
gcaccgaaacgccgac

SEQ ID NO: 3256231 - RNA, 17 nt, Mycobacterium tuberculosis H37Rv
gcaccgaacccgccacc

SEQ ID NO: 3256232 - RNA, 20 nt, Mycobacterium tuberculosis H37Rv
gcaccgaacccgccaccgcg

SEQ ID NO: 3256233 - RNA, 22 nt, Mycobacterium tuberculosis H37Rv
gcaccgaacguguucuggucgc

SEQ ID NO: 3256234 - RNA, 15 nt, Mycobacterium tuberculosis H37Rv
gcaccgaagauggcc

SEQ ID NO: 3256235 - RNA, 19 nt, Mycobacterium tuberculosis H37Rv
gcaccgaagauggccagcg

SEQ ID NO: 3256236 - RNA, 20 nt, Mycobacterium tuberculosis H37Rv
gcaccgaagauggccagcgc

SEQ ID NO: 3256237 - RNA, 13 nt, Mycobacterium tuberculosis H37Rv
gcaccgaagugca

SEQ ID NO: 3256238 - RNA, 15 nt, Mycobacterium tuberculosis H37Rv
gcaccgacagcccga

SEQ ID NO: 3256239 - RNA, 20 nt, Mycobacterium tuberculosis H37Rv
gcaccgaccagggccgccgc

SEQ ID NO: 3256240 - RNA, 20 nt, Mycobacterium tuberculosis H37Rv
gcaccgaccugagucggcau

SEQ ID NO: 3256241 - RNA, 14 nt, Mycobacterium tuberculosis H37Rv
gcaccgacggcgca

SEQ ID NO: 3256242 - RNA, 18 nt, Mycobacterium tuberculosis H37Rv
gcaccgagcugagcggcc

SEQ ID NO: 3256243 - RNA, 16 nt, Mycobacterium tuberculosis H37Rv
gcaccgaggccgccga

SEQ ID NO: 3256244 - RNA, 19 nt, Mycobacterium tuberculosis H37Rv
gcaccgugcggggggcagc

SEQ ID NO: 3256245 - RNA, 18 nt, Mycobacterium tuberculosis H37Rv
gcaccgugucgacgguca

SEQ ID NO: 3256246 - RNA, 16 nt, Mycobacterium tuberculosis H37Rv
gcaccgugugggcccc

SEQ ID NO: 3256247 - RNA, 18 nt, Mycobacterium tuberculosis H37Rv
gcaccgugugggccccgc

SEQ ID NO: 3256248 - RNA, 22 nt, Mycobacterium tuberculosis H37Rv
gcaccgugugggccccgccgau

SEQ ID NO: 3256249 - RNA, 19 nt, Mycobacterium tuberculosis H37Rv
gcaccguuaccgccgucgc

SEQ ID NO: 3256250 - RNA, 21 nt, Mycobacterium tuberculosis H37Rv
gcaccguuaccgccgucgcca

SEQ ID NO: 3256251 - RNA, 22 nt, Mycobacterium tuberculosis H37Rv
gcaccguuaccgccgucgccac

SEQ ID NO: 3256252 - RNA, 13 nt, Mycobacterium tuberculosis H37Rv
gcaccuacccugc

SEQ ID NO: 3256253 - RNA, 17 nt, Mycobacterium tuberculosis H37Rv
gcaccuauggucaaccg

SEQ ID NO: 3256254 - RNA, 14 nt, Mycobacterium tuberculosis H37Rv
gcaccucccgggcg

SEQ ID NO: 3256255 - RNA, 14 nt, Mycobacterium tuberculosis H37Rv
gcaccuccgccggc

SEQ ID NO: 3256256 - RNA, 23 nt, Mycobacterium tuberculosis H37Rv
gcaccuccggcaccgcccuugcc

SEQ ID NO: 3256257 - RNA, 17 nt, Mycobacterium tuberculosis H37Rv
gcaccucgaccgccaac

SEQ ID NO: 3256258 - RNA, 14 nt, Mycobacterium tuberculosis H37Rv
gcaccucgcccucc

SEQ ID NO: 3256259 - RNA, 13 nt, Mycobacterium tuberculosis H37Rv
gcaccucggccuu

SEQ ID NO: 3256260 - RNA, 23 nt, Mycobacterium tuberculosis H37Rv
gcaccucgucccagcgguagccg

SEQ ID NO: 3256261 - RNA, 15 nt, Mycobacterium tuberculosis H37Rv
gcaccugaucgguca

SEQ ID NO: 3256262 - RNA, 16 nt, Mycobacterium tuberculosis H37Rv
gcaccugccgaucggg

SEQ ID NO: 3256263 - RNA, 16 nt, Mycobacterium tuberculosis H37Rv
gcaccugcgaggugcc

SEQ ID NO: 3256264 - RNA, 15 nt, Mycobacterium tuberculosis H37Rv
gcaccugcgcgcggc

SEQ ID NO: 3256265 - RNA, 18 nt, Mycobacterium tuberculosis H37Rv
gcaccugcgcgcggccgc

SEQ ID NO: 3256266 - RNA, 15 nt, Mycobacterium tuberculosis H37Rv
gcaccugggcgcgcu

SEQ ID NO: 3256267 - RNA, 20 nt, Mycobacterium tuberculosis H37Rv
gcaccugggcugccggccag

SEQ ID NO: 3256268 - RNA, 17 nt, Mycobacterium tuberculosis H37Rv
gcaccugggucgacgag

SEQ ID NO: 3256269 - RNA, 20 nt, Mycobacterium tuberculosis H37Rv
gcacgaaaccgcagcgcgaa

SEQ ID NO: 3256270 - RNA, 15 nt, Mycobacterium tuberculosis H37Rv
gcacgaaccggucga

SEQ ID NO: 3256271 - RNA, 17 nt, Mycobacterium tuberculosis H37Rv
gcacgaacgaguccaac

SEQ ID NO: 3256272 - RNA, 18 nt, Mycobacterium tuberculosis H37Rv
gcacgaagcuggcgugca

SEQ ID NO: 3256273 - RNA, 19 nt, Mycobacterium tuberculosis H37Rv
gcacgaaguccuggcagac

SEQ ID NO: 3256274 - RNA, 20 nt, Mycobacterium tuberculosis H37Rv
gcacgaaucccccggacggc

SEQ ID NO: 3256275 - RNA, 18 nt, Mycobacterium tuberculosis H37Rv
gcacgacaacuucgccgg

SEQ ID NO: 3256276 - RNA, 14 nt, Mycobacterium tuberculosis H37Rv
gcacgacaccucga

SEQ ID NO: 3256277 - RNA, 21 nt, Mycobacterium tuberculosis H37Rv
gcacgacaccucgaaggcacu

SEQ ID NO: 3256278 - RNA, 16 nt, Mycobacterium tuberculosis H37Rv
gcacgacccgcugguc

SEQ ID NO: 3256279 - RNA, 17 nt, Mycobacterium tuberculosis H37Rv
gcacgacccgggaagga

SEQ ID NO: 3256280 - RNA, 21 nt, Mycobacterium tuberculosis H37Rv
gcacgaccucgcgcggggcgg

SEQ ID NO: 3256281 - RNA, 13 nt, Mycobacterium tuberculosis H37Rv
gcacgaccugguu

SEQ ID NO: 3256282 - RNA, 19 nt, Mycobacterium tuberculosis H37Rv
gcacgacgacaaccggcca

SEQ ID NO: 3256283 - RNA, 22 nt, Mycobacterium tuberculosis H37Rv
gcacgacgacaaccggccagau

SEQ ID NO: 3256284 - RNA, 16 nt, Mycobacterium tuberculosis H37Rv
gcacgacgccggccug

SEQ ID NO: 3256285 - RNA, 15 nt, Mycobacterium tuberculosis H37Rv
gcacgacgcgacacg

SEQ ID NO: 3256286 - RNA, 18 nt, Mycobacterium tuberculosis H37Rv
gcacgacggcaucgucga

SEQ ID NO: 3256287 - RNA, 16 nt, Mycobacterium tuberculosis H37Rv
gcacgagugcggcgac

SEQ ID NO: 3256288 - RNA, 17 nt, Mycobacterium tuberculosis H37Rv
gcacgagugcggcgacc

SEQ ID NO: 3256289 - RNA, 14 nt, Mycobacterium tuberculosis H37Rv
gcacgauacucacc

SEQ ID NO: 3256290 - RNA, 19 nt, Mycobacterium tuberculosis H37Rv
gcacgauacucaccgacgc

SEQ ID NO: 3256291 - RNA, 22 nt, Mycobacterium tuberculosis H37Rv
gcacgaucaucgggguggccac

SEQ ID NO: 3256292 - RNA, 14 nt, Mycobacterium tuberculosis H37Rv
gcacgauccagcug

SEQ ID NO: 3256293 - RNA, 15 nt, Mycobacterium tuberculosis H37Rv
gcacgauccagcugu

SEQ ID NO: 3256294 - RNA, 23 nt, Mycobacterium tuberculosis H37Rv
gcacgauccgcacccggccgcgc

SEQ ID NO: 3256295 - RNA, 14 nt, Mycobacterium tuberculosis H37Rv
gcacgaucgcaccg

SEQ ID NO: 3256296 - RNA, 18 nt, Mycobacterium tuberculosis H37Rv
gcacgaucgccauccggu

SEQ ID NO: 3256297 - RNA, 21 nt, Mycobacterium tuberculosis H37Rv
gcacgaucgccauccggucgg

SEQ ID NO: 3256298 - RNA, 13 nt, Mycobacterium tuberculosis H37Rv
gcacgaucgcccg

SEQ ID NO: 3256299 - RNA, 14 nt, Mycobacterium tuberculosis H37Rv
gcacgaucgcccgu

SEQ ID NO: 3256300 - RNA, 21 nt, Mycobacterium tuberculosis H37Rv
gcacgaucgcccgugagcgcc

SEQ ID NO: 3256301 - RNA, 13 nt, Mycobacterium tuberculosis H37Rv
gcacgauggccgu

SEQ ID NO: 3256302 - RNA, 18 nt, Mycobacterium tuberculosis H37Rv
gcacgauggugugcagca

SEQ ID NO: 3256303 - RNA, 17 nt, Mycobacterium tuberculosis H37Rv
gcacgaugucgaugccg

SEQ ID NO: 3256304 - RNA, 20 nt, Mycobacterium tuberculosis H37Rv
gcacgcaaugucggcagggc

SEQ ID NO: 3256305 - RNA, 15 nt, Mycobacterium tuberculosis H37Rv
gcacgcaccacaauc

SEQ ID NO: 3256306 - RNA, 17 nt, Mycobacterium tuberculosis H37Rv
gcacgcaccacaaucca

SEQ ID NO: 3256307 - RNA, 17 nt, Mycobacterium tuberculosis H37Rv
gcacgcacgcgguucac

SEQ ID NO: 3256308 - RNA, 14 nt, Mycobacterium tuberculosis H37Rv
gcacgcagagccaa

SEQ ID NO: 3256309 - RNA, 14 nt, Mycobacterium tuberculosis H37Rv
gcacgcaguucggu

SEQ ID NO: 3256310 - RNA, 12 nt, Mycobacterium tuberculosis H37Rv
gcacgcaugccg

SEQ ID NO: 3256311 - RNA, 16 nt, Mycobacterium tuberculosis H37Rv
gcacgcaugccgguga

SEQ ID NO: 3256312 - RNA, 23 nt, Mycobacterium tuberculosis H37Rv
gcacgccaacguugcgccagcgg

SEQ ID NO: 3256313 - RNA, 16 nt, Mycobacterium tuberculosis H37Rv
gcacgccaccgggacg

SEQ ID NO: 3256314 - RNA, 15 nt, Mycobacterium tuberculosis H37Rv
gcacgcccgccugca

SEQ ID NO: 3256315 - RNA, 12 nt, Mycobacterium tuberculosis H37Rv
gcacgcccggcg

SEQ ID NO: 3256316 - RNA, 19 nt, Mycobacterium tuberculosis H37Rv
gcacgcccucgucgaucgc

SEQ ID NO: 3256317 - RNA, 19 nt, Mycobacterium tuberculosis H37Rv
gcacgccgaccggcccgca

SEQ ID NO: 3256318 - RNA, 24 nt, Mycobacterium tuberculosis H37Rv
gcacgccgaccggcccgcauccgc

SEQ ID NO: 3256319 - RNA, 15 nt, Mycobacterium tuberculosis H37Rv
gcacgccgccgacgu

SEQ ID NO: 3256320 - RNA, 15 nt, Mycobacterium tuberculosis H37Rv
gcacgccgcgugccg

SEQ ID NO: 3256321 - RNA, 12 nt, Mycobacterium tuberculosis H37Rv
gcacgccggcau

SEQ ID NO: 3256322 - RNA, 14 nt, Mycobacterium tuberculosis H37Rv
gcacgccggcaugc

SEQ ID NO: 3256323 - RNA, 17 nt, Mycobacterium tuberculosis H37Rv
gcacgccggcaugccag

SEQ ID NO: 3256324 - RNA, 15 nt, Mycobacterium tuberculosis H37Rv
gcacgccggccagcg

SEQ ID NO: 3256325 - RNA, 16 nt, Mycobacterium tuberculosis H37Rv
gcacgccggccagcga

SEQ ID NO: 3256326 - RNA, 17 nt, Mycobacterium tuberculosis H37Rv
gcacgccggcgcuggag

SEQ ID NO: 3256327 - RNA, 12 nt, Mycobacterium tuberculosis H37Rv
gcacgccgggca

SEQ ID NO: 3256328 - RNA, 21 nt, Mycobacterium tuberculosis H37Rv
gcacgccgggugccgccacgu

SEQ ID NO: 3256329 - RNA, 14 nt, Mycobacterium tuberculosis H37Rv
gcacgccggugguc

SEQ ID NO: 3256330 - RNA, 22 nt, Mycobacterium tuberculosis H37Rv
gcacgccgguggucacgccgug

SEQ ID NO: 3256331 - RNA, 21 nt, Mycobacterium tuberculosis H37Rv
gcacgccguagcaucgggcga

SEQ ID NO: 3256332 - RNA, 22 nt, Mycobacterium tuberculosis H37Rv
gcacgccguagcaucgggcgag

SEQ ID NO: 3256333 - RNA, 17 nt, Mycobacterium tuberculosis H37Rv
gcacgccuacgaugacg

SEQ ID NO: 3256334 - RNA, 17 nt, Mycobacterium tuberculosis H37Rv
gcacgcgaggcgcucac

SEQ ID NO: 3256335 - RNA, 22 nt, Mycobacterium tuberculosis H37Rv
gcacgcgaggcgcucacccgcc

SEQ ID NO: 3256336 - RNA, 22 nt, Mycobacterium tuberculosis H37Rv
gcacgcggacaugacagccccg

SEQ ID NO: 3256337 - RNA, 18 nt, Mycobacterium tuberculosis H37Rv
gcacgcgggaagugcacc

SEQ ID NO: 3256338 - RNA, 19 nt, Mycobacterium tuberculosis H37Rv
gcacgcucgcgcacccugc

SEQ ID NO: 3256339 - RNA, 22 nt, Mycobacterium tuberculosis H37Rv
gcacgcucggugaaggucaccg

SEQ ID NO: 3256340 - RNA, 15 nt, Mycobacterium tuberculosis H37Rv
gcacgugcacggcga

SEQ ID NO: 3256341 - RNA, 16 nt, Mycobacterium tuberculosis H37Rv
gcacguggaccggcac

SEQ ID NO: 3256342 - RNA, 16 nt, Mycobacterium tuberculosis H37Rv
gcacguggccacggca

SEQ ID NO: 3256343 - RNA, 12 nt, Mycobacterium tuberculosis H37Rv
gcacguggcgac

SEQ ID NO: 3256344 - RNA, 13 nt, Mycobacterium tuberculosis H37Rv
gcacguggcgacc

SEQ ID NO: 3256345 - RNA, 16 nt, Mycobacterium tuberculosis H37Rv
gcacgugugcgggcac

SEQ ID NO: 3256346 - RNA, 17 nt, Mycobacterium tuberculosis H37Rv
gcacguucagccaggcg

SEQ ID NO: 3256347 - RNA, 21 nt, Mycobacterium tuberculosis H37Rv
gcacguucagccaggcgugca

SEQ ID NO: 3256348 - RNA, 17 nt, Mycobacterium tuberculosis H37Rv
gcacguugacguccaac

SEQ ID NO: 3256349 - RNA, 15 nt, Mycobacterium tuberculosis H37Rv
gcacguugauucggg

SEQ ID NO: 3256350 - RNA, 13 nt, Mycobacterium tuberculosis H37Rv
gcacguugccgaa

SEQ ID NO: 3256351 - RNA, 14 nt, Mycobacterium tuberculosis H37Rv
gcacguuggcggcc

SEQ ID NO: 3256352 - RNA, 15 nt, Mycobacterium tuberculosis H37Rv
gcacguugucgggcu

SEQ ID NO: 3256353 - RNA, 19 nt, Mycobacterium tuberculosis H37Rv
gcacguuguucagcccgcc

SEQ ID NO: 3256354 - RNA, 21 nt, Mycobacterium tuberculosis H37Rv
gcacuagcccgaccgguccag

SEQ ID NO: 3256355 - RNA, 17 nt, Mycobacterium tuberculosis H37Rv
gcacucaugaugccgga

SEQ ID NO: 3256356 - RNA, 19 nt, Mycobacterium tuberculosis H37Rv
gcacuccaagucacagcuc

SEQ ID NO: 3256357 - RNA, 17 nt, Mycobacterium tuberculosis H37Rv
gcacuccaccgcuggcc

SEQ ID NO: 3256358 - RNA, 13 nt, Mycobacterium tuberculosis H37Rv
gcacuccagcggc

SEQ ID NO: 3256359 - RNA, 16 nt, Mycobacterium tuberculosis H37Rv
gcacuccagcggcggg

SEQ ID NO: 3256360 - RNA, 20 nt, Mycobacterium tuberculosis H37Rv
gcacuccagcggcgggggcg

SEQ ID NO: 3256361 - RNA, 20 nt, Mycobacterium tuberculosis H37Rv
gcacucccggcucggccagc

SEQ ID NO: 3256362 - RNA, 21 nt, Mycobacterium tuberculosis H37Rv
gcacucccugguucggcgaug

SEQ ID NO: 3256363 - RNA, 22 nt, Mycobacterium tuberculosis H37Rv
gcacuccgggcucggcgucgcc

SEQ ID NO: 3256364 - RNA, 16 nt, Mycobacterium tuberculosis H37Rv
gcacucgaugcggugc

SEQ ID NO: 3256365 - RNA, 21 nt, Mycobacterium tuberculosis H37Rv
gcacucgcccaagcgcagccu

SEQ ID NO: 3256366 - RNA, 17 nt, Mycobacterium tuberculosis H37Rv
gcacucggcgguuccgg

SEQ ID NO: 3256367 - RNA, 15 nt, Mycobacterium tuberculosis H37Rv
gcacucgggauucgg

SEQ ID NO: 3256368 - RNA, 19 nt, Mycobacterium tuberculosis H37Rv
gcacucggggcugucggcg

SEQ ID NO: 3256369 - RNA, 16 nt, Mycobacterium tuberculosis H37Rv
gcacucgguaaccgcg

SEQ ID NO: 3256370 - RNA, 19 nt, Mycobacterium tuberculosis H37Rv
gcacucguagaacgucugg

SEQ ID NO: 3256371 - RNA, 21 nt, Mycobacterium tuberculosis H37Rv
gcacucguugccgaccaugca

SEQ ID NO: 3256372 - RNA, 13 nt, Mycobacterium tuberculosis H37Rv
gcacugaaauggc

SEQ ID NO: 3256373 - RNA, 13 nt, Mycobacterium tuberculosis H37Rv
gcacugaacgucg

SEQ ID NO: 3256374 - RNA, 16 nt, Mycobacterium tuberculosis H37Rv
gcacugaccgcggcug

SEQ ID NO: 3256375 - RNA, 22 nt, Mycobacterium tuberculosis H37Rv
gcacugaucugcguugcggcaa

SEQ ID NO: 3256376 - RNA, 13 nt, Mycobacterium tuberculosis H37Rv
gcacugcccagca

SEQ ID NO: 3256377 - RNA, 18 nt, Mycobacterium tuberculosis H37Rv
gcacugcccagcagacca

SEQ ID NO: 3256378 - RNA, 16 nt, Mycobacterium tuberculosis H37Rv
gcacugccccgcaucg

SEQ ID NO: 3256379 - RNA, 15 nt, Mycobacterium tuberculosis H37Rv
gcacugccgcggacg

SEQ ID NO: 3256380 - RNA, 18 nt, Mycobacterium tuberculosis H37Rv
gcacugcgccggccgcag

SEQ ID NO: 3256381 - RNA, 15 nt, Mycobacterium tuberculosis H37Rv
gcacugcggcagcga

SEQ ID NO: 3256382 - RNA, 20 nt, Mycobacterium tuberculosis H37Rv
gcacugcugguugaugaagg

SEQ ID NO: 3256383 - RNA, 22 nt, Mycobacterium tuberculosis H37Rv
gcacuggcccccacaccacgcu

SEQ ID NO: 3256384 - RNA, 23 nt, Mycobacterium tuberculosis H37Rv
gcacugggaugaguucgucgugg

SEQ ID NO: 3256385 - RNA, 15 nt, Mycobacterium tuberculosis H37Rv
gcacuggggaggcca

SEQ ID NO: 3256386 - RNA, 23 nt, Mycobacterium tuberculosis H37Rv
gcacugggugcgucgacccagcu

SEQ ID NO: 3256387 - RNA, 22 nt, Mycobacterium tuberculosis H37Rv
gcacuggugcccgacccgccga

SEQ ID NO: 3256388 - RNA, 21 nt, Mycobacterium tuberculosis H37Rv
gcacugguugggcgagaccgc

SEQ ID NO: 3256389 - RNA, 23 nt, Mycobacterium tuberculosis H37Rv
gcacugucgagguggucgacccg

SEQ ID NO: 3256390 - RNA, 20 nt, Mycobacterium tuberculosis H37Rv
gcacugugaggucauuggcg

SEQ ID NO: 3256391 - RNA, 16 nt, Mycobacterium tuberculosis H37Rv
gcacuguggaagaacc

SEQ ID NO: 3256392 - RNA, 20 nt, Mycobacterium tuberculosis H37Rv
gcacuguugcguagcgcgcu

SEQ ID NO: 3256393 - RNA, 13 nt, Mycobacterium tuberculosis H37Rv
gcacuucagcuuc

SEQ ID NO: 3256394 - RNA, 14 nt, Mycobacterium tuberculosis H37Rv
gcacuucagcuucg

SEQ ID NO: 3256395 - RNA, 17 nt, Mycobacterium tuberculosis H37Rv
gcacuuccagcccggca

SEQ ID NO: 3256396 - RNA, 16 nt, Mycobacterium tuberculosis H37Rv
gcacuugaucgacggc

SEQ ID NO: 3256397 - RNA, 15 nt, Mycobacterium tuberculosis H37Rv
gcacuugcguggcgu

SEQ ID NO: 3256398 - RNA, 18 nt, Mycobacterium tuberculosis H37Rv
gcacuuggcccccgacgg

SEQ ID NO: 3256399 - RNA, 20 nt, Mycobacterium tuberculosis H37Rv
gcacuuuugcgugguggacg

SEQ ID NO: 3256400 - RNA, 21 nt, Mycobacterium tuberculosis H37Rv
gcagaaacaacgucgccgcgg

SEQ ID NO: 3256401 - RNA, 14 nt, Mycobacterium tuberculosis H37Rv
gcagaaacaucgac

SEQ ID NO: 3256402 - RNA, 22 nt, Mycobacterium tuberculosis H37Rv
gcagaaacaucgacagcaucac

SEQ ID NO: 3256403 - RNA, 16 nt, Mycobacterium tuberculosis H37Rv
gcagaaaccauucggc

SEQ ID NO: 3256404 - RNA, 19 nt, Mycobacterium tuberculosis H37Rv
gcagaaaccauucggcgag

SEQ ID NO: 3256405 - RNA, 22 nt, Mycobacterium tuberculosis H37Rv
gcagaaccgccaacauugguga

SEQ ID NO: 3256406 - RNA, 18 nt, Mycobacterium tuberculosis H37Rv
gcagaacggaccucggcg

SEQ ID NO: 3256407 - RNA, 18 nt, Mycobacterium tuberculosis H37Rv
gcagaacucgcguauccc

SEQ ID NO: 3256408 - RNA, 15 nt, Mycobacterium tuberculosis H37Rv
gcagaagaguguccc

SEQ ID NO: 3256409 - RNA, 14 nt, Mycobacterium tuberculosis H37Rv
gcagaaggccgcgg

SEQ ID NO: 3256410 - RNA, 19 nt, Mycobacterium tuberculosis H37Rv
gcagaaguccucggcggac

SEQ ID NO: 3256411 - RNA, 18 nt, Mycobacterium tuberculosis H37Rv
gcagaauccguucgacga

SEQ ID NO: 3256412 - RNA, 15 nt, Mycobacterium tuberculosis H37Rv
gcagaauccugcgcu

SEQ ID NO: 3256413 - RNA, 19 nt, Mycobacterium tuberculosis H37Rv
gcagaauccugcgcugcac

SEQ ID NO: 3256414 - RNA, 22 nt, Mycobacterium tuberculosis H37Rv
gcagaaucgcauugggcgggcu

SEQ ID NO: 3256415 - RNA, 12 nt, Mycobacterium tuberculosis H37Rv
gcagaaucgccu

SEQ ID NO: 3256416 - RNA, 13 nt, Mycobacterium tuberculosis H37Rv
gcagaaucggugg

SEQ ID NO: 3256417 - RNA, 23 nt, Mycobacterium tuberculosis H37Rv
gcagaaugucguaggcgccguug

SEQ ID NO: 3256418 - RNA, 18 nt, Mycobacterium tuberculosis H37Rv
gcagacacgagucgccag

SEQ ID NO: 3256419 - RNA, 14 nt, Mycobacterium tuberculosis H37Rv
gcagacacugcugc

SEQ ID NO: 3256420 - RNA, 15 nt, Mycobacterium tuberculosis H37Rv
gcagacacugcugcg

SEQ ID NO: 3256421 - RNA, 16 nt, Mycobacterium tuberculosis H37Rv
gcagacaggcggcggc

SEQ ID NO: 3256422 - RNA, 20 nt, Mycobacterium tuberculosis H37Rv
gcagaccaagcccgucgucg

SEQ ID NO: 3256423 - RNA, 15 nt, Mycobacterium tuberculosis H37Rv
gcagaccaaguccgg

SEQ ID NO: 3256424 - RNA, 22 nt, Mycobacterium tuberculosis H37Rv
gcagaccacaacgccucgccau

SEQ ID NO: 3256425 - RNA, 14 nt, Mycobacterium tuberculosis H37Rv
gcagaccaugguca

SEQ ID NO: 3256426 - RNA, 15 nt, Mycobacterium tuberculosis H37Rv
gcagacccgggccag

SEQ ID NO: 3256427 - RNA, 17 nt, Mycobacterium tuberculosis H37Rv
gcagacccucgucgucg

SEQ ID NO: 3256428 - RNA, 18 nt, Mycobacterium tuberculosis H37Rv
gcagacccucgucgucga

SEQ ID NO: 3256429 - RNA, 18 nt, Mycobacterium tuberculosis H37Rv
gcagaccggugagcaccg

SEQ ID NO: 3256430 - RNA, 19 nt, Mycobacterium tuberculosis H37Rv
gcagaccggugagcaccgg

SEQ ID NO: 3256431 - RNA, 18 nt, Mycobacterium tuberculosis H37Rv
gcagaccugcaucacaag

SEQ ID NO: 3256432 - RNA, 17 nt, Mycobacterium tuberculosis H37Rv
gcagacgaaguagccga

SEQ ID NO: 3256433 - RNA, 20 nt, Mycobacterium tuberculosis H37Rv
gcagacgaaguagccgacca

SEQ ID NO: 3256434 - RNA, 15 nt, Mycobacterium tuberculosis H37Rv
gcagacgcaaaagcc

SEQ ID NO: 3256435 - RNA, 19 nt, Mycobacterium tuberculosis H37Rv
gcagacgcaaaagcccccu

SEQ ID NO: 3256436 - RNA, 19 nt, Mycobacterium tuberculosis H37Rv
gcagcagcgggcuggcgaa

SEQ ID NO: 3256437 - RNA, 17 nt, Mycobacterium tuberculosis H37Rv
gcagcagcgugaccacc

SEQ ID NO: 3256438 - RNA, 18 nt, Mycobacterium tuberculosis H37Rv
gcagcagcgugaccaccg

SEQ ID NO: 3256439 - RNA, 23 nt, Mycobacterium tuberculosis H37Rv
gcagcagcuggucgugggccacc

SEQ ID NO: 3256440 - RNA, 14 nt, Mycobacterium tuberculosis H37Rv
gcagcagcuugacc

SEQ ID NO: 3256441 - RNA, 20 nt, Mycobacterium tuberculosis H37Rv
gcagcaggaaguagccgagc

SEQ ID NO: 3256442 - RNA, 24 nt, Mycobacterium tuberculosis H37Rv
gcagcaggggacgaccaugccgau

SEQ ID NO: 3256443 - RNA, 22 nt, Mycobacterium tuberculosis H37Rv
gcagcaggucgaugcugccagc

SEQ ID NO: 3256444 - RNA, 12 nt, Mycobacterium tuberculosis H37Rv
gcagcaggugag

SEQ ID NO: 3256445 - RNA, 16 nt, Mycobacterium tuberculosis H37Rv
gcagcaggugagccag

SEQ ID NO: 3256446 - RNA, 15 nt, Mycobacterium tuberculosis H37Rv
gcagcaguuggucgc

SEQ ID NO: 3256447 - RNA, 15 nt, Mycobacterium tuberculosis H37Rv
gcagcaucgccagca

SEQ ID NO: 3256448 - RNA, 18 nt, Mycobacterium tuberculosis H37Rv
gcagcaucgccagcagga

SEQ ID NO: 3256449 - RNA, 19 nt, Mycobacterium tuberculosis H37Rv
gcagcaucggcaccccggc

SEQ ID NO: 3256450 - RNA, 23 nt, Mycobacterium tuberculosis H37Rv
gcagcaucggcacgucguugggc

SEQ ID NO: 3256451 - RNA, 13 nt, Mycobacterium tuberculosis H37Rv
gcagcaucggcga

SEQ ID NO: 3256452 - RNA, 15 nt, Mycobacterium tuberculosis H37Rv
gcagcaucgucgcca

SEQ ID NO: 3256453 - RNA, 16 nt, Mycobacterium tuberculosis H37Rv
gcagcaucgucgccac

SEQ ID NO: 3256454 - RNA, 18 nt, Mycobacterium tuberculosis H37Rv
gcagcaucgucgccacga

SEQ ID NO: 3256455 - RNA, 15 nt, Mycobacterium tuberculosis H37Rv
gcagcaucuccgccg

SEQ ID NO: 3256456 - RNA, 21 nt, Mycobacterium tuberculosis H37Rv
gcagcaucuccgucggccagg

SEQ ID NO: 3256457 - RNA, 22 nt, Mycobacterium tuberculosis H37Rv
gcagcaucuccgucggccaggc

SEQ ID NO: 3256458 - RNA, 22 nt, Mycobacterium tuberculosis H37Rv
gcagcauguccgcagcggugcg

SEQ ID NO: 3256459 - RNA, 20 nt, Mycobacterium tuberculosis H37Rv
gcagcaugucguaguagcgg

SEQ ID NO: 3256460 - RNA, 18 nt, Mycobacterium tuberculosis H37Rv
gcagccaagcgagcggcg

SEQ ID NO: 3256461 - RNA, 19 nt, Mycobacterium tuberculosis H37Rv
gcagccaaguccgcccgcc

SEQ ID NO: 3256462 - RNA, 21 nt, Mycobacterium tuberculosis H37Rv
gcagccaaguccgcccgccga

SEQ ID NO: 3256463 - RNA, 15 nt, Mycobacterium tuberculosis H37Rv
gcagccaaugccgga

SEQ ID NO: 3256464 - RNA, 19 nt, Mycobacterium tuberculosis H37Rv
gcagccacauacaggcccg

SEQ ID NO: 3256465 - RNA, 21 nt, Mycobacterium tuberculosis H37Rv
gcagccacauacaggcccgcc

SEQ ID NO: 3256466 - RNA, 15 nt, Mycobacterium tuberculosis H37Rv
gcagccaccagcgac

SEQ ID NO: 3256467 - RNA, 19 nt, Mycobacterium tuberculosis H37Rv
gcagccaccagcgacgacc

SEQ ID NO: 3256468 - RNA, 21 nt, Mycobacterium tuberculosis H37Rv
gcagccaccagcgacgaccac

SEQ ID NO: 3256469 - RNA, 13 nt, Mycobacterium tuberculosis H37Rv
gcagccacccgac

SEQ ID NO: 3256470 - RNA, 14 nt, Mycobacterium tuberculosis H37Rv
gcagccacccgaca

SEQ ID NO: 3256471 - RNA, 13 nt, Mycobacterium tuberculosis H37Rv
gcagccaccguca

SEQ ID NO: 3256472 - RNA, 15 nt, Mycobacterium tuberculosis H37Rv
gcagccacgauccuu

SEQ ID NO: 3256473 - RNA, 15 nt, Mycobacterium tuberculosis H37Rv
gcagccacgcgggcg

SEQ ID NO: 3256474 - RNA, 19 nt, Mycobacterium tuberculosis H37Rv
gcagccacgcgggcgcggu

SEQ ID NO: 3256475 - RNA, 19 nt, Mycobacterium tuberculosis H37Rv
gcagccacguuacgcucgc

SEQ ID NO: 3256476 - RNA, 16 nt, Mycobacterium tuberculosis H37Rv
gcagccagaucuccag

SEQ ID NO: 3256477 - RNA, 22 nt, Mycobacterium tuberculosis H37Rv
gcagccagaucuccccgaccgc

SEQ ID NO: 3256478 - RNA, 12 nt, Mycobacterium tuberculosis H37Rv
gcagccagcaag

SEQ ID NO: 3256479 - RNA, 14 nt, Mycobacterium tuberculosis H37Rv
gcagccagcccagc

SEQ ID NO: 3256480 - RNA, 15 nt, Mycobacterium tuberculosis H37Rv
gcagccagcgccaug

SEQ ID NO: 3256481 - RNA, 16 nt, Mycobacterium tuberculosis H37Rv
gcagccagcggcgaag

SEQ ID NO: 3256482 - RNA, 17 nt, Mycobacterium tuberculosis H37Rv
gcagccagcugaacacg

SEQ ID NO: 3256483 - RNA, 18 nt, Mycobacterium tuberculosis H37Rv
gcagccagcugaacacga

SEQ ID NO: 3256484 - RNA, 13 nt, Mycobacterium tuberculosis H37Rv
gcagccaggcacg

SEQ ID NO: 3256485 - RNA, 14 nt, Mycobacterium tuberculosis H37Rv
gcagccaggcugcg

SEQ ID NO: 3256486 - RNA, 15 nt, Mycobacterium tuberculosis H37Rv
gcagccagggcgccg

SEQ ID NO: 3256487 - RNA, 16 nt, Mycobacterium tuberculosis H37Rv
gcagccagggcgccga

SEQ ID NO: 3256488 - RNA, 16 nt, Mycobacterium tuberculosis H37Rv
gcagccaugcggcugc

SEQ ID NO: 3256489 - RNA, 22 nt, Mycobacterium tuberculosis H37Rv
gcagcccaaagcgccagcagcc

SEQ ID NO: 3256490 - RNA, 21 nt, Mycobacterium tuberculosis H37Rv
gcagcccaaaucccagagcau

SEQ ID NO: 3256491 - RNA, 20 nt, Mycobacterium tuberculosis H37Rv
gcagcccaaggcgacgaauc

SEQ ID NO: 3256492 - RNA, 22 nt, Mycobacterium tuberculosis H37Rv
gcagcccauuucgagcucgaag

SEQ ID NO: 3256493 - RNA, 23 nt, Mycobacterium tuberculosis H37Rv
gcagccccaaaucguaggggucu

SEQ ID NO: 3256494 - RNA, 16 nt, Mycobacterium tuberculosis H37Rv
gcagccccuccgcgcc

SEQ ID NO: 3256495 - RNA, 18 nt, Mycobacterium tuberculosis H37Rv
gcagcccgacaguggucc

SEQ ID NO: 3256496 - RNA, 15 nt, Mycobacterium tuberculosis H37Rv
gcagcccgcccugac

SEQ ID NO: 3256497 - RNA, 16 nt, Mycobacterium tuberculosis H37Rv
gcagcccgccgcugaa

SEQ ID NO: 3256498 - RNA, 13 nt, Mycobacterium tuberculosis H37Rv
gcagcccggcggc

SEQ ID NO: 3256499 - RNA, 14 nt, Mycobacterium tuberculosis H37Rv
gcagcccgggcagc

SEQ ID NO: 3256500 - RNA, 15 nt, Mycobacterium tuberculosis H37Rv
gcagcccgggcagca

SEQ ID NO: 3256501 - RNA, 16 nt, Mycobacterium tuberculosis H37Rv
gcagcccgggcagccc

SEQ ID NO: 3256502 - RNA, 20 nt, Mycobacterium tuberculosis H37Rv
gcagcccgggcagccccucc

SEQ ID NO: 3256503 - RNA, 13 nt, Mycobacterium tuberculosis H37Rv
gcagcccggggau

SEQ ID NO: 3256504 - RNA, 19 nt, Mycobacterium tuberculosis H37Rv
gcagcccgguggugcuguc

SEQ ID NO: 3256505 - RNA, 23 nt, Mycobacterium tuberculosis H37Rv
gcagcccgguggugcugucgugg

SEQ ID NO: 3256506 - RNA, 16 nt, Mycobacterium tuberculosis H37Rv
gcagcccggugugcug

SEQ ID NO: 3256507 - RNA, 17 nt, Mycobacterium tuberculosis H37Rv
gcagcccgucggcgccg

SEQ ID NO: 3256508 - RNA, 19 nt, Mycobacterium tuberculosis H37Rv
gcagcccgugacuggugaa

SEQ ID NO: 3256509 - RNA, 18 nt, Mycobacterium tuberculosis H37Rv
gcagcccugcgcagccgc

SEQ ID NO: 3256510 - RNA, 12 nt, Mycobacterium tuberculosis H37Rv
gcagccgaaccg

SEQ ID NO: 3256511 - RNA, 14 nt, Mycobacterium tuberculosis H37Rv
gcagccgaaccggc

SEQ ID NO: 3256512 - RNA, 14 nt, Mycobacterium tuberculosis H37Rv
gcagccgcagccgg

SEQ ID NO: 3256513 - RNA, 19 nt, Mycobacterium tuberculosis H37Rv
gcagccgcauaggccccgc

SEQ ID NO: 3256514 - RNA, 10 nt, Mycobacterium tuberculosis H37Rv
gcagccgccc

SEQ ID NO: 3256515 - RNA, 17 nt, Mycobacterium tuberculosis H37Rv
gcagccgcccgccagga

SEQ ID NO: 3256516 - RNA, 18 nt, Mycobacterium tuberculosis H37Rv
gcagccgcccgccaggaa

SEQ ID NO: 3256517 - RNA, 16 nt, Mycobacterium tuberculosis H37Rv
gcagccgcccgcccac

SEQ ID NO: 3256518 - RNA, 19 nt, Mycobacterium tuberculosis H37Rv
gcagccgcccgcccaccuc

SEQ ID NO: 3256519 - RNA, 21 nt, Mycobacterium tuberculosis H37Rv
gcagccgcccgcccaccucga

SEQ ID NO: 3256520 - RNA, 23 nt, Mycobacterium tuberculosis H37Rv
gcagccgcccgcccaccucgauc

SEQ ID NO: 3256521 - RNA, 20 nt, Mycobacterium tuberculosis H37Rv
gcagccgccucaaugaccac

SEQ ID NO: 3256522 - RNA, 13 nt, Mycobacterium tuberculosis H37Rv
gcagccgcgcggu

SEQ ID NO: 3256523 - RNA, 21 nt, Mycobacterium tuberculosis H37Rv
gcagccgcgcgguacugcgca

SEQ ID NO: 3256524 - RNA, 22 nt, Mycobacterium tuberculosis H37Rv
gcagccgcgcggugauggucac

SEQ ID NO: 3256525 - RNA, 21 nt, Mycobacterium tuberculosis H37Rv
gcagccgcucgacggcccgcc

SEQ ID NO: 3256526 - RNA, 13 nt, Mycobacterium tuberculosis H37Rv
gcagccggcgggc

SEQ ID NO: 3256527 - RNA, 14 nt, Mycobacterium tuberculosis H37Rv
gcagccggcgggcc

SEQ ID NO: 3256528 - RNA, 11 nt, Mycobacterium tuberculosis H37Rv
gcagccgggca

SEQ ID NO: 3256529 - RNA, 17 nt, Mycobacterium tuberculosis H37Rv
gcagccgggcaccaccc

SEQ ID NO: 3256530 - RNA, 14 nt, Mycobacterium tuberculosis H37Rv
gcagccgggcgucg

SEQ ID NO: 3256531 - RNA, 18 nt, Mycobacterium tuberculosis H37Rv
gcagccgggcgucgcugg

SEQ ID NO: 3256532 - RNA, 20 nt, Mycobacterium tuberculosis H37Rv
gcagcgugaaaugcacgauc

SEQ ID NO: 3256533 - RNA, 14 nt, Mycobacterium tuberculosis H37Rv
gcagcgugagugca

SEQ ID NO: 3256534 - RNA, 21 nt, Mycobacterium tuberculosis H37Rv
gcagcgugcacacccgcaaug

SEQ ID NO: 3256535 - RNA, 18 nt, Mycobacterium tuberculosis H37Rv
gcagcgugcagcggcggg

SEQ ID NO: 3256536 - RNA, 19 nt, Mycobacterium tuberculosis H37Rv
gcagcgugggcagcgcgau

SEQ ID NO: 3256537 - RNA, 22 nt, Mycobacterium tuberculosis H37Rv
gcagcgugugcucgugggcgac

SEQ ID NO: 3256538 - RNA, 15 nt, Mycobacterium tuberculosis H37Rv
gcagcguugacgguc

SEQ ID NO: 3256539 - RNA, 20 nt, Mycobacterium tuberculosis H37Rv
gcagcguuggccgcugucgu

SEQ ID NO: 3256540 - RNA, 22 nt, Mycobacterium tuberculosis H37Rv
gcagcuacggggcggucgagcc

SEQ ID NO: 3256541 - RNA, 18 nt, Mycobacterium tuberculosis H37Rv
gcagcuagcccucagcua

SEQ ID NO: 3256542 - RNA, 16 nt, Mycobacterium tuberculosis H37Rv
gcagcuauuucgcgac

SEQ ID NO: 3256543 - RNA, 21 nt, Mycobacterium tuberculosis H37Rv
gcagcucaccgacggagaucg

SEQ ID NO: 3256544 - RNA, 13 nt, Mycobacterium tuberculosis H37Rv
gcagcucaucgcg

SEQ ID NO: 3256545 - RNA, 16 nt, Mycobacterium tuberculosis H37Rv
gcagcucaucgcgcac

SEQ ID NO: 3256546 - RNA, 14 nt, Mycobacterium tuberculosis H37Rv
gcagcuccaccagg

SEQ ID NO: 3256547 - RNA, 15 nt, Mycobacterium tuberculosis H37Rv
gcagcuccaccagga

SEQ ID NO: 3256548 - RNA, 18 nt, Mycobacterium tuberculosis H37Rv
gcagcuccccgaccgaac

SEQ ID NO: 3256549 - RNA, 20 nt, Mycobacterium tuberculosis H37Rv
gcagcuccccgaccgaaccg

SEQ ID NO: 3256550 - RNA, 15 nt, Mycobacterium tuberculosis H37Rv
gcagcucgaccagga

SEQ ID NO: 3256551 - RNA, 16 nt, Mycobacterium tuberculosis H37Rv
gcagcucgccggcacg

SEQ ID NO: 3256552 - RNA, 17 nt, Mycobacterium tuberculosis H37Rv
gcagcucggccgaggcg

SEQ ID NO: 3256553 - RNA, 12 nt, Mycobacterium tuberculosis H37Rv
gcagcucgguca

SEQ ID NO: 3256554 - RNA, 22 nt, Mycobacterium tuberculosis H37Rv
gcagcucggugacaagcggccc

SEQ ID NO: 3256555 - RNA, 16 nt, Mycobacterium tuberculosis H37Rv
gcagcugaaucgggau

SEQ ID NO: 3256556 - RNA, 10 nt, Mycobacterium tuberculosis H37Rv
gcagcugacg

SEQ ID NO: 3256557 - RNA, 15 nt, Mycobacterium tuberculosis H37Rv
gcagcugacgucacc

SEQ ID NO: 3256558 - RNA, 19 nt, Mycobacterium tuberculosis H37Rv
gcagcugacgucaccacga

SEQ ID NO: 3256559 - RNA, 12 nt, Mycobacterium tuberculosis H37Rv
gcagcugagccg

SEQ ID NO: 3256560 - RNA, 14 nt, Mycobacterium tuberculosis H37Rv
gcagcugcccggcg

SEQ ID NO: 3256561 - RNA, 17 nt, Mycobacterium tuberculosis H37Rv
gcagcugccgcaccccc

SEQ ID NO: 3256562 - RNA, 19 nt, Mycobacterium tuberculosis H37Rv
gcagcugccgcacccccuc

SEQ ID NO: 3256563 - RNA, 19 nt, Mycobacterium tuberculosis H37Rv
gcagcugcgauauggucac

SEQ ID NO: 3256564 - RNA, 22 nt, Mycobacterium tuberculosis H37Rv
gcagcugcgucccggaaaaagu

SEQ ID NO: 3256565 - RNA, 14 nt, Mycobacterium tuberculosis H37Rv
gcagcugcuccagu

SEQ ID NO: 3256566 - RNA, 14 nt, Mycobacterium tuberculosis H37Rv
gcagcugcucgguc

SEQ ID NO: 3256567 - RNA, 22 nt, Mycobacterium tuberculosis H37Rv
gcagcugcucggucaggcggcu

SEQ ID NO: 3256568 - RNA, 12 nt, Mycobacterium tuberculosis H37Rv
gcagcuggcgac

SEQ ID NO: 3256569 - RNA, 18 nt, Mycobacterium tuberculosis H37Rv
gcagcuggcgcagccugc

SEQ ID NO: 3256570 - RNA, 14 nt, Mycobacterium tuberculosis H37Rv
gcagcugggcagga

SEQ ID NO: 3256571 - RNA, 17 nt, Mycobacterium tuberculosis H37Rv
gcagcugggcaucaccg

SEQ ID NO: 3256572 - RNA, 17 nt, Mycobacterium tuberculosis H37Rv
gcagcuggggcccggcc

SEQ ID NO: 3256573 - RNA, 21 nt, Mycobacterium tuberculosis H37Rv
gcagcugggugcgccauugcg

SEQ ID NO: 3256574 - RNA, 23 nt, Mycobacterium tuberculosis H37Rv
gcagcugguaggucaccggucac

SEQ ID NO: 3256575 - RNA, 22 nt, Mycobacterium tuberculosis H37Rv
gcagcuggucgugggccaccac

SEQ ID NO: 3256576 - RNA, 16 nt, Mycobacterium tuberculosis H37Rv
gcagcuguaauuccuc

SEQ ID NO: 3256577 - RNA, 16 nt, Mycobacterium tuberculosis H37Rv
gcagcuuagucagggc

SEQ ID NO: 3256578 - RNA, 12 nt, Mycobacterium tuberculosis H37Rv
gcagcuucucgc

SEQ ID NO: 3256579 - RNA, 18 nt, Mycobacterium tuberculosis H37Rv
gcagcuugccaaucaccg

SEQ ID NO: 3256580 - RNA, 19 nt, Mycobacterium tuberculosis H37Rv
gcagcuugccaaucaccgu

SEQ ID NO: 3256581 - RNA, 17 nt, Mycobacterium tuberculosis H37Rv
gcagcuuggccucagcc

SEQ ID NO: 3256582 - RNA, 15 nt, Mycobacterium tuberculosis H37Rv
gcagcuugguggcgu

SEQ ID NO: 3256583 - RNA, 21 nt, Mycobacterium tuberculosis H37Rv
gcagcuugguggcguggcccu

SEQ ID NO: 3256584 - RNA, 19 nt, Mycobacterium tuberculosis H37Rv
gcagcuuguuuuccaccag

SEQ ID NO: 3256585 - RNA, 23 nt, Mycobacterium tuberculosis H37Rv
gcagcuuugacgcccucggcgac

SEQ ID NO: 3256586 - RNA, 20 nt, Mycobacterium tuberculosis H37Rv
gcaggaaaaccccggccacc

SEQ ID NO: 3256587 - RNA, 21 nt, Mycobacterium tuberculosis H37Rv
gcaggaaaucguccuuggaca

SEQ ID NO: 3256588 - RNA, 14 nt, Mycobacterium tuberculosis H37Rv
gcaggaacacccau

SEQ ID NO: 3256589 - RNA, 22 nt, Mycobacterium tuberculosis H37Rv
gcaggaagaaaccgcagucgcg

SEQ ID NO: 3256590 - RNA, 20 nt, Mycobacterium tuberculosis H37Rv
gcaggaaggcuucggugacc

SEQ ID NO: 3256591 - RNA, 16 nt, Mycobacterium tuberculosis H37Rv
gcaggaaucgggucag

SEQ ID NO: 3256592 - RNA, 21 nt, Mycobacterium tuberculosis H37Rv
gcaggaaucgggucagcacca

SEQ ID NO: 3256593 - RNA, 12 nt, Mycobacterium tuberculosis H37Rv
gcaggaccagca

SEQ ID NO: 3256594 - RNA, 20 nt, Mycobacterium tuberculosis H37Rv
gcaggacgaugaugaucacc

SEQ ID NO: 3256595 - RNA, 18 nt, Mycobacterium tuberculosis H37Rv
gcaggacgcccacaugcu

SEQ ID NO: 3256596 - RNA, 12 nt, Mycobacterium tuberculosis H37Rv
gcaggacgcugc

SEQ ID NO: 3256597 - RNA, 20 nt, Mycobacterium tuberculosis H37Rv
gcaggagcagcacgucgaac

SEQ ID NO: 3256598 - RNA, 17 nt, Mycobacterium tuberculosis H37Rv
gcaggauaccgaaauca

SEQ ID NO: 3256599 - RNA, 19 nt, Mycobacterium tuberculosis H37Rv
gcaggaucgaguugcggug

SEQ ID NO: 3256600 - RNA, 19 nt, Mycobacterium tuberculosis H37Rv
gcaggaucgccugagcgcc

SEQ ID NO: 3256601 - RNA, 21 nt, Mycobacterium tuberculosis H37Rv
gcaggaucggcuugggaaacc

SEQ ID NO: 3256602 - RNA, 16 nt, Mycobacterium tuberculosis H37Rv
gcaggaucuccggguc

SEQ ID NO: 3256603 - RNA, 18 nt, Mycobacterium tuberculosis H37Rv
gcaggaucuccgggucga

SEQ ID NO: 3256604 - RNA, 17 nt, Mycobacterium tuberculosis H37Rv
gcaggaugaugaccgcc

SEQ ID NO: 3256605 - RNA, 18 nt, Mycobacterium tuberculosis H37Rv
gcaggauucggcggucgc

SEQ ID NO: 3256606 - RNA, 15 nt, Mycobacterium tuberculosis H37Rv
gcaggcacaucgcga

SEQ ID NO: 3256607 - RNA, 16 nt, Mycobacterium tuberculosis H37Rv
gcaggcaccccgauca

SEQ ID NO: 3256608 - RNA, 20 nt, Mycobacterium tuberculosis H37Rv
gcaggcaccccgaucacccg

SEQ ID NO: 3256609 - RNA, 10 nt, Mycobacterium tuberculosis H37Rv
gcaggcaggu

SEQ ID NO: 3256610 - RNA, 19 nt, Mycobacterium tuberculosis H37Rv
gcaggcagguuggccaccg

SEQ ID NO: 3256611 - RNA, 22 nt, Mycobacterium tuberculosis H37Rv
gcaggcagguuggccaccgccc

SEQ ID NO: 3256612 - RNA, 23 nt, Mycobacterium tuberculosis H37Rv
gcaggcagguuggccaccgccca

SEQ ID NO: 3256613 - RNA, 18 nt, Mycobacterium tuberculosis H37Rv
gcaggcauggcgccguug

SEQ ID NO: 3256614 - RNA, 17 nt, Mycobacterium tuberculosis H37Rv
gcaggcauucccgcggc

SEQ ID NO: 3256615 - RNA, 23 nt, Mycobacterium tuberculosis H37Rv
gcaggccagggucagcucgguga

SEQ ID NO: 3256616 - RNA, 17 nt, Mycobacterium tuberculosis H37Rv
gcaggcccacccgggcg

SEQ ID NO: 3256617 - RNA, 18 nt, Mycobacterium tuberculosis H37Rv
gcaggccccacuggugca

SEQ ID NO: 3256618 - RNA, 19 nt, Mycobacterium tuberculosis H37Rv
gcaggccccacuggugcag

SEQ ID NO: 3256619 - RNA, 18 nt, Mycobacterium tuberculosis H37Rv
gcaggcccgacggcgccc

SEQ ID NO: 3256620 - RNA, 22 nt, Mycobacterium tuberculosis H37Rv
gcaggcccuggccacccagaau

SEQ ID NO: 3256621 - RNA, 14 nt, Mycobacterium tuberculosis H37Rv
gcaggccgcguucg

SEQ ID NO: 3256622 - RNA, 17 nt, Mycobacterium tuberculosis H37Rv
gcaggccgcguucgugg

SEQ ID NO: 3256623 - RNA, 16 nt, Mycobacterium tuberculosis H37Rv
gcaggccgcugggccg

SEQ ID NO: 3256624 - RNA, 15 nt, Mycobacterium tuberculosis H37Rv
gcaggccgggcacca

SEQ ID NO: 3256625 - RNA, 21 nt, Mycobacterium tuberculosis H37Rv
gcaggccgguuugcacgcacc

SEQ ID NO: 3256626 - RNA, 15 nt, Mycobacterium tuberculosis H37Rv
gcaggccuccaagcc

SEQ ID NO: 3256627 - RNA, 19 nt, Mycobacterium tuberculosis H37Rv
gcaggccuccaagcccgcc

SEQ ID NO: 3256628 - RNA, 14 nt, Mycobacterium tuberculosis H37Rv
gcaguagccgacca

SEQ ID NO: 3256629 - RNA, 17 nt, Mycobacterium tuberculosis H37Rv
gcaguagccgaccagga

SEQ ID NO: 3256630 - RNA, 13 nt, Mycobacterium tuberculosis H37Rv
gcaguagcugcuc

SEQ ID NO: 3256631 - RNA, 22 nt, Mycobacterium tuberculosis H37Rv
gcaguagcugcucaucgcgccc

SEQ ID NO: 3256632 - RNA, 20 nt, Mycobacterium tuberculosis H37Rv
gcaguagugaucgaucgcgg

SEQ ID NO: 3256633 - RNA, 21 nt, Mycobacterium tuberculosis H37Rv
gcaguauucacagucgcucgc

SEQ ID NO: 3256634 - RNA, 21 nt, Mycobacterium tuberculosis H37Rv
gcagucaggccuagcgcggcg

SEQ ID NO: 3256635 - RNA, 17 nt, Mycobacterium tuberculosis H37Rv
gcaguccaccgcgcggc

SEQ ID NO: 3256636 - RNA, 21 nt, Mycobacterium tuberculosis H37Rv
gcaguccaccgcgcggcgcag

SEQ ID NO: 3256637 - RNA, 16 nt, Mycobacterium tuberculosis H37Rv
gcaguccacgagcacg

SEQ ID NO: 3256638 - RNA, 12 nt, Mycobacterium tuberculosis H37Rv
gcaguccaggca

SEQ ID NO: 3256639 - RNA, 21 nt, Mycobacterium tuberculosis H37Rv
gcagucccagcacacccccgu

SEQ ID NO: 3256640 - RNA, 12 nt, Mycobacterium tuberculosis H37Rv
gcagucccagcg

SEQ ID NO: 3256641 - RNA, 16 nt, Mycobacterium tuberculosis H37Rv
gcagucccgucgucgu

SEQ ID NO: 3256642 - RNA, 14 nt, Mycobacterium tuberculosis H37Rv
gcaguccgggugua

SEQ ID NO: 3256643 - RNA, 12 nt, Mycobacterium tuberculosis H37Rv
gcagucgcacgg

SEQ ID NO: 3256644 - RNA, 15 nt, Mycobacterium tuberculosis H37Rv
gcagucgcacggugc

SEQ ID NO: 3256645 - RNA, 19 nt, Mycobacterium tuberculosis H37Rv
gcagucgcuaaagcccccg

SEQ ID NO: 3256646 - RNA, 14 nt, Mycobacterium tuberculosis H37Rv
gcagucgggcagcg

SEQ ID NO: 3256647 - RNA, 20 nt, Mycobacterium tuberculosis H37Rv
gcagucgggcagcgcucuca

SEQ ID NO: 3256648 - RNA, 17 nt, Mycobacterium tuberculosis H37Rv
gcagucggugcggugca

SEQ ID NO: 3256649 - RNA, 13 nt, Mycobacterium tuberculosis H37Rv
gcagucugacgaa

SEQ ID NO: 3256650 - RNA, 17 nt, Mycobacterium tuberculosis H37Rv
gcagucuuucccggggc

SEQ ID NO: 3256651 - RNA, 21 nt, Mycobacterium tuberculosis H37Rv
gcagucuuucccggggcuggg

SEQ ID NO: 3256652 - RNA, 22 nt, Mycobacterium tuberculosis H37Rv
gcagugaacguaucgccucgag

SEQ ID NO: 3256653 - RNA, 23 nt, Mycobacterium tuberculosis H37Rv
gcagugacagcaggaaaaagggc

SEQ ID NO: 3256654 - RNA, 17 nt, Mycobacterium tuberculosis H37Rv
gcagugaccucgucggc

SEQ ID NO: 3256655 - RNA, 19 nt, Mycobacterium tuberculosis H37Rv
gcagugaccucgucggcga

SEQ ID NO: 3256656 - RNA, 23 nt, Mycobacterium tuberculosis H37Rv
gcagugcacccgggccgccucga

SEQ ID NO: 3256657 - RNA, 16 nt, Mycobacterium tuberculosis H37Rv
gcagugcagcgauccc

SEQ ID NO: 3256658 - RNA, 15 nt, Mycobacterium tuberculosis H37Rv
gcagugcaggcggcc

SEQ ID NO: 3256659 - RNA, 18 nt, Mycobacterium tuberculosis H37Rv
gcagugccgcacccagac

SEQ ID NO: 3256660 - RNA, 15 nt, Mycobacterium tuberculosis H37Rv
gcagugccgugcuga

SEQ ID NO: 3256661 - RNA, 16 nt, Mycobacterium tuberculosis H37Rv
gcagugccucggcgau

SEQ ID NO: 3256662 - RNA, 15 nt, Mycobacterium tuberculosis H37Rv
gcagugcgaacucau

SEQ ID NO: 3256663 - RNA, 13 nt, Mycobacterium tuberculosis H37Rv
gcaguggcagccc

SEQ ID NO: 3256664 - RNA, 17 nt, Mycobacterium tuberculosis H37Rv
gcaguggcagcccgucg

SEQ ID NO: 3256665 - RNA, 16 nt, Mycobacterium tuberculosis H37Rv
gcaguggcgcggcgag

SEQ ID NO: 3256666 - RNA, 20 nt, Mycobacterium tuberculosis H37Rv
gcaguggcguuacgcucggc

SEQ ID NO: 3256667 - RNA, 19 nt, Mycobacterium tuberculosis H37Rv
gcagugggcaauccgguca

SEQ ID NO: 3256668 - RNA, 19 nt, Mycobacterium tuberculosis H37Rv
gcaguucaucgggcaccaa

SEQ ID NO: 3256669 - RNA, 16 nt, Mycobacterium tuberculosis H37Rv
gcaguucgcggccauc

SEQ ID NO: 3256670 - RNA, 22 nt, Mycobacterium tuberculosis H37Rv
gcaguucggcgaugcgcgggug

SEQ ID NO: 3256671 - RNA, 15 nt, Mycobacterium tuberculosis H37Rv
gcaguucggucagcg

SEQ ID NO: 3256672 - RNA, 14 nt, Mycobacterium tuberculosis H37Rv
gcaguugacccaug

SEQ ID NO: 3256673 - RNA, 15 nt, Mycobacterium tuberculosis H37Rv
gcaguuggcaccagc

SEQ ID NO: 3256674 - RNA, 19 nt, Mycobacterium tuberculosis H37Rv
gcauaaccggcgcgccccg

SEQ ID NO: 3256675 - RNA, 20 nt, Mycobacterium tuberculosis H37Rv
gcauaacgccagucccggcg

SEQ ID NO: 3256676 - RNA, 24 nt, Mycobacterium tuberculosis H37Rv
gcauaagcccccgacacgccgugc

SEQ ID NO: 3256677 - RNA, 14 nt, Mycobacterium tuberculosis H37Rv
gcauaccggcgucg

SEQ ID NO: 3256678 - RNA, 18 nt, Mycobacterium tuberculosis H37Rv
gcauagcggcccaucggg

SEQ ID NO: 3256679 - RNA, 21 nt, Mycobacterium tuberculosis H37Rv
gcauaggccccgccagcgccg

SEQ ID NO: 3256680 - RNA, 21 nt, Mycobacterium tuberculosis H37Rv
gcauaggcggccaucgacgac

SEQ ID NO: 3256681 - RNA, 19 nt, Mycobacterium tuberculosis H37Rv
gcauagggccaccgccgcc

SEQ ID NO: 3256682 - RNA, 20 nt, Mycobacterium tuberculosis H37Rv
gcauagguaguugcucggcu

SEQ ID NO: 3256683 - RNA, 23 nt, Mycobacterium tuberculosis H37Rv
gcauagguaguugcucggcuucc

SEQ ID NO: 3256684 - RNA, 15 nt, Mycobacterium tuberculosis H37Rv
gcauaucaaccccgg

SEQ ID NO: 3256685 - RNA, 15 nt, Mycobacterium tuberculosis H37Rv
gcauauccgcaggcc

SEQ ID NO: 3256686 - RNA, 17 nt, Mycobacterium tuberculosis H37Rv
gcauauccgccggcgac

SEQ ID NO: 3256687 - RNA, 13 nt, Mycobacterium tuberculosis H37Rv
gcauaugacgucg

SEQ ID NO: 3256688 - RNA, 17 nt, Mycobacterium tuberculosis H37Rv
gcauaugccgccggcag

SEQ ID NO: 3256689 - RNA, 22 nt, Mycobacterium tuberculosis H37Rv
gcaucaaccguccccggcgucc

SEQ ID NO: 3256690 - RNA, 21 nt, Mycobacterium tuberculosis H37Rv
gcaucaacgcgggcgcuugcc

SEQ ID NO: 3256691 - RNA, 21 nt, Mycobacterium tuberculosis H37Rv
gcaucaccaccgcaccggaau

SEQ ID NO: 3256692 - RNA, 22 nt, Mycobacterium tuberculosis H37Rv
gcaucaccacuggacccgccca

SEQ ID NO: 3256693 - RNA, 17 nt, Mycobacterium tuberculosis H37Rv
gcaucaccgccgcggcc

SEQ ID NO: 3256694 - RNA, 24 nt, Mycobacterium tuberculosis H37Rv
gcaucacgaucacgucgucucggc

SEQ ID NO: 3256695 - RNA, 15 nt, Mycobacterium tuberculosis H37Rv
gcaucacgccgucgc

SEQ ID NO: 3256696 - RNA, 18 nt, Mycobacterium tuberculosis H37Rv
gcaucacgccgucgcaga

SEQ ID NO: 3256697 - RNA, 18 nt, Mycobacterium tuberculosis H37Rv
gcaucagcgccagcgagc

SEQ ID NO: 3256698 - RNA, 17 nt, Mycobacterium tuberculosis H37Rv
gcaucagcggcgccagu

SEQ ID NO: 3256699 - RNA, 22 nt, Mycobacterium tuberculosis H37Rv
gcaucagcggcgccaguauggc

SEQ ID NO: 3256700 - RNA, 16 nt, Mycobacterium tuberculosis H37Rv
gcaucagcucgaugcc

SEQ ID NO: 3256701 - RNA, 19 nt, Mycobacterium tuberculosis H37Rv
gcaucaguuugacgccgau

SEQ ID NO: 3256702 - RNA, 19 nt, Mycobacterium tuberculosis H37Rv
gcaucauagacagggccgc

SEQ ID NO: 3256703 - RNA, 13 nt, Mycobacterium tuberculosis H37Rv
gcaucaucgccca

SEQ ID NO: 3256704 - RNA, 22 nt, Mycobacterium tuberculosis H37Rv
gcaucaugcccuuguaggccau

SEQ ID NO: 3256705 - RNA, 20 nt, Mycobacterium tuberculosis H37Rv
gcaucaugggagucgucgug

SEQ ID NO: 3256706 - RNA, 17 nt, Mycobacterium tuberculosis H37Rv
gcauccaaaaucgccug

SEQ ID NO: 3256707 - RNA, 16 nt, Mycobacterium tuberculosis H37Rv
gcauccaacgcggcgc

SEQ ID NO: 3256708 - RNA, 13 nt, Mycobacterium tuberculosis H37Rv
gcauccacaccga

SEQ ID NO: 3256709 - RNA, 16 nt, Mycobacterium tuberculosis H37Rv
gcauccacugcggcgc

SEQ ID NO: 3256710 - RNA, 19 nt, Mycobacterium tuberculosis H37Rv
gcauccagaaguaggcgac

SEQ ID NO: 3256711 - RNA, 12 nt, Mycobacterium tuberculosis H37Rv
gcauccaggcug

SEQ ID NO: 3256712 - RNA, 21 nt, Mycobacterium tuberculosis H37Rv
gcauccaggcugucgcgggcc

SEQ ID NO: 3256713 - RNA, 16 nt, Mycobacterium tuberculosis H37Rv
gcauccauccugccuu

SEQ ID NO: 3256714 - RNA, 23 nt, Mycobacterium tuberculosis H37Rv
gcaucccgggcaguccaggcacu

SEQ ID NO: 3256715 - RNA, 15 nt, Mycobacterium tuberculosis H37Rv
gcauccgccccgccc

SEQ ID NO: 3256716 - RNA, 15 nt, Mycobacterium tuberculosis H37Rv
gcauccgcgguuggc

SEQ ID NO: 3256717 - RNA, 16 nt, Mycobacterium tuberculosis H37Rv
gcauccggucucggcc

SEQ ID NO: 3256718 - RNA, 17 nt, Mycobacterium tuberculosis H37Rv
gcauccuccucgucgac

SEQ ID NO: 3256719 - RNA, 12 nt, Mycobacterium tuberculosis H37Rv
gcauccucgacu

SEQ ID NO: 3256720 - RNA, 16 nt, Mycobacterium tuberculosis H37Rv
gcauccucugaaccug

SEQ ID NO: 3256721 - RNA, 23 nt, Mycobacterium tuberculosis H37Rv
gcauccugcacgacccgcugguc

SEQ ID NO: 3256722 - RNA, 18 nt, Mycobacterium tuberculosis H37Rv
gcauccuugccaaucgcc

SEQ ID NO: 3256723 - RNA, 22 nt, Mycobacterium tuberculosis H37Rv
gcaucgaacgcccugacggugg

SEQ ID NO: 3256724 - RNA, 20 nt, Mycobacterium tuberculosis H37Rv
gcaugcuaggcaugccacac

SEQ ID NO: 3256725 - RNA, 11 nt, Mycobacterium tuberculosis H37Rv
gcaugcucgac

SEQ ID NO: 3256726 - RNA, 20 nt, Mycobacterium tuberculosis H37Rv
gcaugcucgacaaccgcccg

SEQ ID NO: 3256727 - RNA, 21 nt, Mycobacterium tuberculosis H37Rv
gcaugcucgaucgcguucugc

SEQ ID NO: 3256728 - RNA, 18 nt, Mycobacterium tuberculosis H37Rv
gcaugcuggaccucgcga

SEQ ID NO: 3256729 - RNA, 19 nt, Mycobacterium tuberculosis H37Rv
gcaugcuggaccucgcgac

SEQ ID NO: 3256730 - RNA, 18 nt, Mycobacterium tuberculosis H37Rv
gcaugcuugaaacccagg

SEQ ID NO: 3256731 - RNA, 15 nt, Mycobacterium tuberculosis H37Rv
gcauggcccuggcga

SEQ ID NO: 3256732 - RNA, 16 nt, Mycobacterium tuberculosis H37Rv
gcauggcggcuggugc

SEQ ID NO: 3256733 - RNA, 13 nt, Mycobacterium tuberculosis H37Rv
gcaugggccaggu

SEQ ID NO: 3256734 - RNA, 22 nt, Mycobacterium tuberculosis H37Rv
gcaugggcccugcacagcagcg

SEQ ID NO: 3256735 - RNA, 16 nt, Mycobacterium tuberculosis H37Rv
gcaugggucgugcagg

SEQ ID NO: 3256736 - RNA, 19 nt, Mycobacterium tuberculosis H37Rv
gcaugguccacagccggcg

SEQ ID NO: 3256737 - RNA, 22 nt, Mycobacterium tuberculosis H37Rv
gcaugguccacagccggcggcu

SEQ ID NO: 3256738 - RNA, 13 nt, Mycobacterium tuberculosis H37Rv
gcauggucgccgg

SEQ ID NO: 3256739 - RNA, 16 nt, Mycobacterium tuberculosis H37Rv
gcauggucuucgcgga

SEQ ID NO: 3256740 - RNA, 17 nt, Mycobacterium tuberculosis H37Rv
gcaugguggcgccgacc

SEQ ID NO: 3256741 - RNA, 20 nt, Mycobacterium tuberculosis H37Rv
gcaugguggcgccgaccugg

SEQ ID NO: 3256742 - RNA, 14 nt, Mycobacterium tuberculosis H37Rv
gcauggugguggcc

SEQ ID NO: 3256743 - RNA, 17 nt, Mycobacterium tuberculosis H37Rv
gcaugguggugggugau

SEQ ID NO: 3256744 - RNA, 19 nt, Mycobacterium tuberculosis H37Rv
gcauguccauguuuugcug

SEQ ID NO: 3256745 - RNA, 18 nt, Mycobacterium tuberculosis H37Rv
gcaugucgcggacccgcg

SEQ ID NO: 3256746 - RNA, 21 nt, Mycobacterium tuberculosis H37Rv
gcaugugaaagacaacccgcu

SEQ ID NO: 3256747 - RNA, 15 nt, Mycobacterium tuberculosis H37Rv
gcauguuccuugcgg

SEQ ID NO: 3256748 - RNA, 22 nt, Mycobacterium tuberculosis H37Rv
gcauguuccuugcggccgcuga

SEQ ID NO: 3256749 - RNA, 22 nt, Mycobacterium tuberculosis H37Rv
gcauguucuccacgccgaucug

SEQ ID NO: 3256750 - RNA, 20 nt, Mycobacterium tuberculosis H37Rv
gcauguugcaggcgcagcug

SEQ ID NO: 3256751 - RNA, 13 nt, Mycobacterium tuberculosis H37Rv
gcauuaccacuuc

SEQ ID NO: 3256752 - RNA, 15 nt, Mycobacterium tuberculosis H37Rv
gcauuagcacgcugu

SEQ ID NO: 3256753 - RNA, 23 nt, Mycobacterium tuberculosis H37Rv
gcauucccgcggcaacgcggucu

SEQ ID NO: 3256754 - RNA, 20 nt, Mycobacterium tuberculosis H37Rv
gcauucgccgggcggcaucc

SEQ ID NO: 3256755 - RNA, 15 nt, Mycobacterium tuberculosis H37Rv
gcauucgggauucgg

SEQ ID NO: 3256756 - RNA, 21 nt, Mycobacterium tuberculosis H37Rv
gcauucgggauucgggcgccg

SEQ ID NO: 3256757 - RNA, 22 nt, Mycobacterium tuberculosis H37Rv
gcauucguggagccggccguga

SEQ ID NO: 3256758 - RNA, 14 nt, Mycobacterium tuberculosis H37Rv
gcauucucccggua

SEQ ID NO: 3256759 - RNA, 15 nt, Mycobacterium tuberculosis H37Rv
gcauugaagaagccc

SEQ ID NO: 3256760 - RNA, 16 nt, Mycobacterium tuberculosis H37Rv
gcauugaagaagcccg

SEQ ID NO: 3256761 - RNA, 17 nt, Mycobacterium tuberculosis H37Rv
gcauugaagaagcccga

SEQ ID NO: 3256762 - RNA, 16 nt, Mycobacterium tuberculosis H37Rv
gcauugaagaauggac

SEQ ID NO: 3256763 - RNA, 21 nt, Mycobacterium tuberculosis H37Rv
gcauugagcuggcgcccgggu

SEQ ID NO: 3256764 - RNA, 14 nt, Mycobacterium tuberculosis H37Rv
gcauugaguucggc

SEQ ID NO: 3256765 - RNA, 16 nt, Mycobacterium tuberculosis H37Rv
gcauugcggcccgcga

SEQ ID NO: 3256766 - RNA, 20 nt, Mycobacterium tuberculosis H37Rv
gcauuggugaguagauugcu

SEQ ID NO: 3256767 - RNA, 22 nt, Mycobacterium tuberculosis H37Rv
gcauugucauaggagcuuccga

SEQ ID NO: 3256768 - RNA, 21 nt, Mycobacterium tuberculosis H37Rv
gcauuuguugcugcugccgug

SEQ ID NO: 3256769 - RNA, 13 nt, Mycobacterium tuberculosis H37Rv
gccaaaaacgccc

SEQ ID NO: 3256770 - RNA, 17 nt, Mycobacterium tuberculosis H37Rv
gccaaaaacgccccggc

SEQ ID NO: 3256771 - RNA, 15 nt, Mycobacterium tuberculosis H37Rv
gccaaaacgagcaga

SEQ ID NO: 3256772 - RNA, 16 nt, Mycobacterium tuberculosis H37Rv
gccaaaacgagcagau

SEQ ID NO: 3256773 - RNA, 22 nt, Mycobacterium tuberculosis H37Rv
gccaaaacgagcagauggugaa

SEQ ID NO: 3256774 - RNA, 11 nt, Mycobacterium tuberculosis H37Rv
gccaaaagggc

SEQ ID NO: 3256775 - RNA, 15 nt, Mycobacterium tuberculosis H37Rv
gccaaaagggcggca

SEQ ID NO: 3256776 - RNA, 21 nt, Mycobacterium tuberculosis H37Rv
gccaaaagggcggcagcgagg

SEQ ID NO: 3256777 - RNA, 23 nt, Mycobacterium tuberculosis H37Rv
gccaaacccaugucggcgcgccg

SEQ ID NO: 3256778 - RNA, 21 nt, Mycobacterium tuberculosis H37Rv
gccaaagccgggauugccgcc

SEQ ID NO: 3256779 - RNA, 16 nt, Mycobacterium tuberculosis H37Rv
gccaaagccgucagcu

SEQ ID NO: 3256780 - RNA, 16 nt, Mycobacterium tuberculosis H37Rv
gccaaauccggcuugu

SEQ ID NO: 3256781 - RNA, 19 nt, Mycobacterium tuberculosis H37Rv
gccaaaugaugacgaucag

SEQ ID NO: 3256782 - RNA, 19 nt, Mycobacterium tuberculosis H37Rv
gccaaaugcgcugucgccc

SEQ ID NO: 3256783 - RNA, 18 nt, Mycobacterium tuberculosis H37Rv
gccaacaacaucagcgac

SEQ ID NO: 3256784 - RNA, 15 nt, Mycobacterium tuberculosis H37Rv
gccaacaccgccagc

SEQ ID NO: 3256785 - RNA, 17 nt, Mycobacterium tuberculosis H37Rv
gccaacaccgccagcau

SEQ ID NO: 3256786 - RNA, 23 nt, Mycobacterium tuberculosis H37Rv
gccaacaccgccagcaugacacc

SEQ ID NO: 3256787 - RNA, 18 nt, Mycobacterium tuberculosis H37Rv
gccaacaccggcgaucac

SEQ ID NO: 3256788 - RNA, 11 nt, Mycobacterium tuberculosis H37Rv
gccaacaccuc

SEQ ID NO: 3256789 - RNA, 12 nt, Mycobacterium tuberculosis H37Rv
gccaacaccuca

SEQ ID NO: 3256790 - RNA, 14 nt, Mycobacterium tuberculosis H37Rv
gccaacagaugcca

SEQ ID NO: 3256791 - RNA, 16 nt, Mycobacterium tuberculosis H37Rv
gccaacagaugccacc

SEQ ID NO: 3256792 - RNA, 19 nt, Mycobacterium tuberculosis H37Rv
gccaacagaugccacccag

SEQ ID NO: 3256793 - RNA, 16 nt, Mycobacterium tuberculosis H37Rv
gccaaccacuuuccgg

SEQ ID NO: 3256794 - RNA, 16 nt, Mycobacterium tuberculosis H37Rv
gccaacccaauuggga

SEQ ID NO: 3256795 - RNA, 17 nt, Mycobacterium tuberculosis H37Rv
gccaaccccauggccag

SEQ ID NO: 3256796 - RNA, 19 nt, Mycobacterium tuberculosis H37Rv
gccaaccccauggccagcg

SEQ ID NO: 3256797 - RNA, 12 nt, Mycobacterium tuberculosis H37Rv
gccaacccgggc

SEQ ID NO: 3256798 - RNA, 17 nt, Mycobacterium tuberculosis H37Rv
gccaacccgggccgcca

SEQ ID NO: 3256799 - RNA, 17 nt, Mycobacterium tuberculosis H37Rv
gccaacccugcggcguc

SEQ ID NO: 3256800 - RNA, 19 nt, Mycobacterium tuberculosis H37Rv
gccaaccgcgugcgucagc

SEQ ID NO: 3256801 - RNA, 14 nt, Mycobacterium tuberculosis H37Rv
gccaaccggcgcag

SEQ ID NO: 3256802 - RNA, 24 nt, Mycobacterium tuberculosis H37Rv
gccaaccggcgcaguagccgacca

SEQ ID NO: 3256803 - RNA, 19 nt, Mycobacterium tuberculosis H37Rv
gccaaccgggucguucggg

SEQ ID NO: 3256804 - RNA, 19 nt, Mycobacterium tuberculosis H37Rv
gccaaccgguucgucgaac

SEQ ID NO: 3256805 - RNA, 21 nt, Mycobacterium tuberculosis H37Rv
gccaaccgguucgucgaacgg

SEQ ID NO: 3256806 - RNA, 16 nt, Mycobacterium tuberculosis H37Rv
gccaaccgugcgcacu

SEQ ID NO: 3256807 - RNA, 18 nt, Mycobacterium tuberculosis H37Rv
gccaaccguguaggccau

SEQ ID NO: 3256808 - RNA, 17 nt, Mycobacterium tuberculosis H37Rv
gccaaccugaagccagc

SEQ ID NO: 3256809 - RNA, 11 nt, Mycobacterium tuberculosis H37Rv
gccaaccuggg

SEQ ID NO: 3256810 - RNA, 14 nt, Mycobacterium tuberculosis H37Rv
gccaaccugggcca

SEQ ID NO: 3256811 - RNA, 18 nt, Mycobacterium tuberculosis H37Rv
gccaacgaaccgcucagc

SEQ ID NO: 3256812 - RNA, 14 nt, Mycobacterium tuberculosis H37Rv
gccaacgacggccg

SEQ ID NO: 3256813 - RNA, 18 nt, Mycobacterium tuberculosis H37Rv
gccaacgaugaugaugac

SEQ ID NO: 3256814 - RNA, 17 nt, Mycobacterium tuberculosis H37Rv
gccaacgccagcaccag

SEQ ID NO: 3256815 - RNA, 18 nt, Mycobacterium tuberculosis H37Rv
gccaacgccagcaccagc

SEQ ID NO: 3256816 - RNA, 21 nt, Mycobacterium tuberculosis H37Rv
gccaacgcgcagagcguuccg

SEQ ID NO: 3256817 - RNA, 20 nt, Mycobacterium tuberculosis H37Rv
gccaacgcgucccgccgcac

SEQ ID NO: 3256818 - RNA, 16 nt, Mycobacterium tuberculosis H37Rv
gccaacggcaccucga

SEQ ID NO: 3256819 - RNA, 16 nt, Mycobacterium tuberculosis H37Rv
gccaacggcuccgggc

SEQ ID NO: 3256820 - RNA, 17 nt, Mycobacterium tuberculosis H37Rv
gccaccaccacggccag

SEQ ID NO: 3256821 - RNA, 19 nt, Mycobacterium tuberculosis H37Rv
gccaccaccacggccagaa

SEQ ID NO: 3256822 - RNA, 18 nt, Mycobacterium tuberculosis H37Rv
gccaccaccaggcugacg

SEQ ID NO: 3256823 - RNA, 16 nt, Mycobacterium tuberculosis H37Rv
gccaccaccagggcaa

SEQ ID NO: 3256824 - RNA, 16 nt, Mycobacterium tuberculosis H37Rv
gccaccaccaggucgg

SEQ ID NO: 3256825 - RNA, 21 nt, Mycobacterium tuberculosis H37Rv
gccaccacccaacagcccacc

SEQ ID NO: 3256826 - RNA, 15 nt, Mycobacterium tuberculosis H37Rv
gccaccacccaggcc

SEQ ID NO: 3256827 - RNA, 19 nt, Mycobacterium tuberculosis H37Rv
gccaccacccggcgcagcu

SEQ ID NO: 3256828 - RNA, 18 nt, Mycobacterium tuberculosis H37Rv
gccaccaccgccgccggc

SEQ ID NO: 3256829 - RNA, 22 nt, Mycobacterium tuberculosis H37Rv
gccaccaccgccgccggcaccg

SEQ ID NO: 3256830 - RNA, 20 nt, Mycobacterium tuberculosis H37Rv
gccaccaccggcgccccugu

SEQ ID NO: 3256831 - RNA, 17 nt, Mycobacterium tuberculosis H37Rv
gccaccaccuccgcguc

SEQ ID NO: 3256832 - RNA, 23 nt, Mycobacterium tuberculosis H37Rv
gccaccaccucggugaccaggcc

SEQ ID NO: 3256833 - RNA, 21 nt, Mycobacterium tuberculosis H37Rv
gccaccacgcaugcgcgcgcc

SEQ ID NO: 3256834 - RNA, 16 nt, Mycobacterium tuberculosis H37Rv
gccaccacgccgucga

SEQ ID NO: 3256835 - RNA, 20 nt, Mycobacterium tuberculosis H37Rv
gccaccacugcgcccgccac

SEQ ID NO: 3256836 - RNA, 20 nt, Mycobacterium tuberculosis H37Rv
gccaccagaaacaccgacga

SEQ ID NO: 3256837 - RNA, 15 nt, Mycobacterium tuberculosis H37Rv
gccaccagaaccacu

SEQ ID NO: 3256838 - RNA, 16 nt, Mycobacterium tuberculosis H37Rv
gccaccagaaccagcg

SEQ ID NO: 3256839 - RNA, 18 nt, Mycobacterium tuberculosis H37Rv
gccaccagaaccagcgac

SEQ ID NO: 3256840 - RNA, 16 nt, Mycobacterium tuberculosis H37Rv
gccaccagacaacgcc

SEQ ID NO: 3256841 - RNA, 18 nt, Mycobacterium tuberculosis H37Rv
gccaccagacaacgccgu

SEQ ID NO: 3256842 - RNA, 14 nt, Mycobacterium tuberculosis H37Rv
gccaccagaccagg

SEQ ID NO: 3256843 - RNA, 22 nt, Mycobacterium tuberculosis H37Rv
gccaccagcaccgccgcugcca

SEQ ID NO: 3256844 - RNA, 12 nt, Mycobacterium tuberculosis H37Rv
gccaccagccgg

SEQ ID NO: 3256845 - RNA, 15 nt, Mycobacterium tuberculosis H37Rv
gccaccagccgggca

SEQ ID NO: 3256846 - RNA, 20 nt, Mycobacterium tuberculosis H37Rv
gccaccagcgacgaccacac

SEQ ID NO: 3256847 - RNA, 11 nt, Mycobacterium tuberculosis H37Rv
gccaccagcgc

SEQ ID NO: 3256848 - RNA, 14 nt, Mycobacterium tuberculosis H37Rv
gccaccagcggcau

SEQ ID NO: 3256849 - RNA, 16 nt, Mycobacterium tuberculosis H37Rv
gccaccagcuggcgau

SEQ ID NO: 3256850 - RNA, 13 nt, Mycobacterium tuberculosis H37Rv
gccaccaggcggu

SEQ ID NO: 3256851 - RNA, 21 nt, Mycobacterium tuberculosis H37Rv
gccaccaggggaccgcggcgc

SEQ ID NO: 3256852 - RNA, 19 nt, Mycobacterium tuberculosis H37Rv
gccaccaguuguccggcua

SEQ ID NO: 3256853 - RNA, 17 nt, Mycobacterium tuberculosis H37Rv
gccaccaucaccucgca

SEQ ID NO: 3256854 - RNA, 14 nt, Mycobacterium tuberculosis H37Rv
gccaccaucgcccc

SEQ ID NO: 3256855 - RNA, 13 nt, Mycobacterium tuberculosis H37Rv
gccaccaucgccg

SEQ ID NO: 3256856 - RNA, 17 nt, Mycobacterium tuberculosis H37Rv
gccaccaucgccgccgu

SEQ ID NO: 3256857 - RNA, 19 nt, Mycobacterium tuberculosis H37Rv
gccaccaucgccgccguug

SEQ ID NO: 3256858 - RNA, 18 nt, Mycobacterium tuberculosis H37Rv
gccacccagaaugacauc

SEQ ID NO: 3256859 - RNA, 20 nt, Mycobacterium tuberculosis H37Rv
gccacccagaaugacaucgu

SEQ ID NO: 3256860 - RNA, 17 nt, Mycobacterium tuberculosis H37Rv
gccacccagaugcagcg

SEQ ID NO: 3256861 - RNA, 22 nt, Mycobacterium tuberculosis H37Rv
gccacccagaugcagcggucca

SEQ ID NO: 3256862 - RNA, 21 nt, Mycobacterium tuberculosis H37Rv
gccacccagcaccagggcgcg

SEQ ID NO: 3256863 - RNA, 13 nt, Mycobacterium tuberculosis H37Rv
gccacccaucgca

SEQ ID NO: 3256864 - RNA, 23 nt, Mycobacterium tuberculosis H37Rv
gccacccccaaccgccggccagc

SEQ ID NO: 3256865 - RNA, 16 nt, Mycobacterium tuberculosis H37Rv
gccaccccgagcucac

SEQ ID NO: 3256866 - RNA, 22 nt, Mycobacterium tuberculosis H37Rv
gccaccccgagcucaccaaggu

SEQ ID NO: 3256867 - RNA, 22 nt, Mycobacterium tuberculosis H37Rv
gccaccccgcguaugccaggac

SEQ ID NO: 3256868 - RNA, 22 nt, Mycobacterium tuberculosis H37Rv
gccaccccggucggagcggugc

SEQ ID NO: 3256869 - RNA, 12 nt, Mycobacterium tuberculosis H37Rv
gccacccgcaac

SEQ ID NO: 3256870 - RNA, 18 nt, Mycobacterium tuberculosis H37Rv
gccacccgcaggucgcac

SEQ ID NO: 3256871 - RNA, 19 nt, Mycobacterium tuberculosis H37Rv
gccacccgcgaagccgcca

SEQ ID NO: 3256872 - RNA, 16 nt, Mycobacterium tuberculosis H37Rv
gccacccgcgccgcca

SEQ ID NO: 3256873 - RNA, 18 nt, Mycobacterium tuberculosis H37Rv
gccacccgcgcuccaaca

SEQ ID NO: 3256874 - RNA, 13 nt, Mycobacterium tuberculosis H37Rv
gccacccgcggaa

SEQ ID NO: 3256875 - RNA, 16 nt, Mycobacterium tuberculosis H37Rv
gccacccggacauagc

SEQ ID NO: 3256876 - RNA, 13 nt, Mycobacterium tuberculosis H37Rv
gccacccggccag

SEQ ID NO: 3256877 - RNA, 13 nt, Mycobacterium tuberculosis H37Rv
gccacccggccgc

SEQ ID NO: 3256878 - RNA, 17 nt, Mycobacterium tuberculosis H37Rv
gccacccuugccgccgg

SEQ ID NO: 3256879 - RNA, 20 nt, Mycobacterium tuberculosis H37Rv
gccacccuuggcccggugca

SEQ ID NO: 3256880 - RNA, 16 nt, Mycobacterium tuberculosis H37Rv
gccaccgaacagucga

SEQ ID NO: 3256881 - RNA, 17 nt, Mycobacterium tuberculosis H37Rv
gccaccgaacgcaccga

SEQ ID NO: 3256882 - RNA, 16 nt, Mycobacterium tuberculosis H37Rv
gccaccgaacgcggcc

SEQ ID NO: 3256883 - RNA, 17 nt, Mycobacterium tuberculosis H37Rv
gccaccgaacgcggcca

SEQ ID NO: 3256884 - RNA, 19 nt, Mycobacterium tuberculosis H37Rv
gccaccgaacgcggccacc

SEQ ID NO: 3256885 - RNA, 23 nt, Mycobacterium tuberculosis H37Rv
gccaccgaacuugcggaccuggc

SEQ ID NO: 3256886 - RNA, 15 nt, Mycobacterium tuberculosis H37Rv
gccaccgaagccgcc

SEQ ID NO: 3256887 - RNA, 14 nt, Mycobacterium tuberculosis H37Rv
gccaccgaccgagu

SEQ ID NO: 3256888 - RNA, 16 nt, Mycobacterium tuberculosis H37Rv
gccaccgaccgcacga

SEQ ID NO: 3256889 - RNA, 22 nt, Mycobacterium tuberculosis H37Rv
gccaccgacgacaucgguggcc

SEQ ID NO: 3256890 - RNA, 21 nt, Mycobacterium tuberculosis H37Rv
gccaccgagaucaugccggcg

SEQ ID NO: 3256891 - RNA, 16 nt, Mycobacterium tuberculosis H37Rv
gccaccgagcccucca

SEQ ID NO: 3256892 - RNA, 13 nt, Mycobacterium tuberculosis H37Rv
gccaccgauggcg

SEQ ID NO: 3256893 - RNA, 13 nt, Mycobacterium tuberculosis H37Rv
gccaccgcaagaa

SEQ ID NO: 3256894 - RNA, 18 nt, Mycobacterium tuberculosis H37Rv
gccaccgcaagaaucagc

SEQ ID NO: 3256895 - RNA, 13 nt, Mycobacterium tuberculosis H37Rv
gccaccgcacgcu

SEQ ID NO: 3256896 - RNA, 17 nt, Mycobacterium tuberculosis H37Rv
gccaccgcacguucggc

SEQ ID NO: 3256897 - RNA, 13 nt, Mycobacterium tuberculosis H37Rv
gccaccgcaucgc

SEQ ID NO: 3256898 - RNA, 20 nt, Mycobacterium tuberculosis H37Rv
gccaccgccaccgcggccug

SEQ ID NO: 3256899 - RNA, 17 nt, Mycobacterium tuberculosis H37Rv
gccaccgccagcgucga

SEQ ID NO: 3256900 - RNA, 20 nt, Mycobacterium tuberculosis H37Rv
gccaccgccagcgucgacac

SEQ ID NO: 3256901 - RNA, 14 nt, Mycobacterium tuberculosis H37Rv
gccaccgccgccgc

SEQ ID NO: 3256902 - RNA, 16 nt, Mycobacterium tuberculosis H37Rv
gccaccgccgccgcca

SEQ ID NO: 3256903 - RNA, 17 nt, Mycobacterium tuberculosis H37Rv
gccaccgccgccgccac

SEQ ID NO: 3256904 - RNA, 23 nt, Mycobacterium tuberculosis H37Rv
gccaccgccgccgccgacgccgc

SEQ ID NO: 3256905 - RNA, 18 nt, Mycobacterium tuberculosis H37Rv
gccaccgccgccggugua

SEQ ID NO: 3256906 - RNA, 13 nt, Mycobacterium tuberculosis H37Rv
gccaccgccggca

SEQ ID NO: 3256907 - RNA, 14 nt, Mycobacterium tuberculosis H37Rv
gccaccgccggcag

SEQ ID NO: 3256908 - RNA, 21 nt, Mycobacterium tuberculosis H37Rv
gccaccgccggcagcaucggc

SEQ ID NO: 3256909 - RNA, 20 nt, Mycobacterium tuberculosis H37Rv
gccaccgcgacaccccggaa

SEQ ID NO: 3256910 - RNA, 13 nt, Mycobacterium tuberculosis H37Rv
gccaccgcgagca

SEQ ID NO: 3256911 - RNA, 15 nt, Mycobacterium tuberculosis H37Rv
gccaccgcgccguaa

SEQ ID NO: 3256912 - RNA, 16 nt, Mycobacterium tuberculosis H37Rv
gccaccgcggccgcgg

SEQ ID NO: 3256913 - RNA, 14 nt, Mycobacterium tuberculosis H37Rv
gccaccgcggccug

SEQ ID NO: 3256914 - RNA, 15 nt, Mycobacterium tuberculosis H37Rv
gccaccgcggcgauu

SEQ ID NO: 3256915 - RNA, 22 nt, Mycobacterium tuberculosis H37Rv
gccaccgcggcgauuacggcca

SEQ ID NO: 3256916 - RNA, 19 nt, Mycobacterium tuberculosis H37Rv
gccacgcucggcggccagc

SEQ ID NO: 3256917 - RNA, 20 nt, Mycobacterium tuberculosis H37Rv
gccacgcucggcggccagcu

SEQ ID NO: 3256918 - RNA, 22 nt, Mycobacterium tuberculosis H37Rv
gccacgcucggugcugcgccga

SEQ ID NO: 3256919 - RNA, 15 nt, Mycobacterium tuberculosis H37Rv
gccacgcugucccgc

SEQ ID NO: 3256920 - RNA, 18 nt, Mycobacterium tuberculosis H37Rv
gccacgcugucccgcggg

SEQ ID NO: 3256921 - RNA, 21 nt, Mycobacterium tuberculosis H37Rv
gccacgcuucuuccgcgcgcc

SEQ ID NO: 3256922 - RNA, 22 nt, Mycobacterium tuberculosis H37Rv
gccacgcuucuuccgcgcgccg

SEQ ID NO: 3256923 - RNA, 14 nt, Mycobacterium tuberculosis H37Rv
gccacggaucgcgg

SEQ ID NO: 3256924 - RNA, 18 nt, Mycobacterium tuberculosis H37Rv
gccacggaucgcggcggc

SEQ ID NO: 3256925 - RNA, 18 nt, Mycobacterium tuberculosis H37Rv
gccacggcacugggucca

SEQ ID NO: 3256926 - RNA, 14 nt, Mycobacterium tuberculosis H37Rv
gccacggcaucggc

SEQ ID NO: 3256927 - RNA, 18 nt, Mycobacterium tuberculosis H37Rv
gccacggcaucggccacc

SEQ ID NO: 3256928 - RNA, 14 nt, Mycobacterium tuberculosis H37Rv
gccacggcauucga

SEQ ID NO: 3256929 - RNA, 16 nt, Mycobacterium tuberculosis H37Rv
gccacggcccgguugg

SEQ ID NO: 3256930 - RNA, 22 nt, Mycobacterium tuberculosis H37Rv
gccacggccuucagcggucgca

SEQ ID NO: 3256931 - RNA, 12 nt, Mycobacterium tuberculosis H37Rv
gccacggcggcu

SEQ ID NO: 3256932 - RNA, 15 nt, Mycobacterium tuberculosis H37Rv
gccacggcggcuucc

SEQ ID NO: 3256933 - RNA, 14 nt, Mycobacterium tuberculosis H37Rv
gccacggcgucggc

SEQ ID NO: 3256934 - RNA, 16 nt, Mycobacterium tuberculosis H37Rv
gccacggcgucggcca

SEQ ID NO: 3256935 - RNA, 18 nt, Mycobacterium tuberculosis H37Rv
gccacggcugaccggggu

SEQ ID NO: 3256936 - RNA, 14 nt, Mycobacterium tuberculosis H37Rv
gccacggcugcgga

SEQ ID NO: 3256937 - RNA, 19 nt, Mycobacterium tuberculosis H37Rv
gccacggcuuugcggcgcg

SEQ ID NO: 3256938 - RNA, 19 nt, Mycobacterium tuberculosis H37Rv
gccacggggcugccgguga

SEQ ID NO: 3256939 - RNA, 19 nt, Mycobacterium tuberculosis H37Rv
gccacggggcuuggcgacg

SEQ ID NO: 3256940 - RNA, 13 nt, Mycobacterium tuberculosis H37Rv
gccacgggugacg

SEQ ID NO: 3256941 - RNA, 21 nt, Mycobacterium tuberculosis H37Rv
gccacgggugacucgggcacg

SEQ ID NO: 3256942 - RNA, 16 nt, Mycobacterium tuberculosis H37Rv
gccacgguacauccag

SEQ ID NO: 3256943 - RNA, 20 nt, Mycobacterium tuberculosis H37Rv
gccacgguccggcccaccag

SEQ ID NO: 3256944 - RNA, 20 nt, Mycobacterium tuberculosis H37Rv
gccacggugucgucgaccac

SEQ ID NO: 3256945 - RNA, 16 nt, Mycobacterium tuberculosis H37Rv
gccacgguucgggcag

SEQ ID NO: 3256946 - RNA, 17 nt, Mycobacterium tuberculosis H37Rv
gccacgguucgggcagc

SEQ ID NO: 3256947 - RNA, 18 nt, Mycobacterium tuberculosis H37Rv
gccacgguucgggcagca

SEQ ID NO: 3256948 - RNA, 19 nt, Mycobacterium tuberculosis H37Rv
gccacgguucgggcagcac

SEQ ID NO: 3256949 - RNA, 19 nt, Mycobacterium tuberculosis H37Rv
gccacgguugguccaaugc

SEQ ID NO: 3256950 - RNA, 22 nt, Mycobacterium tuberculosis H37Rv
gccacguaagcgguuguccggu

SEQ ID NO: 3256951 - RNA, 15 nt, Mycobacterium tuberculosis H37Rv
gccacguaauucccc

SEQ ID NO: 3256952 - RNA, 19 nt, Mycobacterium tuberculosis H37Rv
gccacguacuccaccgcgc

SEQ ID NO: 3256953 - RNA, 15 nt, Mycobacterium tuberculosis H37Rv
gccacguagcagcag

SEQ ID NO: 3256954 - RNA, 19 nt, Mycobacterium tuberculosis H37Rv
gccacguagcagcgccggc

SEQ ID NO: 3256955 - RNA, 23 nt, Mycobacterium tuberculosis H37Rv
gccacguccaucaccggcggccc

SEQ ID NO: 3256956 - RNA, 19 nt, Mycobacterium tuberculosis H37Rv
gccacguccucagccgugc

SEQ ID NO: 3256957 - RNA, 21 nt, Mycobacterium tuberculosis H37Rv
gccacguccucagccgugccc

SEQ ID NO: 3256958 - RNA, 13 nt, Mycobacterium tuberculosis H37Rv
gccacgucgagca

SEQ ID NO: 3256959 - RNA, 15 nt, Mycobacterium tuberculosis H37Rv
gccacgucgagcacc

SEQ ID NO: 3256960 - RNA, 16 nt, Mycobacterium tuberculosis H37Rv
gccacgucgaugugcg

SEQ ID NO: 3256961 - RNA, 13 nt, Mycobacterium tuberculosis H37Rv
gccacgucgccgg

SEQ ID NO: 3256962 - RNA, 16 nt, Mycobacterium tuberculosis H37Rv
gccacgucgucgccca

SEQ ID NO: 3256963 - RNA, 17 nt, Mycobacterium tuberculosis H37Rv
gccacgucuccuucggc

SEQ ID NO: 3256964 - RNA, 17 nt, Mycobacterium tuberculosis H37Rv
gccacguggucgagcag

SEQ ID NO: 3256965 - RNA, 15 nt, Mycobacterium tuberculosis H37Rv
gccacguggucggcg

SEQ ID NO: 3256966 - RNA, 16 nt, Mycobacterium tuberculosis H37Rv
gccacguucgcggcca

SEQ ID NO: 3256967 - RNA, 17 nt, Mycobacterium tuberculosis H37Rv
gccacguuguccgcgac

SEQ ID NO: 3256968 - RNA, 14 nt, Mycobacterium tuberculosis H37Rv
gccacuagcccuga

SEQ ID NO: 3256969 - RNA, 14 nt, Mycobacterium tuberculosis H37Rv
gccacuaucggcuu

SEQ ID NO: 3256970 - RNA, 13 nt, Mycobacterium tuberculosis H37Rv
gccacucacuacg

SEQ ID NO: 3256971 - RNA, 15 nt, Mycobacterium tuberculosis H37Rv
gccacuccgguggcc

SEQ ID NO: 3256972 - RNA, 22 nt, Mycobacterium tuberculosis H37Rv
gccacucgcccgauccggaucc

SEQ ID NO: 3256973 - RNA, 13 nt, Mycobacterium tuberculosis H37Rv
gccacucgcgcac

SEQ ID NO: 3256974 - RNA, 14 nt, Mycobacterium tuberculosis H37Rv
gccacucuggucac

SEQ ID NO: 3256975 - RNA, 20 nt, Mycobacterium tuberculosis H37Rv
gccacugaccgcgaucgccg

SEQ ID NO: 3256976 - RNA, 15 nt, Mycobacterium tuberculosis H37Rv
gccacugccagccgu

SEQ ID NO: 3256977 - RNA, 14 nt, Mycobacterium tuberculosis H37Rv
gccacugccgacca

SEQ ID NO: 3256978 - RNA, 18 nt, Mycobacterium tuberculosis H37Rv
gccacugccggugggcgu

SEQ ID NO: 3256979 - RNA, 18 nt, Mycobacterium tuberculosis H37Rv
gccacugccguugccgcc

SEQ ID NO: 3256980 - RNA, 16 nt, Mycobacterium tuberculosis H37Rv
gccacugcuuccggaa

SEQ ID NO: 3256981 - RNA, 20 nt, Mycobacterium tuberculosis H37Rv
gccacuguugaagaagcccg

SEQ ID NO: 3256982 - RNA, 20 nt, Mycobacterium tuberculosis H37Rv
gccacuucccccggguccgc

SEQ ID NO: 3256983 - RNA, 16 nt, Mycobacterium tuberculosis H37Rv
gccacuugaugcucga

SEQ ID NO: 3256984 - RNA, 17 nt, Mycobacterium tuberculosis H37Rv
gccacuugaugcucgau

SEQ ID NO: 3256985 - RNA, 14 nt, Mycobacterium tuberculosis H37Rv
gccagaaacccggc

SEQ ID NO: 3256986 - RNA, 20 nt, Mycobacterium tuberculosis H37Rv
gccagaaacccggcgaccac

SEQ ID NO: 3256987 - RNA, 22 nt, Mycobacterium tuberculosis H37Rv
gccagaacggaauucagcgacg

SEQ ID NO: 3256988 - RNA, 17 nt, Mycobacterium tuberculosis H37Rv
gccagaacggcgucgaa

SEQ ID NO: 3256989 - RNA, 15 nt, Mycobacterium tuberculosis H37Rv
gccagaacguggcca

SEQ ID NO: 3256990 - RNA, 21 nt, Mycobacterium tuberculosis H37Rv
gccagaagaccuggcggugcc

SEQ ID NO: 3256991 - RNA, 17 nt, Mycobacterium tuberculosis H37Rv
gccagaaugggcggcau

SEQ ID NO: 3256992 - RNA, 13 nt, Mycobacterium tuberculosis H37Rv
gccagaccagggc

SEQ ID NO: 3256993 - RNA, 15 nt, Mycobacterium tuberculosis H37Rv
gccagaccagggcag

SEQ ID NO: 3256994 - RNA, 16 nt, Mycobacterium tuberculosis H37Rv
gccagaccagggcagc

SEQ ID NO: 3256995 - RNA, 19 nt, Mycobacterium tuberculosis H37Rv
gccagaccagggcagcggc

SEQ ID NO: 3256996 - RNA, 22 nt, Mycobacterium tuberculosis H37Rv
gccagaccagggcagcggccag

SEQ ID NO: 3256997 - RNA, 13 nt, Mycobacterium tuberculosis H37Rv
gccagaccgcacc

SEQ ID NO: 3256998 - RNA, 19 nt, Mycobacterium tuberculosis H37Rv
gccagaccgcaccauugcu

SEQ ID NO: 3256999 - RNA, 14 nt, Mycobacterium tuberculosis H37Rv
gccagaccgcgcgc

SEQ ID NO: 3257000 - RNA, 13 nt, Mycobacterium tuberculosis H37Rv
gccagaccgcggc

SEQ ID NO: 3257001 - RNA, 13 nt, Mycobacterium tuberculosis H37Rv
gccagagccgccc

SEQ ID NO: 3257002 - RNA, 22 nt, Mycobacterium tuberculosis H37Rv
gccagagccgcccuugccuccg

SEQ ID NO: 3257003 - RNA, 20 nt, Mycobacterium tuberculosis H37Rv
gccagagccgcgcgccgguu

SEQ ID NO: 3257004 - RNA, 15 nt, Mycobacterium tuberculosis H37Rv
gccagagguggauca

SEQ ID NO: 3257005 - RNA, 23 nt, Mycobacterium tuberculosis H37Rv
gccagagucggagacccguccgg

SEQ ID NO: 3257006 - RNA, 16 nt, Mycobacterium tuberculosis H37Rv
gccagaguuaccaggu

SEQ ID NO: 3257007 - RNA, 22 nt, Mycobacterium tuberculosis H37Rv
gccagaucaccgucgacagcgu

SEQ ID NO: 3257008 - RNA, 16 nt, Mycobacterium tuberculosis H37Rv
gccagauccgucagcu

SEQ ID NO: 3257009 - RNA, 15 nt, Mycobacterium tuberculosis H37Rv
gccagauccuucaac

SEQ ID NO: 3257010 - RNA, 15 nt, Mycobacterium tuberculosis H37Rv
gccagaucgaacgca

SEQ ID NO: 3257011 - RNA, 16 nt, Mycobacterium tuberculosis H37Rv
gccagaucgaacgcag

SEQ ID NO: 3257012 - RNA, 15 nt, Mycobacterium tuberculosis H37Rv
gccagccgguccagc

SEQ ID NO: 3257013 - RNA, 23 nt, Mycobacterium tuberculosis H37Rv
gccagccgguccagcagcucggc

SEQ ID NO: 3257014 - RNA, 18 nt, Mycobacterium tuberculosis H37Rv
gccagccggucgaugccg

SEQ ID NO: 3257015 - RNA, 20 nt, Mycobacterium tuberculosis H37Rv
gccagccggucgaugccgau

SEQ ID NO: 3257016 - RNA, 21 nt, Mycobacterium tuberculosis H37Rv
gccagccgguggugggcggga

SEQ ID NO: 3257017 - RNA, 14 nt, Mycobacterium tuberculosis H37Rv
gccagccgugcagg

SEQ ID NO: 3257018 - RNA, 14 nt, Mycobacterium tuberculosis H37Rv
gccagccgugccgg

SEQ ID NO: 3257019 - RNA, 19 nt, Mycobacterium tuberculosis H37Rv
gccagccguucucgcccac

SEQ ID NO: 3257020 - RNA, 20 nt, Mycobacterium tuberculosis H37Rv
gccagccguucucgcccacc

SEQ ID NO: 3257021 - RNA, 21 nt, Mycobacterium tuberculosis H37Rv
gccagccugaaccgccccggu

SEQ ID NO: 3257022 - RNA, 20 nt, Mycobacterium tuberculosis H37Rv
gccagccugcuggccgcggc

SEQ ID NO: 3257023 - RNA, 21 nt, Mycobacterium tuberculosis H37Rv
gccagccugcuggccgcggcc

SEQ ID NO: 3257024 - RNA, 23 nt, Mycobacterium tuberculosis H37Rv
gccagccuggccaucgagggcau

SEQ ID NO: 3257025 - RNA, 14 nt, Mycobacterium tuberculosis H37Rv
gccagccugugcug

SEQ ID NO: 3257026 - RNA, 19 nt, Mycobacterium tuberculosis H37Rv
gccagcgaauggggcagcu

SEQ ID NO: 3257027 - RNA, 15 nt, Mycobacterium tuberculosis H37Rv
gccagcgacgcgguc

SEQ ID NO: 3257028 - RNA, 19 nt, Mycobacterium tuberculosis H37Rv
gccagcgagaucagcaugc

SEQ ID NO: 3257029 - RNA, 12 nt, Mycobacterium tuberculosis H37Rv
gccagcgagcgc

SEQ ID NO: 3257030 - RNA, 19 nt, Mycobacterium tuberculosis H37Rv
gccagcgauaucggcggcu

SEQ ID NO: 3257031 - RNA, 14 nt, Mycobacterium tuberculosis H37Rv
gccagcgauucacg

SEQ ID NO: 3257032 - RNA, 16 nt, Mycobacterium tuberculosis H37Rv
gccagcgcagccaggc

SEQ ID NO: 3257033 - RNA, 17 nt, Mycobacterium tuberculosis H37Rv
gccagcgcagccaggcu

SEQ ID NO: 3257034 - RNA, 23 nt, Mycobacterium tuberculosis H37Rv
gccagcgcagccaggcugcggau

SEQ ID NO: 3257035 - RNA, 18 nt, Mycobacterium tuberculosis H37Rv
gccagcgcaucggucacc

SEQ ID NO: 3257036 - RNA, 16 nt, Mycobacterium tuberculosis H37Rv
gccagcgccaacucga

SEQ ID NO: 3257037 - RNA, 14 nt, Mycobacterium tuberculosis H37Rv
gccagcgccaccgu

SEQ ID NO: 3257038 - RNA, 14 nt, Mycobacterium tuberculosis H37Rv
gccagcgccaugcu

SEQ ID NO: 3257039 - RNA, 15 nt, Mycobacterium tuberculosis H37Rv
gccagcgccccgcgg

SEQ ID NO: 3257040 - RNA, 13 nt, Mycobacterium tuberculosis H37Rv
gccagcgccgcca

SEQ ID NO: 3257041 - RNA, 13 nt, Mycobacterium tuberculosis H37Rv
gccagcgccgccg

SEQ ID NO: 3257042 - RNA, 18 nt, Mycobacterium tuberculosis H37Rv
gccagcgccgccgagguc

SEQ ID NO: 3257043 - RNA, 21 nt, Mycobacterium tuberculosis H37Rv
gccagcgccgccgaggucggu

SEQ ID NO: 3257044 - RNA, 16 nt, Mycobacterium tuberculosis H37Rv
gccagcgccgccgcga

SEQ ID NO: 3257045 - RNA, 16 nt, Mycobacterium tuberculosis H37Rv
gccagcgccgccggca

SEQ ID NO: 3257046 - RNA, 19 nt, Mycobacterium tuberculosis H37Rv
gccagcgccgccggcaccu

SEQ ID NO: 3257047 - RNA, 16 nt, Mycobacterium tuberculosis H37Rv
gccagcgccgccggcg

SEQ ID NO: 3257048 - RNA, 15 nt, Mycobacterium tuberculosis H37Rv
gccagcgccgcugaa

SEQ ID NO: 3257049 - RNA, 18 nt, Mycobacterium tuberculosis H37Rv
gccagcgccgcugaagcc

SEQ ID NO: 3257050 - RNA, 12 nt, Mycobacterium tuberculosis H37Rv
gccagcgccggc

SEQ ID NO: 3257051 - RNA, 13 nt, Mycobacterium tuberculosis H37Rv
gccagcgccggcc

SEQ ID NO: 3257052 - RNA, 18 nt, Mycobacterium tuberculosis H37Rv
gccagcgccggccaggcu

SEQ ID NO: 3257053 - RNA, 21 nt, Mycobacterium tuberculosis H37Rv
gccagcgccggucagggcuug

SEQ ID NO: 3257054 - RNA, 18 nt, Mycobacterium tuberculosis H37Rv
gccagcgccucggcaucg

SEQ ID NO: 3257055 - RNA, 17 nt, Mycobacterium tuberculosis H37Rv
gccagcgcgccacgagc

SEQ ID NO: 3257056 - RNA, 12 nt, Mycobacterium tuberculosis H37Rv
gccagcgcgcgc

SEQ ID NO: 3257057 - RNA, 23 nt, Mycobacterium tuberculosis H37Rv
gccagcgcggcgcgcggggccuc

SEQ ID NO: 3257058 - RNA, 19 nt, Mycobacterium tuberculosis H37Rv
gccagcgcgucgccgucga

SEQ ID NO: 3257059 - RNA, 20 nt, Mycobacterium tuberculosis H37Rv
gccagcgcuccuugugccug

SEQ ID NO: 3257060 - RNA, 19 nt, Mycobacterium tuberculosis H37Rv
gccagcgcuucgucggccg

SEQ ID NO: 3257061 - RNA, 12 nt, Mycobacterium tuberculosis H37Rv
gccagcggagca

SEQ ID NO: 3257062 - RNA, 10 nt, Mycobacterium tuberculosis H37Rv
gccagcggca

SEQ ID NO: 3257063 - RNA, 20 nt, Mycobacterium tuberculosis H37Rv
gccagcggcaauggccagca

SEQ ID NO: 3257064 - RNA, 21 nt, Mycobacterium tuberculosis H37Rv
gccagcggcacacccaucacc

SEQ ID NO: 3257065 - RNA, 19 nt, Mycobacterium tuberculosis H37Rv
gccagcggcacugaucugc

SEQ ID NO: 3257066 - RNA, 17 nt, Mycobacterium tuberculosis H37Rv
gccagcggcccgucacc

SEQ ID NO: 3257067 - RNA, 22 nt, Mycobacterium tuberculosis H37Rv
gccagcggccgcuccaccucgg

SEQ ID NO: 3257068 - RNA, 16 nt, Mycobacterium tuberculosis H37Rv
gccagcggcgcgaccg

SEQ ID NO: 3257069 - RNA, 12 nt, Mycobacterium tuberculosis H37Rv
gccagcgggaac

SEQ ID NO: 3257070 - RNA, 18 nt, Mycobacterium tuberculosis H37Rv
gccagcgggaacacaccg

SEQ ID NO: 3257071 - RNA, 15 nt, Mycobacterium tuberculosis H37Rv
gccagcgggcgauga

SEQ ID NO: 3257072 - RNA, 20 nt, Mycobacterium tuberculosis H37Rv
gccagcgguaaugccagcgg

SEQ ID NO: 3257073 - RNA, 13 nt, Mycobacterium tuberculosis H37Rv
gccagcgguggac

SEQ ID NO: 3257074 - RNA, 16 nt, Mycobacterium tuberculosis H37Rv
gccagcgguggaccac

SEQ ID NO: 3257075 - RNA, 16 nt, Mycobacterium tuberculosis H37Rv
gccagcgucaacagcg

SEQ ID NO: 3257076 - RNA, 19 nt, Mycobacterium tuberculosis H37Rv
gccagcguccauggucgcg

SEQ ID NO: 3257077 - RNA, 20 nt, Mycobacterium tuberculosis H37Rv
gccagcguccauggucgcgc

SEQ ID NO: 3257078 - RNA, 15 nt, Mycobacterium tuberculosis H37Rv
gccagcguggugauc

SEQ ID NO: 3257079 - RNA, 14 nt, Mycobacterium tuberculosis H37Rv
gccagcguguccgc

SEQ ID NO: 3257080 - RNA, 18 nt, Mycobacterium tuberculosis H37Rv
gccagcguuaggucgccg

SEQ ID NO: 3257081 - RNA, 20 nt, Mycobacterium tuberculosis H37Rv
gccagcguuaggucgccggc

SEQ ID NO: 3257082 - RNA, 13 nt, Mycobacterium tuberculosis H37Rv
gccagcguuggcg

SEQ ID NO: 3257083 - RNA, 15 nt, Mycobacterium tuberculosis H37Rv
gccagcguuggcggc

SEQ ID NO: 3257084 - RNA, 14 nt, Mycobacterium tuberculosis H37Rv
gccagcucaaccac

SEQ ID NO: 3257085 - RNA, 16 nt, Mycobacterium tuberculosis H37Rv
gccagcucccgcgagc

SEQ ID NO: 3257086 - RNA, 14 nt, Mycobacterium tuberculosis H37Rv
gccagcucccgggc

SEQ ID NO: 3257087 - RNA, 19 nt, Mycobacterium tuberculosis H37Rv
gccagcuccgccugccgcu

SEQ ID NO: 3257088 - RNA, 16 nt, Mycobacterium tuberculosis H37Rv
gccagcuccucagcca

SEQ ID NO: 3257089 - RNA, 13 nt, Mycobacterium tuberculosis H37Rv
gccagcucgccgg

SEQ ID NO: 3257090 - RNA, 14 nt, Mycobacterium tuberculosis H37Rv
gccagcucgccggc

SEQ ID NO: 3257091 - RNA, 16 nt, Mycobacterium tuberculosis H37Rv
gccagcucgccggccg

SEQ ID NO: 3257092 - RNA, 19 nt, Mycobacterium tuberculosis H37Rv
gccagcucgccggccgggu

SEQ ID NO: 3257093 - RNA, 16 nt, Mycobacterium tuberculosis H37Rv
gccagcucgcgggccg

SEQ ID NO: 3257094 - RNA, 20 nt, Mycobacterium tuberculosis H37Rv
gccagcucgggcgcgcggcg

SEQ ID NO: 3257095 - RNA, 20 nt, Mycobacterium tuberculosis H37Rv
gccagcucuucggggaugac

SEQ ID NO: 3257096 - RNA, 15 nt, Mycobacterium tuberculosis H37Rv
gccagcugacacccg

SEQ ID NO: 3257097 - RNA, 14 nt, Mycobacterium tuberculosis H37Rv
gccagcugcagcag

SEQ ID NO: 3257098 - RNA, 15 nt, Mycobacterium tuberculosis H37Rv
gccagcugcagcaga

SEQ ID NO: 3257099 - RNA, 17 nt, Mycobacterium tuberculosis H37Rv
gccagcugcagcagacc

SEQ ID NO: 3257100 - RNA, 12 nt, Mycobacterium tuberculosis H37Rv
gccagcugcccg

SEQ ID NO: 3257101 - RNA, 13 nt, Mycobacterium tuberculosis H37Rv
gccagcugcgcag

SEQ ID NO: 3257102 - RNA, 22 nt, Mycobacterium tuberculosis H37Rv
gccagcugcgcagcgcaacauc

SEQ ID NO: 3257103 - RNA, 21 nt, Mycobacterium tuberculosis H37Rv
gccagcuuagccgcagcuugg

SEQ ID NO: 3257104 - RNA, 22 nt, Mycobacterium tuberculosis H37Rv
gccagcuucguauggacgagga

SEQ ID NO: 3257105 - RNA, 16 nt, Mycobacterium tuberculosis H37Rv
gccagcuugcggagcc

SEQ ID NO: 3257106 - RNA, 17 nt, Mycobacterium tuberculosis H37Rv
gccaggaagcgguggcc

SEQ ID NO: 3257107 - RNA, 18 nt, Mycobacterium tuberculosis H37Rv
gccaggaagcgguggccu

SEQ ID NO: 3257108 - RNA, 14 nt, Mycobacterium tuberculosis H37Rv
gccaggacauuccc

SEQ ID NO: 3257109 - RNA, 19 nt, Mycobacterium tuberculosis H37Rv
gccagugaacgcgcgugca

SEQ ID NO: 3257110 - RNA, 21 nt, Mycobacterium tuberculosis H37Rv
gccagugaacgcgcgugcagc

SEQ ID NO: 3257111 - RNA, 15 nt, Mycobacterium tuberculosis H37Rv
gccagugauggcgcg

SEQ ID NO: 3257112 - RNA, 21 nt, Mycobacterium tuberculosis H37Rv
gccagugauggcgcggucgcu

SEQ ID NO: 3257113 - RNA, 13 nt, Mycobacterium tuberculosis H37Rv
gccagugccaccu

SEQ ID NO: 3257114 - RNA, 18 nt, Mycobacterium tuberculosis H37Rv
gccagugccagcguccgu

SEQ ID NO: 3257115 - RNA, 23 nt, Mycobacterium tuberculosis H37Rv
gccagugcccgcacugccgccgg

SEQ ID NO: 3257116 - RNA, 13 nt, Mycobacterium tuberculosis H37Rv
gccagugccgccc

SEQ ID NO: 3257117 - RNA, 18 nt, Mycobacterium tuberculosis H37Rv
gccagugcgcagaacacc

SEQ ID NO: 3257118 - RNA, 16 nt, Mycobacterium tuberculosis H37Rv
gccagugcgcgcguca

SEQ ID NO: 3257119 - RNA, 16 nt, Mycobacterium tuberculosis H37Rv
gccagugcggucucga

SEQ ID NO: 3257120 - RNA, 21 nt, Mycobacterium tuberculosis H37Rv
gccagugcguggugggcggga

SEQ ID NO: 3257121 - RNA, 22 nt, Mycobacterium tuberculosis H37Rv
gccagugcucgcaaucguuggc

SEQ ID NO: 3257122 - RNA, 17 nt, Mycobacterium tuberculosis H37Rv
gccagugucagcacgac

SEQ ID NO: 3257123 - RNA, 21 nt, Mycobacterium tuberculosis H37Rv
gccaguucggccuugaucgug

SEQ ID NO: 3257124 - RNA, 20 nt, Mycobacterium tuberculosis H37Rv
gccaguucggcggccgccgc

SEQ ID NO: 3257125 - RNA, 22 nt, Mycobacterium tuberculosis H37Rv
gccaguucggcggccgccgcgu

SEQ ID NO: 3257126 - RNA, 15 nt, Mycobacterium tuberculosis H37Rv
gccaguucggcgggc

SEQ ID NO: 3257127 - RNA, 20 nt, Mycobacterium tuberculosis H37Rv
gccaguucggcgucguccgc

SEQ ID NO: 3257128 - RNA, 15 nt, Mycobacterium tuberculosis H37Rv
gccaguucggugagc

SEQ ID NO: 3257129 - RNA, 20 nt, Mycobacterium tuberculosis H37Rv
gccaguucuucauucguggg

SEQ ID NO: 3257130 - RNA, 19 nt, Mycobacterium tuberculosis H37Rv
gccaguugcacaucggugg

SEQ ID NO: 3257131 - RNA, 18 nt, Mycobacterium tuberculosis H37Rv
gccaguuuccagaugcac

SEQ ID NO: 3257132 - RNA, 18 nt, Mycobacterium tuberculosis H37Rv
gccauaaccgguggggac

SEQ ID NO: 3257133 - RNA, 18 nt, Mycobacterium tuberculosis H37Rv
gccauaauucgcccgcuc

SEQ ID NO: 3257134 - RNA, 17 nt, Mycobacterium tuberculosis H37Rv
gccauaccgcaauuggc

SEQ ID NO: 3257135 - RNA, 16 nt, Mycobacterium tuberculosis H37Rv
gccauaccucggcgac

SEQ ID NO: 3257136 - RNA, 19 nt, Mycobacterium tuberculosis H37Rv
gccauacgcgcugacccgc

SEQ ID NO: 3257137 - RNA, 13 nt, Mycobacterium tuberculosis H37Rv
gccauacuccgag

SEQ ID NO: 3257138 - RNA, 12 nt, Mycobacterium tuberculosis H37Rv
gccauagaugcc

SEQ ID NO: 3257139 - RNA, 17 nt, Mycobacterium tuberculosis H37Rv
gccauagaugcccgcga

SEQ ID NO: 3257140 - RNA, 15 nt, Mycobacterium tuberculosis H37Rv
gccauagcccgagcg

SEQ ID NO: 3257141 - RNA, 15 nt, Mycobacterium tuberculosis H37Rv
gccauagcgccgcgc

SEQ ID NO: 3257142 - RNA, 23 nt, Mycobacterium tuberculosis H37Rv
gccauaggcccacggcagcgccg

SEQ ID NO: 3257143 - RNA, 18 nt, Mycobacterium tuberculosis H37Rv
gccauagugaggccgacc

SEQ ID NO: 3257144 - RNA, 19 nt, Mycobacterium tuberculosis H37Rv
gccauagugaggccgacca

SEQ ID NO: 3257145 - RNA, 20 nt, Mycobacterium tuberculosis H37Rv
gccauauugauuccgacccc

SEQ ID NO: 3257146 - RNA, 21 nt, Mycobacterium tuberculosis H37Rv
gccaucaacaaggggcagcac

SEQ ID NO: 3257147 - RNA, 21 nt, Mycobacterium tuberculosis H37Rv
gccaucaacgacuucgggaac

SEQ ID NO: 3257148 - RNA, 11 nt, Mycobacterium tuberculosis H37Rv
gccaucaccgc

SEQ ID NO: 3257149 - RNA, 20 nt, Mycobacterium tuberculosis H37Rv
gccaucacgacucccccggc

SEQ ID NO: 3257150 - RNA, 23 nt, Mycobacterium tuberculosis H37Rv
gccaucacggcggggaucgcugg

SEQ ID NO: 3257151 - RNA, 16 nt, Mycobacterium tuberculosis H37Rv
gccaucagaccaauga

SEQ ID NO: 3257152 - RNA, 14 nt, Mycobacterium tuberculosis H37Rv
gccaucagcccggc

SEQ ID NO: 3257153 - RNA, 19 nt, Mycobacterium tuberculosis H37Rv
gccaucagcccggcgcgcc

SEQ ID NO: 3257154 - RNA, 21 nt, Mycobacterium tuberculosis H37Rv
gccaucagcccggcgcgccga

SEQ ID NO: 3257155 - RNA, 17 nt, Mycobacterium tuberculosis H37Rv
gccaucagcccuucagc

SEQ ID NO: 3257156 - RNA, 14 nt, Mycobacterium tuberculosis H37Rv
gccaucaucgacgg

SEQ ID NO: 3257157 - RNA, 12 nt, Mycobacterium tuberculosis H37Rv
gccaucaucgcu

SEQ ID NO: 3257158 - RNA, 13 nt, Mycobacterium tuberculosis H37Rv
gccaucauggcgg

SEQ ID NO: 3257159 - RNA, 14 nt, Mycobacterium tuberculosis H37Rv
gccauccccuggcc

SEQ ID NO: 3257160 - RNA, 13 nt, Mycobacterium tuberculosis H37Rv
gccaucccgaucc

SEQ ID NO: 3257161 - RNA, 21 nt, Mycobacterium tuberculosis H37Rv
gccaucccgaucccggccagc

SEQ ID NO: 3257162 - RNA, 22 nt, Mycobacterium tuberculosis H37Rv
gccaucccgaucccggccagcu

SEQ ID NO: 3257163 - RNA, 15 nt, Mycobacterium tuberculosis H37Rv
gccaucccgccgccc

SEQ ID NO: 3257164 - RNA, 21 nt, Mycobacterium tuberculosis H37Rv
gccaucccgccgcccgcaucg

SEQ ID NO: 3257165 - RNA, 14 nt, Mycobacterium tuberculosis H37Rv
gccauccgauggcc

SEQ ID NO: 3257166 - RNA, 21 nt, Mycobacterium tuberculosis H37Rv
gccauccggucggucucggcg

SEQ ID NO: 3257167 - RNA, 15 nt, Mycobacterium tuberculosis H37Rv
gccauccgugaaucg

SEQ ID NO: 3257168 - RNA, 16 nt, Mycobacterium tuberculosis H37Rv
gccauccgugaaucga

SEQ ID NO: 3257169 - RNA, 22 nt, Mycobacterium tuberculosis H37Rv
gccauccucgaguuuggccagu

SEQ ID NO: 3257170 - RNA, 22 nt, Mycobacterium tuberculosis H37Rv
gccaucgaccguccgggucacc

SEQ ID NO: 3257171 - RNA, 15 nt, Mycobacterium tuberculosis H37Rv
gccaucgagcagcag

SEQ ID NO: 3257172 - RNA, 15 nt, Mycobacterium tuberculosis H37Rv
gccaucgaguccacc

SEQ ID NO: 3257173 - RNA, 19 nt, Mycobacterium tuberculosis H37Rv
gccaucgaugcggugaauc

SEQ ID NO: 3257174 - RNA, 14 nt, Mycobacterium tuberculosis H37Rv
gccaucgccgccgg

SEQ ID NO: 3257175 - RNA, 18 nt, Mycobacterium tuberculosis H37Rv
gccaucgccuccagccgg

SEQ ID NO: 3257176 - RNA, 21 nt, Mycobacterium tuberculosis H37Rv
gccaucgccuccagccggcga

SEQ ID NO: 3257177 - RNA, 20 nt, Mycobacterium tuberculosis H37Rv
gccaucggcuaggccggccg

SEQ ID NO: 3257178 - RNA, 13 nt, Mycobacterium tuberculosis H37Rv
gccaucgggcgcg

SEQ ID NO: 3257179 - RNA, 19 nt, Mycobacterium tuberculosis H37Rv
gccaucgggucacccccgg

SEQ ID NO: 3257180 - RNA, 17 nt, Mycobacterium tuberculosis H37Rv
gccaucgucgaagaccu

SEQ ID NO: 3257181 - RNA, 18 nt, Mycobacterium tuberculosis H37Rv
gccaucgucgaagaccuc

SEQ ID NO: 3257182 - RNA, 22 nt, Mycobacterium tuberculosis H37Rv
gccaucgucgagcgcgaaagcc

SEQ ID NO: 3257183 - RNA, 16 nt, Mycobacterium tuberculosis H37Rv
gccaucgucgcgccgc

SEQ ID NO: 3257184 - RNA, 22 nt, Mycobacterium tuberculosis H37Rv
gccaugaagccgggcgcuugca

SEQ ID NO: 3257185 - RNA, 23 nt, Mycobacterium tuberculosis H37Rv
gccaugaagccgggcgcuugcac

SEQ ID NO: 3257186 - RNA, 19 nt, Mycobacterium tuberculosis H37Rv
gccaugaucacaccgcugc

SEQ ID NO: 3257187 - RNA, 22 nt, Mycobacterium tuberculosis H37Rv
gccaugcccgcacgcucggcgg

SEQ ID NO: 3257188 - RNA, 16 nt, Mycobacterium tuberculosis H37Rv
gccaugcccucggcgc

SEQ ID NO: 3257189 - RNA, 18 nt, Mycobacterium tuberculosis H37Rv
gccaugccgcucggcaac

SEQ ID NO: 3257190 - RNA, 19 nt, Mycobacterium tuberculosis H37Rv
gccaugcgcaccaguccag

SEQ ID NO: 3257191 - RNA, 20 nt, Mycobacterium tuberculosis H37Rv
gccaugcgcaccaguccagc

SEQ ID NO: 3257192 - RNA, 21 nt, Mycobacterium tuberculosis H37Rv
gccaugcgcaccaguccagcg

SEQ ID NO: 3257193 - RNA, 14 nt, Mycobacterium tuberculosis H37Rv
gccaugcggcgcgu

SEQ ID NO: 3257194 - RNA, 22 nt, Mycobacterium tuberculosis H37Rv
gccaugcgggugucgggcagca

SEQ ID NO: 3257195 - RNA, 20 nt, Mycobacterium tuberculosis H37Rv
gccaugcuaggaccaccagc

SEQ ID NO: 3257196 - RNA, 22 nt, Mycobacterium tuberculosis H37Rv
gccaugcuaggaccaccagcgc

SEQ ID NO: 3257197 - RNA, 18 nt, Mycobacterium tuberculosis H37Rv
gccaugcucgccaaaccc

SEQ ID NO: 3257198 - RNA, 20 nt, Mycobacterium tuberculosis H37Rv
gccaugcucgucuugggccg

SEQ ID NO: 3257199 - RNA, 15 nt, Mycobacterium tuberculosis H37Rv
gccaugcugcccuug

SEQ ID NO: 3257200 - RNA, 16 nt, Mycobacterium tuberculosis H37Rv
gccaugcuggucagcg

SEQ ID NO: 3257201 - RNA, 18 nt, Mycobacterium tuberculosis H37Rv
gccaugcuggucagcggc

SEQ ID NO: 3257202 - RNA, 19 nt, Mycobacterium tuberculosis H37Rv
gccaugcuggucagcggcg

SEQ ID NO: 3257203 - RNA, 22 nt, Mycobacterium tuberculosis H37Rv
gccauggaucccacgaguuggc

SEQ ID NO: 3257204 - RNA, 17 nt, Mycobacterium tuberculosis H37Rv
gcccagauccagcaacg

SEQ ID NO: 3257205 - RNA, 18 nt, Mycobacterium tuberculosis H37Rv
gcccagcaaccgcucggc

SEQ ID NO: 3257206 - RNA, 21 nt, Mycobacterium tuberculosis H37Rv
gcccagcaaccgcucggcgau

SEQ ID NO: 3257207 - RNA, 16 nt, Mycobacterium tuberculosis H37Rv
gcccagcaaggcccga

SEQ ID NO: 3257208 - RNA, 19 nt, Mycobacterium tuberculosis H37Rv
gcccagcaccaccacccga

SEQ ID NO: 3257209 - RNA, 22 nt, Mycobacterium tuberculosis H37Rv
gcccagcaccaccgcggugugc

SEQ ID NO: 3257210 - RNA, 12 nt, Mycobacterium tuberculosis H37Rv
gcccagcagcac

SEQ ID NO: 3257211 - RNA, 19 nt, Mycobacterium tuberculosis H37Rv
gcccagcagcaccugcacc

SEQ ID NO: 3257212 - RNA, 18 nt, Mycobacterium tuberculosis H37Rv
gcccagcaggucgucggc

SEQ ID NO: 3257213 - RNA, 20 nt, Mycobacterium tuberculosis H37Rv
gcccagcaggucgucggcgu

SEQ ID NO: 3257214 - RNA, 21 nt, Mycobacterium tuberculosis H37Rv
gcccagcaucucggcggccaa

SEQ ID NO: 3257215 - RNA, 22 nt, Mycobacterium tuberculosis H37Rv
gcccagcaucucggcggccaac

SEQ ID NO: 3257216 - RNA, 13 nt, Mycobacterium tuberculosis H37Rv
gcccagccaacuc

SEQ ID NO: 3257217 - RNA, 21 nt, Mycobacterium tuberculosis H37Rv
gcccagccacugacggcuucc

SEQ ID NO: 3257218 - RNA, 13 nt, Mycobacterium tuberculosis H37Rv
gcccagcccggcg

SEQ ID NO: 3257219 - RNA, 14 nt, Mycobacterium tuberculosis H37Rv
gcccagcccggcgu

SEQ ID NO: 3257220 - RNA, 13 nt, Mycobacterium tuberculosis H37Rv
gcccagccgagcg

SEQ ID NO: 3257221 - RNA, 14 nt, Mycobacterium tuberculosis H37Rv
gcccagccgagcgg

SEQ ID NO: 3257222 - RNA, 16 nt, Mycobacterium tuberculosis H37Rv
gcccagccgagcggcg

SEQ ID NO: 3257223 - RNA, 18 nt, Mycobacterium tuberculosis H37Rv
gcccagccgagcggcggc

SEQ ID NO: 3257224 - RNA, 14 nt, Mycobacterium tuberculosis H37Rv
gcccagccgccagc

SEQ ID NO: 3257225 - RNA, 22 nt, Mycobacterium tuberculosis H37Rv
gcccagccggaaggugaggucg

SEQ ID NO: 3257226 - RNA, 16 nt, Mycobacterium tuberculosis H37Rv
gcccagccggaccgcg

SEQ ID NO: 3257227 - RNA, 21 nt, Mycobacterium tuberculosis H37Rv
gcccagccggaccgcgacggc

SEQ ID NO: 3257228 - RNA, 19 nt, Mycobacterium tuberculosis H37Rv
gcccagccggguggacacc

SEQ ID NO: 3257229 - RNA, 19 nt, Mycobacterium tuberculosis H37Rv
gcccagcgacaacaccacg

SEQ ID NO: 3257230 - RNA, 15 nt, Mycobacterium tuberculosis H37Rv
gcccagcgacccggc

SEQ ID NO: 3257231 - RNA, 19 nt, Mycobacterium tuberculosis H37Rv
gcccagcgacccggccagc

SEQ ID NO: 3257232 - RNA, 22 nt, Mycobacterium tuberculosis H37Rv
gcccagcgacccggccagcggc

SEQ ID NO: 3257233 - RNA, 16 nt, Mycobacterium tuberculosis H37Rv
gcccagcgcacggacc

SEQ ID NO: 3257234 - RNA, 19 nt, Mycobacterium tuberculosis H37Rv
gcccagcgcccgcgcggcc

SEQ ID NO: 3257235 - RNA, 16 nt, Mycobacterium tuberculosis H37Rv
gcccagcgccgaauuc

SEQ ID NO: 3257236 - RNA, 14 nt, Mycobacterium tuberculosis H37Rv
gcccagcgccucca

SEQ ID NO: 3257237 - RNA, 16 nt, Mycobacterium tuberculosis H37Rv
gcccagcgcgccagcu

SEQ ID NO: 3257238 - RNA, 13 nt, Mycobacterium tuberculosis H37Rv
gcccagcgcgcgc

SEQ ID NO: 3257239 - RNA, 14 nt, Mycobacterium tuberculosis H37Rv
gcccagcggaauca

SEQ ID NO: 3257240 - RNA, 17 nt, Mycobacterium tuberculosis H37Rv
gcccagcggaaucaccg

SEQ ID NO: 3257241 - RNA, 16 nt, Mycobacterium tuberculosis H37Rv
gcccagcggccgcgau

SEQ ID NO: 3257242 - RNA, 14 nt, Mycobacterium tuberculosis H37Rv
gcccagcggcuggu

SEQ ID NO: 3257243 - RNA, 18 nt, Mycobacterium tuberculosis H37Rv
gcccagcucgucgagcug

SEQ ID NO: 3257244 - RNA, 17 nt, Mycobacterium tuberculosis H37Rv
gcccagcugcgccgaac

SEQ ID NO: 3257245 - RNA, 16 nt, Mycobacterium tuberculosis H37Rv
gcccaggcauggccug

SEQ ID NO: 3257246 - RNA, 18 nt, Mycobacterium tuberculosis H37Rv
gcccaggccaagguggcc

SEQ ID NO: 3257247 - RNA, 23 nt, Mycobacterium tuberculosis H37Rv
gcccaggccaccggcugcaacca

SEQ ID NO: 3257248 - RNA, 15 nt, Mycobacterium tuberculosis H37Rv
gcccaggccgaucag

SEQ ID NO: 3257249 - RNA, 17 nt, Mycobacterium tuberculosis H37Rv
gcccaggccgaucagcg

SEQ ID NO: 3257250 - RNA, 23 nt, Mycobacterium tuberculosis H37Rv
gcccaggccgaucagcgcggcgc

SEQ ID NO: 3257251 - RNA, 19 nt, Mycobacterium tuberculosis H37Rv
gcccaggcgaucgcccggc

SEQ ID NO: 3257252 - RNA, 21 nt, Mycobacterium tuberculosis H37Rv
gcccaggcgaucgcccggccc

SEQ ID NO: 3257253 - RNA, 17 nt, Mycobacterium tuberculosis H37Rv
gcccaggcguccaucag

SEQ ID NO: 3257254 - RNA, 19 nt, Mycobacterium tuberculosis H37Rv
gcccaggcguccaucagag

SEQ ID NO: 3257255 - RNA, 22 nt, Mycobacterium tuberculosis H37Rv
gcccaggcguccaucagagaca

SEQ ID NO: 3257256 - RNA, 22 nt, Mycobacterium tuberculosis H37Rv
gcccaggcgugucgucgcggcc

SEQ ID NO: 3257257 - RNA, 18 nt, Mycobacterium tuberculosis H37Rv
gcccagggcgucggcgac

SEQ ID NO: 3257258 - RNA, 21 nt, Mycobacterium tuberculosis H37Rv
gcccaggguguccgucgaacc

SEQ ID NO: 3257259 - RNA, 18 nt, Mycobacterium tuberculosis H37Rv
gcccaggucaacgacguu

SEQ ID NO: 3257260 - RNA, 15 nt, Mycobacterium tuberculosis H37Rv
gcccaggucuccauc

SEQ ID NO: 3257261 - RNA, 22 nt, Mycobacterium tuberculosis H37Rv
gcccaggucuccaucaaccgcg

SEQ ID NO: 3257262 - RNA, 17 nt, Mycobacterium tuberculosis H37Rv
gcccaggugacgcccgc

SEQ ID NO: 3257263 - RNA, 15 nt, Mycobacterium tuberculosis H37Rv
gcccaggugaucgcg

SEQ ID NO: 3257264 - RNA, 20 nt, Mycobacterium tuberculosis H37Rv
gcccaggugaucgcgaggcu

SEQ ID NO: 3257265 - RNA, 15 nt, Mycobacterium tuberculosis H37Rv
gcccaggugggccga

SEQ ID NO: 3257266 - RNA, 23 nt, Mycobacterium tuberculosis H37Rv
gcccaggugggccgagagcagcc

SEQ ID NO: 3257267 - RNA, 22 nt, Mycobacterium tuberculosis H37Rv
gcccagguugauccagugcugg

SEQ ID NO: 3257268 - RNA, 14 nt, Mycobacterium tuberculosis H37Rv
gcccagguugccaa

SEQ ID NO: 3257269 - RNA, 15 nt, Mycobacterium tuberculosis H37Rv
gcccagguugccuug

SEQ ID NO: 3257270 - RNA, 23 nt, Mycobacterium tuberculosis H37Rv
gcccaguacggugguaagacgcc

SEQ ID NO: 3257271 - RNA, 15 nt, Mycobacterium tuberculosis H37Rv
gcccaguagaucgcg

SEQ ID NO: 3257272 - RNA, 13 nt, Mycobacterium tuberculosis H37Rv
gcccagucgccgc

SEQ ID NO: 3257273 - RNA, 21 nt, Mycobacterium tuberculosis H37Rv
gcccagugggacaggucggca

SEQ ID NO: 3257274 - RNA, 21 nt, Mycobacterium tuberculosis H37Rv
gcccaguguccggcgacgcgu

SEQ ID NO: 3257275 - RNA, 15 nt, Mycobacterium tuberculosis H37Rv
gcccaguuccgcugc

SEQ ID NO: 3257276 - RNA, 17 nt, Mycobacterium tuberculosis H37Rv
gcccauaacagcuggcg

SEQ ID NO: 3257277 - RNA, 22 nt, Mycobacterium tuberculosis H37Rv
gcccauaacagcuggcggcagc

SEQ ID NO: 3257278 - RNA, 22 nt, Mycobacterium tuberculosis H37Rv
gcccauaccgaugguggugcca

SEQ ID NO: 3257279 - RNA, 18 nt, Mycobacterium tuberculosis H37Rv
gcccauacgugccgccga

SEQ ID NO: 3257280 - RNA, 20 nt, Mycobacterium tuberculosis H37Rv
gcccaucgcgacuagacgcc

SEQ ID NO: 3257281 - RNA, 22 nt, Mycobacterium tuberculosis H37Rv
gcccaucgcgacuagacgccgc

SEQ ID NO: 3257282 - RNA, 14 nt, Mycobacterium tuberculosis H37Rv
gcccaucucaugca

SEQ ID NO: 3257283 - RNA, 17 nt, Mycobacterium tuberculosis H37Rv
gcccaucucaugcaucu

SEQ ID NO: 3257284 - RNA, 23 nt, Mycobacterium tuberculosis H37Rv
gcccaucucgggcaggccgucga

SEQ ID NO: 3257285 - RNA, 18 nt, Mycobacterium tuberculosis H37Rv
gcccaugaucucggcgaa

SEQ ID NO: 3257286 - RNA, 15 nt, Mycobacterium tuberculosis H37Rv
gcccaugcgccacgc

SEQ ID NO: 3257287 - RNA, 14 nt, Mycobacterium tuberculosis H37Rv
gcccauggacccau

SEQ ID NO: 3257288 - RNA, 16 nt, Mycobacterium tuberculosis H37Rv
gcccauggcagcccgu

SEQ ID NO: 3257289 - RNA, 17 nt, Mycobacterium tuberculosis H37Rv
gcccauggccaccaggg

SEQ ID NO: 3257290 - RNA, 11 nt, Mycobacterium tuberculosis H37Rv
gcccauggcgu

SEQ ID NO: 3257291 - RNA, 15 nt, Mycobacterium tuberculosis H37Rv
gcccauggcgucgaa

SEQ ID NO: 3257292 - RNA, 14 nt, Mycobacterium tuberculosis H37Rv
gcccaugucgagca

SEQ ID NO: 3257293 - RNA, 15 nt, Mycobacterium tuberculosis H37Rv
gcccaugucgagcac

SEQ ID NO: 3257294 - RNA, 17 nt, Mycobacterium tuberculosis H37Rv
gcccaugucgagcacgc

SEQ ID NO: 3257295 - RNA, 18 nt, Mycobacterium tuberculosis H37Rv
gcccaugucgagcacgcc

SEQ ID NO: 3257296 - RNA, 22 nt, Mycobacterium tuberculosis H37Rv
gcccauucauaggcccgcacga

SEQ ID NO: 3257297 - RNA, 19 nt, Mycobacterium tuberculosis H37Rv
gcccauuggguaaccagcg

SEQ ID NO: 3257298 - RNA, 21 nt, Mycobacterium tuberculosis H37Rv
gcccauuggguaaccagcgcc

SEQ ID NO: 3257299 - RNA, 23 nt, Mycobacterium tuberculosis H37Rv
gcccauugucgaucaccugcagc

SEQ ID NO: 3257300 - RNA, 14 nt, Mycobacterium tuberculosis H37Rv
gccccgccgcccuc

SEQ ID NO: 3257301 - RNA, 12 nt, Mycobacterium tuberculosis H37Rv
gccccgccggcc

SEQ ID NO: 3257302 - RNA, 13 nt, Mycobacterium tuberculosis H37Rv
gccccgccggccc

SEQ ID NO: 3257303 - RNA, 19 nt, Mycobacterium tuberculosis H37Rv
gccccgccggggccgccgu

SEQ ID NO: 3257304 - RNA, 16 nt, Mycobacterium tuberculosis H37Rv
gccccgccgucacccc

SEQ ID NO: 3257305 - RNA, 15 nt, Mycobacterium tuberculosis H37Rv
gccccgccguuaccg

SEQ ID NO: 3257306 - RNA, 17 nt, Mycobacterium tuberculosis H37Rv
gccccgccguugccgcc

SEQ ID NO: 3257307 - RNA, 13 nt, Mycobacterium tuberculosis H37Rv
gccccgcgccggc

SEQ ID NO: 3257308 - RNA, 14 nt, Mycobacterium tuberculosis H37Rv
gccccgcgccggcc

SEQ ID NO: 3257309 - RNA, 15 nt, Mycobacterium tuberculosis H37Rv
gccccgcgcguucgg

SEQ ID NO: 3257310 - RNA, 20 nt, Mycobacterium tuberculosis H37Rv
gccccgcgcguucggcgagc

SEQ ID NO: 3257311 - RNA, 14 nt, Mycobacterium tuberculosis H37Rv
gccccgcggccagc

SEQ ID NO: 3257312 - RNA, 16 nt, Mycobacterium tuberculosis H37Rv
gccccgcggccagcag

SEQ ID NO: 3257313 - RNA, 14 nt, Mycobacterium tuberculosis H37Rv
gccccgcggcgccg

SEQ ID NO: 3257314 - RNA, 15 nt, Mycobacterium tuberculosis H37Rv
gccccgcggcgccgc

SEQ ID NO: 3257315 - RNA, 17 nt, Mycobacterium tuberculosis H37Rv
gccccgcggcgccgcca

SEQ ID NO: 3257316 - RNA, 18 nt, Mycobacterium tuberculosis H37Rv
gccccgcggcgccgccac

SEQ ID NO: 3257317 - RNA, 18 nt, Mycobacterium tuberculosis H37Rv
gccccggcaagcgcagac

SEQ ID NO: 3257318 - RNA, 22 nt, Mycobacterium tuberculosis H37Rv
gccccggcaagcgcagacacga

SEQ ID NO: 3257319 - RNA, 20 nt, Mycobacterium tuberculosis H37Rv
gccccggcauugcccgagcc

SEQ ID NO: 3257320 - RNA, 14 nt, Mycobacterium tuberculosis H37Rv
gccccggccaggac

SEQ ID NO: 3257321 - RNA, 13 nt, Mycobacterium tuberculosis H37Rv
gccccggccgcug

SEQ ID NO: 3257322 - RNA, 15 nt, Mycobacterium tuberculosis H37Rv
gccccggcgcggcca

SEQ ID NO: 3257323 - RNA, 14 nt, Mycobacterium tuberculosis H37Rv
gccccggcgcuggu

SEQ ID NO: 3257324 - RNA, 14 nt, Mycobacterium tuberculosis H37Rv
gccccggcggcggc

SEQ ID NO: 3257325 - RNA, 19 nt, Mycobacterium tuberculosis H37Rv
gccccggcgguaccagagc

SEQ ID NO: 3257326 - RNA, 15 nt, Mycobacterium tuberculosis H37Rv
gccccggcucucuuc

SEQ ID NO: 3257327 - RNA, 18 nt, Mycobacterium tuberculosis H37Rv
gccccgggggaagcgcca

SEQ ID NO: 3257328 - RNA, 20 nt, Mycobacterium tuberculosis H37Rv
gccccggggguccaccuugg

SEQ ID NO: 3257329 - RNA, 11 nt, Mycobacterium tuberculosis H37Rv
gccccggucgg

SEQ ID NO: 3257330 - RNA, 16 nt, Mycobacterium tuberculosis H37Rv
gccccggucggcgacg

SEQ ID NO: 3257331 - RNA, 15 nt, Mycobacterium tuberculosis H37Rv
gccccggugccgacc

SEQ ID NO: 3257332 - RNA, 17 nt, Mycobacterium tuberculosis H37Rv
gccccgguggcagggaa

SEQ ID NO: 3257333 - RNA, 14 nt, Mycobacterium tuberculosis H37Rv
gccccgucgaccuc

SEQ ID NO: 3257334 - RNA, 21 nt, Mycobacterium tuberculosis H37Rv
gccccgugggccucgaucagc

SEQ ID NO: 3257335 - RNA, 15 nt, Mycobacterium tuberculosis H37Rv
gccccguugucgggg

SEQ ID NO: 3257336 - RNA, 20 nt, Mycobacterium tuberculosis H37Rv
gccccguuucggucgacaac

SEQ ID NO: 3257337 - RNA, 23 nt, Mycobacterium tuberculosis H37Rv
gccccucaccucggcuuugccgc

SEQ ID NO: 3257338 - RNA, 20 nt, Mycobacterium tuberculosis H37Rv
gccccuccaggggcuggugc

SEQ ID NO: 3257339 - RNA, 14 nt, Mycobacterium tuberculosis H37Rv
gccccuccgcgccg

SEQ ID NO: 3257340 - RNA, 15 nt, Mycobacterium tuberculosis H37Rv
gccccuccgcgccga

SEQ ID NO: 3257341 - RNA, 14 nt, Mycobacterium tuberculosis H37Rv
gccccucgucguca

SEQ ID NO: 3257342 - RNA, 22 nt, Mycobacterium tuberculosis H37Rv
gccccucgucgucaucgagcgg

SEQ ID NO: 3257343 - RNA, 16 nt, Mycobacterium tuberculosis H37Rv
gccccugaaggccagc

SEQ ID NO: 3257344 - RNA, 17 nt, Mycobacterium tuberculosis H37Rv
gccccugaaggccagcc

SEQ ID NO: 3257345 - RNA, 18 nt, Mycobacterium tuberculosis H37Rv
gccccugaaggccagcca

SEQ ID NO: 3257346 - RNA, 13 nt, Mycobacterium tuberculosis H37Rv
gccccugcacagc

SEQ ID NO: 3257347 - RNA, 14 nt, Mycobacterium tuberculosis H37Rv
gccccugcacagca

SEQ ID NO: 3257348 - RNA, 15 nt, Mycobacterium tuberculosis H37Rv
gccccugcacagcag

SEQ ID NO: 3257349 - RNA, 16 nt, Mycobacterium tuberculosis H37Rv
gccccugcacagcagg

SEQ ID NO: 3257350 - RNA, 21 nt, Mycobacterium tuberculosis H37Rv
gccccugcacagcaggcucga

SEQ ID NO: 3257351 - RNA, 15 nt, Mycobacterium tuberculosis H37Rv
gccccugccacgacg

SEQ ID NO: 3257352 - RNA, 16 nt, Mycobacterium tuberculosis H37Rv
gccccugccacgacga

SEQ ID NO: 3257353 - RNA, 20 nt, Mycobacterium tuberculosis H37Rv
gccccugucaacgccgcggu

SEQ ID NO: 3257354 - RNA, 23 nt, Mycobacterium tuberculosis H37Rv
gccccugucauguccugggccgc

SEQ ID NO: 3257355 - RNA, 18 nt, Mycobacterium tuberculosis H37Rv
gccccuucaaagcggccu

SEQ ID NO: 3257356 - RNA, 19 nt, Mycobacterium tuberculosis H37Rv
gccccuugaccgcugccca

SEQ ID NO: 3257357 - RNA, 15 nt, Mycobacterium tuberculosis H37Rv
gccccuuucugaagc

SEQ ID NO: 3257358 - RNA, 17 nt, Mycobacterium tuberculosis H37Rv
gccccuuuugccgcagc

SEQ ID NO: 3257359 - RNA, 18 nt, Mycobacterium tuberculosis H37Rv
gcccgaaccaccgcguug

SEQ ID NO: 3257360 - RNA, 22 nt, Mycobacterium tuberculosis H37Rv
gcccgaacgaggcgcccagcga

SEQ ID NO: 3257361 - RNA, 16 nt, Mycobacterium tuberculosis H37Rv
gcccgaacucguuggc

SEQ ID NO: 3257362 - RNA, 20 nt, Mycobacterium tuberculosis H37Rv
gcccgaacucguuggcgaac

SEQ ID NO: 3257363 - RNA, 14 nt, Mycobacterium tuberculosis H37Rv
gcccgaacuucugg

SEQ ID NO: 3257364 - RNA, 20 nt, Mycobacterium tuberculosis H37Rv
gcccgaagacgggguggugg

SEQ ID NO: 3257365 - RNA, 22 nt, Mycobacterium tuberculosis H37Rv
gcccgaagacggggugguggug

SEQ ID NO: 3257366 - RNA, 13 nt, Mycobacterium tuberculosis H37Rv
gcccgaagccggg

SEQ ID NO: 3257367 - RNA, 22 nt, Mycobacterium tuberculosis H37Rv
gcccgaaggcggcuccaccggg

SEQ ID NO: 3257368 - RNA, 15 nt, Mycobacterium tuberculosis H37Rv
gcccgaaucgccggc

SEQ ID NO: 3257369 - RNA, 19 nt, Mycobacterium tuberculosis H37Rv
gcccgaaucgccggcggcc

SEQ ID NO: 3257370 - RNA, 17 nt, Mycobacterium tuberculosis H37Rv
gcccgaaucgccugcca

SEQ ID NO: 3257371 - RNA, 14 nt, Mycobacterium tuberculosis H37Rv
gcccgaaugcggug

SEQ ID NO: 3257372 - RNA, 21 nt, Mycobacterium tuberculosis H37Rv
gcccgaaugcggugaguccgc

SEQ ID NO: 3257373 - RNA, 12 nt, Mycobacterium tuberculosis H37Rv
gcccgacacccg

SEQ ID NO: 3257374 - RNA, 17 nt, Mycobacterium tuberculosis H37Rv
gcccgacaccgccccgc

SEQ ID NO: 3257375 - RNA, 17 nt, Mycobacterium tuberculosis H37Rv
gcccgacaccguccagc

SEQ ID NO: 3257376 - RNA, 14 nt, Mycobacterium tuberculosis H37Rv
gcccgacccaucac

SEQ ID NO: 3257377 - RNA, 19 nt, Mycobacterium tuberculosis H37Rv
gcccgacccaucaccagcg

SEQ ID NO: 3257378 - RNA, 12 nt, Mycobacterium tuberculosis H37Rv
gcccgacccgcc

SEQ ID NO: 3257379 - RNA, 14 nt, Mycobacterium tuberculosis H37Rv
gcccgacccgccga

SEQ ID NO: 3257380 - RNA, 15 nt, Mycobacterium tuberculosis H37Rv
gcccgacccggccga

SEQ ID NO: 3257381 - RNA, 16 nt, Mycobacterium tuberculosis H37Rv
gcccgacccggccgau

SEQ ID NO: 3257382 - RNA, 14 nt, Mycobacterium tuberculosis H37Rv
gcccgaccgggaac

SEQ ID NO: 3257383 - RNA, 23 nt, Mycobacterium tuberculosis H37Rv
gcccgaccgggaaccacggucag

SEQ ID NO: 3257384 - RNA, 18 nt, Mycobacterium tuberculosis H37Rv
gcccgacgaacagcgguc

SEQ ID NO: 3257385 - RNA, 22 nt, Mycobacterium tuberculosis H37Rv
gcccgacgagauugccgggccg

SEQ ID NO: 3257386 - RNA, 22 nt, Mycobacterium tuberculosis H37Rv
gcccgacgagucgccgcgggca

SEQ ID NO: 3257387 - RNA, 16 nt, Mycobacterium tuberculosis H37Rv
gcccgacgccagcugc

SEQ ID NO: 3257388 - RNA, 17 nt, Mycobacterium tuberculosis H37Rv
gcccgacgccagcugcc

SEQ ID NO: 3257389 - RNA, 17 nt, Mycobacterium tuberculosis H37Rv
gcccgacgcguggcauc

SEQ ID NO: 3257390 - RNA, 19 nt, Mycobacterium tuberculosis H37Rv
gcccgacggcgcccagcgc

SEQ ID NO: 3257391 - RNA, 18 nt, Mycobacterium tuberculosis H37Rv
gcccgacggguaucccgu

SEQ ID NO: 3257392 - RNA, 23 nt, Mycobacterium tuberculosis H37Rv
gcccgacgugaagccaagcgacu

SEQ ID NO: 3257393 - RNA, 18 nt, Mycobacterium tuberculosis H37Rv
gcccgacugccguucagc

SEQ ID NO: 3257394 - RNA, 21 nt, Mycobacterium tuberculosis H37Rv
gcccgacugccguucagcggc

SEQ ID NO: 3257395 - RNA, 14 nt, Mycobacterium tuberculosis H37Rv
gcccgacuggucac

SEQ ID NO: 3257396 - RNA, 21 nt, Mycobacterium tuberculosis H37Rv
gcccgagaccggcaccggccg

SEQ ID NO: 3257397 - RNA, 17 nt, Mycobacterium tuberculosis H37Rv
gcccgccgacgccagau

SEQ ID NO: 3257398 - RNA, 18 nt, Mycobacterium tuberculosis H37Rv
gcccgccgccaccagcug

SEQ ID NO: 3257399 - RNA, 15 nt, Mycobacterium tuberculosis H37Rv
gcccgccgcgaccac

SEQ ID NO: 3257400 - RNA, 16 nt, Mycobacterium tuberculosis H37Rv
gcccgccgcgaccacg

SEQ ID NO: 3257401 - RNA, 13 nt, Mycobacterium tuberculosis H37Rv
gcccgccgcguca

SEQ ID NO: 3257402 - RNA, 16 nt, Mycobacterium tuberculosis H37Rv
gcccgccggacccgcc

SEQ ID NO: 3257403 - RNA, 19 nt, Mycobacterium tuberculosis H37Rv
gcccgccggacccgcccuu

SEQ ID NO: 3257404 - RNA, 13 nt, Mycobacterium tuberculosis H37Rv
gcccgccggcaac

SEQ ID NO: 3257405 - RNA, 15 nt, Mycobacterium tuberculosis H37Rv
gcccgccggcaguga

SEQ ID NO: 3257406 - RNA, 13 nt, Mycobacterium tuberculosis H37Rv
gcccgccggcccc

SEQ ID NO: 3257407 - RNA, 15 nt, Mycobacterium tuberculosis H37Rv
gcccgccggccccgc

SEQ ID NO: 3257408 - RNA, 14 nt, Mycobacterium tuberculosis H37Rv
gcccgccggccucu

SEQ ID NO: 3257409 - RNA, 15 nt, Mycobacterium tuberculosis H37Rv
gcccgccguagacca

SEQ ID NO: 3257410 - RNA, 13 nt, Mycobacterium tuberculosis H37Rv
gcccgccgucacc

SEQ ID NO: 3257411 - RNA, 14 nt, Mycobacterium tuberculosis H37Rv
gcccgccguccggc

SEQ ID NO: 3257412 - RNA, 18 nt, Mycobacterium tuberculosis H37Rv
gcccgccguccggcgccc

SEQ ID NO: 3257413 - RNA, 17 nt, Mycobacterium tuberculosis H37Rv
gcccgccgucuuggccc

SEQ ID NO: 3257414 - RNA, 14 nt, Mycobacterium tuberculosis H37Rv
gcccgccguuacgg

SEQ ID NO: 3257415 - RNA, 22 nt, Mycobacterium tuberculosis H37Rv
gcccgccguuacggagggcacg

SEQ ID NO: 3257416 - RNA, 16 nt, Mycobacterium tuberculosis H37Rv
gcccgccucaucggca

SEQ ID NO: 3257417 - RNA, 17 nt, Mycobacterium tuberculosis H37Rv
gcccgccucaucggcaa

SEQ ID NO: 3257418 - RNA, 15 nt, Mycobacterium tuberculosis H37Rv
gcccgccucgaccgc

SEQ ID NO: 3257419 - RNA, 17 nt, Mycobacterium tuberculosis H37Rv
gcccgccucgaccgcca

SEQ ID NO: 3257420 - RNA, 20 nt, Mycobacterium tuberculosis H37Rv
gcccgccucgaccgccagcc

SEQ ID NO: 3257421 - RNA, 15 nt, Mycobacterium tuberculosis H37Rv
gcccgccucgcagcg

SEQ ID NO: 3257422 - RNA, 20 nt, Mycobacterium tuberculosis H37Rv
gcccgccucugucuucagcu

SEQ ID NO: 3257423 - RNA, 15 nt, Mycobacterium tuberculosis H37Rv
gcccgccugaccgcc

SEQ ID NO: 3257424 - RNA, 20 nt, Mycobacterium tuberculosis H37Rv
gcccgccugaccgccaccgu

SEQ ID NO: 3257425 - RNA, 14 nt, Mycobacterium tuberculosis H37Rv
gcccgcgagcugua

SEQ ID NO: 3257426 - RNA, 13 nt, Mycobacterium tuberculosis H37Rv
gcccgcgaucggg

SEQ ID NO: 3257427 - RNA, 16 nt, Mycobacterium tuberculosis H37Rv
gcccgcgaucgggccg

SEQ ID NO: 3257428 - RNA, 17 nt, Mycobacterium tuberculosis H37Rv
gcccgcgaucgggccga

SEQ ID NO: 3257429 - RNA, 20 nt, Mycobacterium tuberculosis H37Rv
gcccgcgcagcacugcggca

SEQ ID NO: 3257430 - RNA, 23 nt, Mycobacterium tuberculosis H37Rv
gcccgcgccaccagcaccgccgc

SEQ ID NO: 3257431 - RNA, 15 nt, Mycobacterium tuberculosis H37Rv
gcccgcgccaccggc

SEQ ID NO: 3257432 - RNA, 16 nt, Mycobacterium tuberculosis H37Rv
gcccgcgccgccgcca

SEQ ID NO: 3257433 - RNA, 17 nt, Mycobacterium tuberculosis H37Rv
gcccgcgccgccgccac

SEQ ID NO: 3257434 - RNA, 18 nt, Mycobacterium tuberculosis H37Rv
gcccgcgccgccgccacc

SEQ ID NO: 3257435 - RNA, 23 nt, Mycobacterium tuberculosis H37Rv
gcccgcgcggccaaucagcccgc

SEQ ID NO: 3257436 - RNA, 14 nt, Mycobacterium tuberculosis H37Rv
gcccgcgcggcggu

SEQ ID NO: 3257437 - RNA, 21 nt, Mycobacterium tuberculosis H37Rv
gcccgcgcguacccgaucagc

SEQ ID NO: 3257438 - RNA, 15 nt, Mycobacterium tuberculosis H37Rv
gcccgcgcucgcacc

SEQ ID NO: 3257439 - RNA, 16 nt, Mycobacterium tuberculosis H37Rv
gcccgcgcucggcaug

SEQ ID NO: 3257440 - RNA, 13 nt, Mycobacterium tuberculosis H37Rv
gcccgcgggauca

SEQ ID NO: 3257441 - RNA, 15 nt, Mycobacterium tuberculosis H37Rv
gcccgcgggaucagc

SEQ ID NO: 3257442 - RNA, 20 nt, Mycobacterium tuberculosis H37Rv
gcccgcgggcaagccggaca

SEQ ID NO: 3257443 - RNA, 17 nt, Mycobacterium tuberculosis H37Rv
gcccgcgggcgguaauc

SEQ ID NO: 3257444 - RNA, 21 nt, Mycobacterium tuberculosis H37Rv
gcccgcgggcgguaaucgcga

SEQ ID NO: 3257445 - RNA, 18 nt, Mycobacterium tuberculosis H37Rv
gcccgcgguccggcgaaa

SEQ ID NO: 3257446 - RNA, 13 nt, Mycobacterium tuberculosis H37Rv
gcccgcgucgacg

SEQ ID NO: 3257447 - RNA, 20 nt, Mycobacterium tuberculosis H37Rv
gcccgcgugacgcuuggcca

SEQ ID NO: 3257448 - RNA, 17 nt, Mycobacterium tuberculosis H37Rv
gcccgcgugcgcauccc

SEQ ID NO: 3257449 - RNA, 20 nt, Mycobacterium tuberculosis H37Rv
gcccgcgugcgcaucccgaa

SEQ ID NO: 3257450 - RNA, 13 nt, Mycobacterium tuberculosis H37Rv
gcccgcguucagg

SEQ ID NO: 3257451 - RNA, 18 nt, Mycobacterium tuberculosis H37Rv
gcccgcguucagggcacg

SEQ ID NO: 3257452 - RNA, 22 nt, Mycobacterium tuberculosis H37Rv
gcccgcguugccaaagcccaca

SEQ ID NO: 3257453 - RNA, 23 nt, Mycobacterium tuberculosis H37Rv
gcccgcguuugcgaagcccacgu

SEQ ID NO: 3257454 - RNA, 16 nt, Mycobacterium tuberculosis H37Rv
gcccgcuacggcagcc

SEQ ID NO: 3257455 - RNA, 15 nt, Mycobacterium tuberculosis H37Rv
gcccgcucaccuugg

SEQ ID NO: 3257456 - RNA, 14 nt, Mycobacterium tuberculosis H37Rv
gcccgcuccgggac

SEQ ID NO: 3257457 - RNA, 20 nt, Mycobacterium tuberculosis H37Rv
gcccgcuccuccggcaccaa

SEQ ID NO: 3257458 - RNA, 20 nt, Mycobacterium tuberculosis H37Rv
gcccgcuccugcucgucgag

SEQ ID NO: 3257459 - RNA, 21 nt, Mycobacterium tuberculosis H37Rv
gcccgcuccugcucgucgagc

SEQ ID NO: 3257460 - RNA, 15 nt, Mycobacterium tuberculosis H37Rv
gcccgcucgaucggc

SEQ ID NO: 3257461 - RNA, 17 nt, Mycobacterium tuberculosis H37Rv
gcccgcucgaucggcag

SEQ ID NO: 3257462 - RNA, 13 nt, Mycobacterium tuberculosis H37Rv
gcccgcucgaugu

SEQ ID NO: 3257463 - RNA, 13 nt, Mycobacterium tuberculosis H37Rv
gcccgcucggccg

SEQ ID NO: 3257464 - RNA, 14 nt, Mycobacterium tuberculosis H37Rv
gcccgcucggccgc

SEQ ID NO: 3257465 - RNA, 17 nt, Mycobacterium tuberculosis H37Rv
gcccgcucggccgcagc

SEQ ID NO: 3257466 - RNA, 13 nt, Mycobacterium tuberculosis H37Rv
gcccgcugagcac

SEQ ID NO: 3257467 - RNA, 13 nt, Mycobacterium tuberculosis H37Rv
gcccgcugagcca

SEQ ID NO: 3257468 - RNA, 15 nt, Mycobacterium tuberculosis H37Rv
gcccgcugagccagc

SEQ ID NO: 3257469 - RNA, 20 nt, Mycobacterium tuberculosis H37Rv
gcccgcugaucagauccucg

SEQ ID NO: 3257470 - RNA, 14 nt, Mycobacterium tuberculosis H37Rv
gcccgcugcagacg

SEQ ID NO: 3257471 - RNA, 19 nt, Mycobacterium tuberculosis H37Rv
gcccgcugcgccgggucug

SEQ ID NO: 3257472 - RNA, 13 nt, Mycobacterium tuberculosis H37Rv
gcccgcugcgcgg

SEQ ID NO: 3257473 - RNA, 16 nt, Mycobacterium tuberculosis H37Rv
gcccgcugcgcggccc

SEQ ID NO: 3257474 - RNA, 23 nt, Mycobacterium tuberculosis H37Rv
gcccgcugcgcggcccgcaucgu

SEQ ID NO: 3257475 - RNA, 11 nt, Mycobacterium tuberculosis H37Rv
gcccgcuggcc

SEQ ID NO: 3257476 - RNA, 18 nt, Mycobacterium tuberculosis H37Rv
gcccgcuggccuccugga

SEQ ID NO: 3257477 - RNA, 18 nt, Mycobacterium tuberculosis H37Rv
gcccgcugggcucgcugc

SEQ ID NO: 3257478 - RNA, 19 nt, Mycobacterium tuberculosis H37Rv
gcccgcugggcuuggggcc

SEQ ID NO: 3257479 - RNA, 18 nt, Mycobacterium tuberculosis H37Rv
gcccggaaccggcgugca

SEQ ID NO: 3257480 - RNA, 22 nt, Mycobacterium tuberculosis H37Rv
gcccggaaccggcgugcagcac

SEQ ID NO: 3257481 - RNA, 17 nt, Mycobacterium tuberculosis H37Rv
gcccggaauguagucca

SEQ ID NO: 3257482 - RNA, 23 nt, Mycobacterium tuberculosis H37Rv
gcccggaauguaguccagcucgc

SEQ ID NO: 3257483 - RNA, 21 nt, Mycobacterium tuberculosis H37Rv
gcccggacaugcgggcagcac

SEQ ID NO: 3257484 - RNA, 20 nt, Mycobacterium tuberculosis H37Rv
gcccggaccacuguuggugc

SEQ ID NO: 3257485 - RNA, 17 nt, Mycobacterium tuberculosis H37Rv
gcccggacgauggcguc

SEQ ID NO: 3257486 - RNA, 18 nt, Mycobacterium tuberculosis H37Rv
gcccggacgauggcgucg

SEQ ID NO: 3257487 - RNA, 22 nt, Mycobacterium tuberculosis H37Rv
gcccggacgauggcgucggcca

SEQ ID NO: 3257488 - RNA, 15 nt, Mycobacterium tuberculosis H37Rv
gcccggacgucggcg

SEQ ID NO: 3257489 - RNA, 21 nt, Mycobacterium tuberculosis H37Rv
gcccggacugaucgucugaau

SEQ ID NO: 3257490 - RNA, 15 nt, Mycobacterium tuberculosis H37Rv
gcccggagcggucag

SEQ ID NO: 3257491 - RNA, 10 nt, Mycobacterium tuberculosis H37Rv
gcccggaucu

SEQ ID NO: 3257492 - RNA, 18 nt, Mycobacterium tuberculosis H37Rv
gcccggauguccgccgac

SEQ ID NO: 3257493 - RNA, 22 nt, Mycobacterium tuberculosis H37Rv
gcccggcaaugaucaucccggc

SEQ ID NO: 3257494 - RNA, 13 nt, Mycobacterium tuberculosis H37Rv
gcccgguggugcu

SEQ ID NO: 3257495 - RNA, 19 nt, Mycobacterium tuberculosis H37Rv
gcccggugugcugcacggc

SEQ ID NO: 3257496 - RNA, 18 nt, Mycobacterium tuberculosis H37Rv
gcccgguucagcgcuggc

SEQ ID NO: 3257497 - RNA, 15 nt, Mycobacterium tuberculosis H37Rv
gcccgguugaccgcc

SEQ ID NO: 3257498 - RNA, 21 nt, Mycobacterium tuberculosis H37Rv
gcccgguugcggucagacgcc

SEQ ID NO: 3257499 - RNA, 16 nt, Mycobacterium tuberculosis H37Rv
gcccgguugggugugc

SEQ ID NO: 3257500 - RNA, 16 nt, Mycobacterium tuberculosis H37Rv
gcccguagacccacag

SEQ ID NO: 3257501 - RNA, 15 nt, Mycobacterium tuberculosis H37Rv
gcccguagccgagcu

SEQ ID NO: 3257502 - RNA, 15 nt, Mycobacterium tuberculosis H37Rv
gcccguagcguccgc

SEQ ID NO: 3257503 - RNA, 18 nt, Mycobacterium tuberculosis H37Rv
gcccguagcgucgaucac

SEQ ID NO: 3257504 - RNA, 19 nt, Mycobacterium tuberculosis H37Rv
gcccguagcgucgaucacg

SEQ ID NO: 3257505 - RNA, 18 nt, Mycobacterium tuberculosis H37Rv
gcccguauaaccggccau

SEQ ID NO: 3257506 - RNA, 16 nt, Mycobacterium tuberculosis H37Rv
gcccgucacaaugccc

SEQ ID NO: 3257507 - RNA, 13 nt, Mycobacterium tuberculosis H37Rv
gcccgucacgccc

SEQ ID NO: 3257508 - RNA, 13 nt, Mycobacterium tuberculosis H37Rv
gcccgucaucgcg

SEQ ID NO: 3257509 - RNA, 18 nt, Mycobacterium tuberculosis H37Rv
gcccguccaggcgcugca

SEQ ID NO: 3257510 - RNA, 15 nt, Mycobacterium tuberculosis H37Rv
gcccgucccgccggc

SEQ ID NO: 3257511 - RNA, 18 nt, Mycobacterium tuberculosis H37Rv
gcccgucccgccggcccc

SEQ ID NO: 3257512 - RNA, 17 nt, Mycobacterium tuberculosis H37Rv
gcccguccucgucggug

SEQ ID NO: 3257513 - RNA, 22 nt, Mycobacterium tuberculosis H37Rv
gcccguccucgucggugugcca

SEQ ID NO: 3257514 - RNA, 22 nt, Mycobacterium tuberculosis H37Rv
gcccguccugcggguaggugac

SEQ ID NO: 3257515 - RNA, 20 nt, Mycobacterium tuberculosis H37Rv
gcccgucgcgucgaccggac

SEQ ID NO: 3257516 - RNA, 22 nt, Mycobacterium tuberculosis H37Rv
gcccgucgcugggaggcgcggu

SEQ ID NO: 3257517 - RNA, 18 nt, Mycobacterium tuberculosis H37Rv
gcccgucggcgccgaaca

SEQ ID NO: 3257518 - RNA, 13 nt, Mycobacterium tuberculosis H37Rv
gcccgucgggccg

SEQ ID NO: 3257519 - RNA, 19 nt, Mycobacterium tuberculosis H37Rv
gcccgucgucgucgacacg

SEQ ID NO: 3257520 - RNA, 19 nt, Mycobacterium tuberculosis H37Rv
gcccgucgucgugcacgac

SEQ ID NO: 3257521 - RNA, 16 nt, Mycobacterium tuberculosis H37Rv
gcccgucgugaccgac

SEQ ID NO: 3257522 - RNA, 16 nt, Mycobacterium tuberculosis H37Rv
gcccgucuccagcacc

SEQ ID NO: 3257523 - RNA, 15 nt, Mycobacterium tuberculosis H37Rv
gcccgucucguugac

SEQ ID NO: 3257524 - RNA, 15 nt, Mycobacterium tuberculosis H37Rv
gcccgucuuccagcc

SEQ ID NO: 3257525 - RNA, 15 nt, Mycobacterium tuberculosis H37Rv
gcccgugacugguga

SEQ ID NO: 3257526 - RNA, 16 nt, Mycobacterium tuberculosis H37Rv
gcccgugacuggugaa

SEQ ID NO: 3257527 - RNA, 14 nt, Mycobacterium tuberculosis H37Rv
gcccgugccacagc

SEQ ID NO: 3257528 - RNA, 14 nt, Mycobacterium tuberculosis H37Rv
gcccgugccgcccu

SEQ ID NO: 3257529 - RNA, 15 nt, Mycobacterium tuberculosis H37Rv
gcccgugccgcccuc

SEQ ID NO: 3257530 - RNA, 14 nt, Mycobacterium tuberculosis H37Rv
gcccgugcgaugca

SEQ ID NO: 3257531 - RNA, 16 nt, Mycobacterium tuberculosis H37Rv
gcccguggcggugagc

SEQ ID NO: 3257532 - RNA, 16 nt, Mycobacterium tuberculosis H37Rv
gcccguggucgaucau

SEQ ID NO: 3257533 - RNA, 21 nt, Mycobacterium tuberculosis H37Rv
gcccguggucgaucaugacga

SEQ ID NO: 3257534 - RNA, 21 nt, Mycobacterium tuberculosis H37Rv
gcccguggugauggucgugau

SEQ ID NO: 3257535 - RNA, 18 nt, Mycobacterium tuberculosis H37Rv
gcccguguuaaagaagcc

SEQ ID NO: 3257536 - RNA, 19 nt, Mycobacterium tuberculosis H37Rv
gcccguguuaaagaagccu

SEQ ID NO: 3257537 - RNA, 18 nt, Mycobacterium tuberculosis H37Rv
gcccguguugaagaagcc

SEQ ID NO: 3257538 - RNA, 18 nt, Mycobacterium tuberculosis H37Rv
gcccguucaugcggcggc

SEQ ID NO: 3257539 - RNA, 19 nt, Mycobacterium tuberculosis H37Rv
gcccguucaugcggcggcg

SEQ ID NO: 3257540 - RNA, 22 nt, Mycobacterium tuberculosis H37Rv
gcccguucgaaguucucggugc

SEQ ID NO: 3257541 - RNA, 15 nt, Mycobacterium tuberculosis H37Rv
gcccguucgugccgu

SEQ ID NO: 3257542 - RNA, 18 nt, Mycobacterium tuberculosis H37Rv
gcccguucucgcggccga

SEQ ID NO: 3257543 - RNA, 15 nt, Mycobacterium tuberculosis H37Rv
gcccguucugcccag

SEQ ID NO: 3257544 - RNA, 16 nt, Mycobacterium tuberculosis H37Rv
gcccguucugcccagg

SEQ ID NO: 3257545 - RNA, 17 nt, Mycobacterium tuberculosis H37Rv
gcccguuggcagcacag

SEQ ID NO: 3257546 - RNA, 23 nt, Mycobacterium tuberculosis H37Rv
gcccguuguccagaacggcgauc

SEQ ID NO: 3257547 - RNA, 17 nt, Mycobacterium tuberculosis H37Rv
gcccguuuccucagcug

SEQ ID NO: 3257548 - RNA, 15 nt, Mycobacterium tuberculosis H37Rv
gcccguuugccgguu

SEQ ID NO: 3257549 - RNA, 17 nt, Mycobacterium tuberculosis H37Rv
gcccuaacccugcccua

SEQ ID NO: 3257550 - RNA, 16 nt, Mycobacterium tuberculosis H37Rv
gcccuagccggcgcgc

SEQ ID NO: 3257551 - RNA, 18 nt, Mycobacterium tuberculosis H37Rv
gcccuagccggcgcgccc

SEQ ID NO: 3257552 - RNA, 14 nt, Mycobacterium tuberculosis H37Rv
gcccuaucagccga

SEQ ID NO: 3257553 - RNA, 15 nt, Mycobacterium tuberculosis H37Rv
gcccuauggguuccu

SEQ ID NO: 3257554 - RNA, 15 nt, Mycobacterium tuberculosis H37Rv
gcccucacgccaagu

SEQ ID NO: 3257555 - RNA, 12 nt, Mycobacterium tuberculosis H37Rv
gcccucagccgc

SEQ ID NO: 3257556 - RNA, 15 nt, Mycobacterium tuberculosis H37Rv
gcccucagccgcggc

SEQ ID NO: 3257557 - RNA, 16 nt, Mycobacterium tuberculosis H37Rv
gcccucagcuagcgcg

SEQ ID NO: 3257558 - RNA, 20 nt, Mycobacterium tuberculosis H37Rv
gcccucaguucacgcucgac

SEQ ID NO: 3257559 - RNA, 18 nt, Mycobacterium tuberculosis H37Rv
gcccucaguucacguucg

SEQ ID NO: 3257560 - RNA, 23 nt, Mycobacterium tuberculosis H37Rv
gcccucaguucacguucggcgac

SEQ ID NO: 3257561 - RNA, 13 nt, Mycobacterium tuberculosis H37Rv
gcccuccaccggu

SEQ ID NO: 3257562 - RNA, 22 nt, Mycobacterium tuberculosis H37Rv
gcccuccacugcgagcgccggc

SEQ ID NO: 3257563 - RNA, 23 nt, Mycobacterium tuberculosis H37Rv
gcccuccagggcccugcuggccc

SEQ ID NO: 3257564 - RNA, 17 nt, Mycobacterium tuberculosis H37Rv
gcccucccgggcccgcu

SEQ ID NO: 3257565 - RNA, 21 nt, Mycobacterium tuberculosis H37Rv
gcccucccgggcccgcugggc

SEQ ID NO: 3257566 - RNA, 15 nt, Mycobacterium tuberculosis H37Rv
gcccuccgagcacag

SEQ ID NO: 3257567 - RNA, 15 nt, Mycobacterium tuberculosis H37Rv
gcccuccggcgcagc

SEQ ID NO: 3257568 - RNA, 20 nt, Mycobacterium tuberculosis H37Rv
gcccuccggguauggcggcg

SEQ ID NO: 3257569 - RNA, 22 nt, Mycobacterium tuberculosis H37Rv
gcccuccggguauggcggcgac

SEQ ID NO: 3257570 - RNA, 19 nt, Mycobacterium tuberculosis H37Rv
gcccucgaauucggccggc

SEQ ID NO: 3257571 - RNA, 14 nt, Mycobacterium tuberculosis H37Rv
gcccucgacgccgc

SEQ ID NO: 3257572 - RNA, 16 nt, Mycobacterium tuberculosis H37Rv
gcccucgacgccgcgc

SEQ ID NO: 3257573 - RNA, 17 nt, Mycobacterium tuberculosis H37Rv
gcccucgacgccgcgca

SEQ ID NO: 3257574 - RNA, 19 nt, Mycobacterium tuberculosis H37Rv
gcccucgacgccgcgcagc

SEQ ID NO: 3257575 - RNA, 14 nt, Mycobacterium tuberculosis H37Rv
gcccucgacgcgcu

SEQ ID NO: 3257576 - RNA, 15 nt, Mycobacterium tuberculosis H37Rv
gcccucgauggccag

SEQ ID NO: 3257577 - RNA, 21 nt, Mycobacterium tuberculosis H37Rv
gcccucgccauggcguucugc

SEQ ID NO: 3257578 - RNA, 17 nt, Mycobacterium tuberculosis H37Rv
gcccucgccuucgccgc

SEQ ID NO: 3257579 - RNA, 21 nt, Mycobacterium tuberculosis H37Rv
gcccucgcuaauugcggccgc

SEQ ID NO: 3257580 - RNA, 21 nt, Mycobacterium tuberculosis H37Rv
gcccucggccgccugacggua

SEQ ID NO: 3257581 - RNA, 23 nt, Mycobacterium tuberculosis H37Rv
gcccucggcggagacggcggcca

SEQ ID NO: 3257582 - RNA, 20 nt, Mycobacterium tuberculosis H37Rv
gcccucgggacggccgccgc

SEQ ID NO: 3257583 - RNA, 14 nt, Mycobacterium tuberculosis H37Rv
gcccucgggacugc

SEQ ID NO: 3257584 - RNA, 17 nt, Mycobacterium tuberculosis H37Rv
gcccucgucgaucgccg

SEQ ID NO: 3257585 - RNA, 21 nt, Mycobacterium tuberculosis H37Rv
gcccucgucgcgggccaccgc

SEQ ID NO: 3257586 - RNA, 23 nt, Mycobacterium tuberculosis H37Rv
gcccucguuaucgaccgccgcga

SEQ ID NO: 3257587 - RNA, 18 nt, Mycobacterium tuberculosis H37Rv
gcccugaagggccgccuc

SEQ ID NO: 3257588 - RNA, 19 nt, Mycobacterium tuberculosis H37Rv
gcccugacacaacaccggc

SEQ ID NO: 3257589 - RNA, 20 nt, Mycobacterium tuberculosis H37Rv
gcccugacgccccgccacaa

SEQ ID NO: 3257590 - RNA, 21 nt, Mycobacterium tuberculosis H37Rv
gccgaacgccucugcgaucag

SEQ ID NO: 3257591 - RNA, 18 nt, Mycobacterium tuberculosis H37Rv
gccgaacgggucggcgac

SEQ ID NO: 3257592 - RNA, 15 nt, Mycobacterium tuberculosis H37Rv
gccgaacgguugcuc

SEQ ID NO: 3257593 - RNA, 19 nt, Mycobacterium tuberculosis H37Rv
gccgaacgucgcggccagc

SEQ ID NO: 3257594 - RNA, 22 nt, Mycobacterium tuberculosis H37Rv
gccgaacuaucguugugcggac

SEQ ID NO: 3257595 - RNA, 24 nt, Mycobacterium tuberculosis H37Rv
gccgaacucaacgacaccauaggc

SEQ ID NO: 3257596 - RNA, 12 nt, Mycobacterium tuberculosis H37Rv
gccgaacuccgc

SEQ ID NO: 3257597 - RNA, 15 nt, Mycobacterium tuberculosis H37Rv
gccgaacuccgcgga

SEQ ID NO: 3257598 - RNA, 15 nt, Mycobacterium tuberculosis H37Rv
gccgaacugccgcgc

SEQ ID NO: 3257599 - RNA, 19 nt, Mycobacterium tuberculosis H37Rv
gccgaagaacucaaagacc

SEQ ID NO: 3257600 - RNA, 19 nt, Mycobacterium tuberculosis H37Rv
gccgaagcccccgacguug

SEQ ID NO: 3257601 - RNA, 12 nt, Mycobacterium tuberculosis H37Rv
gccgaagcccga

SEQ ID NO: 3257602 - RNA, 19 nt, Mycobacterium tuberculosis H37Rv
gccgaagcccgaucggcgg

SEQ ID NO: 3257603 - RNA, 16 nt, Mycobacterium tuberculosis H37Rv
gccgaagccgaagggg

SEQ ID NO: 3257604 - RNA, 13 nt, Mycobacterium tuberculosis H37Rv
gccgaagccgcgc

SEQ ID NO: 3257605 - RNA, 13 nt, Mycobacterium tuberculosis H37Rv
gccgaagccggac

SEQ ID NO: 3257606 - RNA, 21 nt, Mycobacterium tuberculosis H37Rv
gccgaagccuugcagcgcccc

SEQ ID NO: 3257607 - RNA, 14 nt, Mycobacterium tuberculosis H37Rv
gccgaagcgcccgu

SEQ ID NO: 3257608 - RNA, 19 nt, Mycobacterium tuberculosis H37Rv
gccgaagcgcccguuggcc

SEQ ID NO: 3257609 - RNA, 22 nt, Mycobacterium tuberculosis H37Rv
gccgaagcgcccguuggccaag

SEQ ID NO: 3257610 - RNA, 21 nt, Mycobacterium tuberculosis H37Rv
gccgaagcggccaccgccgcc

SEQ ID NO: 3257611 - RNA, 13 nt, Mycobacterium tuberculosis H37Rv
gccgaagcgggcc

SEQ ID NO: 3257612 - RNA, 14 nt, Mycobacterium tuberculosis H37Rv
gccgaagcucaucg

SEQ ID NO: 3257613 - RNA, 15 nt, Mycobacterium tuberculosis H37Rv
gccgaagcugcccaa

SEQ ID NO: 3257614 - RNA, 21 nt, Mycobacterium tuberculosis H37Rv
gccgaaggauuuggagcuuuu

SEQ ID NO: 3257615 - RNA, 15 nt, Mycobacterium tuberculosis H37Rv
gccgaaggcggggga

SEQ ID NO: 3257616 - RNA, 22 nt, Mycobacterium tuberculosis H37Rv
gccgaaguugaagaagccagag

SEQ ID NO: 3257617 - RNA, 18 nt, Mycobacterium tuberculosis H37Rv
gccgaaguugaugucgcg

SEQ ID NO: 3257618 - RNA, 23 nt, Mycobacterium tuberculosis H37Rv
gccgaaguuuuggaagcccgaau

SEQ ID NO: 3257619 - RNA, 14 nt, Mycobacterium tuberculosis H37Rv
gccgaauaccacac

SEQ ID NO: 3257620 - RNA, 17 nt, Mycobacterium tuberculosis H37Rv
gccgaauaccacaccgu

SEQ ID NO: 3257621 - RNA, 19 nt, Mycobacterium tuberculosis H37Rv
gccgaauaccacaccguga

SEQ ID NO: 3257622 - RNA, 21 nt, Mycobacterium tuberculosis H37Rv
gccgaauaccgguggcagccu

SEQ ID NO: 3257623 - RNA, 14 nt, Mycobacterium tuberculosis H37Rv
gccgaaucccgcga

SEQ ID NO: 3257624 - RNA, 17 nt, Mycobacterium tuberculosis H37Rv
gccgaaucgcugaccgc

SEQ ID NO: 3257625 - RNA, 21 nt, Mycobacterium tuberculosis H37Rv
gccgacaaccccgccaggauc

SEQ ID NO: 3257626 - RNA, 22 nt, Mycobacterium tuberculosis H37Rv
gccgacaacccggccgggccug

SEQ ID NO: 3257627 - RNA, 18 nt, Mycobacterium tuberculosis H37Rv
gccgacaaccuuggcgac

SEQ ID NO: 3257628 - RNA, 17 nt, Mycobacterium tuberculosis H37Rv
gccgacaacgacgucgc

SEQ ID NO: 3257629 - RNA, 21 nt, Mycobacterium tuberculosis H37Rv
gccgacaacgacgucgccgac

SEQ ID NO: 3257630 - RNA, 23 nt, Mycobacterium tuberculosis H37Rv
gccgacaacgacgucgccgaccc

SEQ ID NO: 3257631 - RNA, 15 nt, Mycobacterium tuberculosis H37Rv
gccgacaagucaaga

SEQ ID NO: 3257632 - RNA, 16 nt, Mycobacterium tuberculosis H37Rv
gccgacaagucaagau

SEQ ID NO: 3257633 - RNA, 19 nt, Mycobacterium tuberculosis H37Rv
gccgacaauggcagcgaga

SEQ ID NO: 3257634 - RNA, 18 nt, Mycobacterium tuberculosis H37Rv
gccgacaaugucggcgau

SEQ ID NO: 3257635 - RNA, 13 nt, Mycobacterium tuberculosis H37Rv
gccgacaccaccg

SEQ ID NO: 3257636 - RNA, 16 nt, Mycobacterium tuberculosis H37Rv
gccgacaccacggcgc

SEQ ID NO: 3257637 - RNA, 18 nt, Mycobacterium tuberculosis H37Rv
gccgacaccacggcgcgc

SEQ ID NO: 3257638 - RNA, 23 nt, Mycobacterium tuberculosis H37Rv
gccgacacccucgggcaacucgg

SEQ ID NO: 3257639 - RNA, 18 nt, Mycobacterium tuberculosis H37Rv
gccgacaccgccaccacg

SEQ ID NO: 3257640 - RNA, 22 nt, Mycobacterium tuberculosis H37Rv
gccgacaccgccaccacgccgu

SEQ ID NO: 3257641 - RNA, 16 nt, Mycobacterium tuberculosis H37Rv
gccgacacgaacgcug

SEQ ID NO: 3257642 - RNA, 23 nt, Mycobacterium tuberculosis H37Rv
gccgacaguuuaccgugccgccc

SEQ ID NO: 3257643 - RNA, 13 nt, Mycobacterium tuberculosis H37Rv
gccgacauggcgg

SEQ ID NO: 3257644 - RNA, 16 nt, Mycobacterium tuberculosis H37Rv
gccgacauugcugcuc

SEQ ID NO: 3257645 - RNA, 15 nt, Mycobacterium tuberculosis H37Rv
gccgaccaccagcau

SEQ ID NO: 3257646 - RNA, 16 nt, Mycobacterium tuberculosis H37Rv
gccgaccaccagcauc

SEQ ID NO: 3257647 - RNA, 15 nt, Mycobacterium tuberculosis H37Rv
gccgaccaccgccgg

SEQ ID NO: 3257648 - RNA, 19 nt, Mycobacterium tuberculosis H37Rv
gccgaccacucgagcgcuc

SEQ ID NO: 3257649 - RNA, 20 nt, Mycobacterium tuberculosis H37Rv
gccgaccacucgagcgcuca

SEQ ID NO: 3257650 - RNA, 16 nt, Mycobacterium tuberculosis H37Rv
gccgaccagcacaccg

SEQ ID NO: 3257651 - RNA, 17 nt, Mycobacterium tuberculosis H37Rv
gccgaccagcacccgcu

SEQ ID NO: 3257652 - RNA, 20 nt, Mycobacterium tuberculosis H37Rv
gccgaccagcacccgcucgg

SEQ ID NO: 3257653 - RNA, 19 nt, Mycobacterium tuberculosis H37Rv
gccgaccagcaucucggcc

SEQ ID NO: 3257654 - RNA, 14 nt, Mycobacterium tuberculosis H37Rv
gccgaccagcgcgg

SEQ ID NO: 3257655 - RNA, 17 nt, Mycobacterium tuberculosis H37Rv
gccgaccaggaccaccg

SEQ ID NO: 3257656 - RNA, 22 nt, Mycobacterium tuberculosis H37Rv
gccgaccauaaaacucgggggc

SEQ ID NO: 3257657 - RNA, 23 nt, Mycobacterium tuberculosis H37Rv
gccgaccccggaaugcccgagca

SEQ ID NO: 3257658 - RNA, 21 nt, Mycobacterium tuberculosis H37Rv
gccgacccgcccgaagaugcc

SEQ ID NO: 3257659 - RNA, 13 nt, Mycobacterium tuberculosis H37Rv
gccgacccgccgc

SEQ ID NO: 3257660 - RNA, 15 nt, Mycobacterium tuberculosis H37Rv
gccgacccgccgcgc

SEQ ID NO: 3257661 - RNA, 19 nt, Mycobacterium tuberculosis H37Rv
gccgacccgccgcgcccgg

SEQ ID NO: 3257662 - RNA, 12 nt, Mycobacterium tuberculosis H37Rv
gccgacccgcgc

SEQ ID NO: 3257663 - RNA, 15 nt, Mycobacterium tuberculosis H37Rv
gccgacccgcgcgcc

SEQ ID NO: 3257664 - RNA, 15 nt, Mycobacterium tuberculosis H37Rv
gccgacccgggggcg

SEQ ID NO: 3257665 - RNA, 15 nt, Mycobacterium tuberculosis H37Rv
gccgaccgaaucagc

SEQ ID NO: 3257666 - RNA, 19 nt, Mycobacterium tuberculosis H37Rv
gccgaccgaaucagcacgg

SEQ ID NO: 3257667 - RNA, 14 nt, Mycobacterium tuberculosis H37Rv
gccgaccgacacca

SEQ ID NO: 3257668 - RNA, 18 nt, Mycobacterium tuberculosis H37Rv
gccgaccgacaccaccag

SEQ ID NO: 3257669 - RNA, 15 nt, Mycobacterium tuberculosis H37Rv
gccgaccgacgucgc

SEQ ID NO: 3257670 - RNA, 14 nt, Mycobacterium tuberculosis H37Rv
gccgaccgcggguc

SEQ ID NO: 3257671 - RNA, 18 nt, Mycobacterium tuberculosis H37Rv
gccgaccgcgggucgugc

SEQ ID NO: 3257672 - RNA, 22 nt, Mycobacterium tuberculosis H37Rv
gccgaccgcguuuugcaggccc

SEQ ID NO: 3257673 - RNA, 15 nt, Mycobacterium tuberculosis H37Rv
gccgaccggagccgc

SEQ ID NO: 3257674 - RNA, 17 nt, Mycobacterium tuberculosis H37Rv
gccgaccggcagcgaug

SEQ ID NO: 3257675 - RNA, 18 nt, Mycobacterium tuberculosis H37Rv
gccgaccggcagcgaugc

SEQ ID NO: 3257676 - RNA, 18 nt, Mycobacterium tuberculosis H37Rv
gccgaccggccacgaccu

SEQ ID NO: 3257677 - RNA, 21 nt, Mycobacterium tuberculosis H37Rv
gccgaccggcccgcauccgca

SEQ ID NO: 3257678 - RNA, 14 nt, Mycobacterium tuberculosis H37Rv
gccgaccggcggca

SEQ ID NO: 3257679 - RNA, 17 nt, Mycobacterium tuberculosis H37Rv
gccgaccggcggcaaac

SEQ ID NO: 3257680 - RNA, 14 nt, Mycobacterium tuberculosis H37Rv
gccgaccgggcucu

SEQ ID NO: 3257681 - RNA, 21 nt, Mycobacterium tuberculosis H37Rv
gccgaccgggcucuggccagu

SEQ ID NO: 3257682 - RNA, 23 nt, Mycobacterium tuberculosis H37Rv
gccgaccgggcucuggccagucc

SEQ ID NO: 3257683 - RNA, 12 nt, Mycobacterium tuberculosis H37Rv
gccgaccgggua

SEQ ID NO: 3257684 - RNA, 16 nt, Mycobacterium tuberculosis H37Rv
gccgaccggguugaug

SEQ ID NO: 3257685 - RNA, 21 nt, Mycobacterium tuberculosis H37Rv
gccgaccggucagcgcgcggc

SEQ ID NO: 3257686 - RNA, 17 nt, Mycobacterium tuberculosis H37Rv
gccgagcugugcgcaga

SEQ ID NO: 3257687 - RNA, 20 nt, Mycobacterium tuberculosis H37Rv
gccgagcugugcgcagacau

SEQ ID NO: 3257688 - RNA, 16 nt, Mycobacterium tuberculosis H37Rv
gccgagcuucagcgcg

SEQ ID NO: 3257689 - RNA, 17 nt, Mycobacterium tuberculosis H37Rv
gccgagcuucagcgcgc

SEQ ID NO: 3257690 - RNA, 18 nt, Mycobacterium tuberculosis H37Rv
gccgagcuucagcgcgcu

SEQ ID NO: 3257691 - RNA, 18 nt, Mycobacterium tuberculosis H37Rv
gccgagcuugucgagcag

SEQ ID NO: 3257692 - RNA, 21 nt, Mycobacterium tuberculosis H37Rv
gccgagcuugucgagcaggcc

SEQ ID NO: 3257693 - RNA, 23 nt, Mycobacterium tuberculosis H37Rv
gccgaggaauacucucgcgacau

SEQ ID NO: 3257694 - RNA, 14 nt, Mycobacterium tuberculosis H37Rv
gccgaggaccagag

SEQ ID NO: 3257695 - RNA, 15 nt, Mycobacterium tuberculosis H37Rv
gccgaggaccagagg

SEQ ID NO: 3257696 - RNA, 19 nt, Mycobacterium tuberculosis H37Rv
gccgaggaccagaggcgcu

SEQ ID NO: 3257697 - RNA, 15 nt, Mycobacterium tuberculosis H37Rv
gccgaggacgccggc

SEQ ID NO: 3257698 - RNA, 21 nt, Mycobacterium tuberculosis H37Rv
gccgaggacuggaaagcagca

SEQ ID NO: 3257699 - RNA, 22 nt, Mycobacterium tuberculosis H37Rv
gccgaggacuggaaagcagcag

SEQ ID NO: 3257700 - RNA, 23 nt, Mycobacterium tuberculosis H37Rv
gccgaggacuggaaagcagcagc

SEQ ID NO: 3257701 - RNA, 13 nt, Mycobacterium tuberculosis H37Rv
gccgaggcaaccg

SEQ ID NO: 3257702 - RNA, 20 nt, Mycobacterium tuberculosis H37Rv
gccgaggcaaccgacacugg

SEQ ID NO: 3257703 - RNA, 14 nt, Mycobacterium tuberculosis H37Rv
gccgaggcagcguc

SEQ ID NO: 3257704 - RNA, 21 nt, Mycobacterium tuberculosis H37Rv
gccgaggcagcgucgucgacg

SEQ ID NO: 3257705 - RNA, 16 nt, Mycobacterium tuberculosis H37Rv
gccgaggccgccguug

SEQ ID NO: 3257706 - RNA, 18 nt, Mycobacterium tuberculosis H37Rv
gccgaggccgcugccagg

SEQ ID NO: 3257707 - RNA, 18 nt, Mycobacterium tuberculosis H37Rv
gccgaggccucggccagc

SEQ ID NO: 3257708 - RNA, 21 nt, Mycobacterium tuberculosis H37Rv
gccgaggcggucuuguccagg

SEQ ID NO: 3257709 - RNA, 23 nt, Mycobacterium tuberculosis H37Rv
gccgaggguagacggggcgagca

SEQ ID NO: 3257710 - RNA, 21 nt, Mycobacterium tuberculosis H37Rv
gccgaggucgaaccgccggcu

SEQ ID NO: 3257711 - RNA, 19 nt, Mycobacterium tuberculosis H37Rv
gccgaggucgaacgcccgc

SEQ ID NO: 3257712 - RNA, 15 nt, Mycobacterium tuberculosis H37Rv
gccgaggucguaugc

SEQ ID NO: 3257713 - RNA, 20 nt, Mycobacterium tuberculosis H37Rv
gccgaguaccggccagccgc

SEQ ID NO: 3257714 - RNA, 18 nt, Mycobacterium tuberculosis H37Rv
gccgaguagauggucgac

SEQ ID NO: 3257715 - RNA, 15 nt, Mycobacterium tuberculosis H37Rv
gccgaguccggcaag

SEQ ID NO: 3257716 - RNA, 22 nt, Mycobacterium tuberculosis H37Rv
gccgagugcccagcgaugcgcu

SEQ ID NO: 3257717 - RNA, 17 nt, Mycobacterium tuberculosis H37Rv
gccgaguggccgcauua

SEQ ID NO: 3257718 - RNA, 15 nt, Mycobacterium tuberculosis H37Rv
gccgaguucgucagc

SEQ ID NO: 3257719 - RNA, 15 nt, Mycobacterium tuberculosis H37Rv
gccgaguugaccgcc

SEQ ID NO: 3257720 - RNA, 15 nt, Mycobacterium tuberculosis H37Rv
gccgaguugcccggg

SEQ ID NO: 3257721 - RNA, 21 nt, Mycobacterium tuberculosis H37Rv
gccgauacagcacauccagcc

SEQ ID NO: 3257722 - RNA, 17 nt, Mycobacterium tuberculosis H37Rv
gccgauacaggccacgc

SEQ ID NO: 3257723 - RNA, 24 nt, Mycobacterium tuberculosis H37Rv
gccgauaccagccaaaacgagcag

SEQ ID NO: 3257724 - RNA, 19 nt, Mycobacterium tuberculosis H37Rv
gccgauacuucaucggcac

SEQ ID NO: 3257725 - RNA, 13 nt, Mycobacterium tuberculosis H37Rv
gccgauagcgcgg

SEQ ID NO: 3257726 - RNA, 23 nt, Mycobacterium tuberculosis H37Rv
gccgauauccaaugccagaucgg

SEQ ID NO: 3257727 - RNA, 21 nt, Mycobacterium tuberculosis H37Rv
gccgauaucggugaccguggc

SEQ ID NO: 3257728 - RNA, 15 nt, Mycobacterium tuberculosis H37Rv
gccgauaucugccac

SEQ ID NO: 3257729 - RNA, 16 nt, Mycobacterium tuberculosis H37Rv
gccgauaucugccacg

SEQ ID NO: 3257730 - RNA, 23 nt, Mycobacterium tuberculosis H37Rv
gccgaucaacagcaccguacggc

SEQ ID NO: 3257731 - RNA, 14 nt, Mycobacterium tuberculosis H37Rv
gccgaucaccaccg

SEQ ID NO: 3257732 - RNA, 16 nt, Mycobacterium tuberculosis H37Rv
gccgaucaccaccggc

SEQ ID NO: 3257733 - RNA, 21 nt, Mycobacterium tuberculosis H37Rv
gccgaucaccgcaucggugcc

SEQ ID NO: 3257734 - RNA, 23 nt, Mycobacterium tuberculosis H37Rv
gccgaucaccgcaucggugccaa

SEQ ID NO: 3257735 - RNA, 23 nt, Mycobacterium tuberculosis H37Rv
gccgaucaccgcuguguucagcg

SEQ ID NO: 3257736 - RNA, 14 nt, Mycobacterium tuberculosis H37Rv
gccgaucagcgaac

SEQ ID NO: 3257737 - RNA, 21 nt, Mycobacterium tuberculosis H37Rv
gccgaucagcgaaccaccggc

SEQ ID NO: 3257738 - RNA, 23 nt, Mycobacterium tuberculosis H37Rv
gccgaucagcgaaccaccggcgc

SEQ ID NO: 3257739 - RNA, 14 nt, Mycobacterium tuberculosis H37Rv
gccgauccagcagg

SEQ ID NO: 3257740 - RNA, 15 nt, Mycobacterium tuberculosis H37Rv
gccgauccagcaggc

SEQ ID NO: 3257741 - RNA, 18 nt, Mycobacterium tuberculosis H37Rv
gccgauccaggagugauu

SEQ ID NO: 3257742 - RNA, 19 nt, Mycobacterium tuberculosis H37Rv
gccgaucccggcgagcacc

SEQ ID NO: 3257743 - RNA, 20 nt, Mycobacterium tuberculosis H37Rv
gccgaucccggcgagcaccc

SEQ ID NO: 3257744 - RNA, 15 nt, Mycobacterium tuberculosis H37Rv
gccgaucccggcggu

SEQ ID NO: 3257745 - RNA, 17 nt, Mycobacterium tuberculosis H37Rv
gccgaucccgugguggc

SEQ ID NO: 3257746 - RNA, 19 nt, Mycobacterium tuberculosis H37Rv
gccgaucgaaccgcugcuc

SEQ ID NO: 3257747 - RNA, 15 nt, Mycobacterium tuberculosis H37Rv
gccgaucgacacccg

SEQ ID NO: 3257748 - RNA, 21 nt, Mycobacterium tuberculosis H37Rv
gccgaucgacacccgcucggc

SEQ ID NO: 3257749 - RNA, 11 nt, Mycobacterium tuberculosis H37Rv
gccgaucgccg

SEQ ID NO: 3257750 - RNA, 12 nt, Mycobacterium tuberculosis H37Rv
gccgaucggcac

SEQ ID NO: 3257751 - RNA, 14 nt, Mycobacterium tuberculosis H37Rv
gccgaucggccaac

SEQ ID NO: 3257752 - RNA, 16 nt, Mycobacterium tuberculosis H37Rv
gccgaucggccacagu

SEQ ID NO: 3257753 - RNA, 21 nt, Mycobacterium tuberculosis H37Rv
gccgaucggccugcagcgaug

SEQ ID NO: 3257754 - RNA, 22 nt, Mycobacterium tuberculosis H37Rv
gccgaucggccugcagcgauga

SEQ ID NO: 3257755 - RNA, 13 nt, Mycobacterium tuberculosis H37Rv
gccgaucgggagu

SEQ ID NO: 3257756 - RNA, 22 nt, Mycobacterium tuberculosis H37Rv
gccgaucgggcucacucgccga

SEQ ID NO: 3257757 - RNA, 20 nt, Mycobacterium tuberculosis H37Rv
gccgaucgggcuucggccag

SEQ ID NO: 3257758 - RNA, 12 nt, Mycobacterium tuberculosis H37Rv
gccgaucggugc

SEQ ID NO: 3257759 - RNA, 15 nt, Mycobacterium tuberculosis H37Rv
gccgaucucggugac

SEQ ID NO: 3257760 - RNA, 18 nt, Mycobacterium tuberculosis H37Rv
gccgaucucuccggcggc

SEQ ID NO: 3257761 - RNA, 20 nt, Mycobacterium tuberculosis H37Rv
gccgaucucuccggcggcga

SEQ ID NO: 3257762 - RNA, 16 nt, Mycobacterium tuberculosis H37Rv
gccgaucugcucgccg

SEQ ID NO: 3257763 - RNA, 19 nt, Mycobacterium tuberculosis H37Rv
gccgaucugcucgccgagc

SEQ ID NO: 3257764 - RNA, 23 nt, Mycobacterium tuberculosis H37Rv
gccgaucugguaagucagcucga

SEQ ID NO: 3257765 - RNA, 13 nt, Mycobacterium tuberculosis H37Rv
gccgaugacgaug

SEQ ID NO: 3257766 - RNA, 20 nt, Mycobacterium tuberculosis H37Rv
gccgaugacgaugccgccga

SEQ ID NO: 3257767 - RNA, 18 nt, Mycobacterium tuberculosis H37Rv
gccgaugacgauggccgc

SEQ ID NO: 3257768 - RNA, 16 nt, Mycobacterium tuberculosis H37Rv
gccgaugacguacggc

SEQ ID NO: 3257769 - RNA, 17 nt, Mycobacterium tuberculosis H37Rv
gccgaugaugcggcgca

SEQ ID NO: 3257770 - RNA, 19 nt, Mycobacterium tuberculosis H37Rv
gccgaugaugcggcgcagc

SEQ ID NO: 3257771 - RNA, 12 nt, Mycobacterium tuberculosis H37Rv
gccgaugccacc

SEQ ID NO: 3257772 - RNA, 16 nt, Mycobacterium tuberculosis H37Rv
gccgaugcccaucacg

SEQ ID NO: 3257773 - RNA, 15 nt, Mycobacterium tuberculosis H37Rv
gccgaugccgccggc

SEQ ID NO: 3257774 - RNA, 16 nt, Mycobacterium tuberculosis H37Rv
gccgaugccgccggca

SEQ ID NO: 3257775 - RNA, 17 nt, Mycobacterium tuberculosis H37Rv
gccgaugccgccggcac

SEQ ID NO: 3257776 - RNA, 17 nt, Mycobacterium tuberculosis H37Rv
gccgaugcgacgcagac

SEQ ID NO: 3257777 - RNA, 17 nt, Mycobacterium tuberculosis H37Rv
gccgaugcgggucucga

SEQ ID NO: 3257778 - RNA, 14 nt, Mycobacterium tuberculosis H37Rv
gccgaugcggugcg

SEQ ID NO: 3257779 - RNA, 22 nt, Mycobacterium tuberculosis H37Rv
gccgauggaugggcugcgcguc

SEQ ID NO: 3257780 - RNA, 21 nt, Mycobacterium tuberculosis H37Rv
gccgauggcuaccccagggag

SEQ ID NO: 3257781 - RNA, 15 nt, Mycobacterium tuberculosis H37Rv
gccgauggugauggg

SEQ ID NO: 3257782 - RNA, 16 nt, Mycobacterium tuberculosis H37Rv
gccgcauucggcgaug

SEQ ID NO: 3257783 - RNA, 23 nt, Mycobacterium tuberculosis H37Rv
gccgccaacuccucagccgccug

SEQ ID NO: 3257784 - RNA, 21 nt, Mycobacterium tuberculosis H37Rv
gccgccaacuucaccacccug

SEQ ID NO: 3257785 - RNA, 16 nt, Mycobacterium tuberculosis H37Rv
gccgccaagcucggcc

SEQ ID NO: 3257786 - RNA, 15 nt, Mycobacterium tuberculosis H37Rv
gccgccacaccgccg

SEQ ID NO: 3257787 - RNA, 19 nt, Mycobacterium tuberculosis H37Rv
gccgccacagcacccacgc

SEQ ID NO: 3257788 - RNA, 21 nt, Mycobacterium tuberculosis H37Rv
gccgccacagcacccacgccg

SEQ ID NO: 3257789 - RNA, 14 nt, Mycobacterium tuberculosis H37Rv
gccgccaccaccgg

SEQ ID NO: 3257790 - RNA, 12 nt, Mycobacterium tuberculosis H37Rv
gccgccaccagc

SEQ ID NO: 3257791 - RNA, 14 nt, Mycobacterium tuberculosis H37Rv
gccgccacccgcaa

SEQ ID NO: 3257792 - RNA, 13 nt, Mycobacterium tuberculosis H37Rv
gccgccacccggc

SEQ ID NO: 3257793 - RNA, 15 nt, Mycobacterium tuberculosis H37Rv
gccgccaccgaggcc

SEQ ID NO: 3257794 - RNA, 13 nt, Mycobacterium tuberculosis H37Rv
gccgccaccgcga

SEQ ID NO: 3257795 - RNA, 19 nt, Mycobacterium tuberculosis H37Rv
gccgccaccggcgccgccg

SEQ ID NO: 3257796 - RNA, 15 nt, Mycobacterium tuberculosis H37Rv
gccgccaccggcguc

SEQ ID NO: 3257797 - RNA, 18 nt, Mycobacterium tuberculosis H37Rv
gccgccaccguacgacag

SEQ ID NO: 3257798 - RNA, 21 nt, Mycobacterium tuberculosis H37Rv
gccgccaccuuggcugggccc

SEQ ID NO: 3257799 - RNA, 22 nt, Mycobacterium tuberculosis H37Rv
gccgccaccuuggcugggcccg

SEQ ID NO: 3257800 - RNA, 19 nt, Mycobacterium tuberculosis H37Rv
gccgccacggaucgcggcg

SEQ ID NO: 3257801 - RNA, 22 nt, Mycobacterium tuberculosis H37Rv
gccgccacggaucgcggcggcg

SEQ ID NO: 3257802 - RNA, 16 nt, Mycobacterium tuberculosis H37Rv
gccgccacgggcggcc

SEQ ID NO: 3257803 - RNA, 19 nt, Mycobacterium tuberculosis H37Rv
gccgccacgggcggccacc

SEQ ID NO: 3257804 - RNA, 15 nt, Mycobacterium tuberculosis H37Rv
gccgccacugccggc

SEQ ID NO: 3257805 - RNA, 18 nt, Mycobacterium tuberculosis H37Rv
gccgccagaugaggacgg

SEQ ID NO: 3257806 - RNA, 23 nt, Mycobacterium tuberculosis H37Rv
gccgccagauuggcgcugcccgc

SEQ ID NO: 3257807 - RNA, 18 nt, Mycobacterium tuberculosis H37Rv
gccgccagcaccaccggc

SEQ ID NO: 3257808 - RNA, 17 nt, Mycobacterium tuberculosis H37Rv
gccgccagccccagcgu

SEQ ID NO: 3257809 - RNA, 13 nt, Mycobacterium tuberculosis H37Rv
gccgccagcccgu

SEQ ID NO: 3257810 - RNA, 13 nt, Mycobacterium tuberculosis H37Rv
gccgccagccggc

SEQ ID NO: 3257811 - RNA, 15 nt, Mycobacterium tuberculosis H37Rv
gccgccagccggcgc

SEQ ID NO: 3257812 - RNA, 13 nt, Mycobacterium tuberculosis H37Rv
gccgccagccugg

SEQ ID NO: 3257813 - RNA, 15 nt, Mycobacterium tuberculosis H37Rv
gccgccagcgccacc

SEQ ID NO: 3257814 - RNA, 17 nt, Mycobacterium tuberculosis H37Rv
gccgccagcgccaccgu

SEQ ID NO: 3257815 - RNA, 16 nt, Mycobacterium tuberculosis H37Rv
gccgccagcgccgccg

SEQ ID NO: 3257816 - RNA, 18 nt, Mycobacterium tuberculosis H37Rv
gccgccagcgccgccggc

SEQ ID NO: 3257817 - RNA, 20 nt, Mycobacterium tuberculosis H37Rv
gccgccaggcgcuuggccgg

SEQ ID NO: 3257818 - RNA, 15 nt, Mycobacterium tuberculosis H37Rv
gccgccaggcggccg

SEQ ID NO: 3257819 - RNA, 21 nt, Mycobacterium tuberculosis H37Rv
gccgccagggcccuagccggc

SEQ ID NO: 3257820 - RNA, 22 nt, Mycobacterium tuberculosis H37Rv
gccgccagggcccuagccggcg

SEQ ID NO: 3257821 - RNA, 21 nt, Mycobacterium tuberculosis H37Rv
gccgccaguucggcgucgucc

SEQ ID NO: 3257822 - RNA, 19 nt, Mycobacterium tuberculosis H37Rv
gccgccauaccucggcgac

SEQ ID NO: 3257823 - RNA, 14 nt, Mycobacterium tuberculosis H37Rv
gccgccaucagccg

SEQ ID NO: 3257824 - RNA, 22 nt, Mycobacterium tuberculosis H37Rv
gccgccauccccuggccagcag

SEQ ID NO: 3257825 - RNA, 23 nt, Mycobacterium tuberculosis H37Rv
gccgccauccccuggccagcaga

SEQ ID NO: 3257826 - RNA, 22 nt, Mycobacterium tuberculosis H37Rv
gccgccaucgcccgauccccgg

SEQ ID NO: 3257827 - RNA, 17 nt, Mycobacterium tuberculosis H37Rv
gccgccaucgccgccgg

SEQ ID NO: 3257828 - RNA, 23 nt, Mycobacterium tuberculosis H37Rv
gccgccaugcgcaccaguccagc

SEQ ID NO: 3257829 - RNA, 17 nt, Mycobacterium tuberculosis H37Rv
gccgccauggccgccgu

SEQ ID NO: 3257830 - RNA, 19 nt, Mycobacterium tuberculosis H37Rv
gccgccauguacaggcccc

SEQ ID NO: 3257831 - RNA, 16 nt, Mycobacterium tuberculosis H37Rv
gccgccauuccagccg

SEQ ID NO: 3257832 - RNA, 18 nt, Mycobacterium tuberculosis H37Rv
gccgccauuccagccggu

SEQ ID NO: 3257833 - RNA, 19 nt, Mycobacterium tuberculosis H37Rv
gccgccauugacgccguug

SEQ ID NO: 3257834 - RNA, 22 nt, Mycobacterium tuberculosis H37Rv
gccgccauugagcucccgcaac

SEQ ID NO: 3257835 - RNA, 13 nt, Mycobacterium tuberculosis H37Rv
gccgccauugcca

SEQ ID NO: 3257836 - RNA, 13 nt, Mycobacterium tuberculosis H37Rv
gccgccauugccg

SEQ ID NO: 3257837 - RNA, 17 nt, Mycobacterium tuberculosis H37Rv
gccgccauugccgccgg

SEQ ID NO: 3257838 - RNA, 13 nt, Mycobacterium tuberculosis H37Rv
gccgccauuggcu

SEQ ID NO: 3257839 - RNA, 18 nt, Mycobacterium tuberculosis H37Rv
gccgcccaagccgccggc

SEQ ID NO: 3257840 - RNA, 20 nt, Mycobacterium tuberculosis H37Rv
gccgcccaauugccuccgcu

SEQ ID NO: 3257841 - RNA, 14 nt, Mycobacterium tuberculosis H37Rv
gccgcccacaugaa

SEQ ID NO: 3257842 - RNA, 11 nt, Mycobacterium tuberculosis H37Rv
gccgcccagcg

SEQ ID NO: 3257843 - RNA, 13 nt, Mycobacterium tuberculosis H37Rv
gccgcccagcgac

SEQ ID NO: 3257844 - RNA, 13 nt, Mycobacterium tuberculosis H37Rv
gccgcccagcgga

SEQ ID NO: 3257845 - RNA, 21 nt, Mycobacterium tuberculosis H37Rv
gccgcccagcggaaucaccga

SEQ ID NO: 3257846 - RNA, 22 nt, Mycobacterium tuberculosis H37Rv
gccgcccaggagcaccucgaag

SEQ ID NO: 3257847 - RNA, 12 nt, Mycobacterium tuberculosis H37Rv
gccgcccaucac

SEQ ID NO: 3257848 - RNA, 17 nt, Mycobacterium tuberculosis H37Rv
gccgcccaucaccccga

SEQ ID NO: 3257849 - RNA, 12 nt, Mycobacterium tuberculosis H37Rv
gccgcccccgcc

SEQ ID NO: 3257850 - RNA, 15 nt, Mycobacterium tuberculosis H37Rv
gccgcccccgccggc

SEQ ID NO: 3257851 - RNA, 13 nt, Mycobacterium tuberculosis H37Rv
gccgccccgcagc

SEQ ID NO: 3257852 - RNA, 17 nt, Mycobacterium tuberculosis H37Rv
gccgccccgcagcugcg

SEQ ID NO: 3257853 - RNA, 11 nt, Mycobacterium tuberculosis H37Rv
gccgccccggc

SEQ ID NO: 3257854 - RNA, 15 nt, Mycobacterium tuberculosis H37Rv
gccgccccggccgcu

SEQ ID NO: 3257855 - RNA, 14 nt, Mycobacterium tuberculosis H37Rv
gccgccccggcgcu

SEQ ID NO: 3257856 - RNA, 15 nt, Mycobacterium tuberculosis H37Rv
gccgccccggcgcug

SEQ ID NO: 3257857 - RNA, 17 nt, Mycobacterium tuberculosis H37Rv
gccgcccgcagggccgc

SEQ ID NO: 3257858 - RNA, 20 nt, Mycobacterium tuberculosis H37Rv
gccgcccgcagggccgccgc

SEQ ID NO: 3257859 - RNA, 14 nt, Mycobacterium tuberculosis H37Rv
gccgcccgcaucgc

SEQ ID NO: 3257860 - RNA, 18 nt, Mycobacterium tuberculosis H37Rv
gccgcccgcccaccucga

SEQ ID NO: 3257861 - RNA, 15 nt, Mycobacterium tuberculosis H37Rv
gccgcccgcgccacc

SEQ ID NO: 3257862 - RNA, 17 nt, Mycobacterium tuberculosis H37Rv
gccgcccgcgccgccgc

SEQ ID NO: 3257863 - RNA, 23 nt, Mycobacterium tuberculosis H37Rv
gccgcccgcgccgccgcuacccc

SEQ ID NO: 3257864 - RNA, 19 nt, Mycobacterium tuberculosis H37Rv
gccgcccgcgccgccggac

SEQ ID NO: 3257865 - RNA, 13 nt, Mycobacterium tuberculosis H37Rv
gccgcccgcgccu

SEQ ID NO: 3257866 - RNA, 22 nt, Mycobacterium tuberculosis H37Rv
gccgcccgcuccuccggcacca

SEQ ID NO: 3257867 - RNA, 20 nt, Mycobacterium tuberculosis H37Rv
gccgcccgcugcggcggcuu

SEQ ID NO: 3257868 - RNA, 19 nt, Mycobacterium tuberculosis H37Rv
gccgcccggacccaaagca

SEQ ID NO: 3257869 - RNA, 12 nt, Mycobacterium tuberculosis H37Rv
gccgcccggcga

SEQ ID NO: 3257870 - RNA, 21 nt, Mycobacterium tuberculosis H37Rv
gccgcccggcgagcagggcgu

SEQ ID NO: 3257871 - RNA, 13 nt, Mycobacterium tuberculosis H37Rv
gccgcccggucgg

SEQ ID NO: 3257872 - RNA, 15 nt, Mycobacterium tuberculosis H37Rv
gccgcccggucgggc

SEQ ID NO: 3257873 - RNA, 18 nt, Mycobacterium tuberculosis H37Rv
gccgcccggucgggcgcg

SEQ ID NO: 3257874 - RNA, 22 nt, Mycobacterium tuberculosis H37Rv
gccgcccggucgggcgcggggc

SEQ ID NO: 3257875 - RNA, 21 nt, Mycobacterium tuberculosis H37Rv
gccgcccguagaacaguucga

SEQ ID NO: 3257876 - RNA, 19 nt, Mycobacterium tuberculosis H37Rv
gccgcccgucccgccggcc

SEQ ID NO: 3257877 - RNA, 16 nt, Mycobacterium tuberculosis H37Rv
gccgcccucgggauug

SEQ ID NO: 3257878 - RNA, 18 nt, Mycobacterium tuberculosis H37Rv
gccgcccuggacgucggc

SEQ ID NO: 3257879 - RNA, 20 nt, Mycobacterium tuberculosis H37Rv
gccgcccuugccgccggccc

SEQ ID NO: 3257880 - RNA, 21 nt, Mycobacterium tuberculosis H37Rv
gccgcccuugccgccggcccc

SEQ ID NO: 3257881 - RNA, 22 nt, Mycobacterium tuberculosis H37Rv
gccgcccuugccuccggcgccg

SEQ ID NO: 3257882 - RNA, 17 nt, Mycobacterium tuberculosis H37Rv
gccgccgaaacucacca

SEQ ID NO: 3257883 - RNA, 19 nt, Mycobacterium tuberculosis H37Rv
gccgccgaaacucaccagc

SEQ ID NO: 3257884 - RNA, 15 nt, Mycobacterium tuberculosis H37Rv
gccgccgaacagcug

SEQ ID NO: 3257885 - RNA, 17 nt, Mycobacterium tuberculosis H37Rv
gccgccgaagccgcgca

SEQ ID NO: 3257886 - RNA, 15 nt, Mycobacterium tuberculosis H37Rv
gccgccgacaacccc

SEQ ID NO: 3257887 - RNA, 22 nt, Mycobacterium tuberculosis H37Rv
gccgccgacaaccccgccagga

SEQ ID NO: 3257888 - RNA, 22 nt, Mycobacterium tuberculosis H37Rv
gccgccgacaccaccggcgccg

SEQ ID NO: 3257889 - RNA, 23 nt, Mycobacterium tuberculosis H37Rv
gccgccgacaccaccggcgccgc

SEQ ID NO: 3257890 - RNA, 14 nt, Mycobacterium tuberculosis H37Rv
gccgccgacaggga

SEQ ID NO: 3257891 - RNA, 17 nt, Mycobacterium tuberculosis H37Rv
gccgccgacagggaccc

SEQ ID NO: 3257892 - RNA, 21 nt, Mycobacterium tuberculosis H37Rv
gccgccgaccggagccgccgg

SEQ ID NO: 3257893 - RNA, 13 nt, Mycobacterium tuberculosis H37Rv
gccgccgagcucg

SEQ ID NO: 3257894 - RNA, 15 nt, Mycobacterium tuberculosis H37Rv
gccgccgagcuggcg

SEQ ID NO: 3257895 - RNA, 16 nt, Mycobacterium tuberculosis H37Rv
gccgccgagggcgccg

SEQ ID NO: 3257896 - RNA, 17 nt, Mycobacterium tuberculosis H37Rv
gccgccgagggcgccgg

SEQ ID NO: 3257897 - RNA, 23 nt, Mycobacterium tuberculosis H37Rv
gccgccgaggucgguucggccgg

SEQ ID NO: 3257898 - RNA, 13 nt, Mycobacterium tuberculosis H37Rv
gccgccgauaccg

SEQ ID NO: 3257899 - RNA, 21 nt, Mycobacterium tuberculosis H37Rv
gccgccgauaccgccggcccc

SEQ ID NO: 3257900 - RNA, 13 nt, Mycobacterium tuberculosis H37Rv
gccgccgaucccg

SEQ ID NO: 3257901 - RNA, 15 nt, Mycobacterium tuberculosis H37Rv
gccgccgaucccguc

SEQ ID NO: 3257902 - RNA, 23 nt, Mycobacterium tuberculosis H37Rv
gccgccgaucgacacccgcucgg

SEQ ID NO: 3257903 - RNA, 19 nt, Mycobacterium tuberculosis H37Rv
gccgccgaucugcugcagc

SEQ ID NO: 3257904 - RNA, 19 nt, Mycobacterium tuberculosis H37Rv
gccgccgaugaugugcggu

SEQ ID NO: 3257905 - RNA, 18 nt, Mycobacterium tuberculosis H37Rv
gccgccgaugccaccgcu

SEQ ID NO: 3257906 - RNA, 15 nt, Mycobacterium tuberculosis H37Rv
gccgccgaugccgcc

SEQ ID NO: 3257907 - RNA, 16 nt, Mycobacterium tuberculosis H37Rv
gccgccgaugccgccg

SEQ ID NO: 3257908 - RNA, 17 nt, Mycobacterium tuberculosis H37Rv
gccgccgaugccgccgg

SEQ ID NO: 3257909 - RNA, 19 nt, Mycobacterium tuberculosis H37Rv
gccgccgaugccgccggca

SEQ ID NO: 3257910 - RNA, 22 nt, Mycobacterium tuberculosis H37Rv
gccgccgauguagacgguggcg

SEQ ID NO: 3257911 - RNA, 17 nt, Mycobacterium tuberculosis H37Rv
gccgccgaugucgacga

SEQ ID NO: 3257912 - RNA, 15 nt, Mycobacterium tuberculosis H37Rv
gccgccgccaccggc

SEQ ID NO: 3257913 - RNA, 23 nt, Mycobacterium tuberculosis H37Rv
gccgccgccaccggcgccgccgu

SEQ ID NO: 3257914 - RNA, 13 nt, Mycobacterium tuberculosis H37Rv
gccgccgccaccu

SEQ ID NO: 3257915 - RNA, 12 nt, Mycobacterium tuberculosis H37Rv
gccgccgccauc

SEQ ID NO: 3257916 - RNA, 14 nt, Mycobacterium tuberculosis H37Rv
gccgccgccccggc

SEQ ID NO: 3257917 - RNA, 13 nt, Mycobacterium tuberculosis H37Rv
gccgccgcccugg

SEQ ID NO: 3257918 - RNA, 16 nt, Mycobacterium tuberculosis H37Rv
gccgccgccgccggcg

SEQ ID NO: 3257919 - RNA, 16 nt, Mycobacterium tuberculosis H37Rv
gccgccgccgucggcg

SEQ ID NO: 3257920 - RNA, 17 nt, Mycobacterium tuberculosis H37Rv
gccgccgccgucggcga

SEQ ID NO: 3257921 - RNA, 14 nt, Mycobacterium tuberculosis H37Rv
gccgccgccugcuc

SEQ ID NO: 3257922 - RNA, 16 nt, Mycobacterium tuberculosis H37Rv
gccgccgcgaggaugc

SEQ ID NO: 3257923 - RNA, 15 nt, Mycobacterium tuberculosis H37Rv
gccgccgcgauggcc

SEQ ID NO: 3257924 - RNA, 14 nt, Mycobacterium tuberculosis H37Rv
gccgccgcgccggc

SEQ ID NO: 3257925 - RNA, 15 nt, Mycobacterium tuberculosis H37Rv
gccgccgcgccggca

SEQ ID NO: 3257926 - RNA, 21 nt, Mycobacterium tuberculosis H37Rv
gccgccgcgcguucggcgcug

SEQ ID NO: 3257927 - RNA, 19 nt, Mycobacterium tuberculosis H37Rv
gccgccgcggcagggcggu

SEQ ID NO: 3257928 - RNA, 12 nt, Mycobacterium tuberculosis H37Rv
gccgccgcggcc

SEQ ID NO: 3257929 - RNA, 14 nt, Mycobacterium tuberculosis H37Rv
gccgccgcggccac

SEQ ID NO: 3257930 - RNA, 15 nt, Mycobacterium tuberculosis H37Rv
gccgccgcggccacc

SEQ ID NO: 3257931 - RNA, 16 nt, Mycobacterium tuberculosis H37Rv
gccgccgcggccacca

SEQ ID NO: 3257932 - RNA, 15 nt, Mycobacterium tuberculosis H37Rv
gccgccgcggccggc

SEQ ID NO: 3257933 - RNA, 15 nt, Mycobacterium tuberculosis H37Rv
gccgccgcggcgaag

SEQ ID NO: 3257934 - RNA, 16 nt, Mycobacterium tuberculosis H37Rv
gccgccgcggcgaagc

SEQ ID NO: 3257935 - RNA, 15 nt, Mycobacterium tuberculosis H37Rv
gccgccgcggcgccc

SEQ ID NO: 3257936 - RNA, 13 nt, Mycobacterium tuberculosis H37Rv
gccgccgcgggcg

SEQ ID NO: 3257937 - RNA, 16 nt, Mycobacterium tuberculosis H37Rv
gccgccgcgggcgccg

SEQ ID NO: 3257938 - RNA, 17 nt, Mycobacterium tuberculosis H37Rv
gccgccgcuacccccga

SEQ ID NO: 3257939 - RNA, 13 nt, Mycobacterium tuberculosis H37Rv
gccgccgcugccg

SEQ ID NO: 3257940 - RNA, 15 nt, Mycobacterium tuberculosis H37Rv
gccgccgcugccgcc

SEQ ID NO: 3257941 - RNA, 18 nt, Mycobacterium tuberculosis H37Rv
gccgccggaagcgccggc

SEQ ID NO: 3257942 - RNA, 23 nt, Mycobacterium tuberculosis H37Rv
gccgccggaagcgccggccgauc

SEQ ID NO: 3257943 - RNA, 13 nt, Mycobacterium tuberculosis H37Rv
gccgccggaaucg

SEQ ID NO: 3257944 - RNA, 14 nt, Mycobacterium tuberculosis H37Rv
gccgccggaaucga

SEQ ID NO: 3257945 - RNA, 19 nt, Mycobacterium tuberculosis H37Rv
gccgccggacccgucgagc

SEQ ID NO: 3257946 - RNA, 13 nt, Mycobacterium tuberculosis H37Rv
gccgccggagauc

SEQ ID NO: 3257947 - RNA, 12 nt, Mycobacterium tuberculosis H37Rv
gccgccggaggu

SEQ ID NO: 3257948 - RNA, 17 nt, Mycobacterium tuberculosis H37Rv
gccgccggaggucgggc

SEQ ID NO: 3257949 - RNA, 15 nt, Mycobacterium tuberculosis H37Rv
gccgccggaucgccg

SEQ ID NO: 3257950 - RNA, 15 nt, Mycobacterium tuberculosis H37Rv
gccgccggcaccgcc

SEQ ID NO: 3257951 - RNA, 22 nt, Mycobacterium tuberculosis H37Rv
gccgccggcaccgccggcgccg

SEQ ID NO: 3257952 - RNA, 16 nt, Mycobacterium tuberculosis H37Rv
gccgccggcaccgggg

SEQ ID NO: 3257953 - RNA, 18 nt, Mycobacterium tuberculosis H37Rv
gccgccggcaccucccug

SEQ ID NO: 3257954 - RNA, 14 nt, Mycobacterium tuberculosis H37Rv
gccgccggcagcgc

SEQ ID NO: 3257955 - RNA, 16 nt, Mycobacterium tuberculosis H37Rv
gccgccggcagcgcgg

SEQ ID NO: 3257956 - RNA, 17 nt, Mycobacterium tuberculosis H37Rv
gccgccggcagcgcgga

SEQ ID NO: 3257957 - RNA, 11 nt, Mycobacterium tuberculosis H37Rv
gccgccggcca

SEQ ID NO: 3257958 - RNA, 23 nt, Mycobacterium tuberculosis H37Rv
gccgccggccaguccgcgcgcaa

SEQ ID NO: 3257959 - RNA, 12 nt, Mycobacterium tuberculosis H37Rv
gccgccggccau

SEQ ID NO: 3257960 - RNA, 18 nt, Mycobacterium tuberculosis H37Rv
gccgccggccaugugcac

SEQ ID NO: 3257961 - RNA, 14 nt, Mycobacterium tuberculosis H37Rv
gccgccggccccgc

SEQ ID NO: 3257962 - RNA, 15 nt, Mycobacterium tuberculosis H37Rv
gccgccggccccgcc

SEQ ID NO: 3257963 - RNA, 19 nt, Mycobacterium tuberculosis H37Rv
gccgccggccccgccguca

SEQ ID NO: 3257964 - RNA, 20 nt, Mycobacterium tuberculosis H37Rv
gccgccggccccgccgucac

SEQ ID NO: 3257965 - RNA, 23 nt, Mycobacterium tuberculosis H37Rv
gccgccggccccgccguuuccgc

SEQ ID NO: 3257966 - RNA, 12 nt, Mycobacterium tuberculosis H37Rv
gccgccggccgc

SEQ ID NO: 3257967 - RNA, 16 nt, Mycobacterium tuberculosis H37Rv
gccgccggccgccagc

SEQ ID NO: 3257968 - RNA, 18 nt, Mycobacterium tuberculosis H37Rv
gccgccggccgccagcgc

SEQ ID NO: 3257969 - RNA, 15 nt, Mycobacterium tuberculosis H37Rv
gccgccggccgcgca

SEQ ID NO: 3257970 - RNA, 13 nt, Mycobacterium tuberculosis H37Rv
gccgccggcgcca

SEQ ID NO: 3257971 - RNA, 17 nt, Mycobacterium tuberculosis H37Rv
gccgccggcgccagcgc

SEQ ID NO: 3257972 - RNA, 22 nt, Mycobacterium tuberculosis H37Rv
gccgccggcgccagcgccgcca

SEQ ID NO: 3257973 - RNA, 13 nt, Mycobacterium tuberculosis H37Rv
gccgccggcgccc

SEQ ID NO: 3257974 - RNA, 14 nt, Mycobacterium tuberculosis H37Rv
gccgccggcgccgc

SEQ ID NO: 3257975 - RNA, 17 nt, Mycobacterium tuberculosis H37Rv
gccgcgaaugucgccgc

SEQ ID NO: 3257976 - RNA, 20 nt, Mycobacterium tuberculosis H37Rv
gccgcgaaugucgccgccug

SEQ ID NO: 3257977 - RNA, 22 nt, Mycobacterium tuberculosis H37Rv
gccgcgacaaaucggucgacga

SEQ ID NO: 3257978 - RNA, 19 nt, Mycobacterium tuberculosis H37Rv
gccgcgaccagcgccgcac

SEQ ID NO: 3257979 - RNA, 14 nt, Mycobacterium tuberculosis H37Rv
gccgcgacccgcgc

SEQ ID NO: 3257980 - RNA, 15 nt, Mycobacterium tuberculosis H37Rv
gccgcgacccgcgca

SEQ ID NO: 3257981 - RNA, 20 nt, Mycobacterium tuberculosis H37Rv
gccgcgacccgcgcaaucag

SEQ ID NO: 3257982 - RNA, 23 nt, Mycobacterium tuberculosis H37Rv
gccgcgaccgcgaccgcauugag

SEQ ID NO: 3257983 - RNA, 17 nt, Mycobacterium tuberculosis H37Rv
gccgcgaccggcguaac

SEQ ID NO: 3257984 - RNA, 14 nt, Mycobacterium tuberculosis H37Rv
gccgcgacgacacg

SEQ ID NO: 3257985 - RNA, 15 nt, Mycobacterium tuberculosis H37Rv
gccgcgacgacacgc

SEQ ID NO: 3257986 - RNA, 14 nt, Mycobacterium tuberculosis H37Rv
gccgcgacggcacg

SEQ ID NO: 3257987 - RNA, 17 nt, Mycobacterium tuberculosis H37Rv
gccgcgagccggugauc

SEQ ID NO: 3257988 - RNA, 13 nt, Mycobacterium tuberculosis H37Rv
gccgcgagcgcgc

SEQ ID NO: 3257989 - RNA, 16 nt, Mycobacterium tuberculosis H37Rv
gccgcgagcgcgcgac

SEQ ID NO: 3257990 - RNA, 12 nt, Mycobacterium tuberculosis H37Rv
gccgcgaucgac

SEQ ID NO: 3257991 - RNA, 18 nt, Mycobacterium tuberculosis H37Rv
gccgcgaucgggcccagc

SEQ ID NO: 3257992 - RNA, 22 nt, Mycobacterium tuberculosis H37Rv
gccgcgaucggugcgggcgccg

SEQ ID NO: 3257993 - RNA, 23 nt, Mycobacterium tuberculosis H37Rv
gccgcgaucggugcgggcgccgc

SEQ ID NO: 3257994 - RNA, 16 nt, Mycobacterium tuberculosis H37Rv
gccgcgaucgugcagg

SEQ ID NO: 3257995 - RNA, 20 nt, Mycobacterium tuberculosis H37Rv
gccgcgaucuccuuggccgu

SEQ ID NO: 3257996 - RNA, 20 nt, Mycobacterium tuberculosis H37Rv
gccgcgaugacggugccgac

SEQ ID NO: 3257997 - RNA, 23 nt, Mycobacterium tuberculosis H37Rv
gccgcgcacccguccgccgcaga

SEQ ID NO: 3257998 - RNA, 13 nt, Mycobacterium tuberculosis H37Rv
gccgcgcaccgcg

SEQ ID NO: 3257999 - RNA, 16 nt, Mycobacterium tuberculosis H37Rv
gccgcgcagccgcucg

SEQ ID NO: 3258000 - RNA, 17 nt, Mycobacterium tuberculosis H37Rv
gccgcgcagccgcucga

SEQ ID NO: 3258001 - RNA, 20 nt, Mycobacterium tuberculosis H37Rv
gccgcgcagccgcucgacgg

SEQ ID NO: 3258002 - RNA, 13 nt, Mycobacterium tuberculosis H37Rv
gccgcgcagcugc

SEQ ID NO: 3258003 - RNA, 22 nt, Mycobacterium tuberculosis H37Rv
gccgcgcaggggcggcgugaag

SEQ ID NO: 3258004 - RNA, 14 nt, Mycobacterium tuberculosis H37Rv
gccgcgcauccgca

SEQ ID NO: 3258005 - RNA, 22 nt, Mycobacterium tuberculosis H37Rv
gccgcgcaucugucgcgcggca

SEQ ID NO: 3258006 - RNA, 15 nt, Mycobacterium tuberculosis H37Rv
gccgcgccagcuccg

SEQ ID NO: 3258007 - RNA, 16 nt, Mycobacterium tuberculosis H37Rv
gccgcgcccaaugcgg

SEQ ID NO: 3258008 - RNA, 19 nt, Mycobacterium tuberculosis H37Rv
gccgcgcccaaugcgggcu

SEQ ID NO: 3258009 - RNA, 22 nt, Mycobacterium tuberculosis H37Rv
gccgcgcccaaugcgggcuggg

SEQ ID NO: 3258010 - RNA, 16 nt, Mycobacterium tuberculosis H37Rv
gccgcgcccaccauga

SEQ ID NO: 3258011 - RNA, 24 nt, Mycobacterium tuberculosis H37Rv
gccgcgcccaccaugaucacaccg

SEQ ID NO: 3258012 - RNA, 12 nt, Mycobacterium tuberculosis H37Rv
gccgcgcccggc

SEQ ID NO: 3258013 - RNA, 13 nt, Mycobacterium tuberculosis H37Rv
gccgcgcccggcg

SEQ ID NO: 3258014 - RNA, 16 nt, Mycobacterium tuberculosis H37Rv
gccgcgcccggcgcaa

SEQ ID NO: 3258015 - RNA, 20 nt, Mycobacterium tuberculosis H37Rv
gccgcgcccggcgcaagcgc

SEQ ID NO: 3258016 - RNA, 16 nt, Mycobacterium tuberculosis H37Rv
gccgcgcccuggccuu

SEQ ID NO: 3258017 - RNA, 14 nt, Mycobacterium tuberculosis H37Rv
gccgcgccgaaucg

SEQ ID NO: 3258018 - RNA, 17 nt, Mycobacterium tuberculosis H37Rv
gccgcgccgaaucgcgg

SEQ ID NO: 3258019 - RNA, 12 nt, Mycobacterium tuberculosis H37Rv
gccgcgccgacc

SEQ ID NO: 3258020 - RNA, 13 nt, Mycobacterium tuberculosis H37Rv
gccgcgccgaccu

SEQ ID NO: 3258021 - RNA, 18 nt, Mycobacterium tuberculosis H37Rv
gccgcgccgauuccaccg

SEQ ID NO: 3258022 - RNA, 13 nt, Mycobacterium tuberculosis H37Rv
gccgcgccgcaga

SEQ ID NO: 3258023 - RNA, 16 nt, Mycobacterium tuberculosis H37Rv
gccgcgccgcagagca

SEQ ID NO: 3258024 - RNA, 13 nt, Mycobacterium tuberculosis H37Rv
gccgcgccgcggc

SEQ ID NO: 3258025 - RNA, 16 nt, Mycobacterium tuberculosis H37Rv
gccgcgccgcggcccg

SEQ ID NO: 3258026 - RNA, 13 nt, Mycobacterium tuberculosis H37Rv
gccgcgccggcac

SEQ ID NO: 3258027 - RNA, 14 nt, Mycobacterium tuberculosis H37Rv
gccgcgccggcaga

SEQ ID NO: 3258028 - RNA, 14 nt, Mycobacterium tuberculosis H37Rv
gccgcgccggcccc

SEQ ID NO: 3258029 - RNA, 14 nt, Mycobacterium tuberculosis H37Rv
gccgcgccggcggc

SEQ ID NO: 3258030 - RNA, 15 nt, Mycobacterium tuberculosis H37Rv
gccgcgccggcggcc

SEQ ID NO: 3258031 - RNA, 18 nt, Mycobacterium tuberculosis H37Rv
gccgcgccggcgggcgag

SEQ ID NO: 3258032 - RNA, 16 nt, Mycobacterium tuberculosis H37Rv
gccgcgccggguccgc

SEQ ID NO: 3258033 - RNA, 15 nt, Mycobacterium tuberculosis H37Rv
gccgcgccggugugc

SEQ ID NO: 3258034 - RNA, 20 nt, Mycobacterium tuberculosis H37Rv
gccgcgccguagagccgcuc

SEQ ID NO: 3258035 - RNA, 24 nt, Mycobacterium tuberculosis H37Rv
gccgcgccguaguucuccgccaac

SEQ ID NO: 3258036 - RNA, 15 nt, Mycobacterium tuberculosis H37Rv
gccgcgccgucccga

SEQ ID NO: 3258037 - RNA, 18 nt, Mycobacterium tuberculosis H37Rv
gccgcgcgacaacccggc

SEQ ID NO: 3258038 - RNA, 22 nt, Mycobacterium tuberculosis H37Rv
gccgcgcgccaucgccuccagc

SEQ ID NO: 3258039 - RNA, 15 nt, Mycobacterium tuberculosis H37Rv
gccgcgcgccggcca

SEQ ID NO: 3258040 - RNA, 14 nt, Mycobacterium tuberculosis H37Rv
gccgcgcgccgguu

SEQ ID NO: 3258041 - RNA, 16 nt, Mycobacterium tuberculosis H37Rv
gccgcgcgcucgagca

SEQ ID NO: 3258042 - RNA, 19 nt, Mycobacterium tuberculosis H37Rv
gccgcgcggacccagcacc

SEQ ID NO: 3258043 - RNA, 13 nt, Mycobacterium tuberculosis H37Rv
gccgcgcggcgac

SEQ ID NO: 3258044 - RNA, 15 nt, Mycobacterium tuberculosis H37Rv
gccgcgcggcgagag

SEQ ID NO: 3258045 - RNA, 18 nt, Mycobacterium tuberculosis H37Rv
gccgcgcgggccgccgca

SEQ ID NO: 3258046 - RNA, 21 nt, Mycobacterium tuberculosis H37Rv
gccgcgcgggccgccgcaagu

SEQ ID NO: 3258047 - RNA, 14 nt, Mycobacterium tuberculosis H37Rv
gccgcgcgggucac

SEQ ID NO: 3258048 - RNA, 18 nt, Mycobacterium tuberculosis H37Rv
gccgcgcgggugcucggu

SEQ ID NO: 3258049 - RNA, 13 nt, Mycobacterium tuberculosis H37Rv
gccgcgcgguacu

SEQ ID NO: 3258050 - RNA, 21 nt, Mycobacterium tuberculosis H37Rv
gccgcgcggugauggucaccg

SEQ ID NO: 3258051 - RNA, 15 nt, Mycobacterium tuberculosis H37Rv
gccgcgcguccgggc

SEQ ID NO: 3258052 - RNA, 14 nt, Mycobacterium tuberculosis H37Rv
gccgcgcgugacag

SEQ ID NO: 3258053 - RNA, 15 nt, Mycobacterium tuberculosis H37Rv
gccgcgcguuccagc

SEQ ID NO: 3258054 - RNA, 18 nt, Mycobacterium tuberculosis H37Rv
gccgcgcucaucgcggcg

SEQ ID NO: 3258055 - RNA, 21 nt, Mycobacterium tuberculosis H37Rv
gccgcgcucaucgcggcgaac

SEQ ID NO: 3258056 - RNA, 13 nt, Mycobacterium tuberculosis H37Rv
gccgcgcucgaac

SEQ ID NO: 3258057 - RNA, 14 nt, Mycobacterium tuberculosis H37Rv
gccgcgcucgucga

SEQ ID NO: 3258058 - RNA, 20 nt, Mycobacterium tuberculosis H37Rv
gccgcgcucgucgaaguagc

SEQ ID NO: 3258059 - RNA, 22 nt, Mycobacterium tuberculosis H37Rv
gccgcgcuggugauucgcagcc

SEQ ID NO: 3258060 - RNA, 23 nt, Mycobacterium tuberculosis H37Rv
gccgcgcuggugauucgcagccg

SEQ ID NO: 3258061 - RNA, 14 nt, Mycobacterium tuberculosis H37Rv
gccgcgcuugcgau

SEQ ID NO: 3258062 - RNA, 19 nt, Mycobacterium tuberculosis H37Rv
gccgcgcuugcgaucgccg

SEQ ID NO: 3258063 - RNA, 18 nt, Mycobacterium tuberculosis H37Rv
gccgcgcuugcgaucggc

SEQ ID NO: 3258064 - RNA, 19 nt, Mycobacterium tuberculosis H37Rv
gccgcgcuugcgaucggca

SEQ ID NO: 3258065 - RNA, 15 nt, Mycobacterium tuberculosis H37Rv
gccgcggaccccgac

SEQ ID NO: 3258066 - RNA, 17 nt, Mycobacterium tuberculosis H37Rv
gccgcggacguggucgg

SEQ ID NO: 3258067 - RNA, 15 nt, Mycobacterium tuberculosis H37Rv
gccgcggagaaggcg

SEQ ID NO: 3258068 - RNA, 22 nt, Mycobacterium tuberculosis H37Rv
gccgcggagaaggcgcgggcga

SEQ ID NO: 3258069 - RNA, 17 nt, Mycobacterium tuberculosis H37Rv
gccgcggaguaggccgc

SEQ ID NO: 3258070 - RNA, 21 nt, Mycobacterium tuberculosis H37Rv
gccgcggcaacaccaccucga

SEQ ID NO: 3258071 - RNA, 23 nt, Mycobacterium tuberculosis H37Rv
gccgcggcaacaccaccucgacg

SEQ ID NO: 3258072 - RNA, 17 nt, Mycobacterium tuberculosis H37Rv
gccgcucgggccagcga

SEQ ID NO: 3258073 - RNA, 20 nt, Mycobacterium tuberculosis H37Rv
gccgcucguuacgccgagca

SEQ ID NO: 3258074 - RNA, 16 nt, Mycobacterium tuberculosis H37Rv
gccgcucuagcgucgu

SEQ ID NO: 3258075 - RNA, 17 nt, Mycobacterium tuberculosis H37Rv
gccgcugaagccaaaug

SEQ ID NO: 3258076 - RNA, 20 nt, Mycobacterium tuberculosis H37Rv
gccgcugaagccaggauugc

SEQ ID NO: 3258077 - RNA, 16 nt, Mycobacterium tuberculosis H37Rv
gccgcugacgguucgg

SEQ ID NO: 3258078 - RNA, 12 nt, Mycobacterium tuberculosis H37Rv
gccgcugagccc

SEQ ID NO: 3258079 - RNA, 15 nt, Mycobacterium tuberculosis H37Rv
gccgcugagcccugc

SEQ ID NO: 3258080 - RNA, 14 nt, Mycobacterium tuberculosis H37Rv
gccgcugaucaaca

SEQ ID NO: 3258081 - RNA, 21 nt, Mycobacterium tuberculosis H37Rv
gccgcugaucugccgccgcgg

SEQ ID NO: 3258082 - RNA, 22 nt, Mycobacterium tuberculosis H37Rv
gccgcugaucugccgccgcggc

SEQ ID NO: 3258083 - RNA, 22 nt, Mycobacterium tuberculosis H37Rv
gccgcugaugcuggccaggacg

SEQ ID NO: 3258084 - RNA, 22 nt, Mycobacterium tuberculosis H37Rv
gccgcugcauacaaccccgcgc

SEQ ID NO: 3258085 - RNA, 14 nt, Mycobacterium tuberculosis H37Rv
gccgcugcauccgc

SEQ ID NO: 3258086 - RNA, 15 nt, Mycobacterium tuberculosis H37Rv
gccgcugcauccgca

SEQ ID NO: 3258087 - RNA, 18 nt, Mycobacterium tuberculosis H37Rv
gccgcugcauccgcagca

SEQ ID NO: 3258088 - RNA, 19 nt, Mycobacterium tuberculosis H37Rv
gccgcugcauccgcagcac

SEQ ID NO: 3258089 - RNA, 12 nt, Mycobacterium tuberculosis H37Rv
gccgcugccacu

SEQ ID NO: 3258090 - RNA, 14 nt, Mycobacterium tuberculosis H37Rv
gccgcugccagccg

SEQ ID NO: 3258091 - RNA, 15 nt, Mycobacterium tuberculosis H37Rv
gccgcugccagccgu

SEQ ID NO: 3258092 - RNA, 20 nt, Mycobacterium tuberculosis H37Rv
gccgcugccgcccuugccgc

SEQ ID NO: 3258093 - RNA, 21 nt, Mycobacterium tuberculosis H37Rv
gccgcugccgcccuugccgcc

SEQ ID NO: 3258094 - RNA, 16 nt, Mycobacterium tuberculosis H37Rv
gccgcugccgcgcggc

SEQ ID NO: 3258095 - RNA, 17 nt, Mycobacterium tuberculosis H37Rv
gccgcugccgcgcggcg

SEQ ID NO: 3258096 - RNA, 14 nt, Mycobacterium tuberculosis H37Rv
gccgcugccuucuu

SEQ ID NO: 3258097 - RNA, 23 nt, Mycobacterium tuberculosis H37Rv
gccgcugcgaaagcacgugcacg

SEQ ID NO: 3258098 - RNA, 16 nt, Mycobacterium tuberculosis H37Rv
gccgcugcgccgucgc

SEQ ID NO: 3258099 - RNA, 19 nt, Mycobacterium tuberculosis H37Rv
gccgcugcgccgucgcagc

SEQ ID NO: 3258100 - RNA, 13 nt, Mycobacterium tuberculosis H37Rv
gccgcugcggcac

SEQ ID NO: 3258101 - RNA, 15 nt, Mycobacterium tuberculosis H37Rv
gccgcuggaagucgg

SEQ ID NO: 3258102 - RNA, 20 nt, Mycobacterium tuberculosis H37Rv
gccgcuggagaucacgccga

SEQ ID NO: 3258103 - RNA, 23 nt, Mycobacterium tuberculosis H37Rv
gccgcuggagaucacgccgacga

SEQ ID NO: 3258104 - RNA, 12 nt, Mycobacterium tuberculosis H37Rv
gccgcuggcaau

SEQ ID NO: 3258105 - RNA, 17 nt, Mycobacterium tuberculosis H37Rv
gccgcuggcaaucccgc

SEQ ID NO: 3258106 - RNA, 22 nt, Mycobacterium tuberculosis H37Rv
gccgcuggcaaucccgcggucg

SEQ ID NO: 3258107 - RNA, 19 nt, Mycobacterium tuberculosis H37Rv
gccgcuggggcgcccgaga

SEQ ID NO: 3258108 - RNA, 17 nt, Mycobacterium tuberculosis H37Rv
gccgcugggugaccagg

SEQ ID NO: 3258109 - RNA, 22 nt, Mycobacterium tuberculosis H37Rv
gccgcugucguaccgcucggcg

SEQ ID NO: 3258110 - RNA, 20 nt, Mycobacterium tuberculosis H37Rv
gccgcugugagcuuggucgc

SEQ ID NO: 3258111 - RNA, 13 nt, Mycobacterium tuberculosis H37Rv
gccgcugugcggu

SEQ ID NO: 3258112 - RNA, 14 nt, Mycobacterium tuberculosis H37Rv
gccgcuguggccgc

SEQ ID NO: 3258113 - RNA, 20 nt, Mycobacterium tuberculosis H37Rv
gccgcugugggucgauccgg

SEQ ID NO: 3258114 - RNA, 16 nt, Mycobacterium tuberculosis H37Rv
gccgcuguugaucgac

SEQ ID NO: 3258115 - RNA, 17 nt, Mycobacterium tuberculosis H37Rv
gccgcuuagcaaucggc

SEQ ID NO: 3258116 - RNA, 17 nt, Mycobacterium tuberculosis H37Rv
gccgcuucggcggucag

SEQ ID NO: 3258117 - RNA, 21 nt, Mycobacterium tuberculosis H37Rv
gccgcuucggcggucagcggc

SEQ ID NO: 3258118 - RNA, 19 nt, Mycobacterium tuberculosis H37Rv
gccgcuucgggcgucaucc

SEQ ID NO: 3258119 - RNA, 21 nt, Mycobacterium tuberculosis H37Rv
gccgcuucgggcgucauccgc

SEQ ID NO: 3258120 - RNA, 15 nt, Mycobacterium tuberculosis H37Rv
gccgcuugccccgcc

SEQ ID NO: 3258121 - RNA, 17 nt, Mycobacterium tuberculosis H37Rv
gccgcuugccccgccuu

SEQ ID NO: 3258122 - RNA, 18 nt, Mycobacterium tuberculosis H37Rv
gccgcuugccccgccuug

SEQ ID NO: 3258123 - RNA, 23 nt, Mycobacterium tuberculosis H37Rv
gccgcuugccccgccuuggccac

SEQ ID NO: 3258124 - RNA, 13 nt, Mycobacterium tuberculosis H37Rv
gccgcuuggccgc

SEQ ID NO: 3258125 - RNA, 14 nt, Mycobacterium tuberculosis H37Rv
gccgcuugggccug

SEQ ID NO: 3258126 - RNA, 19 nt, Mycobacterium tuberculosis H37Rv
gccgcuuucgccggcgcca

SEQ ID NO: 3258127 - RNA, 23 nt, Mycobacterium tuberculosis H37Rv
gccgcuuuugauugaccaacccu

SEQ ID NO: 3258128 - RNA, 14 nt, Mycobacterium tuberculosis H37Rv
gccggaaagcccgu

SEQ ID NO: 3258129 - RNA, 18 nt, Mycobacterium tuberculosis H37Rv
gccggaacgagcggccgc

SEQ ID NO: 3258130 - RNA, 20 nt, Mycobacterium tuberculosis H37Rv
gccggaacgagcggccgcgc

SEQ ID NO: 3258131 - RNA, 21 nt, Mycobacterium tuberculosis H37Rv
gccggaacgcacgcccgccug

SEQ ID NO: 3258132 - RNA, 13 nt, Mycobacterium tuberculosis H37Rv
gccggaagcgccg

SEQ ID NO: 3258133 - RNA, 18 nt, Mycobacterium tuberculosis H37Rv
gccggaauacccgcuggc

SEQ ID NO: 3258134 - RNA, 20 nt, Mycobacterium tuberculosis H37Rv
gccggaaucgagacgguagc

SEQ ID NO: 3258135 - RNA, 22 nt, Mycobacterium tuberculosis H37Rv
gccggacaaaccgggcggccaa

SEQ ID NO: 3258136 - RNA, 12 nt, Mycobacterium tuberculosis H37Rv
gccggacaacug

SEQ ID NO: 3258137 - RNA, 20 nt, Mycobacterium tuberculosis H37Rv
gccggacagcucgcgcucgc

SEQ ID NO: 3258138 - RNA, 24 nt, Mycobacterium tuberculosis H37Rv
gccggacaggcuugacugcacacc

SEQ ID NO: 3258139 - RNA, 17 nt, Mycobacterium tuberculosis H37Rv
gccggaccagcuccugc

SEQ ID NO: 3258140 - RNA, 18 nt, Mycobacterium tuberculosis H37Rv
gccggaccagcuccugca

SEQ ID NO: 3258141 - RNA, 23 nt, Mycobacterium tuberculosis H37Rv
gccggacccaccgucacccccga

SEQ ID NO: 3258142 - RNA, 20 nt, Mycobacterium tuberculosis H37Rv
gccggacccgccggguccgc

SEQ ID NO: 3258143 - RNA, 17 nt, Mycobacterium tuberculosis H37Rv
gccggacccggucgccg

SEQ ID NO: 3258144 - RNA, 17 nt, Mycobacterium tuberculosis H37Rv
gccggaccgcgacggcg

SEQ ID NO: 3258145 - RNA, 16 nt, Mycobacterium tuberculosis H37Rv
gccggacgggugcggg

SEQ ID NO: 3258146 - RNA, 17 nt, Mycobacterium tuberculosis H37Rv
gccggacuaccgccggc

SEQ ID NO: 3258147 - RNA, 18 nt, Mycobacterium tuberculosis H37Rv
gccggacuaccgccggcg

SEQ ID NO: 3258148 - RNA, 18 nt, Mycobacterium tuberculosis H37Rv
gccggacugaagccgcga

SEQ ID NO: 3258149 - RNA, 14 nt, Mycobacterium tuberculosis H37Rv
gccggacugcggcc

SEQ ID NO: 3258150 - RNA, 17 nt, Mycobacterium tuberculosis H37Rv
gccggagacccgggugc

SEQ ID NO: 3258151 - RNA, 20 nt, Mycobacterium tuberculosis H37Rv
gccggagacgucgccgcagu

SEQ ID NO: 3258152 - RNA, 14 nt, Mycobacterium tuberculosis H37Rv
gccggagaguagga

SEQ ID NO: 3258153 - RNA, 14 nt, Mycobacterium tuberculosis H37Rv
gccggagagucggg

SEQ ID NO: 3258154 - RNA, 15 nt, Mycobacterium tuberculosis H37Rv
gccggagccgccggc

SEQ ID NO: 3258155 - RNA, 18 nt, Mycobacterium tuberculosis H37Rv
gccggagccgccggcccc

SEQ ID NO: 3258156 - RNA, 20 nt, Mycobacterium tuberculosis H37Rv
gccggagccgccggccccgc

SEQ ID NO: 3258157 - RNA, 15 nt, Mycobacterium tuberculosis H37Rv
gccggagccggugcc

SEQ ID NO: 3258158 - RNA, 19 nt, Mycobacterium tuberculosis H37Rv
gccggagccggugccgacg

SEQ ID NO: 3258159 - RNA, 17 nt, Mycobacterium tuberculosis H37Rv
gccggaggaucgcuggu

SEQ ID NO: 3258160 - RNA, 20 nt, Mycobacterium tuberculosis H37Rv
gccggaggaucgcugguugg

SEQ ID NO: 3258161 - RNA, 18 nt, Mycobacterium tuberculosis H37Rv
gccggaggcaagcaaccg

SEQ ID NO: 3258162 - RNA, 21 nt, Mycobacterium tuberculosis H37Rv
gccggaggcaagcaaccggug

SEQ ID NO: 3258163 - RNA, 23 nt, Mycobacterium tuberculosis H37Rv
gccggaggcaagcaaccggugcg

SEQ ID NO: 3258164 - RNA, 15 nt, Mycobacterium tuberculosis H37Rv
gccggaggucgggcg

SEQ ID NO: 3258165 - RNA, 18 nt, Mycobacterium tuberculosis H37Rv
gccggaggucgggcggcg

SEQ ID NO: 3258166 - RNA, 13 nt, Mycobacterium tuberculosis H37Rv
gccggagucaccg

SEQ ID NO: 3258167 - RNA, 15 nt, Mycobacterium tuberculosis H37Rv
gccggagucgacgac

SEQ ID NO: 3258168 - RNA, 17 nt, Mycobacterium tuberculosis H37Rv
gccggccagcggccauc

SEQ ID NO: 3258169 - RNA, 15 nt, Mycobacterium tuberculosis H37Rv
gccggccagcgucgc

SEQ ID NO: 3258170 - RNA, 18 nt, Mycobacterium tuberculosis H37Rv
gccggccagcgucgcaag

SEQ ID NO: 3258171 - RNA, 21 nt, Mycobacterium tuberculosis H37Rv
gccggccauaccgcucgccgu

SEQ ID NO: 3258172 - RNA, 15 nt, Mycobacterium tuberculosis H37Rv
gccggccaucgcccg

SEQ ID NO: 3258173 - RNA, 18 nt, Mycobacterium tuberculosis H37Rv
gccggccaugccuucggu

SEQ ID NO: 3258174 - RNA, 18 nt, Mycobacterium tuberculosis H37Rv
gccggcccaccaggccca

SEQ ID NO: 3258175 - RNA, 17 nt, Mycobacterium tuberculosis H37Rv
gccggccccaccggugc

SEQ ID NO: 3258176 - RNA, 20 nt, Mycobacterium tuberculosis H37Rv
gccggccccaccggugccgc

SEQ ID NO: 3258177 - RNA, 12 nt, Mycobacterium tuberculosis H37Rv
gccggcccccac

SEQ ID NO: 3258178 - RNA, 14 nt, Mycobacterium tuberculosis H37Rv
gccggccccgccga

SEQ ID NO: 3258179 - RNA, 22 nt, Mycobacterium tuberculosis H37Rv
gccggccccgccgaugccgccg

SEQ ID NO: 3258180 - RNA, 14 nt, Mycobacterium tuberculosis H37Rv
gccggccccgccgg

SEQ ID NO: 3258181 - RNA, 20 nt, Mycobacterium tuberculosis H37Rv
gccggccccgccggccccgc

SEQ ID NO: 3258182 - RNA, 23 nt, Mycobacterium tuberculosis H37Rv
gccggccccgccgucaccgccgu

SEQ ID NO: 3258183 - RNA, 23 nt, Mycobacterium tuberculosis H37Rv
gccggccccgccguuaccgccgu

SEQ ID NO: 3258184 - RNA, 16 nt, Mycobacterium tuberculosis H37Rv
gccggcccgacgggua

SEQ ID NO: 3258185 - RNA, 12 nt, Mycobacterium tuberculosis H37Rv
gccggcccgcaa

SEQ ID NO: 3258186 - RNA, 12 nt, Mycobacterium tuberculosis H37Rv
gccggcccgcag

SEQ ID NO: 3258187 - RNA, 14 nt, Mycobacterium tuberculosis H37Rv
gccggcccgcagcc

SEQ ID NO: 3258188 - RNA, 15 nt, Mycobacterium tuberculosis H37Rv
gccggcccgcgggcg

SEQ ID NO: 3258189 - RNA, 20 nt, Mycobacterium tuberculosis H37Rv
gccggcccggguaucgccag

SEQ ID NO: 3258190 - RNA, 14 nt, Mycobacterium tuberculosis H37Rv
gccggcccugcggc

SEQ ID NO: 3258191 - RNA, 19 nt, Mycobacterium tuberculosis H37Rv
gccggcccugcggccaaug

SEQ ID NO: 3258192 - RNA, 18 nt, Mycobacterium tuberculosis H37Rv
gccggcccugcucgccgu

SEQ ID NO: 3258193 - RNA, 22 nt, Mycobacterium tuberculosis H37Rv
gccggcccugcucgccgucucg

SEQ ID NO: 3258194 - RNA, 18 nt, Mycobacterium tuberculosis H37Rv
gccggcccugcucggcca

SEQ ID NO: 3258195 - RNA, 23 nt, Mycobacterium tuberculosis H37Rv
gccggccgagcgcacuggggagg

SEQ ID NO: 3258196 - RNA, 17 nt, Mycobacterium tuberculosis H37Rv
gccggccgaucggccgg

SEQ ID NO: 3258197 - RNA, 13 nt, Mycobacterium tuberculosis H37Rv
gccggccgccagc

SEQ ID NO: 3258198 - RNA, 17 nt, Mycobacterium tuberculosis H37Rv
gccggccgccagccggu

SEQ ID NO: 3258199 - RNA, 23 nt, Mycobacterium tuberculosis H37Rv
gccggccgccagccgguccagca

SEQ ID NO: 3258200 - RNA, 13 nt, Mycobacterium tuberculosis H37Rv
gccggccgcccgc

SEQ ID NO: 3258201 - RNA, 14 nt, Mycobacterium tuberculosis H37Rv
gccggccgccgacc

SEQ ID NO: 3258202 - RNA, 14 nt, Mycobacterium tuberculosis H37Rv
gccggccgccgcgg

SEQ ID NO: 3258203 - RNA, 15 nt, Mycobacterium tuberculosis H37Rv
gccggccgcgaccgc

SEQ ID NO: 3258204 - RNA, 15 nt, Mycobacterium tuberculosis H37Rv
gccggccgcgccggc

SEQ ID NO: 3258205 - RNA, 15 nt, Mycobacterium tuberculosis H37Rv
gccggccgcgcuggu

SEQ ID NO: 3258206 - RNA, 13 nt, Mycobacterium tuberculosis H37Rv
gccggccgcgggc

SEQ ID NO: 3258207 - RNA, 14 nt, Mycobacterium tuberculosis H37Rv
gccggccgcgggcg

SEQ ID NO: 3258208 - RNA, 14 nt, Mycobacterium tuberculosis H37Rv
gccggccgcggggc

SEQ ID NO: 3258209 - RNA, 20 nt, Mycobacterium tuberculosis H37Rv
gccggccgcucaccccgcgc

SEQ ID NO: 3258210 - RNA, 20 nt, Mycobacterium tuberculosis H37Rv
gccggccgcuuggccgcugc

SEQ ID NO: 3258211 - RNA, 16 nt, Mycobacterium tuberculosis H37Rv
gccggccggcccauuc

SEQ ID NO: 3258212 - RNA, 15 nt, Mycobacterium tuberculosis H37Rv
gccggccggcccggg

SEQ ID NO: 3258213 - RNA, 14 nt, Mycobacterium tuberculosis H37Rv
gccggccgggugua

SEQ ID NO: 3258214 - RNA, 14 nt, Mycobacterium tuberculosis H37Rv
gccggccgguggcc

SEQ ID NO: 3258215 - RNA, 14 nt, Mycobacterium tuberculosis H37Rv
gccggccgucgauc

SEQ ID NO: 3258216 - RNA, 13 nt, Mycobacterium tuberculosis H37Rv
gccggccgucggc

SEQ ID NO: 3258217 - RNA, 16 nt, Mycobacterium tuberculosis H37Rv
gccggccgucggccgg

SEQ ID NO: 3258218 - RNA, 18 nt, Mycobacterium tuberculosis H37Rv
gccggccgucggccggau

SEQ ID NO: 3258219 - RNA, 21 nt, Mycobacterium tuberculosis H37Rv
gccggccuagccgauggcuac

SEQ ID NO: 3258220 - RNA, 16 nt, Mycobacterium tuberculosis H37Rv
gccggccucgccgaag

SEQ ID NO: 3258221 - RNA, 21 nt, Mycobacterium tuberculosis H37Rv
gccggccucgccgaagcgggc

SEQ ID NO: 3258222 - RNA, 13 nt, Mycobacterium tuberculosis H37Rv
gccggccucugga

SEQ ID NO: 3258223 - RNA, 18 nt, Mycobacterium tuberculosis H37Rv
gccggccucuggaucacg

SEQ ID NO: 3258224 - RNA, 19 nt, Mycobacterium tuberculosis H37Rv
gccggcgaaccccagcgca

SEQ ID NO: 3258225 - RNA, 19 nt, Mycobacterium tuberculosis H37Rv
gccggcgaacucgcgccga

SEQ ID NO: 3258226 - RNA, 19 nt, Mycobacterium tuberculosis H37Rv
gccggcgaagugcuccacc

SEQ ID NO: 3258227 - RNA, 22 nt, Mycobacterium tuberculosis H37Rv
gccggcgaagugcuccaccucg

SEQ ID NO: 3258228 - RNA, 14 nt, Mycobacterium tuberculosis H37Rv
gccggcgaaugcgg

SEQ ID NO: 3258229 - RNA, 15 nt, Mycobacterium tuberculosis H37Rv
gccggcgacggcguc

SEQ ID NO: 3258230 - RNA, 15 nt, Mycobacterium tuberculosis H37Rv
gccggcgacgggucg

SEQ ID NO: 3258231 - RNA, 18 nt, Mycobacterium tuberculosis H37Rv
gccggcgacgggucgggc

SEQ ID NO: 3258232 - RNA, 19 nt, Mycobacterium tuberculosis H37Rv
gccggcgagcagacgcaaa

SEQ ID NO: 3258233 - RNA, 16 nt, Mycobacterium tuberculosis H37Rv
gccggcgagggccacg

SEQ ID NO: 3258234 - RNA, 17 nt, Mycobacterium tuberculosis H37Rv
gccggcgagggccacgg

SEQ ID NO: 3258235 - RNA, 14 nt, Mycobacterium tuberculosis H37Rv
gccggcgauggccc

SEQ ID NO: 3258236 - RNA, 19 nt, Mycobacterium tuberculosis H37Rv
gccggcgauuaccggcacg

SEQ ID NO: 3258237 - RNA, 13 nt, Mycobacterium tuberculosis H37Rv
gccggcgcagugg

SEQ ID NO: 3258238 - RNA, 13 nt, Mycobacterium tuberculosis H37Rv
gccggcgccaagu

SEQ ID NO: 3258239 - RNA, 15 nt, Mycobacterium tuberculosis H37Rv
gccggcgccacccgc

SEQ ID NO: 3258240 - RNA, 16 nt, Mycobacterium tuberculosis H37Rv
gccggcgccaccgagu

SEQ ID NO: 3258241 - RNA, 15 nt, Mycobacterium tuberculosis H37Rv
gccggcgccagcaga

SEQ ID NO: 3258242 - RNA, 17 nt, Mycobacterium tuberculosis H37Rv
gccggcgcccaggccga

SEQ ID NO: 3258243 - RNA, 18 nt, Mycobacterium tuberculosis H37Rv
gccggcgcccaggccgau

SEQ ID NO: 3258244 - RNA, 14 nt, Mycobacterium tuberculosis H37Rv
gccggcgcccccgu

SEQ ID NO: 3258245 - RNA, 19 nt, Mycobacterium tuberculosis H37Rv
gccggcgcccgccgcgaac

SEQ ID NO: 3258246 - RNA, 22 nt, Mycobacterium tuberculosis H37Rv
gccggcgcccgccgcgaacucc

SEQ ID NO: 3258247 - RNA, 17 nt, Mycobacterium tuberculosis H37Rv
gccggcgccgcccgcgc

SEQ ID NO: 3258248 - RNA, 15 nt, Mycobacterium tuberculosis H37Rv
gccggcgccgcccuu

SEQ ID NO: 3258249 - RNA, 16 nt, Mycobacterium tuberculosis H37Rv
gccggcgccgccggcg

SEQ ID NO: 3258250 - RNA, 16 nt, Mycobacterium tuberculosis H37Rv
gccggcgccgccggug

SEQ ID NO: 3258251 - RNA, 18 nt, Mycobacterium tuberculosis H37Rv
gccggcgccgccggugcc

SEQ ID NO: 3258252 - RNA, 23 nt, Mycobacterium tuberculosis H37Rv
gccggcgccgccggugccaccgg

SEQ ID NO: 3258253 - RNA, 14 nt, Mycobacterium tuberculosis H37Rv
gccggcgccgccgu

SEQ ID NO: 3258254 - RNA, 23 nt, Mycobacterium tuberculosis H37Rv
gccggcgccgccguuaccgccgg

SEQ ID NO: 3258255 - RNA, 12 nt, Mycobacterium tuberculosis H37Rv
gccggcgccggc

SEQ ID NO: 3258256 - RNA, 16 nt, Mycobacterium tuberculosis H37Rv
gccggcgccggcaucu

SEQ ID NO: 3258257 - RNA, 14 nt, Mycobacterium tuberculosis H37Rv
gccggcgccggccc

SEQ ID NO: 3258258 - RNA, 19 nt, Mycobacterium tuberculosis H37Rv
gccggcgccggcgcugcug

SEQ ID NO: 3258259 - RNA, 18 nt, Mycobacterium tuberculosis H37Rv
gccggcgcgcaccccggc

SEQ ID NO: 3258260 - RNA, 16 nt, Mycobacterium tuberculosis H37Rv
gccggcgcgccccacc

SEQ ID NO: 3258261 - RNA, 14 nt, Mycobacterium tuberculosis H37Rv
gccggcgcgccgau

SEQ ID NO: 3258262 - RNA, 12 nt, Mycobacterium tuberculosis H37Rv
gccggcgcggcg

SEQ ID NO: 3258263 - RNA, 14 nt, Mycobacterium tuberculosis H37Rv
gccggcgcggcggc

SEQ ID NO: 3258264 - RNA, 16 nt, Mycobacterium tuberculosis H37Rv
gccggcgcggcguaac

SEQ ID NO: 3258265 - RNA, 15 nt, Mycobacterium tuberculosis H37Rv
gccgggccaggccga

SEQ ID NO: 3258266 - RNA, 19 nt, Mycobacterium tuberculosis H37Rv
gccgggccauucaccgcgc

SEQ ID NO: 3258267 - RNA, 11 nt, Mycobacterium tuberculosis H37Rv
gccgggcccag

SEQ ID NO: 3258268 - RNA, 15 nt, Mycobacterium tuberculosis H37Rv
gccgggccccacauc

SEQ ID NO: 3258269 - RNA, 14 nt, Mycobacterium tuberculosis H37Rv
gccgggcccgacgu

SEQ ID NO: 3258270 - RNA, 21 nt, Mycobacterium tuberculosis H37Rv
gccgggcccuccacugcgagc

SEQ ID NO: 3258271 - RNA, 22 nt, Mycobacterium tuberculosis H37Rv
gccgggcccuuccuggccgaau

SEQ ID NO: 3258272 - RNA, 15 nt, Mycobacterium tuberculosis H37Rv
gccgggccgccgagc

SEQ ID NO: 3258273 - RNA, 15 nt, Mycobacterium tuberculosis H37Rv
gccgggccgcgcggg

SEQ ID NO: 3258274 - RNA, 13 nt, Mycobacterium tuberculosis H37Rv
gccgggccggcca

SEQ ID NO: 3258275 - RNA, 13 nt, Mycobacterium tuberculosis H37Rv
gccgggccguaga

SEQ ID NO: 3258276 - RNA, 22 nt, Mycobacterium tuberculosis H37Rv
gccgggcgaguacaggcgcagc

SEQ ID NO: 3258277 - RNA, 16 nt, Mycobacterium tuberculosis H37Rv
gccgggcgaugcuggg

SEQ ID NO: 3258278 - RNA, 17 nt, Mycobacterium tuberculosis H37Rv
gccgggcgaugcugggc

SEQ ID NO: 3258279 - RNA, 13 nt, Mycobacterium tuberculosis H37Rv
gccgggcgcacgc

SEQ ID NO: 3258280 - RNA, 14 nt, Mycobacterium tuberculosis H37Rv
gccgggcgccgugc

SEQ ID NO: 3258281 - RNA, 21 nt, Mycobacterium tuberculosis H37Rv
gccgggcgccgugccccgggc

SEQ ID NO: 3258282 - RNA, 15 nt, Mycobacterium tuberculosis H37Rv
gccgggcgcgccggc

SEQ ID NO: 3258283 - RNA, 19 nt, Mycobacterium tuberculosis H37Rv
gccgggcgcgccggccaug

SEQ ID NO: 3258284 - RNA, 13 nt, Mycobacterium tuberculosis H37Rv
gccgggcggccgc

SEQ ID NO: 3258285 - RNA, 19 nt, Mycobacterium tuberculosis H37Rv
gccgggcggcggugcguca

SEQ ID NO: 3258286 - RNA, 17 nt, Mycobacterium tuberculosis H37Rv
gccgggcguccucgucg

SEQ ID NO: 3258287 - RNA, 14 nt, Mycobacterium tuberculosis H37Rv
gccgggcucagcug

SEQ ID NO: 3258288 - RNA, 20 nt, Mycobacterium tuberculosis H37Rv
gccgggcucagcugggccgc

SEQ ID NO: 3258289 - RNA, 16 nt, Mycobacterium tuberculosis H37Rv
gccgggcucgcgaucg

SEQ ID NO: 3258290 - RNA, 18 nt, Mycobacterium tuberculosis H37Rv
gccgggcuucagcacgcg

SEQ ID NO: 3258291 - RNA, 23 nt, Mycobacterium tuberculosis H37Rv
gccgggcuuguagacgccaugca

SEQ ID NO: 3258292 - RNA, 16 nt, Mycobacterium tuberculosis H37Rv
gccggggacgccgcgg

SEQ ID NO: 3258293 - RNA, 18 nt, Mycobacterium tuberculosis H37Rv
gccggggacgccgcggcg

SEQ ID NO: 3258294 - RNA, 13 nt, Mycobacterium tuberculosis H37Rv
gccggggccccau

SEQ ID NO: 3258295 - RNA, 21 nt, Mycobacterium tuberculosis H37Rv
gccggggccccaugccgaccg

SEQ ID NO: 3258296 - RNA, 16 nt, Mycobacterium tuberculosis H37Rv
gccggggccgccgaug

SEQ ID NO: 3258297 - RNA, 17 nt, Mycobacterium tuberculosis H37Rv
gccggggccgccgucgc

SEQ ID NO: 3258298 - RNA, 20 nt, Mycobacterium tuberculosis H37Rv
gccggggcgaugucggcugg

SEQ ID NO: 3258299 - RNA, 16 nt, Mycobacterium tuberculosis H37Rv
gccggggcggaaccug

SEQ ID NO: 3258300 - RNA, 20 nt, Mycobacterium tuberculosis H37Rv
gccgggguacccgguggcac

SEQ ID NO: 3258301 - RNA, 18 nt, Mycobacterium tuberculosis H37Rv
gccgggguaggggucgag

SEQ ID NO: 3258302 - RNA, 21 nt, Mycobacterium tuberculosis H37Rv
gccgggguaggggucgagguc

SEQ ID NO: 3258303 - RNA, 16 nt, Mycobacterium tuberculosis H37Rv
gccggggucggcccgc

SEQ ID NO: 3258304 - RNA, 13 nt, Mycobacterium tuberculosis H37Rv
gccggggugugca

SEQ ID NO: 3258305 - RNA, 15 nt, Mycobacterium tuberculosis H37Rv
gccggggugugcggg

SEQ ID NO: 3258306 - RNA, 18 nt, Mycobacterium tuberculosis H37Rv
gccgggguucaccgucga

SEQ ID NO: 3258307 - RNA, 18 nt, Mycobacterium tuberculosis H37Rv
gccggguccgcggagaac

SEQ ID NO: 3258308 - RNA, 22 nt, Mycobacterium tuberculosis H37Rv
gccggguccggaaccgguaucg

SEQ ID NO: 3258309 - RNA, 14 nt, Mycobacterium tuberculosis H37Rv
gccgggucggugac

SEQ ID NO: 3258310 - RNA, 15 nt, Mycobacterium tuberculosis H37Rv
gccgggucggugacg

SEQ ID NO: 3258311 - RNA, 21 nt, Mycobacterium tuberculosis H37Rv
gccgggucucuugcggggucg

SEQ ID NO: 3258312 - RNA, 19 nt, Mycobacterium tuberculosis H37Rv
gccgggugaggcggugacg

SEQ ID NO: 3258313 - RNA, 16 nt, Mycobacterium tuberculosis H37Rv
gccgggugaguucggc

SEQ ID NO: 3258314 - RNA, 21 nt, Mycobacterium tuberculosis H37Rv
gccgggugcaacggcguuggc

SEQ ID NO: 3258315 - RNA, 20 nt, Mycobacterium tuberculosis H37Rv
gccgggugcgagcgacaccg

SEQ ID NO: 3258316 - RNA, 16 nt, Mycobacterium tuberculosis H37Rv
gccgggugcgccguug

SEQ ID NO: 3258317 - RNA, 21 nt, Mycobacterium tuberculosis H37Rv
gccgggugcgccguugccgcc

SEQ ID NO: 3258318 - RNA, 19 nt, Mycobacterium tuberculosis H37Rv
gccggguggcccggcgaaa

SEQ ID NO: 3258319 - RNA, 16 nt, Mycobacterium tuberculosis H37Rv
gccgggugggagcagc

SEQ ID NO: 3258320 - RNA, 17 nt, Mycobacterium tuberculosis H37Rv
gccgggugggagcagcc

SEQ ID NO: 3258321 - RNA, 12 nt, Mycobacterium tuberculosis H37Rv
gccgggugggca

SEQ ID NO: 3258322 - RNA, 16 nt, Mycobacterium tuberculosis H37Rv
gccggguuaucggcag

SEQ ID NO: 3258323 - RNA, 12 nt, Mycobacterium tuberculosis H37Rv
gccggguuccag

SEQ ID NO: 3258324 - RNA, 16 nt, Mycobacterium tuberculosis H37Rv
gccggguucgcgucug

SEQ ID NO: 3258325 - RNA, 20 nt, Mycobacterium tuberculosis H37Rv
gccggguuggccggcgcugc

SEQ ID NO: 3258326 - RNA, 13 nt, Mycobacterium tuberculosis H37Rv
gccggguuggcgc

SEQ ID NO: 3258327 - RNA, 16 nt, Mycobacterium tuberculosis H37Rv
gccggguugguaccca

SEQ ID NO: 3258328 - RNA, 17 nt, Mycobacterium tuberculosis H37Rv
gccggguuuauccaguc

SEQ ID NO: 3258329 - RNA, 17 nt, Mycobacterium tuberculosis H37Rv
gccggguuugaucagcu

SEQ ID NO: 3258330 - RNA, 21 nt, Mycobacterium tuberculosis H37Rv
gccggguuugaucagcucggu

SEQ ID NO: 3258331 - RNA, 22 nt, Mycobacterium tuberculosis H37Rv
gccggguuugaucagcucgguc

SEQ ID NO: 3258332 - RNA, 22 nt, Mycobacterium tuberculosis H37Rv
gccgguacacguccaguggcag

SEQ ID NO: 3258333 - RNA, 16 nt, Mycobacterium tuberculosis H37Rv
gccgguaccggcgauc

SEQ ID NO: 3258334 - RNA, 20 nt, Mycobacterium tuberculosis H37Rv
gccgguagaucuucggccgc

SEQ ID NO: 3258335 - RNA, 18 nt, Mycobacterium tuberculosis H37Rv
gccgguagcacagcagca

SEQ ID NO: 3258336 - RNA, 13 nt, Mycobacterium tuberculosis H37Rv
gccgguagccggg

SEQ ID NO: 3258337 - RNA, 20 nt, Mycobacterium tuberculosis H37Rv
gccgguagcugucgccuuug

SEQ ID NO: 3258338 - RNA, 21 nt, Mycobacterium tuberculosis H37Rv
gccggucaacccucgccacgc

SEQ ID NO: 3258339 - RNA, 15 nt, Mycobacterium tuberculosis H37Rv
gccggucacgacguc

SEQ ID NO: 3258340 - RNA, 15 nt, Mycobacterium tuberculosis H37Rv
gccggucacguccgc

SEQ ID NO: 3258341 - RNA, 19 nt, Mycobacterium tuberculosis H37Rv
gccggucaggcaguccacc

SEQ ID NO: 3258342 - RNA, 15 nt, Mycobacterium tuberculosis H37Rv
gccggucaggccgcc

SEQ ID NO: 3258343 - RNA, 16 nt, Mycobacterium tuberculosis H37Rv
gccggucaggccgccg

SEQ ID NO: 3258344 - RNA, 18 nt, Mycobacterium tuberculosis H37Rv
gccggucaguauggcgac

SEQ ID NO: 3258345 - RNA, 13 nt, Mycobacterium tuberculosis H37Rv
gccggucauacca

SEQ ID NO: 3258346 - RNA, 22 nt, Mycobacterium tuberculosis H37Rv
gccggucaucccaagcguccgc

SEQ ID NO: 3258347 - RNA, 22 nt, Mycobacterium tuberculosis H37Rv
gccggucauccgggcgaccacc

SEQ ID NO: 3258348 - RNA, 22 nt, Mycobacterium tuberculosis H37Rv
gccggucaugauccgaacuucg

SEQ ID NO: 3258349 - RNA, 18 nt, Mycobacterium tuberculosis H37Rv
gccgguccagacccagcu

SEQ ID NO: 3258350 - RNA, 17 nt, Mycobacterium tuberculosis H37Rv
gccgguccagcgccggc

SEQ ID NO: 3258351 - RNA, 21 nt, Mycobacterium tuberculosis H37Rv
gccgguccccccguugccgcc

SEQ ID NO: 3258352 - RNA, 13 nt, Mycobacterium tuberculosis H37Rv
gccgguccccgcc

SEQ ID NO: 3258353 - RNA, 16 nt, Mycobacterium tuberculosis H37Rv
gccgguccccgccggc

SEQ ID NO: 3258354 - RNA, 17 nt, Mycobacterium tuberculosis H37Rv
gccgguccccgccggcg

SEQ ID NO: 3258355 - RNA, 14 nt, Mycobacterium tuberculosis H37Rv
gccgguccggggca

SEQ ID NO: 3258356 - RNA, 13 nt, Mycobacterium tuberculosis H37Rv
gccgguccgguac

SEQ ID NO: 3258357 - RNA, 16 nt, Mycobacterium tuberculosis H37Rv
gccgguccucgucggc

SEQ ID NO: 3258358 - RNA, 17 nt, Mycobacterium tuberculosis H37Rv
gccgguccucgucggcg

SEQ ID NO: 3258359 - RNA, 15 nt, Mycobacterium tuberculosis H37Rv
gccggucgaggugac

SEQ ID NO: 3258360 - RNA, 20 nt, Mycobacterium tuberculosis H37Rv
gccggucgaugucggcgaac

SEQ ID NO: 3258361 - RNA, 15 nt, Mycobacterium tuberculosis H37Rv
gccguagcgcagcgc

SEQ ID NO: 3258362 - RNA, 17 nt, Mycobacterium tuberculosis H37Rv
gccguaucggggcacca

SEQ ID NO: 3258363 - RNA, 19 nt, Mycobacterium tuberculosis H37Rv
gccguaugccgccaaccgc

SEQ ID NO: 3258364 - RNA, 16 nt, Mycobacterium tuberculosis H37Rv
gccgucaacgauggug

SEQ ID NO: 3258365 - RNA, 13 nt, Mycobacterium tuberculosis H37Rv
gccgucacccccg

SEQ ID NO: 3258366 - RNA, 22 nt, Mycobacterium tuberculosis H37Rv
gccgucaccgaucgaacagugc

SEQ ID NO: 3258367 - RNA, 15 nt, Mycobacterium tuberculosis H37Rv
gccgucaccgccauu

SEQ ID NO: 3258368 - RNA, 19 nt, Mycobacterium tuberculosis H37Rv
gccgucaccgccauugcca

SEQ ID NO: 3258369 - RNA, 14 nt, Mycobacterium tuberculosis H37Rv
gccgucaccgccga

SEQ ID NO: 3258370 - RNA, 16 nt, Mycobacterium tuberculosis H37Rv
gccgucaccgccguug

SEQ ID NO: 3258371 - RNA, 21 nt, Mycobacterium tuberculosis H37Rv
gccgucaccgccguugccgcc

SEQ ID NO: 3258372 - RNA, 18 nt, Mycobacterium tuberculosis H37Rv
gccgucaccgcugagccc

SEQ ID NO: 3258373 - RNA, 15 nt, Mycobacterium tuberculosis H37Rv
gccgucaccggucgg

SEQ ID NO: 3258374 - RNA, 16 nt, Mycobacterium tuberculosis H37Rv
gccgucaccggucggc

SEQ ID NO: 3258375 - RNA, 15 nt, Mycobacterium tuberculosis H37Rv
gccgucagaacaccg

SEQ ID NO: 3258376 - RNA, 21 nt, Mycobacterium tuberculosis H37Rv
gccgucagaacaccggccagg

SEQ ID NO: 3258377 - RNA, 14 nt, Mycobacterium tuberculosis H37Rv
gccgucagccaggu

SEQ ID NO: 3258378 - RNA, 21 nt, Mycobacterium tuberculosis H37Rv
gccgucagccaggugcccaag

SEQ ID NO: 3258379 - RNA, 16 nt, Mycobacterium tuberculosis H37Rv
gccgucagcccaggug

SEQ ID NO: 3258380 - RNA, 22 nt, Mycobacterium tuberculosis H37Rv
gccgucagcucaccacccagau

SEQ ID NO: 3258381 - RNA, 20 nt, Mycobacterium tuberculosis H37Rv
gccgucagggucagcuggga

SEQ ID NO: 3258382 - RNA, 13 nt, Mycobacterium tuberculosis H37Rv
gccgucagggugu

SEQ ID NO: 3258383 - RNA, 19 nt, Mycobacterium tuberculosis H37Rv
gccgucauagcaggccucc

SEQ ID NO: 3258384 - RNA, 19 nt, Mycobacterium tuberculosis H37Rv
gccgucaucgugcccgcgu

SEQ ID NO: 3258385 - RNA, 17 nt, Mycobacterium tuberculosis H37Rv
gccgucaucuccgacuc

SEQ ID NO: 3258386 - RNA, 20 nt, Mycobacterium tuberculosis H37Rv
gccgucaucuccgacucgau

SEQ ID NO: 3258387 - RNA, 17 nt, Mycobacterium tuberculosis H37Rv
gccgucaucuggaagua

SEQ ID NO: 3258388 - RNA, 20 nt, Mycobacterium tuberculosis H37Rv
gccgucaugcccaucuccaa

SEQ ID NO: 3258389 - RNA, 16 nt, Mycobacterium tuberculosis H37Rv
gccgucauggcccgau

SEQ ID NO: 3258390 - RNA, 16 nt, Mycobacterium tuberculosis H37Rv
gccguccaagccagcg

SEQ ID NO: 3258391 - RNA, 21 nt, Mycobacterium tuberculosis H37Rv
gccguccaagccagcguuggc

SEQ ID NO: 3258392 - RNA, 21 nt, Mycobacterium tuberculosis H37Rv
gccguccaauuccgcagagac

SEQ ID NO: 3258393 - RNA, 18 nt, Mycobacterium tuberculosis H37Rv
gccguccaggacggaucg

SEQ ID NO: 3258394 - RNA, 19 nt, Mycobacterium tuberculosis H37Rv
gccguccagguucaugcaa

SEQ ID NO: 3258395 - RNA, 14 nt, Mycobacterium tuberculosis H37Rv
gccguccccgccgc

SEQ ID NO: 3258396 - RNA, 21 nt, Mycobacterium tuberculosis H37Rv
gccgucccgaaacgccggguu

SEQ ID NO: 3258397 - RNA, 21 nt, Mycobacterium tuberculosis H37Rv
gccgucccggcucgagcucgg

SEQ ID NO: 3258398 - RNA, 14 nt, Mycobacterium tuberculosis H37Rv
gccguccgaccagg

SEQ ID NO: 3258399 - RNA, 15 nt, Mycobacterium tuberculosis H37Rv
gccguccgcaccggc

SEQ ID NO: 3258400 - RNA, 16 nt, Mycobacterium tuberculosis H37Rv
gccguccggcgcccac

SEQ ID NO: 3258401 - RNA, 17 nt, Mycobacterium tuberculosis H37Rv
gccguccggcgccugcu

SEQ ID NO: 3258402 - RNA, 19 nt, Mycobacterium tuberculosis H37Rv
gccguccggcuuggcggcg

SEQ ID NO: 3258403 - RNA, 19 nt, Mycobacterium tuberculosis H37Rv
gccguccgguccgucgggu

SEQ ID NO: 3258404 - RNA, 20 nt, Mycobacterium tuberculosis H37Rv
gccguccgguggaccgccga

SEQ ID NO: 3258405 - RNA, 18 nt, Mycobacterium tuberculosis H37Rv
gccguccuagcgugccgc

SEQ ID NO: 3258406 - RNA, 19 nt, Mycobacterium tuberculosis H37Rv
gccguccuagcgugccgcc

SEQ ID NO: 3258407 - RNA, 14 nt, Mycobacterium tuberculosis H37Rv
gccguccucccaca

SEQ ID NO: 3258408 - RNA, 21 nt, Mycobacterium tuberculosis H37Rv
gccgucgaaccaguccucggg

SEQ ID NO: 3258409 - RNA, 23 nt, Mycobacterium tuberculosis H37Rv
gccgucgaagacgaacgugucgg

SEQ ID NO: 3258410 - RNA, 12 nt, Mycobacterium tuberculosis H37Rv
gccgucgaccac

SEQ ID NO: 3258411 - RNA, 15 nt, Mycobacterium tuberculosis H37Rv
gccgucgaccggcgg

SEQ ID NO: 3258412 - RNA, 16 nt, Mycobacterium tuberculosis H37Rv
gccgucgacgcauggg

SEQ ID NO: 3258413 - RNA, 14 nt, Mycobacterium tuberculosis H37Rv
gccgucgacgcggc

SEQ ID NO: 3258414 - RNA, 16 nt, Mycobacterium tuberculosis H37Rv
gccgucgacgcggccg

SEQ ID NO: 3258415 - RNA, 16 nt, Mycobacterium tuberculosis H37Rv
gccgucgacgcggucc

SEQ ID NO: 3258416 - RNA, 17 nt, Mycobacterium tuberculosis H37Rv
gccgucgacgcgguccu

SEQ ID NO: 3258417 - RNA, 19 nt, Mycobacterium tuberculosis H37Rv
gccgucgacgucgauggug

SEQ ID NO: 3258418 - RNA, 21 nt, Mycobacterium tuberculosis H37Rv
gccgucgacgucgauggugcg

SEQ ID NO: 3258419 - RNA, 22 nt, Mycobacterium tuberculosis H37Rv
gccgucgacguugaugaccugu

SEQ ID NO: 3258420 - RNA, 15 nt, Mycobacterium tuberculosis H37Rv
gccgucgagcacggu

SEQ ID NO: 3258421 - RNA, 21 nt, Mycobacterium tuberculosis H37Rv
gccgucgaguccaggccggca

SEQ ID NO: 3258422 - RNA, 20 nt, Mycobacterium tuberculosis H37Rv
gccgucgaucccggucggug

SEQ ID NO: 3258423 - RNA, 22 nt, Mycobacterium tuberculosis H37Rv
gccgucgaugaucugcuugcca

SEQ ID NO: 3258424 - RNA, 22 nt, Mycobacterium tuberculosis H37Rv
gccgucgauguugccgagagcc

SEQ ID NO: 3258425 - RNA, 12 nt, Mycobacterium tuberculosis H37Rv
gccgucgcagcc

SEQ ID NO: 3258426 - RNA, 15 nt, Mycobacterium tuberculosis H37Rv
gccgucgcagccagc

SEQ ID NO: 3258427 - RNA, 15 nt, Mycobacterium tuberculosis H37Rv
gccgucgccaccauc

SEQ ID NO: 3258428 - RNA, 20 nt, Mycobacterium tuberculosis H37Rv
gccgucgccaccgguaccga

SEQ ID NO: 3258429 - RNA, 21 nt, Mycobacterium tuberculosis H37Rv
gccgucgccaccgguaccgau

SEQ ID NO: 3258430 - RNA, 23 nt, Mycobacterium tuberculosis H37Rv
gccgucgccaccgguaccgauca

SEQ ID NO: 3258431 - RNA, 15 nt, Mycobacterium tuberculosis H37Rv
gccgucgcccagcgu

SEQ ID NO: 3258432 - RNA, 20 nt, Mycobacterium tuberculosis H37Rv
gccgucgcccuuagggucgc

SEQ ID NO: 3258433 - RNA, 23 nt, Mycobacterium tuberculosis H37Rv
gccgucgccgaacagcagcccgc

SEQ ID NO: 3258434 - RNA, 12 nt, Mycobacterium tuberculosis H37Rv
gccgucgccgau

SEQ ID NO: 3258435 - RNA, 13 nt, Mycobacterium tuberculosis H37Rv
gccgucgccgauc

SEQ ID NO: 3258436 - RNA, 23 nt, Mycobacterium tuberculosis H37Rv
gccgucgccguacaaccacccac

SEQ ID NO: 3258437 - RNA, 16 nt, Mycobacterium tuberculosis H37Rv
gccgucgccguccagu

SEQ ID NO: 3258438 - RNA, 17 nt, Mycobacterium tuberculosis H37Rv
gccgucgccguuggguu

SEQ ID NO: 3258439 - RNA, 16 nt, Mycobacterium tuberculosis H37Rv
gccgucgccugcaagc

SEQ ID NO: 3258440 - RNA, 16 nt, Mycobacterium tuberculosis H37Rv
gccgucgcgacgucgg

SEQ ID NO: 3258441 - RNA, 17 nt, Mycobacterium tuberculosis H37Rv
gccgucgcgacgucggc

SEQ ID NO: 3258442 - RNA, 13 nt, Mycobacterium tuberculosis H37Rv
gccgucgcggcac

SEQ ID NO: 3258443 - RNA, 23 nt, Mycobacterium tuberculosis H37Rv
gccgucgcggcacgcccacagcu

SEQ ID NO: 3258444 - RNA, 14 nt, Mycobacterium tuberculosis H37Rv
gccgucggacaccg

SEQ ID NO: 3258445 - RNA, 16 nt, Mycobacterium tuberculosis H37Rv
gccgucggccggcaac

SEQ ID NO: 3258446 - RNA, 17 nt, Mycobacterium tuberculosis H37Rv
gccgucggccucggcgg

SEQ ID NO: 3258447 - RNA, 18 nt, Mycobacterium tuberculosis H37Rv
gccgucggcgagcagacg

SEQ ID NO: 3258448 - RNA, 14 nt, Mycobacterium tuberculosis H37Rv
gccgucggcgccuc

SEQ ID NO: 3258449 - RNA, 12 nt, Mycobacterium tuberculosis H37Rv
gccgucggcgcu

SEQ ID NO: 3258450 - RNA, 16 nt, Mycobacterium tuberculosis H37Rv
gccgucggcgcugcgc

SEQ ID NO: 3258451 - RNA, 20 nt, Mycobacterium tuberculosis H37Rv
gccgucggguaggccgccgu

SEQ ID NO: 3258452 - RNA, 18 nt, Mycobacterium tuberculosis H37Rv
gccgucggguccgcggcc

SEQ ID NO: 3258453 - RNA, 19 nt, Mycobacterium tuberculosis H37Rv
gccgucggguccgcggccc

SEQ ID NO: 3258454 - RNA, 20 nt, Mycobacterium tuberculosis H37Rv
gccgucgggugcagcacggc

SEQ ID NO: 3258455 - RNA, 20 nt, Mycobacterium tuberculosis H37Rv
gccgucggugaugacguagu

SEQ ID NO: 3258456 - RNA, 12 nt, Mycobacterium tuberculosis H37Rv
gccgucggugcc

SEQ ID NO: 3258457 - RNA, 17 nt, Mycobacterium tuberculosis H37Rv
gccguucggcaucuggu

SEQ ID NO: 3258458 - RNA, 15 nt, Mycobacterium tuberculosis H37Rv
gccguucggggcgcg

SEQ ID NO: 3258459 - RNA, 19 nt, Mycobacterium tuberculosis H37Rv
gccguucggggcgcgguac

SEQ ID NO: 3258460 - RNA, 14 nt, Mycobacterium tuberculosis H37Rv
gccguucgucgcgg

SEQ ID NO: 3258461 - RNA, 23 nt, Mycobacterium tuberculosis H37Rv
gccguucgugggcauugcggcgc

SEQ ID NO: 3258462 - RNA, 15 nt, Mycobacterium tuberculosis H37Rv
gccguucucgcccac

SEQ ID NO: 3258463 - RNA, 20 nt, Mycobacterium tuberculosis H37Rv
gccguucucgucgaggaucu

SEQ ID NO: 3258464 - RNA, 14 nt, Mycobacterium tuberculosis H37Rv
gccguugacaacua

SEQ ID NO: 3258465 - RNA, 20 nt, Mycobacterium tuberculosis H37Rv
gccguugacgccguugccgc

SEQ ID NO: 3258466 - RNA, 20 nt, Mycobacterium tuberculosis H37Rv
gccguugcacggccgggacg

SEQ ID NO: 3258467 - RNA, 12 nt, Mycobacterium tuberculosis H37Rv
gccguugccaac

SEQ ID NO: 3258468 - RNA, 21 nt, Mycobacterium tuberculosis H37Rv
gccguugcccccguugccgcc

SEQ ID NO: 3258469 - RNA, 12 nt, Mycobacterium tuberculosis H37Rv
gccguugccgcc

SEQ ID NO: 3258470 - RNA, 14 nt, Mycobacterium tuberculosis H37Rv
gccguugccgccag

SEQ ID NO: 3258471 - RNA, 15 nt, Mycobacterium tuberculosis H37Rv
gccguugccgccaug

SEQ ID NO: 3258472 - RNA, 19 nt, Mycobacterium tuberculosis H37Rv
gccguugccgccauuggca

SEQ ID NO: 3258473 - RNA, 17 nt, Mycobacterium tuberculosis H37Rv
gccguugccgccgacgc

SEQ ID NO: 3258474 - RNA, 15 nt, Mycobacterium tuberculosis H37Rv
gccguugccgccgcc

SEQ ID NO: 3258475 - RNA, 20 nt, Mycobacterium tuberculosis H37Rv
gccguugccgccggugccac

SEQ ID NO: 3258476 - RNA, 17 nt, Mycobacterium tuberculosis H37Rv
gccguugccgccgucac

SEQ ID NO: 3258477 - RNA, 20 nt, Mycobacterium tuberculosis H37Rv
gccguugccggcguugccgc

SEQ ID NO: 3258478 - RNA, 16 nt, Mycobacterium tuberculosis H37Rv
gccguugcgucugcuc

SEQ ID NO: 3258479 - RNA, 14 nt, Mycobacterium tuberculosis H37Rv
gccguuggagacgu

SEQ ID NO: 3258480 - RNA, 16 nt, Mycobacterium tuberculosis H37Rv
gccguuggagccgcca

SEQ ID NO: 3258481 - RNA, 20 nt, Mycobacterium tuberculosis H37Rv
gccguuggagccgccaccga

SEQ ID NO: 3258482 - RNA, 17 nt, Mycobacterium tuberculosis H37Rv
gccguuggcaccgggug

SEQ ID NO: 3258483 - RNA, 13 nt, Mycobacterium tuberculosis H37Rv
gccguuggcggcg

SEQ ID NO: 3258484 - RNA, 22 nt, Mycobacterium tuberculosis H37Rv
gccguugggaaccgacuugguu

SEQ ID NO: 3258485 - RNA, 22 nt, Mycobacterium tuberculosis H37Rv
gccguugggcaccguguagcug

SEQ ID NO: 3258486 - RNA, 17 nt, Mycobacterium tuberculosis H37Rv
gccguugggccaccggc

SEQ ID NO: 3258487 - RNA, 15 nt, Mycobacterium tuberculosis H37Rv
gccguugggccgcgc

SEQ ID NO: 3258488 - RNA, 22 nt, Mycobacterium tuberculosis H37Rv
gccguugggccgcgcccuggcc

SEQ ID NO: 3258489 - RNA, 17 nt, Mycobacterium tuberculosis H37Rv
gccguuggugccgccug

SEQ ID NO: 3258490 - RNA, 23 nt, Mycobacterium tuberculosis H37Rv
gccguuggugccgccugugccac

SEQ ID NO: 3258491 - RNA, 19 nt, Mycobacterium tuberculosis H37Rv
gccguuguaguacaccuug

SEQ ID NO: 3258492 - RNA, 15 nt, Mycobacterium tuberculosis H37Rv
gccguugucgucggc

SEQ ID NO: 3258493 - RNA, 19 nt, Mycobacterium tuberculosis H37Rv
gccguugucgucggcggcg

SEQ ID NO: 3258494 - RNA, 21 nt, Mycobacterium tuberculosis H37Rv
gccguugucgucggcggcgaa

SEQ ID NO: 3258495 - RNA, 22 nt, Mycobacterium tuberculosis H37Rv
gccguugucgucggcggcgaac

SEQ ID NO: 3258496 - RNA, 21 nt, Mycobacterium tuberculosis H37Rv
gccguuuccgccgccgccauc

SEQ ID NO: 3258497 - RNA, 14 nt, Mycobacterium tuberculosis H37Rv
gccuaacagccggc

SEQ ID NO: 3258498 - RNA, 17 nt, Mycobacterium tuberculosis H37Rv
gccuaaccccggcucga

SEQ ID NO: 3258499 - RNA, 18 nt, Mycobacterium tuberculosis H37Rv
gccuaccaggcgcggccc

SEQ ID NO: 3258500 - RNA, 12 nt, Mycobacterium tuberculosis H37Rv
gccuaccggccu

SEQ ID NO: 3258501 - RNA, 18 nt, Mycobacterium tuberculosis H37Rv
gccuaccggccuuuccag

SEQ ID NO: 3258502 - RNA, 15 nt, Mycobacterium tuberculosis H37Rv
gccuagccgauggcu

SEQ ID NO: 3258503 - RNA, 16 nt, Mycobacterium tuberculosis H37Rv
gccuagccgcggcacc

SEQ ID NO: 3258504 - RNA, 14 nt, Mycobacterium tuberculosis H37Rv
gccuaggacaccgg

SEQ ID NO: 3258505 - RNA, 15 nt, Mycobacterium tuberculosis H37Rv
gccuagggcggcggc

SEQ ID NO: 3258506 - RNA, 17 nt, Mycobacterium tuberculosis H37Rv
gccuaggucgacgccga

SEQ ID NO: 3258507 - RNA, 21 nt, Mycobacterium tuberculosis H37Rv
gccuagguucgccacgcccga

SEQ ID NO: 3258508 - RNA, 17 nt, Mycobacterium tuberculosis H37Rv
gccuaguacgccgagca

SEQ ID NO: 3258509 - RNA, 20 nt, Mycobacterium tuberculosis H37Rv
gccuaguccuggcucggcau

SEQ ID NO: 3258510 - RNA, 14 nt, Mycobacterium tuberculosis H37Rv
gccucaacgccagc

SEQ ID NO: 3258511 - RNA, 15 nt, Mycobacterium tuberculosis H37Rv
gccucaagcucgccg

SEQ ID NO: 3258512 - RNA, 18 nt, Mycobacterium tuberculosis H37Rv
gccucaaugaccaccggg

SEQ ID NO: 3258513 - RNA, 23 nt, Mycobacterium tuberculosis H37Rv
gccucaccgccgcuaccgcccgc

SEQ ID NO: 3258514 - RNA, 17 nt, Mycobacterium tuberculosis H37Rv
gccucaccggcgcgagc

SEQ ID NO: 3258515 - RNA, 13 nt, Mycobacterium tuberculosis H37Rv
gccucacuggacc

SEQ ID NO: 3258516 - RNA, 23 nt, Mycobacterium tuberculosis H37Rv
gccucagccaccgggcgugcggc

SEQ ID NO: 3258517 - RNA, 17 nt, Mycobacterium tuberculosis H37Rv
gccucagcccggccagc

SEQ ID NO: 3258518 - RNA, 18 nt, Mycobacterium tuberculosis H37Rv
gccucagcccggccagcc

SEQ ID NO: 3258519 - RNA, 17 nt, Mycobacterium tuberculosis H37Rv
gccucagcccgucagcc

SEQ ID NO: 3258520 - RNA, 12 nt, Mycobacterium tuberculosis H37Rv
gccucagccgcu

SEQ ID NO: 3258521 - RNA, 15 nt, Mycobacterium tuberculosis H37Rv
gccucaggggcgccu

SEQ ID NO: 3258522 - RNA, 19 nt, Mycobacterium tuberculosis H37Rv
gccucauccaccgauggcg

SEQ ID NO: 3258523 - RNA, 23 nt, Mycobacterium tuberculosis H37Rv
gccucaucggacagcgccuggcc

SEQ ID NO: 3258524 - RNA, 21 nt, Mycobacterium tuberculosis H37Rv
gccucaucggcaaacuccugc

SEQ ID NO: 3258525 - RNA, 15 nt, Mycobacterium tuberculosis H37Rv
gccucaugcuaggcc

SEQ ID NO: 3258526 - RNA, 14 nt, Mycobacterium tuberculosis H37Rv
gccuccaagcccgc

SEQ ID NO: 3258527 - RNA, 18 nt, Mycobacterium tuberculosis H37Rv
gccuccacauacgcggcg

SEQ ID NO: 3258528 - RNA, 21 nt, Mycobacterium tuberculosis H37Rv
gccuccacauacgcggcggcc

SEQ ID NO: 3258529 - RNA, 14 nt, Mycobacterium tuberculosis H37Rv
gccuccacccgcca

SEQ ID NO: 3258530 - RNA, 12 nt, Mycobacterium tuberculosis H37Rv
gccuccaccgcg

SEQ ID NO: 3258531 - RNA, 16 nt, Mycobacterium tuberculosis H37Rv
gccuccaccgcgucca

SEQ ID NO: 3258532 - RNA, 21 nt, Mycobacterium tuberculosis H37Rv
gccuccacucuucgggcggcg

SEQ ID NO: 3258533 - RNA, 20 nt, Mycobacterium tuberculosis H37Rv
gccuccagauucgccgccca

SEQ ID NO: 3258534 - RNA, 15 nt, Mycobacterium tuberculosis H37Rv
gccuccagcaggucc

SEQ ID NO: 3258535 - RNA, 13 nt, Mycobacterium tuberculosis H37Rv
gccuccagccggc

SEQ ID NO: 3258536 - RNA, 18 nt, Mycobacterium tuberculosis H37Rv
gccuccagcuuggcgagc

SEQ ID NO: 3258537 - RNA, 22 nt, Mycobacterium tuberculosis H37Rv
gccuccauaucgcagcguuggc

SEQ ID NO: 3258538 - RNA, 13 nt, Mycobacterium tuberculosis H37Rv
gccuccauggccu

SEQ ID NO: 3258539 - RNA, 15 nt, Mycobacterium tuberculosis H37Rv
gccucccgcgccggc

SEQ ID NO: 3258540 - RNA, 19 nt, Mycobacterium tuberculosis H37Rv
gccucccgggccgccgcga

SEQ ID NO: 3258541 - RNA, 15 nt, Mycobacterium tuberculosis H37Rv
gccucccuuuuccaa

SEQ ID NO: 3258542 - RNA, 13 nt, Mycobacterium tuberculosis H37Rv
gccuccgccugcc

SEQ ID NO: 3258543 - RNA, 16 nt, Mycobacterium tuberculosis H37Rv
gccuccgccugcccca

SEQ ID NO: 3258544 - RNA, 16 nt, Mycobacterium tuberculosis H37Rv
gccuccgcugccgccc

SEQ ID NO: 3258545 - RNA, 18 nt, Mycobacterium tuberculosis H37Rv
gccuccgcugccgcccgc

SEQ ID NO: 3258546 - RNA, 16 nt, Mycobacterium tuberculosis H37Rv
gccuccggagaauccg

SEQ ID NO: 3258547 - RNA, 17 nt, Mycobacterium tuberculosis H37Rv
gccuccggcaccuccag

SEQ ID NO: 3258548 - RNA, 16 nt, Mycobacterium tuberculosis H37Rv
gccuccggcgccgccc

SEQ ID NO: 3258549 - RNA, 18 nt, Mycobacterium tuberculosis H37Rv
gccuccggcgccgcccga

SEQ ID NO: 3258550 - RNA, 23 nt, Mycobacterium tuberculosis H37Rv
gccuccggugcauauuggaucgu

SEQ ID NO: 3258551 - RNA, 15 nt, Mycobacterium tuberculosis H37Rv
gccuccguugccccc

SEQ ID NO: 3258552 - RNA, 14 nt, Mycobacterium tuberculosis H37Rv
gccuccuccccgac

SEQ ID NO: 3258553 - RNA, 18 nt, Mycobacterium tuberculosis H37Rv
gccugcccagcaccaccg

SEQ ID NO: 3258554 - RNA, 16 nt, Mycobacterium tuberculosis H37Rv
gccugccccacccgcg

SEQ ID NO: 3258555 - RNA, 12 nt, Mycobacterium tuberculosis H37Rv
gccugccccaga

SEQ ID NO: 3258556 - RNA, 17 nt, Mycobacterium tuberculosis H37Rv
gccugcccccgcgcgca

SEQ ID NO: 3258557 - RNA, 23 nt, Mycobacterium tuberculosis H37Rv
gccugcccccgcgcgcacggcgu

SEQ ID NO: 3258558 - RNA, 21 nt, Mycobacterium tuberculosis H37Rv
gccugcccggcccgcucagcc

SEQ ID NO: 3258559 - RNA, 17 nt, Mycobacterium tuberculosis H37Rv
gccugccgacggcauca

SEQ ID NO: 3258560 - RNA, 18 nt, Mycobacterium tuberculosis H37Rv
gccugccgacggcaucaa

SEQ ID NO: 3258561 - RNA, 21 nt, Mycobacterium tuberculosis H37Rv
gccugccgacggcaucaacgc

SEQ ID NO: 3258562 - RNA, 15 nt, Mycobacterium tuberculosis H37Rv
gccugccgaugacga

SEQ ID NO: 3258563 - RNA, 16 nt, Mycobacterium tuberculosis H37Rv
gccugccgaugacgau

SEQ ID NO: 3258564 - RNA, 16 nt, Mycobacterium tuberculosis H37Rv
gccugccgcucgccgg

SEQ ID NO: 3258565 - RNA, 13 nt, Mycobacterium tuberculosis H37Rv
gccugccgggaca

SEQ ID NO: 3258566 - RNA, 13 nt, Mycobacterium tuberculosis H37Rv
gccugcgacagca

SEQ ID NO: 3258567 - RNA, 16 nt, Mycobacterium tuberculosis H37Rv
gccugcgacagcacgu

SEQ ID NO: 3258568 - RNA, 13 nt, Mycobacterium tuberculosis H37Rv
gccugcgcacgac

SEQ ID NO: 3258569 - RNA, 13 nt, Mycobacterium tuberculosis H37Rv
gccugcgcagacu

SEQ ID NO: 3258570 - RNA, 17 nt, Mycobacterium tuberculosis H37Rv
gccugcgccgacccgcg

SEQ ID NO: 3258571 - RNA, 18 nt, Mycobacterium tuberculosis H37Rv
gccugcgccgacccgcgc

SEQ ID NO: 3258572 - RNA, 16 nt, Mycobacterium tuberculosis H37Rv
gccugcgccgccagcg

SEQ ID NO: 3258573 - RNA, 13 nt, Mycobacterium tuberculosis H37Rv
gccugcgccgccc

SEQ ID NO: 3258574 - RNA, 15 nt, Mycobacterium tuberculosis H37Rv
gccugcgccgcccgc

SEQ ID NO: 3258575 - RNA, 17 nt, Mycobacterium tuberculosis H37Rv
gccugcgccgcccgcgc

SEQ ID NO: 3258576 - RNA, 21 nt, Mycobacterium tuberculosis H37Rv
gccugcgccuuggucgccggc

SEQ ID NO: 3258577 - RNA, 22 nt, Mycobacterium tuberculosis H37Rv
gccugcgccuuggucgccggcg

SEQ ID NO: 3258578 - RNA, 19 nt, Mycobacterium tuberculosis H37Rv
gccugcgcgaccgaccagc

SEQ ID NO: 3258579 - RNA, 14 nt, Mycobacterium tuberculosis H37Rv
gccugcggcagcac

SEQ ID NO: 3258580 - RNA, 20 nt, Mycobacterium tuberculosis H37Rv
gccugcggcaggugcgguca

SEQ ID NO: 3258581 - RNA, 13 nt, Mycobacterium tuberculosis H37Rv
gccugcggcggcg

SEQ ID NO: 3258582 - RNA, 20 nt, Mycobacterium tuberculosis H37Rv
gccugcggcgguuacgguca

SEQ ID NO: 3258583 - RNA, 15 nt, Mycobacterium tuberculosis H37Rv
gccugcgggccggca

SEQ ID NO: 3258584 - RNA, 20 nt, Mycobacterium tuberculosis H37Rv
gccugcgggggacacgucgu

SEQ ID NO: 3258585 - RNA, 15 nt, Mycobacterium tuberculosis H37Rv
gccugcgucucgaug

SEQ ID NO: 3258586 - RNA, 17 nt, Mycobacterium tuberculosis H37Rv
gccugcgucucgaugag

SEQ ID NO: 3258587 - RNA, 14 nt, Mycobacterium tuberculosis H37Rv
gccugcuagcagca

SEQ ID NO: 3258588 - RNA, 17 nt, Mycobacterium tuberculosis H37Rv
gccugcucaaccagcag

SEQ ID NO: 3258589 - RNA, 14 nt, Mycobacterium tuberculosis H37Rv
gccugcucgaccau

SEQ ID NO: 3258590 - RNA, 19 nt, Mycobacterium tuberculosis H37Rv
gccugcucggagagcagca

SEQ ID NO: 3258591 - RNA, 13 nt, Mycobacterium tuberculosis H37Rv
gccugcugcggcc

SEQ ID NO: 3258592 - RNA, 15 nt, Mycobacterium tuberculosis H37Rv
gccugcugcggccag

SEQ ID NO: 3258593 - RNA, 13 nt, Mycobacterium tuberculosis H37Rv
gccugcuggagca

SEQ ID NO: 3258594 - RNA, 20 nt, Mycobacterium tuberculosis H37Rv
gccugcuucaggaucggcga

SEQ ID NO: 3258595 - RNA, 14 nt, Mycobacterium tuberculosis H37Rv
gccugcuuggccac

SEQ ID NO: 3258596 - RNA, 16 nt, Mycobacterium tuberculosis H37Rv
gccugcuugucaaccc

SEQ ID NO: 3258597 - RNA, 15 nt, Mycobacterium tuberculosis H37Rv
gccuggaagaucacg

SEQ ID NO: 3258598 - RNA, 23 nt, Mycobacterium tuberculosis H37Rv
gccuggaaggaaccgaucggucg

SEQ ID NO: 3258599 - RNA, 22 nt, Mycobacterium tuberculosis H37Rv
gccuggaaucgcggagccagga

SEQ ID NO: 3258600 - RNA, 16 nt, Mycobacterium tuberculosis H37Rv
gccuggacgccgccgg

SEQ ID NO: 3258601 - RNA, 15 nt, Mycobacterium tuberculosis H37Rv
gccuggagcuguggc

SEQ ID NO: 3258602 - RNA, 18 nt, Mycobacterium tuberculosis H37Rv
gccuggaucagcgcguug

SEQ ID NO: 3258603 - RNA, 14 nt, Mycobacterium tuberculosis H37Rv
gccuggauggguug

SEQ ID NO: 3258604 - RNA, 14 nt, Mycobacterium tuberculosis H37Rv
gccuggcacccggg

SEQ ID NO: 3258605 - RNA, 16 nt, Mycobacterium tuberculosis H37Rv
gccuggcagggugggg

SEQ ID NO: 3258606 - RNA, 15 nt, Mycobacterium tuberculosis H37Rv
gccuggccaccuggu

SEQ ID NO: 3258607 - RNA, 16 nt, Mycobacterium tuberculosis H37Rv
gccuggccaccugguu

SEQ ID NO: 3258608 - RNA, 16 nt, Mycobacterium tuberculosis H37Rv
gccuggcccgucggcg

SEQ ID NO: 3258609 - RNA, 15 nt, Mycobacterium tuberculosis H37Rv
gccuggccugcccag

SEQ ID NO: 3258610 - RNA, 18 nt, Mycobacterium tuberculosis H37Rv
gccuggcggcgccgcaga

SEQ ID NO: 3258611 - RNA, 23 nt, Mycobacterium tuberculosis H37Rv
gccuggcuaguugggugggugca

SEQ ID NO: 3258612 - RNA, 16 nt, Mycobacterium tuberculosis H37Rv
gccuggcuggccagcu

SEQ ID NO: 3258613 - RNA, 18 nt, Mycobacterium tuberculosis H37Rv
gccuggcuggccagcugc

SEQ ID NO: 3258614 - RNA, 23 nt, Mycobacterium tuberculosis H37Rv
gccuggcuguccgcgggccgcgc

SEQ ID NO: 3258615 - RNA, 13 nt, Mycobacterium tuberculosis H37Rv
gccugggacggcg

SEQ ID NO: 3258616 - RNA, 17 nt, Mycobacterium tuberculosis H37Rv
gccugggccagccgcuc

SEQ ID NO: 3258617 - RNA, 17 nt, Mycobacterium tuberculosis H37Rv
gccugggccgcacaagu

SEQ ID NO: 3258618 - RNA, 21 nt, Mycobacterium tuberculosis H37Rv
gccuggguuggugauugcggc

SEQ ID NO: 3258619 - RNA, 14 nt, Mycobacterium tuberculosis H37Rv
gccugguccucacg

SEQ ID NO: 3258620 - RNA, 13 nt, Mycobacterium tuberculosis H37Rv
gccuggucggcca

SEQ ID NO: 3258621 - RNA, 14 nt, Mycobacterium tuberculosis H37Rv
gccuguacgagcag

SEQ ID NO: 3258622 - RNA, 23 nt, Mycobacterium tuberculosis H37Rv
gccuguagucccucaucaccucu

SEQ ID NO: 3258623 - RNA, 14 nt, Mycobacterium tuberculosis H37Rv
gccuguccugcggg

SEQ ID NO: 3258624 - RNA, 16 nt, Mycobacterium tuberculosis H37Rv
gccuguccugcgggag

SEQ ID NO: 3258625 - RNA, 21 nt, Mycobacterium tuberculosis H37Rv
gccuguccugcgggaggcagc

SEQ ID NO: 3258626 - RNA, 21 nt, Mycobacterium tuberculosis H37Rv
gccugugccaccgcuggaucg

SEQ ID NO: 3258627 - RNA, 22 nt, Mycobacterium tuberculosis H37Rv
gccugugccaccgcuggaucga

SEQ ID NO: 3258628 - RNA, 14 nt, Mycobacterium tuberculosis H37Rv
gccugugccgccgg

SEQ ID NO: 3258629 - RNA, 13 nt, Mycobacterium tuberculosis H37Rv
gccugugcggcgg

SEQ ID NO: 3258630 - RNA, 14 nt, Mycobacterium tuberculosis H37Rv
gccugugcggcggg

SEQ ID NO: 3258631 - RNA, 22 nt, Mycobacterium tuberculosis H37Rv
gccuguucgagaucgccgagca

SEQ ID NO: 3258632 - RNA, 21 nt, Mycobacterium tuberculosis H37Rv
gccuguuuguuugcugcggcg

SEQ ID NO: 3258633 - RNA, 23 nt, Mycobacterium tuberculosis H37Rv
gccuguuuguuugcugcggcgau

SEQ ID NO: 3258634 - RNA, 20 nt, Mycobacterium tuberculosis H37Rv
gccuuagcccggccgcggcc

SEQ ID NO: 3258635 - RNA, 22 nt, Mycobacterium tuberculosis H37Rv
gccuucaacgcgaguccgcugc

SEQ ID NO: 3258636 - RNA, 16 nt, Mycobacterium tuberculosis H37Rv
gccuucacgcuggccu

SEQ ID NO: 3258637 - RNA, 15 nt, Mycobacterium tuberculosis H37Rv
gccuucagcggucgc

SEQ ID NO: 3258638 - RNA, 16 nt, Mycobacterium tuberculosis H37Rv
gccuucagcguccagg

SEQ ID NO: 3258639 - RNA, 16 nt, Mycobacterium tuberculosis H37Rv
gccuuccuggcgggcg

SEQ ID NO: 3258640 - RNA, 20 nt, Mycobacterium tuberculosis H37Rv
gccuuccuggcgggcgccuu

SEQ ID NO: 3258641 - RNA, 15 nt, Mycobacterium tuberculosis H37Rv
gccuucgccagcggc

SEQ ID NO: 3258642 - RNA, 13 nt, Mycobacterium tuberculosis H37Rv
gccuucgccgccg

SEQ ID NO: 3258643 - RNA, 16 nt, Mycobacterium tuberculosis H37Rv
gccuucggguucggug

SEQ ID NO: 3258644 - RNA, 16 nt, Mycobacterium tuberculosis H37Rv
gccuucggugccggaa

SEQ ID NO: 3258645 - RNA, 14 nt, Mycobacterium tuberculosis H37Rv
gccuucggugucgc

SEQ ID NO: 3258646 - RNA, 20 nt, Mycobacterium tuberculosis H37Rv
gccuucggugucgccgaaca

SEQ ID NO: 3258647 - RNA, 16 nt, Mycobacterium tuberculosis H37Rv
gccuucguaaccacga

SEQ ID NO: 3258648 - RNA, 18 nt, Mycobacterium tuberculosis H37Rv
gccuucguagaaggaccg

SEQ ID NO: 3258649 - RNA, 17 nt, Mycobacterium tuberculosis H37Rv
gccuucguagcggccgc

SEQ ID NO: 3258650 - RNA, 15 nt, Mycobacterium tuberculosis H37Rv
gcgaccacggcaccg

SEQ ID NO: 3258651 - RNA, 18 nt, Mycobacterium tuberculosis H37Rv
gcgaccacggcaccgauc

SEQ ID NO: 3258652 - RNA, 22 nt, Mycobacterium tuberculosis H37Rv
gcgaccacggcaccgaucaacg

SEQ ID NO: 3258653 - RNA, 14 nt, Mycobacterium tuberculosis H37Rv
gcgaccagaaucuc

SEQ ID NO: 3258654 - RNA, 15 nt, Mycobacterium tuberculosis H37Rv
gcgaccagccgagcg

SEQ ID NO: 3258655 - RNA, 14 nt, Mycobacterium tuberculosis H37Rv
gcgaccagcucagc

SEQ ID NO: 3258656 - RNA, 18 nt, Mycobacterium tuberculosis H37Rv
gcgaccaggcgcggcgac

SEQ ID NO: 3258657 - RNA, 16 nt, Mycobacterium tuberculosis H37Rv
gcgaccagugguggcc

SEQ ID NO: 3258658 - RNA, 22 nt, Mycobacterium tuberculosis H37Rv
gcgaccauacccgcgcgcacca

SEQ ID NO: 3258659 - RNA, 18 nt, Mycobacterium tuberculosis H37Rv
gcgaccaucugaucgggc

SEQ ID NO: 3258660 - RNA, 13 nt, Mycobacterium tuberculosis H37Rv
gcgaccaugcucc

SEQ ID NO: 3258661 - RNA, 23 nt, Mycobacterium tuberculosis H37Rv
gcgacccccagcgcccgccggca

SEQ ID NO: 3258662 - RNA, 16 nt, Mycobacterium tuberculosis H37Rv
gcgaccccgccgagcg

SEQ ID NO: 3258663 - RNA, 15 nt, Mycobacterium tuberculosis H37Rv
gcgaccccggcugcg

SEQ ID NO: 3258664 - RNA, 15 nt, Mycobacterium tuberculosis H37Rv
gcgacccggccagcg

SEQ ID NO: 3258665 - RNA, 17 nt, Mycobacterium tuberculosis H37Rv
gcgacccggccagcggc

SEQ ID NO: 3258666 - RNA, 16 nt, Mycobacterium tuberculosis H37Rv
gcgacccggcccagcg

SEQ ID NO: 3258667 - RNA, 17 nt, Mycobacterium tuberculosis H37Rv
gcgacccgggccgcggc

SEQ ID NO: 3258668 - RNA, 21 nt, Mycobacterium tuberculosis H37Rv
gcgacccggguagacaccgcg

SEQ ID NO: 3258669 - RNA, 20 nt, Mycobacterium tuberculosis H37Rv
gcgacccgucccccgcacgc

SEQ ID NO: 3258670 - RNA, 12 nt, Mycobacterium tuberculosis H37Rv
gcgacccgucga

SEQ ID NO: 3258671 - RNA, 14 nt, Mycobacterium tuberculosis H37Rv
gcgacccgucgaac

SEQ ID NO: 3258672 - RNA, 14 nt, Mycobacterium tuberculosis H37Rv
gcgaccgaccagcc

SEQ ID NO: 3258673 - RNA, 21 nt, Mycobacterium tuberculosis H37Rv
gcgaccgaugaucucacccag

SEQ ID NO: 3258674 - RNA, 12 nt, Mycobacterium tuberculosis H37Rv
gcgaccgccauu

SEQ ID NO: 3258675 - RNA, 16 nt, Mycobacterium tuberculosis H37Rv
gcgaccgccucgccgu

SEQ ID NO: 3258676 - RNA, 20 nt, Mycobacterium tuberculosis H37Rv
gcgaccgccugcgcggcugc

SEQ ID NO: 3258677 - RNA, 14 nt, Mycobacterium tuberculosis H37Rv
gcgaccgcgaccgc

SEQ ID NO: 3258678 - RNA, 16 nt, Mycobacterium tuberculosis H37Rv
gcgaccgcgagggcca

SEQ ID NO: 3258679 - RNA, 14 nt, Mycobacterium tuberculosis H37Rv
gcgaccgcgauccc

SEQ ID NO: 3258680 - RNA, 23 nt, Mycobacterium tuberculosis H37Rv
gcgaccgcgcacggcuggcguac

SEQ ID NO: 3258681 - RNA, 13 nt, Mycobacterium tuberculosis H37Rv
gcgaccgcggccc

SEQ ID NO: 3258682 - RNA, 17 nt, Mycobacterium tuberculosis H37Rv
gcgaccgcgggccgacg

SEQ ID NO: 3258683 - RNA, 21 nt, Mycobacterium tuberculosis H37Rv
gcgaccggcguaaccggcagc

SEQ ID NO: 3258684 - RNA, 16 nt, Mycobacterium tuberculosis H37Rv
gcgaccggucugaucg

SEQ ID NO: 3258685 - RNA, 19 nt, Mycobacterium tuberculosis H37Rv
gcgaccggucugaucggcu

SEQ ID NO: 3258686 - RNA, 19 nt, Mycobacterium tuberculosis H37Rv
gcgaccggugccugcaacg

SEQ ID NO: 3258687 - RNA, 15 nt, Mycobacterium tuberculosis H37Rv
gcgaccgguucggcg

SEQ ID NO: 3258688 - RNA, 14 nt, Mycobacterium tuberculosis H37Rv
gcgaccgucccagc

SEQ ID NO: 3258689 - RNA, 16 nt, Mycobacterium tuberculosis H37Rv
gcgaccgucccagcgc

SEQ ID NO: 3258690 - RNA, 19 nt, Mycobacterium tuberculosis H37Rv
gcgaccgucccagcgccgc

SEQ ID NO: 3258691 - RNA, 15 nt, Mycobacterium tuberculosis H37Rv
gcgaccgucccggcc

SEQ ID NO: 3258692 - RNA, 17 nt, Mycobacterium tuberculosis H37Rv
gcgaccgucccggccuc

SEQ ID NO: 3258693 - RNA, 23 nt, Mycobacterium tuberculosis H37Rv
gcgaccgucgauuucgacgacca

SEQ ID NO: 3258694 - RNA, 17 nt, Mycobacterium tuberculosis H37Rv
gcgaccgucguccagac

SEQ ID NO: 3258695 - RNA, 12 nt, Mycobacterium tuberculosis H37Rv
gcgaccgucugg

SEQ ID NO: 3258696 - RNA, 19 nt, Mycobacterium tuberculosis H37Rv
gcgaccuccgcgaucaccg

SEQ ID NO: 3258697 - RNA, 19 nt, Mycobacterium tuberculosis H37Rv
gcgaccuccggaaucgccc

SEQ ID NO: 3258698 - RNA, 20 nt, Mycobacterium tuberculosis H37Rv
gcgaccuccggaaucgcccg

SEQ ID NO: 3258699 - RNA, 20 nt, Mycobacterium tuberculosis H37Rv
gcgaccucgccgcggcggaa

SEQ ID NO: 3258700 - RNA, 21 nt, Mycobacterium tuberculosis H37Rv
gcgaccucggguugcagcagc

SEQ ID NO: 3258701 - RNA, 22 nt, Mycobacterium tuberculosis H37Rv
gcgaccucggguugcagcagca

SEQ ID NO: 3258702 - RNA, 12 nt, Mycobacterium tuberculosis H37Rv
gcgaccugaaug

SEQ ID NO: 3258703 - RNA, 18 nt, Mycobacterium tuberculosis H37Rv
gcgaccugccggaccgcg

SEQ ID NO: 3258704 - RNA, 13 nt, Mycobacterium tuberculosis H37Rv
gcgaccugcgcga

SEQ ID NO: 3258705 - RNA, 13 nt, Mycobacterium tuberculosis H37Rv
gcgaccugcggac

SEQ ID NO: 3258706 - RNA, 19 nt, Mycobacterium tuberculosis H37Rv
gcgaccuugacccgcaagu

SEQ ID NO: 3258707 - RNA, 15 nt, Mycobacterium tuberculosis H37Rv
gcgacgaaccgccag

SEQ ID NO: 3258708 - RNA, 16 nt, Mycobacterium tuberculosis H37Rv
gcgacgaacgccguca

SEQ ID NO: 3258709 - RNA, 15 nt, Mycobacterium tuberculosis H37Rv
gcgacgaagaagaac

SEQ ID NO: 3258710 - RNA, 21 nt, Mycobacterium tuberculosis H37Rv
gcgacgaagaagaacucggcg

SEQ ID NO: 3258711 - RNA, 21 nt, Mycobacterium tuberculosis H37Rv
gcgacgacacgccugggcgac

SEQ ID NO: 3258712 - RNA, 19 nt, Mycobacterium tuberculosis H37Rv
gcgacgacccgggucggca

SEQ ID NO: 3258713 - RNA, 17 nt, Mycobacterium tuberculosis H37Rv
gcgacgacgacaccgcg

SEQ ID NO: 3258714 - RNA, 14 nt, Mycobacterium tuberculosis H37Rv
gcgacgacgagguc

SEQ ID NO: 3258715 - RNA, 13 nt, Mycobacterium tuberculosis H37Rv
gcgacgacgccaa

SEQ ID NO: 3258716 - RNA, 16 nt, Mycobacterium tuberculosis H37Rv
gcgacgacgcccacca

SEQ ID NO: 3258717 - RNA, 12 nt, Mycobacterium tuberculosis H37Rv
gcgacgagaucu

SEQ ID NO: 3258718 - RNA, 15 nt, Mycobacterium tuberculosis H37Rv
gcgacgagaucugcg

SEQ ID NO: 3258719 - RNA, 17 nt, Mycobacterium tuberculosis H37Rv
gcgacgagaucugcgau

SEQ ID NO: 3258720 - RNA, 19 nt, Mycobacterium tuberculosis H37Rv
gcgacgagcccaccgucgc

SEQ ID NO: 3258721 - RNA, 20 nt, Mycobacterium tuberculosis H37Rv
gcgacgaggcaaugcgagca

SEQ ID NO: 3258722 - RNA, 22 nt, Mycobacterium tuberculosis H37Rv
gcgacgauaucgggagcggcug

SEQ ID NO: 3258723 - RNA, 14 nt, Mycobacterium tuberculosis H37Rv
gcgacgaucgucca

SEQ ID NO: 3258724 - RNA, 20 nt, Mycobacterium tuberculosis H37Rv
gcgacgaugaucucgcccac

SEQ ID NO: 3258725 - RNA, 22 nt, Mycobacterium tuberculosis H37Rv
gcgacgaugaucucgcccaccu

SEQ ID NO: 3258726 - RNA, 15 nt, Mycobacterium tuberculosis H37Rv
gcgacgcacugcccc

SEQ ID NO: 3258727 - RNA, 12 nt, Mycobacterium tuberculosis H37Rv
gcgacgcagacc

SEQ ID NO: 3258728 - RNA, 17 nt, Mycobacterium tuberculosis H37Rv
gcgacgcagaccgucca

SEQ ID NO: 3258729 - RNA, 20 nt, Mycobacterium tuberculosis H37Rv
gcgacgcagaccguccagca

SEQ ID NO: 3258730 - RNA, 15 nt, Mycobacterium tuberculosis H37Rv
gcgacgcauaaccgg

SEQ ID NO: 3258731 - RNA, 19 nt, Mycobacterium tuberculosis H37Rv
gcgacgccauggucagaua

SEQ ID NO: 3258732 - RNA, 21 nt, Mycobacterium tuberculosis H37Rv
gcgacgccgaaaaugccgccc

SEQ ID NO: 3258733 - RNA, 18 nt, Mycobacterium tuberculosis H37Rv
gcgacgccggcccgacgg

SEQ ID NO: 3258734 - RNA, 22 nt, Mycobacterium tuberculosis H37Rv
gcgacgcgacacacgccgccgg

SEQ ID NO: 3258735 - RNA, 14 nt, Mycobacterium tuberculosis H37Rv
gcgacgcgaccgcg

SEQ ID NO: 3258736 - RNA, 15 nt, Mycobacterium tuberculosis H37Rv
gcgacgcgaccgcga

SEQ ID NO: 3258737 - RNA, 19 nt, Mycobacterium tuberculosis H37Rv
gcgacgcggaguccgucga

SEQ ID NO: 3258738 - RNA, 14 nt, Mycobacterium tuberculosis H37Rv
gcgacgcggccagc

SEQ ID NO: 3258739 - RNA, 15 nt, Mycobacterium tuberculosis H37Rv
gcgacgcggcgucgg

SEQ ID NO: 3258740 - RNA, 15 nt, Mycobacterium tuberculosis H37Rv
gcgacgcggucaucg

SEQ ID NO: 3258741 - RNA, 15 nt, Mycobacterium tuberculosis H37Rv
gcgacgcguagcacg

SEQ ID NO: 3258742 - RNA, 17 nt, Mycobacterium tuberculosis H37Rv
gcgacgcguagcacggc

SEQ ID NO: 3258743 - RNA, 19 nt, Mycobacterium tuberculosis H37Rv
gcgacgcguagcacggcga

SEQ ID NO: 3258744 - RNA, 22 nt, Mycobacterium tuberculosis H37Rv
gcgacgcguagcacggcgaucc

SEQ ID NO: 3258745 - RNA, 16 nt, Mycobacterium tuberculosis H37Rv
gcgacgcuaccgccgg

SEQ ID NO: 3258746 - RNA, 20 nt, Mycobacterium tuberculosis H37Rv
gcgacgcuaggacggcugcc

SEQ ID NO: 3258747 - RNA, 12 nt, Mycobacterium tuberculosis H37Rv
gcgagcccgcau

SEQ ID NO: 3258748 - RNA, 19 nt, Mycobacterium tuberculosis H37Rv
gcgagcccgcaucgcacca

SEQ ID NO: 3258749 - RNA, 14 nt, Mycobacterium tuberculosis H37Rv
gcgagccggcgcgc

SEQ ID NO: 3258750 - RNA, 19 nt, Mycobacterium tuberculosis H37Rv
gcgagccucuuggucaacg

SEQ ID NO: 3258751 - RNA, 16 nt, Mycobacterium tuberculosis H37Rv
gcgagcgaguccagcg

SEQ ID NO: 3258752 - RNA, 18 nt, Mycobacterium tuberculosis H37Rv
gcgagcgccggccgcggc

SEQ ID NO: 3258753 - RNA, 14 nt, Mycobacterium tuberculosis H37Rv
gcgagcgccggcuu

SEQ ID NO: 3258754 - RNA, 20 nt, Mycobacterium tuberculosis H37Rv
gcgagcgccuuucggucacg

SEQ ID NO: 3258755 - RNA, 15 nt, Mycobacterium tuberculosis H37Rv
gcgagcgcgccggcc

SEQ ID NO: 3258756 - RNA, 14 nt, Mycobacterium tuberculosis H37Rv
gcgagcgcgcgacu

SEQ ID NO: 3258757 - RNA, 12 nt, Mycobacterium tuberculosis H37Rv
gcgagcgcggcg

SEQ ID NO: 3258758 - RNA, 16 nt, Mycobacterium tuberculosis H37Rv
gcgagcgcuaucaccg

SEQ ID NO: 3258759 - RNA, 18 nt, Mycobacterium tuberculosis H37Rv
gcgagcgcuaucaccgcc

SEQ ID NO: 3258760 - RNA, 22 nt, Mycobacterium tuberculosis H37Rv
gcgagcggaauggaggccgccg

SEQ ID NO: 3258761 - RNA, 19 nt, Mycobacterium tuberculosis H37Rv
gcgagcggauccgugucgc

SEQ ID NO: 3258762 - RNA, 18 nt, Mycobacterium tuberculosis H37Rv
gcgagcggccuccagcac

SEQ ID NO: 3258763 - RNA, 22 nt, Mycobacterium tuberculosis H37Rv
gcgagcggcgaacucgggcgac

SEQ ID NO: 3258764 - RNA, 14 nt, Mycobacterium tuberculosis H37Rv
gcgagcggucgacg

SEQ ID NO: 3258765 - RNA, 18 nt, Mycobacterium tuberculosis H37Rv
gcgagcguuucaccaguc

SEQ ID NO: 3258766 - RNA, 20 nt, Mycobacterium tuberculosis H37Rv
gcgagcguuucaccagucca

SEQ ID NO: 3258767 - RNA, 19 nt, Mycobacterium tuberculosis H37Rv
gcgagcguuuggacgggcg

SEQ ID NO: 3258768 - RNA, 16 nt, Mycobacterium tuberculosis H37Rv
gcgagcuggcguuccc

SEQ ID NO: 3258769 - RNA, 21 nt, Mycobacterium tuberculosis H37Rv
gcgaggaacuggaccggugcc

SEQ ID NO: 3258770 - RNA, 22 nt, Mycobacterium tuberculosis H37Rv
gcgaggaacuggaccggugcca

SEQ ID NO: 3258771 - RNA, 20 nt, Mycobacterium tuberculosis H37Rv
gcgaggaauuccgcuaccgc

SEQ ID NO: 3258772 - RNA, 19 nt, Mycobacterium tuberculosis H37Rv
gcgaggacgcugauccacg

SEQ ID NO: 3258773 - RNA, 15 nt, Mycobacterium tuberculosis H37Rv
gcgaggagcagggcu

SEQ ID NO: 3258774 - RNA, 21 nt, Mycobacterium tuberculosis H37Rv
gcgaggauccauuggaaccug

SEQ ID NO: 3258775 - RNA, 22 nt, Mycobacterium tuberculosis H37Rv
gcgaggccagcgguaaugccag

SEQ ID NO: 3258776 - RNA, 22 nt, Mycobacterium tuberculosis H37Rv
gcgaggcgcucacccgccgcgg

SEQ ID NO: 3258777 - RNA, 21 nt, Mycobacterium tuberculosis H37Rv
gcgaggcgcucgagugcguug

SEQ ID NO: 3258778 - RNA, 20 nt, Mycobacterium tuberculosis H37Rv
gcgaggcguaaucaagcagc

SEQ ID NO: 3258779 - RNA, 19 nt, Mycobacterium tuberculosis H37Rv
gcgaggcucccccaccagg

SEQ ID NO: 3258780 - RNA, 19 nt, Mycobacterium tuberculosis H37Rv
gcgaggcucgcguggccgc

SEQ ID NO: 3258781 - RNA, 17 nt, Mycobacterium tuberculosis H37Rv
gcgagggcauccgagcg

SEQ ID NO: 3258782 - RNA, 22 nt, Mycobacterium tuberculosis H37Rv
gcgagggcggucagcggccaac

SEQ ID NO: 3258783 - RNA, 20 nt, Mycobacterium tuberculosis H37Rv
gcgagggcuaccggcgccgc

SEQ ID NO: 3258784 - RNA, 22 nt, Mycobacterium tuberculosis H37Rv
gcgagggcuaccggcgccgcgc

SEQ ID NO: 3258785 - RNA, 22 nt, Mycobacterium tuberculosis H37Rv
gcgaggggauuuugcgucugcu

SEQ ID NO: 3258786 - RNA, 21 nt, Mycobacterium tuberculosis H37Rv
gcgagggugagcauggcuagg

SEQ ID NO: 3258787 - RNA, 19 nt, Mycobacterium tuberculosis H37Rv
gcgagguacccaucgucga

SEQ ID NO: 3258788 - RNA, 13 nt, Mycobacterium tuberculosis H37Rv
gcgagguccagca

SEQ ID NO: 3258789 - RNA, 15 nt, Mycobacterium tuberculosis H37Rv
gcgagguccagcaug

SEQ ID NO: 3258790 - RNA, 19 nt, Mycobacterium tuberculosis H37Rv
gcgaggucccggccgagcg

SEQ ID NO: 3258791 - RNA, 15 nt, Mycobacterium tuberculosis H37Rv
gcgaggucggcggcg

SEQ ID NO: 3258792 - RNA, 22 nt, Mycobacterium tuberculosis H37Rv
gcgaggucggugaggucgaugc

SEQ ID NO: 3258793 - RNA, 21 nt, Mycobacterium tuberculosis H37Rv
gcgaggugauuggucacaccc

SEQ ID NO: 3258794 - RNA, 20 nt, Mycobacterium tuberculosis H37Rv
gcgaggugcccaaggccagg

SEQ ID NO: 3258795 - RNA, 13 nt, Mycobacterium tuberculosis H37Rv
gcgaggugccggg

SEQ ID NO: 3258796 - RNA, 15 nt, Mycobacterium tuberculosis H37Rv
gcgagguugcgccga

SEQ ID NO: 3258797 - RNA, 20 nt, Mycobacterium tuberculosis H37Rv
gcgagguuggcguugguggu

SEQ ID NO: 3258798 - RNA, 19 nt, Mycobacterium tuberculosis H37Rv
gcgaguaacccguccggug

SEQ ID NO: 3258799 - RNA, 15 nt, Mycobacterium tuberculosis H37Rv
gcgaguaaucgaccg

SEQ ID NO: 3258800 - RNA, 20 nt, Mycobacterium tuberculosis H37Rv
gcgaguacggccugccgcuc

SEQ ID NO: 3258801 - RNA, 17 nt, Mycobacterium tuberculosis H37Rv
gcgaguagucgacgucg

SEQ ID NO: 3258802 - RNA, 19 nt, Mycobacterium tuberculosis H37Rv
gcgagucgaacccgcgagc

SEQ ID NO: 3258803 - RNA, 12 nt, Mycobacterium tuberculosis H37Rv
gcgagucgcacu

SEQ ID NO: 3258804 - RNA, 16 nt, Mycobacterium tuberculosis H37Rv
gcgagugaacucgucc

SEQ ID NO: 3258805 - RNA, 23 nt, Mycobacterium tuberculosis H37Rv
gcgagugcgugaucuggccgaag

SEQ ID NO: 3258806 - RNA, 15 nt, Mycobacterium tuberculosis H37Rv
gcgagugucagcaga

SEQ ID NO: 3258807 - RNA, 16 nt, Mycobacterium tuberculosis H37Rv
gcgagugucagcagau

SEQ ID NO: 3258808 - RNA, 21 nt, Mycobacterium tuberculosis H37Rv
gcgagugucagcagaugggcg

SEQ ID NO: 3258809 - RNA, 22 nt, Mycobacterium tuberculosis H37Rv
gcgagugucuuagccagcagca

SEQ ID NO: 3258810 - RNA, 19 nt, Mycobacterium tuberculosis H37Rv
gcgaguuucugcucgaccg

SEQ ID NO: 3258811 - RNA, 19 nt, Mycobacterium tuberculosis H37Rv
gcgauaacuccgcggcgaa

SEQ ID NO: 3258812 - RNA, 16 nt, Mycobacterium tuberculosis H37Rv
gcgauacacggcggcg

SEQ ID NO: 3258813 - RNA, 19 nt, Mycobacterium tuberculosis H37Rv
gcgauacccaucgaucgaa

SEQ ID NO: 3258814 - RNA, 15 nt, Mycobacterium tuberculosis H37Rv
gcgauaccgacaccc

SEQ ID NO: 3258815 - RNA, 17 nt, Mycobacterium tuberculosis H37Rv
gcgauaccgacacccca

SEQ ID NO: 3258816 - RNA, 14 nt, Mycobacterium tuberculosis H37Rv
gcgauagcggcgcu

SEQ ID NO: 3258817 - RNA, 14 nt, Mycobacterium tuberculosis H37Rv
gcgauaggcccggu

SEQ ID NO: 3258818 - RNA, 17 nt, Mycobacterium tuberculosis H37Rv
gcgauaggcccggucuu

SEQ ID NO: 3258819 - RNA, 16 nt, Mycobacterium tuberculosis H37Rv
gcgauaucgcacaugg

SEQ ID NO: 3258820 - RNA, 17 nt, Mycobacterium tuberculosis H37Rv
gcgauaucgcacaugga

SEQ ID NO: 3258821 - RNA, 13 nt, Mycobacterium tuberculosis H37Rv
gcgauaucggcgg

SEQ ID NO: 3258822 - RNA, 21 nt, Mycobacterium tuberculosis H37Rv
gcgaucaaccgcugucaccgu

SEQ ID NO: 3258823 - RNA, 15 nt, Mycobacterium tuberculosis H37Rv
gcgaucaacggaucg

SEQ ID NO: 3258824 - RNA, 19 nt, Mycobacterium tuberculosis H37Rv
gcgaucaauugcccggcac

SEQ ID NO: 3258825 - RNA, 19 nt, Mycobacterium tuberculosis H37Rv
gcgaucacccacaugguga

SEQ ID NO: 3258826 - RNA, 14 nt, Mycobacterium tuberculosis H37Rv
gcgaucaccgacga

SEQ ID NO: 3258827 - RNA, 21 nt, Mycobacterium tuberculosis H37Rv
gcgaucaccgagucgacggcc

SEQ ID NO: 3258828 - RNA, 20 nt, Mycobacterium tuberculosis H37Rv
gcgaucagcagcgccagcac

SEQ ID NO: 3258829 - RNA, 14 nt, Mycobacterium tuberculosis H37Rv
gcgaucaggcgcuc

SEQ ID NO: 3258830 - RNA, 22 nt, Mycobacterium tuberculosis H37Rv
gcgaucaggcugccgcugcgcc

SEQ ID NO: 3258831 - RNA, 18 nt, Mycobacterium tuberculosis H37Rv
gcgaucaguucgugacgu

SEQ ID NO: 3258832 - RNA, 20 nt, Mycobacterium tuberculosis H37Rv
gcgaucaguucgugacgugc

SEQ ID NO: 3258833 - RNA, 19 nt, Mycobacterium tuberculosis H37Rv
gcgauccaccaagcucgca

SEQ ID NO: 3258834 - RNA, 14 nt, Mycobacterium tuberculosis H37Rv
gcgauccagggccg

SEQ ID NO: 3258835 - RNA, 15 nt, Mycobacterium tuberculosis H37Rv
gcgauccagggccga

SEQ ID NO: 3258836 - RNA, 20 nt, Mycobacterium tuberculosis H37Rv
gcgauccagggccgacgcga

SEQ ID NO: 3258837 - RNA, 21 nt, Mycobacterium tuberculosis H37Rv
gcgauccagggccgacgcgaa

SEQ ID NO: 3258838 - RNA, 20 nt, Mycobacterium tuberculosis H37Rv
gcgaucccaacgcccgggcg

SEQ ID NO: 3258839 - RNA, 13 nt, Mycobacterium tuberculosis H37Rv
gcgaucccgaucg

SEQ ID NO: 3258840 - RNA, 16 nt, Mycobacterium tuberculosis H37Rv
gcgauccgagaccgcg

SEQ ID NO: 3258841 - RNA, 16 nt, Mycobacterium tuberculosis H37Rv
gcgauccgcggcguuc

SEQ ID NO: 3258842 - RNA, 14 nt, Mycobacterium tuberculosis H37Rv
gcgauccggucggc

SEQ ID NO: 3258843 - RNA, 19 nt, Mycobacterium tuberculosis H37Rv
gcgauucugugucugcucg

SEQ ID NO: 3258844 - RNA, 23 nt, Mycobacterium tuberculosis H37Rv
gcgauugcgcacacccugcagcu

SEQ ID NO: 3258845 - RNA, 13 nt, Mycobacterium tuberculosis H37Rv
gcgauuggcuggg

SEQ ID NO: 3258846 - RNA, 14 nt, Mycobacterium tuberculosis H37Rv
gcgauuuucggcac

SEQ ID NO: 3258847 - RNA, 19 nt, Mycobacterium tuberculosis H37Rv
gcgauuuugcgucugcucg

SEQ ID NO: 3258848 - RNA, 19 nt, Mycobacterium tuberculosis H37Rv
gcgauuuugugucugcucg

SEQ ID NO: 3258849 - RNA, 20 nt, Mycobacterium tuberculosis H37Rv
gcgauuuugugucugcucgc

SEQ ID NO: 3258850 - RNA, 15 nt, Mycobacterium tuberculosis H37Rv
gcgcaaacucagacu

SEQ ID NO: 3258851 - RNA, 18 nt, Mycobacterium tuberculosis H37Rv
gcgcaaaugccugcuggu

SEQ ID NO: 3258852 - RNA, 20 nt, Mycobacterium tuberculosis H37Rv
gcgcaacaaccgguuggcga

SEQ ID NO: 3258853 - RNA, 23 nt, Mycobacterium tuberculosis H37Rv
gcgcaacacauccaguaaccguc

SEQ ID NO: 3258854 - RNA, 14 nt, Mycobacterium tuberculosis H37Rv
gcgcaacaccauca

SEQ ID NO: 3258855 - RNA, 22 nt, Mycobacterium tuberculosis H37Rv
gcgcaacaccgugcaccagcuc

SEQ ID NO: 3258856 - RNA, 20 nt, Mycobacterium tuberculosis H37Rv
gcgcaacaccucgucggcuu

SEQ ID NO: 3258857 - RNA, 21 nt, Mycobacterium tuberculosis H37Rv
gcgcaaccagcaaugccgacu

SEQ ID NO: 3258858 - RNA, 17 nt, Mycobacterium tuberculosis H37Rv
gcgcaacccagccgcgc

SEQ ID NO: 3258859 - RNA, 14 nt, Mycobacterium tuberculosis H37Rv
gcgcaaccggccgu

SEQ ID NO: 3258860 - RNA, 16 nt, Mycobacterium tuberculosis H37Rv
gcgcaaccggccgucc

SEQ ID NO: 3258861 - RNA, 22 nt, Mycobacterium tuberculosis H37Rv
gcgcaaccgguggaugaacacc

SEQ ID NO: 3258862 - RNA, 23 nt, Mycobacterium tuberculosis H37Rv
gcgcaaccuaaauugccgggccc

SEQ ID NO: 3258863 - RNA, 14 nt, Mycobacterium tuberculosis H37Rv
gcgcaaccuccgcg

SEQ ID NO: 3258864 - RNA, 20 nt, Mycobacterium tuberculosis H37Rv
gcgcaacgccauaccagcgu

SEQ ID NO: 3258865 - RNA, 14 nt, Mycobacterium tuberculosis H37Rv
gcgcaacgccgcca

SEQ ID NO: 3258866 - RNA, 20 nt, Mycobacterium tuberculosis H37Rv
gcgcaacgccgccagccugg

SEQ ID NO: 3258867 - RNA, 15 nt, Mycobacterium tuberculosis H37Rv
gcgcaacggccagcg

SEQ ID NO: 3258868 - RNA, 16 nt, Mycobacterium tuberculosis H37Rv
gcgcaacggccagcgc

SEQ ID NO: 3258869 - RNA, 22 nt, Mycobacterium tuberculosis H37Rv
gcgcaacgggucgguccacuuc

SEQ ID NO: 3258870 - RNA, 18 nt, Mycobacterium tuberculosis H37Rv
gcgcaacguacgcacgca

SEQ ID NO: 3258871 - RNA, 18 nt, Mycobacterium tuberculosis H37Rv
gcgcaacguagccagcag

SEQ ID NO: 3258872 - RNA, 22 nt, Mycobacterium tuberculosis H37Rv
gcgcaacguagccagcagcggc

SEQ ID NO: 3258873 - RNA, 16 nt, Mycobacterium tuberculosis H37Rv
gcgcaacucccagcac

SEQ ID NO: 3258874 - RNA, 18 nt, Mycobacterium tuberculosis H37Rv
gcgcaacucccagcacgg

SEQ ID NO: 3258875 - RNA, 23 nt, Mycobacterium tuberculosis H37Rv
gcgcaacuucgacuugagaaacc

SEQ ID NO: 3258876 - RNA, 18 nt, Mycobacterium tuberculosis H37Rv
gcgcaagaaugccgccga

SEQ ID NO: 3258877 - RNA, 17 nt, Mycobacterium tuberculosis H37Rv
gcgcaagcgccgcgcuu

SEQ ID NO: 3258878 - RNA, 22 nt, Mycobacterium tuberculosis H37Rv
gcgcaaggcaaaucggugcgau

SEQ ID NO: 3258879 - RNA, 20 nt, Mycobacterium tuberculosis H37Rv
gcgcaagugauuucggugac

SEQ ID NO: 3258880 - RNA, 20 nt, Mycobacterium tuberculosis H37Rv
gcgcaaguugagcagcuugg

SEQ ID NO: 3258881 - RNA, 18 nt, Mycobacterium tuberculosis H37Rv
gcgcaauagcgacagcag

SEQ ID NO: 3258882 - RNA, 16 nt, Mycobacterium tuberculosis H37Rv
gcgcaaucgacaccag

SEQ ID NO: 3258883 - RNA, 19 nt, Mycobacterium tuberculosis H37Rv
gcgcaaucgacaccagcgu

SEQ ID NO: 3258884 - RNA, 21 nt, Mycobacterium tuberculosis H37Rv
gcgcaaucgaccacgacgugg

SEQ ID NO: 3258885 - RNA, 18 nt, Mycobacterium tuberculosis H37Rv
gcgcaaucgugguucggc

SEQ ID NO: 3258886 - RNA, 16 nt, Mycobacterium tuberculosis H37Rv
gcgcaaugcaucgcgg

SEQ ID NO: 3258887 - RNA, 21 nt, Mycobacterium tuberculosis H37Rv
gcgcaaugcaucgcggcggcg

SEQ ID NO: 3258888 - RNA, 23 nt, Mycobacterium tuberculosis H37Rv
gcgcaaugcaucgcggcggcgcu

SEQ ID NO: 3258889 - RNA, 24 nt, Mycobacterium tuberculosis H37Rv
gcgcaaugccgacgccaacgccag

SEQ ID NO: 3258890 - RNA, 17 nt, Mycobacterium tuberculosis H37Rv
gcgcaaugcgcgacggu

SEQ ID NO: 3258891 - RNA, 14 nt, Mycobacterium tuberculosis H37Rv
gcgcaaugcggccc

SEQ ID NO: 3258892 - RNA, 17 nt, Mycobacterium tuberculosis H37Rv
gcgcaaugcggcccggg

SEQ ID NO: 3258893 - RNA, 20 nt, Mycobacterium tuberculosis H37Rv
gcgcacaaacauacgccacc

SEQ ID NO: 3258894 - RNA, 13 nt, Mycobacterium tuberculosis H37Rv
gcgcacacccugc

SEQ ID NO: 3258895 - RNA, 16 nt, Mycobacterium tuberculosis H37Rv
gcgcacacccugcagc

SEQ ID NO: 3258896 - RNA, 15 nt, Mycobacterium tuberculosis H37Rv
gcgcacagcgagcac

SEQ ID NO: 3258897 - RNA, 17 nt, Mycobacterium tuberculosis H37Rv
gcgcaccaacaccagcg

SEQ ID NO: 3258898 - RNA, 18 nt, Mycobacterium tuberculosis H37Rv
gcgcaccaagacgccacc

SEQ ID NO: 3258899 - RNA, 15 nt, Mycobacterium tuberculosis H37Rv
gcgcaccacaccacg

SEQ ID NO: 3258900 - RNA, 21 nt, Mycobacterium tuberculosis H37Rv
gcgcaccaccgccccgcgccc

SEQ ID NO: 3258901 - RNA, 13 nt, Mycobacterium tuberculosis H37Rv
gcgcaccagcggc

SEQ ID NO: 3258902 - RNA, 15 nt, Mycobacterium tuberculosis H37Rv
gcgcaccaguccagc

SEQ ID NO: 3258903 - RNA, 18 nt, Mycobacterium tuberculosis H37Rv
gcgcaccaucgcggccgc

SEQ ID NO: 3258904 - RNA, 19 nt, Mycobacterium tuberculosis H37Rv
gcgcaccaucgcggccgcu

SEQ ID NO: 3258905 - RNA, 17 nt, Mycobacterium tuberculosis H37Rv
gcgcacccagcccagcc

SEQ ID NO: 3258906 - RNA, 19 nt, Mycobacterium tuberculosis H37Rv
gcgcacccagcccagccgu

SEQ ID NO: 3258907 - RNA, 22 nt, Mycobacterium tuberculosis H37Rv
gcgcacccagcccagccguucg

SEQ ID NO: 3258908 - RNA, 21 nt, Mycobacterium tuberculosis H37Rv
gcgcaccccgcuugcgcggcu

SEQ ID NO: 3258909 - RNA, 15 nt, Mycobacterium tuberculosis H37Rv
gcgcaccccggcaua

SEQ ID NO: 3258910 - RNA, 13 nt, Mycobacterium tuberculosis H37Rv
gcgcacccgcggg

SEQ ID NO: 3258911 - RNA, 19 nt, Mycobacterium tuberculosis H37Rv
gcgcaccgcauaacgcgaa

SEQ ID NO: 3258912 - RNA, 14 nt, Mycobacterium tuberculosis H37Rv
gcgcaccgccgaug

SEQ ID NO: 3258913 - RNA, 14 nt, Mycobacterium tuberculosis H37Rv
gcgcaccgcggacc

SEQ ID NO: 3258914 - RNA, 12 nt, Mycobacterium tuberculosis H37Rv
gcgcaccggagu

SEQ ID NO: 3258915 - RNA, 22 nt, Mycobacterium tuberculosis H37Rv
gcgcaccggaucgccgucgcga

SEQ ID NO: 3258916 - RNA, 16 nt, Mycobacterium tuberculosis H37Rv
gcgcaccggcgucggc

SEQ ID NO: 3258917 - RNA, 22 nt, Mycobacterium tuberculosis H37Rv
gcgcaccggcuggcccagcgac

SEQ ID NO: 3258918 - RNA, 12 nt, Mycobacterium tuberculosis H37Rv
gcgcaccgucgc

SEQ ID NO: 3258919 - RNA, 15 nt, Mycobacterium tuberculosis H37Rv
gcgcaccucggcgaa

SEQ ID NO: 3258920 - RNA, 14 nt, Mycobacterium tuberculosis H37Rv
gcgcaccugaaggc

SEQ ID NO: 3258921 - RNA, 22 nt, Mycobacterium tuberculosis H37Rv
gcgcaccugaucggucaacucg

SEQ ID NO: 3258922 - RNA, 19 nt, Mycobacterium tuberculosis H37Rv
gcgcaccugggcugccggc

SEQ ID NO: 3258923 - RNA, 17 nt, Mycobacterium tuberculosis H37Rv
gcgcacgaaaccgcagc

SEQ ID NO: 3258924 - RNA, 15 nt, Mycobacterium tuberculosis H37Rv
gcgcacgauagccac

SEQ ID NO: 3258925 - RNA, 16 nt, Mycobacterium tuberculosis H37Rv
gcgcacggaccaucgc

SEQ ID NO: 3258926 - RNA, 14 nt, Mycobacterium tuberculosis H37Rv
gcgcacggcgccga

SEQ ID NO: 3258927 - RNA, 18 nt, Mycobacterium tuberculosis H37Rv
gcgcacggcgccgacccg

SEQ ID NO: 3258928 - RNA, 13 nt, Mycobacterium tuberculosis H37Rv
gcgcacggcggcc

SEQ ID NO: 3258929 - RNA, 18 nt, Mycobacterium tuberculosis H37Rv
gcgcacggcggcccacgc

SEQ ID NO: 3258930 - RNA, 14 nt, Mycobacterium tuberculosis H37Rv
gcgcacggcgucgg

SEQ ID NO: 3258931 - RNA, 18 nt, Mycobacterium tuberculosis H37Rv
gcgcacggcgucggccac

SEQ ID NO: 3258932 - RNA, 13 nt, Mycobacterium tuberculosis H37Rv
gcgcacggcuggc

SEQ ID NO: 3258933 - RNA, 14 nt, Mycobacterium tuberculosis H37Rv
gcgcacgguuggcg

SEQ ID NO: 3258934 - RNA, 13 nt, Mycobacterium tuberculosis H37Rv
gcgcacuaccgcc

SEQ ID NO: 3258935 - RNA, 14 nt, Mycobacterium tuberculosis H37Rv
gcgcacucaccuug

SEQ ID NO: 3258936 - RNA, 22 nt, Mycobacterium tuberculosis H37Rv
gcgcacucccggcucggccagc

SEQ ID NO: 3258937 - RNA, 16 nt, Mycobacterium tuberculosis H37Rv
gcgcacucuagccggg

SEQ ID NO: 3258938 - RNA, 17 nt, Mycobacterium tuberculosis H37Rv
gcgcacucuagccgggu

SEQ ID NO: 3258939 - RNA, 15 nt, Mycobacterium tuberculosis H37Rv
gcgccaaacaccccg

SEQ ID NO: 3258940 - RNA, 22 nt, Mycobacterium tuberculosis H37Rv
gcgccaaacaccccggccuugc

SEQ ID NO: 3258941 - RNA, 14 nt, Mycobacterium tuberculosis H37Rv
gcgccaaauccggc

SEQ ID NO: 3258942 - RNA, 20 nt, Mycobacterium tuberculosis H37Rv
gcgccaacccggcgggcccg

SEQ ID NO: 3258943 - RNA, 21 nt, Mycobacterium tuberculosis H37Rv
gcgccaacgcccccauccggu

SEQ ID NO: 3258944 - RNA, 16 nt, Mycobacterium tuberculosis H37Rv
gcgccaagacgucggc

SEQ ID NO: 3258945 - RNA, 22 nt, Mycobacterium tuberculosis H37Rv
gcgccaagccgugccgcacagc

SEQ ID NO: 3258946 - RNA, 22 nt, Mycobacterium tuberculosis H37Rv
gcgccaaggucugccgggcgcg

SEQ ID NO: 3258947 - RNA, 23 nt, Mycobacterium tuberculosis H37Rv
gcgccaaggucugccgggcgcgc

SEQ ID NO: 3258948 - RNA, 17 nt, Mycobacterium tuberculosis H37Rv
gcgccaauucagcggca

SEQ ID NO: 3258949 - RNA, 13 nt, Mycobacterium tuberculosis H37Rv
gcgccacagcagc

SEQ ID NO: 3258950 - RNA, 15 nt, Mycobacterium tuberculosis H37Rv
gcgccacagcagcgu

SEQ ID NO: 3258951 - RNA, 17 nt, Mycobacterium tuberculosis H37Rv
gcgccacagcagcguug

SEQ ID NO: 3258952 - RNA, 20 nt, Mycobacterium tuberculosis H37Rv
gcgccacauacaccggccgg

SEQ ID NO: 3258953 - RNA, 15 nt, Mycobacterium tuberculosis H37Rv
gcgccaccaccggcg

SEQ ID NO: 3258954 - RNA, 20 nt, Mycobacterium tuberculosis H37Rv
gcgccaccagcaccgccgcu

SEQ ID NO: 3258955 - RNA, 21 nt, Mycobacterium tuberculosis H37Rv
gcgccaccagucacgcccacc

SEQ ID NO: 3258956 - RNA, 21 nt, Mycobacterium tuberculosis H37Rv
gcgccacccgaucgggcguca

SEQ ID NO: 3258957 - RNA, 15 nt, Mycobacterium tuberculosis H37Rv
gcgccacccgcgccg

SEQ ID NO: 3258958 - RNA, 23 nt, Mycobacterium tuberculosis H37Rv
gcgccacccgcgccgccagcgcc

SEQ ID NO: 3258959 - RNA, 17 nt, Mycobacterium tuberculosis H37Rv
gcgccacccgguccggc

SEQ ID NO: 3258960 - RNA, 14 nt, Mycobacterium tuberculosis H37Rv
gcgccaccgaccga

SEQ ID NO: 3258961 - RNA, 21 nt, Mycobacterium tuberculosis H37Rv
gcgccaccgaguagaacuucg

SEQ ID NO: 3258962 - RNA, 13 nt, Mycobacterium tuberculosis H37Rv
gcgccaccgccgc

SEQ ID NO: 3258963 - RNA, 17 nt, Mycobacterium tuberculosis H37Rv
gcgccaccggcaccgcc

SEQ ID NO: 3258964 - RNA, 18 nt, Mycobacterium tuberculosis H37Rv
gcgccaccggcgccgccc

SEQ ID NO: 3258965 - RNA, 16 nt, Mycobacterium tuberculosis H37Rv
gcgccaccguggugga

SEQ ID NO: 3258966 - RNA, 19 nt, Mycobacterium tuberculosis H37Rv
gcgccaccgugguggacga

SEQ ID NO: 3258967 - RNA, 19 nt, Mycobacterium tuberculosis H37Rv
gcgccaccgugguucggcg

SEQ ID NO: 3258968 - RNA, 21 nt, Mycobacterium tuberculosis H37Rv
gcgccaccguuaccgccguuu

SEQ ID NO: 3258969 - RNA, 22 nt, Mycobacterium tuberculosis H37Rv
gcgccaccucccacgccgccgu

SEQ ID NO: 3258970 - RNA, 19 nt, Mycobacterium tuberculosis H37Rv
gcgccacgaccgcggcggc

SEQ ID NO: 3258971 - RNA, 14 nt, Mycobacterium tuberculosis H37Rv
gcgccacgaugacc

SEQ ID NO: 3258972 - RNA, 13 nt, Mycobacterium tuberculosis H37Rv
gcgccacgccacc

SEQ ID NO: 3258973 - RNA, 14 nt, Mycobacterium tuberculosis H37Rv
gcgccacggcagcg

SEQ ID NO: 3258974 - RNA, 15 nt, Mycobacterium tuberculosis H37Rv
gcgccacggcagcgc

SEQ ID NO: 3258975 - RNA, 17 nt, Mycobacterium tuberculosis H37Rv
gcgccacggcagcgccc

SEQ ID NO: 3258976 - RNA, 19 nt, Mycobacterium tuberculosis H37Rv
gcgccacggugucgucgac

SEQ ID NO: 3258977 - RNA, 20 nt, Mycobacterium tuberculosis H37Rv
gcgccacguggucgagcagg

SEQ ID NO: 3258978 - RNA, 18 nt, Mycobacterium tuberculosis H37Rv
gcgccacuagcccugagc

SEQ ID NO: 3258979 - RNA, 21 nt, Mycobacterium tuberculosis H37Rv
gcgccacugaccgcgaucgcc

SEQ ID NO: 3258980 - RNA, 16 nt, Mycobacterium tuberculosis H37Rv
gcgccacugcuuccgg

SEQ ID NO: 3258981 - RNA, 18 nt, Mycobacterium tuberculosis H37Rv
gcgccagacacaaccgcu

SEQ ID NO: 3258982 - RNA, 21 nt, Mycobacterium tuberculosis H37Rv
gcgccagcacaaccaucgcga

SEQ ID NO: 3258983 - RNA, 16 nt, Mycobacterium tuberculosis H37Rv
gcgccagccccgccgg

SEQ ID NO: 3258984 - RNA, 12 nt, Mycobacterium tuberculosis H37Rv
gcgccagccggu

SEQ ID NO: 3258985 - RNA, 15 nt, Mycobacterium tuberculosis H37Rv
gcgccagccuccacc

SEQ ID NO: 3258986 - RNA, 22 nt, Mycobacterium tuberculosis H37Rv
gcgccagccuccaccaggucgu

SEQ ID NO: 3258987 - RNA, 13 nt, Mycobacterium tuberculosis H37Rv
gcgccagcgagca

SEQ ID NO: 3258988 - RNA, 20 nt, Mycobacterium tuberculosis H37Rv
gcgccagcgauaucggcggc

SEQ ID NO: 3258989 - RNA, 22 nt, Mycobacterium tuberculosis H37Rv
gcgccagcgauaucggcggcuu

SEQ ID NO: 3258990 - RNA, 15 nt, Mycobacterium tuberculosis H37Rv
gcgccagcgccgcca

SEQ ID NO: 3258991 - RNA, 16 nt, Mycobacterium tuberculosis H37Rv
gcgccagcgccugcgc

SEQ ID NO: 3258992 - RNA, 13 nt, Mycobacterium tuberculosis H37Rv
gcgccagcgggcu

SEQ ID NO: 3258993 - RNA, 20 nt, Mycobacterium tuberculosis H37Rv
gcgccagcguuaggucgccg

SEQ ID NO: 3258994 - RNA, 13 nt, Mycobacterium tuberculosis H37Rv
gcgccagcuccgu

SEQ ID NO: 3258995 - RNA, 17 nt, Mycobacterium tuberculosis H37Rv
gcgccaggccacguagc

SEQ ID NO: 3258996 - RNA, 22 nt, Mycobacterium tuberculosis H37Rv
gcgccaggccacguagcagcgc

SEQ ID NO: 3258997 - RNA, 21 nt, Mycobacterium tuberculosis H37Rv
gcgccaggccgcacagcacca

SEQ ID NO: 3258998 - RNA, 18 nt, Mycobacterium tuberculosis H37Rv
gcgccaggcgcgaucgcg

SEQ ID NO: 3258999 - RNA, 15 nt, Mycobacterium tuberculosis H37Rv
gcgccaggcggcaau

SEQ ID NO: 3259000 - RNA, 15 nt, Mycobacterium tuberculosis H37Rv
gcgccaggggugugc

SEQ ID NO: 3259001 - RNA, 18 nt, Mycobacterium tuberculosis H37Rv
gcgccagggucgguugcu

SEQ ID NO: 3259002 - RNA, 13 nt, Mycobacterium tuberculosis H37Rv
gcgccaggucggc

SEQ ID NO: 3259003 - RNA, 18 nt, Mycobacterium tuberculosis H37Rv
gcgccaggucggcggacg

SEQ ID NO: 3259004 - RNA, 17 nt, Mycobacterium tuberculosis H37Rv
gcgccaggucggcgggc

SEQ ID NO: 3259005 - RNA, 20 nt, Mycobacterium tuberculosis H37Rv
gcgccaggucggcgggcgcg

SEQ ID NO: 3259006 - RNA, 13 nt, Mycobacterium tuberculosis H37Rv
gcgccaggucggu

SEQ ID NO: 3259007 - RNA, 22 nt, Mycobacterium tuberculosis H37Rv
gcgccaggucggugacgaagag

SEQ ID NO: 3259008 - RNA, 21 nt, Mycobacterium tuberculosis H37Rv
gcgccaguaacgcccacaaug

SEQ ID NO: 3259009 - RNA, 14 nt, Mycobacterium tuberculosis H37Rv
gcgccaguagcacg

SEQ ID NO: 3259010 - RNA, 19 nt, Mycobacterium tuberculosis H37Rv
gcgccaguauggccgccac

SEQ ID NO: 3259011 - RNA, 13 nt, Mycobacterium tuberculosis H37Rv
gcgccagugccuc

SEQ ID NO: 3259012 - RNA, 12 nt, Mycobacterium tuberculosis H37Rv
gcgccagugcgg

SEQ ID NO: 3259013 - RNA, 13 nt, Mycobacterium tuberculosis H37Rv
gcgccagugcggu

SEQ ID NO: 3259014 - RNA, 18 nt, Mycobacterium tuberculosis H37Rv
gcgccaguguggugcggc

SEQ ID NO: 3259015 - RNA, 20 nt, Mycobacterium tuberculosis H37Rv
gcgccaguguggugcggcgc

SEQ ID NO: 3259016 - RNA, 19 nt, Mycobacterium tuberculosis H37Rv
gcgccaguucgcggcugcg

SEQ ID NO: 3259017 - RNA, 21 nt, Mycobacterium tuberculosis H37Rv
gcgccaguucggcgggcgcgg

SEQ ID NO: 3259018 - RNA, 23 nt, Mycobacterium tuberculosis H37Rv
gcgccauaauauugccgccuccg

SEQ ID NO: 3259019 - RNA, 22 nt, Mycobacterium tuberculosis H37Rv
gcgccaucacaucggccucuga

SEQ ID NO: 3259020 - RNA, 18 nt, Mycobacterium tuberculosis H37Rv
gcgccaucgaugcgguga

SEQ ID NO: 3259021 - RNA, 15 nt, Mycobacterium tuberculosis H37Rv
gcgccaucgccucca

SEQ ID NO: 3259022 - RNA, 21 nt, Mycobacterium tuberculosis H37Rv
gcgccaucgggucacccccgg

SEQ ID NO: 3259023 - RNA, 20 nt, Mycobacterium tuberculosis H37Rv
gcgccaucgucgcgccgcgu

SEQ ID NO: 3259024 - RNA, 13 nt, Mycobacterium tuberculosis H37Rv
gcgccaucucgac

SEQ ID NO: 3259025 - RNA, 15 nt, Mycobacterium tuberculosis H37Rv
gcgccaucucgacgg

SEQ ID NO: 3259026 - RNA, 22 nt, Mycobacterium tuberculosis H37Rv
gcgccaugcugucguagcgcga

SEQ ID NO: 3259027 - RNA, 20 nt, Mycobacterium tuberculosis H37Rv
gcgccauuccaagacguugc

SEQ ID NO: 3259028 - RNA, 17 nt, Mycobacterium tuberculosis H37Rv
gcgccauucgccccacc

SEQ ID NO: 3259029 - RNA, 21 nt, Mycobacterium tuberculosis H37Rv
gcgccauucgcccggccgcag

SEQ ID NO: 3259030 - RNA, 18 nt, Mycobacterium tuberculosis H37Rv
gcgccauuggcgucccgc

SEQ ID NO: 3259031 - RNA, 12 nt, Mycobacterium tuberculosis H37Rv
gcgccauuucga

SEQ ID NO: 3259032 - RNA, 16 nt, Mycobacterium tuberculosis H37Rv
gcgccauuugggccca

SEQ ID NO: 3259033 - RNA, 15 nt, Mycobacterium tuberculosis H37Rv
gcgcccaauccaccg

SEQ ID NO: 3259034 - RNA, 23 nt, Mycobacterium tuberculosis H37Rv
gcgcccaauccaccgauucggcg

SEQ ID NO: 3259035 - RNA, 23 nt, Mycobacterium tuberculosis H37Rv
gcgccgcaaugacgucgucggcc

SEQ ID NO: 3259036 - RNA, 12 nt, Mycobacterium tuberculosis H37Rv
gcgccgcacggc

SEQ ID NO: 3259037 - RNA, 14 nt, Mycobacterium tuberculosis H37Rv
gcgccgcacggcga

SEQ ID NO: 3259038 - RNA, 16 nt, Mycobacterium tuberculosis H37Rv
gcgccgcacggcgacg

SEQ ID NO: 3259039 - RNA, 17 nt, Mycobacterium tuberculosis H37Rv
gcgccgcacggcgacgc

SEQ ID NO: 3259040 - RNA, 17 nt, Mycobacterium tuberculosis H37Rv
gcgccgcagaucaccgc

SEQ ID NO: 3259041 - RNA, 21 nt, Mycobacterium tuberculosis H37Rv
gcgccgcagaucaccgccagc

SEQ ID NO: 3259042 - RNA, 19 nt, Mycobacterium tuberculosis H37Rv
gcgccgcagcaggugcauc

SEQ ID NO: 3259043 - RNA, 22 nt, Mycobacterium tuberculosis H37Rv
gcgccgcagcgauauccacaau

SEQ ID NO: 3259044 - RNA, 14 nt, Mycobacterium tuberculosis H37Rv
gcgccgcagggccg

SEQ ID NO: 3259045 - RNA, 15 nt, Mycobacterium tuberculosis H37Rv
gcgccgcagggccgc

SEQ ID NO: 3259046 - RNA, 14 nt, Mycobacterium tuberculosis H37Rv
gcgccgcauaccag

SEQ ID NO: 3259047 - RNA, 17 nt, Mycobacterium tuberculosis H37Rv
gcgccgcauaccaguac

SEQ ID NO: 3259048 - RNA, 15 nt, Mycobacterium tuberculosis H37Rv
gcgccgcauccagcc

SEQ ID NO: 3259049 - RNA, 14 nt, Mycobacterium tuberculosis H37Rv
gcgccgcaucggcg

SEQ ID NO: 3259050 - RNA, 16 nt, Mycobacterium tuberculosis H37Rv
gcgccgcaucggcgaa

SEQ ID NO: 3259051 - RNA, 22 nt, Mycobacterium tuberculosis H37Rv
gcgccgccaacuccucagccgc

SEQ ID NO: 3259052 - RNA, 12 nt, Mycobacterium tuberculosis H37Rv
gcgccgccacag

SEQ ID NO: 3259053 - RNA, 14 nt, Mycobacterium tuberculosis H37Rv
gcgccgccacagca

SEQ ID NO: 3259054 - RNA, 15 nt, Mycobacterium tuberculosis H37Rv
gcgccgccacagcac

SEQ ID NO: 3259055 - RNA, 19 nt, Mycobacterium tuberculosis H37Rv
gcgccgccacagcacccac

SEQ ID NO: 3259056 - RNA, 21 nt, Mycobacterium tuberculosis H37Rv
gcgccgccaccgaagccgccg

SEQ ID NO: 3259057 - RNA, 23 nt, Mycobacterium tuberculosis H37Rv
gcgccgccacggaucgcggcggc

SEQ ID NO: 3259058 - RNA, 23 nt, Mycobacterium tuberculosis H37Rv
gcgccgccacgguacauccagag

SEQ ID NO: 3259059 - RNA, 17 nt, Mycobacterium tuberculosis H37Rv
gcgccgccacugccggc

SEQ ID NO: 3259060 - RNA, 20 nt, Mycobacterium tuberculosis H37Rv
gcgccgccacugccggcagc

SEQ ID NO: 3259061 - RNA, 12 nt, Mycobacterium tuberculosis H37Rv
gcgccgccagcg

SEQ ID NO: 3259062 - RNA, 13 nt, Mycobacterium tuberculosis H37Rv
gcgccgccagcgc

SEQ ID NO: 3259063 - RNA, 14 nt, Mycobacterium tuberculosis H37Rv
gcgccgccagcgcc

SEQ ID NO: 3259064 - RNA, 21 nt, Mycobacterium tuberculosis H37Rv
gcgccgccagguguucgccgg

SEQ ID NO: 3259065 - RNA, 16 nt, Mycobacterium tuberculosis H37Rv
gcgccgccaucacgca

SEQ ID NO: 3259066 - RNA, 18 nt, Mycobacterium tuberculosis H37Rv
gcgccgccauugucgcca

SEQ ID NO: 3259067 - RNA, 15 nt, Mycobacterium tuberculosis H37Rv
gcgccgcccaacgcg

SEQ ID NO: 3259068 - RNA, 15 nt, Mycobacterium tuberculosis H37Rv
gcgccgcccagcauc

SEQ ID NO: 3259069 - RNA, 16 nt, Mycobacterium tuberculosis H37Rv
gcgccgccccgcucgg

SEQ ID NO: 3259070 - RNA, 17 nt, Mycobacterium tuberculosis H37Rv
gcgccgcccgcgccacc

SEQ ID NO: 3259071 - RNA, 20 nt, Mycobacterium tuberculosis H37Rv
gcgccgcccgcgccaccagc

SEQ ID NO: 3259072 - RNA, 20 nt, Mycobacterium tuberculosis H37Rv
gcgccgcccuugccgccggc

SEQ ID NO: 3259073 - RNA, 12 nt, Mycobacterium tuberculosis H37Rv
gcgccgccgacc

SEQ ID NO: 3259074 - RNA, 13 nt, Mycobacterium tuberculosis H37Rv
gcgccgccgaucc

SEQ ID NO: 3259075 - RNA, 14 nt, Mycobacterium tuberculosis H37Rv
gcgccgccgccacc

SEQ ID NO: 3259076 - RNA, 17 nt, Mycobacterium tuberculosis H37Rv
gcgccgccgcgagcgcc

SEQ ID NO: 3259077 - RNA, 20 nt, Mycobacterium tuberculosis H37Rv
gcgccgccgcgagcgccggc

SEQ ID NO: 3259078 - RNA, 22 nt, Mycobacterium tuberculosis H37Rv
gcgccgccgcgagcgccggccg

SEQ ID NO: 3259079 - RNA, 14 nt, Mycobacterium tuberculosis H37Rv
gcgccgccggaagc

SEQ ID NO: 3259080 - RNA, 20 nt, Mycobacterium tuberculosis H37Rv
gcgccgccggaagcgccggc

SEQ ID NO: 3259081 - RNA, 22 nt, Mycobacterium tuberculosis H37Rv
gcgccgccggaagcgccggccg

SEQ ID NO: 3259082 - RNA, 18 nt, Mycobacterium tuberculosis H37Rv
gcgccgccggcaccaccg

SEQ ID NO: 3259083 - RNA, 17 nt, Mycobacterium tuberculosis H37Rv
gcgccgccggcaccgcc

SEQ ID NO: 3259084 - RNA, 19 nt, Mycobacterium tuberculosis H37Rv
gcgccgccggcaccgccgg

SEQ ID NO: 3259085 - RNA, 21 nt, Mycobacterium tuberculosis H37Rv
gcgccgccggcaccgccggca

SEQ ID NO: 3259086 - RNA, 17 nt, Mycobacterium tuberculosis H37Rv
gcgccgccggcaccucc

SEQ ID NO: 3259087 - RNA, 20 nt, Mycobacterium tuberculosis H37Rv
gcgccgccggcgccgcccgc

SEQ ID NO: 3259088 - RNA, 14 nt, Mycobacterium tuberculosis H37Rv
gcgccgccggcgcg

SEQ ID NO: 3259089 - RNA, 15 nt, Mycobacterium tuberculosis H37Rv
gcgccgccggcggcg

SEQ ID NO: 3259090 - RNA, 17 nt, Mycobacterium tuberculosis H37Rv
gcgccgccggcggcggu

SEQ ID NO: 3259091 - RNA, 18 nt, Mycobacterium tuberculosis H37Rv
gcgccgccguccagcgcc

SEQ ID NO: 3259092 - RNA, 14 nt, Mycobacterium tuberculosis H37Rv
gcgccgccgucgcc

SEQ ID NO: 3259093 - RNA, 16 nt, Mycobacterium tuberculosis H37Rv
gcgccgccgucgccgu

SEQ ID NO: 3259094 - RNA, 21 nt, Mycobacterium tuberculosis H37Rv
gcgccgccguuaccgccggcg

SEQ ID NO: 3259095 - RNA, 12 nt, Mycobacterium tuberculosis H37Rv
gcgccgccguug

SEQ ID NO: 3259096 - RNA, 16 nt, Mycobacterium tuberculosis H37Rv
gcgccgccguugccga

SEQ ID NO: 3259097 - RNA, 19 nt, Mycobacterium tuberculosis H37Rv
gcgccgccucgggcaccug

SEQ ID NO: 3259098 - RNA, 22 nt, Mycobacterium tuberculosis H37Rv
gcgccgcgacaaaucggucgac

SEQ ID NO: 3259099 - RNA, 16 nt, Mycobacterium tuberculosis H37Rv
gcgccgcgaggcaccg

SEQ ID NO: 3259100 - RNA, 17 nt, Mycobacterium tuberculosis H37Rv
gcgccgcgcagcgagga

SEQ ID NO: 3259101 - RNA, 17 nt, Mycobacterium tuberculosis H37Rv
gcgccgcgccgcgccgc

SEQ ID NO: 3259102 - RNA, 15 nt, Mycobacterium tuberculosis H37Rv
gcgccgcgccguccc

SEQ ID NO: 3259103 - RNA, 15 nt, Mycobacterium tuberculosis H37Rv
gcgccgcgcggcuug

SEQ ID NO: 3259104 - RNA, 14 nt, Mycobacterium tuberculosis H37Rv
gcgccgcgcgggug

SEQ ID NO: 3259105 - RNA, 17 nt, Mycobacterium tuberculosis H37Rv
gcgccgcgcucgccgau

SEQ ID NO: 3259106 - RNA, 16 nt, Mycobacterium tuberculosis H37Rv
gcgccgcgcuugcgau

SEQ ID NO: 3259107 - RNA, 18 nt, Mycobacterium tuberculosis H37Rv
gcgccgcggcccgcucca

SEQ ID NO: 3259108 - RNA, 13 nt, Mycobacterium tuberculosis H37Rv
gcgccgcggcgac

SEQ ID NO: 3259109 - RNA, 14 nt, Mycobacterium tuberculosis H37Rv
gcgccgcggcgacg

SEQ ID NO: 3259110 - RNA, 13 nt, Mycobacterium tuberculosis H37Rv
gcgccgcggcgga

SEQ ID NO: 3259111 - RNA, 12 nt, Mycobacterium tuberculosis H37Rv
gcgccgcggcua

SEQ ID NO: 3259112 - RNA, 20 nt, Mycobacterium tuberculosis H37Rv
gcgccgcggcuacaucggcg

SEQ ID NO: 3259113 - RNA, 14 nt, Mycobacterium tuberculosis H37Rv
gcgccgcggcuggg

SEQ ID NO: 3259114 - RNA, 19 nt, Mycobacterium tuberculosis H37Rv
gcgccgcguggcuggcggc

SEQ ID NO: 3259115 - RNA, 17 nt, Mycobacterium tuberculosis H37Rv
gcgccgcguugucggcg

SEQ ID NO: 3259116 - RNA, 19 nt, Mycobacterium tuberculosis H37Rv
gcgccgcguugucggcgcu

SEQ ID NO: 3259117 - RNA, 21 nt, Mycobacterium tuberculosis H37Rv
gcgccgcuaggugacgccgcc

SEQ ID NO: 3259118 - RNA, 22 nt, Mycobacterium tuberculosis H37Rv
gcgccgcuaggugacgccgcca

SEQ ID NO: 3259119 - RNA, 18 nt, Mycobacterium tuberculosis H37Rv
gcgccgcugacuccugcg

SEQ ID NO: 3259120 - RNA, 17 nt, Mycobacterium tuberculosis H37Rv
gcgccgcuggucguggc

SEQ ID NO: 3259121 - RNA, 15 nt, Mycobacterium tuberculosis H37Rv
gcgccgcuuggcgau

SEQ ID NO: 3259122 - RNA, 17 nt, Mycobacterium tuberculosis H37Rv
gcgccggaacgagcggc

SEQ ID NO: 3259123 - RNA, 20 nt, Mycobacterium tuberculosis H37Rv
gcgccggaacgagcggccgc

SEQ ID NO: 3259124 - RNA, 19 nt, Mycobacterium tuberculosis H37Rv
gcgccggacaaaccgggcg

SEQ ID NO: 3259125 - RNA, 21 nt, Mycobacterium tuberculosis H37Rv
gcgccggacaaaccgggcggc

SEQ ID NO: 3259126 - RNA, 13 nt, Mycobacterium tuberculosis H37Rv
gcgccggacagcg

SEQ ID NO: 3259127 - RNA, 14 nt, Mycobacterium tuberculosis H37Rv
gcgccggacagcgc

SEQ ID NO: 3259128 - RNA, 15 nt, Mycobacterium tuberculosis H37Rv
gcgccggaccagcuc

SEQ ID NO: 3259129 - RNA, 17 nt, Mycobacterium tuberculosis H37Rv
gcgccggaccagcuccu

SEQ ID NO: 3259130 - RNA, 14 nt, Mycobacterium tuberculosis H37Rv
gcgccggaccgucu

SEQ ID NO: 3259131 - RNA, 17 nt, Mycobacterium tuberculosis H37Rv
gcgccggaccgucuuug

SEQ ID NO: 3259132 - RNA, 14 nt, Mycobacterium tuberculosis H37Rv
gcgccucgccggcc

SEQ ID NO: 3259133 - RNA, 19 nt, Mycobacterium tuberculosis H37Rv
gcgccucgccggccacccg

SEQ ID NO: 3259134 - RNA, 13 nt, Mycobacterium tuberculosis H37Rv
gcgccucggugac

SEQ ID NO: 3259135 - RNA, 19 nt, Mycobacterium tuberculosis H37Rv
gcgccugaauaggucgguc

SEQ ID NO: 3259136 - RNA, 19 nt, Mycobacterium tuberculosis H37Rv
gcgccugacucaucaccga

SEQ ID NO: 3259137 - RNA, 20 nt, Mycobacterium tuberculosis H37Rv
gcgccugaugcggccggcgc

SEQ ID NO: 3259138 - RNA, 12 nt, Mycobacterium tuberculosis H37Rv
gcgccugcugcg

SEQ ID NO: 3259139 - RNA, 17 nt, Mycobacterium tuberculosis H37Rv
gcgccugcugcggccag

SEQ ID NO: 3259140 - RNA, 20 nt, Mycobacterium tuberculosis H37Rv
gcgccuggcggcgccgcaga

SEQ ID NO: 3259141 - RNA, 20 nt, Mycobacterium tuberculosis H37Rv
gcgccuggcuggccagcugc

SEQ ID NO: 3259142 - RNA, 21 nt, Mycobacterium tuberculosis H37Rv
gcgccuggcuggccagcugcg

SEQ ID NO: 3259143 - RNA, 17 nt, Mycobacterium tuberculosis H37Rv
gcgccugugcgcaaggc

SEQ ID NO: 3259144 - RNA, 18 nt, Mycobacterium tuberculosis H37Rv
gcgccuucaccuggugug

SEQ ID NO: 3259145 - RNA, 20 nt, Mycobacterium tuberculosis H37Rv
gcgccuuccaggcgggcggc

SEQ ID NO: 3259146 - RNA, 14 nt, Mycobacterium tuberculosis H37Rv
gcgccuucgccagc

SEQ ID NO: 3259147 - RNA, 17 nt, Mycobacterium tuberculosis H37Rv
gcgccuucgccagcggc

SEQ ID NO: 3259148 - RNA, 13 nt, Mycobacterium tuberculosis H37Rv
gcgccuugaccac

SEQ ID NO: 3259149 - RNA, 17 nt, Mycobacterium tuberculosis H37Rv
gcgccuugaccagcagc

SEQ ID NO: 3259150 - RNA, 12 nt, Mycobacterium tuberculosis H37Rv
gcgccuugacgc

SEQ ID NO: 3259151 - RNA, 18 nt, Mycobacterium tuberculosis H37Rv
gcgccuugcgggccuggu

SEQ ID NO: 3259152 - RNA, 17 nt, Mycobacterium tuberculosis H37Rv
gcgccuuggcacccucc

SEQ ID NO: 3259153 - RNA, 15 nt, Mycobacterium tuberculosis H37Rv
gcgccuuggccagcg

SEQ ID NO: 3259154 - RNA, 22 nt, Mycobacterium tuberculosis H37Rv
gcgccuuggccagcgcguuguc

SEQ ID NO: 3259155 - RNA, 22 nt, Mycobacterium tuberculosis H37Rv
gcgccuuggucgccgcuuucuu

SEQ ID NO: 3259156 - RNA, 16 nt, Mycobacterium tuberculosis H37Rv
gcgccuuggucgccgg

SEQ ID NO: 3259157 - RNA, 17 nt, Mycobacterium tuberculosis H37Rv
gcgccuuggucgccggc

SEQ ID NO: 3259158 - RNA, 22 nt, Mycobacterium tuberculosis H37Rv
gcgccuuugagcccgcgaucac

SEQ ID NO: 3259159 - RNA, 18 nt, Mycobacterium tuberculosis H37Rv
gcgccuuugccccgugga

SEQ ID NO: 3259160 - RNA, 21 nt, Mycobacterium tuberculosis H37Rv
gcgcgaaaccaguccaucgac

SEQ ID NO: 3259161 - RNA, 17 nt, Mycobacterium tuberculosis H37Rv
gcgcgaaccccagccga

SEQ ID NO: 3259162 - RNA, 19 nt, Mycobacterium tuberculosis H37Rv
gcgcgaaccgcuccgagca

SEQ ID NO: 3259163 - RNA, 20 nt, Mycobacterium tuberculosis H37Rv
gcgcgaaccggcccggucca

SEQ ID NO: 3259164 - RNA, 15 nt, Mycobacterium tuberculosis H37Rv
gcgcgaacgccugcu

SEQ ID NO: 3259165 - RNA, 16 nt, Mycobacterium tuberculosis H37Rv
gcgcgaacgucaaccg

SEQ ID NO: 3259166 - RNA, 20 nt, Mycobacterium tuberculosis H37Rv
gcgcgaagccaccaggucga

SEQ ID NO: 3259167 - RNA, 14 nt, Mycobacterium tuberculosis H37Rv
gcgcgaaggggacg

SEQ ID NO: 3259168 - RNA, 18 nt, Mycobacterium tuberculosis H37Rv
gcgcgaagucuugaccgc

SEQ ID NO: 3259169 - RNA, 23 nt, Mycobacterium tuberculosis H37Rv
gcgcgaagucuugaccgcaccgg

SEQ ID NO: 3259170 - RNA, 24 nt, Mycobacterium tuberculosis H37Rv
gcgcgaagucuugaccgcaccggc

SEQ ID NO: 3259171 - RNA, 19 nt, Mycobacterium tuberculosis H37Rv
gcgcgaaguuugcgacgac

SEQ ID NO: 3259172 - RNA, 21 nt, Mycobacterium tuberculosis H37Rv
gcgcgaaguuugcgacgacgc

SEQ ID NO: 3259173 - RNA, 20 nt, Mycobacterium tuberculosis H37Rv
gcgcgacaacccggcgucga

SEQ ID NO: 3259174 - RNA, 21 nt, Mycobacterium tuberculosis H37Rv
gcgcgacaacccggcgucgac

SEQ ID NO: 3259175 - RNA, 16 nt, Mycobacterium tuberculosis H37Rv
gcgcgacaggcccugg

SEQ ID NO: 3259176 - RNA, 18 nt, Mycobacterium tuberculosis H37Rv
gcgcgaccaaugcguuga

SEQ ID NO: 3259177 - RNA, 16 nt, Mycobacterium tuberculosis H37Rv
gcgcgaccacccgccg

SEQ ID NO: 3259178 - RNA, 12 nt, Mycobacterium tuberculosis H37Rv
gcgcgaccauga

SEQ ID NO: 3259179 - RNA, 15 nt, Mycobacterium tuberculosis H37Rv
gcgcgaccgaccagc

SEQ ID NO: 3259180 - RNA, 16 nt, Mycobacterium tuberculosis H37Rv
gcgcgaccgaccagcc

SEQ ID NO: 3259181 - RNA, 22 nt, Mycobacterium tuberculosis H37Rv
gcgcgaccuccgcgaucaccga

SEQ ID NO: 3259182 - RNA, 17 nt, Mycobacterium tuberculosis H37Rv
gcgcgaccucgcuggcc

SEQ ID NO: 3259183 - RNA, 18 nt, Mycobacterium tuberculosis H37Rv
gcgcgaccucgcuggccg

SEQ ID NO: 3259184 - RNA, 14 nt, Mycobacterium tuberculosis H37Rv
gcgcgacgagcaug

SEQ ID NO: 3259185 - RNA, 22 nt, Mycobacterium tuberculosis H37Rv
gcgcgacggucccuucgucacc

SEQ ID NO: 3259186 - RNA, 18 nt, Mycobacterium tuberculosis H37Rv
gcgcgacguccaccagcc

SEQ ID NO: 3259187 - RNA, 15 nt, Mycobacterium tuberculosis H37Rv
gcgcgagaacacccg

SEQ ID NO: 3259188 - RNA, 11 nt, Mycobacterium tuberculosis H37Rv
gcgcgagauca

SEQ ID NO: 3259189 - RNA, 17 nt, Mycobacterium tuberculosis H37Rv
gcgcgagaucagccggc

SEQ ID NO: 3259190 - RNA, 17 nt, Mycobacterium tuberculosis H37Rv
gcgcgagcagacacaga

SEQ ID NO: 3259191 - RNA, 17 nt, Mycobacterium tuberculosis H37Rv
gcgcgagcagacgcaga

SEQ ID NO: 3259192 - RNA, 15 nt, Mycobacterium tuberculosis H37Rv
gcgcgagcagcuaca

SEQ ID NO: 3259193 - RNA, 13 nt, Mycobacterium tuberculosis H37Rv
gcgcgagccgcuc

SEQ ID NO: 3259194 - RNA, 20 nt, Mycobacterium tuberculosis H37Rv
gcgcgaggaacgccggggcg

SEQ ID NO: 3259195 - RNA, 18 nt, Mycobacterium tuberculosis H37Rv
gcgcgaggggccggcuca

SEQ ID NO: 3259196 - RNA, 14 nt, Mycobacterium tuberculosis H37Rv
gcgcgaggucggcg

SEQ ID NO: 3259197 - RNA, 21 nt, Mycobacterium tuberculosis H37Rv
gcgcgauagauacccgcggca

SEQ ID NO: 3259198 - RNA, 18 nt, Mycobacterium tuberculosis H37Rv
gcgcgauaggugcucgcg

SEQ ID NO: 3259199 - RNA, 13 nt, Mycobacterium tuberculosis H37Rv
gcgcgaucaacgc

SEQ ID NO: 3259200 - RNA, 13 nt, Mycobacterium tuberculosis H37Rv
gcgcgaucaccga

SEQ ID NO: 3259201 - RNA, 23 nt, Mycobacterium tuberculosis H37Rv
gcgcgaucccaacgcccgggcga

SEQ ID NO: 3259202 - RNA, 11 nt, Mycobacterium tuberculosis H37Rv
gcgcgaucgac

SEQ ID NO: 3259203 - RNA, 18 nt, Mycobacterium tuberculosis H37Rv
gcgcgaucgacgcucggc

SEQ ID NO: 3259204 - RNA, 19 nt, Mycobacterium tuberculosis H37Rv
gcgcgaucgacgcucggcu

SEQ ID NO: 3259205 - RNA, 11 nt, Mycobacterium tuberculosis H37Rv
gcgcgaucgau

SEQ ID NO: 3259206 - RNA, 16 nt, Mycobacterium tuberculosis H37Rv
gcgcgaucgcggucaa

SEQ ID NO: 3259207 - RNA, 19 nt, Mycobacterium tuberculosis H37Rv
gcgcgaucgggccggcgcg

SEQ ID NO: 3259208 - RNA, 21 nt, Mycobacterium tuberculosis H37Rv
gcgcgaucgggccggcgcggu

SEQ ID NO: 3259209 - RNA, 14 nt, Mycobacterium tuberculosis H37Rv
gcgcgaucggugcc

SEQ ID NO: 3259210 - RNA, 17 nt, Mycobacterium tuberculosis H37Rv
gcgcgaucugcucgccc

SEQ ID NO: 3259211 - RNA, 21 nt, Mycobacterium tuberculosis H37Rv
gcgcgaucugcucgccccaug

SEQ ID NO: 3259212 - RNA, 18 nt, Mycobacterium tuberculosis H37Rv
gcgcgaugaccucggcga

SEQ ID NO: 3259213 - RNA, 12 nt, Mycobacterium tuberculosis H37Rv
gcgcgaugccca

SEQ ID NO: 3259214 - RNA, 16 nt, Mycobacterium tuberculosis H37Rv
gcgcgaugcuggcgaa

SEQ ID NO: 3259215 - RNA, 16 nt, Mycobacterium tuberculosis H37Rv
gcgcgauggacccaag

SEQ ID NO: 3259216 - RNA, 18 nt, Mycobacterium tuberculosis H37Rv
gcgcgauggcagcgccga

SEQ ID NO: 3259217 - RNA, 21 nt, Mycobacterium tuberculosis H37Rv
gcgcgaugggagcccggcggc

SEQ ID NO: 3259218 - RNA, 21 nt, Mycobacterium tuberculosis H37Rv
gcgcgcaacacauccaguaac

SEQ ID NO: 3259219 - RNA, 22 nt, Mycobacterium tuberculosis H37Rv
gcgcgcaacguagccagcagcg

SEQ ID NO: 3259220 - RNA, 22 nt, Mycobacterium tuberculosis H37Rv
gcgcgcaagugcuggccgaaga

SEQ ID NO: 3259221 - RNA, 15 nt, Mycobacterium tuberculosis H37Rv
gcgcgcacacggcua

SEQ ID NO: 3259222 - RNA, 13 nt, Mycobacterium tuberculosis H37Rv
gcgcgcaccaccg

SEQ ID NO: 3259223 - RNA, 18 nt, Mycobacterium tuberculosis H37Rv
gcgcgcaccaccgcggcg

SEQ ID NO: 3259224 - RNA, 19 nt, Mycobacterium tuberculosis H37Rv
gcgcgcaccaccgcggcgg

SEQ ID NO: 3259225 - RNA, 22 nt, Mycobacterium tuberculosis H37Rv
gcgcgcaccggguugagccgcc

SEQ ID NO: 3259226 - RNA, 18 nt, Mycobacterium tuberculosis H37Rv
gcgcgcacgacaggaucg

SEQ ID NO: 3259227 - RNA, 13 nt, Mycobacterium tuberculosis H37Rv
gcgcgcacggcgu

SEQ ID NO: 3259228 - RNA, 21 nt, Mycobacterium tuberculosis H37Rv
gcgcggccacgccgaucaaca

SEQ ID NO: 3259229 - RNA, 18 nt, Mycobacterium tuberculosis H37Rv
gcgcggccagcagcagau

SEQ ID NO: 3259230 - RNA, 13 nt, Mycobacterium tuberculosis H37Rv
gcgcggccagccc

SEQ ID NO: 3259231 - RNA, 22 nt, Mycobacterium tuberculosis H37Rv
gcgcggccagcccacucgucga

SEQ ID NO: 3259232 - RNA, 18 nt, Mycobacterium tuberculosis H37Rv
gcgcggcccgcaucguug

SEQ ID NO: 3259233 - RNA, 22 nt, Mycobacterium tuberculosis H37Rv
gcgcggcccgcaucguugccga

SEQ ID NO: 3259234 - RNA, 13 nt, Mycobacterium tuberculosis H37Rv
gcgcggccgcagc

SEQ ID NO: 3259235 - RNA, 11 nt, Mycobacterium tuberculosis H37Rv
gcgcggccgcc

SEQ ID NO: 3259236 - RNA, 14 nt, Mycobacterium tuberculosis H37Rv
gcgcggccggcacg

SEQ ID NO: 3259237 - RNA, 19 nt, Mycobacterium tuberculosis H37Rv
gcgcggccggccgcucacc

SEQ ID NO: 3259238 - RNA, 13 nt, Mycobacterium tuberculosis H37Rv
gcgcggccgggcg

SEQ ID NO: 3259239 - RNA, 18 nt, Mycobacterium tuberculosis H37Rv
gcgcggccugcaccagcg

SEQ ID NO: 3259240 - RNA, 17 nt, Mycobacterium tuberculosis H37Rv
gcgcggccuuggugggc

SEQ ID NO: 3259241 - RNA, 19 nt, Mycobacterium tuberculosis H37Rv
gcgcggccuuggugggcag

SEQ ID NO: 3259242 - RNA, 18 nt, Mycobacterium tuberculosis H37Rv
gcgcggcgaagccgggug

SEQ ID NO: 3259243 - RNA, 14 nt, Mycobacterium tuberculosis H37Rv
gcgcggcgaccugu

SEQ ID NO: 3259244 - RNA, 20 nt, Mycobacterium tuberculosis H37Rv
gcgcggcgacgacggccugc

SEQ ID NO: 3259245 - RNA, 14 nt, Mycobacterium tuberculosis H37Rv
gcgcggcgagcacg

SEQ ID NO: 3259246 - RNA, 19 nt, Mycobacterium tuberculosis H37Rv
gcgcggcgagcacgcgggc

SEQ ID NO: 3259247 - RNA, 13 nt, Mycobacterium tuberculosis H37Rv
gcgcggcgagggc

SEQ ID NO: 3259248 - RNA, 21 nt, Mycobacterium tuberculosis H37Rv
gcgcggcgcagcaccgucggc

SEQ ID NO: 3259249 - RNA, 15 nt, Mycobacterium tuberculosis H37Rv
gcgcggcgcauuccg

SEQ ID NO: 3259250 - RNA, 12 nt, Mycobacterium tuberculosis H37Rv
gcgcggcgccag

SEQ ID NO: 3259251 - RNA, 16 nt, Mycobacterium tuberculosis H37Rv
gcgcggcgccgcaaug

SEQ ID NO: 3259252 - RNA, 14 nt, Mycobacterium tuberculosis H37Rv
gcgcggcgcggguc

SEQ ID NO: 3259253 - RNA, 15 nt, Mycobacterium tuberculosis H37Rv
gcgcggcgucuagcc

SEQ ID NO: 3259254 - RNA, 18 nt, Mycobacterium tuberculosis H37Rv
gcgcggcgugcuugagca

SEQ ID NO: 3259255 - RNA, 12 nt, Mycobacterium tuberculosis H37Rv
gcgcggcugccg

SEQ ID NO: 3259256 - RNA, 19 nt, Mycobacterium tuberculosis H37Rv
gcgcggcuuguaccgcaau

SEQ ID NO: 3259257 - RNA, 15 nt, Mycobacterium tuberculosis H37Rv
gcgcgggccaccacg

SEQ ID NO: 3259258 - RNA, 18 nt, Mycobacterium tuberculosis H37Rv
gcgcgggccaccacgcgc

SEQ ID NO: 3259259 - RNA, 21 nt, Mycobacterium tuberculosis H37Rv
gcgcgggcgggguaucaaccg

SEQ ID NO: 3259260 - RNA, 15 nt, Mycobacterium tuberculosis H37Rv
gcgcgggcucggugg

SEQ ID NO: 3259261 - RNA, 17 nt, Mycobacterium tuberculosis H37Rv
gcgcgggcucgguggcg

SEQ ID NO: 3259262 - RNA, 22 nt, Mycobacterium tuberculosis H37Rv
gcgcggggaucacaccccaggc

SEQ ID NO: 3259263 - RNA, 16 nt, Mycobacterium tuberculosis H37Rv
gcgcggggcggcugcg

SEQ ID NO: 3259264 - RNA, 14 nt, Mycobacterium tuberculosis H37Rv
gcgcgggggugggc

SEQ ID NO: 3259265 - RNA, 19 nt, Mycobacterium tuberculosis H37Rv
gcgcggggugcgcgcgacc

SEQ ID NO: 3259266 - RNA, 19 nt, Mycobacterium tuberculosis H37Rv
gcgcgggguggcggcgcug

SEQ ID NO: 3259267 - RNA, 14 nt, Mycobacterium tuberculosis H37Rv
gcgcgggucggcga

SEQ ID NO: 3259268 - RNA, 17 nt, Mycobacterium tuberculosis H37Rv
gcgcgggugaccaggcg

SEQ ID NO: 3259269 - RNA, 19 nt, Mycobacterium tuberculosis H37Rv
gcgcgggugcaaccggauu

SEQ ID NO: 3259270 - RNA, 18 nt, Mycobacterium tuberculosis H37Rv
gcgcggguggcagcggcg

SEQ ID NO: 3259271 - RNA, 18 nt, Mycobacterium tuberculosis H37Rv
gcgcggguggcgccaggu

SEQ ID NO: 3259272 - RNA, 23 nt, Mycobacterium tuberculosis H37Rv
gcgcggguggcgccaggucggcg

SEQ ID NO: 3259273 - RNA, 22 nt, Mycobacterium tuberculosis H37Rv
gcgcggguggcgccaguucggc

SEQ ID NO: 3259274 - RNA, 14 nt, Mycobacterium tuberculosis H37Rv
gcgcggguggcucg

SEQ ID NO: 3259275 - RNA, 24 nt, Mycobacterium tuberculosis H37Rv
gcgcgggugguucaccucggcgac

SEQ ID NO: 3259276 - RNA, 22 nt, Mycobacterium tuberculosis H37Rv
gcgcggguuugcgguaguccgc

SEQ ID NO: 3259277 - RNA, 17 nt, Mycobacterium tuberculosis H37Rv
gcgcgguaccgguguca

SEQ ID NO: 3259278 - RNA, 23 nt, Mycobacterium tuberculosis H37Rv
gcgcgguaccggugucaguccga

SEQ ID NO: 3259279 - RNA, 15 nt, Mycobacterium tuberculosis H37Rv
gcgcgguacugcgca

SEQ ID NO: 3259280 - RNA, 16 nt, Mycobacterium tuberculosis H37Rv
gcgcgguacugcgcag

SEQ ID NO: 3259281 - RNA, 18 nt, Mycobacterium tuberculosis H37Rv
gcgcgguacugcgcagcg

SEQ ID NO: 3259282 - RNA, 16 nt, Mycobacterium tuberculosis H37Rv
gcgcgguagcucgucg

SEQ ID NO: 3259283 - RNA, 17 nt, Mycobacterium tuberculosis H37Rv
gcgcgguagcucgucga

SEQ ID NO: 3259284 - RNA, 16 nt, Mycobacterium tuberculosis H37Rv
gcgcgguagucgucgc

SEQ ID NO: 3259285 - RNA, 14 nt, Mycobacterium tuberculosis H37Rv
gcgcggucaccgcg

SEQ ID NO: 3259286 - RNA, 15 nt, Mycobacterium tuberculosis H37Rv
gcgcggucgaccuga

SEQ ID NO: 3259287 - RNA, 12 nt, Mycobacterium tuberculosis H37Rv
gcgcggucgcgc

SEQ ID NO: 3259288 - RNA, 21 nt, Mycobacterium tuberculosis H37Rv
gcgcggucugaccgcgucggc

SEQ ID NO: 3259289 - RNA, 15 nt, Mycobacterium tuberculosis H37Rv
gcgcggugaccgggu

SEQ ID NO: 3259290 - RNA, 19 nt, Mycobacterium tuberculosis H37Rv
gcgcggugcccgcgaacga

SEQ ID NO: 3259291 - RNA, 17 nt, Mycobacterium tuberculosis H37Rv
gcgcggugcccugccgg

SEQ ID NO: 3259292 - RNA, 18 nt, Mycobacterium tuberculosis H37Rv
gcgcggugcccugccggc

SEQ ID NO: 3259293 - RNA, 22 nt, Mycobacterium tuberculosis H37Rv
gcgcggugcccugccggcagcg

SEQ ID NO: 3259294 - RNA, 12 nt, Mycobacterium tuberculosis H37Rv
gcgcggugccgc

SEQ ID NO: 3259295 - RNA, 15 nt, Mycobacterium tuberculosis H37Rv
gcgcggugccggccg

SEQ ID NO: 3259296 - RNA, 17 nt, Mycobacterium tuberculosis H37Rv
gcgcggugccggccguu

SEQ ID NO: 3259297 - RNA, 23 nt, Mycobacterium tuberculosis H37Rv
gcgcggugcggccacucgcccga

SEQ ID NO: 3259298 - RNA, 16 nt, Mycobacterium tuberculosis H37Rv
gcgcgguggggcgcgc

SEQ ID NO: 3259299 - RNA, 17 nt, Mycobacterium tuberculosis H37Rv
gcgcgguggggcgcgcc

SEQ ID NO: 3259300 - RNA, 13 nt, Mycobacterium tuberculosis H37Rv
gcgcgguggucag

SEQ ID NO: 3259301 - RNA, 20 nt, Mycobacterium tuberculosis H37Rv
gcgcgguggucgcgaccgac

SEQ ID NO: 3259302 - RNA, 17 nt, Mycobacterium tuberculosis H37Rv
gcgcgguucgucggcga

SEQ ID NO: 3259303 - RNA, 16 nt, Mycobacterium tuberculosis H37Rv
gcgcgguugggcagau

SEQ ID NO: 3259304 - RNA, 18 nt, Mycobacterium tuberculosis H37Rv
gcgcgguuucggcgauga

SEQ ID NO: 3259305 - RNA, 22 nt, Mycobacterium tuberculosis H37Rv
gcgcgguuucggcgucaccgug

SEQ ID NO: 3259306 - RNA, 19 nt, Mycobacterium tuberculosis H37Rv
gcgcgguuuucggcugccg

SEQ ID NO: 3259307 - RNA, 21 nt, Mycobacterium tuberculosis H37Rv
gcgcguaauccgagcgcggcg

SEQ ID NO: 3259308 - RNA, 14 nt, Mycobacterium tuberculosis H37Rv
gcgcguacccgauc

SEQ ID NO: 3259309 - RNA, 15 nt, Mycobacterium tuberculosis H37Rv
gcgcguacccgauca

SEQ ID NO: 3259310 - RNA, 16 nt, Mycobacterium tuberculosis H37Rv
gcgcguagcgggggag

SEQ ID NO: 3259311 - RNA, 20 nt, Mycobacterium tuberculosis H37Rv
gcgcguaucgcgucugggug

SEQ ID NO: 3259312 - RNA, 16 nt, Mycobacterium tuberculosis H37Rv
gcgcguauggcucacc

SEQ ID NO: 3259313 - RNA, 15 nt, Mycobacterium tuberculosis H37Rv
gcgcgucacauccga

SEQ ID NO: 3259314 - RNA, 21 nt, Mycobacterium tuberculosis H37Rv
gcgcgucacauccgacagcag

SEQ ID NO: 3259315 - RNA, 22 nt, Mycobacterium tuberculosis H37Rv
gcgcgucaggccagcgcucacc

SEQ ID NO: 3259316 - RNA, 19 nt, Mycobacterium tuberculosis H37Rv
gcgcguccccagcgccacc

SEQ ID NO: 3259317 - RNA, 14 nt, Mycobacterium tuberculosis H37Rv
gcgcguccgggcag

SEQ ID NO: 3259318 - RNA, 15 nt, Mycobacterium tuberculosis H37Rv
gcgcguccgucggcg

SEQ ID NO: 3259319 - RNA, 22 nt, Mycobacterium tuberculosis H37Rv
gcgcguccucgccgcacgccgg

SEQ ID NO: 3259320 - RNA, 14 nt, Mycobacterium tuberculosis H37Rv
gcgcgucgagcagc

SEQ ID NO: 3259321 - RNA, 14 nt, Mycobacterium tuberculosis H37Rv
gcgcgucgcccagu

SEQ ID NO: 3259322 - RNA, 19 nt, Mycobacterium tuberculosis H37Rv
gcgcgucgcgcgcggcaug

SEQ ID NO: 3259323 - RNA, 22 nt, Mycobacterium tuberculosis H37Rv
gcgcgucgcgggauugcgcgcu

SEQ ID NO: 3259324 - RNA, 20 nt, Mycobacterium tuberculosis H37Rv
gcgcugcggaucguggcgcc

SEQ ID NO: 3259325 - RNA, 13 nt, Mycobacterium tuberculosis H37Rv
gcgcugcggccag

SEQ ID NO: 3259326 - RNA, 21 nt, Mycobacterium tuberculosis H37Rv
gcgcugcggcccacaccagcg

SEQ ID NO: 3259327 - RNA, 20 nt, Mycobacterium tuberculosis H37Rv
gcgcugcggcgugccgggug

SEQ ID NO: 3259328 - RNA, 12 nt, Mycobacterium tuberculosis H37Rv
gcgcugcucacg

SEQ ID NO: 3259329 - RNA, 19 nt, Mycobacterium tuberculosis H37Rv
gcgcugcucacgcagcagu

SEQ ID NO: 3259330 - RNA, 20 nt, Mycobacterium tuberculosis H37Rv
gcgcugcucacgcagcagug

SEQ ID NO: 3259331 - RNA, 22 nt, Mycobacterium tuberculosis H37Rv
gcgcugcucccgaaaagcgccu

SEQ ID NO: 3259332 - RNA, 23 nt, Mycobacterium tuberculosis H37Rv
gcgcugcugaccugcaugggcag

SEQ ID NO: 3259333 - RNA, 21 nt, Mycobacterium tuberculosis H37Rv
gcgcugcugccgaugugugga

SEQ ID NO: 3259334 - RNA, 13 nt, Mycobacterium tuberculosis H37Rv
gcgcuggacggcg

SEQ ID NO: 3259335 - RNA, 21 nt, Mycobacterium tuberculosis H37Rv
gcgcuggaggacccgcuacga

SEQ ID NO: 3259336 - RNA, 23 nt, Mycobacterium tuberculosis H37Rv
gcgcuggaucgagcuaguucggc

SEQ ID NO: 3259337 - RNA, 21 nt, Mycobacterium tuberculosis H37Rv
gcgcuggcaggcuuagcuucc

SEQ ID NO: 3259338 - RNA, 14 nt, Mycobacterium tuberculosis H37Rv
gcgcuggccagcag

SEQ ID NO: 3259339 - RNA, 15 nt, Mycobacterium tuberculosis H37Rv
gcgcuggccagcagg

SEQ ID NO: 3259340 - RNA, 16 nt, Mycobacterium tuberculosis H37Rv
gcgcuggccauggugg

SEQ ID NO: 3259341 - RNA, 15 nt, Mycobacterium tuberculosis H37Rv
gcgcuggcgccgccg

SEQ ID NO: 3259342 - RNA, 16 nt, Mycobacterium tuberculosis H37Rv
gcgcuggcgccgccgg

SEQ ID NO: 3259343 - RNA, 14 nt, Mycobacterium tuberculosis H37Rv
gcgcuggcgggcgg

SEQ ID NO: 3259344 - RNA, 17 nt, Mycobacterium tuberculosis H37Rv
gcgcuggcgggcggcgu

SEQ ID NO: 3259345 - RNA, 18 nt, Mycobacterium tuberculosis H37Rv
gcgcuggcgggcggcgug

SEQ ID NO: 3259346 - RNA, 15 nt, Mycobacterium tuberculosis H37Rv
gcgcuggcgucgucu

SEQ ID NO: 3259347 - RNA, 21 nt, Mycobacterium tuberculosis H37Rv
gcgcuggcuacccaccggccg

SEQ ID NO: 3259348 - RNA, 22 nt, Mycobacterium tuberculosis H37Rv
gcgcugggauguucgaucagcg

SEQ ID NO: 3259349 - RNA, 22 nt, Mycobacterium tuberculosis H37Rv
gcgcugggcccgagcgcgcgcu

SEQ ID NO: 3259350 - RNA, 14 nt, Mycobacterium tuberculosis H37Rv
gcgcugggcgcgcu

SEQ ID NO: 3259351 - RNA, 23 nt, Mycobacterium tuberculosis H37Rv
gcgcugggcgcgcucaucgaccg

SEQ ID NO: 3259352 - RNA, 20 nt, Mycobacterium tuberculosis H37Rv
gcgcugggucgugucgccac

SEQ ID NO: 3259353 - RNA, 13 nt, Mycobacterium tuberculosis H37Rv
gcgcuggucagcc

SEQ ID NO: 3259354 - RNA, 19 nt, Mycobacterium tuberculosis H37Rv
gcgcuggucagccgugccg

SEQ ID NO: 3259355 - RNA, 21 nt, Mycobacterium tuberculosis H37Rv
gcgcuggucagccgugccgug

SEQ ID NO: 3259356 - RNA, 21 nt, Mycobacterium tuberculosis H37Rv
gcgcuggucgcgguggcggcg

SEQ ID NO: 3259357 - RNA, 15 nt, Mycobacterium tuberculosis H37Rv
gcgcuggugcgcggu

SEQ ID NO: 3259358 - RNA, 22 nt, Mycobacterium tuberculosis H37Rv
gcgcugguugaacauguccagu

SEQ ID NO: 3259359 - RNA, 14 nt, Mycobacterium tuberculosis H37Rv
gcgcuguccacgau

SEQ ID NO: 3259360 - RNA, 21 nt, Mycobacterium tuberculosis H37Rv
gcgcuguccacgaugacgucg

SEQ ID NO: 3259361 - RNA, 15 nt, Mycobacterium tuberculosis H37Rv
gcgcuguucggcacg

SEQ ID NO: 3259362 - RNA, 19 nt, Mycobacterium tuberculosis H37Rv
gcgcuguugccaucgacgc

SEQ ID NO: 3259363 - RNA, 16 nt, Mycobacterium tuberculosis H37Rv
gcgcuguugcuggcgc

SEQ ID NO: 3259364 - RNA, 18 nt, Mycobacterium tuberculosis H37Rv
gcgcuguugcuggcgccc

SEQ ID NO: 3259365 - RNA, 22 nt, Mycobacterium tuberculosis H37Rv
gcgcuguugcuggcgcccccgc

SEQ ID NO: 3259366 - RNA, 14 nt, Mycobacterium tuberculosis H37Rv
gcgcuucgccacac

SEQ ID NO: 3259367 - RNA, 12 nt, Mycobacterium tuberculosis H37Rv
gcgcuucggcca

SEQ ID NO: 3259368 - RNA, 16 nt, Mycobacterium tuberculosis H37Rv
gcgcuucggcggucgc

SEQ ID NO: 3259369 - RNA, 21 nt, Mycobacterium tuberculosis H37Rv
gcgcuucgucgccgaacagcg

SEQ ID NO: 3259370 - RNA, 22 nt, Mycobacterium tuberculosis H37Rv
gcgcuugaaacugauccacguc

SEQ ID NO: 3259371 - RNA, 16 nt, Mycobacterium tuberculosis H37Rv
gcgcuugaccccgccg

SEQ ID NO: 3259372 - RNA, 22 nt, Mycobacterium tuberculosis H37Rv
gcgcuugaccccgccgaacggc

SEQ ID NO: 3259373 - RNA, 17 nt, Mycobacterium tuberculosis H37Rv
gcgcuugaugccggcca

SEQ ID NO: 3259374 - RNA, 23 nt, Mycobacterium tuberculosis H37Rv
gcgcuugcgaucgccgcuaacgc

SEQ ID NO: 3259375 - RNA, 15 nt, Mycobacterium tuberculosis H37Rv
gcgcuugcgaucggc

SEQ ID NO: 3259376 - RNA, 23 nt, Mycobacterium tuberculosis H37Rv
gcgcuugcgaucggcacuuagcc

SEQ ID NO: 3259377 - RNA, 20 nt, Mycobacterium tuberculosis H37Rv
gcgcuugcgccgcccaugcc

SEQ ID NO: 3259378 - RNA, 13 nt, Mycobacterium tuberculosis H37Rv
gcgcuugcggccg

SEQ ID NO: 3259379 - RNA, 22 nt, Mycobacterium tuberculosis H37Rv
gcgcuugcugcauguccucccc

SEQ ID NO: 3259380 - RNA, 20 nt, Mycobacterium tuberculosis H37Rv
gcggaaaacccagaucggcg

SEQ ID NO: 3259381 - RNA, 22 nt, Mycobacterium tuberculosis H37Rv
gcggaaaacccagaucggcgac

SEQ ID NO: 3259382 - RNA, 24 nt, Mycobacterium tuberculosis H37Rv
gcggaacaagguauagccggagcg

SEQ ID NO: 3259383 - RNA, 15 nt, Mycobacterium tuberculosis H37Rv
gcggaacaccaccag

SEQ ID NO: 3259384 - RNA, 20 nt, Mycobacterium tuberculosis H37Rv
gcggaacaccagcaggcggc

SEQ ID NO: 3259385 - RNA, 16 nt, Mycobacterium tuberculosis H37Rv
gcggaacaccgacgac

SEQ ID NO: 3259386 - RNA, 12 nt, Mycobacterium tuberculosis H37Rv
gcggaacaccgc

SEQ ID NO: 3259387 - RNA, 17 nt, Mycobacterium tuberculosis H37Rv
gcggaaccguacgccag

SEQ ID NO: 3259388 - RNA, 16 nt, Mycobacterium tuberculosis H37Rv
gcggaaccugcucggc

SEQ ID NO: 3259389 - RNA, 19 nt, Mycobacterium tuberculosis H37Rv
gcggaaccugcucggccgu

SEQ ID NO: 3259390 - RNA, 14 nt, Mycobacterium tuberculosis H37Rv
gcggaacgauggac

SEQ ID NO: 3259391 - RNA, 15 nt, Mycobacterium tuberculosis H37Rv
gcggaacgccgagca

SEQ ID NO: 3259392 - RNA, 17 nt, Mycobacterium tuberculosis H37Rv
gcggaacgcgucgccga

SEQ ID NO: 3259393 - RNA, 18 nt, Mycobacterium tuberculosis H37Rv
gcggaacgcgucgccgac

SEQ ID NO: 3259394 - RNA, 19 nt, Mycobacterium tuberculosis H37Rv
gcggaacgcgucgccgacg

SEQ ID NO: 3259395 - RNA, 14 nt, Mycobacterium tuberculosis H37Rv
gcggaagaagugcu

SEQ ID NO: 3259396 - RNA, 13 nt, Mycobacterium tuberculosis H37Rv
gcggaagaccgga

SEQ ID NO: 3259397 - RNA, 18 nt, Mycobacterium tuberculosis H37Rv
gcggaagcaucggcugcg

SEQ ID NO: 3259398 - RNA, 16 nt, Mycobacterium tuberculosis H37Rv
gcggaagcggcggccc

SEQ ID NO: 3259399 - RNA, 17 nt, Mycobacterium tuberculosis H37Rv
gcggaagcggcggcccu

SEQ ID NO: 3259400 - RNA, 21 nt, Mycobacterium tuberculosis H37Rv
gcggaagcgguugacccacag

SEQ ID NO: 3259401 - RNA, 22 nt, Mycobacterium tuberculosis H37Rv
gcggaagcgguugacccacagc

SEQ ID NO: 3259402 - RNA, 14 nt, Mycobacterium tuberculosis H37Rv
gcggaaggcgucga

SEQ ID NO: 3259403 - RNA, 16 nt, Mycobacterium tuberculosis H37Rv
gcggaaggcgucgaac

SEQ ID NO: 3259404 - RNA, 13 nt, Mycobacterium tuberculosis H37Rv
gcggaaucaccga

SEQ ID NO: 3259405 - RNA, 17 nt, Mycobacterium tuberculosis H37Rv
gcggaaucgcaucggcg

SEQ ID NO: 3259406 - RNA, 20 nt, Mycobacterium tuberculosis H37Rv
gcggaaucgucggcuagcuc

SEQ ID NO: 3259407 - RNA, 16 nt, Mycobacterium tuberculosis H37Rv
gcggaauggaggccgc

SEQ ID NO: 3259408 - RNA, 19 nt, Mycobacterium tuberculosis H37Rv
gcggacaaaagaacgccag

SEQ ID NO: 3259409 - RNA, 23 nt, Mycobacterium tuberculosis H37Rv
gcggacaaaagaacgccaguucg

SEQ ID NO: 3259410 - RNA, 23 nt, Mycobacterium tuberculosis H37Rv
gcggacaccuuucuccacauugg

SEQ ID NO: 3259411 - RNA, 13 nt, Mycobacterium tuberculosis H37Rv
gcggacacugcga

SEQ ID NO: 3259412 - RNA, 18 nt, Mycobacterium tuberculosis H37Rv
gcggacagcaucacgauc

SEQ ID NO: 3259413 - RNA, 16 nt, Mycobacterium tuberculosis H37Rv
gcggacagcccggacg

SEQ ID NO: 3259414 - RNA, 13 nt, Mycobacterium tuberculosis H37Rv
gcggacagcucgc

SEQ ID NO: 3259415 - RNA, 17 nt, Mycobacterium tuberculosis H37Rv
gcggacagcucgcggua

SEQ ID NO: 3259416 - RNA, 13 nt, Mycobacterium tuberculosis H37Rv
gcggacaucaccg

SEQ ID NO: 3259417 - RNA, 20 nt, Mycobacterium tuberculosis H37Rv
gcggacauccgggccgagcg

SEQ ID NO: 3259418 - RNA, 23 nt, Mycobacterium tuberculosis H37Rv
gcggacauccgggccgagcgcac

SEQ ID NO: 3259419 - RNA, 16 nt, Mycobacterium tuberculosis H37Rv
gcggaccaccgcucgc

SEQ ID NO: 3259420 - RNA, 15 nt, Mycobacterium tuberculosis H37Rv
gcggcaaggucaacg

SEQ ID NO: 3259421 - RNA, 22 nt, Mycobacterium tuberculosis H37Rv
gcggcaauggccagcaccacgg

SEQ ID NO: 3259422 - RNA, 21 nt, Mycobacterium tuberculosis H37Rv
gcggcaauucgggcauggucg

SEQ ID NO: 3259423 - RNA, 22 nt, Mycobacterium tuberculosis H37Rv
gcggcaauucgggcauggucgc

SEQ ID NO: 3259424 - RNA, 13 nt, Mycobacterium tuberculosis H37Rv
gcggcacacccau

SEQ ID NO: 3259425 - RNA, 18 nt, Mycobacterium tuberculosis H37Rv
gcggcacacccaucaccg

SEQ ID NO: 3259426 - RNA, 21 nt, Mycobacterium tuberculosis H37Rv
gcggcacacccaucaccgcca

SEQ ID NO: 3259427 - RNA, 22 nt, Mycobacterium tuberculosis H37Rv
gcggcacacccaucaccgccag

SEQ ID NO: 3259428 - RNA, 21 nt, Mycobacterium tuberculosis H37Rv
gcggcacaucaugggcgcugc

SEQ ID NO: 3259429 - RNA, 13 nt, Mycobacterium tuberculosis H37Rv
gcggcaccagcac

SEQ ID NO: 3259430 - RNA, 15 nt, Mycobacterium tuberculosis H37Rv
gcggcaccagcaccg

SEQ ID NO: 3259431 - RNA, 14 nt, Mycobacterium tuberculosis H37Rv
gcggcacccaacca

SEQ ID NO: 3259432 - RNA, 22 nt, Mycobacterium tuberculosis H37Rv
gcggcacccaaccaggccgcga

SEQ ID NO: 3259433 - RNA, 24 nt, Mycobacterium tuberculosis H37Rv
gcggcacccaaccaggccgcgaca

SEQ ID NO: 3259434 - RNA, 18 nt, Mycobacterium tuberculosis H37Rv
gcggcacccagucggcgc

SEQ ID NO: 3259435 - RNA, 16 nt, Mycobacterium tuberculosis H37Rv
gcggcacccggucggc

SEQ ID NO: 3259436 - RNA, 20 nt, Mycobacterium tuberculosis H37Rv
gcggcaccgauggcgcaccg

SEQ ID NO: 3259437 - RNA, 13 nt, Mycobacterium tuberculosis H37Rv
gcggcaccgccga

SEQ ID NO: 3259438 - RNA, 16 nt, Mycobacterium tuberculosis H37Rv
gcggcaccgcgccggc

SEQ ID NO: 3259439 - RNA, 13 nt, Mycobacterium tuberculosis H37Rv
gcggcaccgcuga

SEQ ID NO: 3259440 - RNA, 16 nt, Mycobacterium tuberculosis H37Rv
gcggcacgaucgccaa

SEQ ID NO: 3259441 - RNA, 20 nt, Mycobacterium tuberculosis H37Rv
gcggcacgaucgccaacgac

SEQ ID NO: 3259442 - RNA, 15 nt, Mycobacterium tuberculosis H37Rv
gcggcacgaucggca

SEQ ID NO: 3259443 - RNA, 15 nt, Mycobacterium tuberculosis H37Rv
gcggcacgcccacag

SEQ ID NO: 3259444 - RNA, 16 nt, Mycobacterium tuberculosis H37Rv
gcggcacgcccacagc

SEQ ID NO: 3259445 - RNA, 14 nt, Mycobacterium tuberculosis H37Rv
gcggcacgccggcc

SEQ ID NO: 3259446 - RNA, 15 nt, Mycobacterium tuberculosis H37Rv
gcggcacgcuccagc

SEQ ID NO: 3259447 - RNA, 22 nt, Mycobacterium tuberculosis H37Rv
gcggcacgcugaccggaucuga

SEQ ID NO: 3259448 - RNA, 13 nt, Mycobacterium tuberculosis H37Rv
gcggcacgucggc

SEQ ID NO: 3259449 - RNA, 16 nt, Mycobacterium tuberculosis H37Rv
gcggcacucccugggg

SEQ ID NO: 3259450 - RNA, 23 nt, Mycobacterium tuberculosis H37Rv
gcggcacuuuguagcccgcgauc

SEQ ID NO: 3259451 - RNA, 18 nt, Mycobacterium tuberculosis H37Rv
gcggcagauacucggcga

SEQ ID NO: 3259452 - RNA, 20 nt, Mycobacterium tuberculosis H37Rv
gcggcagauacucggcgacu

SEQ ID NO: 3259453 - RNA, 18 nt, Mycobacterium tuberculosis H37Rv
gcggcagcaacgacgucg

SEQ ID NO: 3259454 - RNA, 14 nt, Mycobacterium tuberculosis H37Rv
gcggcagcacccac

SEQ ID NO: 3259455 - RNA, 20 nt, Mycobacterium tuberculosis H37Rv
gcggcagcacccacaucagc

SEQ ID NO: 3259456 - RNA, 23 nt, Mycobacterium tuberculosis H37Rv
gcggcagcauauccgccggcgac

SEQ ID NO: 3259457 - RNA, 17 nt, Mycobacterium tuberculosis H37Rv
gcggcagccaagcgagc

SEQ ID NO: 3259458 - RNA, 18 nt, Mycobacterium tuberculosis H37Rv
gcggcagccaagcgagcg

SEQ ID NO: 3259459 - RNA, 21 nt, Mycobacterium tuberculosis H37Rv
gcggcagccaagcgagcggcg

SEQ ID NO: 3259460 - RNA, 15 nt, Mycobacterium tuberculosis H37Rv
gcggcagccuggccu

SEQ ID NO: 3259461 - RNA, 23 nt, Mycobacterium tuberculosis H37Rv
gcggcagccuggccucgccauug

SEQ ID NO: 3259462 - RNA, 19 nt, Mycobacterium tuberculosis H37Rv
gcggcagcgaaagcgucga

SEQ ID NO: 3259463 - RNA, 15 nt, Mycobacterium tuberculosis H37Rv
gcggcagcgaucggg

SEQ ID NO: 3259464 - RNA, 14 nt, Mycobacterium tuberculosis H37Rv
gcggcagcgcggcc

SEQ ID NO: 3259465 - RNA, 17 nt, Mycobacterium tuberculosis H37Rv
gcggcagcgcggccaau

SEQ ID NO: 3259466 - RNA, 22 nt, Mycobacterium tuberculosis H37Rv
gcggcagcggaccgcugccugc

SEQ ID NO: 3259467 - RNA, 14 nt, Mycobacterium tuberculosis H37Rv
gcggcagcggcgau

SEQ ID NO: 3259468 - RNA, 15 nt, Mycobacterium tuberculosis H37Rv
gcggcagcggugcug

SEQ ID NO: 3259469 - RNA, 16 nt, Mycobacterium tuberculosis H37Rv
gcggcagcggugcugg

SEQ ID NO: 3259470 - RNA, 21 nt, Mycobacterium tuberculosis H37Rv
gcggcagcguugacggucagc

SEQ ID NO: 3259471 - RNA, 20 nt, Mycobacterium tuberculosis H37Rv
gcggcagcuacuaugccaac

SEQ ID NO: 3259472 - RNA, 22 nt, Mycobacterium tuberculosis H37Rv
gcggcagcuggcgcagccugcc

SEQ ID NO: 3259473 - RNA, 14 nt, Mycobacterium tuberculosis H37Rv
gcggcaggugcggc

SEQ ID NO: 3259474 - RNA, 16 nt, Mycobacterium tuberculosis H37Rv
gcggcaggugcggcgg

SEQ ID NO: 3259475 - RNA, 22 nt, Mycobacterium tuberculosis H37Rv
gcggcaguaccccucgcacaau

SEQ ID NO: 3259476 - RNA, 22 nt, Mycobacterium tuberculosis H37Rv
gcggcagucauuauucgcgcaa

SEQ ID NO: 3259477 - RNA, 16 nt, Mycobacterium tuberculosis H37Rv
gcggcauacauccagg

SEQ ID NO: 3259478 - RNA, 20 nt, Mycobacterium tuberculosis H37Rv
gcggcauagccgaacagcgg

SEQ ID NO: 3259479 - RNA, 20 nt, Mycobacterium tuberculosis H37Rv
gcggcauccugcacgacccg

SEQ ID NO: 3259480 - RNA, 22 nt, Mycobacterium tuberculosis H37Rv
gcggcaucgaauuccagccagc

SEQ ID NO: 3259481 - RNA, 20 nt, Mycobacterium tuberculosis H37Rv
gcggcaucgaggccagcagc

SEQ ID NO: 3259482 - RNA, 17 nt, Mycobacterium tuberculosis H37Rv
gcggcaucgaguucggc

SEQ ID NO: 3259483 - RNA, 15 nt, Mycobacterium tuberculosis H37Rv
gcggcaucgcgggcg

SEQ ID NO: 3259484 - RNA, 16 nt, Mycobacterium tuberculosis H37Rv
gcggcaucgcgggcgg

SEQ ID NO: 3259485 - RNA, 18 nt, Mycobacterium tuberculosis H37Rv
gcggcaucgcgggcggcg

SEQ ID NO: 3259486 - RNA, 14 nt, Mycobacterium tuberculosis H37Rv
gcggcaucggccag

SEQ ID NO: 3259487 - RNA, 22 nt, Mycobacterium tuberculosis H37Rv
gcggcaucggugguaacaccgg

SEQ ID NO: 3259488 - RNA, 20 nt, Mycobacterium tuberculosis H37Rv
gcggcaugauuuuucgcagu

SEQ ID NO: 3259489 - RNA, 22 nt, Mycobacterium tuberculosis H37Rv
gcggcauggcauggcgaacacg

SEQ ID NO: 3259490 - RNA, 21 nt, Mycobacterium tuberculosis H37Rv
gcggcaugggcccugcacagc

SEQ ID NO: 3259491 - RNA, 22 nt, Mycobacterium tuberculosis H37Rv
gcggcaugggucgugcaggcga

SEQ ID NO: 3259492 - RNA, 17 nt, Mycobacterium tuberculosis H37Rv
gcggcaugugacaucgg

SEQ ID NO: 3259493 - RNA, 20 nt, Mycobacterium tuberculosis H37Rv
gcggcauuaccaacgcggug

SEQ ID NO: 3259494 - RNA, 16 nt, Mycobacterium tuberculosis H37Rv
gcggcauucucgagca

SEQ ID NO: 3259495 - RNA, 17 nt, Mycobacterium tuberculosis H37Rv
gcggcauucucgagcac

SEQ ID NO: 3259496 - RNA, 22 nt, Mycobacterium tuberculosis H37Rv
gcggcauucucgagcacccgca

SEQ ID NO: 3259497 - RNA, 14 nt, Mycobacterium tuberculosis H37Rv
gcggcauugccagc

SEQ ID NO: 3259498 - RNA, 15 nt, Mycobacterium tuberculosis H37Rv
gcggcauugccagcc

SEQ ID NO: 3259499 - RNA, 15 nt, Mycobacterium tuberculosis H37Rv
gcggcauuggcggug

SEQ ID NO: 3259500 - RNA, 17 nt, Mycobacterium tuberculosis H37Rv
gcggccaacgacgaccc

SEQ ID NO: 3259501 - RNA, 15 nt, Mycobacterium tuberculosis H37Rv
gcggccaagucacca

SEQ ID NO: 3259502 - RNA, 18 nt, Mycobacterium tuberculosis H37Rv
gcggccaaucagcccgcc

SEQ ID NO: 3259503 - RNA, 21 nt, Mycobacterium tuberculosis H37Rv
gcggccaaucagcccgccgga

SEQ ID NO: 3259504 - RNA, 17 nt, Mycobacterium tuberculosis H37Rv
gcggccaauggccgcgg

SEQ ID NO: 3259505 - RNA, 17 nt, Mycobacterium tuberculosis H37Rv
gcggccacaaacccgau

SEQ ID NO: 3259506 - RNA, 22 nt, Mycobacterium tuberculosis H37Rv
gcggccacaaugcggccguucg

SEQ ID NO: 3259507 - RNA, 19 nt, Mycobacterium tuberculosis H37Rv
gcggccacauaccaccacg

SEQ ID NO: 3259508 - RNA, 16 nt, Mycobacterium tuberculosis H37Rv
gcggccacaucgccag

SEQ ID NO: 3259509 - RNA, 21 nt, Mycobacterium tuberculosis H37Rv
gcggccacaucgccagcagca

SEQ ID NO: 3259510 - RNA, 21 nt, Mycobacterium tuberculosis H37Rv
gcggccaccacaacgccagga

SEQ ID NO: 3259511 - RNA, 13 nt, Mycobacterium tuberculosis H37Rv
gcggccaccaccg

SEQ ID NO: 3259512 - RNA, 15 nt, Mycobacterium tuberculosis H37Rv
gcggccaccaccgcc

SEQ ID NO: 3259513 - RNA, 20 nt, Mycobacterium tuberculosis H37Rv
gcggccaccagaucgcacac

SEQ ID NO: 3259514 - RNA, 16 nt, Mycobacterium tuberculosis H37Rv
gcggccacccgcgacg

SEQ ID NO: 3259515 - RNA, 13 nt, Mycobacterium tuberculosis H37Rv
gcggccgcgguga

SEQ ID NO: 3259516 - RNA, 23 nt, Mycobacterium tuberculosis H37Rv
gcggccgcgucgucgagaaucgg

SEQ ID NO: 3259517 - RNA, 15 nt, Mycobacterium tuberculosis H37Rv
gcggccgcuccaccu

SEQ ID NO: 3259518 - RNA, 18 nt, Mycobacterium tuberculosis H37Rv
gcggccgcugaucaacag

SEQ ID NO: 3259519 - RNA, 13 nt, Mycobacterium tuberculosis H37Rv
gcggccgcugggc

SEQ ID NO: 3259520 - RNA, 15 nt, Mycobacterium tuberculosis H37Rv
gcggccggcaugcug

SEQ ID NO: 3259521 - RNA, 14 nt, Mycobacterium tuberculosis H37Rv
gcggccggccgccc

SEQ ID NO: 3259522 - RNA, 20 nt, Mycobacterium tuberculosis H37Rv
gcggccggccgcccgcucga

SEQ ID NO: 3259523 - RNA, 15 nt, Mycobacterium tuberculosis H37Rv
gcggccggccgcuca

SEQ ID NO: 3259524 - RNA, 14 nt, Mycobacterium tuberculosis H37Rv
gcggccggcgucgg

SEQ ID NO: 3259525 - RNA, 14 nt, Mycobacterium tuberculosis H37Rv
gcggccgggcgccc

SEQ ID NO: 3259526 - RNA, 17 nt, Mycobacterium tuberculosis H37Rv
gcggccgggcggccagg

SEQ ID NO: 3259527 - RNA, 17 nt, Mycobacterium tuberculosis H37Rv
gcggccgggcgggcggc

SEQ ID NO: 3259528 - RNA, 20 nt, Mycobacterium tuberculosis H37Rv
gcggccgguacacguccagu

SEQ ID NO: 3259529 - RNA, 14 nt, Mycobacterium tuberculosis H37Rv
gcggccguaacggc

SEQ ID NO: 3259530 - RNA, 19 nt, Mycobacterium tuberculosis H37Rv
gcggccgucaccggucggc

SEQ ID NO: 3259531 - RNA, 18 nt, Mycobacterium tuberculosis H37Rv
gcggccgucgucggccag

SEQ ID NO: 3259532 - RNA, 22 nt, Mycobacterium tuberculosis H37Rv
gcggccgugaacggcgcgggcc

SEQ ID NO: 3259533 - RNA, 17 nt, Mycobacterium tuberculosis H37Rv
gcggccguggcguggcu

SEQ ID NO: 3259534 - RNA, 15 nt, Mycobacterium tuberculosis H37Rv
gcggccgugucgggc

SEQ ID NO: 3259535 - RNA, 13 nt, Mycobacterium tuberculosis H37Rv
gcggccguucgcc

SEQ ID NO: 3259536 - RNA, 19 nt, Mycobacterium tuberculosis H37Rv
gcggccuaggacgccgccc

SEQ ID NO: 3259537 - RNA, 19 nt, Mycobacterium tuberculosis H37Rv
gcggccuagggcggcggcg

SEQ ID NO: 3259538 - RNA, 20 nt, Mycobacterium tuberculosis H37Rv
gcggccuccaccacgucggg

SEQ ID NO: 3259539 - RNA, 18 nt, Mycobacterium tuberculosis H37Rv
gcggccuccagcacccgg

SEQ ID NO: 3259540 - RNA, 23 nt, Mycobacterium tuberculosis H37Rv
gcggccucccgcaaugcgagcgc

SEQ ID NO: 3259541 - RNA, 22 nt, Mycobacterium tuberculosis H37Rv
gcggccuccgcggacgauuacg

SEQ ID NO: 3259542 - RNA, 14 nt, Mycobacterium tuberculosis H37Rv
gcggccuccgggcc

SEQ ID NO: 3259543 - RNA, 15 nt, Mycobacterium tuberculosis H37Rv
gcggccucgaccucu

SEQ ID NO: 3259544 - RNA, 16 nt, Mycobacterium tuberculosis H37Rv
gcggccucgcugcuca

SEQ ID NO: 3259545 - RNA, 14 nt, Mycobacterium tuberculosis H37Rv
gcggccucgucgag

SEQ ID NO: 3259546 - RNA, 12 nt, Mycobacterium tuberculosis H37Rv
gcggccugaccg

SEQ ID NO: 3259547 - RNA, 15 nt, Mycobacterium tuberculosis H37Rv
gcggccugacgcugc

SEQ ID NO: 3259548 - RNA, 16 nt, Mycobacterium tuberculosis H37Rv
gcggccugagcgucgu

SEQ ID NO: 3259549 - RNA, 13 nt, Mycobacterium tuberculosis H37Rv
gcggccugcucga

SEQ ID NO: 3259550 - RNA, 13 nt, Mycobacterium tuberculosis H37Rv
gcggccugcucgc

SEQ ID NO: 3259551 - RNA, 16 nt, Mycobacterium tuberculosis H37Rv
gcggccugcucgcaga

SEQ ID NO: 3259552 - RNA, 16 nt, Mycobacterium tuberculosis H37Rv
gcggccuggcacccgg

SEQ ID NO: 3259553 - RNA, 16 nt, Mycobacterium tuberculosis H37Rv
gcggccugggccagcc

SEQ ID NO: 3259554 - RNA, 19 nt, Mycobacterium tuberculosis H37Rv
gcggccugggccagccgcu

SEQ ID NO: 3259555 - RNA, 14 nt, Mycobacterium tuberculosis H37Rv
gcggccuggucggc

SEQ ID NO: 3259556 - RNA, 17 nt, Mycobacterium tuberculosis H37Rv
gcggccuggucggccag

SEQ ID NO: 3259557 - RNA, 19 nt, Mycobacterium tuberculosis H37Rv
gcggccuggucggccaggu

SEQ ID NO: 3259558 - RNA, 17 nt, Mycobacterium tuberculosis H37Rv
gcggccuguugacccau

SEQ ID NO: 3259559 - RNA, 17 nt, Mycobacterium tuberculosis H37Rv
gcggccuucggccggcg

SEQ ID NO: 3259560 - RNA, 23 nt, Mycobacterium tuberculosis H37Rv
gcggccuucggccggcguguucu

SEQ ID NO: 3259561 - RNA, 20 nt, Mycobacterium tuberculosis H37Rv
gcggccuucgggugugacgc

SEQ ID NO: 3259562 - RNA, 16 nt, Mycobacterium tuberculosis H37Rv
gcggccuugccgggcc

SEQ ID NO: 3259563 - RNA, 15 nt, Mycobacterium tuberculosis H37Rv
gcggccuugcucagc

SEQ ID NO: 3259564 - RNA, 13 nt, Mycobacterium tuberculosis H37Rv
gcggccuuggcga

SEQ ID NO: 3259565 - RNA, 15 nt, Mycobacterium tuberculosis H37Rv
gcggccuuggcggcc

SEQ ID NO: 3259566 - RNA, 15 nt, Mycobacterium tuberculosis H37Rv
gcggccuuggugggc

SEQ ID NO: 3259567 - RNA, 19 nt, Mycobacterium tuberculosis H37Rv
gcggcgaacagccccaggg

SEQ ID NO: 3259568 - RNA, 20 nt, Mycobacterium tuberculosis H37Rv
gcggcgaacagccccagggu

SEQ ID NO: 3259569 - RNA, 20 nt, Mycobacterium tuberculosis H37Rv
gcggcgaacaucaccgucgc

SEQ ID NO: 3259570 - RNA, 14 nt, Mycobacterium tuberculosis H37Rv
gcggcgaaccagcg

SEQ ID NO: 3259571 - RNA, 15 nt, Mycobacterium tuberculosis H37Rv
gcggcgaaccagcgc

SEQ ID NO: 3259572 - RNA, 19 nt, Mycobacterium tuberculosis H37Rv
gcggcgaaccagcgcgucu

SEQ ID NO: 3259573 - RNA, 12 nt, Mycobacterium tuberculosis H37Rv
gcggcgaacucu

SEQ ID NO: 3259574 - RNA, 21 nt, Mycobacterium tuberculosis H37Rv
gcggcgaacucuacgguggug

SEQ ID NO: 3259575 - RNA, 22 nt, Mycobacterium tuberculosis H37Rv
gcggcgaacucuacgguggugc

SEQ ID NO: 3259576 - RNA, 23 nt, Mycobacterium tuberculosis H37Rv
gcggcgaacucuacgguggugcg

SEQ ID NO: 3259577 - RNA, 17 nt, Mycobacterium tuberculosis H37Rv
gcggcgaagaagccggc

SEQ ID NO: 3259578 - RNA, 18 nt, Mycobacterium tuberculosis H37Rv
gcggcgaagaagccggca

SEQ ID NO: 3259579 - RNA, 19 nt, Mycobacterium tuberculosis H37Rv
gcggcgaagauaucggcac

SEQ ID NO: 3259580 - RNA, 20 nt, Mycobacterium tuberculosis H37Rv
gcggcgaagauaucggcacg

SEQ ID NO: 3259581 - RNA, 17 nt, Mycobacterium tuberculosis H37Rv
gcggcgaagccgggugc

SEQ ID NO: 3259582 - RNA, 15 nt, Mycobacterium tuberculosis H37Rv
gcggcgacacaucgc

SEQ ID NO: 3259583 - RNA, 14 nt, Mycobacterium tuberculosis H37Rv
gcggcgacauccac

SEQ ID NO: 3259584 - RNA, 14 nt, Mycobacterium tuberculosis H37Rv
gcggcgaccagauu

SEQ ID NO: 3259585 - RNA, 14 nt, Mycobacterium tuberculosis H37Rv
gcggcgaccgucga

SEQ ID NO: 3259586 - RNA, 23 nt, Mycobacterium tuberculosis H37Rv
gcggcgaccgucgauuucgacga

SEQ ID NO: 3259587 - RNA, 19 nt, Mycobacterium tuberculosis H37Rv
gcggcgaccucggcggcgg

SEQ ID NO: 3259588 - RNA, 16 nt, Mycobacterium tuberculosis H37Rv
gcggcgacgaccgucg

SEQ ID NO: 3259589 - RNA, 17 nt, Mycobacterium tuberculosis H37Rv
gcggcgacgaccgucgg

SEQ ID NO: 3259590 - RNA, 16 nt, Mycobacterium tuberculosis H37Rv
gcggcgacgacggccu

SEQ ID NO: 3259591 - RNA, 16 nt, Mycobacterium tuberculosis H37Rv
gcggcgacgccgcugg

SEQ ID NO: 3259592 - RNA, 15 nt, Mycobacterium tuberculosis H37Rv
gcggcgagagccucg

SEQ ID NO: 3259593 - RNA, 15 nt, Mycobacterium tuberculosis H37Rv
gcggcgagcagcagg

SEQ ID NO: 3259594 - RNA, 13 nt, Mycobacterium tuberculosis H37Rv
gcggcgagcgcga

SEQ ID NO: 3259595 - RNA, 18 nt, Mycobacterium tuberculosis H37Rv
gcggcgagcuccgaugcc

SEQ ID NO: 3259596 - RNA, 16 nt, Mycobacterium tuberculosis H37Rv
gcggcgagggcgguca

SEQ ID NO: 3259597 - RNA, 20 nt, Mycobacterium tuberculosis H37Rv
gcggcgaguuggccguggcg

SEQ ID NO: 3259598 - RNA, 22 nt, Mycobacterium tuberculosis H37Rv
gcggcgauaccgguugcgguca

SEQ ID NO: 3259599 - RNA, 20 nt, Mycobacterium tuberculosis H37Rv
gcggcgaucaacucgggcag

SEQ ID NO: 3259600 - RNA, 16 nt, Mycobacterium tuberculosis H37Rv
gcggcgaucaggcgga

SEQ ID NO: 3259601 - RNA, 19 nt, Mycobacterium tuberculosis H37Rv
gcggcgaucaggcggacgg

SEQ ID NO: 3259602 - RNA, 18 nt, Mycobacterium tuberculosis H37Rv
gcggcgauccggucgggg

SEQ ID NO: 3259603 - RNA, 15 nt, Mycobacterium tuberculosis H37Rv
gcggcgaucgcuccg

SEQ ID NO: 3259604 - RNA, 15 nt, Mycobacterium tuberculosis H37Rv
gcggcgaucugcgac

SEQ ID NO: 3259605 - RNA, 16 nt, Mycobacterium tuberculosis H37Rv
gcggcgaucuggucga

SEQ ID NO: 3259606 - RNA, 15 nt, Mycobacterium tuberculosis H37Rv
gcggcgaugauggcg

SEQ ID NO: 3259607 - RNA, 21 nt, Mycobacterium tuberculosis H37Rv
gcggcgaugguugaaccaguc

SEQ ID NO: 3259608 - RNA, 23 nt, Mycobacterium tuberculosis H37Rv
gcggcgaugguugaaccagucga

SEQ ID NO: 3259609 - RNA, 15 nt, Mycobacterium tuberculosis H37Rv
gcggcgcacaacccg

SEQ ID NO: 3259610 - RNA, 18 nt, Mycobacterium tuberculosis H37Rv
gcggcgcagcaccgucgg

SEQ ID NO: 3259611 - RNA, 13 nt, Mycobacterium tuberculosis H37Rv
gcggcgcagcgac

SEQ ID NO: 3259612 - RNA, 21 nt, Mycobacterium tuberculosis H37Rv
gcggcguccaucgcgcgccga

SEQ ID NO: 3259613 - RNA, 22 nt, Mycobacterium tuberculosis H37Rv
gcggcgucgaugagguucaucg

SEQ ID NO: 3259614 - RNA, 19 nt, Mycobacterium tuberculosis H37Rv
gcggcgucggugccgcuga

SEQ ID NO: 3259615 - RNA, 17 nt, Mycobacterium tuberculosis H37Rv
gcggcgucgucgucgag

SEQ ID NO: 3259616 - RNA, 21 nt, Mycobacterium tuberculosis H37Rv
gcggcgucgugagaggccaag

SEQ ID NO: 3259617 - RNA, 18 nt, Mycobacterium tuberculosis H37Rv
gcggcgucguggaucuuc

SEQ ID NO: 3259618 - RNA, 17 nt, Mycobacterium tuberculosis H37Rv
gcggcgucuagcccgcc

SEQ ID NO: 3259619 - RNA, 19 nt, Mycobacterium tuberculosis H37Rv
gcggcgucuagcccgccau

SEQ ID NO: 3259620 - RNA, 18 nt, Mycobacterium tuberculosis H37Rv
gcggcgucuucgucggag

SEQ ID NO: 3259621 - RNA, 22 nt, Mycobacterium tuberculosis H37Rv
gcggcgucuucgucggagucuu

SEQ ID NO: 3259622 - RNA, 20 nt, Mycobacterium tuberculosis H37Rv
gcggcgugacgucgucggug

SEQ ID NO: 3259623 - RNA, 16 nt, Mycobacterium tuberculosis H37Rv
gcggcgugcccgucgu

SEQ ID NO: 3259624 - RNA, 14 nt, Mycobacterium tuberculosis H37Rv
gcggcgugcgcggu

SEQ ID NO: 3259625 - RNA, 16 nt, Mycobacterium tuberculosis H37Rv
gcggcgugcgcgguga

SEQ ID NO: 3259626 - RNA, 16 nt, Mycobacterium tuberculosis H37Rv
gcggcgugcuccugcc

SEQ ID NO: 3259627 - RNA, 22 nt, Mycobacterium tuberculosis H37Rv
gcggcgugcuccugcccgaacu

SEQ ID NO: 3259628 - RNA, 16 nt, Mycobacterium tuberculosis H37Rv
gcggcguggcgccggc

SEQ ID NO: 3259629 - RNA, 16 nt, Mycobacterium tuberculosis H37Rv
gcggcguguacgucga

SEQ ID NO: 3259630 - RNA, 17 nt, Mycobacterium tuberculosis H37Rv
gcggcguguacgucgau

SEQ ID NO: 3259631 - RNA, 19 nt, Mycobacterium tuberculosis H37Rv
gcggcguguacgucgauca

SEQ ID NO: 3259632 - RNA, 22 nt, Mycobacterium tuberculosis H37Rv
gcggcgugucguugccagggcg

SEQ ID NO: 3259633 - RNA, 23 nt, Mycobacterium tuberculosis H37Rv
gcggcguuaagguacccggucgg

SEQ ID NO: 3259634 - RNA, 22 nt, Mycobacterium tuberculosis H37Rv
gcggcguuaccaccgucaccgc

SEQ ID NO: 3259635 - RNA, 19 nt, Mycobacterium tuberculosis H37Rv
gcggcguuccaacucgguu

SEQ ID NO: 3259636 - RNA, 23 nt, Mycobacterium tuberculosis H37Rv
gcggcguuccgggccgaucaccc

SEQ ID NO: 3259637 - RNA, 14 nt, Mycobacterium tuberculosis H37Rv
gcggcguucgccgg

SEQ ID NO: 3259638 - RNA, 12 nt, Mycobacterium tuberculosis H37Rv
gcggcguucggc

SEQ ID NO: 3259639 - RNA, 16 nt, Mycobacterium tuberculosis H37Rv
gcggcguugugaccgc

SEQ ID NO: 3259640 - RNA, 19 nt, Mycobacterium tuberculosis H37Rv
gcggcguugugaccgccga

SEQ ID NO: 3259641 - RNA, 18 nt, Mycobacterium tuberculosis H37Rv
gcggcuacaucggcggcg

SEQ ID NO: 3259642 - RNA, 13 nt, Mycobacterium tuberculosis H37Rv
gcggcuaggccag

SEQ ID NO: 3259643 - RNA, 21 nt, Mycobacterium tuberculosis H37Rv
gcggcuaggccagcacggcga

SEQ ID NO: 3259644 - RNA, 22 nt, Mycobacterium tuberculosis H37Rv
gcggcuaggccagcacggcgac

SEQ ID NO: 3259645 - RNA, 19 nt, Mycobacterium tuberculosis H37Rv
gcggcuauggcgccgcggc

SEQ ID NO: 3259646 - RNA, 22 nt, Mycobacterium tuberculosis H37Rv
gcggcucaaccucuggcggcgg

SEQ ID NO: 3259647 - RNA, 15 nt, Mycobacterium tuberculosis H37Rv
gcggcucacgggcga

SEQ ID NO: 3259648 - RNA, 18 nt, Mycobacterium tuberculosis H37Rv
gcggcuccgagggcugcg

SEQ ID NO: 3259649 - RNA, 19 nt, Mycobacterium tuberculosis H37Rv
gcggcuccgaucucuggug

SEQ ID NO: 3259650 - RNA, 22 nt, Mycobacterium tuberculosis H37Rv
gcggcuccgcccggcgugucgc

SEQ ID NO: 3259651 - RNA, 12 nt, Mycobacterium tuberculosis H37Rv
gcggcucgcgcg

SEQ ID NO: 3259652 - RNA, 21 nt, Mycobacterium tuberculosis H37Rv
gcggcucgggugcgcccggcc

SEQ ID NO: 3259653 - RNA, 15 nt, Mycobacterium tuberculosis H37Rv
gcggcugaacggcag

SEQ ID NO: 3259654 - RNA, 13 nt, Mycobacterium tuberculosis H37Rv
gcggcugcaccgg

SEQ ID NO: 3259655 - RNA, 12 nt, Mycobacterium tuberculosis H37Rv
gcggcugcagcc

SEQ ID NO: 3259656 - RNA, 15 nt, Mycobacterium tuberculosis H37Rv
gcggcugccagaaug

SEQ ID NO: 3259657 - RNA, 18 nt, Mycobacterium tuberculosis H37Rv
gcggcugccagaaugggc

SEQ ID NO: 3259658 - RNA, 23 nt, Mycobacterium tuberculosis H37Rv
gcggcugccaucccgaucccggc

SEQ ID NO: 3259659 - RNA, 13 nt, Mycobacterium tuberculosis H37Rv
gcggcugccgguu

SEQ ID NO: 3259660 - RNA, 21 nt, Mycobacterium tuberculosis H37Rv
gcggcugcgggcccggcggcc

SEQ ID NO: 3259661 - RNA, 22 nt, Mycobacterium tuberculosis H37Rv
gcggcugcgggcccggcggcca

SEQ ID NO: 3259662 - RNA, 18 nt, Mycobacterium tuberculosis H37Rv
gcggcugcugcgcggugc

SEQ ID NO: 3259663 - RNA, 15 nt, Mycobacterium tuberculosis H37Rv
gcggcugcuuggucg

SEQ ID NO: 3259664 - RNA, 16 nt, Mycobacterium tuberculosis H37Rv
gcggcugggcggucgg

SEQ ID NO: 3259665 - RNA, 22 nt, Mycobacterium tuberculosis H37Rv
gcggcuggggccccgcgccggc

SEQ ID NO: 3259666 - RNA, 16 nt, Mycobacterium tuberculosis H37Rv
gcggcugguguccagc

SEQ ID NO: 3259667 - RNA, 21 nt, Mycobacterium tuberculosis H37Rv
gcggcugucacgccugccacc

SEQ ID NO: 3259668 - RNA, 22 nt, Mycobacterium tuberculosis H37Rv
gcggcugugcccgaucagccgu

SEQ ID NO: 3259669 - RNA, 17 nt, Mycobacterium tuberculosis H37Rv
gcggcuguugcggcggc

SEQ ID NO: 3259670 - RNA, 23 nt, Mycobacterium tuberculosis H37Rv
gcggcuucacugcuaguggucug

SEQ ID NO: 3259671 - RNA, 14 nt, Mycobacterium tuberculosis H37Rv
gcggcuucagcacg

SEQ ID NO: 3259672 - RNA, 21 nt, Mycobacterium tuberculosis H37Rv
gcggcuuccucgagcgaaccg

SEQ ID NO: 3259673 - RNA, 20 nt, Mycobacterium tuberculosis H37Rv
gcggcuucgacgucggcgac

SEQ ID NO: 3259674 - RNA, 21 nt, Mycobacterium tuberculosis H37Rv
gcggcuucgccccgaggaugc

SEQ ID NO: 3259675 - RNA, 18 nt, Mycobacterium tuberculosis H37Rv
gcggcuucgucgacaucg

SEQ ID NO: 3259676 - RNA, 21 nt, Mycobacterium tuberculosis H37Rv
gcggcuucgucgacaucgcca

SEQ ID NO: 3259677 - RNA, 15 nt, Mycobacterium tuberculosis H37Rv
gcggcuugaacagcu

SEQ ID NO: 3259678 - RNA, 18 nt, Mycobacterium tuberculosis H37Rv
gcggcuugaacagcugau

SEQ ID NO: 3259679 - RNA, 22 nt, Mycobacterium tuberculosis H37Rv
gcggcuuggccuagccgcggca

SEQ ID NO: 3259680 - RNA, 18 nt, Mycobacterium tuberculosis H37Rv
gcggcuugucgccccaug

SEQ ID NO: 3259681 - RNA, 18 nt, Mycobacterium tuberculosis H37Rv
gcggcuugucgcggugcg

SEQ ID NO: 3259682 - RNA, 15 nt, Mycobacterium tuberculosis H37Rv
gcggcuuucagcgcu

SEQ ID NO: 3259683 - RNA, 20 nt, Mycobacterium tuberculosis H37Rv
gcggcuuucagcgcuucaaa

SEQ ID NO: 3259684 - RNA, 15 nt, Mycobacterium tuberculosis H37Rv
gcggcuuugccgguu

SEQ ID NO: 3259685 - RNA, 23 nt, Mycobacterium tuberculosis H37Rv
gcgggaaacccaugcaugcguug

SEQ ID NO: 3259686 - RNA, 17 nt, Mycobacterium tuberculosis H37Rv
gcgggaaccccccauag

SEQ ID NO: 3259687 - RNA, 15 nt, Mycobacterium tuberculosis H37Rv
gcgggaacgaucgau

SEQ ID NO: 3259688 - RNA, 22 nt, Mycobacterium tuberculosis H37Rv
gcgggaacgaucgaugaccuuu

SEQ ID NO: 3259689 - RNA, 20 nt, Mycobacterium tuberculosis H37Rv
gcgggaacgaugccgccggc

SEQ ID NO: 3259690 - RNA, 16 nt, Mycobacterium tuberculosis H37Rv
gcgggaacgcggcggc

SEQ ID NO: 3259691 - RNA, 23 nt, Mycobacterium tuberculosis H37Rv
gcgggaacgcggcggcgaacucg

SEQ ID NO: 3259692 - RNA, 20 nt, Mycobacterium tuberculosis H37Rv
gcgggaagaacaucaccucg

SEQ ID NO: 3259693 - RNA, 21 nt, Mycobacterium tuberculosis H37Rv
gcgggaagaacaucaccucga

SEQ ID NO: 3259694 - RNA, 23 nt, Mycobacterium tuberculosis H37Rv
gcgggaagucccgaguggccggu

SEQ ID NO: 3259695 - RNA, 19 nt, Mycobacterium tuberculosis H37Rv
gcgggaaguccgucggucg

SEQ ID NO: 3259696 - RNA, 19 nt, Mycobacterium tuberculosis H37Rv
gcgggaaguucgucgguug

SEQ ID NO: 3259697 - RNA, 18 nt, Mycobacterium tuberculosis H37Rv
gcgggacaaaaucagcag

SEQ ID NO: 3259698 - RNA, 18 nt, Mycobacterium tuberculosis H37Rv
gcgggacaacagcauggg

SEQ ID NO: 3259699 - RNA, 14 nt, Mycobacterium tuberculosis H37Rv
gcgggacaccaccg

SEQ ID NO: 3259700 - RNA, 15 nt, Mycobacterium tuberculosis H37Rv
gcgggacaccaccgc

SEQ ID NO: 3259701 - RNA, 14 nt, Mycobacterium tuberculosis H37Rv
gcgggacacgucgc

SEQ ID NO: 3259702 - RNA, 22 nt, Mycobacterium tuberculosis H37Rv
gcgggacacgucgcgccaggcg

SEQ ID NO: 3259703 - RNA, 14 nt, Mycobacterium tuberculosis H37Rv
gcgggacaucaccg

SEQ ID NO: 3259704 - RNA, 21 nt, Mycobacterium tuberculosis H37Rv
gcgggaccuucgagccgcaca

SEQ ID NO: 3259705 - RNA, 18 nt, Mycobacterium tuberculosis H37Rv
gcgggacgcgacucggcg

SEQ ID NO: 3259706 - RNA, 21 nt, Mycobacterium tuberculosis H37Rv
gcgggacgggggcuguccacc

SEQ ID NO: 3259707 - RNA, 20 nt, Mycobacterium tuberculosis H37Rv
gcgggcucuacucgcggccg

SEQ ID NO: 3259708 - RNA, 19 nt, Mycobacterium tuberculosis H37Rv
gcgggcucucggcgucgag

SEQ ID NO: 3259709 - RNA, 16 nt, Mycobacterium tuberculosis H37Rv
gcgggcugaccaacuc

SEQ ID NO: 3259710 - RNA, 19 nt, Mycobacterium tuberculosis H37Rv
gcgggcugaucgcccggcg

SEQ ID NO: 3259711 - RNA, 18 nt, Mycobacterium tuberculosis H37Rv
gcgggcugauuucgugcg

SEQ ID NO: 3259712 - RNA, 23 nt, Mycobacterium tuberculosis H37Rv
gcgggcugcagugacucgaucac

SEQ ID NO: 3259713 - RNA, 20 nt, Mycobacterium tuberculosis H37Rv
gcgggcuguccgggcuguug

SEQ ID NO: 3259714 - RNA, 20 nt, Mycobacterium tuberculosis H37Rv
gcgggcugugaacagcgcgu

SEQ ID NO: 3259715 - RNA, 15 nt, Mycobacterium tuberculosis H37Rv
gcgggcuuaugcacg

SEQ ID NO: 3259716 - RNA, 19 nt, Mycobacterium tuberculosis H37Rv
gcgggcuuaugcacgacgg

SEQ ID NO: 3259717 - RNA, 16 nt, Mycobacterium tuberculosis H37Rv
gcgggcuugagcgccg

SEQ ID NO: 3259718 - RNA, 22 nt, Mycobacterium tuberculosis H37Rv
gcgggcuugccgucuucgccgc

SEQ ID NO: 3259719 - RNA, 18 nt, Mycobacterium tuberculosis H37Rv
gcggggaccgcggucaug

SEQ ID NO: 3259720 - RNA, 13 nt, Mycobacterium tuberculosis H37Rv
gcggggaucagcg

SEQ ID NO: 3259721 - RNA, 20 nt, Mycobacterium tuberculosis H37Rv
gcggggaucgcuggccgcga

SEQ ID NO: 3259722 - RNA, 14 nt, Mycobacterium tuberculosis H37Rv
gcggggaugucgac

SEQ ID NO: 3259723 - RNA, 20 nt, Mycobacterium tuberculosis H37Rv
gcggggaugucgaccgcgag

SEQ ID NO: 3259724 - RNA, 20 nt, Mycobacterium tuberculosis H37Rv
gcggggcagaagucguugcg

SEQ ID NO: 3259725 - RNA, 12 nt, Mycobacterium tuberculosis H37Rv
gcggggccggcg

SEQ ID NO: 3259726 - RNA, 16 nt, Mycobacterium tuberculosis H37Rv
gcggggccggcggcuc

SEQ ID NO: 3259727 - RNA, 23 nt, Mycobacterium tuberculosis H37Rv
gcggggccggcggcucgggugcg

SEQ ID NO: 3259728 - RNA, 13 nt, Mycobacterium tuberculosis H37Rv
gcggggccgggcg

SEQ ID NO: 3259729 - RNA, 13 nt, Mycobacterium tuberculosis H37Rv
gcggggccggucg

SEQ ID NO: 3259730 - RNA, 17 nt, Mycobacterium tuberculosis H37Rv
gcggggcggcggugggc

SEQ ID NO: 3259731 - RNA, 21 nt, Mycobacterium tuberculosis H37Rv
gcggggcuagucgggguggga

SEQ ID NO: 3259732 - RNA, 16 nt, Mycobacterium tuberculosis H37Rv
gcgggggacacgucgu

SEQ ID NO: 3259733 - RNA, 15 nt, Mycobacterium tuberculosis H37Rv
gcgggggagcgaacg

SEQ ID NO: 3259734 - RNA, 20 nt, Mycobacterium tuberculosis H37Rv
gcgggggaguaguggugggc

SEQ ID NO: 3259735 - RNA, 12 nt, Mycobacterium tuberculosis H37Rv
gcgggggcagcg

SEQ ID NO: 3259736 - RNA, 12 nt, Mycobacterium tuberculosis H37Rv
gcgggggcggcg

SEQ ID NO: 3259737 - RNA, 12 nt, Mycobacterium tuberculosis H37Rv
gcgggggugggc

SEQ ID NO: 3259738 - RNA, 14 nt, Mycobacterium tuberculosis H37Rv
gcgggguaggccca

SEQ ID NO: 3259739 - RNA, 19 nt, Mycobacterium tuberculosis H37Rv
gcggggucgaacagcucga

SEQ ID NO: 3259740 - RNA, 19 nt, Mycobacterium tuberculosis H37Rv
gcggggugagggggugguc

SEQ ID NO: 3259741 - RNA, 22 nt, Mycobacterium tuberculosis H37Rv
gcggguagauguucacgccgcc

SEQ ID NO: 3259742 - RNA, 14 nt, Mycobacterium tuberculosis H37Rv
gcggguaggugacg

SEQ ID NO: 3259743 - RNA, 12 nt, Mycobacterium tuberculosis H37Rv
gcgggucagccu

SEQ ID NO: 3259744 - RNA, 18 nt, Mycobacterium tuberculosis H37Rv
gcgggucagcgccgagag

SEQ ID NO: 3259745 - RNA, 22 nt, Mycobacterium tuberculosis H37Rv
gcgggucagcgcguauggcuca

SEQ ID NO: 3259746 - RNA, 14 nt, Mycobacterium tuberculosis H37Rv
gcgggucagcucga

SEQ ID NO: 3259747 - RNA, 14 nt, Mycobacterium tuberculosis H37Rv
gcgggucaggccag

SEQ ID NO: 3259748 - RNA, 15 nt, Mycobacterium tuberculosis H37Rv
gcgggucaggccagg

SEQ ID NO: 3259749 - RNA, 16 nt, Mycobacterium tuberculosis H37Rv
gcgggucaggccaggg

SEQ ID NO: 3259750 - RNA, 20 nt, Mycobacterium tuberculosis H37Rv
gcggguccuucugccgggag

SEQ ID NO: 3259751 - RNA, 17 nt, Mycobacterium tuberculosis H37Rv
gcgggucgcgggugccg

SEQ ID NO: 3259752 - RNA, 16 nt, Mycobacterium tuberculosis H37Rv
gcgggucggcgaccgc

SEQ ID NO: 3259753 - RNA, 17 nt, Mycobacterium tuberculosis H37Rv
gcgggucggcggugccg

SEQ ID NO: 3259754 - RNA, 20 nt, Mycobacterium tuberculosis H37Rv
gcgggucguccgccugcacc

SEQ ID NO: 3259755 - RNA, 19 nt, Mycobacterium tuberculosis H37Rv
gcgggucgugccagcagca

SEQ ID NO: 3259756 - RNA, 23 nt, Mycobacterium tuberculosis H37Rv
gcgggucgugccccggcgcgguc

SEQ ID NO: 3259757 - RNA, 17 nt, Mycobacterium tuberculosis H37Rv
gcgggucguuaccaggc

SEQ ID NO: 3259758 - RNA, 18 nt, Mycobacterium tuberculosis H37Rv
gcgggucucgccgaccuu

SEQ ID NO: 3259759 - RNA, 16 nt, Mycobacterium tuberculosis H37Rv
gcgggugaccaggcgg

SEQ ID NO: 3259760 - RNA, 18 nt, Mycobacterium tuberculosis H37Rv
gcgggugaucugggcggu

SEQ ID NO: 3259761 - RNA, 23 nt, Mycobacterium tuberculosis H37Rv
gcgggugaugacgccgucggcgc

SEQ ID NO: 3259762 - RNA, 14 nt, Mycobacterium tuberculosis H37Rv
gcgggugaugcagu

SEQ ID NO: 3259763 - RNA, 16 nt, Mycobacterium tuberculosis H37Rv
gcgggugaugcaguga

SEQ ID NO: 3259764 - RNA, 15 nt, Mycobacterium tuberculosis H37Rv
gcgggugauguucgu

SEQ ID NO: 3259765 - RNA, 18 nt, Mycobacterium tuberculosis H37Rv
gcgggugccagaucggcg

SEQ ID NO: 3259766 - RNA, 12 nt, Mycobacterium tuberculosis H37Rv
gcgggugccagc

SEQ ID NO: 3259767 - RNA, 15 nt, Mycobacterium tuberculosis H37Rv
gcgggugccagcccg

SEQ ID NO: 3259768 - RNA, 22 nt, Mycobacterium tuberculosis H37Rv
gcgggugccagcccguugcagg

SEQ ID NO: 3259769 - RNA, 17 nt, Mycobacterium tuberculosis H37Rv
gcgggugccgagcuggc

SEQ ID NO: 3259770 - RNA, 14 nt, Mycobacterium tuberculosis H37Rv
gcgggugccgggca

SEQ ID NO: 3259771 - RNA, 14 nt, Mycobacterium tuberculosis H37Rv
gcgggugcgccggc

SEQ ID NO: 3259772 - RNA, 19 nt, Mycobacterium tuberculosis H37Rv
gcgggugcgcgaggucggc

SEQ ID NO: 3259773 - RNA, 18 nt, Mycobacterium tuberculosis H37Rv
gcgggugcggacaccgag

SEQ ID NO: 3259774 - RNA, 14 nt, Mycobacterium tuberculosis H37Rv
gcgggugcggauca

SEQ ID NO: 3259775 - RNA, 23 nt, Mycobacterium tuberculosis H37Rv
gcgggugcgucgaugccggugug

SEQ ID NO: 3259776 - RNA, 12 nt, Mycobacterium tuberculosis H37Rv
gcgggugcuggu

SEQ ID NO: 3259777 - RNA, 18 nt, Mycobacterium tuberculosis H37Rv
gcgggugcuggucaacag

SEQ ID NO: 3259778 - RNA, 22 nt, Mycobacterium tuberculosis H37Rv
gcggguggauuggugccgguca

SEQ ID NO: 3259779 - RNA, 15 nt, Mycobacterium tuberculosis H37Rv
gcggguggcagcggc

SEQ ID NO: 3259780 - RNA, 16 nt, Mycobacterium tuberculosis H37Rv
gcggguggcgccggug

SEQ ID NO: 3259781 - RNA, 14 nt, Mycobacterium tuberculosis H37Rv
gcggguggcggcgu

SEQ ID NO: 3259782 - RNA, 23 nt, Mycobacterium tuberculosis H37Rv
gcgggugggacaccaucuccgcc

SEQ ID NO: 3259783 - RNA, 14 nt, Mycobacterium tuberculosis H37Rv
gcggguggugccag

SEQ ID NO: 3259784 - RNA, 15 nt, Mycobacterium tuberculosis H37Rv
gcggguggugccagg

SEQ ID NO: 3259785 - RNA, 18 nt, Mycobacterium tuberculosis H37Rv
gcggguggugccaggucg

SEQ ID NO: 3259786 - RNA, 19 nt, Mycobacterium tuberculosis H37Rv
gcgggugguuugcgcccug

SEQ ID NO: 3259787 - RNA, 20 nt, Mycobacterium tuberculosis H37Rv
gcgggugguuugcgcccuga

SEQ ID NO: 3259788 - RNA, 20 nt, Mycobacterium tuberculosis H37Rv
gcggguucgacguugaucgc

SEQ ID NO: 3259789 - RNA, 21 nt, Mycobacterium tuberculosis H37Rv
gcggguucgacguugaucgcc

SEQ ID NO: 3259790 - RNA, 14 nt, Mycobacterium tuberculosis H37Rv
gcggguuggucccg

SEQ ID NO: 3259791 - RNA, 16 nt, Mycobacterium tuberculosis H37Rv
gcggguugucggcgac

SEQ ID NO: 3259792 - RNA, 18 nt, Mycobacterium tuberculosis H37Rv
gcggguuugaucuccacc

SEQ ID NO: 3259793 - RNA, 21 nt, Mycobacterium tuberculosis H37Rv
gcggguuugaucuccaccuuc

SEQ ID NO: 3259794 - RNA, 16 nt, Mycobacterium tuberculosis H37Rv
gcggguuugccgggcg

SEQ ID NO: 3259795 - RNA, 20 nt, Mycobacterium tuberculosis H37Rv
gcggguuugccgggcgcugg

SEQ ID NO: 3259796 - RNA, 17 nt, Mycobacterium tuberculosis H37Rv
gcggguuugcgguaguc

SEQ ID NO: 3259797 - RNA, 14 nt, Mycobacterium tuberculosis H37Rv
gcgguaaagccccg

SEQ ID NO: 3259798 - RNA, 15 nt, Mycobacterium tuberculosis H37Rv
gcgguaacucuggug

SEQ ID NO: 3259799 - RNA, 17 nt, Mycobacterium tuberculosis H37Rv
gcgguaaugccagcggc

SEQ ID NO: 3259800 - RNA, 16 nt, Mycobacterium tuberculosis H37Rv
gcgguacaccgacacg

SEQ ID NO: 3259801 - RNA, 20 nt, Mycobacterium tuberculosis H37Rv
gcgguacaccgacacgccgu

SEQ ID NO: 3259802 - RNA, 22 nt, Mycobacterium tuberculosis H37Rv
gcgguaccaaccugcgcggcga

SEQ ID NO: 3259803 - RNA, 23 nt, Mycobacterium tuberculosis H37Rv
gcggugacuccgcgcgcggacag

SEQ ID NO: 3259804 - RNA, 20 nt, Mycobacterium tuberculosis H37Rv
gcggugacucggccuccgcc

SEQ ID NO: 3259805 - RNA, 18 nt, Mycobacterium tuberculosis H37Rv
gcggugaggcagcgaccg

SEQ ID NO: 3259806 - RNA, 17 nt, Mycobacterium tuberculosis H37Rv
gcggugaucccacgagc

SEQ ID NO: 3259807 - RNA, 16 nt, Mycobacterium tuberculosis H37Rv
gcggugaucggggucg

SEQ ID NO: 3259808 - RNA, 16 nt, Mycobacterium tuberculosis H37Rv
gcggugaugggccagg

SEQ ID NO: 3259809 - RNA, 18 nt, Mycobacterium tuberculosis H37Rv
gcggugaugggccaggcg

SEQ ID NO: 3259810 - RNA, 17 nt, Mycobacterium tuberculosis H37Rv
gcggugauugacaacaa

SEQ ID NO: 3259811 - RNA, 20 nt, Mycobacterium tuberculosis H37Rv
gcggugccaaccgcgggaac

SEQ ID NO: 3259812 - RNA, 23 nt, Mycobacterium tuberculosis H37Rv
gcggugccacggugacccuggug

SEQ ID NO: 3259813 - RNA, 13 nt, Mycobacterium tuberculosis H37Rv
gcggugcccagca

SEQ ID NO: 3259814 - RNA, 16 nt, Mycobacterium tuberculosis H37Rv
gcggugcccagcagcg

SEQ ID NO: 3259815 - RNA, 18 nt, Mycobacterium tuberculosis H37Rv
gcggugcccgcaccagaa

SEQ ID NO: 3259816 - RNA, 13 nt, Mycobacterium tuberculosis H37Rv
gcggugcccgcga

SEQ ID NO: 3259817 - RNA, 23 nt, Mycobacterium tuberculosis H37Rv
gcggugccgccggaaucgagacg

SEQ ID NO: 3259818 - RNA, 16 nt, Mycobacterium tuberculosis H37Rv
gcggugccggcccugc

SEQ ID NO: 3259819 - RNA, 16 nt, Mycobacterium tuberculosis H37Rv
gcggugccggcggcgc

SEQ ID NO: 3259820 - RNA, 15 nt, Mycobacterium tuberculosis H37Rv
gcggugccgggaucg

SEQ ID NO: 3259821 - RNA, 19 nt, Mycobacterium tuberculosis H37Rv
gcggugccgucagcggcgg

SEQ ID NO: 3259822 - RNA, 14 nt, Mycobacterium tuberculosis H37Rv
gcggugccguggug

SEQ ID NO: 3259823 - RNA, 12 nt, Mycobacterium tuberculosis H37Rv
gcggugcgcggu

SEQ ID NO: 3259824 - RNA, 19 nt, Mycobacterium tuberculosis H37Rv
gcggugcggaucagaggac

SEQ ID NO: 3259825 - RNA, 13 nt, Mycobacterium tuberculosis H37Rv
gcggugcggcaac

SEQ ID NO: 3259826 - RNA, 17 nt, Mycobacterium tuberculosis H37Rv
gcggugcggcaacagcg

SEQ ID NO: 3259827 - RNA, 12 nt, Mycobacterium tuberculosis H37Rv
gcggugcggcca

SEQ ID NO: 3259828 - RNA, 13 nt, Mycobacterium tuberculosis H37Rv
gcgguggccggcg

SEQ ID NO: 3259829 - RNA, 21 nt, Mycobacterium tuberculosis H37Rv
gcgguggccgucgggugcagc

SEQ ID NO: 3259830 - RNA, 21 nt, Mycobacterium tuberculosis H37Rv
gcgguggccucccacggcgcg

SEQ ID NO: 3259831 - RNA, 17 nt, Mycobacterium tuberculosis H37Rv
gcgguggcggcgagcag

SEQ ID NO: 3259832 - RNA, 19 nt, Mycobacterium tuberculosis H37Rv
gcgguggcggugucggcgc

SEQ ID NO: 3259833 - RNA, 12 nt, Mycobacterium tuberculosis H37Rv
gcgguggcgucg

SEQ ID NO: 3259834 - RNA, 18 nt, Mycobacterium tuberculosis H37Rv
gcgguggcgucgucggcg

SEQ ID NO: 3259835 - RNA, 21 nt, Mycobacterium tuberculosis H37Rv
gcgguggcgucgucggcgggc

SEQ ID NO: 3259836 - RNA, 23 nt, Mycobacterium tuberculosis H37Rv
gcgguggcgucgucggcgggcug

SEQ ID NO: 3259837 - RNA, 18 nt, Mycobacterium tuberculosis H37Rv
gcgguggcuugccccgcc

SEQ ID NO: 3259838 - RNA, 18 nt, Mycobacterium tuberculosis H37Rv
gcgguggucccgauggcg

SEQ ID NO: 3259839 - RNA, 16 nt, Mycobacterium tuberculosis H37Rv
gcgguggucggcgcgc

SEQ ID NO: 3259840 - RNA, 19 nt, Mycobacterium tuberculosis H37Rv
gcgguggugagugcgucuc

SEQ ID NO: 3259841 - RNA, 12 nt, Mycobacterium tuberculosis H37Rv
gcgguggugccg

SEQ ID NO: 3259842 - RNA, 23 nt, Mycobacterium tuberculosis H37Rv
gcgguggugccgcggccaccgcc

SEQ ID NO: 3259843 - RNA, 21 nt, Mycobacterium tuberculosis H37Rv
gcgguggugcgcaaucgacac

SEQ ID NO: 3259844 - RNA, 22 nt, Mycobacterium tuberculosis H37Rv
gcgguggugguguaggaguaca

SEQ ID NO: 3259845 - RNA, 22 nt, Mycobacterium tuberculosis H37Rv
gcgguguagaagcgggcgucgc

SEQ ID NO: 3259846 - RNA, 18 nt, Mycobacterium tuberculosis H37Rv
gcgguguagagcgcaccg

SEQ ID NO: 3259847 - RNA, 19 nt, Mycobacterium tuberculosis H37Rv
gcggugucacaacgcguga

SEQ ID NO: 3259848 - RNA, 14 nt, Mycobacterium tuberculosis H37Rv
gcggugucacgacc

SEQ ID NO: 3259849 - RNA, 18 nt, Mycobacterium tuberculosis H37Rv
gcggugucacgacccaag

SEQ ID NO: 3259850 - RNA, 23 nt, Mycobacterium tuberculosis H37Rv
gcgguguccagaacgguggcgcg

SEQ ID NO: 3259851 - RNA, 20 nt, Mycobacterium tuberculosis H37Rv
gcgguguccuacuuuuccac

SEQ ID NO: 3259852 - RNA, 15 nt, Mycobacterium tuberculosis H37Rv
gcggugucgaccuca

SEQ ID NO: 3259853 - RNA, 13 nt, Mycobacterium tuberculosis H37Rv
gcggugugccgag

SEQ ID NO: 3259854 - RNA, 21 nt, Mycobacterium tuberculosis H37Rv
gcggugugccggucuccgaac

SEQ ID NO: 3259855 - RNA, 18 nt, Mycobacterium tuberculosis H37Rv
gcggugugcgcauggugg

SEQ ID NO: 3259856 - RNA, 19 nt, Mycobacterium tuberculosis H37Rv
gcggugugcggcagcccgc

SEQ ID NO: 3259857 - RNA, 22 nt, Mycobacterium tuberculosis H37Rv
gcgguguggcuugcgucgcgga

SEQ ID NO: 3259858 - RNA, 14 nt, Mycobacterium tuberculosis H37Rv
gcgguguugccgga

SEQ ID NO: 3259859 - RNA, 15 nt, Mycobacterium tuberculosis H37Rv
gcgguguugccggag

SEQ ID NO: 3259860 - RNA, 13 nt, Mycobacterium tuberculosis H37Rv
gcgguguuggcgc

SEQ ID NO: 3259861 - RNA, 18 nt, Mycobacterium tuberculosis H37Rv
gcgguguuggcgccagcc

SEQ ID NO: 3259862 - RNA, 23 nt, Mycobacterium tuberculosis H37Rv
gcgguguuggcgccagccccgcc

SEQ ID NO: 3259863 - RNA, 21 nt, Mycobacterium tuberculosis H37Rv
gcgguuagaucacccgcagcc

SEQ ID NO: 3259864 - RNA, 18 nt, Mycobacterium tuberculosis H37Rv
gcgguuagcagccgcuga

SEQ ID NO: 3259865 - RNA, 16 nt, Mycobacterium tuberculosis H37Rv
gcgguucucgagcucg

SEQ ID NO: 3259866 - RNA, 17 nt, Mycobacterium tuberculosis H37Rv
gcgguugacccacagca

SEQ ID NO: 3259867 - RNA, 16 nt, Mycobacterium tuberculosis H37Rv
gcgguugauucgugcg

SEQ ID NO: 3259868 - RNA, 13 nt, Mycobacterium tuberculosis H37Rv
gcgguugcgcgga

SEQ ID NO: 3259869 - RNA, 19 nt, Mycobacterium tuberculosis H37Rv
gcgguuggaucggcggccg

SEQ ID NO: 3259870 - RNA, 14 nt, Mycobacterium tuberculosis H37Rv
gcgguuggcggcga

SEQ ID NO: 3259871 - RNA, 15 nt, Mycobacterium tuberculosis H37Rv
gcgguuguccggucg

SEQ ID NO: 3259872 - RNA, 16 nt, Mycobacterium tuberculosis H37Rv
gcgguuguccggucgc

SEQ ID NO: 3259873 - RNA, 16 nt, Mycobacterium tuberculosis H37Rv
gcgguuguccuccgac

SEQ ID NO: 3259874 - RNA, 17 nt, Mycobacterium tuberculosis H37Rv
gcgguuguggcugaucc

SEQ ID NO: 3259875 - RNA, 16 nt, Mycobacterium tuberculosis H37Rv
gcgguuugccagugau

SEQ ID NO: 3259876 - RNA, 17 nt, Mycobacterium tuberculosis H37Rv
gcgguuugccagugaug

SEQ ID NO: 3259877 - RNA, 17 nt, Mycobacterium tuberculosis H37Rv
gcgguuuucggcugccg

SEQ ID NO: 3259878 - RNA, 17 nt, Mycobacterium tuberculosis H37Rv
gcguaauccgagcgcgg

SEQ ID NO: 3259879 - RNA, 18 nt, Mycobacterium tuberculosis H37Rv
gcguaauugucgaugucc

SEQ ID NO: 3259880 - RNA, 20 nt, Mycobacterium tuberculosis H37Rv
gcguacaggccggccaccac

SEQ ID NO: 3259881 - RNA, 22 nt, Mycobacterium tuberculosis H37Rv
gcguacauucgggcgugcucgc

SEQ ID NO: 3259882 - RNA, 18 nt, Mycobacterium tuberculosis H37Rv
gcguaccagcuggccacu

SEQ ID NO: 3259883 - RNA, 16 nt, Mycobacterium tuberculosis H37Rv
gcguacccgaucagcg

SEQ ID NO: 3259884 - RNA, 22 nt, Mycobacterium tuberculosis H37Rv
gcguacccguuaugcgccgccc

SEQ ID NO: 3259885 - RNA, 16 nt, Mycobacterium tuberculosis H37Rv
gcguacucggugaucg

SEQ ID NO: 3259886 - RNA, 16 nt, Mycobacterium tuberculosis H37Rv
gcguacucgugaugaa

SEQ ID NO: 3259887 - RNA, 20 nt, Mycobacterium tuberculosis H37Rv
gcguacuucgcuggaaaccu

SEQ ID NO: 3259888 - RNA, 15 nt, Mycobacterium tuberculosis H37Rv
gcguagagcagcagc

SEQ ID NO: 3259889 - RNA, 16 nt, Mycobacterium tuberculosis H37Rv
gcguagagcagcagcg

SEQ ID NO: 3259890 - RNA, 18 nt, Mycobacterium tuberculosis H37Rv
gcguagaucaucagcgac

SEQ ID NO: 3259891 - RNA, 20 nt, Mycobacterium tuberculosis H37Rv
gcguagaucaucuggcuggu

SEQ ID NO: 3259892 - RNA, 15 nt, Mycobacterium tuberculosis H37Rv
gcguagcaacccagg

SEQ ID NO: 3259893 - RNA, 15 nt, Mycobacterium tuberculosis H37Rv
gcguagcacggcgau

SEQ ID NO: 3259894 - RNA, 13 nt, Mycobacterium tuberculosis H37Rv
gcguagcaggucg

SEQ ID NO: 3259895 - RNA, 21 nt, Mycobacterium tuberculosis H37Rv
gcguagcccacccgggugggc

SEQ ID NO: 3259896 - RNA, 14 nt, Mycobacterium tuberculosis H37Rv
gcguagcggcgaua

SEQ ID NO: 3259897 - RNA, 13 nt, Mycobacterium tuberculosis H37Rv
gcguagcggggga

SEQ ID NO: 3259898 - RNA, 13 nt, Mycobacterium tuberculosis H37Rv
gcguaggccagcg

SEQ ID NO: 3259899 - RNA, 18 nt, Mycobacterium tuberculosis H37Rv
gcgucgcggacggugcgg

SEQ ID NO: 3259900 - RNA, 15 nt, Mycobacterium tuberculosis H37Rv
gcgucgcuacgcaac

SEQ ID NO: 3259901 - RNA, 20 nt, Mycobacterium tuberculosis H37Rv
gcgucgcucgucgucaccga

SEQ ID NO: 3259902 - RNA, 15 nt, Mycobacterium tuberculosis H37Rv
gcgucgcugaccgcg

SEQ ID NO: 3259903 - RNA, 15 nt, Mycobacterium tuberculosis H37Rv
gcgucggaaauucca

SEQ ID NO: 3259904 - RNA, 21 nt, Mycobacterium tuberculosis H37Rv
gcgucggaccguuucgucggc

SEQ ID NO: 3259905 - RNA, 16 nt, Mycobacterium tuberculosis H37Rv
gcgucggagccgggca

SEQ ID NO: 3259906 - RNA, 13 nt, Mycobacterium tuberculosis H37Rv
gcgucggccaccc

SEQ ID NO: 3259907 - RNA, 21 nt, Mycobacterium tuberculosis H37Rv
gcgucggccacccgguccacc

SEQ ID NO: 3259908 - RNA, 20 nt, Mycobacterium tuberculosis H37Rv
gcgucggccaggaucaaccg

SEQ ID NO: 3259909 - RNA, 16 nt, Mycobacterium tuberculosis H37Rv
gcgucggcccggugcu

SEQ ID NO: 3259910 - RNA, 13 nt, Mycobacterium tuberculosis H37Rv
gcgucggccgcgc

SEQ ID NO: 3259911 - RNA, 11 nt, Mycobacterium tuberculosis H37Rv
gcgucggcgaa

SEQ ID NO: 3259912 - RNA, 17 nt, Mycobacterium tuberculosis H37Rv
gcgucggcgacguccag

SEQ ID NO: 3259913 - RNA, 23 nt, Mycobacterium tuberculosis H37Rv
gcgucggcgaugaacagcgacgc

SEQ ID NO: 3259914 - RNA, 18 nt, Mycobacterium tuberculosis H37Rv
gcgucggcgcccagcucg

SEQ ID NO: 3259915 - RNA, 15 nt, Mycobacterium tuberculosis H37Rv
gcgucggcggcuucc

SEQ ID NO: 3259916 - RNA, 23 nt, Mycobacterium tuberculosis H37Rv
gcgucggcggcuuccucgagcga

SEQ ID NO: 3259917 - RNA, 15 nt, Mycobacterium tuberculosis H37Rv
gcgucggcgucaucc

SEQ ID NO: 3259918 - RNA, 14 nt, Mycobacterium tuberculosis H37Rv
gcgucggcugccgc

SEQ ID NO: 3259919 - RNA, 16 nt, Mycobacterium tuberculosis H37Rv
gcgucgggcacaucgc

SEQ ID NO: 3259920 - RNA, 14 nt, Mycobacterium tuberculosis H37Rv
gcgucggucaccga

SEQ ID NO: 3259921 - RNA, 16 nt, Mycobacterium tuberculosis H37Rv
gcgucggugagcgcgu

SEQ ID NO: 3259922 - RNA, 13 nt, Mycobacterium tuberculosis H37Rv
gcgucggugccgc

SEQ ID NO: 3259923 - RNA, 22 nt, Mycobacterium tuberculosis H37Rv
gcgucguaaacgucggucgggg

SEQ ID NO: 3259924 - RNA, 15 nt, Mycobacterium tuberculosis H37Rv
gcgucguagaggugc

SEQ ID NO: 3259925 - RNA, 17 nt, Mycobacterium tuberculosis H37Rv
gcgucguagcgcucgug

SEQ ID NO: 3259926 - RNA, 21 nt, Mycobacterium tuberculosis H37Rv
gcgucguagcgcucgugaccg

SEQ ID NO: 3259927 - RNA, 13 nt, Mycobacterium tuberculosis H37Rv
gcgucgucgauga

SEQ ID NO: 3259928 - RNA, 22 nt, Mycobacterium tuberculosis H37Rv
gcgucgucgauggcugcgccga

SEQ ID NO: 3259929 - RNA, 17 nt, Mycobacterium tuberculosis H37Rv
gcgucgucgccggcgcu

SEQ ID NO: 3259930 - RNA, 16 nt, Mycobacterium tuberculosis H37Rv
gcgucgucggccccac

SEQ ID NO: 3259931 - RNA, 17 nt, Mycobacterium tuberculosis H37Rv
gcgucgucggcggcgac

SEQ ID NO: 3259932 - RNA, 21 nt, Mycobacterium tuberculosis H37Rv
gcgucgucggcgggcugcagu

SEQ ID NO: 3259933 - RNA, 22 nt, Mycobacterium tuberculosis H37Rv
gcgucgucgguaaugccgggcc

SEQ ID NO: 3259934 - RNA, 15 nt, Mycobacterium tuberculosis H37Rv
gcgucgucgucgaga

SEQ ID NO: 3259935 - RNA, 19 nt, Mycobacterium tuberculosis H37Rv
gcgucgucuucuucgcgga

SEQ ID NO: 3259936 - RNA, 22 nt, Mycobacterium tuberculosis H37Rv
gcgucgugguggcuauuccgac

SEQ ID NO: 3259937 - RNA, 19 nt, Mycobacterium tuberculosis H37Rv
gcgucgugucggguccaac

SEQ ID NO: 3259938 - RNA, 22 nt, Mycobacterium tuberculosis H37Rv
gcgucguucgagaccccgacga

SEQ ID NO: 3259939 - RNA, 14 nt, Mycobacterium tuberculosis H37Rv
gcgucguucgcggg

SEQ ID NO: 3259940 - RNA, 17 nt, Mycobacterium tuberculosis H37Rv
gcgucguugaggaagcc

SEQ ID NO: 3259941 - RNA, 16 nt, Mycobacterium tuberculosis H37Rv
gcgucguuugggugcg

SEQ ID NO: 3259942 - RNA, 17 nt, Mycobacterium tuberculosis H37Rv
gcgucguuugggugcgc

SEQ ID NO: 3259943 - RNA, 17 nt, Mycobacterium tuberculosis H37Rv
gcgucuccacuuucugc

SEQ ID NO: 3259944 - RNA, 16 nt, Mycobacterium tuberculosis H37Rv
gcgucuccagcugggu

SEQ ID NO: 3259945 - RNA, 14 nt, Mycobacterium tuberculosis H37Rv
gcgucuccuugagc

SEQ ID NO: 3259946 - RNA, 23 nt, Mycobacterium tuberculosis H37Rv
gcgucucgaugagcgcgaaguac

SEQ ID NO: 3259947 - RNA, 18 nt, Mycobacterium tuberculosis H37Rv
gcgucucgccgggaaaca

SEQ ID NO: 3259948 - RNA, 20 nt, Mycobacterium tuberculosis H37Rv
gcgucucggaggcgaccacg

SEQ ID NO: 3259949 - RNA, 12 nt, Mycobacterium tuberculosis H37Rv
gcgucucggugg

SEQ ID NO: 3259950 - RNA, 13 nt, Mycobacterium tuberculosis H37Rv
gcgucugagcgcc

SEQ ID NO: 3259951 - RNA, 16 nt, Mycobacterium tuberculosis H37Rv
gcgucugagcgccggc

SEQ ID NO: 3259952 - RNA, 21 nt, Mycobacterium tuberculosis H37Rv
gcgucugagcgccggcaucgc

SEQ ID NO: 3259953 - RNA, 21 nt, Mycobacterium tuberculosis H37Rv
gcgucugcgaucccgaucgcg

SEQ ID NO: 3259954 - RNA, 13 nt, Mycobacterium tuberculosis H37Rv
gcgucugcggcgg

SEQ ID NO: 3259955 - RNA, 19 nt, Mycobacterium tuberculosis H37Rv
gcgucugcgguggccuguc

SEQ ID NO: 3259956 - RNA, 16 nt, Mycobacterium tuberculosis H37Rv
gcgucugcucgccagc

SEQ ID NO: 3259957 - RNA, 17 nt, Mycobacterium tuberculosis H37Rv
gcgucugcucgccagcc

SEQ ID NO: 3259958 - RNA, 15 nt, Mycobacterium tuberculosis H37Rv
gcgucugcucgccgg

SEQ ID NO: 3259959 - RNA, 22 nt, Mycobacterium tuberculosis H37Rv
gcgucugcucgcgcagccgggu

SEQ ID NO: 3259960 - RNA, 22 nt, Mycobacterium tuberculosis H37Rv
gcgucugcucgcgcagggaucg

SEQ ID NO: 3259961 - RNA, 12 nt, Mycobacterium tuberculosis H37Rv
gcgucugcucgg

SEQ ID NO: 3259962 - RNA, 16 nt, Mycobacterium tuberculosis H37Rv
gcgucugcucggcauc

SEQ ID NO: 3259963 - RNA, 15 nt, Mycobacterium tuberculosis H37Rv
gcgucugcucggcgc

SEQ ID NO: 3259964 - RNA, 18 nt, Mycobacterium tuberculosis H37Rv
gcgucugcucggcgcagc

SEQ ID NO: 3259965 - RNA, 16 nt, Mycobacterium tuberculosis H37Rv
gcgucugcugaccgga

SEQ ID NO: 3259966 - RNA, 18 nt, Mycobacterium tuberculosis H37Rv
gcgucugcugaccggagu

SEQ ID NO: 3259967 - RNA, 14 nt, Mycobacterium tuberculosis H37Rv
gcgucugcuggcgc

SEQ ID NO: 3259968 - RNA, 16 nt, Mycobacterium tuberculosis H37Rv
gcgucugggugcaggu

SEQ ID NO: 3259969 - RNA, 14 nt, Mycobacterium tuberculosis H37Rv
gcgucuggucagcc

SEQ ID NO: 3259970 - RNA, 20 nt, Mycobacterium tuberculosis H37Rv
gcgucuuccucggccacccg

SEQ ID NO: 3259971 - RNA, 21 nt, Mycobacterium tuberculosis H37Rv
gcgucuuccucggccacccgc

SEQ ID NO: 3259972 - RNA, 16 nt, Mycobacterium tuberculosis H37Rv
gcgucuugcaucagcg

SEQ ID NO: 3259973 - RNA, 22 nt, Mycobacterium tuberculosis H37Rv
gcgucuuggaaggcgcgcgccc

SEQ ID NO: 3259974 - RNA, 19 nt, Mycobacterium tuberculosis H37Rv
gcgugaaaugcacgaucgc

SEQ ID NO: 3259975 - RNA, 16 nt, Mycobacterium tuberculosis H37Rv
gcgugaaccuggcgac

SEQ ID NO: 3259976 - RNA, 14 nt, Mycobacterium tuberculosis H37Rv
gcgugaacugaggg

SEQ ID NO: 3259977 - RNA, 19 nt, Mycobacterium tuberculosis H37Rv
gcgugaagucacggcggcu

SEQ ID NO: 3259978 - RNA, 14 nt, Mycobacterium tuberculosis H37Rv
gcgugacagggcgg

SEQ ID NO: 3259979 - RNA, 16 nt, Mycobacterium tuberculosis H37Rv
gcgugaccaccgccga

SEQ ID NO: 3259980 - RNA, 22 nt, Mycobacterium tuberculosis H37Rv
gcgugaccacugaaccguucga

SEQ ID NO: 3259981 - RNA, 19 nt, Mycobacterium tuberculosis H37Rv
gcgugaccagggccugagu

SEQ ID NO: 3259982 - RNA, 23 nt, Mycobacterium tuberculosis H37Rv
gcgugaccagucgcggcguucgg

SEQ ID NO: 3259983 - RNA, 15 nt, Mycobacterium tuberculosis H37Rv
gcgugacccgccggc

SEQ ID NO: 3259984 - RNA, 18 nt, Mycobacterium tuberculosis H37Rv
gcgugaccgacugcgggu

SEQ ID NO: 3259985 - RNA, 16 nt, Mycobacterium tuberculosis H37Rv
gcgugacgaccagccc

SEQ ID NO: 3259986 - RNA, 17 nt, Mycobacterium tuberculosis H37Rv
gcgugacgaccagcccc

SEQ ID NO: 3259987 - RNA, 22 nt, Mycobacterium tuberculosis H37Rv
gcgugacgcuaacgucgaucuc

SEQ ID NO: 3259988 - RNA, 15 nt, Mycobacterium tuberculosis H37Rv
gcgugacgggcagga

SEQ ID NO: 3259989 - RNA, 17 nt, Mycobacterium tuberculosis H37Rv
gcgugacguaccacggc

SEQ ID NO: 3259990 - RNA, 14 nt, Mycobacterium tuberculosis H37Rv
gcgugagcagacgc

SEQ ID NO: 3259991 - RNA, 20 nt, Mycobacterium tuberculosis H37Rv
gcgugagccaugccgcucgg

SEQ ID NO: 3259992 - RNA, 18 nt, Mycobacterium tuberculosis H37Rv
gcgugaucuggccacggc

SEQ ID NO: 3259993 - RNA, 21 nt, Mycobacterium tuberculosis H37Rv
gcgugaucuggccgaagcccg

SEQ ID NO: 3259994 - RNA, 16 nt, Mycobacterium tuberculosis H37Rv
gcgugcacacccgcaa

SEQ ID NO: 3259995 - RNA, 19 nt, Mycobacterium tuberculosis H37Rv
gcguucagcggccagcagu

SEQ ID NO: 3259996 - RNA, 23 nt, Mycobacterium tuberculosis H37Rv
gcguucagugauucggccugagc

SEQ ID NO: 3259997 - RNA, 18 nt, Mycobacterium tuberculosis H37Rv
gcguuccaacucgguucg

SEQ ID NO: 3259998 - RNA, 16 nt, Mycobacterium tuberculosis H37Rv
gcguuccaucgccgac

SEQ ID NO: 3259999 - RNA, 20 nt, Mycobacterium tuberculosis H37Rv
gcguuccauggcccgcucgu

SEQ ID NO: 3260000 - RNA, 21 nt, Mycobacterium tuberculosis H37Rv
gcguuccauuugaguuggucc

SEQ ID NO: 3260001 - RNA, 17 nt, Mycobacterium tuberculosis H37Rv
gcguucccacuggaggu

SEQ ID NO: 3260002 - RNA, 23 nt, Mycobacterium tuberculosis H37Rv
gcguucccccacucggacccgca

SEQ ID NO: 3260003 - RNA, 14 nt, Mycobacterium tuberculosis H37Rv
gcguucccgcucgg

SEQ ID NO: 3260004 - RNA, 17 nt, Mycobacterium tuberculosis H37Rv
gcguuccuccagcagcg

SEQ ID NO: 3260005 - RNA, 22 nt, Mycobacterium tuberculosis H37Rv
gcguuccucgacguaggccagg

SEQ ID NO: 3260006 - RNA, 22 nt, Mycobacterium tuberculosis H37Rv
gcguuccugaucgagcgccagc

SEQ ID NO: 3260007 - RNA, 23 nt, Mycobacterium tuberculosis H37Rv
gcguuccugaucgagcgccagcg

SEQ ID NO: 3260008 - RNA, 23 nt, Mycobacterium tuberculosis H37Rv
gcguucgagagccccgaccagca

SEQ ID NO: 3260009 - RNA, 15 nt, Mycobacterium tuberculosis H37Rv
gcguucgccgcccgg

SEQ ID NO: 3260010 - RNA, 15 nt, Mycobacterium tuberculosis H37Rv
gcguucggcgagcag

SEQ ID NO: 3260011 - RNA, 19 nt, Mycobacterium tuberculosis H37Rv
gcguucgggcuccagcagc

SEQ ID NO: 3260012 - RNA, 20 nt, Mycobacterium tuberculosis H37Rv
gcguucgggcuccagcagcg

SEQ ID NO: 3260013 - RNA, 18 nt, Mycobacterium tuberculosis H37Rv
gcguucggucagugggac

SEQ ID NO: 3260014 - RNA, 23 nt, Mycobacterium tuberculosis H37Rv
gcguucggucagugggacgggcg

SEQ ID NO: 3260015 - RNA, 20 nt, Mycobacterium tuberculosis H37Rv
gcguugaccagcacgacggc

SEQ ID NO: 3260016 - RNA, 13 nt, Mycobacterium tuberculosis H37Rv
gcguugaccugca

SEQ ID NO: 3260017 - RNA, 18 nt, Mycobacterium tuberculosis H37Rv
gcguugacggcggggcgg

SEQ ID NO: 3260018 - RNA, 16 nt, Mycobacterium tuberculosis H37Rv
gcguugacgucgagca

SEQ ID NO: 3260019 - RNA, 20 nt, Mycobacterium tuberculosis H37Rv
gcguugacgucgagcagcgc

SEQ ID NO: 3260020 - RNA, 22 nt, Mycobacterium tuberculosis H37Rv
gcguugagcucaauggcuucga

SEQ ID NO: 3260021 - RNA, 20 nt, Mycobacterium tuberculosis H37Rv
gcguugaugaccgccgccgg

SEQ ID NO: 3260022 - RNA, 16 nt, Mycobacterium tuberculosis H37Rv
gcguugcacagcagcg

SEQ ID NO: 3260023 - RNA, 14 nt, Mycobacterium tuberculosis H37Rv
gcguugcacugcug

SEQ ID NO: 3260024 - RNA, 19 nt, Mycobacterium tuberculosis H37Rv
gcguugcacugcugguuga

SEQ ID NO: 3260025 - RNA, 21 nt, Mycobacterium tuberculosis H37Rv
gcguugcaggaaaguggccga

SEQ ID NO: 3260026 - RNA, 20 nt, Mycobacterium tuberculosis H37Rv
gcguugcaucagcacgucgc

SEQ ID NO: 3260027 - RNA, 19 nt, Mycobacterium tuberculosis H37Rv
gcguugccaggugcuguuu

SEQ ID NO: 3260028 - RNA, 16 nt, Mycobacterium tuberculosis H37Rv
gcguugcccuccuucu

SEQ ID NO: 3260029 - RNA, 17 nt, Mycobacterium tuberculosis H37Rv
gcguugccgaaacccga

SEQ ID NO: 3260030 - RNA, 21 nt, Mycobacterium tuberculosis H37Rv
gcguugccgccguugccgcca

SEQ ID NO: 3260031 - RNA, 17 nt, Mycobacterium tuberculosis H37Rv
gcguugcggcaacagcg

SEQ ID NO: 3260032 - RNA, 15 nt, Mycobacterium tuberculosis H37Rv
gcguuggaucccagc

SEQ ID NO: 3260033 - RNA, 14 nt, Mycobacterium tuberculosis H37Rv
gcguuggaugaagu

SEQ ID NO: 3260034 - RNA, 15 nt, Mycobacterium tuberculosis H37Rv
gcguuggccagcagg

SEQ ID NO: 3260035 - RNA, 12 nt, Mycobacterium tuberculosis H37Rv
gcguuggcggcg

SEQ ID NO: 3260036 - RNA, 12 nt, Mycobacterium tuberculosis H37Rv
gcguuggcuggu

SEQ ID NO: 3260037 - RNA, 19 nt, Mycobacterium tuberculosis H37Rv
gcguugggcagcuccacca

SEQ ID NO: 3260038 - RNA, 17 nt, Mycobacterium tuberculosis H37Rv
gcguuggggcacgacgc

SEQ ID NO: 3260039 - RNA, 18 nt, Mycobacterium tuberculosis H37Rv
gcguugguggucugccaa

SEQ ID NO: 3260040 - RNA, 19 nt, Mycobacterium tuberculosis H37Rv
gcguugguggucugccaaa

SEQ ID NO: 3260041 - RNA, 22 nt, Mycobacterium tuberculosis H37Rv
gcguuguaguccugcgggccgu

SEQ ID NO: 3260042 - RNA, 12 nt, Mycobacterium tuberculosis H37Rv
gcguuguccacc

SEQ ID NO: 3260043 - RNA, 18 nt, Mycobacterium tuberculosis H37Rv
gcguugucggcuggacgg

SEQ ID NO: 3260044 - RNA, 19 nt, Mycobacterium tuberculosis H37Rv
gcguugucggguggcugcu

SEQ ID NO: 3260045 - RNA, 22 nt, Mycobacterium tuberculosis H37Rv
gcguugucuagcugguggugcg

SEQ ID NO: 3260046 - RNA, 13 nt, Mycobacterium tuberculosis H37Rv
gcguuguggcuga

SEQ ID NO: 3260047 - RNA, 12 nt, Mycobacterium tuberculosis H37Rv
gcguuguugacc

SEQ ID NO: 3260048 - RNA, 16 nt, Mycobacterium tuberculosis H37Rv
gcguuguugaccagca

SEQ ID NO: 3260049 - RNA, 22 nt, Mycobacterium tuberculosis H37Rv
gcguuuauaccucgccgcccug

SEQ ID NO: 3260050 - RNA, 21 nt, Mycobacterium tuberculosis H37Rv
gcguuucgaaccgcacgguga

SEQ ID NO: 3260051 - RNA, 15 nt, Mycobacterium tuberculosis H37Rv
gcguuucggcgggcg

SEQ ID NO: 3260052 - RNA, 18 nt, Mycobacterium tuberculosis H37Rv
gcguuucggcgggcgccu

SEQ ID NO: 3260053 - RNA, 22 nt, Mycobacterium tuberculosis H37Rv
gcguuugagaacaacgggaucc

SEQ ID NO: 3260054 - RNA, 15 nt, Mycobacterium tuberculosis H37Rv
gcguuuggacgggcg

SEQ ID NO: 3260055 - RNA, 20 nt, Mycobacterium tuberculosis H37Rv
gcuaaacuccgugccgagcg

SEQ ID NO: 3260056 - RNA, 24 nt, Mycobacterium tuberculosis H37Rv
gcuaaagcccccgacacgccgugc

SEQ ID NO: 3260057 - RNA, 14 nt, Mycobacterium tuberculosis H37Rv
gcuaaccaugcugu

SEQ ID NO: 3260058 - RNA, 14 nt, Mycobacterium tuberculosis H37Rv
gcuaacuggcccgg

SEQ ID NO: 3260059 - RNA, 15 nt, Mycobacterium tuberculosis H37Rv
gcuaacuggcccgga

SEQ ID NO: 3260060 - RNA, 17 nt, Mycobacterium tuberculosis H37Rv
gcuaaggugggcacagc

SEQ ID NO: 3260061 - RNA, 17 nt, Mycobacterium tuberculosis H37Rv
gcuacaccugcggcguc

SEQ ID NO: 3260062 - RNA, 23 nt, Mycobacterium tuberculosis H37Rv
gcuaccagccauagugcggcagc

SEQ ID NO: 3260063 - RNA, 18 nt, Mycobacterium tuberculosis H37Rv
gcuacccauucggcggcg

SEQ ID NO: 3260064 - RNA, 23 nt, Mycobacterium tuberculosis H37Rv
gcuacccauucggcggcgguggc

SEQ ID NO: 3260065 - RNA, 16 nt, Mycobacterium tuberculosis H37Rv
gcuaccccagccggca

SEQ ID NO: 3260066 - RNA, 22 nt, Mycobacterium tuberculosis H37Rv
gcuaccccagccggcagcagcg

SEQ ID NO: 3260067 - RNA, 15 nt, Mycobacterium tuberculosis H37Rv
gcuaccccgcagaau

SEQ ID NO: 3260068 - RNA, 21 nt, Mycobacterium tuberculosis H37Rv
gcuacccgcgcgaccugaaug

SEQ ID NO: 3260069 - RNA, 17 nt, Mycobacterium tuberculosis H37Rv
gcuacccgggccaggcu

SEQ ID NO: 3260070 - RNA, 21 nt, Mycobacterium tuberculosis H37Rv
gcuaccgaacaguaggccucc

SEQ ID NO: 3260071 - RNA, 19 nt, Mycobacterium tuberculosis H37Rv
gcuaccgcaggugccaccu

SEQ ID NO: 3260072 - RNA, 14 nt, Mycobacterium tuberculosis H37Rv
gcuaccgcccgcgc

SEQ ID NO: 3260073 - RNA, 18 nt, Mycobacterium tuberculosis H37Rv
gcuaccgcccgcgccacc

SEQ ID NO: 3260074 - RNA, 13 nt, Mycobacterium tuberculosis H37Rv
gcuaccgccgacc

SEQ ID NO: 3260075 - RNA, 13 nt, Mycobacterium tuberculosis H37Rv
gcuaccgccggag

SEQ ID NO: 3260076 - RNA, 16 nt, Mycobacterium tuberculosis H37Rv
gcuaccggcgccgcgc

SEQ ID NO: 3260077 - RNA, 13 nt, Mycobacterium tuberculosis H37Rv
gcuaccuuggacu

SEQ ID NO: 3260078 - RNA, 21 nt, Mycobacterium tuberculosis H37Rv
gcuacgcaacgggucgggucc

SEQ ID NO: 3260079 - RNA, 15 nt, Mycobacterium tuberculosis H37Rv
gcuacgccuccuucg

SEQ ID NO: 3260080 - RNA, 13 nt, Mycobacterium tuberculosis H37Rv
gcuacgcgcgccc

SEQ ID NO: 3260081 - RNA, 13 nt, Mycobacterium tuberculosis H37Rv
gcuacgcgcgcuc

SEQ ID NO: 3260082 - RNA, 22 nt, Mycobacterium tuberculosis H37Rv
gcuacggccagugccaucgcca

SEQ ID NO: 3260083 - RNA, 18 nt, Mycobacterium tuberculosis H37Rv
gcuacgggccgcgguacc

SEQ ID NO: 3260084 - RNA, 22 nt, Mycobacterium tuberculosis H37Rv
gcuacgggccgcgguacccacc

SEQ ID NO: 3260085 - RNA, 21 nt, Mycobacterium tuberculosis H37Rv
gcuacggggcggucgagccac

SEQ ID NO: 3260086 - RNA, 22 nt, Mycobacterium tuberculosis H37Rv
gcuacgucggcucgucgcucga

SEQ ID NO: 3260087 - RNA, 17 nt, Mycobacterium tuberculosis H37Rv
gcuacuaggcccagcac

SEQ ID NO: 3260088 - RNA, 13 nt, Mycobacterium tuberculosis H37Rv
gcuacuaugccaa

SEQ ID NO: 3260089 - RNA, 17 nt, Mycobacterium tuberculosis H37Rv
gcuacucacggugaucg

SEQ ID NO: 3260090 - RNA, 20 nt, Mycobacterium tuberculosis H37Rv
gcuacucacggugaucguuc

SEQ ID NO: 3260091 - RNA, 19 nt, Mycobacterium tuberculosis H37Rv
gcucagggugcgccgcagc

SEQ ID NO: 3260092 - RNA, 23 nt, Mycobacterium tuberculosis H37Rv
gcucaggguguucacguucagcc

SEQ ID NO: 3260093 - RNA, 20 nt, Mycobacterium tuberculosis H37Rv
gcucaggucaccggccgccg

SEQ ID NO: 3260094 - RNA, 14 nt, Mycobacterium tuberculosis H37Rv
gcucagguucagcu

SEQ ID NO: 3260095 - RNA, 17 nt, Mycobacterium tuberculosis H37Rv
gcucagugaugcgcccc

SEQ ID NO: 3260096 - RNA, 15 nt, Mycobacterium tuberculosis H37Rv
gcucaucaccggcgc

SEQ ID NO: 3260097 - RNA, 18 nt, Mycobacterium tuberculosis H37Rv
gcucauccagcgcgugga

SEQ ID NO: 3260098 - RNA, 22 nt, Mycobacterium tuberculosis H37Rv
gcucaucccgacccuucgggcu

SEQ ID NO: 3260099 - RNA, 21 nt, Mycobacterium tuberculosis H37Rv
gcucauccgccgggccaggcc

SEQ ID NO: 3260100 - RNA, 17 nt, Mycobacterium tuberculosis H37Rv
gcucaucgaccgcggcc

SEQ ID NO: 3260101 - RNA, 20 nt, Mycobacterium tuberculosis H37Rv
gcucaucgaccgcggccggg

SEQ ID NO: 3260102 - RNA, 17 nt, Mycobacterium tuberculosis H37Rv
gcucaucgaccggggcu

SEQ ID NO: 3260103 - RNA, 14 nt, Mycobacterium tuberculosis H37Rv
gcucaucgaucccg

SEQ ID NO: 3260104 - RNA, 20 nt, Mycobacterium tuberculosis H37Rv
gcucaucgcggcgaacauca

SEQ ID NO: 3260105 - RNA, 18 nt, Mycobacterium tuberculosis H37Rv
gcucaucugcgcgcggaa

SEQ ID NO: 3260106 - RNA, 19 nt, Mycobacterium tuberculosis H37Rv
gcucaucuguaaccuccuc

SEQ ID NO: 3260107 - RNA, 20 nt, Mycobacterium tuberculosis H37Rv
gcucaucuguaaccuccucg

SEQ ID NO: 3260108 - RNA, 18 nt, Mycobacterium tuberculosis H37Rv
gcucauguucucgaccgc

SEQ ID NO: 3260109 - RNA, 17 nt, Mycobacterium tuberculosis H37Rv
gcucauucgugcccggg

SEQ ID NO: 3260110 - RNA, 18 nt, Mycobacterium tuberculosis H37Rv
gcuccaacaacuccagca

SEQ ID NO: 3260111 - RNA, 20 nt, Mycobacterium tuberculosis H37Rv
gcuccaacaacuccagcagg

SEQ ID NO: 3260112 - RNA, 20 nt, Mycobacterium tuberculosis H37Rv
gcuccaacaaugccagcugu

SEQ ID NO: 3260113 - RNA, 21 nt, Mycobacterium tuberculosis H37Rv
gcuccaacgauggaacgggcg

SEQ ID NO: 3260114 - RNA, 22 nt, Mycobacterium tuberculosis H37Rv
gcuccaacuccaagaugccgcc

SEQ ID NO: 3260115 - RNA, 22 nt, Mycobacterium tuberculosis H37Rv
gcuccaauccuuugccagccac

SEQ ID NO: 3260116 - RNA, 18 nt, Mycobacterium tuberculosis H37Rv
gcuccaauugcggccgcg

SEQ ID NO: 3260117 - RNA, 14 nt, Mycobacterium tuberculosis H37Rv
gcuccaccaggacg

SEQ ID NO: 3260118 - RNA, 14 nt, Mycobacterium tuberculosis H37Rv
gcuccacccaccug

SEQ ID NO: 3260119 - RNA, 13 nt, Mycobacterium tuberculosis H37Rv
gcuccacccccac

SEQ ID NO: 3260120 - RNA, 19 nt, Mycobacterium tuberculosis H37Rv
gcuccaccgggcccgccgu

SEQ ID NO: 3260121 - RNA, 17 nt, Mycobacterium tuberculosis H37Rv
gcuccagcaccgugacc

SEQ ID NO: 3260122 - RNA, 22 nt, Mycobacterium tuberculosis H37Rv
gcuccagcaccgugacccugau

SEQ ID NO: 3260123 - RNA, 15 nt, Mycobacterium tuberculosis H37Rv
gcuccagcagcgcca

SEQ ID NO: 3260124 - RNA, 20 nt, Mycobacterium tuberculosis H37Rv
gcuccagcgcgcgccgcagc

SEQ ID NO: 3260125 - RNA, 21 nt, Mycobacterium tuberculosis H37Rv
gcuccagcgcgcgccgcagcg

SEQ ID NO: 3260126 - RNA, 15 nt, Mycobacterium tuberculosis H37Rv
gcuccagcucggcca

SEQ ID NO: 3260127 - RNA, 17 nt, Mycobacterium tuberculosis H37Rv
gcuccagcucggcgggc

SEQ ID NO: 3260128 - RNA, 21 nt, Mycobacterium tuberculosis H37Rv
gcuccagcugagcggccggca

SEQ ID NO: 3260129 - RNA, 16 nt, Mycobacterium tuberculosis H37Rv
gcuccaggcgcgccgc

SEQ ID NO: 3260130 - RNA, 15 nt, Mycobacterium tuberculosis H37Rv
gcuccaguggcgcca

SEQ ID NO: 3260131 - RNA, 17 nt, Mycobacterium tuberculosis H37Rv
gcuccaguggcgccagg

SEQ ID NO: 3260132 - RNA, 18 nt, Mycobacterium tuberculosis H37Rv
gcuccaguggcgccaggg

SEQ ID NO: 3260133 - RNA, 16 nt, Mycobacterium tuberculosis H37Rv
gcucccaugaucgccg

SEQ ID NO: 3260134 - RNA, 17 nt, Mycobacterium tuberculosis H37Rv
gcucccaugaucgccga

SEQ ID NO: 3260135 - RNA, 19 nt, Mycobacterium tuberculosis H37Rv
gcucccaugaucgccgacc

SEQ ID NO: 3260136 - RNA, 21 nt, Mycobacterium tuberculosis H37Rv
gcucccccgcuacgcgcgcuc

SEQ ID NO: 3260137 - RNA, 14 nt, Mycobacterium tuberculosis H37Rv
gcuccccgccggaa

SEQ ID NO: 3260138 - RNA, 15 nt, Mycobacterium tuberculosis H37Rv
gcucccggccgccga

SEQ ID NO: 3260139 - RNA, 23 nt, Mycobacterium tuberculosis H37Rv
gcucccggcgucuuaccugaagc

SEQ ID NO: 3260140 - RNA, 20 nt, Mycobacterium tuberculosis H37Rv
gcucccggcuucuugaccac

SEQ ID NO: 3260141 - RNA, 16 nt, Mycobacterium tuberculosis H37Rv
gcucccgggcggcggc

SEQ ID NO: 3260142 - RNA, 14 nt, Mycobacterium tuberculosis H37Rv
gcucccgggggcac

SEQ ID NO: 3260143 - RNA, 23 nt, Mycobacterium tuberculosis H37Rv
gcucccgguugggguggcggugc

SEQ ID NO: 3260144 - RNA, 22 nt, Mycobacterium tuberculosis H37Rv
gcucccgugcuggcgccgaagu

SEQ ID NO: 3260145 - RNA, 22 nt, Mycobacterium tuberculosis H37Rv
gcucccuacgagcccacgcgcc

SEQ ID NO: 3260146 - RNA, 17 nt, Mycobacterium tuberculosis H37Rv
gcucccuauugcugcgg

SEQ ID NO: 3260147 - RNA, 13 nt, Mycobacterium tuberculosis H37Rv
gcucccugcaccc

SEQ ID NO: 3260148 - RNA, 21 nt, Mycobacterium tuberculosis H37Rv
gcuccgaacauggccagcauc

SEQ ID NO: 3260149 - RNA, 18 nt, Mycobacterium tuberculosis H37Rv
gcuccgaugcaucggugc

SEQ ID NO: 3260150 - RNA, 21 nt, Mycobacterium tuberculosis H37Rv
gcuccgaugcaucggugcagc

SEQ ID NO: 3260151 - RNA, 18 nt, Mycobacterium tuberculosis H37Rv
gcuccgaugccgacggcg

SEQ ID NO: 3260152 - RNA, 21 nt, Mycobacterium tuberculosis H37Rv
gcuccgcagcgaagaccagcg

SEQ ID NO: 3260153 - RNA, 17 nt, Mycobacterium tuberculosis H37Rv
gcuccgcccauucccag

SEQ ID NO: 3260154 - RNA, 12 nt, Mycobacterium tuberculosis H37Rv
gcuccgccgccg

SEQ ID NO: 3260155 - RNA, 23 nt, Mycobacterium tuberculosis H37Rv
gcuccgccggguuggcgccggcc

SEQ ID NO: 3260156 - RNA, 14 nt, Mycobacterium tuberculosis H37Rv
gcuccgccgucgcc

SEQ ID NO: 3260157 - RNA, 16 nt, Mycobacterium tuberculosis H37Rv
gcuccgccgucgccgc

SEQ ID NO: 3260158 - RNA, 19 nt, Mycobacterium tuberculosis H37Rv
gcuccgccguugacgccgu

SEQ ID NO: 3260159 - RNA, 23 nt, Mycobacterium tuberculosis H37Rv
gcuccgccugccgcuggucgucg

SEQ ID NO: 3260160 - RNA, 19 nt, Mycobacterium tuberculosis H37Rv
gcuccgcgccgccccgcuc

SEQ ID NO: 3260161 - RNA, 15 nt, Mycobacterium tuberculosis H37Rv
gcuccgcgccgcuca

SEQ ID NO: 3260162 - RNA, 19 nt, Mycobacterium tuberculosis H37Rv
gcuccgcgccgcucaucgg

SEQ ID NO: 3260163 - RNA, 23 nt, Mycobacterium tuberculosis H37Rv
gcuccgcggcgagcuccgaugcc

SEQ ID NO: 3260164 - RNA, 14 nt, Mycobacterium tuberculosis H37Rv
gcuccggauugcug

SEQ ID NO: 3260165 - RNA, 12 nt, Mycobacterium tuberculosis H37Rv
gcuccggccagg

SEQ ID NO: 3260166 - RNA, 22 nt, Mycobacterium tuberculosis H37Rv
gcuccggccaggggaucaccgg

SEQ ID NO: 3260167 - RNA, 16 nt, Mycobacterium tuberculosis H37Rv
gcuccgggacggugaa

SEQ ID NO: 3260168 - RNA, 21 nt, Mycobacterium tuberculosis H37Rv
gcuccguggugcuagcgccgc

SEQ ID NO: 3260169 - RNA, 19 nt, Mycobacterium tuberculosis H37Rv
gcuccgugucggacaagga

SEQ ID NO: 3260170 - RNA, 15 nt, Mycobacterium tuberculosis H37Rv
gcuccguuguccagc

SEQ ID NO: 3260171 - RNA, 23 nt, Mycobacterium tuberculosis H37Rv
gcuccuaucacuggacucuucgg

SEQ ID NO: 3260172 - RNA, 16 nt, Mycobacterium tuberculosis H37Rv
gcuccucaucgugggg

SEQ ID NO: 3260173 - RNA, 18 nt, Mycobacterium tuberculosis H37Rv
gcuccuccgguaucggcg

SEQ ID NO: 3260174 - RNA, 19 nt, Mycobacterium tuberculosis H37Rv
gcuccucggucagcggggu

SEQ ID NO: 3260175 - RNA, 24 nt, Mycobacterium tuberculosis H37Rv
gcuccugcucgucgagccgaccgc

SEQ ID NO: 3260176 - RNA, 20 nt, Mycobacterium tuberculosis H37Rv
gcuccuguaacugcuccugg

SEQ ID NO: 3260177 - RNA, 14 nt, Mycobacterium tuberculosis H37Rv
gcuccuugagguca

SEQ ID NO: 3260178 - RNA, 16 nt, Mycobacterium tuberculosis H37Rv
gcuccuuggcccagcg

SEQ ID NO: 3260179 - RNA, 19 nt, Mycobacterium tuberculosis H37Rv
gcuccuuggcccagcggua

SEQ ID NO: 3260180 - RNA, 16 nt, Mycobacterium tuberculosis H37Rv
gcucgaaacgcccuug

SEQ ID NO: 3260181 - RNA, 21 nt, Mycobacterium tuberculosis H37Rv
gcucgaaauccugguggcaga

SEQ ID NO: 3260182 - RNA, 24 nt, Mycobacterium tuberculosis H37Rv
gcucgaaauccugguggcagacau

SEQ ID NO: 3260183 - RNA, 22 nt, Mycobacterium tuberculosis H37Rv
gcucgaacuccccggucgccgc

SEQ ID NO: 3260184 - RNA, 16 nt, Mycobacterium tuberculosis H37Rv
gcucgaacucggcggc

SEQ ID NO: 3260185 - RNA, 17 nt, Mycobacterium tuberculosis H37Rv
gcucgaacucggcggcc

SEQ ID NO: 3260186 - RNA, 22 nt, Mycobacterium tuberculosis H37Rv
gcucggcagcaucuccgucggc

SEQ ID NO: 3260187 - RNA, 13 nt, Mycobacterium tuberculosis H37Rv
gcucggcaggccc

SEQ ID NO: 3260188 - RNA, 13 nt, Mycobacterium tuberculosis H37Rv
gcucggcaucgag

SEQ ID NO: 3260189 - RNA, 15 nt, Mycobacterium tuberculosis H37Rv
gcucggccaccagcg

SEQ ID NO: 3260190 - RNA, 19 nt, Mycobacterium tuberculosis H37Rv
gcucggccagcacgccgcc

SEQ ID NO: 3260191 - RNA, 17 nt, Mycobacterium tuberculosis H37Rv
gcucggcccagcgcgcc

SEQ ID NO: 3260192 - RNA, 19 nt, Mycobacterium tuberculosis H37Rv
gcucggccgaugcgcagug

SEQ ID NO: 3260193 - RNA, 21 nt, Mycobacterium tuberculosis H37Rv
gcucggccgcagccagcggua

SEQ ID NO: 3260194 - RNA, 21 nt, Mycobacterium tuberculosis H37Rv
gcucggccgucaggguguugc

SEQ ID NO: 3260195 - RNA, 16 nt, Mycobacterium tuberculosis H37Rv
gcucggccuguucggc

SEQ ID NO: 3260196 - RNA, 17 nt, Mycobacterium tuberculosis H37Rv
gcucggccuguucggcg

SEQ ID NO: 3260197 - RNA, 20 nt, Mycobacterium tuberculosis H37Rv
gcucggccuguucggcggcu

SEQ ID NO: 3260198 - RNA, 16 nt, Mycobacterium tuberculosis H37Rv
gcucggcgagccucuu

SEQ ID NO: 3260199 - RNA, 20 nt, Mycobacterium tuberculosis H37Rv
gcucggcgaucugcguuugg

SEQ ID NO: 3260200 - RNA, 12 nt, Mycobacterium tuberculosis H37Rv
gcucggcgcagc

SEQ ID NO: 3260201 - RNA, 18 nt, Mycobacterium tuberculosis H37Rv
gcucggcgcagcacaucc

SEQ ID NO: 3260202 - RNA, 14 nt, Mycobacterium tuberculosis H37Rv
gcucggcgcagcua

SEQ ID NO: 3260203 - RNA, 22 nt, Mycobacterium tuberculosis H37Rv
gcucggcggccagcucccgcga

SEQ ID NO: 3260204 - RNA, 23 nt, Mycobacterium tuberculosis H37Rv
gcucggcgggggaccccgccagc

SEQ ID NO: 3260205 - RNA, 13 nt, Mycobacterium tuberculosis H37Rv
gcucggcggugcc

SEQ ID NO: 3260206 - RNA, 14 nt, Mycobacterium tuberculosis H37Rv
gcucggcguccgcc

SEQ ID NO: 3260207 - RNA, 18 nt, Mycobacterium tuberculosis H37Rv
gcucggcguccgcccagc

SEQ ID NO: 3260208 - RNA, 19 nt, Mycobacterium tuberculosis H37Rv
gcucggcgucgccgccauu

SEQ ID NO: 3260209 - RNA, 15 nt, Mycobacterium tuberculosis H37Rv
gcucggcgugucggg

SEQ ID NO: 3260210 - RNA, 21 nt, Mycobacterium tuberculosis H37Rv
gcucggcuagguagucgacga

SEQ ID NO: 3260211 - RNA, 18 nt, Mycobacterium tuberculosis H37Rv
gcucggcuauggguucgc

SEQ ID NO: 3260212 - RNA, 15 nt, Mycobacterium tuberculosis H37Rv
gcucggcugcucgac

SEQ ID NO: 3260213 - RNA, 23 nt, Mycobacterium tuberculosis H37Rv
gcucggcuucccuaggcuccaac

SEQ ID NO: 3260214 - RNA, 17 nt, Mycobacterium tuberculosis H37Rv
gcucgggcccagcgcgc

SEQ ID NO: 3260215 - RNA, 20 nt, Mycobacterium tuberculosis H37Rv
gcucgggcccagcgcgcgga

SEQ ID NO: 3260216 - RNA, 15 nt, Mycobacterium tuberculosis H37Rv
gcucgggcgcacggu

SEQ ID NO: 3260217 - RNA, 18 nt, Mycobacterium tuberculosis H37Rv
gcucgggcgcgcggcgag

SEQ ID NO: 3260218 - RNA, 19 nt, Mycobacterium tuberculosis H37Rv
gcucgggcgcgcggcgagc

SEQ ID NO: 3260219 - RNA, 14 nt, Mycobacterium tuberculosis H37Rv
gcucgggcugccgc

SEQ ID NO: 3260220 - RNA, 15 nt, Mycobacterium tuberculosis H37Rv
gcucggggaguucca

SEQ ID NO: 3260221 - RNA, 22 nt, Mycobacterium tuberculosis H37Rv
gcucggggcgaugagccugcag

SEQ ID NO: 3260222 - RNA, 21 nt, Mycobacterium tuberculosis H37Rv
gcucgggggauccggcgcagc

SEQ ID NO: 3260223 - RNA, 13 nt, Mycobacterium tuberculosis H37Rv
gcucgggggccga

SEQ ID NO: 3260224 - RNA, 18 nt, Mycobacterium tuberculosis H37Rv
gcucgggguugcucgcga

SEQ ID NO: 3260225 - RNA, 20 nt, Mycobacterium tuberculosis H37Rv
gcucgggguugcucgcgauc

SEQ ID NO: 3260226 - RNA, 15 nt, Mycobacterium tuberculosis H37Rv
gcucgggucaucuug

SEQ ID NO: 3260227 - RNA, 23 nt, Mycobacterium tuberculosis H37Rv
gcucggucagcgucaggugcgcg

SEQ ID NO: 3260228 - RNA, 22 nt, Mycobacterium tuberculosis H37Rv
gcucgguccagccgguccagac

SEQ ID NO: 3260229 - RNA, 18 nt, Mycobacterium tuberculosis H37Rv
gcucgguccccgcagcuc

SEQ ID NO: 3260230 - RNA, 19 nt, Mycobacterium tuberculosis H37Rv
gcucgguccuugccguaga

SEQ ID NO: 3260231 - RNA, 22 nt, Mycobacterium tuberculosis H37Rv
gcucggucuuguauaggccguu

SEQ ID NO: 3260232 - RNA, 22 nt, Mycobacterium tuberculosis H37Rv
gcucggugaaggucaccgucga

SEQ ID NO: 3260233 - RNA, 18 nt, Mycobacterium tuberculosis H37Rv
gcucggugacccccgaga

SEQ ID NO: 3260234 - RNA, 14 nt, Mycobacterium tuberculosis H37Rv
gcucggugacguag

SEQ ID NO: 3260235 - RNA, 21 nt, Mycobacterium tuberculosis H37Rv
gcucggugaucaccaugauca

SEQ ID NO: 3260236 - RNA, 21 nt, Mycobacterium tuberculosis H37Rv
gcucggugcgccagaucaccg

SEQ ID NO: 3260237 - RNA, 20 nt, Mycobacterium tuberculosis H37Rv
gcucggugcugcgccgauac

SEQ ID NO: 3260238 - RNA, 21 nt, Mycobacterium tuberculosis H37Rv
gcucggugcuguugcgcgguc

SEQ ID NO: 3260239 - RNA, 18 nt, Mycobacterium tuberculosis H37Rv
gcucgguggcaucggcgg

SEQ ID NO: 3260240 - RNA, 22 nt, Mycobacterium tuberculosis H37Rv
gcucgguggcaucggcggccug

SEQ ID NO: 3260241 - RNA, 17 nt, Mycobacterium tuberculosis H37Rv
gcucgguuagcccgauc

SEQ ID NO: 3260242 - RNA, 18 nt, Mycobacterium tuberculosis H37Rv
gcucgguuugcguccugg

SEQ ID NO: 3260243 - RNA, 14 nt, Mycobacterium tuberculosis H37Rv
gcucguagcccagg

SEQ ID NO: 3260244 - RNA, 12 nt, Mycobacterium tuberculosis H37Rv
gcucgucaaacg

SEQ ID NO: 3260245 - RNA, 17 nt, Mycobacterium tuberculosis H37Rv
gcucgucauccauccgg

SEQ ID NO: 3260246 - RNA, 12 nt, Mycobacterium tuberculosis H37Rv
gcucguccagca

SEQ ID NO: 3260247 - RNA, 19 nt, Mycobacterium tuberculosis H37Rv
gcucguccagcgagcgcag

SEQ ID NO: 3260248 - RNA, 21 nt, Mycobacterium tuberculosis H37Rv
gcucguccagcgagcgcagca

SEQ ID NO: 3260249 - RNA, 21 nt, Mycobacterium tuberculosis H37Rv
gcucguccggugcgaucccac

SEQ ID NO: 3260250 - RNA, 16 nt, Mycobacterium tuberculosis H37Rv
gcucgucgaacauggc

SEQ ID NO: 3260251 - RNA, 12 nt, Mycobacterium tuberculosis H37Rv
gcucgucgacgu

SEQ ID NO: 3260252 - RNA, 19 nt, Mycobacterium tuberculosis H37Rv
gcucgucgagccgaccgcg

SEQ ID NO: 3260253 - RNA, 15 nt, Mycobacterium tuberculosis H37Rv
gcucgucgagcgcgu

SEQ ID NO: 3260254 - RNA, 19 nt, Mycobacterium tuberculosis H37Rv
gcucgucgagcgcgucggu

SEQ ID NO: 3260255 - RNA, 23 nt, Mycobacterium tuberculosis H37Rv
gcucgucgaugucgacgucgcgu

SEQ ID NO: 3260256 - RNA, 14 nt, Mycobacterium tuberculosis H37Rv
gcucgucgccggug

SEQ ID NO: 3260257 - RNA, 13 nt, Mycobacterium tuberculosis H37Rv
gcucgucgcggcc

SEQ ID NO: 3260258 - RNA, 14 nt, Mycobacterium tuberculosis H37Rv
gcucgucgcggccc

SEQ ID NO: 3260259 - RNA, 13 nt, Mycobacterium tuberculosis H37Rv
gcucgucggcgcc

SEQ ID NO: 3260260 - RNA, 20 nt, Mycobacterium tuberculosis H37Rv
gcucgucggcgccggcggcc

SEQ ID NO: 3260261 - RNA, 13 nt, Mycobacterium tuberculosis H37Rv
gcucgucggucac

SEQ ID NO: 3260262 - RNA, 15 nt, Mycobacterium tuberculosis H37Rv
gcucgucggucaccg

SEQ ID NO: 3260263 - RNA, 17 nt, Mycobacterium tuberculosis H37Rv
gcucgucguacaugggc

SEQ ID NO: 3260264 - RNA, 20 nt, Mycobacterium tuberculosis H37Rv
gcucgucguacaugggcaga

SEQ ID NO: 3260265 - RNA, 15 nt, Mycobacterium tuberculosis H37Rv
gcucgucgucaccga

SEQ ID NO: 3260266 - RNA, 19 nt, Mycobacterium tuberculosis H37Rv
gcucgucguccggccacgg

SEQ ID NO: 3260267 - RNA, 19 nt, Mycobacterium tuberculosis H37Rv
gcucgucgucgauccagcc

SEQ ID NO: 3260268 - RNA, 21 nt, Mycobacterium tuberculosis H37Rv
gcucgucgucgauccagccca

SEQ ID NO: 3260269 - RNA, 22 nt, Mycobacterium tuberculosis H37Rv
gcucgucuaccccgagccuuga

SEQ ID NO: 3260270 - RNA, 18 nt, Mycobacterium tuberculosis H37Rv
gcucgucuuggcggcggu

SEQ ID NO: 3260271 - RNA, 20 nt, Mycobacterium tuberculosis H37Rv
gcucgucuugggccgggaug

SEQ ID NO: 3260272 - RNA, 12 nt, Mycobacterium tuberculosis H37Rv
gcucgugaccga

SEQ ID NO: 3260273 - RNA, 16 nt, Mycobacterium tuberculosis H37Rv
gcucgugagccccagc

SEQ ID NO: 3260274 - RNA, 17 nt, Mycobacterium tuberculosis H37Rv
gcucguggucgacguga

SEQ ID NO: 3260275 - RNA, 21 nt, Mycobacterium tuberculosis H37Rv
gcucguggucgacgugaucgc

SEQ ID NO: 3260276 - RNA, 21 nt, Mycobacterium tuberculosis H37Rv
gcucguguuguugaagcccga

SEQ ID NO: 3260277 - RNA, 17 nt, Mycobacterium tuberculosis H37Rv
gcucguucaccgcagcg

SEQ ID NO: 3260278 - RNA, 16 nt, Mycobacterium tuberculosis H37Rv
gcucguuccggcgguc

SEQ ID NO: 3260279 - RNA, 18 nt, Mycobacterium tuberculosis H37Rv
gcucguuccggcggucaa

SEQ ID NO: 3260280 - RNA, 17 nt, Mycobacterium tuberculosis H37Rv
gcucguucgugcagccc

SEQ ID NO: 3260281 - RNA, 16 nt, Mycobacterium tuberculosis H37Rv
gcucguugaugcggcu

SEQ ID NO: 3260282 - RNA, 19 nt, Mycobacterium tuberculosis H37Rv
gcugauagcggucggucac

SEQ ID NO: 3260283 - RNA, 21 nt, Mycobacterium tuberculosis H37Rv
gcugauagcggucggucacca

SEQ ID NO: 3260284 - RNA, 12 nt, Mycobacterium tuberculosis H37Rv
gcugaucaacag

SEQ ID NO: 3260285 - RNA, 14 nt, Mycobacterium tuberculosis H37Rv
gcugauccaaguac

SEQ ID NO: 3260286 - RNA, 19 nt, Mycobacterium tuberculosis H37Rv
gcugauccggguggcguca

SEQ ID NO: 3260287 - RNA, 20 nt, Mycobacterium tuberculosis H37Rv
gcugauccggguggcgucac

SEQ ID NO: 3260288 - RNA, 23 nt, Mycobacterium tuberculosis H37Rv
gcugaucucggucuccacgccgu

SEQ ID NO: 3260289 - RNA, 19 nt, Mycobacterium tuberculosis H37Rv
gcugaucuugccgccgcgc

SEQ ID NO: 3260290 - RNA, 23 nt, Mycobacterium tuberculosis H37Rv
gcugaugaagaugauuucgccga

SEQ ID NO: 3260291 - RNA, 20 nt, Mycobacterium tuberculosis H37Rv
gcugaugcgguagucgccga

SEQ ID NO: 3260292 - RNA, 18 nt, Mycobacterium tuberculosis H37Rv
gcugaugggucaggccga

SEQ ID NO: 3260293 - RNA, 14 nt, Mycobacterium tuberculosis H37Rv
gcugauggugccga

SEQ ID NO: 3260294 - RNA, 15 nt, Mycobacterium tuberculosis H37Rv
gcugauggugcugcg

SEQ ID NO: 3260295 - RNA, 18 nt, Mycobacterium tuberculosis H37Rv
gcugaugucgccgguguc

SEQ ID NO: 3260296 - RNA, 17 nt, Mycobacterium tuberculosis H37Rv
gcugauuaccgacaccg

SEQ ID NO: 3260297 - RNA, 17 nt, Mycobacterium tuberculosis H37Rv
gcugauugcgaccgcgc

SEQ ID NO: 3260298 - RNA, 18 nt, Mycobacterium tuberculosis H37Rv
gcugcaaccagcggcaca

SEQ ID NO: 3260299 - RNA, 16 nt, Mycobacterium tuberculosis H37Rv
gcugcaaccgacuucg

SEQ ID NO: 3260300 - RNA, 18 nt, Mycobacterium tuberculosis H37Rv
gcugcaacgauugaacuc

SEQ ID NO: 3260301 - RNA, 17 nt, Mycobacterium tuberculosis H37Rv
gcugcaacggagcgagc

SEQ ID NO: 3260302 - RNA, 14 nt, Mycobacterium tuberculosis H37Rv
gcugcacaacgugg

SEQ ID NO: 3260303 - RNA, 14 nt, Mycobacterium tuberculosis H37Rv
gcugcaccgauucg

SEQ ID NO: 3260304 - RNA, 22 nt, Mycobacterium tuberculosis H37Rv
gcugcaccguuuccggcgcucc

SEQ ID NO: 3260305 - RNA, 15 nt, Mycobacterium tuberculosis H37Rv
gcugcacguggccac

SEQ ID NO: 3260306 - RNA, 13 nt, Mycobacterium tuberculosis H37Rv
gcugcagacccgu

SEQ ID NO: 3260307 - RNA, 20 nt, Mycobacterium tuberculosis H37Rv
gcugcagacccguucgccgu

SEQ ID NO: 3260308 - RNA, 18 nt, Mycobacterium tuberculosis H37Rv
gcugcagauggaaccucg

SEQ ID NO: 3260309 - RNA, 14 nt, Mycobacterium tuberculosis H37Rv
gcugcagcaauugc

SEQ ID NO: 3260310 - RNA, 20 nt, Mycobacterium tuberculosis H37Rv
gcugcagcagacccgguggc

SEQ ID NO: 3260311 - RNA, 23 nt, Mycobacterium tuberculosis H37Rv
gcugcagcauggcuccgaagucc

SEQ ID NO: 3260312 - RNA, 15 nt, Mycobacterium tuberculosis H37Rv
gcugcagccugugga

SEQ ID NO: 3260313 - RNA, 12 nt, Mycobacterium tuberculosis H37Rv
gcugcagcgaga

SEQ ID NO: 3260314 - RNA, 18 nt, Mycobacterium tuberculosis H37Rv
gcugcagcgagaccucuc

SEQ ID NO: 3260315 - RNA, 14 nt, Mycobacterium tuberculosis H37Rv
gcugcaggcggccg

SEQ ID NO: 3260316 - RNA, 17 nt, Mycobacterium tuberculosis H37Rv
gcugcagugccgcaccc

SEQ ID NO: 3260317 - RNA, 15 nt, Mycobacterium tuberculosis H37Rv
gcugcauccgcagca

SEQ ID NO: 3260318 - RNA, 19 nt, Mycobacterium tuberculosis H37Rv
gcugcauccgcagcaccaa

SEQ ID NO: 3260319 - RNA, 22 nt, Mycobacterium tuberculosis H37Rv
gcugcauccuccucgucgacgu

SEQ ID NO: 3260320 - RNA, 16 nt, Mycobacterium tuberculosis H37Rv
gcugcauguuaugggu

SEQ ID NO: 3260321 - RNA, 20 nt, Mycobacterium tuberculosis H37Rv
gcugccaaacuaacggcagc

SEQ ID NO: 3260322 - RNA, 15 nt, Mycobacterium tuberculosis H37Rv
gcugccaagcgaccu

SEQ ID NO: 3260323 - RNA, 21 nt, Mycobacterium tuberculosis H37Rv
gcugccacacaggcguccauc

SEQ ID NO: 3260324 - RNA, 17 nt, Mycobacterium tuberculosis H37Rv
gcugccacaggugaccu

SEQ ID NO: 3260325 - RNA, 14 nt, Mycobacterium tuberculosis H37Rv
gcugccacccaucg

SEQ ID NO: 3260326 - RNA, 15 nt, Mycobacterium tuberculosis H37Rv
gcugccacccaucgc

SEQ ID NO: 3260327 - RNA, 15 nt, Mycobacterium tuberculosis H37Rv
gcugccaccggccgg

SEQ ID NO: 3260328 - RNA, 14 nt, Mycobacterium tuberculosis H37Rv
gcugccacgaacgc

SEQ ID NO: 3260329 - RNA, 16 nt, Mycobacterium tuberculosis H37Rv
gcugccacgcgucggu

SEQ ID NO: 3260330 - RNA, 23 nt, Mycobacterium tuberculosis H37Rv
gcugccacggccuucagcggucg

SEQ ID NO: 3260331 - RNA, 18 nt, Mycobacterium tuberculosis H37Rv
gcugccagaaugggcggc

SEQ ID NO: 3260332 - RNA, 18 nt, Mycobacterium tuberculosis H37Rv
gcugccagaucggucggc

SEQ ID NO: 3260333 - RNA, 16 nt, Mycobacterium tuberculosis H37Rv
gcugccagccauggcc

SEQ ID NO: 3260334 - RNA, 18 nt, Mycobacterium tuberculosis H37Rv
gcugccagccauggccgc

SEQ ID NO: 3260335 - RNA, 15 nt, Mycobacterium tuberculosis H37Rv
gcugccagccguucc

SEQ ID NO: 3260336 - RNA, 18 nt, Mycobacterium tuberculosis H37Rv
gcugccagccuggagaug

SEQ ID NO: 3260337 - RNA, 12 nt, Mycobacterium tuberculosis H37Rv
gcugccagcggc

SEQ ID NO: 3260338 - RNA, 17 nt, Mycobacterium tuberculosis H37Rv
gcugccagggugcgccg

SEQ ID NO: 3260339 - RNA, 22 nt, Mycobacterium tuberculosis H37Rv
gcugccagugccgcccaccaca

SEQ ID NO: 3260340 - RNA, 12 nt, Mycobacterium tuberculosis H37Rv
gcugccaugcgg

SEQ ID NO: 3260341 - RNA, 15 nt, Mycobacterium tuberculosis H37Rv
gcugccauuccagau

SEQ ID NO: 3260342 - RNA, 14 nt, Mycobacterium tuberculosis H37Rv
gcugcccaaaagcg

SEQ ID NO: 3260343 - RNA, 19 nt, Mycobacterium tuberculosis H37Rv
gcugcccaaaagcgcggca

SEQ ID NO: 3260344 - RNA, 20 nt, Mycobacterium tuberculosis H37Rv
gcugcccaaaaggaagaccu

SEQ ID NO: 3260345 - RNA, 21 nt, Mycobacterium tuberculosis H37Rv
gcugcccaaaaggaagaccuc

SEQ ID NO: 3260346 - RNA, 16 nt, Mycobacterium tuberculosis H37Rv
gcugcccaaccgguca

SEQ ID NO: 3260347 - RNA, 17 nt, Mycobacterium tuberculosis H37Rv
gcugcccacgggccggc

SEQ ID NO: 3260348 - RNA, 20 nt, Mycobacterium tuberculosis H37Rv
gcugcccagcgucaucccga

SEQ ID NO: 3260349 - RNA, 18 nt, Mycobacterium tuberculosis H37Rv
gcugcccaucggugaucg

SEQ ID NO: 3260350 - RNA, 16 nt, Mycobacterium tuberculosis H37Rv
gcugcccaugcggcag

SEQ ID NO: 3260351 - RNA, 15 nt, Mycobacterium tuberculosis H37Rv
gcugccccccagaca

SEQ ID NO: 3260352 - RNA, 16 nt, Mycobacterium tuberculosis H37Rv
gcugccccgccaccuc

SEQ ID NO: 3260353 - RNA, 16 nt, Mycobacterium tuberculosis H37Rv
gcugccccgccgccau

SEQ ID NO: 3260354 - RNA, 16 nt, Mycobacterium tuberculosis H37Rv
gcugcccgccagccca

SEQ ID NO: 3260355 - RNA, 16 nt, Mycobacterium tuberculosis H37Rv
gcugcccgccagcgcc

SEQ ID NO: 3260356 - RNA, 12 nt, Mycobacterium tuberculosis H37Rv
gcugcccgccgc

SEQ ID NO: 3260357 - RNA, 16 nt, Mycobacterium tuberculosis H37Rv
gcugcccgggcugccg

SEQ ID NO: 3260358 - RNA, 18 nt, Mycobacterium tuberculosis H37Rv
gcugcccgggcugccgcc

SEQ ID NO: 3260359 - RNA, 19 nt, Mycobacterium tuberculosis H37Rv
gcugcccgggcugccgccc

SEQ ID NO: 3260360 - RNA, 14 nt, Mycobacterium tuberculosis H37Rv
gcugccgagcgguc

SEQ ID NO: 3260361 - RNA, 18 nt, Mycobacterium tuberculosis H37Rv
gcugccgauagcgcggca

SEQ ID NO: 3260362 - RNA, 20 nt, Mycobacterium tuberculosis H37Rv
gcugccgauagcgcggcacc

SEQ ID NO: 3260363 - RNA, 20 nt, Mycobacterium tuberculosis H37Rv
gcugccgaucaauggcaacg

SEQ ID NO: 3260364 - RNA, 15 nt, Mycobacterium tuberculosis H37Rv
gcugccgcaucggca

SEQ ID NO: 3260365 - RNA, 17 nt, Mycobacterium tuberculosis H37Rv
gcugccgccgagcuggc

SEQ ID NO: 3260366 - RNA, 15 nt, Mycobacterium tuberculosis H37Rv
gcugccgccgccggc

SEQ ID NO: 3260367 - RNA, 14 nt, Mycobacterium tuberculosis H37Rv
gcugccgcgcgcug

SEQ ID NO: 3260368 - RNA, 20 nt, Mycobacterium tuberculosis H37Rv
gcugccgcgcggcgagagcc

SEQ ID NO: 3260369 - RNA, 16 nt, Mycobacterium tuberculosis H37Rv
gcugccgcggcugcca

SEQ ID NO: 3260370 - RNA, 18 nt, Mycobacterium tuberculosis H37Rv
gcugccgcggcugccauc

SEQ ID NO: 3260371 - RNA, 13 nt, Mycobacterium tuberculosis H37Rv
gcugccgcggugc

SEQ ID NO: 3260372 - RNA, 15 nt, Mycobacterium tuberculosis H37Rv
gcugccgcggugcca

SEQ ID NO: 3260373 - RNA, 22 nt, Mycobacterium tuberculosis H37Rv
gcugccgcugcgccgucgcagc

SEQ ID NO: 3260374 - RNA, 15 nt, Mycobacterium tuberculosis H37Rv
gcugccggcaacagc

SEQ ID NO: 3260375 - RNA, 20 nt, Mycobacterium tuberculosis H37Rv
gcugccggcacgcaugccgg

SEQ ID NO: 3260376 - RNA, 15 nt, Mycobacterium tuberculosis H37Rv
gcugccggccagacg

SEQ ID NO: 3260377 - RNA, 16 nt, Mycobacterium tuberculosis H37Rv
gcugccggcccaccag

SEQ ID NO: 3260378 - RNA, 17 nt, Mycobacterium tuberculosis H37Rv
gcugccggcccaccagg

SEQ ID NO: 3260379 - RNA, 22 nt, Mycobacterium tuberculosis H37Rv
gcuggaaaccucuucgggugca

SEQ ID NO: 3260380 - RNA, 22 nt, Mycobacterium tuberculosis H37Rv
gcuggaacaaaauucgcuggcg

SEQ ID NO: 3260381 - RNA, 18 nt, Mycobacterium tuberculosis H37Rv
gcuggaacuuggcgucga

SEQ ID NO: 3260382 - RNA, 23 nt, Mycobacterium tuberculosis H37Rv
gcuggaaucgaaaaggugcacca

SEQ ID NO: 3260383 - RNA, 21 nt, Mycobacterium tuberculosis H37Rv
gcuggacggccuccaucgcga

SEQ ID NO: 3260384 - RNA, 23 nt, Mycobacterium tuberculosis H37Rv
gcuggacuccggucagcgcggcg

SEQ ID NO: 3260385 - RNA, 12 nt, Mycobacterium tuberculosis H37Rv
gcuggagauguu

SEQ ID NO: 3260386 - RNA, 12 nt, Mycobacterium tuberculosis H37Rv
gcuggaggccac

SEQ ID NO: 3260387 - RNA, 18 nt, Mycobacterium tuberculosis H37Rv
gcuggauaugagccaacc

SEQ ID NO: 3260388 - RNA, 13 nt, Mycobacterium tuberculosis H37Rv
gcuggcaaccgcg

SEQ ID NO: 3260389 - RNA, 22 nt, Mycobacterium tuberculosis H37Rv
gcuggcaacgccgcgccguucc

SEQ ID NO: 3260390 - RNA, 23 nt, Mycobacterium tuberculosis H37Rv
gcuggcaaguccggucgcggaga

SEQ ID NO: 3260391 - RNA, 18 nt, Mycobacterium tuberculosis H37Rv
gcuggcaaguucggccga

SEQ ID NO: 3260392 - RNA, 20 nt, Mycobacterium tuberculosis H37Rv
gcuggcaaucccgcggucga

SEQ ID NO: 3260393 - RNA, 11 nt, Mycobacterium tuberculosis H37Rv
gcuggcagacu

SEQ ID NO: 3260394 - RNA, 21 nt, Mycobacterium tuberculosis H37Rv
gcuggcagcgacuuaggcaga

SEQ ID NO: 3260395 - RNA, 13 nt, Mycobacterium tuberculosis H37Rv
gcuggcagcucgg

SEQ ID NO: 3260396 - RNA, 15 nt, Mycobacterium tuberculosis H37Rv
gcuggcagcuuuggu

SEQ ID NO: 3260397 - RNA, 15 nt, Mycobacterium tuberculosis H37Rv
gcuggcaggccgggc

SEQ ID NO: 3260398 - RNA, 19 nt, Mycobacterium tuberculosis H37Rv
gcuggcaggccgggcacca

SEQ ID NO: 3260399 - RNA, 14 nt, Mycobacterium tuberculosis H37Rv
gcuggcaugccggc

SEQ ID NO: 3260400 - RNA, 20 nt, Mycobacterium tuberculosis H37Rv
gcuggccacgauccgcggua

SEQ ID NO: 3260401 - RNA, 13 nt, Mycobacterium tuberculosis H37Rv
gcuggccagcaca

SEQ ID NO: 3260402 - RNA, 22 nt, Mycobacterium tuberculosis H37Rv
gcuggccagcacaccgucgacg

SEQ ID NO: 3260403 - RNA, 16 nt, Mycobacterium tuberculosis H37Rv
gcuggccagcacgccc

SEQ ID NO: 3260404 - RNA, 14 nt, Mycobacterium tuberculosis H37Rv
gcuggccagcgcgc

SEQ ID NO: 3260405 - RNA, 19 nt, Mycobacterium tuberculosis H37Rv
gcuggccaugguggcgccg

SEQ ID NO: 3260406 - RNA, 12 nt, Mycobacterium tuberculosis H37Rv
gcuggcccagcg

SEQ ID NO: 3260407 - RNA, 12 nt, Mycobacterium tuberculosis H37Rv
gcuggcccgcau

SEQ ID NO: 3260408 - RNA, 17 nt, Mycobacterium tuberculosis H37Rv
gcuggcccgcaugccgg

SEQ ID NO: 3260409 - RNA, 23 nt, Mycobacterium tuberculosis H37Rv
gcuggcccgcucauaccgggagg

SEQ ID NO: 3260410 - RNA, 13 nt, Mycobacterium tuberculosis H37Rv
gcuggccgaaccg

SEQ ID NO: 3260411 - RNA, 14 nt, Mycobacterium tuberculosis H37Rv
gcuggccucgucgc

SEQ ID NO: 3260412 - RNA, 22 nt, Mycobacterium tuberculosis H37Rv
gcuggcgaacucgaggucgagc

SEQ ID NO: 3260413 - RNA, 15 nt, Mycobacterium tuberculosis H37Rv
gcuggcgacgacgac

SEQ ID NO: 3260414 - RNA, 18 nt, Mycobacterium tuberculosis H37Rv
gcuggcgagcagacgcga

SEQ ID NO: 3260415 - RNA, 17 nt, Mycobacterium tuberculosis H37Rv
gcuggcgagggcugacg

SEQ ID NO: 3260416 - RNA, 16 nt, Mycobacterium tuberculosis H37Rv
gcuggcgaugccgaga

SEQ ID NO: 3260417 - RNA, 17 nt, Mycobacterium tuberculosis H37Rv
gcuggcgcccccgccau

SEQ ID NO: 3260418 - RNA, 12 nt, Mycobacterium tuberculosis H37Rv
gcuggcgcccgg

SEQ ID NO: 3260419 - RNA, 19 nt, Mycobacterium tuberculosis H37Rv
gcuggcgcccuugccggcg

SEQ ID NO: 3260420 - RNA, 14 nt, Mycobacterium tuberculosis H37Rv
gcuggcgccgcagg

SEQ ID NO: 3260421 - RNA, 23 nt, Mycobacterium tuberculosis H37Rv
gcuggcgccgccggugccaccga

SEQ ID NO: 3260422 - RNA, 21 nt, Mycobacterium tuberculosis H37Rv
gcuggcgcucauaggccggcg

SEQ ID NO: 3260423 - RNA, 13 nt, Mycobacterium tuberculosis H37Rv
gcuggcggcagcg

SEQ ID NO: 3260424 - RNA, 23 nt, Mycobacterium tuberculosis H37Rv
gcuggcgggcagcuguucggcca

SEQ ID NO: 3260425 - RNA, 17 nt, Mycobacterium tuberculosis H37Rv
gcuggcggguugguccc

SEQ ID NO: 3260426 - RNA, 14 nt, Mycobacterium tuberculosis H37Rv
gcuggcgucaccgc

SEQ ID NO: 3260427 - RNA, 24 nt, Mycobacterium tuberculosis H37Rv
gcuggcuagcagguacucgcccca

SEQ ID NO: 3260428 - RNA, 15 nt, Mycobacterium tuberculosis H37Rv
gcuggcucaccgaca

SEQ ID NO: 3260429 - RNA, 20 nt, Mycobacterium tuberculosis H37Rv
gcuggcucaccgacaugacg

SEQ ID NO: 3260430 - RNA, 22 nt, Mycobacterium tuberculosis H37Rv
gcuggcucaucgaagcuucggc

SEQ ID NO: 3260431 - RNA, 17 nt, Mycobacterium tuberculosis H37Rv
gcuggcugacaccgauc

SEQ ID NO: 3260432 - RNA, 12 nt, Mycobacterium tuberculosis H37Rv
gcuggcugacga

SEQ ID NO: 3260433 - RNA, 23 nt, Mycobacterium tuberculosis H37Rv
gcuggcugccacgaacgcuucca

SEQ ID NO: 3260434 - RNA, 14 nt, Mycobacterium tuberculosis H37Rv
gcuggcuguggcug

SEQ ID NO: 3260435 - RNA, 16 nt, Mycobacterium tuberculosis H37Rv
gcuggcuguggcugaa

SEQ ID NO: 3260436 - RNA, 15 nt, Mycobacterium tuberculosis H37Rv
gcuggcuucucgcag

SEQ ID NO: 3260437 - RNA, 17 nt, Mycobacterium tuberculosis H37Rv
gcugggacgggcgcguc

SEQ ID NO: 3260438 - RNA, 22 nt, Mycobacterium tuberculosis H37Rv
gcugggacgggcgcgucggcgu

SEQ ID NO: 3260439 - RNA, 13 nt, Mycobacterium tuberculosis H37Rv
gcugggaggcgcg

SEQ ID NO: 3260440 - RNA, 21 nt, Mycobacterium tuberculosis H37Rv
gcugggauguucgaucagcga

SEQ ID NO: 3260441 - RNA, 19 nt, Mycobacterium tuberculosis H37Rv
gcugggauguucuugguca

SEQ ID NO: 3260442 - RNA, 19 nt, Mycobacterium tuberculosis H37Rv
gcugggcaagaucguuucc

SEQ ID NO: 3260443 - RNA, 12 nt, Mycobacterium tuberculosis H37Rv
gcugggcagacc

SEQ ID NO: 3260444 - RNA, 19 nt, Mycobacterium tuberculosis H37Rv
gcugggcccgagcgcgcgc

SEQ ID NO: 3260445 - RNA, 21 nt, Mycobacterium tuberculosis H37Rv
gcugggcccgagcgcgcgcug

SEQ ID NO: 3260446 - RNA, 14 nt, Mycobacterium tuberculosis H37Rv
gcugggcccgccgu

SEQ ID NO: 3260447 - RNA, 21 nt, Mycobacterium tuberculosis H37Rv
gcugggccggggaggcuaggc

SEQ ID NO: 3260448 - RNA, 16 nt, Mycobacterium tuberculosis H37Rv
gcugggcgccaccauc

SEQ ID NO: 3260449 - RNA, 22 nt, Mycobacterium tuberculosis H37Rv
gcugggcgccgucgggccugcc

SEQ ID NO: 3260450 - RNA, 17 nt, Mycobacterium tuberculosis H37Rv
gcugggcgcgcucaucg

SEQ ID NO: 3260451 - RNA, 23 nt, Mycobacterium tuberculosis H37Rv
gcuggggaacagcagcgcacugc

SEQ ID NO: 3260452 - RNA, 14 nt, Mycobacterium tuberculosis H37Rv
gcuggggcgcccga

SEQ ID NO: 3260453 - RNA, 13 nt, Mycobacterium tuberculosis H37Rv
gcugggggccggc

SEQ ID NO: 3260454 - RNA, 16 nt, Mycobacterium tuberculosis H37Rv
gcuggggguaccuccc

SEQ ID NO: 3260455 - RNA, 17 nt, Mycobacterium tuberculosis H37Rv
gcugggggucaaucggg

SEQ ID NO: 3260456 - RNA, 18 nt, Mycobacterium tuberculosis H37Rv
gcuggguaugcacccagg

SEQ ID NO: 3260457 - RNA, 23 nt, Mycobacterium tuberculosis H37Rv
gcugggucagguugucggcgauc

SEQ ID NO: 3260458 - RNA, 13 nt, Mycobacterium tuberculosis H37Rv
gcugggucgccgu

SEQ ID NO: 3260459 - RNA, 20 nt, Mycobacterium tuberculosis H37Rv
gcuggguggccaaccaaccg

SEQ ID NO: 3260460 - RNA, 12 nt, Mycobacterium tuberculosis H37Rv
gcugguagcugc

SEQ ID NO: 3260461 - RNA, 20 nt, Mycobacterium tuberculosis H37Rv
gcugguaggucaccggucac

SEQ ID NO: 3260462 - RNA, 23 nt, Mycobacterium tuberculosis H37Rv
gcugguaucgagcaccccgacgu

SEQ ID NO: 3260463 - RNA, 23 nt, Mycobacterium tuberculosis H37Rv
gcuggucaagaucagcgguuugc

SEQ ID NO: 3260464 - RNA, 13 nt, Mycobacterium tuberculosis H37Rv
gcuggucagccgu

SEQ ID NO: 3260465 - RNA, 19 nt, Mycobacterium tuberculosis H37Rv
gcuggucagccgugccgug

SEQ ID NO: 3260466 - RNA, 22 nt, Mycobacterium tuberculosis H37Rv
gcuggucagccgugccguggug

SEQ ID NO: 3260467 - RNA, 15 nt, Mycobacterium tuberculosis H37Rv
gcuggucagguaucg

SEQ ID NO: 3260468 - RNA, 18 nt, Mycobacterium tuberculosis H37Rv
gcuggucaugcggaucac

SEQ ID NO: 3260469 - RNA, 19 nt, Mycobacterium tuberculosis H37Rv
gcugguccaggcggugacg

SEQ ID NO: 3260470 - RNA, 19 nt, Mycobacterium tuberculosis H37Rv
gcugguccuccuucggugg

SEQ ID NO: 3260471 - RNA, 21 nt, Mycobacterium tuberculosis H37Rv
gcugguccuccuucgguggug

SEQ ID NO: 3260472 - RNA, 23 nt, Mycobacterium tuberculosis H37Rv
gcugguccuccuucggugguggg

SEQ ID NO: 3260473 - RNA, 14 nt, Mycobacterium tuberculosis H37Rv
gcugguccuugucg

SEQ ID NO: 3260474 - RNA, 14 nt, Mycobacterium tuberculosis H37Rv
gcuggucggugggc

SEQ ID NO: 3260475 - RNA, 12 nt, Mycobacterium tuberculosis H37Rv
gcuuccguggcc

SEQ ID NO: 3260476 - RNA, 20 nt, Mycobacterium tuberculosis H37Rv
gcuuccguggcccaacccgg

SEQ ID NO: 3260477 - RNA, 17 nt, Mycobacterium tuberculosis H37Rv
gcuuccuccgacgcgau

SEQ ID NO: 3260478 - RNA, 18 nt, Mycobacterium tuberculosis H37Rv
gcuucgaccaucaccacg

SEQ ID NO: 3260479 - RNA, 20 nt, Mycobacterium tuberculosis H37Rv
gcuucgaccgaguaccgaua

SEQ ID NO: 3260480 - RNA, 17 nt, Mycobacterium tuberculosis H37Rv
gcuucgacggcggccaa

SEQ ID NO: 3260481 - RNA, 18 nt, Mycobacterium tuberculosis H37Rv
gcuucgacggcggccaag

SEQ ID NO: 3260482 - RNA, 13 nt, Mycobacterium tuberculosis H37Rv
gcuucgagcaccg

SEQ ID NO: 3260483 - RNA, 13 nt, Mycobacterium tuberculosis H37Rv
gcuucgauagaag

SEQ ID NO: 3260484 - RNA, 17 nt, Mycobacterium tuberculosis H37Rv
gcuucgccaacugcggc

SEQ ID NO: 3260485 - RNA, 16 nt, Mycobacterium tuberculosis H37Rv
gcuucgccacaccaug

SEQ ID NO: 3260486 - RNA, 20 nt, Mycobacterium tuberculosis H37Rv
gcuucgccagguggccgcuc

SEQ ID NO: 3260487 - RNA, 17 nt, Mycobacterium tuberculosis H37Rv
gcuucgcccagagccgc

SEQ ID NO: 3260488 - RNA, 13 nt, Mycobacterium tuberculosis H37Rv
gcuucgcccggcu

SEQ ID NO: 3260489 - RNA, 17 nt, Mycobacterium tuberculosis H37Rv
gcuucgcccggcugcgc

SEQ ID NO: 3260490 - RNA, 16 nt, Mycobacterium tuberculosis H37Rv
gcuucgccgcgcagcc

SEQ ID NO: 3260491 - RNA, 14 nt, Mycobacterium tuberculosis H37Rv
gcuucgcgguuggc

SEQ ID NO: 3260492 - RNA, 21 nt, Mycobacterium tuberculosis H37Rv
gcuucggacuggggcacgcca

SEQ ID NO: 3260493 - RNA, 21 nt, Mycobacterium tuberculosis H37Rv
gcuucggagccgacaacgacg

SEQ ID NO: 3260494 - RNA, 18 nt, Mycobacterium tuberculosis H37Rv
gcuucggcaccgacugcu

SEQ ID NO: 3260495 - RNA, 23 nt, Mycobacterium tuberculosis H37Rv
gcuucggcaccgacugcugucac

SEQ ID NO: 3260496 - RNA, 13 nt, Mycobacterium tuberculosis H37Rv
gcuucggcagacc

SEQ ID NO: 3260497 - RNA, 15 nt, Mycobacterium tuberculosis H37Rv
gcuucggcgaacccu

SEQ ID NO: 3260498 - RNA, 20 nt, Mycobacterium tuberculosis H37Rv
gcuucggcgaacccuccgca

SEQ ID NO: 3260499 - RNA, 15 nt, Mycobacterium tuberculosis H37Rv
gcuucggcggccgag

SEQ ID NO: 3260500 - RNA, 17 nt, Mycobacterium tuberculosis H37Rv
gcuucggcggccgagcg

SEQ ID NO: 3260501 - RNA, 18 nt, Mycobacterium tuberculosis H37Rv
gcuucggcggccgagcgc

SEQ ID NO: 3260502 - RNA, 20 nt, Mycobacterium tuberculosis H37Rv
gcuucggcggccgagcgcac

SEQ ID NO: 3260503 - RNA, 14 nt, Mycobacterium tuberculosis H37Rv
gcuucggcggucag

SEQ ID NO: 3260504 - RNA, 14 nt, Mycobacterium tuberculosis H37Rv
gcuucggcggucgc

SEQ ID NO: 3260505 - RNA, 16 nt, Mycobacterium tuberculosis H37Rv
gcuucggugagcgggc

SEQ ID NO: 3260506 - RNA, 21 nt, Mycobacterium tuberculosis H37Rv
gcuucgguucuguuccagaag

SEQ ID NO: 3260507 - RNA, 15 nt, Mycobacterium tuberculosis H37Rv
gcuucguccaccgcg

SEQ ID NO: 3260508 - RNA, 17 nt, Mycobacterium tuberculosis H37Rv
gcuucgucggccagcag

SEQ ID NO: 3260509 - RNA, 20 nt, Mycobacterium tuberculosis H37Rv
gcuucgucggccagcagcaa

SEQ ID NO: 3260510 - RNA, 21 nt, Mycobacterium tuberculosis H37Rv
gcuucgucggccggcacccca

SEQ ID NO: 3260511 - RNA, 22 nt, Mycobacterium tuberculosis H37Rv
gcuucgucggccggcaccccac

SEQ ID NO: 3260512 - RNA, 19 nt, Mycobacterium tuberculosis H37Rv
gcuucucccgccacugcug

SEQ ID NO: 3260513 - RNA, 12 nt, Mycobacterium tuberculosis H37Rv
gcuucuccucca

SEQ ID NO: 3260514 - RNA, 16 nt, Mycobacterium tuberculosis H37Rv
gcuucuccuccagaga

SEQ ID NO: 3260515 - RNA, 17 nt, Mycobacterium tuberculosis H37Rv
gcuucuccuccagagac

SEQ ID NO: 3260516 - RNA, 21 nt, Mycobacterium tuberculosis H37Rv
gcuucugggcuuucugcaccc

SEQ ID NO: 3260517 - RNA, 22 nt, Mycobacterium tuberculosis H37Rv
gcuucugggguuggcucggcgc

SEQ ID NO: 3260518 - RNA, 18 nt, Mycobacterium tuberculosis H37Rv
gcuucuuaccgcgggccg

SEQ ID NO: 3260519 - RNA, 21 nt, Mycobacterium tuberculosis H37Rv
gcuucuuaccgcgggccgcca

SEQ ID NO: 3260520 - RNA, 22 nt, Mycobacterium tuberculosis H37Rv
gcuucuucggucaccucgaugc

SEQ ID NO: 3260521 - RNA, 20 nt, Mycobacterium tuberculosis H37Rv
gcuucuuguggauuguccga

SEQ ID NO: 3260522 - RNA, 16 nt, Mycobacterium tuberculosis H37Rv
gcuugaaauagucuuc

SEQ ID NO: 3260523 - RNA, 17 nt, Mycobacterium tuberculosis H37Rv
gcuugaaauagucuucu

SEQ ID NO: 3260524 - RNA, 23 nt, Mycobacterium tuberculosis H37Rv
gcuugaacgcauacagcgcccgg

SEQ ID NO: 3260525 - RNA, 16 nt, Mycobacterium tuberculosis H37Rv
gcuugacaacccuguu

SEQ ID NO: 3260526 - RNA, 15 nt, Mycobacterium tuberculosis H37Rv
gcuugacaucgguca

SEQ ID NO: 3260527 - RNA, 15 nt, Mycobacterium tuberculosis H37Rv
gcuugaccccgccga

SEQ ID NO: 3260528 - RNA, 15 nt, Mycobacterium tuberculosis H37Rv
gcuugacugcacacc

SEQ ID NO: 3260529 - RNA, 17 nt, Mycobacterium tuberculosis H37Rv
gcuugacugcacaccac

SEQ ID NO: 3260530 - RNA, 22 nt, Mycobacterium tuberculosis H37Rv
gcuugagcacacguccggcgau

SEQ ID NO: 3260531 - RNA, 17 nt, Mycobacterium tuberculosis H37Rv
gcuugaguuucggcgca

SEQ ID NO: 3260532 - RNA, 21 nt, Mycobacterium tuberculosis H37Rv
gcuugaucugggcugcggccg

SEQ ID NO: 3260533 - RNA, 17 nt, Mycobacterium tuberculosis H37Rv
gcuugcaggcgaucugg

SEQ ID NO: 3260534 - RNA, 17 nt, Mycobacterium tuberculosis H37Rv
gcuugcauugaggggcg

SEQ ID NO: 3260535 - RNA, 13 nt, Mycobacterium tuberculosis H37Rv
gcuugccccgccu

SEQ ID NO: 3260536 - RNA, 14 nt, Mycobacterium tuberculosis H37Rv
gcuugccgaccugc

SEQ ID NO: 3260537 - RNA, 21 nt, Mycobacterium tuberculosis H37Rv
gcuugcgaucggcacuuagcc

SEQ ID NO: 3260538 - RNA, 19 nt, Mycobacterium tuberculosis H37Rv
gcuugcgcagcaccgguca

SEQ ID NO: 3260539 - RNA, 15 nt, Mycobacterium tuberculosis H37Rv
gcuugcgcagcagcg

SEQ ID NO: 3260540 - RNA, 17 nt, Mycobacterium tuberculosis H37Rv
gcuugcgcagccgcagc

SEQ ID NO: 3260541 - RNA, 15 nt, Mycobacterium tuberculosis H37Rv
gcuugcgccgcagcg

SEQ ID NO: 3260542 - RNA, 15 nt, Mycobacterium tuberculosis H37Rv
gcuugcgccggauga

SEQ ID NO: 3260543 - RNA, 18 nt, Mycobacterium tuberculosis H37Rv
gcuugcgcgagcagacgc

SEQ ID NO: 3260544 - RNA, 15 nt, Mycobacterium tuberculosis H37Rv
gcuugcgcguggcag

SEQ ID NO: 3260545 - RNA, 13 nt, Mycobacterium tuberculosis H37Rv
gcuugcggcacaa

SEQ ID NO: 3260546 - RNA, 14 nt, Mycobacterium tuberculosis H37Rv
gcuugcggcaccca

SEQ ID NO: 3260547 - RNA, 23 nt, Mycobacterium tuberculosis H37Rv
gcuugcgggggaguagugguggg

SEQ ID NO: 3260548 - RNA, 19 nt, Mycobacterium tuberculosis H37Rv
gcuuggagaucgccgccgg

SEQ ID NO: 3260549 - RNA, 15 nt, Mycobacterium tuberculosis H37Rv
gcuuggccgccgcca

SEQ ID NO: 3260550 - RNA, 14 nt, Mycobacterium tuberculosis H37Rv
gcuuggccgcgcag

SEQ ID NO: 3260551 - RNA, 14 nt, Mycobacterium tuberculosis H37Rv
gcuuggccuaugcu

SEQ ID NO: 3260552 - RNA, 17 nt, Mycobacterium tuberculosis H37Rv
gcuuggccucagccacc

SEQ ID NO: 3260553 - RNA, 23 nt, Mycobacterium tuberculosis H37Rv
gcuuggcgacgaugcaggugaca

SEQ ID NO: 3260554 - RNA, 21 nt, Mycobacterium tuberculosis H37Rv
gcuuggcgaucucaccuggag

SEQ ID NO: 3260555 - RNA, 19 nt, Mycobacterium tuberculosis H37Rv
gcuuggcgccgaugccggc

SEQ ID NO: 3260556 - RNA, 22 nt, Mycobacterium tuberculosis H37Rv
gcuuggcggcgaucaacucggg

SEQ ID NO: 3260557 - RNA, 13 nt, Mycobacterium tuberculosis H37Rv
gcuuggcgggacc

SEQ ID NO: 3260558 - RNA, 13 nt, Mycobacterium tuberculosis H37Rv
gcuuggcgucggc

SEQ ID NO: 3260559 - RNA, 15 nt, Mycobacterium tuberculosis H37Rv
gcuuggcgugaccua

SEQ ID NO: 3260560 - RNA, 16 nt, Mycobacterium tuberculosis H37Rv
gcuuggcgugaccuac

SEQ ID NO: 3260561 - RNA, 21 nt, Mycobacterium tuberculosis H37Rv
gcuuggcgugaccuaccuccu

SEQ ID NO: 3260562 - RNA, 15 nt, Mycobacterium tuberculosis H37Rv
gcuuggcuuggccgu

SEQ ID NO: 3260563 - RNA, 14 nt, Mycobacterium tuberculosis H37Rv
gcuugggccccuug

SEQ ID NO: 3260564 - RNA, 22 nt, Mycobacterium tuberculosis H37Rv
gcuuggggccggaugucgacga

SEQ ID NO: 3260565 - RNA, 18 nt, Mycobacterium tuberculosis H37Rv
gcuuggucgcccagccac

SEQ ID NO: 3260566 - RNA, 22 nt, Mycobacterium tuberculosis H37Rv
gcuuggugaacguuuccagcug

SEQ ID NO: 3260567 - RNA, 19 nt, Mycobacterium tuberculosis H37Rv
gcuugguggcguggcccuc

SEQ ID NO: 3260568 - RNA, 22 nt, Mycobacterium tuberculosis H37Rv
gcuugguggucuuggccggugc

SEQ ID NO: 3260569 - RNA, 18 nt, Mycobacterium tuberculosis H37Rv
gcuuguacgaacugcuga

SEQ ID NO: 3260570 - RNA, 18 nt, Mycobacterium tuberculosis H37Rv
gcuuguagcgcaucgcca

SEQ ID NO: 3260571 - RNA, 13 nt, Mycobacterium tuberculosis H37Rv
ggaagcggcggcc

SEQ ID NO: 3260572 - RNA, 18 nt, Mycobacterium tuberculosis H37Rv
ggaagcgggauugccgag

SEQ ID NO: 3260573 - RNA, 21 nt, Mycobacterium tuberculosis H37Rv
ggaagcgguugacccacagca

SEQ ID NO: 3260574 - RNA, 13 nt, Mycobacterium tuberculosis H37Rv
ggaagcgugcggu

SEQ ID NO: 3260575 - RNA, 15 nt, Mycobacterium tuberculosis H37Rv
ggaaggaaccgggca

SEQ ID NO: 3260576 - RNA, 19 nt, Mycobacterium tuberculosis H37Rv
ggaaggcccaccauggcug

SEQ ID NO: 3260577 - RNA, 14 nt, Mycobacterium tuberculosis H37Rv
ggaaggcggccagg

SEQ ID NO: 3260578 - RNA, 17 nt, Mycobacterium tuberculosis H37Rv
ggaaggcucaccacggu

SEQ ID NO: 3260579 - RNA, 15 nt, Mycobacterium tuberculosis H37Rv
ggaaggucagcgccc

SEQ ID NO: 3260580 - RNA, 19 nt, Mycobacterium tuberculosis H37Rv
ggaaguaaggcacgggugu

SEQ ID NO: 3260581 - RNA, 22 nt, Mycobacterium tuberculosis H37Rv
ggaaguacuccacccaggccga

SEQ ID NO: 3260582 - RNA, 15 nt, Mycobacterium tuberculosis H37Rv
ggaaguagccgagcc

SEQ ID NO: 3260583 - RNA, 15 nt, Mycobacterium tuberculosis H37Rv
ggaagugcaccugga

SEQ ID NO: 3260584 - RNA, 12 nt, Mycobacterium tuberculosis H37Rv
ggaagugcggug

SEQ ID NO: 3260585 - RNA, 20 nt, Mycobacterium tuberculosis H37Rv
ggaagugcggugagauggcg

SEQ ID NO: 3260586 - RNA, 14 nt, Mycobacterium tuberculosis H37Rv
ggaaguucgucggu

SEQ ID NO: 3260587 - RNA, 23 nt, Mycobacterium tuberculosis H37Rv
ggaaguugaucuugccgcccuug

SEQ ID NO: 3260588 - RNA, 13 nt, Mycobacterium tuberculosis H37Rv
ggaauacagcuug

SEQ ID NO: 3260589 - RNA, 13 nt, Mycobacterium tuberculosis H37Rv
ggaauacgcgguu

SEQ ID NO: 3260590 - RNA, 14 nt, Mycobacterium tuberculosis H37Rv
ggaauacgcgguua

SEQ ID NO: 3260591 - RNA, 23 nt, Mycobacterium tuberculosis H37Rv
ggaauacgcugcuggucuugccg

SEQ ID NO: 3260592 - RNA, 20 nt, Mycobacterium tuberculosis H37Rv
ggaauagcaacgcugcagca

SEQ ID NO: 3260593 - RNA, 22 nt, Mycobacterium tuberculosis H37Rv
ggaaucaccgaaugcacgacgg

SEQ ID NO: 3260594 - RNA, 16 nt, Mycobacterium tuberculosis H37Rv
ggaaucccgagucugc

SEQ ID NO: 3260595 - RNA, 19 nt, Mycobacterium tuberculosis H37Rv
ggaauccgaacgcgauccg

SEQ ID NO: 3260596 - RNA, 21 nt, Mycobacterium tuberculosis H37Rv
ggaaucggcggcggauucggu

SEQ ID NO: 3260597 - RNA, 15 nt, Mycobacterium tuberculosis H37Rv
ggaaucgucgcggcc

SEQ ID NO: 3260598 - RNA, 20 nt, Mycobacterium tuberculosis H37Rv
ggaaucgucgcggccgucgc

SEQ ID NO: 3260599 - RNA, 13 nt, Mycobacterium tuberculosis H37Rv
ggaaucguucggg

SEQ ID NO: 3260600 - RNA, 18 nt, Mycobacterium tuberculosis H37Rv
ggaaugcccgagcaggac

SEQ ID NO: 3260601 - RNA, 17 nt, Mycobacterium tuberculosis H37Rv
ggaaugggcgccacagc

SEQ ID NO: 3260602 - RNA, 20 nt, Mycobacterium tuberculosis H37Rv
ggaaugggucguugccggac

SEQ ID NO: 3260603 - RNA, 14 nt, Mycobacterium tuberculosis H37Rv
ggaauggucccggg

SEQ ID NO: 3260604 - RNA, 18 nt, Mycobacterium tuberculosis H37Rv
ggaauuccccaccgucgu

SEQ ID NO: 3260605 - RNA, 19 nt, Mycobacterium tuberculosis H37Rv
ggaauuccgcuaccgcaca

SEQ ID NO: 3260606 - RNA, 17 nt, Mycobacterium tuberculosis H37Rv
ggaauucgaucuggcgg

SEQ ID NO: 3260607 - RNA, 14 nt, Mycobacterium tuberculosis H37Rv
ggacaaaagaacgc

SEQ ID NO: 3260608 - RNA, 20 nt, Mycobacterium tuberculosis H37Rv
ggacaaaaucagcagccccc

SEQ ID NO: 3260609 - RNA, 18 nt, Mycobacterium tuberculosis H37Rv
ggacaaacaucgcaccca

SEQ ID NO: 3260610 - RNA, 14 nt, Mycobacterium tuberculosis H37Rv
ggacaaagcugcuc

SEQ ID NO: 3260611 - RNA, 16 nt, Mycobacterium tuberculosis H37Rv
ggacaaagcugcucgu

SEQ ID NO: 3260612 - RNA, 22 nt, Mycobacterium tuberculosis H37Rv
ggacaacaagaugccugacacg

SEQ ID NO: 3260613 - RNA, 14 nt, Mycobacterium tuberculosis H37Rv
ggacaacacggcga

SEQ ID NO: 3260614 - RNA, 13 nt, Mycobacterium tuberculosis H37Rv
ggacaacagcaug

SEQ ID NO: 3260615 - RNA, 19 nt, Mycobacterium tuberculosis H37Rv
ggacaaccgcgccgacaga

SEQ ID NO: 3260616 - RNA, 15 nt, Mycobacterium tuberculosis H37Rv
ggacaaccucgucga

SEQ ID NO: 3260617 - RNA, 19 nt, Mycobacterium tuberculosis H37Rv
ggacaaccuggggccacca

SEQ ID NO: 3260618 - RNA, 20 nt, Mycobacterium tuberculosis H37Rv
ggacaacgugccgaacgcca

SEQ ID NO: 3260619 - RNA, 22 nt, Mycobacterium tuberculosis H37Rv
ggacaacgugccgaacgccaga

SEQ ID NO: 3260620 - RNA, 20 nt, Mycobacterium tuberculosis H37Rv
ggacaagcacagcgaacaga

SEQ ID NO: 3260621 - RNA, 13 nt, Mycobacterium tuberculosis H37Rv
ggacaagcuccuc

SEQ ID NO: 3260622 - RNA, 18 nt, Mycobacterium tuberculosis H37Rv
ggacaagugccggcgcgg

SEQ ID NO: 3260623 - RNA, 14 nt, Mycobacterium tuberculosis H37Rv
ggacacacaggcgg

SEQ ID NO: 3260624 - RNA, 18 nt, Mycobacterium tuberculosis H37Rv
ggacacagcguccgucgu

SEQ ID NO: 3260625 - RNA, 19 nt, Mycobacterium tuberculosis H37Rv
ggacacagcguccgucguc

SEQ ID NO: 3260626 - RNA, 17 nt, Mycobacterium tuberculosis H37Rv
ggacacauugaccaggu

SEQ ID NO: 3260627 - RNA, 20 nt, Mycobacterium tuberculosis H37Rv
ggacaccaacccacccccca

SEQ ID NO: 3260628 - RNA, 15 nt, Mycobacterium tuberculosis H37Rv
ggacaccaccguggc

SEQ ID NO: 3260629 - RNA, 13 nt, Mycobacterium tuberculosis H37Rv
ggacaccagccag

SEQ ID NO: 3260630 - RNA, 19 nt, Mycobacterium tuberculosis H37Rv
ggacaccaucuccgccguc

SEQ ID NO: 3260631 - RNA, 16 nt, Mycobacterium tuberculosis H37Rv
ggacaccccgcacgga

SEQ ID NO: 3260632 - RNA, 15 nt, Mycobacterium tuberculosis H37Rv
ggacaccgcggcgau

SEQ ID NO: 3260633 - RNA, 16 nt, Mycobacterium tuberculosis H37Rv
ggacaccgcggcgauc

SEQ ID NO: 3260634 - RNA, 16 nt, Mycobacterium tuberculosis H37Rv
ggacaccggcaccacg

SEQ ID NO: 3260635 - RNA, 22 nt, Mycobacterium tuberculosis H37Rv
ggacaccuaccgagaucaccgc

SEQ ID NO: 3260636 - RNA, 14 nt, Mycobacterium tuberculosis H37Rv
ggacaccugcugca

SEQ ID NO: 3260637 - RNA, 13 nt, Mycobacterium tuberculosis H37Rv
ggacacuccugca

SEQ ID NO: 3260638 - RNA, 21 nt, Mycobacterium tuberculosis H37Rv
ggacacuccugcacacaggac

SEQ ID NO: 3260639 - RNA, 20 nt, Mycobacterium tuberculosis H37Rv
ggacagaugcauccagcugc

SEQ ID NO: 3260640 - RNA, 15 nt, Mycobacterium tuberculosis H37Rv
ggacagauggcggcc

SEQ ID NO: 3260641 - RNA, 11 nt, Mycobacterium tuberculosis H37Rv
ggacagcagcc

SEQ ID NO: 3260642 - RNA, 23 nt, Mycobacterium tuberculosis H37Rv
ggacagcaucacgaucacgucgu

SEQ ID NO: 3260643 - RNA, 24 nt, Mycobacterium tuberculosis H37Rv
ggacagcccggacgcgcggauggc

SEQ ID NO: 3260644 - RNA, 14 nt, Mycobacterium tuberculosis H37Rv
ggacagcgcaucca

SEQ ID NO: 3260645 - RNA, 11 nt, Mycobacterium tuberculosis H37Rv
ggacagcgccu

SEQ ID NO: 3260646 - RNA, 20 nt, Mycobacterium tuberculosis H37Rv
ggacagcgcgagaucagccg

SEQ ID NO: 3260647 - RNA, 19 nt, Mycobacterium tuberculosis H37Rv
ggacagcguaucucccaac

SEQ ID NO: 3260648 - RNA, 13 nt, Mycobacterium tuberculosis H37Rv
ggacagggcggcg

SEQ ID NO: 3260649 - RNA, 14 nt, Mycobacterium tuberculosis H37Rv
ggacagggugcgcu

SEQ ID NO: 3260650 - RNA, 17 nt, Mycobacterium tuberculosis H37Rv
ggacagguaacgcgguu

SEQ ID NO: 3260651 - RNA, 16 nt, Mycobacterium tuberculosis H37Rv
ggacagguagucgccg

SEQ ID NO: 3260652 - RNA, 21 nt, Mycobacterium tuberculosis H37Rv
ggacaggucgaaugggggcug

SEQ ID NO: 3260653 - RNA, 15 nt, Mycobacterium tuberculosis H37Rv
ggacaggucgcccaa

SEQ ID NO: 3260654 - RNA, 18 nt, Mycobacterium tuberculosis H37Rv
ggacaggucgcccaacac

SEQ ID NO: 3260655 - RNA, 23 nt, Mycobacterium tuberculosis H37Rv
ggacaggucgggcccccggcagc

SEQ ID NO: 3260656 - RNA, 12 nt, Mycobacterium tuberculosis H37Rv
ggacaucaccgc

SEQ ID NO: 3260657 - RNA, 13 nt, Mycobacterium tuberculosis H37Rv
ggacaucaccgca

SEQ ID NO: 3260658 - RNA, 16 nt, Mycobacterium tuberculosis H37Rv
ggacauccagugcggu

SEQ ID NO: 3260659 - RNA, 14 nt, Mycobacterium tuberculosis H37Rv
ggacauccgaugcg

SEQ ID NO: 3260660 - RNA, 23 nt, Mycobacterium tuberculosis H37Rv
ggacauccgaugcgucacaccac

SEQ ID NO: 3260661 - RNA, 20 nt, Mycobacterium tuberculosis H37Rv
ggacauccgcuuacgggugu

SEQ ID NO: 3260662 - RNA, 21 nt, Mycobacterium tuberculosis H37Rv
ggacauccgcuuacggguguc

SEQ ID NO: 3260663 - RNA, 18 nt, Mycobacterium tuberculosis H37Rv
ggacauccgggccgagcg

SEQ ID NO: 3260664 - RNA, 20 nt, Mycobacterium tuberculosis H37Rv
ggacauccgggccgagcgca

SEQ ID NO: 3260665 - RNA, 22 nt, Mycobacterium tuberculosis H37Rv
ggacauccgggccgagcgcacc

SEQ ID NO: 3260666 - RNA, 16 nt, Mycobacterium tuberculosis H37Rv
ggacaucggccggcgu

SEQ ID NO: 3260667 - RNA, 13 nt, Mycobacterium tuberculosis H37Rv
ggacggucgccag

SEQ ID NO: 3260668 - RNA, 14 nt, Mycobacterium tuberculosis H37Rv
ggacggucgcucgg

SEQ ID NO: 3260669 - RNA, 18 nt, Mycobacterium tuberculosis H37Rv
ggacggucgcucggcaug

SEQ ID NO: 3260670 - RNA, 13 nt, Mycobacterium tuberculosis H37Rv
ggacggugaaacc

SEQ ID NO: 3260671 - RNA, 18 nt, Mycobacterium tuberculosis H37Rv
ggacggugaaaccggccu

SEQ ID NO: 3260672 - RNA, 16 nt, Mycobacterium tuberculosis H37Rv
ggacggugcggucaga

SEQ ID NO: 3260673 - RNA, 21 nt, Mycobacterium tuberculosis H37Rv
ggacgguguacaggucgccgg

SEQ ID NO: 3260674 - RNA, 13 nt, Mycobacterium tuberculosis H37Rv
ggacggugucagc

SEQ ID NO: 3260675 - RNA, 14 nt, Mycobacterium tuberculosis H37Rv
ggacggugucagcc

SEQ ID NO: 3260676 - RNA, 17 nt, Mycobacterium tuberculosis H37Rv
ggacgguugagaugguc

SEQ ID NO: 3260677 - RNA, 20 nt, Mycobacterium tuberculosis H37Rv
ggacguacugucgucgcccu

SEQ ID NO: 3260678 - RNA, 14 nt, Mycobacterium tuberculosis H37Rv
ggacgucaccguca

SEQ ID NO: 3260679 - RNA, 23 nt, Mycobacterium tuberculosis H37Rv
ggacgucaccgucaguucggugu

SEQ ID NO: 3260680 - RNA, 15 nt, Mycobacterium tuberculosis H37Rv
ggacgucggcgaauc

SEQ ID NO: 3260681 - RNA, 17 nt, Mycobacterium tuberculosis H37Rv
ggacgucuccaccgcga

SEQ ID NO: 3260682 - RNA, 18 nt, Mycobacterium tuberculosis H37Rv
ggacgugacgucguggcg

SEQ ID NO: 3260683 - RNA, 21 nt, Mycobacterium tuberculosis H37Rv
ggacguggacuuuggugucgc

SEQ ID NO: 3260684 - RNA, 14 nt, Mycobacterium tuberculosis H37Rv
ggacguucuggauc

SEQ ID NO: 3260685 - RNA, 15 nt, Mycobacterium tuberculosis H37Rv
ggacguuucagccgg

SEQ ID NO: 3260686 - RNA, 16 nt, Mycobacterium tuberculosis H37Rv
ggacguuucagccggg

SEQ ID NO: 3260687 - RNA, 12 nt, Mycobacterium tuberculosis H37Rv
ggacucgccgac

SEQ ID NO: 3260688 - RNA, 17 nt, Mycobacterium tuberculosis H37Rv
ggacucgggcaggcccc

SEQ ID NO: 3260689 - RNA, 15 nt, Mycobacterium tuberculosis H37Rv
ggacucuucggaccg

SEQ ID NO: 3260690 - RNA, 18 nt, Mycobacterium tuberculosis H37Rv
ggacugaacaguugcaca

SEQ ID NO: 3260691 - RNA, 13 nt, Mycobacterium tuberculosis H37Rv
ggacugaagagca

SEQ ID NO: 3260692 - RNA, 15 nt, Mycobacterium tuberculosis H37Rv
ggacugaccucguca

SEQ ID NO: 3260693 - RNA, 11 nt, Mycobacterium tuberculosis H37Rv
ggacugcagcg

SEQ ID NO: 3260694 - RNA, 16 nt, Mycobacterium tuberculosis H37Rv
ggacugcagcgcggug

SEQ ID NO: 3260695 - RNA, 18 nt, Mycobacterium tuberculosis H37Rv
ggacugcggacacguugc

SEQ ID NO: 3260696 - RNA, 17 nt, Mycobacterium tuberculosis H37Rv
ggacuggcaccgccagc

SEQ ID NO: 3260697 - RNA, 21 nt, Mycobacterium tuberculosis H37Rv
ggacuggcaccgccagccacc

SEQ ID NO: 3260698 - RNA, 16 nt, Mycobacterium tuberculosis H37Rv
ggacugucccaccagg

SEQ ID NO: 3260699 - RNA, 18 nt, Mycobacterium tuberculosis H37Rv
ggacugucccaccaggua

SEQ ID NO: 3260700 - RNA, 14 nt, Mycobacterium tuberculosis H37Rv
ggacuucgggggcc

SEQ ID NO: 3260701 - RNA, 17 nt, Mycobacterium tuberculosis H37Rv
ggacuugauaucggcgg

SEQ ID NO: 3260702 - RNA, 22 nt, Mycobacterium tuberculosis H37Rv
ggagaacacgucgacaccgagg

SEQ ID NO: 3260703 - RNA, 17 nt, Mycobacterium tuberculosis H37Rv
ggagaacgggucgacgu

SEQ ID NO: 3260704 - RNA, 20 nt, Mycobacterium tuberculosis H37Rv
ggagaagauuuucucggugc

SEQ ID NO: 3260705 - RNA, 24 nt, Mycobacterium tuberculosis H37Rv
ggagaaguucgugagcgaacgggc

SEQ ID NO: 3260706 - RNA, 19 nt, Mycobacterium tuberculosis H37Rv
ggagacacccgccaggccg

SEQ ID NO: 3260707 - RNA, 19 nt, Mycobacterium tuberculosis H37Rv
ggagacaccgcaacgcgug

SEQ ID NO: 3260708 - RNA, 13 nt, Mycobacterium tuberculosis H37Rv
ggagaccagcguc

SEQ ID NO: 3260709 - RNA, 14 nt, Mycobacterium tuberculosis H37Rv
ggagacccgggugc

SEQ ID NO: 3260710 - RNA, 23 nt, Mycobacterium tuberculosis H37Rv
ggagacgagcacaagauccgcca

SEQ ID NO: 3260711 - RNA, 18 nt, Mycobacterium tuberculosis H37Rv
ggagacgaucgccaggcc

SEQ ID NO: 3260712 - RNA, 23 nt, Mycobacterium tuberculosis H37Rv
ggagagccgguagaucagcgccu

SEQ ID NO: 3260713 - RNA, 17 nt, Mycobacterium tuberculosis H37Rv
ggagauaccgaccaucg

SEQ ID NO: 3260714 - RNA, 14 nt, Mycobacterium tuberculosis H37Rv
ggagaucaccucgg

SEQ ID NO: 3260715 - RNA, 18 nt, Mycobacterium tuberculosis H37Rv
ggagauccaccgguccag

SEQ ID NO: 3260716 - RNA, 16 nt, Mycobacterium tuberculosis H37Rv
ggagauccagggccuu

SEQ ID NO: 3260717 - RNA, 14 nt, Mycobacterium tuberculosis H37Rv
ggagaucgucgcca

SEQ ID NO: 3260718 - RNA, 16 nt, Mycobacterium tuberculosis H37Rv
ggagaucucguccaga

SEQ ID NO: 3260719 - RNA, 21 nt, Mycobacterium tuberculosis H37Rv
ggagaugaucaugugguggcg

SEQ ID NO: 3260720 - RNA, 20 nt, Mycobacterium tuberculosis H37Rv
ggagauguaguccucggugg

SEQ ID NO: 3260721 - RNA, 13 nt, Mycobacterium tuberculosis H37Rv
ggagccagaaugc

SEQ ID NO: 3260722 - RNA, 16 nt, Mycobacterium tuberculosis H37Rv
ggagccaggacgacgc

SEQ ID NO: 3260723 - RNA, 21 nt, Mycobacterium tuberculosis H37Rv
ggagccccagguagucgacca

SEQ ID NO: 3260724 - RNA, 21 nt, Mycobacterium tuberculosis H37Rv
ggagcccgagcucaccgcaca

SEQ ID NO: 3260725 - RNA, 16 nt, Mycobacterium tuberculosis H37Rv
ggagcccguccaggcc

SEQ ID NO: 3260726 - RNA, 17 nt, Mycobacterium tuberculosis H37Rv
ggagccgaggugcugca

SEQ ID NO: 3260727 - RNA, 15 nt, Mycobacterium tuberculosis H37Rv
ggagccgcccaagcc

SEQ ID NO: 3260728 - RNA, 22 nt, Mycobacterium tuberculosis H37Rv
ggagccgcccaagccgccggcg

SEQ ID NO: 3260729 - RNA, 19 nt, Mycobacterium tuberculosis H37Rv
ggagccgccggccccgcca

SEQ ID NO: 3260730 - RNA, 13 nt, Mycobacterium tuberculosis H37Rv
ggagccggccacc

SEQ ID NO: 3260731 - RNA, 22 nt, Mycobacterium tuberculosis H37Rv
ggagccggccaccucggugcgg

SEQ ID NO: 3260732 - RNA, 22 nt, Mycobacterium tuberculosis H37Rv
ggagccgggccguccggguaga

SEQ ID NO: 3260733 - RNA, 15 nt, Mycobacterium tuberculosis H37Rv
ggagccgucgcauca

SEQ ID NO: 3260734 - RNA, 18 nt, Mycobacterium tuberculosis H37Rv
ggagccgucgcaucaggu

SEQ ID NO: 3260735 - RNA, 13 nt, Mycobacterium tuberculosis H37Rv
ggagccgugcggu

SEQ ID NO: 3260736 - RNA, 22 nt, Mycobacterium tuberculosis H37Rv
ggagccgugcggucgcgcccuc

SEQ ID NO: 3260737 - RNA, 23 nt, Mycobacterium tuberculosis H37Rv
ggagccgugcggucgcgcccuca

SEQ ID NO: 3260738 - RNA, 13 nt, Mycobacterium tuberculosis H37Rv
ggagccuccagcg

SEQ ID NO: 3260739 - RNA, 12 nt, Mycobacterium tuberculosis H37Rv
ggagccucgacc

SEQ ID NO: 3260740 - RNA, 20 nt, Mycobacterium tuberculosis H37Rv
ggagccuugguagccggccg

SEQ ID NO: 3260741 - RNA, 23 nt, Mycobacterium tuberculosis H37Rv
ggagcgcaaguugagcagcuugg

SEQ ID NO: 3260742 - RNA, 17 nt, Mycobacterium tuberculosis H37Rv
ggagcgcagcgccggca

SEQ ID NO: 3260743 - RNA, 15 nt, Mycobacterium tuberculosis H37Rv
ggagcgccagccgcu

SEQ ID NO: 3260744 - RNA, 13 nt, Mycobacterium tuberculosis H37Rv
ggagcgcccggcu

SEQ ID NO: 3260745 - RNA, 16 nt, Mycobacterium tuberculosis H37Rv
ggagcgcccggcugau

SEQ ID NO: 3260746 - RNA, 21 nt, Mycobacterium tuberculosis H37Rv
ggagcgcgaugaccucggcga

SEQ ID NO: 3260747 - RNA, 18 nt, Mycobacterium tuberculosis H37Rv
ggagcgcgccucgcccag

SEQ ID NO: 3260748 - RNA, 20 nt, Mycobacterium tuberculosis H37Rv
ggagcgcgccucgcccagca

SEQ ID NO: 3260749 - RNA, 13 nt, Mycobacterium tuberculosis H37Rv
ggagcggccgccg

SEQ ID NO: 3260750 - RNA, 15 nt, Mycobacterium tuberculosis H37Rv
ggagcggcgcggggg

SEQ ID NO: 3260751 - RNA, 13 nt, Mycobacterium tuberculosis H37Rv
ggagcggcucgcg

SEQ ID NO: 3260752 - RNA, 12 nt, Mycobacterium tuberculosis H37Rv
ggagcggcugca

SEQ ID NO: 3260753 - RNA, 13 nt, Mycobacterium tuberculosis H37Rv
ggagcggcugcac

SEQ ID NO: 3260754 - RNA, 15 nt, Mycobacterium tuberculosis H37Rv
ggagcggcugcggca

SEQ ID NO: 3260755 - RNA, 17 nt, Mycobacterium tuberculosis H37Rv
ggagcggcugcggcaac

SEQ ID NO: 3260756 - RNA, 16 nt, Mycobacterium tuberculosis H37Rv
ggagcggcuugcggug

SEQ ID NO: 3260757 - RNA, 18 nt, Mycobacterium tuberculosis H37Rv
ggagcggcuugcgguggc

SEQ ID NO: 3260758 - RNA, 13 nt, Mycobacterium tuberculosis H37Rv
ggagcgggccagc

SEQ ID NO: 3260759 - RNA, 14 nt, Mycobacterium tuberculosis H37Rv
ggagcgggccagca

SEQ ID NO: 3260760 - RNA, 16 nt, Mycobacterium tuberculosis H37Rv
ggagcgggccagcacc

SEQ ID NO: 3260761 - RNA, 17 nt, Mycobacterium tuberculosis H37Rv
ggagcgggccagcaccc

SEQ ID NO: 3260762 - RNA, 14 nt, Mycobacterium tuberculosis H37Rv
ggagcgggugcggg

SEQ ID NO: 3260763 - RNA, 16 nt, Mycobacterium tuberculosis H37Rv
ggagcgggugcgggcg

SEQ ID NO: 3260764 - RNA, 18 nt, Mycobacterium tuberculosis H37Rv
ggauccgaagagccagca

SEQ ID NO: 3260765 - RNA, 16 nt, Mycobacterium tuberculosis H37Rv
ggauccgauccgcaca

SEQ ID NO: 3260766 - RNA, 16 nt, Mycobacterium tuberculosis H37Rv
ggauccgcaccacgcc

SEQ ID NO: 3260767 - RNA, 17 nt, Mycobacterium tuberculosis H37Rv
ggauccggaggcggcuc

SEQ ID NO: 3260768 - RNA, 17 nt, Mycobacterium tuberculosis H37Rv
ggauccggcagcagccg

SEQ ID NO: 3260769 - RNA, 15 nt, Mycobacterium tuberculosis H37Rv
ggauccgggagucga

SEQ ID NO: 3260770 - RNA, 18 nt, Mycobacterium tuberculosis H37Rv
ggauccuccggguuggcg

SEQ ID NO: 3260771 - RNA, 22 nt, Mycobacterium tuberculosis H37Rv
ggauccuccggguuggcgacga

SEQ ID NO: 3260772 - RNA, 21 nt, Mycobacterium tuberculosis H37Rv
ggauccucggccgccaucgcc

SEQ ID NO: 3260773 - RNA, 20 nt, Mycobacterium tuberculosis H37Rv
ggaucgacaguugcgccagc

SEQ ID NO: 3260774 - RNA, 21 nt, Mycobacterium tuberculosis H37Rv
ggaucgaccaauucgaccgcg

SEQ ID NO: 3260775 - RNA, 14 nt, Mycobacterium tuberculosis H37Rv
ggaucgaccgccag

SEQ ID NO: 3260776 - RNA, 19 nt, Mycobacterium tuberculosis H37Rv
ggaucgacgucgcggcgcc

SEQ ID NO: 3260777 - RNA, 20 nt, Mycobacterium tuberculosis H37Rv
ggaucgagagccgaccgggu

SEQ ID NO: 3260778 - RNA, 16 nt, Mycobacterium tuberculosis H37Rv
ggaucgaguugcggug

SEQ ID NO: 3260779 - RNA, 16 nt, Mycobacterium tuberculosis H37Rv
ggaucgaucugcggag

SEQ ID NO: 3260780 - RNA, 13 nt, Mycobacterium tuberculosis H37Rv
ggaucgcagcgcc

SEQ ID NO: 3260781 - RNA, 15 nt, Mycobacterium tuberculosis H37Rv
ggaucgccaccggcg

SEQ ID NO: 3260782 - RNA, 12 nt, Mycobacterium tuberculosis H37Rv
ggaucgccacgg

SEQ ID NO: 3260783 - RNA, 13 nt, Mycobacterium tuberculosis H37Rv
ggaucgccaggcc

SEQ ID NO: 3260784 - RNA, 15 nt, Mycobacterium tuberculosis H37Rv
ggaucgcccaggcgc

SEQ ID NO: 3260785 - RNA, 17 nt, Mycobacterium tuberculosis H37Rv
ggaucgccgaaucggca

SEQ ID NO: 3260786 - RNA, 17 nt, Mycobacterium tuberculosis H37Rv
ggaucgccgagaccgcg

SEQ ID NO: 3260787 - RNA, 20 nt, Mycobacterium tuberculosis H37Rv
ggaucgccggugaacaggga

SEQ ID NO: 3260788 - RNA, 13 nt, Mycobacterium tuberculosis H37Rv
ggaucgccgucgc

SEQ ID NO: 3260789 - RNA, 12 nt, Mycobacterium tuberculosis H37Rv
ggaucgcgcuca

SEQ ID NO: 3260790 - RNA, 13 nt, Mycobacterium tuberculosis H37Rv
ggaucgcggcggc

SEQ ID NO: 3260791 - RNA, 23 nt, Mycobacterium tuberculosis H37Rv
ggaucgcguggcgcaccaccgcc

SEQ ID NO: 3260792 - RNA, 14 nt, Mycobacterium tuberculosis H37Rv
ggaucgcugccagc

SEQ ID NO: 3260793 - RNA, 18 nt, Mycobacterium tuberculosis H37Rv
ggaucggauggcggccac

SEQ ID NO: 3260794 - RNA, 18 nt, Mycobacterium tuberculosis H37Rv
ggaucggcaccccacgcc

SEQ ID NO: 3260795 - RNA, 16 nt, Mycobacterium tuberculosis H37Rv
ggaucggccggcgguc

SEQ ID NO: 3260796 - RNA, 15 nt, Mycobacterium tuberculosis H37Rv
ggaucggccugucca

SEQ ID NO: 3260797 - RNA, 14 nt, Mycobacterium tuberculosis H37Rv
ggaucggcucgcca

SEQ ID NO: 3260798 - RNA, 22 nt, Mycobacterium tuberculosis H37Rv
ggaucgguuccggccccgucgu

SEQ ID NO: 3260799 - RNA, 18 nt, Mycobacterium tuberculosis H37Rv
ggaucgguuucugcggcc

SEQ ID NO: 3260800 - RNA, 22 nt, Mycobacterium tuberculosis H37Rv
ggaucguacgggucggcgacga

SEQ ID NO: 3260801 - RNA, 17 nt, Mycobacterium tuberculosis H37Rv
ggaucguccggccgggg

SEQ ID NO: 3260802 - RNA, 21 nt, Mycobacterium tuberculosis H37Rv
ggaucgucgggagcacacaag

SEQ ID NO: 3260803 - RNA, 21 nt, Mycobacterium tuberculosis H37Rv
ggaucgucgugcacggcggcc

SEQ ID NO: 3260804 - RNA, 17 nt, Mycobacterium tuberculosis H37Rv
ggaucgucucgcgcacc

SEQ ID NO: 3260805 - RNA, 23 nt, Mycobacterium tuberculosis H37Rv
ggaucguggcgcccgucuccagc

SEQ ID NO: 3260806 - RNA, 20 nt, Mycobacterium tuberculosis H37Rv
ggaucguucgcgugccagcg

SEQ ID NO: 3260807 - RNA, 22 nt, Mycobacterium tuberculosis H37Rv
ggaucguucgcgugccagcgcc

SEQ ID NO: 3260808 - RNA, 22 nt, Mycobacterium tuberculosis H37Rv
ggaucuagaggcggcccccggc

SEQ ID NO: 3260809 - RNA, 17 nt, Mycobacterium tuberculosis H37Rv
ggaucuauuggaugcga

SEQ ID NO: 3260810 - RNA, 21 nt, Mycobacterium tuberculosis H37Rv
ggaucucaucgggccacagca

SEQ ID NO: 3260811 - RNA, 15 nt, Mycobacterium tuberculosis H37Rv
ggaucugacggcgcc

SEQ ID NO: 3260812 - RNA, 20 nt, Mycobacterium tuberculosis H37Rv
ggaucugacggcgccgucga

SEQ ID NO: 3260813 - RNA, 15 nt, Mycobacterium tuberculosis H37Rv
ggaucuggcgcagca

SEQ ID NO: 3260814 - RNA, 15 nt, Mycobacterium tuberculosis H37Rv
ggaucugguccagug

SEQ ID NO: 3260815 - RNA, 18 nt, Mycobacterium tuberculosis H37Rv
ggaucugguugaaccggu

SEQ ID NO: 3260816 - RNA, 20 nt, Mycobacterium tuberculosis H37Rv
ggaucuugccgcugguggug

SEQ ID NO: 3260817 - RNA, 16 nt, Mycobacterium tuberculosis H37Rv
ggaucuuggccagcag

SEQ ID NO: 3260818 - RNA, 20 nt, Mycobacterium tuberculosis H37Rv
ggaugaauuuggugaaguga

SEQ ID NO: 3260819 - RNA, 15 nt, Mycobacterium tuberculosis H37Rv
ggaugacaccgaccg

SEQ ID NO: 3260820 - RNA, 21 nt, Mycobacterium tuberculosis H37Rv
ggaugaccagugaucagcgca

SEQ ID NO: 3260821 - RNA, 16 nt, Mycobacterium tuberculosis H37Rv
ggaugaccuuggccgu

SEQ ID NO: 3260822 - RNA, 14 nt, Mycobacterium tuberculosis H37Rv
ggaugacgcccagg

SEQ ID NO: 3260823 - RNA, 15 nt, Mycobacterium tuberculosis H37Rv
ggaugacgcccaggg

SEQ ID NO: 3260824 - RNA, 19 nt, Mycobacterium tuberculosis H37Rv
ggaugacgguuccggucgg

SEQ ID NO: 3260825 - RNA, 21 nt, Mycobacterium tuberculosis H37Rv
ggaugaguucgucguggagcu

SEQ ID NO: 3260826 - RNA, 23 nt, Mycobacterium tuberculosis H37Rv
ggaugcaugucaaguucgccagc

SEQ ID NO: 3260827 - RNA, 22 nt, Mycobacterium tuberculosis H37Rv
ggaugccccuucaaagcggccu

SEQ ID NO: 3260828 - RNA, 19 nt, Mycobacterium tuberculosis H37Rv
ggaugcccguagacgccga

SEQ ID NO: 3260829 - RNA, 22 nt, Mycobacterium tuberculosis H37Rv
ggaugcccguagacgccgagca

SEQ ID NO: 3260830 - RNA, 15 nt, Mycobacterium tuberculosis H37Rv
ggaugccgaaccgcu

SEQ ID NO: 3260831 - RNA, 19 nt, Mycobacterium tuberculosis H37Rv
ggaugccugccucggcgag

SEQ ID NO: 3260832 - RNA, 23 nt, Mycobacterium tuberculosis H37Rv
ggaugcgauggccgacgcugcug

SEQ ID NO: 3260833 - RNA, 22 nt, Mycobacterium tuberculosis H37Rv
ggaugcgcaaccgcggccccga

SEQ ID NO: 3260834 - RNA, 19 nt, Mycobacterium tuberculosis H37Rv
ggaugcggacucagcggcg

SEQ ID NO: 3260835 - RNA, 20 nt, Mycobacterium tuberculosis H37Rv
ggaugcggacucagcggcgu

SEQ ID NO: 3260836 - RNA, 19 nt, Mycobacterium tuberculosis H37Rv
ggaugcggccccaugcgcc

SEQ ID NO: 3260837 - RNA, 21 nt, Mycobacterium tuberculosis H37Rv
ggaugcguuggccccaggauc

SEQ ID NO: 3260838 - RNA, 22 nt, Mycobacterium tuberculosis H37Rv
ggaugcucgauccacugccgcg

SEQ ID NO: 3260839 - RNA, 15 nt, Mycobacterium tuberculosis H37Rv
ggauggaaggcggcc

SEQ ID NO: 3260840 - RNA, 14 nt, Mycobacterium tuberculosis H37Rv
ggauggacaccacc

SEQ ID NO: 3260841 - RNA, 20 nt, Mycobacterium tuberculosis H37Rv
ggauggacaccaccucguca

SEQ ID NO: 3260842 - RNA, 12 nt, Mycobacterium tuberculosis H37Rv
ggauggaccacg

SEQ ID NO: 3260843 - RNA, 20 nt, Mycobacterium tuberculosis H37Rv
ggauggaccacgaaccgggu

SEQ ID NO: 3260844 - RNA, 22 nt, Mycobacterium tuberculosis H37Rv
ggauggacggcagccagccacc

SEQ ID NO: 3260845 - RNA, 16 nt, Mycobacterium tuberculosis H37Rv
ggauggcgauggcagg

SEQ ID NO: 3260846 - RNA, 16 nt, Mycobacterium tuberculosis H37Rv
ggauggcgcccugcgc

SEQ ID NO: 3260847 - RNA, 13 nt, Mycobacterium tuberculosis H37Rv
ggauggcggccac

SEQ ID NO: 3260848 - RNA, 13 nt, Mycobacterium tuberculosis H37Rv
ggauggcucgccg

SEQ ID NO: 3260849 - RNA, 22 nt, Mycobacterium tuberculosis H37Rv
ggauguaguuggcgaccugcgc

SEQ ID NO: 3260850 - RNA, 22 nt, Mycobacterium tuberculosis H37Rv
ggaugucgacgagcaccgcgcc

SEQ ID NO: 3260851 - RNA, 20 nt, Mycobacterium tuberculosis H37Rv
ggaugucgagcccgucgagu

SEQ ID NO: 3260852 - RNA, 19 nt, Mycobacterium tuberculosis H37Rv
ggaugucgagcguggcgac

SEQ ID NO: 3260853 - RNA, 15 nt, Mycobacterium tuberculosis H37Rv
ggaugucgucgacca

SEQ ID NO: 3260854 - RNA, 19 nt, Mycobacterium tuberculosis H37Rv
ggaugucgucgaccaggcc

SEQ ID NO: 3260855 - RNA, 13 nt, Mycobacterium tuberculosis H37Rv
ggaugucgugcgg

SEQ ID NO: 3260856 - RNA, 17 nt, Mycobacterium tuberculosis H37Rv
ggaugucucggcaccac

SEQ ID NO: 3260857 - RNA, 14 nt, Mycobacterium tuberculosis H37Rv
ggauuaccagugga

SEQ ID NO: 3260858 - RNA, 20 nt, Mycobacterium tuberculosis H37Rv
ggauuaccaguggauuggcg

SEQ ID NO: 3260859 - RNA, 21 nt, Mycobacterium tuberculosis H37Rv
ggauucagcgcagcaacuggg

SEQ ID NO: 3260860 - RNA, 15 nt, Mycobacterium tuberculosis H37Rv
ggcacacccuccaca

SEQ ID NO: 3260861 - RNA, 21 nt, Mycobacterium tuberculosis H37Rv
ggcacacccuccacagcggcc

SEQ ID NO: 3260862 - RNA, 15 nt, Mycobacterium tuberculosis H37Rv
ggcacaccgguggcg

SEQ ID NO: 3260863 - RNA, 23 nt, Mycobacterium tuberculosis H37Rv
ggcacacgaguacagaucgaggg

SEQ ID NO: 3260864 - RNA, 23 nt, Mycobacterium tuberculosis H37Rv
ggcacacuguuacuccgacggcc

SEQ ID NO: 3260865 - RNA, 18 nt, Mycobacterium tuberculosis H37Rv
ggcacagccaguaaaaag

SEQ ID NO: 3260866 - RNA, 20 nt, Mycobacterium tuberculosis H37Rv
ggcacaucaugggcgcugcc

SEQ ID NO: 3260867 - RNA, 14 nt, Mycobacterium tuberculosis H37Rv
ggcacaucgcacaa

SEQ ID NO: 3260868 - RNA, 18 nt, Mycobacterium tuberculosis H37Rv
ggcacaucgcacggucgc

SEQ ID NO: 3260869 - RNA, 20 nt, Mycobacterium tuberculosis H37Rv
ggcacauugaucgacggcca

SEQ ID NO: 3260870 - RNA, 22 nt, Mycobacterium tuberculosis H37Rv
ggcacauugaucgacggccagc

SEQ ID NO: 3260871 - RNA, 15 nt, Mycobacterium tuberculosis H37Rv
ggcaccaaccugagc

SEQ ID NO: 3260872 - RNA, 21 nt, Mycobacterium tuberculosis H37Rv
ggcaccaauaccgcacccgcu

SEQ ID NO: 3260873 - RNA, 20 nt, Mycobacterium tuberculosis H37Rv
ggcaccaccaagcucggcca

SEQ ID NO: 3260874 - RNA, 19 nt, Mycobacterium tuberculosis H37Rv
ggcaccaccacaccggagc

SEQ ID NO: 3260875 - RNA, 19 nt, Mycobacterium tuberculosis H37Rv
ggcaccacccgauuggcca

SEQ ID NO: 3260876 - RNA, 16 nt, Mycobacterium tuberculosis H37Rv
ggcaccacccuugccg

SEQ ID NO: 3260877 - RNA, 13 nt, Mycobacterium tuberculosis H37Rv
ggcaccacgucga

SEQ ID NO: 3260878 - RNA, 20 nt, Mycobacterium tuberculosis H37Rv
ggcaccacuacaucgaucag

SEQ ID NO: 3260879 - RNA, 19 nt, Mycobacterium tuberculosis H37Rv
ggcaccagaaaacauugcg

SEQ ID NO: 3260880 - RNA, 18 nt, Mycobacterium tuberculosis H37Rv
ggcaccagcggcaccgcg

SEQ ID NO: 3260881 - RNA, 21 nt, Mycobacterium tuberculosis H37Rv
ggcaccagcggcaccgcggcc

SEQ ID NO: 3260882 - RNA, 19 nt, Mycobacterium tuberculosis H37Rv
ggcaccagguugccgaggu

SEQ ID NO: 3260883 - RNA, 21 nt, Mycobacterium tuberculosis H37Rv
ggcaccauguacaggcugucc

SEQ ID NO: 3260884 - RNA, 21 nt, Mycobacterium tuberculosis H37Rv
ggcacccaauccggcgccagc

SEQ ID NO: 3260885 - RNA, 20 nt, Mycobacterium tuberculosis H37Rv
ggcacccaauuucgaccaga

SEQ ID NO: 3260886 - RNA, 21 nt, Mycobacterium tuberculosis H37Rv
ggcacccacuuuucgguggcg

SEQ ID NO: 3260887 - RNA, 13 nt, Mycobacterium tuberculosis H37Rv
ggcacccagucgg

SEQ ID NO: 3260888 - RNA, 15 nt, Mycobacterium tuberculosis H37Rv
ggcaccccacggcca

SEQ ID NO: 3260889 - RNA, 16 nt, Mycobacterium tuberculosis H37Rv
ggcaccccacggccag

SEQ ID NO: 3260890 - RNA, 14 nt, Mycobacterium tuberculosis H37Rv
ggcacccccgucgc

SEQ ID NO: 3260891 - RNA, 20 nt, Mycobacterium tuberculosis H37Rv
ggcaccccgaccaccagagc

SEQ ID NO: 3260892 - RNA, 14 nt, Mycobacterium tuberculosis H37Rv
ggcaccccggccac

SEQ ID NO: 3260893 - RNA, 19 nt, Mycobacterium tuberculosis H37Rv
ggcaccccguuccacgauc

SEQ ID NO: 3260894 - RNA, 16 nt, Mycobacterium tuberculosis H37Rv
ggcaccccuuugacgc

SEQ ID NO: 3260895 - RNA, 22 nt, Mycobacterium tuberculosis H37Rv
ggcaccccuuugacgccgagca

SEQ ID NO: 3260896 - RNA, 14 nt, Mycobacterium tuberculosis H37Rv
ggcacccgacucgu

SEQ ID NO: 3260897 - RNA, 17 nt, Mycobacterium tuberculosis H37Rv
ggcacccgacucgucgg

SEQ ID NO: 3260898 - RNA, 19 nt, Mycobacterium tuberculosis H37Rv
ggcacccgagccgcacagc

SEQ ID NO: 3260899 - RNA, 17 nt, Mycobacterium tuberculosis H37Rv
ggcacccgcacggccuc

SEQ ID NO: 3260900 - RNA, 14 nt, Mycobacterium tuberculosis H37Rv
ggcacccgcgucga

SEQ ID NO: 3260901 - RNA, 20 nt, Mycobacterium tuberculosis H37Rv
ggcacccgcuggcgguaagc

SEQ ID NO: 3260902 - RNA, 11 nt, Mycobacterium tuberculosis H37Rv
ggcacccggcu

SEQ ID NO: 3260903 - RNA, 21 nt, Mycobacterium tuberculosis H37Rv
ggcacccggugagaagaagcc

SEQ ID NO: 3260904 - RNA, 22 nt, Mycobacterium tuberculosis H37Rv
ggcacccggugagaagaagccc

SEQ ID NO: 3260905 - RNA, 23 nt, Mycobacterium tuberculosis H37Rv
ggcacccggugagaagaagccca

SEQ ID NO: 3260906 - RNA, 13 nt, Mycobacterium tuberculosis H37Rv
ggcacccuccgcc

SEQ ID NO: 3260907 - RNA, 14 nt, Mycobacterium tuberculosis H37Rv
ggcacccucggcgu

SEQ ID NO: 3260908 - RNA, 13 nt, Mycobacterium tuberculosis H37Rv
ggcacccuugccg

SEQ ID NO: 3260909 - RNA, 20 nt, Mycobacterium tuberculosis H37Rv
ggcaccgaaaaacaccagcg

SEQ ID NO: 3260910 - RNA, 22 nt, Mycobacterium tuberculosis H37Rv
ggcaccgaaaaacaccagcgag

SEQ ID NO: 3260911 - RNA, 17 nt, Mycobacterium tuberculosis H37Rv
ggcaccgagucuaagga

SEQ ID NO: 3260912 - RNA, 15 nt, Mycobacterium tuberculosis H37Rv
ggcaccgauccugga

SEQ ID NO: 3260913 - RNA, 14 nt, Mycobacterium tuberculosis H37Rv
ggcaccgaugcacu

SEQ ID NO: 3260914 - RNA, 16 nt, Mycobacterium tuberculosis H37Rv
ggcaccgccagccacc

SEQ ID NO: 3260915 - RNA, 19 nt, Mycobacterium tuberculosis H37Rv
ggcaccgcccccgucggcc

SEQ ID NO: 3260916 - RNA, 11 nt, Mycobacterium tuberculosis H37Rv
ggcaccgcccu

SEQ ID NO: 3260917 - RNA, 14 nt, Mycobacterium tuberculosis H37Rv
ggcaccgccgagca

SEQ ID NO: 3260918 - RNA, 13 nt, Mycobacterium tuberculosis H37Rv
ggcaccgccgccc

SEQ ID NO: 3260919 - RNA, 14 nt, Mycobacterium tuberculosis H37Rv
ggcaccgccgcccc

SEQ ID NO: 3260920 - RNA, 18 nt, Mycobacterium tuberculosis H37Rv
ggcaccgccgcccccgcc

SEQ ID NO: 3260921 - RNA, 19 nt, Mycobacterium tuberculosis H37Rv
ggcaccgccggcuccgccg

SEQ ID NO: 3260922 - RNA, 16 nt, Mycobacterium tuberculosis H37Rv
ggcaccgccgguggcg

SEQ ID NO: 3260923 - RNA, 21 nt, Mycobacterium tuberculosis H37Rv
ggcaccgccgguggcgccggg

SEQ ID NO: 3260924 - RNA, 15 nt, Mycobacterium tuberculosis H37Rv
ggcaccgcgccggcg

SEQ ID NO: 3260925 - RNA, 13 nt, Mycobacterium tuberculosis H37Rv
ggcaccgcgcgcu

SEQ ID NO: 3260926 - RNA, 16 nt, Mycobacterium tuberculosis H37Rv
ggcaccgcggccagcg

SEQ ID NO: 3260927 - RNA, 15 nt, Mycobacterium tuberculosis H37Rv
ggcaccgcggccgcg

SEQ ID NO: 3260928 - RNA, 14 nt, Mycobacterium tuberculosis H37Rv
ggcaccgcugccgc

SEQ ID NO: 3260929 - RNA, 19 nt, Mycobacterium tuberculosis H37Rv
ggcaccgcugccgcugccg

SEQ ID NO: 3260930 - RNA, 15 nt, Mycobacterium tuberculosis H37Rv
ggcaccgcuucaggc

SEQ ID NO: 3260931 - RNA, 22 nt, Mycobacterium tuberculosis H37Rv
ggcaccggcccagaucgguuga

SEQ ID NO: 3260932 - RNA, 13 nt, Mycobacterium tuberculosis H37Rv
ggcaccggcgauc

SEQ ID NO: 3260933 - RNA, 15 nt, Mycobacterium tuberculosis H37Rv
ggcaccggcggucug

SEQ ID NO: 3260934 - RNA, 22 nt, Mycobacterium tuberculosis H37Rv
ggcaccgggguuacucgcagcg

SEQ ID NO: 3260935 - RNA, 12 nt, Mycobacterium tuberculosis H37Rv
ggcaccgggugc

SEQ ID NO: 3260936 - RNA, 19 nt, Mycobacterium tuberculosis H37Rv
ggcaccgggugcgacggcg

SEQ ID NO: 3260937 - RNA, 14 nt, Mycobacterium tuberculosis H37Rv
ggcaccggucgguu

SEQ ID NO: 3260938 - RNA, 17 nt, Mycobacterium tuberculosis H37Rv
ggcaccggugcccacca

SEQ ID NO: 3260939 - RNA, 20 nt, Mycobacterium tuberculosis H37Rv
ggcaccgguuugacguccag

SEQ ID NO: 3260940 - RNA, 22 nt, Mycobacterium tuberculosis H37Rv
ggcaccguagagcaugccgccc

SEQ ID NO: 3260941 - RNA, 19 nt, Mycobacterium tuberculosis H37Rv
ggcaccgucggaacugacc

SEQ ID NO: 3260942 - RNA, 18 nt, Mycobacterium tuberculosis H37Rv
ggcaccgucucgcaccgc

SEQ ID NO: 3260943 - RNA, 21 nt, Mycobacterium tuberculosis H37Rv
ggcaccgucucgcaccgcguu

SEQ ID NO: 3260944 - RNA, 19 nt, Mycobacterium tuberculosis H37Rv
ggcaccguggaucugaaga

SEQ ID NO: 3260945 - RNA, 20 nt, Mycobacterium tuberculosis H37Rv
ggcaccguuaccgccgucgc

SEQ ID NO: 3260946 - RNA, 21 nt, Mycobacterium tuberculosis H37Rv
ggcaccguuaccgccgucgcc

SEQ ID NO: 3260947 - RNA, 13 nt, Mycobacterium tuberculosis H37Rv
ggcaccuccagca

SEQ ID NO: 3260948 - RNA, 19 nt, Mycobacterium tuberculosis H37Rv
ggcaccuccagcaccaccg

SEQ ID NO: 3260949 - RNA, 17 nt, Mycobacterium tuberculosis H37Rv
ggcaccuccgccggcac

SEQ ID NO: 3260950 - RNA, 21 nt, Mycobacterium tuberculosis H37Rv
ggcaccuccgccggcaccucc

SEQ ID NO: 3260951 - RNA, 16 nt, Mycobacterium tuberculosis H37Rv
ggcaccuccggcaccg

SEQ ID NO: 3260952 - RNA, 15 nt, Mycobacterium tuberculosis H37Rv
ggcaccucgcccucc

SEQ ID NO: 3260953 - RNA, 18 nt, Mycobacterium tuberculosis H37Rv
ggcaccuggucggccgca

SEQ ID NO: 3260954 - RNA, 22 nt, Mycobacterium tuberculosis H37Rv
ggcacgaacaucagaucgccga

SEQ ID NO: 3260955 - RNA, 15 nt, Mycobacterium tuberculosis H37Rv
ggcacgaaucccccg

SEQ ID NO: 3260956 - RNA, 16 nt, Mycobacterium tuberculosis H37Rv
ggcagcaggcgaugcg

SEQ ID NO: 3260957 - RNA, 16 nt, Mycobacterium tuberculosis H37Rv
ggcagcauccucgacu

SEQ ID NO: 3260958 - RNA, 14 nt, Mycobacterium tuberculosis H37Rv
ggcagcaucgguca

SEQ ID NO: 3260959 - RNA, 23 nt, Mycobacterium tuberculosis H37Rv
ggcagcaucuccgucggccaggc

SEQ ID NO: 3260960 - RNA, 16 nt, Mycobacterium tuberculosis H37Rv
ggcagccaagcgagcg

SEQ ID NO: 3260961 - RNA, 17 nt, Mycobacterium tuberculosis H37Rv
ggcagccaagcgagcgg

SEQ ID NO: 3260962 - RNA, 22 nt, Mycobacterium tuberculosis H37Rv
ggcagccaagcgagcggcgaac

SEQ ID NO: 3260963 - RNA, 13 nt, Mycobacterium tuberculosis H37Rv
ggcagccaccagc

SEQ ID NO: 3260964 - RNA, 18 nt, Mycobacterium tuberculosis H37Rv
ggcagccaccagcgacga

SEQ ID NO: 3260965 - RNA, 14 nt, Mycobacterium tuberculosis H37Rv
ggcagccaccguca

SEQ ID NO: 3260966 - RNA, 23 nt, Mycobacterium tuberculosis H37Rv
ggcagccaccgucaugccgacga

SEQ ID NO: 3260967 - RNA, 14 nt, Mycobacterium tuberculosis H37Rv
ggcagccagcggcg

SEQ ID NO: 3260968 - RNA, 15 nt, Mycobacterium tuberculosis H37Rv
ggcagccagcggcga

SEQ ID NO: 3260969 - RNA, 12 nt, Mycobacterium tuberculosis H37Rv
ggcagccagggc

SEQ ID NO: 3260970 - RNA, 22 nt, Mycobacterium tuberculosis H37Rv
ggcagcccaaagcgccagcagc

SEQ ID NO: 3260971 - RNA, 13 nt, Mycobacterium tuberculosis H37Rv
ggcagcccgcugg

SEQ ID NO: 3260972 - RNA, 21 nt, Mycobacterium tuberculosis H37Rv
ggcagcccgcuggccuccugg

SEQ ID NO: 3260973 - RNA, 14 nt, Mycobacterium tuberculosis H37Rv
ggcagcccggcgau

SEQ ID NO: 3260974 - RNA, 13 nt, Mycobacterium tuberculosis H37Rv
ggcagcccggcgg

SEQ ID NO: 3260975 - RNA, 13 nt, Mycobacterium tuberculosis H37Rv
ggcagcccgucgg

SEQ ID NO: 3260976 - RNA, 13 nt, Mycobacterium tuberculosis H37Rv
ggcagcccguucg

SEQ ID NO: 3260977 - RNA, 18 nt, Mycobacterium tuberculosis H37Rv
ggcagccgcacgguucgg

SEQ ID NO: 3260978 - RNA, 19 nt, Mycobacterium tuberculosis H37Rv
ggcagccgcccgcccaccu

SEQ ID NO: 3260979 - RNA, 14 nt, Mycobacterium tuberculosis H37Rv
ggcagccgcgccgc

SEQ ID NO: 3260980 - RNA, 19 nt, Mycobacterium tuberculosis H37Rv
ggcagccggcggagagggc

SEQ ID NO: 3260981 - RNA, 14 nt, Mycobacterium tuberculosis H37Rv
ggcagccgggcguc

SEQ ID NO: 3260982 - RNA, 14 nt, Mycobacterium tuberculosis H37Rv
ggcagccggguugg

SEQ ID NO: 3260983 - RNA, 13 nt, Mycobacterium tuberculosis H37Rv
ggcagccucgagu

SEQ ID NO: 3260984 - RNA, 23 nt, Mycobacterium tuberculosis H37Rv
ggcagccucucgcuuaggucgcu

SEQ ID NO: 3260985 - RNA, 12 nt, Mycobacterium tuberculosis H37Rv
ggcagccugcug

SEQ ID NO: 3260986 - RNA, 13 nt, Mycobacterium tuberculosis H37Rv
ggcagccugcugc

SEQ ID NO: 3260987 - RNA, 19 nt, Mycobacterium tuberculosis H37Rv
ggcagcgaaagcgucgagc

SEQ ID NO: 3260988 - RNA, 16 nt, Mycobacterium tuberculosis H37Rv
ggcagcgaccgucguc

SEQ ID NO: 3260989 - RNA, 18 nt, Mycobacterium tuberculosis H37Rv
ggcagcgaccgucgucca

SEQ ID NO: 3260990 - RNA, 23 nt, Mycobacterium tuberculosis H37Rv
ggcagcgacgccggcccgacggg

SEQ ID NO: 3260991 - RNA, 16 nt, Mycobacterium tuberculosis H37Rv
ggcagcgagucgacgu

SEQ ID NO: 3260992 - RNA, 20 nt, Mycobacterium tuberculosis H37Rv
ggcagcgaugcggugucggg

SEQ ID NO: 3260993 - RNA, 22 nt, Mycobacterium tuberculosis H37Rv
ggcagcgcacccggucggcggc

SEQ ID NO: 3260994 - RNA, 16 nt, Mycobacterium tuberculosis H37Rv
ggcagcgccaggccgu

SEQ ID NO: 3260995 - RNA, 19 nt, Mycobacterium tuberculosis H37Rv
ggcagcgcccagaucgccg

SEQ ID NO: 3260996 - RNA, 13 nt, Mycobacterium tuberculosis H37Rv
ggcagcgcgauca

SEQ ID NO: 3260997 - RNA, 16 nt, Mycobacterium tuberculosis H37Rv
ggcagcgcgaucaccg

SEQ ID NO: 3260998 - RNA, 14 nt, Mycobacterium tuberculosis H37Rv
ggcagcgcgaucga

SEQ ID NO: 3260999 - RNA, 16 nt, Mycobacterium tuberculosis H37Rv
ggcagcgcgcccgaca

SEQ ID NO: 3261000 - RNA, 13 nt, Mycobacterium tuberculosis H37Rv
ggcagcgcggaug

SEQ ID NO: 3261001 - RNA, 15 nt, Mycobacterium tuberculosis H37Rv
ggcagcgcggauguc

SEQ ID NO: 3261002 - RNA, 23 nt, Mycobacterium tuberculosis H37Rv
ggcagcgcggaugucggcaucga

SEQ ID NO: 3261003 - RNA, 13 nt, Mycobacterium tuberculosis H37Rv
ggcagcgcggcac

SEQ ID NO: 3261004 - RNA, 14 nt, Mycobacterium tuberculosis H37Rv
ggcagcgcggcacc

SEQ ID NO: 3261005 - RNA, 15 nt, Mycobacterium tuberculosis H37Rv
ggcagcgcggccagu

SEQ ID NO: 3261006 - RNA, 15 nt, Mycobacterium tuberculosis H37Rv
ggcagcgcggccggg

SEQ ID NO: 3261007 - RNA, 17 nt, Mycobacterium tuberculosis H37Rv
ggcagcgcggccgggcg

SEQ ID NO: 3261008 - RNA, 12 nt, Mycobacterium tuberculosis H37Rv
ggcagcgcuggc

SEQ ID NO: 3261009 - RNA, 17 nt, Mycobacterium tuberculosis H37Rv
ggcagcggaccgcugcc

SEQ ID NO: 3261010 - RNA, 20 nt, Mycobacterium tuberculosis H37Rv
ggcagcggaccgcugccugc

SEQ ID NO: 3261011 - RNA, 13 nt, Mycobacterium tuberculosis H37Rv
ggcagcggcgagu

SEQ ID NO: 3261012 - RNA, 15 nt, Mycobacterium tuberculosis H37Rv
ggcagcggcgcgcug

SEQ ID NO: 3261013 - RNA, 16 nt, Mycobacterium tuberculosis H37Rv
ggcagcggcgcgguuu

SEQ ID NO: 3261014 - RNA, 17 nt, Mycobacterium tuberculosis H37Rv
ggcagcggcgucgucgu

SEQ ID NO: 3261015 - RNA, 14 nt, Mycobacterium tuberculosis H37Rv
ggcagcggcuggga

SEQ ID NO: 3261016 - RNA, 19 nt, Mycobacterium tuberculosis H37Rv
ggcagcgggacugcggaag

SEQ ID NO: 3261017 - RNA, 20 nt, Mycobacterium tuberculosis H37Rv
ggcagcgggacugcggaagc

SEQ ID NO: 3261018 - RNA, 16 nt, Mycobacterium tuberculosis H37Rv
ggcagcgggcuccccg

SEQ ID NO: 3261019 - RNA, 20 nt, Mycobacterium tuberculosis H37Rv
ggcagcgguaagcgcaucga

SEQ ID NO: 3261020 - RNA, 14 nt, Mycobacterium tuberculosis H37Rv
ggcagcgguggcaa

SEQ ID NO: 3261021 - RNA, 14 nt, Mycobacterium tuberculosis H37Rv
ggcagcgguggcuu

SEQ ID NO: 3261022 - RNA, 16 nt, Mycobacterium tuberculosis H37Rv
ggcagcgguggcuugc

SEQ ID NO: 3261023 - RNA, 23 nt, Mycobacterium tuberculosis H37Rv
ggcagcguaagaccugaguuggu

SEQ ID NO: 3261024 - RNA, 19 nt, Mycobacterium tuberculosis H37Rv
ggcagcgucacccugucgc

SEQ ID NO: 3261025 - RNA, 17 nt, Mycobacterium tuberculosis H37Rv
ggcagcgucgucgacga

SEQ ID NO: 3261026 - RNA, 18 nt, Mycobacterium tuberculosis H37Rv
ggcagcgugggcgacgga

SEQ ID NO: 3261027 - RNA, 14 nt, Mycobacterium tuberculosis H37Rv
ggcagcguguaacc

SEQ ID NO: 3261028 - RNA, 15 nt, Mycobacterium tuberculosis H37Rv
ggcagcuacggggcg

SEQ ID NO: 3261029 - RNA, 15 nt, Mycobacterium tuberculosis H37Rv
ggcagcucaucgcgc

SEQ ID NO: 3261030 - RNA, 17 nt, Mycobacterium tuberculosis H37Rv
ggcagcucaucgcgcac

SEQ ID NO: 3261031 - RNA, 13 nt, Mycobacterium tuberculosis H37Rv
ggcagcuccacca

SEQ ID NO: 3261032 - RNA, 22 nt, Mycobacterium tuberculosis H37Rv
ggcagcucccgccacgucgccg

SEQ ID NO: 3261033 - RNA, 14 nt, Mycobacterium tuberculosis H37Rv
ggcagcuccgccgc

SEQ ID NO: 3261034 - RNA, 19 nt, Mycobacterium tuberculosis H37Rv
ggcagcucguccagcgagc

SEQ ID NO: 3261035 - RNA, 17 nt, Mycobacterium tuberculosis H37Rv
ggcagcugguaaccggc

SEQ ID NO: 3261036 - RNA, 21 nt, Mycobacterium tuberculosis H37Rv
ggcagcugguaaccggcggca

SEQ ID NO: 3261037 - RNA, 19 nt, Mycobacterium tuberculosis H37Rv
ggcagcugguaggucaccg

SEQ ID NO: 3261038 - RNA, 22 nt, Mycobacterium tuberculosis H37Rv
ggcagcuggucggugggcuugc

SEQ ID NO: 3261039 - RNA, 15 nt, Mycobacterium tuberculosis H37Rv
ggcagcuucucgccg

SEQ ID NO: 3261040 - RNA, 18 nt, Mycobacterium tuberculosis H37Rv
ggcagcuucucgccgacg

SEQ ID NO: 3261041 - RNA, 21 nt, Mycobacterium tuberculosis H37Rv
ggcagcuucucgccgacgaac

SEQ ID NO: 3261042 - RNA, 20 nt, Mycobacterium tuberculosis H37Rv
ggcagcuugccaaucaccgu

SEQ ID NO: 3261043 - RNA, 16 nt, Mycobacterium tuberculosis H37Rv
ggcagcuuggacucau

SEQ ID NO: 3261044 - RNA, 19 nt, Mycobacterium tuberculosis H37Rv
ggcagcuuugagucccggu

SEQ ID NO: 3261045 - RNA, 22 nt, Mycobacterium tuberculosis H37Rv
ggcaggacugaacaguugcaca

SEQ ID NO: 3261046 - RNA, 16 nt, Mycobacterium tuberculosis H37Rv
ggcaggagaacacauc

SEQ ID NO: 3261047 - RNA, 16 nt, Mycobacterium tuberculosis H37Rv
ggcaggagcagcacgu

SEQ ID NO: 3261048 - RNA, 22 nt, Mycobacterium tuberculosis H37Rv
ggcaggaucuccgggucgaugu

SEQ ID NO: 3261049 - RNA, 21 nt, Mycobacterium tuberculosis H37Rv
ggcaggcagcucggcaacgug

SEQ ID NO: 3261050 - RNA, 14 nt, Mycobacterium tuberculosis H37Rv
ggcaggcagggcag

SEQ ID NO: 3261051 - RNA, 14 nt, Mycobacterium tuberculosis H37Rv
ggcaggcagguugg

SEQ ID NO: 3261052 - RNA, 13 nt, Mycobacterium tuberculosis H37Rv
ggcaggcauggcg

SEQ ID NO: 3261053 - RNA, 18 nt, Mycobacterium tuberculosis H37Rv
ggcaugcuggcgaucgcg

SEQ ID NO: 3261054 - RNA, 22 nt, Mycobacterium tuberculosis H37Rv
ggcaugggcccugcacagcagc

SEQ ID NO: 3261055 - RNA, 17 nt, Mycobacterium tuberculosis H37Rv
ggcaugggccggcgccg

SEQ ID NO: 3261056 - RNA, 13 nt, Mycobacterium tuberculosis H37Rv
ggcauggucaggc

SEQ ID NO: 3261057 - RNA, 15 nt, Mycobacterium tuberculosis H37Rv
ggcauggucaggcgg

SEQ ID NO: 3261058 - RNA, 17 nt, Mycobacterium tuberculosis H37Rv
ggcauggucaggcggcc

SEQ ID NO: 3261059 - RNA, 21 nt, Mycobacterium tuberculosis H37Rv
ggcauggucaggcggccgucg

SEQ ID NO: 3261060 - RNA, 14 nt, Mycobacterium tuberculosis H37Rv
ggcauggucgccgg

SEQ ID NO: 3261061 - RNA, 13 nt, Mycobacterium tuberculosis H37Rv
ggcaugguggugg

SEQ ID NO: 3261062 - RNA, 14 nt, Mycobacterium tuberculosis H37Rv
ggcauggugguggc

SEQ ID NO: 3261063 - RNA, 19 nt, Mycobacterium tuberculosis H37Rv
ggcauguaccgaccgcguu

SEQ ID NO: 3261064 - RNA, 20 nt, Mycobacterium tuberculosis H37Rv
ggcauguaccgaccgcguug

SEQ ID NO: 3261065 - RNA, 13 nt, Mycobacterium tuberculosis H37Rv
ggcaugucgccga

SEQ ID NO: 3261066 - RNA, 20 nt, Mycobacterium tuberculosis H37Rv
ggcaugucgguuuccucgag

SEQ ID NO: 3261067 - RNA, 19 nt, Mycobacterium tuberculosis H37Rv
ggcauguuccuugcggccg

SEQ ID NO: 3261068 - RNA, 21 nt, Mycobacterium tuberculosis H37Rv
ggcauuaccacuucggcgucc

SEQ ID NO: 3261069 - RNA, 13 nt, Mycobacterium tuberculosis H37Rv
ggcauucccgcgg

SEQ ID NO: 3261070 - RNA, 16 nt, Mycobacterium tuberculosis H37Rv
ggcauucccgcggcaa

SEQ ID NO: 3261071 - RNA, 21 nt, Mycobacterium tuberculosis H37Rv
ggcauuccuugauaacgaccc

SEQ ID NO: 3261072 - RNA, 14 nt, Mycobacterium tuberculosis H37Rv
ggcauucgucgagu

SEQ ID NO: 3261073 - RNA, 20 nt, Mycobacterium tuberculosis H37Rv
ggcauugcccgagcccagcg

SEQ ID NO: 3261074 - RNA, 21 nt, Mycobacterium tuberculosis H37Rv
ggccaaaaccagggagcgccc

SEQ ID NO: 3261075 - RNA, 21 nt, Mycobacterium tuberculosis H37Rv
ggccaaaccccugcacggugc

SEQ ID NO: 3261076 - RNA, 15 nt, Mycobacterium tuberculosis H37Rv
ggccaacaccgccag

SEQ ID NO: 3261077 - RNA, 18 nt, Mycobacterium tuberculosis H37Rv
ggccaacaccgccagcau

SEQ ID NO: 3261078 - RNA, 19 nt, Mycobacterium tuberculosis H37Rv
ggccaacagguuccacgga

SEQ ID NO: 3261079 - RNA, 13 nt, Mycobacterium tuberculosis H37Rv
ggccaacagucgc

SEQ ID NO: 3261080 - RNA, 20 nt, Mycobacterium tuberculosis H37Rv
ggccaacagucgcagcacgg

SEQ ID NO: 3261081 - RNA, 18 nt, Mycobacterium tuberculosis H37Rv
ggccaacccugcggcguc

SEQ ID NO: 3261082 - RNA, 20 nt, Mycobacterium tuberculosis H37Rv
ggccaacccugcggcgucgu

SEQ ID NO: 3261083 - RNA, 14 nt, Mycobacterium tuberculosis H37Rv
ggccaaccgggccg

SEQ ID NO: 3261084 - RNA, 20 nt, Mycobacterium tuberculosis H37Rv
ggccaaccgggccgccugga

SEQ ID NO: 3261085 - RNA, 21 nt, Mycobacterium tuberculosis H37Rv
ggccaaccgggucguucgggu

SEQ ID NO: 3261086 - RNA, 16 nt, Mycobacterium tuberculosis H37Rv
ggccaacggcgcugcc

SEQ ID NO: 3261087 - RNA, 21 nt, Mycobacterium tuberculosis H37Rv
ggccaacggcuccgggcgcuc

SEQ ID NO: 3261088 - RNA, 13 nt, Mycobacterium tuberculosis H37Rv
ggccaacucgaca

SEQ ID NO: 3261089 - RNA, 14 nt, Mycobacterium tuberculosis H37Rv
ggccaacugggcgg

SEQ ID NO: 3261090 - RNA, 23 nt, Mycobacterium tuberculosis H37Rv
ggccaacuuggcggccagccgcu

SEQ ID NO: 3261091 - RNA, 21 nt, Mycobacterium tuberculosis H37Rv
ggccaagaaugugggcgacgg

SEQ ID NO: 3261092 - RNA, 14 nt, Mycobacterium tuberculosis H37Rv
ggccaagaucggcg

SEQ ID NO: 3261093 - RNA, 21 nt, Mycobacterium tuberculosis H37Rv
ggccaagaucggcgccccugc

SEQ ID NO: 3261094 - RNA, 21 nt, Mycobacterium tuberculosis H37Rv
ggccaagggugcuugucgccg

SEQ ID NO: 3261095 - RNA, 15 nt, Mycobacterium tuberculosis H37Rv
ggccaagguggccac

SEQ ID NO: 3261096 - RNA, 18 nt, Mycobacterium tuberculosis H37Rv
ggccaauagaagcacguc

SEQ ID NO: 3261097 - RNA, 17 nt, Mycobacterium tuberculosis H37Rv
ggccaaucagcccgccg

SEQ ID NO: 3261098 - RNA, 15 nt, Mycobacterium tuberculosis H37Rv
ggccaauccggcggc

SEQ ID NO: 3261099 - RNA, 18 nt, Mycobacterium tuberculosis H37Rv
ggccaauccggcggcgac

SEQ ID NO: 3261100 - RNA, 12 nt, Mycobacterium tuberculosis H37Rv
ggccaauccggg

SEQ ID NO: 3261101 - RNA, 22 nt, Mycobacterium tuberculosis H37Rv
ggccaaugacgucggaccagcu

SEQ ID NO: 3261102 - RNA, 22 nt, Mycobacterium tuberculosis H37Rv
ggccaaugccuugagcaaaaug

SEQ ID NO: 3261103 - RNA, 17 nt, Mycobacterium tuberculosis H37Rv
ggccaauggccugcagc

SEQ ID NO: 3261104 - RNA, 18 nt, Mycobacterium tuberculosis H37Rv
ggccaauggccugcagcg

SEQ ID NO: 3261105 - RNA, 23 nt, Mycobacterium tuberculosis H37Rv
ggccacaaccgaauccaucgaga

SEQ ID NO: 3261106 - RNA, 15 nt, Mycobacterium tuberculosis H37Rv
ggccacaaccucguc

SEQ ID NO: 3261107 - RNA, 18 nt, Mycobacterium tuberculosis H37Rv
ggccacacagucacggac

SEQ ID NO: 3261108 - RNA, 21 nt, Mycobacterium tuberculosis H37Rv
ggccacaccuuggccgccggc

SEQ ID NO: 3261109 - RNA, 22 nt, Mycobacterium tuberculosis H37Rv
ggccacagcaacgugugcacca

SEQ ID NO: 3261110 - RNA, 12 nt, Mycobacterium tuberculosis H37Rv
ggccacagugca

SEQ ID NO: 3261111 - RNA, 15 nt, Mycobacterium tuberculosis H37Rv
ggccacauccagcgc

SEQ ID NO: 3261112 - RNA, 16 nt, Mycobacterium tuberculosis H37Rv
ggccacauccagcgcu

SEQ ID NO: 3261113 - RNA, 14 nt, Mycobacterium tuberculosis H37Rv
ggccacaugccaca

SEQ ID NO: 3261114 - RNA, 17 nt, Mycobacterium tuberculosis H37Rv
ggccaccaccgagcgca

SEQ ID NO: 3261115 - RNA, 15 nt, Mycobacterium tuberculosis H37Rv
ggccaccaccgccgc

SEQ ID NO: 3261116 - RNA, 17 nt, Mycobacterium tuberculosis H37Rv
ggccaccaccgccgccg

SEQ ID NO: 3261117 - RNA, 23 nt, Mycobacterium tuberculosis H37Rv
ggccaccaccgccgccggcaccg

SEQ ID NO: 3261118 - RNA, 18 nt, Mycobacterium tuberculosis H37Rv
ggccaccacgcgccgcac

SEQ ID NO: 3261119 - RNA, 12 nt, Mycobacterium tuberculosis H37Rv
ggccaccacugc

SEQ ID NO: 3261120 - RNA, 14 nt, Mycobacterium tuberculosis H37Rv
ggccaccagcaugc

SEQ ID NO: 3261121 - RNA, 14 nt, Mycobacterium tuberculosis H37Rv
ggccaccagcuggc

SEQ ID NO: 3261122 - RNA, 16 nt, Mycobacterium tuberculosis H37Rv
ggccaccaggugccgu

SEQ ID NO: 3261123 - RNA, 16 nt, Mycobacterium tuberculosis H37Rv
ggccaccaguccgaug

SEQ ID NO: 3261124 - RNA, 17 nt, Mycobacterium tuberculosis H37Rv
ggccaccaucgccgccg

SEQ ID NO: 3261125 - RNA, 14 nt, Mycobacterium tuberculosis H37Rv
ggccacccccguca

SEQ ID NO: 3261126 - RNA, 14 nt, Mycobacterium tuberculosis H37Rv
ggccaccccgaccu

SEQ ID NO: 3261127 - RNA, 22 nt, Mycobacterium tuberculosis H37Rv
ggccaccccgaccucccggcaa

SEQ ID NO: 3261128 - RNA, 24 nt, Mycobacterium tuberculosis H37Rv
ggccacccgcaggucgcaccacag

SEQ ID NO: 3261129 - RNA, 17 nt, Mycobacterium tuberculosis H37Rv
ggccaccgaacgcggcc

SEQ ID NO: 3261130 - RNA, 22 nt, Mycobacterium tuberculosis H37Rv
ggccaccgaacgcggccaccga

SEQ ID NO: 3261131 - RNA, 13 nt, Mycobacterium tuberculosis H37Rv
ggccaccgcagac

SEQ ID NO: 3261132 - RNA, 16 nt, Mycobacterium tuberculosis H37Rv
ggccaccgcccagugc

SEQ ID NO: 3261133 - RNA, 14 nt, Mycobacterium tuberculosis H37Rv
ggccaccgccgccg

SEQ ID NO: 3261134 - RNA, 16 nt, Mycobacterium tuberculosis H37Rv
ggccaccgccgccugc

SEQ ID NO: 3261135 - RNA, 19 nt, Mycobacterium tuberculosis H37Rv
ggccaccgccgccugcccg

SEQ ID NO: 3261136 - RNA, 13 nt, Mycobacterium tuberculosis H37Rv
ggccaccggcgcc

SEQ ID NO: 3261137 - RNA, 13 nt, Mycobacterium tuberculosis H37Rv
ggccaccggcggu

SEQ ID NO: 3261138 - RNA, 14 nt, Mycobacterium tuberculosis H37Rv
ggccaccggcgguc

SEQ ID NO: 3261139 - RNA, 23 nt, Mycobacterium tuberculosis H37Rv
ggccaccggcugcaaccagcggc

SEQ ID NO: 3261140 - RNA, 22 nt, Mycobacterium tuberculosis H37Rv
ggccaccguaaacagcgcgccg

SEQ ID NO: 3261141 - RNA, 16 nt, Mycobacterium tuberculosis H37Rv
ggccaccguagccagc

SEQ ID NO: 3261142 - RNA, 19 nt, Mycobacterium tuberculosis H37Rv
ggccaccguagccagcagg

SEQ ID NO: 3261143 - RNA, 17 nt, Mycobacterium tuberculosis H37Rv
ggccaccgucagcgcga

SEQ ID NO: 3261144 - RNA, 12 nt, Mycobacterium tuberculosis H37Rv
ggccaccgucgc

SEQ ID NO: 3261145 - RNA, 16 nt, Mycobacterium tuberculosis H37Rv
ggccaccuccgaggcc

SEQ ID NO: 3261146 - RNA, 23 nt, Mycobacterium tuberculosis H37Rv
ggccaccucggugcggaacaccg

SEQ ID NO: 3261147 - RNA, 16 nt, Mycobacterium tuberculosis H37Rv
ggccaccucuucucgg

SEQ ID NO: 3261148 - RNA, 16 nt, Mycobacterium tuberculosis H37Rv
ggccaccugcuggccg

SEQ ID NO: 3261149 - RNA, 17 nt, Mycobacterium tuberculosis H37Rv
ggccagcuccucagcca

SEQ ID NO: 3261150 - RNA, 22 nt, Mycobacterium tuberculosis H37Rv
ggccagcuccucagccaccgcg

SEQ ID NO: 3261151 - RNA, 19 nt, Mycobacterium tuberculosis H37Rv
ggccagcugcggcuccggc

SEQ ID NO: 3261152 - RNA, 21 nt, Mycobacterium tuberculosis H37Rv
ggccagcuugcggagccgccg

SEQ ID NO: 3261153 - RNA, 14 nt, Mycobacterium tuberculosis H37Rv
ggccaggaccaacu

SEQ ID NO: 3261154 - RNA, 20 nt, Mycobacterium tuberculosis H37Rv
ggccaggauaaguccggaca

SEQ ID NO: 3261155 - RNA, 15 nt, Mycobacterium tuberculosis H37Rv
ggccaggccggcggc

SEQ ID NO: 3261156 - RNA, 17 nt, Mycobacterium tuberculosis H37Rv
ggccaggcgaagucgac

SEQ ID NO: 3261157 - RNA, 20 nt, Mycobacterium tuberculosis H37Rv
ggccaggcgguacgggucgc

SEQ ID NO: 3261158 - RNA, 22 nt, Mycobacterium tuberculosis H37Rv
ggccaggcgguacgggucgccg

SEQ ID NO: 3261159 - RNA, 23 nt, Mycobacterium tuberculosis H37Rv
ggccaggcgguacgggucgccgg

SEQ ID NO: 3261160 - RNA, 16 nt, Mycobacterium tuberculosis H37Rv
ggccaggcugcgcagu

SEQ ID NO: 3261161 - RNA, 16 nt, Mycobacterium tuberculosis H37Rv
ggccaggggaucaccg

SEQ ID NO: 3261162 - RNA, 17 nt, Mycobacterium tuberculosis H37Rv
ggccaggggaucaccgg

SEQ ID NO: 3261163 - RNA, 18 nt, Mycobacterium tuberculosis H37Rv
ggccaggggaucaccggc

SEQ ID NO: 3261164 - RNA, 19 nt, Mycobacterium tuberculosis H37Rv
ggccaggggaucaccggcu

SEQ ID NO: 3261165 - RNA, 15 nt, Mycobacterium tuberculosis H37Rv
ggccagggugaccag

SEQ ID NO: 3261166 - RNA, 20 nt, Mycobacterium tuberculosis H37Rv
ggccagguaauugccgaccg

SEQ ID NO: 3261167 - RNA, 21 nt, Mycobacterium tuberculosis H37Rv
ggccagguaauugccgaccgc

SEQ ID NO: 3261168 - RNA, 18 nt, Mycobacterium tuberculosis H37Rv
ggccaggucagccgcgcg

SEQ ID NO: 3261169 - RNA, 14 nt, Mycobacterium tuberculosis H37Rv
ggccaggucgacgg

SEQ ID NO: 3261170 - RNA, 16 nt, Mycobacterium tuberculosis H37Rv
ggccaggucgagcacc

SEQ ID NO: 3261171 - RNA, 23 nt, Mycobacterium tuberculosis H37Rv
ggccaggucgagcaccggcugcg

SEQ ID NO: 3261172 - RNA, 13 nt, Mycobacterium tuberculosis H37Rv
ggccaggucgcca

SEQ ID NO: 3261173 - RNA, 14 nt, Mycobacterium tuberculosis H37Rv
ggccaggucggcca

SEQ ID NO: 3261174 - RNA, 16 nt, Mycobacterium tuberculosis H37Rv
ggccaggucggccacc

SEQ ID NO: 3261175 - RNA, 15 nt, Mycobacterium tuberculosis H37Rv
ggccaggucggcgau

SEQ ID NO: 3261176 - RNA, 14 nt, Mycobacterium tuberculosis H37Rv
ggccaggugcaggc

SEQ ID NO: 3261177 - RNA, 15 nt, Mycobacterium tuberculosis H37Rv
ggccaggugcagggu

SEQ ID NO: 3261178 - RNA, 16 nt, Mycobacterium tuberculosis H37Rv
ggccagguggcgagcg

SEQ ID NO: 3261179 - RNA, 17 nt, Mycobacterium tuberculosis H37Rv
ggccaguacgucgauca

SEQ ID NO: 3261180 - RNA, 15 nt, Mycobacterium tuberculosis H37Rv
ggccaguaugcggug

SEQ ID NO: 3261181 - RNA, 22 nt, Mycobacterium tuberculosis H37Rv
ggccaguaugcggugcccgccc

SEQ ID NO: 3261182 - RNA, 13 nt, Mycobacterium tuberculosis H37Rv
ggccaguccgggg

SEQ ID NO: 3261183 - RNA, 14 nt, Mycobacterium tuberculosis H37Rv
ggccagucgugcuu

SEQ ID NO: 3261184 - RNA, 13 nt, Mycobacterium tuberculosis H37Rv
ggccagugccacc

SEQ ID NO: 3261185 - RNA, 22 nt, Mycobacterium tuberculosis H37Rv
ggccagugccgguucgauggca

SEQ ID NO: 3261186 - RNA, 17 nt, Mycobacterium tuberculosis H37Rv
ggccagugcgcgcguca

SEQ ID NO: 3261187 - RNA, 17 nt, Mycobacterium tuberculosis H37Rv
ggccagugucagcacga

SEQ ID NO: 3261188 - RNA, 21 nt, Mycobacterium tuberculosis H37Rv
ggccaguucggcggccgccgc

SEQ ID NO: 3261189 - RNA, 16 nt, Mycobacterium tuberculosis H37Rv
ggccaguucggugagc

SEQ ID NO: 3261190 - RNA, 16 nt, Mycobacterium tuberculosis H37Rv
ggccaguucgucggcg

SEQ ID NO: 3261191 - RNA, 18 nt, Mycobacterium tuberculosis H37Rv
ggccaguuggccggccag

SEQ ID NO: 3261192 - RNA, 23 nt, Mycobacterium tuberculosis H37Rv
ggccauaaaugcgcguucgaccu

SEQ ID NO: 3261193 - RNA, 19 nt, Mycobacterium tuberculosis H37Rv
ggccauaccgcucgccguu

SEQ ID NO: 3261194 - RNA, 14 nt, Mycobacterium tuberculosis H37Rv
ggccauacgcgcgc

SEQ ID NO: 3261195 - RNA, 19 nt, Mycobacterium tuberculosis H37Rv
ggccauagcgccgcgccca

SEQ ID NO: 3261196 - RNA, 23 nt, Mycobacterium tuberculosis H37Rv
ggccauagugaggccgaccagca

SEQ ID NO: 3261197 - RNA, 15 nt, Mycobacterium tuberculosis H37Rv
ggccaucaccgcgcu

SEQ ID NO: 3261198 - RNA, 19 nt, Mycobacterium tuberculosis H37Rv
ggccaucaccgcgcucucg

SEQ ID NO: 3261199 - RNA, 14 nt, Mycobacterium tuberculosis H37Rv
ggccaucacgguca

SEQ ID NO: 3261200 - RNA, 16 nt, Mycobacterium tuberculosis H37Rv
ggccaucacggucagc

SEQ ID NO: 3261201 - RNA, 19 nt, Mycobacterium tuberculosis H37Rv
ggccaucacggucagcucg

SEQ ID NO: 3261202 - RNA, 16 nt, Mycobacterium tuberculosis H37Rv
ggccaucagcucgcca

SEQ ID NO: 3261203 - RNA, 20 nt, Mycobacterium tuberculosis H37Rv
ggccaucagcucgccagggu

SEQ ID NO: 3261204 - RNA, 13 nt, Mycobacterium tuberculosis H37Rv
ggccaucccggcc

SEQ ID NO: 3261205 - RNA, 21 nt, Mycobacterium tuberculosis H37Rv
ggccauccggucgcucgaugg

SEQ ID NO: 3261206 - RNA, 20 nt, Mycobacterium tuberculosis H37Rv
ggccaucgcauccccagcac

SEQ ID NO: 3261207 - RNA, 22 nt, Mycobacterium tuberculosis H37Rv
ggccaucgcauccccagcacaa

SEQ ID NO: 3261208 - RNA, 22 nt, Mycobacterium tuberculosis H37Rv
ggccaucgccgacacccucggg

SEQ ID NO: 3261209 - RNA, 19 nt, Mycobacterium tuberculosis H37Rv
ggccaucgcgcggaccaga

SEQ ID NO: 3261210 - RNA, 14 nt, Mycobacterium tuberculosis H37Rv
ggccaucgucagga

SEQ ID NO: 3261211 - RNA, 14 nt, Mycobacterium tuberculosis H37Rv
ggccaucguccagc

SEQ ID NO: 3261212 - RNA, 12 nt, Mycobacterium tuberculosis H37Rv
ggccaucgucgu

SEQ ID NO: 3261213 - RNA, 19 nt, Mycobacterium tuberculosis H37Rv
ggccaucugauccgguguc

SEQ ID NO: 3261214 - RNA, 13 nt, Mycobacterium tuberculosis H37Rv
ggccaucugcucg

SEQ ID NO: 3261215 - RNA, 14 nt, Mycobacterium tuberculosis H37Rv
ggccaucugcucgu

SEQ ID NO: 3261216 - RNA, 12 nt, Mycobacterium tuberculosis H37Rv
ggccaugaugau

SEQ ID NO: 3261217 - RNA, 21 nt, Mycobacterium tuberculosis H37Rv
ggccaugcuaggaccaccagc

SEQ ID NO: 3261218 - RNA, 13 nt, Mycobacterium tuberculosis H37Rv
ggccaugcugguc

SEQ ID NO: 3261219 - RNA, 21 nt, Mycobacterium tuberculosis H37Rv
ggccaugcuggucagcggcgc

SEQ ID NO: 3261220 - RNA, 21 nt, Mycobacterium tuberculosis H37Rv
ggccauggacgccauggugaa

SEQ ID NO: 3261221 - RNA, 22 nt, Mycobacterium tuberculosis H37Rv
ggccauguagccguugccgccg

SEQ ID NO: 3261222 - RNA, 17 nt, Mycobacterium tuberculosis H37Rv
ggccaugucagcggccu

SEQ ID NO: 3261223 - RNA, 22 nt, Mycobacterium tuberculosis H37Rv
ggccaugucagcggccugcucg

SEQ ID NO: 3261224 - RNA, 23 nt, Mycobacterium tuberculosis H37Rv
ggccaugucagcggccugcucgg

SEQ ID NO: 3261225 - RNA, 16 nt, Mycobacterium tuberculosis H37Rv
ggccauguccaccagc

SEQ ID NO: 3261226 - RNA, 17 nt, Mycobacterium tuberculosis H37Rv
ggccaugugcacggcgu

SEQ ID NO: 3261227 - RNA, 16 nt, Mycobacterium tuberculosis H37Rv
ggccauguggacggca

SEQ ID NO: 3261228 - RNA, 16 nt, Mycobacterium tuberculosis H37Rv
ggcccacaccagcgca

SEQ ID NO: 3261229 - RNA, 14 nt, Mycobacterium tuberculosis H37Rv
ggcccaccagcgca

SEQ ID NO: 3261230 - RNA, 17 nt, Mycobacterium tuberculosis H37Rv
ggcccaccagcgcagcc

SEQ ID NO: 3261231 - RNA, 13 nt, Mycobacterium tuberculosis H37Rv
ggcccaccgacgg

SEQ ID NO: 3261232 - RNA, 18 nt, Mycobacterium tuberculosis H37Rv
ggcccaccgcugcggcac

SEQ ID NO: 3261233 - RNA, 15 nt, Mycobacterium tuberculosis H37Rv
ggcccaccggccacu

SEQ ID NO: 3261234 - RNA, 17 nt, Mycobacterium tuberculosis H37Rv
ggcccaccggucgcgca

SEQ ID NO: 3261235 - RNA, 12 nt, Mycobacterium tuberculosis H37Rv
ggcccacggcag

SEQ ID NO: 3261236 - RNA, 16 nt, Mycobacterium tuberculosis H37Rv
ggcccacggcagcgcc

SEQ ID NO: 3261237 - RNA, 13 nt, Mycobacterium tuberculosis H37Rv
ggcccacggcgac

SEQ ID NO: 3261238 - RNA, 17 nt, Mycobacterium tuberculosis H37Rv
ggcccacggcgaccagg

SEQ ID NO: 3261239 - RNA, 18 nt, Mycobacterium tuberculosis H37Rv
ggcccacggcgaccagga

SEQ ID NO: 3261240 - RNA, 15 nt, Mycobacterium tuberculosis H37Rv
ggcccacggugcgau

SEQ ID NO: 3261241 - RNA, 20 nt, Mycobacterium tuberculosis H37Rv
ggcccacggugcgaucccca

SEQ ID NO: 3261242 - RNA, 21 nt, Mycobacterium tuberculosis H37Rv
ggcccacggugcgauccccaa

SEQ ID NO: 3261243 - RNA, 19 nt, Mycobacterium tuberculosis H37Rv
ggcccacuugugacccggc

SEQ ID NO: 3261244 - RNA, 16 nt, Mycobacterium tuberculosis H37Rv
ggcccagauaucguac

SEQ ID NO: 3261245 - RNA, 23 nt, Mycobacterium tuberculosis H37Rv
ggcccgcgcgagagccuccaugg

SEQ ID NO: 3261246 - RNA, 12 nt, Mycobacterium tuberculosis H37Rv
ggcccgcgcggc

SEQ ID NO: 3261247 - RNA, 12 nt, Mycobacterium tuberculosis H37Rv
ggcccgcgcgua

SEQ ID NO: 3261248 - RNA, 22 nt, Mycobacterium tuberculosis H37Rv
ggcccgcgcguacccgaucagc

SEQ ID NO: 3261249 - RNA, 13 nt, Mycobacterium tuberculosis H37Rv
ggcccgcgggauc

SEQ ID NO: 3261250 - RNA, 12 nt, Mycobacterium tuberculosis H37Rv
ggcccgcgguga

SEQ ID NO: 3261251 - RNA, 21 nt, Mycobacterium tuberculosis H37Rv
ggcccgcggugacgcaacauc

SEQ ID NO: 3261252 - RNA, 21 nt, Mycobacterium tuberculosis H37Rv
ggcccgcucccugcacccagc

SEQ ID NO: 3261253 - RNA, 14 nt, Mycobacterium tuberculosis H37Rv
ggcccgcucggggu

SEQ ID NO: 3261254 - RNA, 22 nt, Mycobacterium tuberculosis H37Rv
ggcccgcucgggguugcucgcg

SEQ ID NO: 3261255 - RNA, 16 nt, Mycobacterium tuberculosis H37Rv
ggcccgcuguggucuu

SEQ ID NO: 3261256 - RNA, 20 nt, Mycobacterium tuberculosis H37Rv
ggcccggacaugcgggcagc

SEQ ID NO: 3261257 - RNA, 19 nt, Mycobacterium tuberculosis H37Rv
ggcccggacgucggcggcc

SEQ ID NO: 3261258 - RNA, 14 nt, Mycobacterium tuberculosis H37Rv
ggcccggcaggacu

SEQ ID NO: 3261259 - RNA, 14 nt, Mycobacterium tuberculosis H37Rv
ggcccggcgcggcc

SEQ ID NO: 3261260 - RNA, 19 nt, Mycobacterium tuberculosis H37Rv
ggcccggcgcggccgcaag

SEQ ID NO: 3261261 - RNA, 15 nt, Mycobacterium tuberculosis H37Rv
ggcccggcggccagc

SEQ ID NO: 3261262 - RNA, 18 nt, Mycobacterium tuberculosis H37Rv
ggcccggcuacgacggcg

SEQ ID NO: 3261263 - RNA, 19 nt, Mycobacterium tuberculosis H37Rv
ggcccggcucggugcgcca

SEQ ID NO: 3261264 - RNA, 19 nt, Mycobacterium tuberculosis H37Rv
ggcccgggaggcguugcac

SEQ ID NO: 3261265 - RNA, 12 nt, Mycobacterium tuberculosis H37Rv
ggcccgggcggc

SEQ ID NO: 3261266 - RNA, 16 nt, Mycobacterium tuberculosis H37Rv
ggcccgggcggccagc

SEQ ID NO: 3261267 - RNA, 16 nt, Mycobacterium tuberculosis H37Rv
ggcccgggcucggcga

SEQ ID NO: 3261268 - RNA, 19 nt, Mycobacterium tuberculosis H37Rv
ggcccggggacgcccucgg

SEQ ID NO: 3261269 - RNA, 20 nt, Mycobacterium tuberculosis H37Rv
ggcccggggacgcccucggg

SEQ ID NO: 3261270 - RNA, 19 nt, Mycobacterium tuberculosis H37Rv
ggcccgggucuccggcgca

SEQ ID NO: 3261271 - RNA, 23 nt, Mycobacterium tuberculosis H37Rv
ggcccgggucuccggcgcaccug

SEQ ID NO: 3261272 - RNA, 16 nt, Mycobacterium tuberculosis H37Rv
ggcccgggugacggga

SEQ ID NO: 3261273 - RNA, 17 nt, Mycobacterium tuberculosis H37Rv
ggcccgguccgccauug

SEQ ID NO: 3261274 - RNA, 24 nt, Mycobacterium tuberculosis H37Rv
ggcccggucuacgccaccgagauc

SEQ ID NO: 3261275 - RNA, 19 nt, Mycobacterium tuberculosis H37Rv
ggcccggucuugggcgcgg

SEQ ID NO: 3261276 - RNA, 12 nt, Mycobacterium tuberculosis H37Rv
ggcccggugcuc

SEQ ID NO: 3261277 - RNA, 14 nt, Mycobacterium tuberculosis H37Rv
ggcccgguucgagg

SEQ ID NO: 3261278 - RNA, 20 nt, Mycobacterium tuberculosis H37Rv
ggcccguagcgucgaucacg

SEQ ID NO: 3261279 - RNA, 20 nt, Mycobacterium tuberculosis H37Rv
ggcccgucauacucgacacc

SEQ ID NO: 3261280 - RNA, 12 nt, Mycobacterium tuberculosis H37Rv
ggcccgucgcgu

SEQ ID NO: 3261281 - RNA, 15 nt, Mycobacterium tuberculosis H37Rv
ggcccgucgcgucga

SEQ ID NO: 3261282 - RNA, 17 nt, Mycobacterium tuberculosis H37Rv
ggcccgucgcgucgacc

SEQ ID NO: 3261283 - RNA, 22 nt, Mycobacterium tuberculosis H37Rv
ggcccgucggcgugcggacuga

SEQ ID NO: 3261284 - RNA, 18 nt, Mycobacterium tuberculosis H37Rv
ggcccgugccacagcucg

SEQ ID NO: 3261285 - RNA, 21 nt, Mycobacterium tuberculosis H37Rv
ggcccgugccacagcucgccg

SEQ ID NO: 3261286 - RNA, 22 nt, Mycobacterium tuberculosis H37Rv
ggcccgugccuggccggugcgc

SEQ ID NO: 3261287 - RNA, 19 nt, Mycobacterium tuberculosis H37Rv
ggcccguuggcagcacagg

SEQ ID NO: 3261288 - RNA, 19 nt, Mycobacterium tuberculosis H37Rv
ggcccguuugccgguucgg

SEQ ID NO: 3261289 - RNA, 18 nt, Mycobacterium tuberculosis H37Rv
ggcccuagccggcgcgcc

SEQ ID NO: 3261290 - RNA, 19 nt, Mycobacterium tuberculosis H37Rv
ggcccuagccggcgcgccc

SEQ ID NO: 3261291 - RNA, 18 nt, Mycobacterium tuberculosis H37Rv
ggcccuccacugcgagcg

SEQ ID NO: 3261292 - RNA, 21 nt, Mycobacterium tuberculosis H37Rv
ggcccuccggcgcagcgaccg

SEQ ID NO: 3261293 - RNA, 19 nt, Mycobacterium tuberculosis H37Rv
ggcccucgagcagugccgu

SEQ ID NO: 3261294 - RNA, 13 nt, Mycobacterium tuberculosis H37Rv
ggcccucgccaga

SEQ ID NO: 3261295 - RNA, 13 nt, Mycobacterium tuberculosis H37Rv
ggcccucgcgcgc

SEQ ID NO: 3261296 - RNA, 18 nt, Mycobacterium tuberculosis H37Rv
ggcccucgcgcgcgucga

SEQ ID NO: 3261297 - RNA, 14 nt, Mycobacterium tuberculosis H37Rv
ggcccucggcgauc

SEQ ID NO: 3261298 - RNA, 23 nt, Mycobacterium tuberculosis H37Rv
ggcccucuaugcgggcagcgauc

SEQ ID NO: 3261299 - RNA, 19 nt, Mycobacterium tuberculosis H37Rv
ggcccugagcugccgagcg

SEQ ID NO: 3261300 - RNA, 20 nt, Mycobacterium tuberculosis H37Rv
ggcccugcacagcagcguca

SEQ ID NO: 3261301 - RNA, 19 nt, Mycobacterium tuberculosis H37Rv
ggcccugccgacgcuccag

SEQ ID NO: 3261302 - RNA, 16 nt, Mycobacterium tuberculosis H37Rv
ggcccugccgccggcc

SEQ ID NO: 3261303 - RNA, 22 nt, Mycobacterium tuberculosis H37Rv
ggcccugcuccucgcgggcggc

SEQ ID NO: 3261304 - RNA, 11 nt, Mycobacterium tuberculosis H37Rv
ggcccugcugg

SEQ ID NO: 3261305 - RNA, 16 nt, Mycobacterium tuberculosis H37Rv
ggcccugcuggcccaa

SEQ ID NO: 3261306 - RNA, 14 nt, Mycobacterium tuberculosis H37Rv
ggcccuggccagcc

SEQ ID NO: 3261307 - RNA, 23 nt, Mycobacterium tuberculosis H37Rv
ggcccugggugguuccgcgcggc

SEQ ID NO: 3261308 - RNA, 17 nt, Mycobacterium tuberculosis H37Rv
ggcccuugcucguccag

SEQ ID NO: 3261309 - RNA, 21 nt, Mycobacterium tuberculosis H37Rv
ggcccuuguggaguacggcga

SEQ ID NO: 3261310 - RNA, 23 nt, Mycobacterium tuberculosis H37Rv
ggcccuuguggaguacggcgaug

SEQ ID NO: 3261311 - RNA, 21 nt, Mycobacterium tuberculosis H37Rv
ggcccuuguuggccugcaacg

SEQ ID NO: 3261312 - RNA, 23 nt, Mycobacterium tuberculosis H37Rv
ggccgaaaacgacaucaccaccg

SEQ ID NO: 3261313 - RNA, 22 nt, Mycobacterium tuberculosis H37Rv
ggccgaaacuucgcccgggccg

SEQ ID NO: 3261314 - RNA, 15 nt, Mycobacterium tuberculosis H37Rv
ggccgaacagcaggc

SEQ ID NO: 3261315 - RNA, 22 nt, Mycobacterium tuberculosis H37Rv
ggccgaacagcugcccgccagc

SEQ ID NO: 3261316 - RNA, 16 nt, Mycobacterium tuberculosis H37Rv
ggccgaaccguucggc

SEQ ID NO: 3261317 - RNA, 17 nt, Mycobacterium tuberculosis H37Rv
ggccgaacgccucgccg

SEQ ID NO: 3261318 - RNA, 18 nt, Mycobacterium tuberculosis H37Rv
ggccgaacgggucggcga

SEQ ID NO: 3261319 - RNA, 19 nt, Mycobacterium tuberculosis H37Rv
ggccgaacgggucggcgac

SEQ ID NO: 3261320 - RNA, 20 nt, Mycobacterium tuberculosis H37Rv
ggccgaacgggucggcgacc

SEQ ID NO: 3261321 - RNA, 21 nt, Mycobacterium tuberculosis H37Rv
ggccgaacugccgcgccgacg

SEQ ID NO: 3261322 - RNA, 20 nt, Mycobacterium tuberculosis H37Rv
ggccgaagcucacacuggcu

SEQ ID NO: 3261323 - RNA, 17 nt, Mycobacterium tuberculosis H37Rv
ggccgacaacccggccg

SEQ ID NO: 3261324 - RNA, 17 nt, Mycobacterium tuberculosis H37Rv
ggccgacaaugucggcg

SEQ ID NO: 3261325 - RNA, 20 nt, Mycobacterium tuberculosis H37Rv
ggccgacaaugucggcgaug

SEQ ID NO: 3261326 - RNA, 11 nt, Mycobacterium tuberculosis H37Rv
ggccgacaccg

SEQ ID NO: 3261327 - RNA, 17 nt, Mycobacterium tuberculosis H37Rv
ggccgacaccgccacca

SEQ ID NO: 3261328 - RNA, 19 nt, Mycobacterium tuberculosis H37Rv
ggccgacaccgccaccacg

SEQ ID NO: 3261329 - RNA, 17 nt, Mycobacterium tuberculosis H37Rv
ggccgacacgccgaugc

SEQ ID NO: 3261330 - RNA, 23 nt, Mycobacterium tuberculosis H37Rv
ggccgacacgccgaugccgaacu

SEQ ID NO: 3261331 - RNA, 17 nt, Mycobacterium tuberculosis H37Rv
ggccgacagccaccgcg

SEQ ID NO: 3261332 - RNA, 13 nt, Mycobacterium tuberculosis H37Rv
ggccgaccagagc

SEQ ID NO: 3261333 - RNA, 22 nt, Mycobacterium tuberculosis H37Rv
ggccgaccagagcuucgccgcg

SEQ ID NO: 3261334 - RNA, 18 nt, Mycobacterium tuberculosis H37Rv
ggccgaccagcacaccgg

SEQ ID NO: 3261335 - RNA, 12 nt, Mycobacterium tuberculosis H37Rv
ggccgaccagcc

SEQ ID NO: 3261336 - RNA, 23 nt, Mycobacterium tuberculosis H37Rv
ggccgaccagccgaucaucaccg

SEQ ID NO: 3261337 - RNA, 17 nt, Mycobacterium tuberculosis H37Rv
ggccgaccagucgacgu

SEQ ID NO: 3261338 - RNA, 16 nt, Mycobacterium tuberculosis H37Rv
ggccgacccggauguc

SEQ ID NO: 3261339 - RNA, 22 nt, Mycobacterium tuberculosis H37Rv
ggccgaccgcgacccggcccag

SEQ ID NO: 3261340 - RNA, 17 nt, Mycobacterium tuberculosis H37Rv
ggccgccguccccgccg

SEQ ID NO: 3261341 - RNA, 19 nt, Mycobacterium tuberculosis H37Rv
ggccgccguccccgccguc

SEQ ID NO: 3261342 - RNA, 15 nt, Mycobacterium tuberculosis H37Rv
ggccgccguugccgu

SEQ ID NO: 3261343 - RNA, 23 nt, Mycobacterium tuberculosis H37Rv
ggccgccuacccguucuucgcga

SEQ ID NO: 3261344 - RNA, 16 nt, Mycobacterium tuberculosis H37Rv
ggccgccuccgcggca

SEQ ID NO: 3261345 - RNA, 15 nt, Mycobacterium tuberculosis H37Rv
ggccgccucgaucga

SEQ ID NO: 3261346 - RNA, 21 nt, Mycobacterium tuberculosis H37Rv
ggccgccugccucgccugcac

SEQ ID NO: 3261347 - RNA, 22 nt, Mycobacterium tuberculosis H37Rv
ggccgccuucgccgccgccgau

SEQ ID NO: 3261348 - RNA, 23 nt, Mycobacterium tuberculosis H37Rv
ggccgccuucgccgccgccgauc

SEQ ID NO: 3261349 - RNA, 23 nt, Mycobacterium tuberculosis H37Rv
ggccgccuucuccggcgucacgg

SEQ ID NO: 3261350 - RNA, 16 nt, Mycobacterium tuberculosis H37Rv
ggccgccuugaggccc

SEQ ID NO: 3261351 - RNA, 23 nt, Mycobacterium tuberculosis H37Rv
ggccgccuugaggcccugcggcc

SEQ ID NO: 3261352 - RNA, 13 nt, Mycobacterium tuberculosis H37Rv
ggccgcgaccagc

SEQ ID NO: 3261353 - RNA, 19 nt, Mycobacterium tuberculosis H37Rv
ggccgcgaccagcgccgca

SEQ ID NO: 3261354 - RNA, 23 nt, Mycobacterium tuberculosis H37Rv
ggccgcgaggugaaucgcgucga

SEQ ID NO: 3261355 - RNA, 14 nt, Mycobacterium tuberculosis H37Rv
ggccgcgauccagc

SEQ ID NO: 3261356 - RNA, 16 nt, Mycobacterium tuberculosis H37Rv
ggccgcgauccagcgc

SEQ ID NO: 3261357 - RNA, 20 nt, Mycobacterium tuberculosis H37Rv
ggccgcgauccagcgcugac

SEQ ID NO: 3261358 - RNA, 19 nt, Mycobacterium tuberculosis H37Rv
ggccgcgaucgacgguguc

SEQ ID NO: 3261359 - RNA, 15 nt, Mycobacterium tuberculosis H37Rv
ggccgcgcagauucc

SEQ ID NO: 3261360 - RNA, 11 nt, Mycobacterium tuberculosis H37Rv
ggccgcgcagg

SEQ ID NO: 3261361 - RNA, 19 nt, Mycobacterium tuberculosis H37Rv
ggccgcgcaggggcggcgu

SEQ ID NO: 3261362 - RNA, 21 nt, Mycobacterium tuberculosis H37Rv
ggccgcgcccgccucgaccgc

SEQ ID NO: 3261363 - RNA, 14 nt, Mycobacterium tuberculosis H37Rv
ggccgcgcccuggc

SEQ ID NO: 3261364 - RNA, 15 nt, Mycobacterium tuberculosis H37Rv
ggccgcgccggcccc

SEQ ID NO: 3261365 - RNA, 16 nt, Mycobacterium tuberculosis H37Rv
ggccgcgccggccccg

SEQ ID NO: 3261366 - RNA, 15 nt, Mycobacterium tuberculosis H37Rv
ggccgcgcgacaacc

SEQ ID NO: 3261367 - RNA, 21 nt, Mycobacterium tuberculosis H37Rv
ggccgcgcgacaacccggcgu

SEQ ID NO: 3261368 - RNA, 22 nt, Mycobacterium tuberculosis H37Rv
ggccgcgcgacaacccggcguc

SEQ ID NO: 3261369 - RNA, 22 nt, Mycobacterium tuberculosis H37Rv
ggccgcgcgcacuugcguggcg

SEQ ID NO: 3261370 - RNA, 18 nt, Mycobacterium tuberculosis H37Rv
ggccgcgcgcagggcguc

SEQ ID NO: 3261371 - RNA, 14 nt, Mycobacterium tuberculosis H37Rv
ggccgcgcgcucga

SEQ ID NO: 3261372 - RNA, 22 nt, Mycobacterium tuberculosis H37Rv
ggccgcgcgcucgagcaggcug

SEQ ID NO: 3261373 - RNA, 17 nt, Mycobacterium tuberculosis H37Rv
ggccgcgcggacccagc

SEQ ID NO: 3261374 - RNA, 22 nt, Mycobacterium tuberculosis H37Rv
ggccgcgcucaucgcggcgaac

SEQ ID NO: 3261375 - RNA, 14 nt, Mycobacterium tuberculosis H37Rv
ggccgcgcucgucg

SEQ ID NO: 3261376 - RNA, 15 nt, Mycobacterium tuberculosis H37Rv
ggccgcgcucgucga

SEQ ID NO: 3261377 - RNA, 13 nt, Mycobacterium tuberculosis H37Rv
ggccgcgcugaac

SEQ ID NO: 3261378 - RNA, 18 nt, Mycobacterium tuberculosis H37Rv
ggccgcgcugcagcacgg

SEQ ID NO: 3261379 - RNA, 14 nt, Mycobacterium tuberculosis H37Rv
ggccgcgcugguca

SEQ ID NO: 3261380 - RNA, 13 nt, Mycobacterium tuberculosis H37Rv
ggccgcggagaag

SEQ ID NO: 3261381 - RNA, 23 nt, Mycobacterium tuberculosis H37Rv
ggccgcggaugcucaggucaccg

SEQ ID NO: 3261382 - RNA, 15 nt, Mycobacterium tuberculosis H37Rv
ggccgcggcacccag

SEQ ID NO: 3261383 - RNA, 20 nt, Mycobacterium tuberculosis H37Rv
ggccgcggcacccagguguc

SEQ ID NO: 3261384 - RNA, 15 nt, Mycobacterium tuberculosis H37Rv
ggccgcggcacccgg

SEQ ID NO: 3261385 - RNA, 12 nt, Mycobacterium tuberculosis H37Rv
ggccgcggccuc

SEQ ID NO: 3261386 - RNA, 16 nt, Mycobacterium tuberculosis H37Rv
ggccgcggccucccgc

SEQ ID NO: 3261387 - RNA, 17 nt, Mycobacterium tuberculosis H37Rv
ggccgcggcgcggcggg

SEQ ID NO: 3261388 - RNA, 17 nt, Mycobacterium tuberculosis H37Rv
ggccgcggcggccagcg

SEQ ID NO: 3261389 - RNA, 19 nt, Mycobacterium tuberculosis H37Rv
ggccgcggcggccagcgca

SEQ ID NO: 3261390 - RNA, 14 nt, Mycobacterium tuberculosis H37Rv
ggccgcggcggccc

SEQ ID NO: 3261391 - RNA, 19 nt, Mycobacterium tuberculosis H37Rv
ggccgcggcggccccgcgc

SEQ ID NO: 3261392 - RNA, 14 nt, Mycobacterium tuberculosis H37Rv
ggccgcggcgucgu

SEQ ID NO: 3261393 - RNA, 16 nt, Mycobacterium tuberculosis H37Rv
ggccgcgggcgcggcc

SEQ ID NO: 3261394 - RNA, 22 nt, Mycobacterium tuberculosis H37Rv
ggccgcggucgauguccgcagc

SEQ ID NO: 3261395 - RNA, 18 nt, Mycobacterium tuberculosis H37Rv
ggccgcggucggccacca

SEQ ID NO: 3261396 - RNA, 24 nt, Mycobacterium tuberculosis H37Rv
ggccgcgguguauccgacgucggu

SEQ ID NO: 3261397 - RNA, 18 nt, Mycobacterium tuberculosis H37Rv
ggccgcguaaaccggcug

SEQ ID NO: 3261398 - RNA, 16 nt, Mycobacterium tuberculosis H37Rv
ggccgcgucacggacc

SEQ ID NO: 3261399 - RNA, 16 nt, Mycobacterium tuberculosis H37Rv
ggccgcuaugcagguc

SEQ ID NO: 3261400 - RNA, 22 nt, Mycobacterium tuberculosis H37Rv
ggccgcucagcgauuccacggc

SEQ ID NO: 3261401 - RNA, 15 nt, Mycobacterium tuberculosis H37Rv
ggccgcucgccucga

SEQ ID NO: 3261402 - RNA, 14 nt, Mycobacterium tuberculosis H37Rv
ggccgcugccacua

SEQ ID NO: 3261403 - RNA, 21 nt, Mycobacterium tuberculosis H37Rv
ggccgcugugggcgagucggg

SEQ ID NO: 3261404 - RNA, 22 nt, Mycobacterium tuberculosis H37Rv
ggccgcugugggucgauccggu

SEQ ID NO: 3261405 - RNA, 19 nt, Mycobacterium tuberculosis H37Rv
ggccgcuucggcggucagc

SEQ ID NO: 3261406 - RNA, 13 nt, Mycobacterium tuberculosis H37Rv
ggccgcuucgggc

SEQ ID NO: 3261407 - RNA, 21 nt, Mycobacterium tuberculosis H37Rv
ggccgcuugccccgccuuggc

SEQ ID NO: 3261408 - RNA, 19 nt, Mycobacterium tuberculosis H37Rv
ggccgcuuggccgcugccu

SEQ ID NO: 3261409 - RNA, 20 nt, Mycobacterium tuberculosis H37Rv
ggccgcuuugcgcggucagc

SEQ ID NO: 3261410 - RNA, 19 nt, Mycobacterium tuberculosis H37Rv
ggccggaagauccgggccu

SEQ ID NO: 3261411 - RNA, 21 nt, Mycobacterium tuberculosis H37Rv
ggccggacaacagagucaccg

SEQ ID NO: 3261412 - RNA, 20 nt, Mycobacterium tuberculosis H37Rv
ggccggacccauuggaccga

SEQ ID NO: 3261413 - RNA, 20 nt, Mycobacterium tuberculosis H37Rv
ggccggaccuuguuggccau

SEQ ID NO: 3261414 - RNA, 23 nt, Mycobacterium tuberculosis H37Rv
ggccggacugaagccgcgagcgc

SEQ ID NO: 3261415 - RNA, 19 nt, Mycobacterium tuberculosis H37Rv
ggccggagccggugccgac

SEQ ID NO: 3261416 - RNA, 15 nt, Mycobacterium tuberculosis H37Rv
ggccggagucgacga

SEQ ID NO: 3261417 - RNA, 16 nt, Mycobacterium tuberculosis H37Rv
ggccggagucgacgac

SEQ ID NO: 3261418 - RNA, 19 nt, Mycobacterium tuberculosis H37Rv
ggccggagucgacgacguc

SEQ ID NO: 3261419 - RNA, 16 nt, Mycobacterium tuberculosis H37Rv
ggccggauacggcgac

SEQ ID NO: 3261420 - RNA, 19 nt, Mycobacterium tuberculosis H37Rv
ggccggaucccagugccag

SEQ ID NO: 3261421 - RNA, 20 nt, Mycobacterium tuberculosis H37Rv
ggccggaugagcgaacgcca

SEQ ID NO: 3261422 - RNA, 16 nt, Mycobacterium tuberculosis H37Rv
ggccggaugucgacga

SEQ ID NO: 3261423 - RNA, 18 nt, Mycobacterium tuberculosis H37Rv
ggccggaugucgacgagc

SEQ ID NO: 3261424 - RNA, 18 nt, Mycobacterium tuberculosis H37Rv
ggccggcaacggcgcgcc

SEQ ID NO: 3261425 - RNA, 15 nt, Mycobacterium tuberculosis H37Rv
ggccggcacccacca

SEQ ID NO: 3261426 - RNA, 17 nt, Mycobacterium tuberculosis H37Rv
ggccggcaccccacggc

SEQ ID NO: 3261427 - RNA, 15 nt, Mycobacterium tuberculosis H37Rv
ggccggcaccgcagc

SEQ ID NO: 3261428 - RNA, 17 nt, Mycobacterium tuberculosis H37Rv
ggccggcagcggcuggg

SEQ ID NO: 3261429 - RNA, 17 nt, Mycobacterium tuberculosis H37Rv
ggccggcaucgucgggu

SEQ ID NO: 3261430 - RNA, 17 nt, Mycobacterium tuberculosis H37Rv
ggccggccaccaccgcg

SEQ ID NO: 3261431 - RNA, 19 nt, Mycobacterium tuberculosis H37Rv
ggccggccaccaguccgau

SEQ ID NO: 3261432 - RNA, 13 nt, Mycobacterium tuberculosis H37Rv
ggccggccgagcg

SEQ ID NO: 3261433 - RNA, 20 nt, Mycobacterium tuberculosis H37Rv
ggccggccgagcgcacuggg

SEQ ID NO: 3261434 - RNA, 12 nt, Mycobacterium tuberculosis H37Rv
ggccggccgccg

SEQ ID NO: 3261435 - RNA, 14 nt, Mycobacterium tuberculosis H37Rv
ggccggccgcgauc

SEQ ID NO: 3261436 - RNA, 17 nt, Mycobacterium tuberculosis H37Rv
ggccggcgacgcgucga

SEQ ID NO: 3261437 - RNA, 14 nt, Mycobacterium tuberculosis H37Rv
ggccggcgauggcc

SEQ ID NO: 3261438 - RNA, 14 nt, Mycobacterium tuberculosis H37Rv
ggccggcgccggcg

SEQ ID NO: 3261439 - RNA, 13 nt, Mycobacterium tuberculosis H37Rv
ggccggcgcggcg

SEQ ID NO: 3261440 - RNA, 14 nt, Mycobacterium tuberculosis H37Rv
ggccggcggcggcg

SEQ ID NO: 3261441 - RNA, 17 nt, Mycobacterium tuberculosis H37Rv
ggccggcggcggcgcuc

SEQ ID NO: 3261442 - RNA, 22 nt, Mycobacterium tuberculosis H37Rv
ggccggcggcggcgcucggcca

SEQ ID NO: 3261443 - RNA, 13 nt, Mycobacterium tuberculosis H37Rv
ggccggcggcggu

SEQ ID NO: 3261444 - RNA, 16 nt, Mycobacterium tuberculosis H37Rv
ggccggcgggccugcc

SEQ ID NO: 3261445 - RNA, 13 nt, Mycobacterium tuberculosis H37Rv
ggccggcgguagc

SEQ ID NO: 3261446 - RNA, 17 nt, Mycobacterium tuberculosis H37Rv
ggccggcggucgccagu

SEQ ID NO: 3261447 - RNA, 18 nt, Mycobacterium tuberculosis H37Rv
ggccggcguagcggcgau

SEQ ID NO: 3261448 - RNA, 19 nt, Mycobacterium tuberculosis H37Rv
ggccggcguagcggcgaua

SEQ ID NO: 3261449 - RNA, 22 nt, Mycobacterium tuberculosis H37Rv
ggccggcguagcggcgauaccg

SEQ ID NO: 3261450 - RNA, 22 nt, Mycobacterium tuberculosis H37Rv
ggccggcguguucugaucggug

SEQ ID NO: 3261451 - RNA, 14 nt, Mycobacterium tuberculosis H37Rv
ggccggcuaccgcg

SEQ ID NO: 3261452 - RNA, 20 nt, Mycobacterium tuberculosis H37Rv
ggccggcucagucacgcacu

SEQ ID NO: 3261453 - RNA, 18 nt, Mycobacterium tuberculosis H37Rv
ggccggcucguccgggca

SEQ ID NO: 3261454 - RNA, 19 nt, Mycobacterium tuberculosis H37Rv
ggccggcucguccgggcag

SEQ ID NO: 3261455 - RNA, 16 nt, Mycobacterium tuberculosis H37Rv
ggccgggacggcgaua

SEQ ID NO: 3261456 - RNA, 22 nt, Mycobacterium tuberculosis H37Rv
ggccgggaucucgaaggccgcc

SEQ ID NO: 3261457 - RNA, 15 nt, Mycobacterium tuberculosis H37Rv
ggccgggcagugcgc

SEQ ID NO: 3261458 - RNA, 17 nt, Mycobacterium tuberculosis H37Rv
ggccgggcaguucacgg

SEQ ID NO: 3261459 - RNA, 22 nt, Mycobacterium tuberculosis H37Rv
ggccgggcccuccacugcgagc

SEQ ID NO: 3261460 - RNA, 14 nt, Mycobacterium tuberculosis H37Rv
ggccgggccgagug

SEQ ID NO: 3261461 - RNA, 15 nt, Mycobacterium tuberculosis H37Rv
ggccgggccggccac

SEQ ID NO: 3261462 - RNA, 15 nt, Mycobacterium tuberculosis H37Rv
ggccgggccugcacc

SEQ ID NO: 3261463 - RNA, 22 nt, Mycobacterium tuberculosis H37Rv
ggccgggcgaucgccugggcuu

SEQ ID NO: 3261464 - RNA, 23 nt, Mycobacterium tuberculosis H37Rv
ggccgggcgaucgccugggcuug

SEQ ID NO: 3261465 - RNA, 17 nt, Mycobacterium tuberculosis H37Rv
ggccgggcgcaagcagc

SEQ ID NO: 3261466 - RNA, 12 nt, Mycobacterium tuberculosis H37Rv
ggccgggcggcc

SEQ ID NO: 3261467 - RNA, 16 nt, Mycobacterium tuberculosis H37Rv
ggccgggcggccaggc

SEQ ID NO: 3261468 - RNA, 16 nt, Mycobacterium tuberculosis H37Rv
ggccgggcuccucugg

SEQ ID NO: 3261469 - RNA, 16 nt, Mycobacterium tuberculosis H37Rv
ggccggggucggcccg

SEQ ID NO: 3261470 - RNA, 19 nt, Mycobacterium tuberculosis H37Rv
ggccggggugccggcgaug

SEQ ID NO: 3261471 - RNA, 17 nt, Mycobacterium tuberculosis H37Rv
ggccgggucauccgugu

SEQ ID NO: 3261472 - RNA, 21 nt, Mycobacterium tuberculosis H37Rv
ggccgggucgaacuugaucac

SEQ ID NO: 3261473 - RNA, 21 nt, Mycobacterium tuberculosis H37Rv
ggccggguuaucggcagcagg

SEQ ID NO: 3261474 - RNA, 22 nt, Mycobacterium tuberculosis H37Rv
ggccggguuaucggcagcagga

SEQ ID NO: 3261475 - RNA, 17 nt, Mycobacterium tuberculosis H37Rv
ggccggguuccagcggc

SEQ ID NO: 3261476 - RNA, 23 nt, Mycobacterium tuberculosis H37Rv
ggccggguuccagcggcaccgcg

SEQ ID NO: 3261477 - RNA, 16 nt, Mycobacterium tuberculosis H37Rv
ggccgguacacgucca

SEQ ID NO: 3261478 - RNA, 23 nt, Mycobacterium tuberculosis H37Rv
ggccgguacacguccaguggcag

SEQ ID NO: 3261479 - RNA, 16 nt, Mycobacterium tuberculosis H37Rv
ggccgguaccgggacg

SEQ ID NO: 3261480 - RNA, 20 nt, Mycobacterium tuberculosis H37Rv
ggccgguaccgggacgaauc

SEQ ID NO: 3261481 - RNA, 21 nt, Mycobacterium tuberculosis H37Rv
ggccgguaccgggacgaaucc

SEQ ID NO: 3261482 - RNA, 17 nt, Mycobacterium tuberculosis H37Rv
ggccgguagcgcgggug

SEQ ID NO: 3261483 - RNA, 14 nt, Mycobacterium tuberculosis H37Rv
ggccgguaguagcu

SEQ ID NO: 3261484 - RNA, 16 nt, Mycobacterium tuberculosis H37Rv
ggccgguaguagcuga

SEQ ID NO: 3261485 - RNA, 19 nt, Mycobacterium tuberculosis H37Rv
ggccggucacguccgcggg

SEQ ID NO: 3261486 - RNA, 22 nt, Mycobacterium tuberculosis H37Rv
ggccggucccaucaguugcaca

SEQ ID NO: 3261487 - RNA, 13 nt, Mycobacterium tuberculosis H37Rv
ggccgguccgggg

SEQ ID NO: 3261488 - RNA, 12 nt, Mycobacterium tuberculosis H37Rv
ggccgguccggu

SEQ ID NO: 3261489 - RNA, 13 nt, Mycobacterium tuberculosis H37Rv
ggccggucgagac

SEQ ID NO: 3261490 - RNA, 21 nt, Mycobacterium tuberculosis H37Rv
ggccggugaugaucgcgccgg

SEQ ID NO: 3261491 - RNA, 20 nt, Mycobacterium tuberculosis H37Rv
ggccggugcgaauggugcaa

SEQ ID NO: 3261492 - RNA, 13 nt, Mycobacterium tuberculosis H37Rv
ggccggugcgcau

SEQ ID NO: 3261493 - RNA, 20 nt, Mycobacterium tuberculosis H37Rv
ggccgguggaaaagccacgg

SEQ ID NO: 3261494 - RNA, 21 nt, Mycobacterium tuberculosis H37Rv
ggccgguggaaaagccacggc

SEQ ID NO: 3261495 - RNA, 19 nt, Mycobacterium tuberculosis H37Rv
ggccgguggaaaccgggcg

SEQ ID NO: 3261496 - RNA, 13 nt, Mycobacterium tuberculosis H37Rv
ggccggugggccg

SEQ ID NO: 3261497 - RNA, 19 nt, Mycobacterium tuberculosis H37Rv
ggccgguggguagccagcg

SEQ ID NO: 3261498 - RNA, 20 nt, Mycobacterium tuberculosis H37Rv
ggccgguuagcaccaguucc

SEQ ID NO: 3261499 - RNA, 17 nt, Mycobacterium tuberculosis H37Rv
ggccgguucaggggugg

SEQ ID NO: 3261500 - RNA, 15 nt, Mycobacterium tuberculosis H37Rv
ggccgguuccucagc

SEQ ID NO: 3261501 - RNA, 16 nt, Mycobacterium tuberculosis H37Rv
ggccgguucgcccgag

SEQ ID NO: 3261502 - RNA, 16 nt, Mycobacterium tuberculosis H37Rv
ggccgguuggccagcc

SEQ ID NO: 3261503 - RNA, 15 nt, Mycobacterium tuberculosis H37Rv
ggccguacaacagcg

SEQ ID NO: 3261504 - RNA, 14 nt, Mycobacterium tuberculosis H37Rv
ggccguacgacggc

SEQ ID NO: 3261505 - RNA, 16 nt, Mycobacterium tuberculosis H37Rv
ggccguaggcggcgac

SEQ ID NO: 3261506 - RNA, 24 nt, Mycobacterium tuberculosis H37Rv
ggccguagucggcgaugcgcacca

SEQ ID NO: 3261507 - RNA, 20 nt, Mycobacterium tuberculosis H37Rv
ggccguagugcacgucggcg

SEQ ID NO: 3261508 - RNA, 17 nt, Mycobacterium tuberculosis H37Rv
ggccguaguggccggcu

SEQ ID NO: 3261509 - RNA, 18 nt, Mycobacterium tuberculosis H37Rv
ggccguaguggccggcuu

SEQ ID NO: 3261510 - RNA, 16 nt, Mycobacterium tuberculosis H37Rv
ggccguaucgucgagc

SEQ ID NO: 3261511 - RNA, 23 nt, Mycobacterium tuberculosis H37Rv
ggccgucagccaggugcccaagc

SEQ ID NO: 3261512 - RNA, 15 nt, Mycobacterium tuberculosis H37Rv
ggccgucaucgccgg

SEQ ID NO: 3261513 - RNA, 17 nt, Mycobacterium tuberculosis H37Rv
ggccgucaucgccgggu

SEQ ID NO: 3261514 - RNA, 16 nt, Mycobacterium tuberculosis H37Rv
ggccgucauggcccga

SEQ ID NO: 3261515 - RNA, 18 nt, Mycobacterium tuberculosis H37Rv
ggccgucccgcgagcagc

SEQ ID NO: 3261516 - RNA, 13 nt, Mycobacterium tuberculosis H37Rv
ggccguccgcacc

SEQ ID NO: 3261517 - RNA, 15 nt, Mycobacterium tuberculosis H37Rv
ggccguccgcaccgg

SEQ ID NO: 3261518 - RNA, 17 nt, Mycobacterium tuberculosis H37Rv
ggccguccgcaccggcg

SEQ ID NO: 3261519 - RNA, 20 nt, Mycobacterium tuberculosis H37Rv
ggccguccgcaccggcggcg

SEQ ID NO: 3261520 - RNA, 14 nt, Mycobacterium tuberculosis H37Rv
ggccguccggcgcc

SEQ ID NO: 3261521 - RNA, 13 nt, Mycobacterium tuberculosis H37Rv
ggccguccucggu

SEQ ID NO: 3261522 - RNA, 20 nt, Mycobacterium tuberculosis H37Rv
ggccguccucggucagcucg

SEQ ID NO: 3261523 - RNA, 22 nt, Mycobacterium tuberculosis H37Rv
ggccgucgaacgguagcacggu

SEQ ID NO: 3261524 - RNA, 15 nt, Mycobacterium tuberculosis H37Rv
ggccgucgacccagc

SEQ ID NO: 3261525 - RNA, 14 nt, Mycobacterium tuberculosis H37Rv
ggccgucgacgauc

SEQ ID NO: 3261526 - RNA, 21 nt, Mycobacterium tuberculosis H37Rv
ggccgucgacgaucagcgagu

SEQ ID NO: 3261527 - RNA, 12 nt, Mycobacterium tuberculosis H37Rv
ggccgucgacgc

SEQ ID NO: 3261528 - RNA, 23 nt, Mycobacterium tuberculosis H37Rv
ggccgucgacgcaugggucaugg

SEQ ID NO: 3261529 - RNA, 20 nt, Mycobacterium tuberculosis H37Rv
ggccgucgauugcaggucgg

SEQ ID NO: 3261530 - RNA, 12 nt, Mycobacterium tuberculosis H37Rv
ggccgucgccga

SEQ ID NO: 3261531 - RNA, 12 nt, Mycobacterium tuberculosis H37Rv
ggccgucgccgu

SEQ ID NO: 3261532 - RNA, 17 nt, Mycobacterium tuberculosis H37Rv
ggccugcgcgauccgcg

SEQ ID NO: 3261533 - RNA, 18 nt, Mycobacterium tuberculosis H37Rv
ggccugcgcuucguccag

SEQ ID NO: 3261534 - RNA, 22 nt, Mycobacterium tuberculosis H37Rv
ggccugcgcuucguccagcgau

SEQ ID NO: 3261535 - RNA, 21 nt, Mycobacterium tuberculosis H37Rv
ggccugcggcaccggcucagg

SEQ ID NO: 3261536 - RNA, 17 nt, Mycobacterium tuberculosis H37Rv
ggccuggaucgugccga

SEQ ID NO: 3261537 - RNA, 12 nt, Mycobacterium tuberculosis H37Rv
ggccuggccggu

SEQ ID NO: 3261538 - RNA, 16 nt, Mycobacterium tuberculosis H37Rv
ggccugggacggcggc

SEQ ID NO: 3261539 - RNA, 17 nt, Mycobacterium tuberculosis H37Rv
ggccugggccgcacaag

SEQ ID NO: 3261540 - RNA, 16 nt, Mycobacterium tuberculosis H37Rv
ggccugguacucccgc

SEQ ID NO: 3261541 - RNA, 23 nt, Mycobacterium tuberculosis H37Rv
ggccugguacucccgcgaucgcg

SEQ ID NO: 3261542 - RNA, 17 nt, Mycobacterium tuberculosis H37Rv
ggccugucaggcggcgg

SEQ ID NO: 3261543 - RNA, 21 nt, Mycobacterium tuberculosis H37Rv
ggccugucgaagauccagcgc

SEQ ID NO: 3261544 - RNA, 22 nt, Mycobacterium tuberculosis H37Rv
ggccugucgaagauccagcgca

SEQ ID NO: 3261545 - RNA, 15 nt, Mycobacterium tuberculosis H37Rv
ggccuguucgagauc

SEQ ID NO: 3261546 - RNA, 19 nt, Mycobacterium tuberculosis H37Rv
ggccuguucgagaucgccg

SEQ ID NO: 3261547 - RNA, 15 nt, Mycobacterium tuberculosis H37Rv
ggccuguucggcggc

SEQ ID NO: 3261548 - RNA, 17 nt, Mycobacterium tuberculosis H37Rv
ggccuuauucacccggu

SEQ ID NO: 3261549 - RNA, 22 nt, Mycobacterium tuberculosis H37Rv
ggccuucaaggaagccgcggcc

SEQ ID NO: 3261550 - RNA, 12 nt, Mycobacterium tuberculosis H37Rv
ggccuucgccga

SEQ ID NO: 3261551 - RNA, 12 nt, Mycobacterium tuberculosis H37Rv
ggccuugacagc

SEQ ID NO: 3261552 - RNA, 18 nt, Mycobacterium tuberculosis H37Rv
ggccuugacagcuuucuu

SEQ ID NO: 3261553 - RNA, 13 nt, Mycobacterium tuberculosis H37Rv
ggccuugccaccg

SEQ ID NO: 3261554 - RNA, 22 nt, Mycobacterium tuberculosis H37Rv
ggccuugcgcacaggcgcgauc

SEQ ID NO: 3261555 - RNA, 22 nt, Mycobacterium tuberculosis H37Rv
ggccuugcucagcacgccgggu

SEQ ID NO: 3261556 - RNA, 18 nt, Mycobacterium tuberculosis H37Rv
ggccuuggcaguccagcc

SEQ ID NO: 3261557 - RNA, 24 nt, Mycobacterium tuberculosis H37Rv
ggccuuggcgaucuuguccagggu

SEQ ID NO: 3261558 - RNA, 15 nt, Mycobacterium tuberculosis H37Rv
ggccuuggcggcggc

SEQ ID NO: 3261559 - RNA, 14 nt, Mycobacterium tuberculosis H37Rv
ggccuugggcggca

SEQ ID NO: 3261560 - RNA, 20 nt, Mycobacterium tuberculosis H37Rv
ggccuuguucuuggccaccc

SEQ ID NO: 3261561 - RNA, 22 nt, Mycobacterium tuberculosis H37Rv
ggccuuguugccgcgccacugu

SEQ ID NO: 3261562 - RNA, 21 nt, Mycobacterium tuberculosis H37Rv
ggccuuuuggcgaaccgcaga

SEQ ID NO: 3261563 - RNA, 23 nt, Mycobacterium tuberculosis H37Rv
ggccuuuuggcgaaccgcagacc

SEQ ID NO: 3261564 - RNA, 21 nt, Mycobacterium tuberculosis H37Rv
ggcgaaaagacugcgccgccg

SEQ ID NO: 3261565 - RNA, 23 nt, Mycobacterium tuberculosis H37Rv
ggcgaaauagcccaagccgaucg

SEQ ID NO: 3261566 - RNA, 18 nt, Mycobacterium tuberculosis H37Rv
ggcgaaaucgucgaaccg

SEQ ID NO: 3261567 - RNA, 16 nt, Mycobacterium tuberculosis H37Rv
ggcgaaauuccgggcc

SEQ ID NO: 3261568 - RNA, 14 nt, Mycobacterium tuberculosis H37Rv
ggcgaacagcccca

SEQ ID NO: 3261569 - RNA, 17 nt, Mycobacterium tuberculosis H37Rv
ggcgaacagugacgcca

SEQ ID NO: 3261570 - RNA, 18 nt, Mycobacterium tuberculosis H37Rv
ggcgaaccacggcagcca

SEQ ID NO: 3261571 - RNA, 14 nt, Mycobacterium tuberculosis H37Rv
ggcgaaccagcgcg

SEQ ID NO: 3261572 - RNA, 22 nt, Mycobacterium tuberculosis H37Rv
ggcgaacccgccgaugccgccg

SEQ ID NO: 3261573 - RNA, 17 nt, Mycobacterium tuberculosis H37Rv
ggcgaaccgucagcgcg

SEQ ID NO: 3261574 - RNA, 18 nt, Mycobacterium tuberculosis H37Rv
ggcgaaccgucagcgcgc

SEQ ID NO: 3261575 - RNA, 20 nt, Mycobacterium tuberculosis H37Rv
ggcgaacgcguccagcgcgg

SEQ ID NO: 3261576 - RNA, 22 nt, Mycobacterium tuberculosis H37Rv
ggcgaacggauucccgcccagc

SEQ ID NO: 3261577 - RNA, 20 nt, Mycobacterium tuberculosis H37Rv
ggcgaacucgaggucgagcg

SEQ ID NO: 3261578 - RNA, 19 nt, Mycobacterium tuberculosis H37Rv
ggcgaacucgcgccgagcc

SEQ ID NO: 3261579 - RNA, 15 nt, Mycobacterium tuberculosis H37Rv
ggcgaacugggugcg

SEQ ID NO: 3261580 - RNA, 21 nt, Mycobacterium tuberculosis H37Rv
ggcgaagaacaacaucgccau

SEQ ID NO: 3261581 - RNA, 21 nt, Mycobacterium tuberculosis H37Rv
ggcgaagccgcugaucgccga

SEQ ID NO: 3261582 - RNA, 20 nt, Mycobacterium tuberculosis H37Rv
ggcgaagcgggcgugcucgg

SEQ ID NO: 3261583 - RNA, 22 nt, Mycobacterium tuberculosis H37Rv
ggcgaagcgucuggucagccgc

SEQ ID NO: 3261584 - RNA, 14 nt, Mycobacterium tuberculosis H37Rv
ggcgaaggccagca

SEQ ID NO: 3261585 - RNA, 18 nt, Mycobacterium tuberculosis H37Rv
ggcgaaggucuggccugc

SEQ ID NO: 3261586 - RNA, 18 nt, Mycobacterium tuberculosis H37Rv
ggcgaagguguccuccag

SEQ ID NO: 3261587 - RNA, 16 nt, Mycobacterium tuberculosis H37Rv
ggcgaagucacgcacc

SEQ ID NO: 3261588 - RNA, 12 nt, Mycobacterium tuberculosis H37Rv
ggcgaaguuggu

SEQ ID NO: 3261589 - RNA, 17 nt, Mycobacterium tuberculosis H37Rv
ggcgaauccgcacaggu

SEQ ID NO: 3261590 - RNA, 23 nt, Mycobacterium tuberculosis H37Rv
ggcgaauccgcacagguccgggu

SEQ ID NO: 3261591 - RNA, 14 nt, Mycobacterium tuberculosis H37Rv
ggcgaaucgggcaa

SEQ ID NO: 3261592 - RNA, 16 nt, Mycobacterium tuberculosis H37Rv
ggcgaaugacggccag

SEQ ID NO: 3261593 - RNA, 15 nt, Mycobacterium tuberculosis H37Rv
ggcgaaugcgggccu

SEQ ID NO: 3261594 - RNA, 17 nt, Mycobacterium tuberculosis H37Rv
ggcgaaugcgggccucc

SEQ ID NO: 3261595 - RNA, 14 nt, Mycobacterium tuberculosis H37Rv
ggcgaaugcggucc

SEQ ID NO: 3261596 - RNA, 22 nt, Mycobacterium tuberculosis H37Rv
ggcgaauugcaggacgcgggcu

SEQ ID NO: 3261597 - RNA, 18 nt, Mycobacterium tuberculosis H37Rv
ggcgacaaucgagaacgc

SEQ ID NO: 3261598 - RNA, 21 nt, Mycobacterium tuberculosis H37Rv
ggcgacaccggaaacggucag

SEQ ID NO: 3261599 - RNA, 15 nt, Mycobacterium tuberculosis H37Rv
ggcgacacgccagcc

SEQ ID NO: 3261600 - RNA, 12 nt, Mycobacterium tuberculosis H37Rv
ggcgacagcgcg

SEQ ID NO: 3261601 - RNA, 13 nt, Mycobacterium tuberculosis H37Rv
ggcgacagcgcgg

SEQ ID NO: 3261602 - RNA, 18 nt, Mycobacterium tuberculosis H37Rv
ggcgacagcgcggcgguc

SEQ ID NO: 3261603 - RNA, 20 nt, Mycobacterium tuberculosis H37Rv
ggcgaccaacacgucgagca

SEQ ID NO: 3261604 - RNA, 20 nt, Mycobacterium tuberculosis H37Rv
ggcgaccaaggccgaccugu

SEQ ID NO: 3261605 - RNA, 14 nt, Mycobacterium tuberculosis H37Rv
ggcgaccaccaccg

SEQ ID NO: 3261606 - RNA, 19 nt, Mycobacterium tuberculosis H37Rv
ggcgaccacccccggcagg

SEQ ID NO: 3261607 - RNA, 19 nt, Mycobacterium tuberculosis H37Rv
ggcgaccaccgcggcaugu

SEQ ID NO: 3261608 - RNA, 11 nt, Mycobacterium tuberculosis H37Rv
ggcgaccacgc

SEQ ID NO: 3261609 - RNA, 19 nt, Mycobacterium tuberculosis H37Rv
ggcgaccacgccgccggcg

SEQ ID NO: 3261610 - RNA, 22 nt, Mycobacterium tuberculosis H37Rv
ggcgaccacgccgccggcgcug

SEQ ID NO: 3261611 - RNA, 12 nt, Mycobacterium tuberculosis H37Rv
ggcgaccacggc

SEQ ID NO: 3261612 - RNA, 14 nt, Mycobacterium tuberculosis H37Rv
ggcgaccaggagcc

SEQ ID NO: 3261613 - RNA, 20 nt, Mycobacterium tuberculosis H37Rv
ggcgaccauauucagcucgg

SEQ ID NO: 3261614 - RNA, 11 nt, Mycobacterium tuberculosis H37Rv
ggcgacccagc

SEQ ID NO: 3261615 - RNA, 15 nt, Mycobacterium tuberculosis H37Rv
ggcgacccagcggua

SEQ ID NO: 3261616 - RNA, 16 nt, Mycobacterium tuberculosis H37Rv
ggcgacccagcgguau

SEQ ID NO: 3261617 - RNA, 22 nt, Mycobacterium tuberculosis H37Rv
ggcgaccccgaacauccgccgc

SEQ ID NO: 3261618 - RNA, 15 nt, Mycobacterium tuberculosis H37Rv
ggcgacccggguaga

SEQ ID NO: 3261619 - RNA, 22 nt, Mycobacterium tuberculosis H37Rv
ggcgacccgucccccgcacgcg

SEQ ID NO: 3261620 - RNA, 19 nt, Mycobacterium tuberculosis H37Rv
ggcgaccgagacggcgucg

SEQ ID NO: 3261621 - RNA, 20 nt, Mycobacterium tuberculosis H37Rv
ggcgaccgagacggcgucgg

SEQ ID NO: 3261622 - RNA, 14 nt, Mycobacterium tuberculosis H37Rv
ggcgaccgcgcuca

SEQ ID NO: 3261623 - RNA, 13 nt, Mycobacterium tuberculosis H37Rv
ggcgaccggccgg

SEQ ID NO: 3261624 - RNA, 22 nt, Mycobacterium tuberculosis H37Rv
ggcgaccggccggccgcgggcg

SEQ ID NO: 3261625 - RNA, 23 nt, Mycobacterium tuberculosis H37Rv
ggcgaccggcgagcccgcaucgc

SEQ ID NO: 3261626 - RNA, 22 nt, Mycobacterium tuberculosis H37Rv
ggcgaccggugccugcaacgcc

SEQ ID NO: 3261627 - RNA, 21 nt, Mycobacterium tuberculosis H37Rv
ggcgaccgucgauuucgacga

SEQ ID NO: 3261628 - RNA, 12 nt, Mycobacterium tuberculosis H37Rv
ggcgaucaccga

SEQ ID NO: 3261629 - RNA, 18 nt, Mycobacterium tuberculosis H37Rv
ggcgaucagcagccgccg

SEQ ID NO: 3261630 - RNA, 19 nt, Mycobacterium tuberculosis H37Rv
ggcgaucagcagccgccga

SEQ ID NO: 3261631 - RNA, 14 nt, Mycobacterium tuberculosis H37Rv
ggcgaucaucaggu

SEQ ID NO: 3261632 - RNA, 20 nt, Mycobacterium tuberculosis H37Rv
ggcgaucaucaggugcgccu

SEQ ID NO: 3261633 - RNA, 17 nt, Mycobacterium tuberculosis H37Rv
ggcgaucaugagcagca

SEQ ID NO: 3261634 - RNA, 15 nt, Mycobacterium tuberculosis H37Rv
ggcgauccccgacgu

SEQ ID NO: 3261635 - RNA, 15 nt, Mycobacterium tuberculosis H37Rv
ggcgauccgauacag

SEQ ID NO: 3261636 - RNA, 22 nt, Mycobacterium tuberculosis H37Rv
ggcgauccgauacagugcgcgg

SEQ ID NO: 3261637 - RNA, 18 nt, Mycobacterium tuberculosis H37Rv
ggcgauccggucggccag

SEQ ID NO: 3261638 - RNA, 19 nt, Mycobacterium tuberculosis H37Rv
ggcgauccggucggccagg

SEQ ID NO: 3261639 - RNA, 16 nt, Mycobacterium tuberculosis H37Rv
ggcgaucgacaccgug

SEQ ID NO: 3261640 - RNA, 18 nt, Mycobacterium tuberculosis H37Rv
ggcgaucgcauccgcggu

SEQ ID NO: 3261641 - RNA, 22 nt, Mycobacterium tuberculosis H37Rv
ggcgaucgcgaucgcguccucc

SEQ ID NO: 3261642 - RNA, 18 nt, Mycobacterium tuberculosis H37Rv
ggcgaucgcuucgcaagu

SEQ ID NO: 3261643 - RNA, 16 nt, Mycobacterium tuberculosis H37Rv
ggcgaucgucaagccg

SEQ ID NO: 3261644 - RNA, 16 nt, Mycobacterium tuberculosis H37Rv
ggcgaucgucagccag

SEQ ID NO: 3261645 - RNA, 17 nt, Mycobacterium tuberculosis H37Rv
ggcgaucguguccaccg

SEQ ID NO: 3261646 - RNA, 15 nt, Mycobacterium tuberculosis H37Rv
ggcgaucucaccugg

SEQ ID NO: 3261647 - RNA, 18 nt, Mycobacterium tuberculosis H37Rv
ggcgaucucaccuggagc

SEQ ID NO: 3261648 - RNA, 22 nt, Mycobacterium tuberculosis H37Rv
ggcgaucucuaccagccgcccc

SEQ ID NO: 3261649 - RNA, 13 nt, Mycobacterium tuberculosis H37Rv
ggcgaucugcgac

SEQ ID NO: 3261650 - RNA, 12 nt, Mycobacterium tuberculosis H37Rv
ggcgaucugcug

SEQ ID NO: 3261651 - RNA, 21 nt, Mycobacterium tuberculosis H37Rv
ggcgaucugcugcucgaucau

SEQ ID NO: 3261652 - RNA, 18 nt, Mycobacterium tuberculosis H37Rv
ggcgaucugggugccggu

SEQ ID NO: 3261653 - RNA, 13 nt, Mycobacterium tuberculosis H37Rv
ggcgaucuggucg

SEQ ID NO: 3261654 - RNA, 20 nt, Mycobacterium tuberculosis H37Rv
ggcgaucuggucggcggccu

SEQ ID NO: 3261655 - RNA, 21 nt, Mycobacterium tuberculosis H37Rv
ggcgaucuggucggcggccuc

SEQ ID NO: 3261656 - RNA, 21 nt, Mycobacterium tuberculosis H37Rv
ggcgaucuuggaucgguugga

SEQ ID NO: 3261657 - RNA, 19 nt, Mycobacterium tuberculosis H37Rv
ggcgaugacaaucaccugg

SEQ ID NO: 3261658 - RNA, 21 nt, Mycobacterium tuberculosis H37Rv
ggcgaugacaaucaccuggua

SEQ ID NO: 3261659 - RNA, 19 nt, Mycobacterium tuberculosis H37Rv
ggcgaugaccacgccgacg

SEQ ID NO: 3261660 - RNA, 18 nt, Mycobacterium tuberculosis H37Rv
ggcgaugagcaugcccag

SEQ ID NO: 3261661 - RNA, 14 nt, Mycobacterium tuberculosis H37Rv
ggcgaugagcgcga

SEQ ID NO: 3261662 - RNA, 14 nt, Mycobacterium tuberculosis H37Rv
ggcgaugagcgugc

SEQ ID NO: 3261663 - RNA, 19 nt, Mycobacterium tuberculosis H37Rv
ggcgaugagcgugccgcag

SEQ ID NO: 3261664 - RNA, 20 nt, Mycobacterium tuberculosis H37Rv
ggcgaugagggcuuguggug

SEQ ID NO: 3261665 - RNA, 16 nt, Mycobacterium tuberculosis H37Rv
ggcgaugaugacggcg

SEQ ID NO: 3261666 - RNA, 19 nt, Mycobacterium tuberculosis H37Rv
ggcgaugaugacggcggcc

SEQ ID NO: 3261667 - RNA, 17 nt, Mycobacterium tuberculosis H37Rv
ggcgaugauguugagcu

SEQ ID NO: 3261668 - RNA, 17 nt, Mycobacterium tuberculosis H37Rv
ggcgaugcagccgggaa

SEQ ID NO: 3261669 - RNA, 21 nt, Mycobacterium tuberculosis H37Rv
ggcgaugcgggccgccaggcg

SEQ ID NO: 3261670 - RNA, 21 nt, Mycobacterium tuberculosis H37Rv
ggcgauuaccggcacgccggc

SEQ ID NO: 3261671 - RNA, 16 nt, Mycobacterium tuberculosis H37Rv
ggcgauuacggccagu

SEQ ID NO: 3261672 - RNA, 21 nt, Mycobacterium tuberculosis H37Rv
ggcgauucgcaaucagcuggu

SEQ ID NO: 3261673 - RNA, 19 nt, Mycobacterium tuberculosis H37Rv
ggcgauucugcgucugcuc

SEQ ID NO: 3261674 - RNA, 19 nt, Mycobacterium tuberculosis H37Rv
ggcgauucugugucugcuc

SEQ ID NO: 3261675 - RNA, 20 nt, Mycobacterium tuberculosis H37Rv
ggcgauucugugucugcucg

SEQ ID NO: 3261676 - RNA, 22 nt, Mycobacterium tuberculosis H37Rv
ggcgauucugugucugcucgcg

SEQ ID NO: 3261677 - RNA, 17 nt, Mycobacterium tuberculosis H37Rv
ggcgauugcagcuucgg

SEQ ID NO: 3261678 - RNA, 16 nt, Mycobacterium tuberculosis H37Rv
ggcgauugcgccgcac

SEQ ID NO: 3261679 - RNA, 16 nt, Mycobacterium tuberculosis H37Rv
ggcgauuggcugugau

SEQ ID NO: 3261680 - RNA, 20 nt, Mycobacterium tuberculosis H37Rv
ggcgauuuugcgucugcucg

SEQ ID NO: 3261681 - RNA, 23 nt, Mycobacterium tuberculosis H37Rv
ggcgauuuugcgucugcucggcg

SEQ ID NO: 3261682 - RNA, 22 nt, Mycobacterium tuberculosis H37Rv
ggcgcaacgccauaccagcguu

SEQ ID NO: 3261683 - RNA, 15 nt, Mycobacterium tuberculosis H37Rv
ggcgcaacucgacca

SEQ ID NO: 3261684 - RNA, 18 nt, Mycobacterium tuberculosis H37Rv
ggcgcaacucgaccacuu

SEQ ID NO: 3261685 - RNA, 17 nt, Mycobacterium tuberculosis H37Rv
ggcgcaagaaugccgcc

SEQ ID NO: 3261686 - RNA, 18 nt, Mycobacterium tuberculosis H37Rv
ggcgcaagaaugccgccg

SEQ ID NO: 3261687 - RNA, 21 nt, Mycobacterium tuberculosis H37Rv
ggcgcaagaaugccgccgacg

SEQ ID NO: 3261688 - RNA, 13 nt, Mycobacterium tuberculosis H37Rv
ggcgcaagcgccg

SEQ ID NO: 3261689 - RNA, 20 nt, Mycobacterium tuberculosis H37Rv
ggcgcacaacccgucgagcc

SEQ ID NO: 3261690 - RNA, 18 nt, Mycobacterium tuberculosis H37Rv
ggcgcaccacaccacggu

SEQ ID NO: 3261691 - RNA, 22 nt, Mycobacterium tuberculosis H37Rv
ggcgcaccacaccacgguggcc

SEQ ID NO: 3261692 - RNA, 12 nt, Mycobacterium tuberculosis H37Rv
ggcgcaccaccg

SEQ ID NO: 3261693 - RNA, 22 nt, Mycobacterium tuberculosis H37Rv
ggcgcaccagggagccguucaa

SEQ ID NO: 3261694 - RNA, 17 nt, Mycobacterium tuberculosis H37Rv
ggcgcaccaucgcggcc

SEQ ID NO: 3261695 - RNA, 20 nt, Mycobacterium tuberculosis H37Rv
ggcgcaccgcggaccggcgu

SEQ ID NO: 3261696 - RNA, 13 nt, Mycobacterium tuberculosis H37Rv
ggcgcaccggcgu

SEQ ID NO: 3261697 - RNA, 19 nt, Mycobacterium tuberculosis H37Rv
ggcgcaccggcgucggcgc

SEQ ID NO: 3261698 - RNA, 16 nt, Mycobacterium tuberculosis H37Rv
ggcgcaccgucgcggg

SEQ ID NO: 3261699 - RNA, 17 nt, Mycobacterium tuberculosis H37Rv
ggcgcaccugggcugcc

SEQ ID NO: 3261700 - RNA, 20 nt, Mycobacterium tuberculosis H37Rv
ggcgcaccugggcugccggc

SEQ ID NO: 3261701 - RNA, 14 nt, Mycobacterium tuberculosis H37Rv
ggcgcacgaaaccg

SEQ ID NO: 3261702 - RNA, 19 nt, Mycobacterium tuberculosis H37Rv
ggcgcacgaaaccgcagcg

SEQ ID NO: 3261703 - RNA, 22 nt, Mycobacterium tuberculosis H37Rv
ggcgcacgaaaccgcagcgcga

SEQ ID NO: 3261704 - RNA, 19 nt, Mycobacterium tuberculosis H37Rv
ggcgcacgcccgcacucgg

SEQ ID NO: 3261705 - RNA, 19 nt, Mycobacterium tuberculosis H37Rv
ggcgcacgguccacggugg

SEQ ID NO: 3261706 - RNA, 18 nt, Mycobacterium tuberculosis H37Rv
ggcgcacugguugggcga

SEQ ID NO: 3261707 - RNA, 20 nt, Mycobacterium tuberculosis H37Rv
ggcgcacugguugggcgaga

SEQ ID NO: 3261708 - RNA, 15 nt, Mycobacterium tuberculosis H37Rv
ggcgcagcacggcgg

SEQ ID NO: 3261709 - RNA, 17 nt, Mycobacterium tuberculosis H37Rv
ggcgcagcacggcggcc

SEQ ID NO: 3261710 - RNA, 14 nt, Mycobacterium tuberculosis H37Rv
ggcgcagcgccagc

SEQ ID NO: 3261711 - RNA, 15 nt, Mycobacterium tuberculosis H37Rv
ggcgcagcgcggcaa

SEQ ID NO: 3261712 - RNA, 13 nt, Mycobacterium tuberculosis H37Rv
ggcgcagcgucuc

SEQ ID NO: 3261713 - RNA, 14 nt, Mycobacterium tuberculosis H37Rv
ggcgcagcucaccg

SEQ ID NO: 3261714 - RNA, 23 nt, Mycobacterium tuberculosis H37Rv
ggcgcagcucaccgacggagauc

SEQ ID NO: 3261715 - RNA, 16 nt, Mycobacterium tuberculosis H37Rv
ggcgcagcugggugcg

SEQ ID NO: 3261716 - RNA, 21 nt, Mycobacterium tuberculosis H37Rv
ggcgcagggacugugggggcg

SEQ ID NO: 3261717 - RNA, 14 nt, Mycobacterium tuberculosis H37Rv
ggcgcaguagaugc

SEQ ID NO: 3261718 - RNA, 14 nt, Mycobacterium tuberculosis H37Rv
ggcgcaguagccga

SEQ ID NO: 3261719 - RNA, 16 nt, Mycobacterium tuberculosis H37Rv
ggcgcaguagccgacc

SEQ ID NO: 3261720 - RNA, 16 nt, Mycobacterium tuberculosis H37Rv
ggcgcauuccggcgcc

SEQ ID NO: 3261721 - RNA, 17 nt, Mycobacterium tuberculosis H37Rv
ggcgcauuccggcgcca

SEQ ID NO: 3261722 - RNA, 22 nt, Mycobacterium tuberculosis H37Rv
ggcgccaauggcggaccgggcc

SEQ ID NO: 3261723 - RNA, 20 nt, Mycobacterium tuberculosis H37Rv
ggcgccaauucagcggcaac

SEQ ID NO: 3261724 - RNA, 21 nt, Mycobacterium tuberculosis H37Rv
ggcgccgccuggacgccgccg

SEQ ID NO: 3261725 - RNA, 12 nt, Mycobacterium tuberculosis H37Rv
ggcgccgcgcgc

SEQ ID NO: 3261726 - RNA, 14 nt, Mycobacterium tuberculosis H37Rv
ggcgccgcgcucga

SEQ ID NO: 3261727 - RNA, 16 nt, Mycobacterium tuberculosis H37Rv
ggcgccgcgcucgacg

SEQ ID NO: 3261728 - RNA, 17 nt, Mycobacterium tuberculosis H37Rv
ggcgccgcggcuggggg

SEQ ID NO: 3261729 - RNA, 23 nt, Mycobacterium tuberculosis H37Rv
ggcgccggacaaaccgggcggcc

SEQ ID NO: 3261730 - RNA, 15 nt, Mycobacterium tuberculosis H37Rv
ggcgccggagccgcc

SEQ ID NO: 3261731 - RNA, 19 nt, Mycobacterium tuberculosis H37Rv
ggcgccggauauggcagug

SEQ ID NO: 3261732 - RNA, 18 nt, Mycobacterium tuberculosis H37Rv
ggcgccggcgcgucggca

SEQ ID NO: 3261733 - RNA, 13 nt, Mycobacterium tuberculosis H37Rv
ggcgccggcggcc

SEQ ID NO: 3261734 - RNA, 17 nt, Mycobacterium tuberculosis H37Rv
ggcgccggcgucggcgc

SEQ ID NO: 3261735 - RNA, 18 nt, Mycobacterium tuberculosis H37Rv
ggcgccggcgucggcgcc

SEQ ID NO: 3261736 - RNA, 14 nt, Mycobacterium tuberculosis H37Rv
ggcgccggcuugga

SEQ ID NO: 3261737 - RNA, 12 nt, Mycobacterium tuberculosis H37Rv
ggcgccggggcc

SEQ ID NO: 3261738 - RNA, 17 nt, Mycobacterium tuberculosis H37Rv
ggcgccgggucgauggg

SEQ ID NO: 3261739 - RNA, 12 nt, Mycobacterium tuberculosis H37Rv
ggcgccggucgc

SEQ ID NO: 3261740 - RNA, 15 nt, Mycobacterium tuberculosis H37Rv
ggcgccggugccgcc

SEQ ID NO: 3261741 - RNA, 16 nt, Mycobacterium tuberculosis H37Rv
ggcgccggugccgccg

SEQ ID NO: 3261742 - RNA, 17 nt, Mycobacterium tuberculosis H37Rv
ggcgccggugccgccgg

SEQ ID NO: 3261743 - RNA, 16 nt, Mycobacterium tuberculosis H37Rv
ggcgccggugccgccu

SEQ ID NO: 3261744 - RNA, 17 nt, Mycobacterium tuberculosis H37Rv
ggcgccggugcggcggg

SEQ ID NO: 3261745 - RNA, 18 nt, Mycobacterium tuberculosis H37Rv
ggcgccggugcggcgggc

SEQ ID NO: 3261746 - RNA, 14 nt, Mycobacterium tuberculosis H37Rv
ggcgccggugggcg

SEQ ID NO: 3261747 - RNA, 23 nt, Mycobacterium tuberculosis H37Rv
ggcgccgguguuuccgaaacccg

SEQ ID NO: 3261748 - RNA, 20 nt, Mycobacterium tuberculosis H37Rv
ggcgccgguuacccggaccg

SEQ ID NO: 3261749 - RNA, 17 nt, Mycobacterium tuberculosis H37Rv
ggcgccgucgcccagcg

SEQ ID NO: 3261750 - RNA, 23 nt, Mycobacterium tuberculosis H37Rv
ggcgccgucggagccggccaccu

SEQ ID NO: 3261751 - RNA, 15 nt, Mycobacterium tuberculosis H37Rv
ggcgccgucggccga

SEQ ID NO: 3261752 - RNA, 21 nt, Mycobacterium tuberculosis H37Rv
ggcgccgucgggccugccgga

SEQ ID NO: 3261753 - RNA, 18 nt, Mycobacterium tuberculosis H37Rv
ggcgccgugccccgggcc

SEQ ID NO: 3261754 - RNA, 13 nt, Mycobacterium tuberculosis H37Rv
ggcgccgugucac

SEQ ID NO: 3261755 - RNA, 17 nt, Mycobacterium tuberculosis H37Rv
ggcgccguuaccgccgu

SEQ ID NO: 3261756 - RNA, 19 nt, Mycobacterium tuberculosis H37Rv
ggcgccguuagcgucgccu

SEQ ID NO: 3261757 - RNA, 15 nt, Mycobacterium tuberculosis H37Rv
ggcgccguugccgcc

SEQ ID NO: 3261758 - RNA, 16 nt, Mycobacterium tuberculosis H37Rv
ggcgccguugccgccg

SEQ ID NO: 3261759 - RNA, 14 nt, Mycobacterium tuberculosis H37Rv
ggcgccucaucgga

SEQ ID NO: 3261760 - RNA, 17 nt, Mycobacterium tuberculosis H37Rv
ggcgccucggaccagac

SEQ ID NO: 3261761 - RNA, 23 nt, Mycobacterium tuberculosis H37Rv
ggcgccucggaccagacccacga

SEQ ID NO: 3261762 - RNA, 21 nt, Mycobacterium tuberculosis H37Rv
ggcgccucgugcgugggcgcg

SEQ ID NO: 3261763 - RNA, 16 nt, Mycobacterium tuberculosis H37Rv
ggcgccucguugccgu

SEQ ID NO: 3261764 - RNA, 19 nt, Mycobacterium tuberculosis H37Rv
ggcgccugacucaucaccg

SEQ ID NO: 3261765 - RNA, 16 nt, Mycobacterium tuberculosis H37Rv
ggcgccugaggugcug

SEQ ID NO: 3261766 - RNA, 20 nt, Mycobacterium tuberculosis H37Rv
ggcgccugaugcggccggcg

SEQ ID NO: 3261767 - RNA, 19 nt, Mycobacterium tuberculosis H37Rv
ggcgccugcugcggccagg

SEQ ID NO: 3261768 - RNA, 23 nt, Mycobacterium tuberculosis H37Rv
ggcgccuguccugcgggaggcag

SEQ ID NO: 3261769 - RNA, 22 nt, Mycobacterium tuberculosis H37Rv
ggcgccuuccaggcgggcggca

SEQ ID NO: 3261770 - RNA, 11 nt, Mycobacterium tuberculosis H37Rv
ggcgccuuggu

SEQ ID NO: 3261771 - RNA, 22 nt, Mycobacterium tuberculosis H37Rv
ggcgccuugguccguagcgcgg

SEQ ID NO: 3261772 - RNA, 16 nt, Mycobacterium tuberculosis H37Rv
ggcgccuuggucgccg

SEQ ID NO: 3261773 - RNA, 18 nt, Mycobacterium tuberculosis H37Rv
ggcgcgaaacgccgcaau

SEQ ID NO: 3261774 - RNA, 19 nt, Mycobacterium tuberculosis H37Rv
ggcgcgaauauucgcuggg

SEQ ID NO: 3261775 - RNA, 16 nt, Mycobacterium tuberculosis H37Rv
ggcgcgacagccgugg

SEQ ID NO: 3261776 - RNA, 12 nt, Mycobacterium tuberculosis H37Rv
ggcgcgaccaga

SEQ ID NO: 3261777 - RNA, 18 nt, Mycobacterium tuberculosis H37Rv
ggcgcgaccuccgcgauc

SEQ ID NO: 3261778 - RNA, 16 nt, Mycobacterium tuberculosis H37Rv
ggcgcgagccgcacga

SEQ ID NO: 3261779 - RNA, 21 nt, Mycobacterium tuberculosis H37Rv
ggcgcgaggaacgccggggcg

SEQ ID NO: 3261780 - RNA, 24 nt, Mycobacterium tuberculosis H37Rv
ggcgcgauagauacccgcggcagc

SEQ ID NO: 3261781 - RNA, 20 nt, Mycobacterium tuberculosis H37Rv
ggcgcgauccccgcgcugag

SEQ ID NO: 3261782 - RNA, 24 nt, Mycobacterium tuberculosis H37Rv
ggcgcgaucgcucauucgugcccg

SEQ ID NO: 3261783 - RNA, 20 nt, Mycobacterium tuberculosis H37Rv
ggcgcgaugguuauccccug

SEQ ID NO: 3261784 - RNA, 22 nt, Mycobacterium tuberculosis H37Rv
ggcgcgcaacguagccagcagc

SEQ ID NO: 3261785 - RNA, 14 nt, Mycobacterium tuberculosis H37Rv
ggcgcgcaccaccg

SEQ ID NO: 3261786 - RNA, 17 nt, Mycobacterium tuberculosis H37Rv
ggcgcgcaccccggcau

SEQ ID NO: 3261787 - RNA, 14 nt, Mycobacterium tuberculosis H37Rv
ggcgcgcaccucgg

SEQ ID NO: 3261788 - RNA, 13 nt, Mycobacterium tuberculosis H37Rv
ggcgcgcagcgac

SEQ ID NO: 3261789 - RNA, 18 nt, Mycobacterium tuberculosis H37Rv
ggcgcgcagcgacgcggu

SEQ ID NO: 3261790 - RNA, 17 nt, Mycobacterium tuberculosis H37Rv
ggcgcgcagcucgggcu

SEQ ID NO: 3261791 - RNA, 21 nt, Mycobacterium tuberculosis H37Rv
ggcgcgcaucugcucggcauc

SEQ ID NO: 3261792 - RNA, 23 nt, Mycobacterium tuberculosis H37Rv
ggcgcgcaucugcucggcaucga

SEQ ID NO: 3261793 - RNA, 21 nt, Mycobacterium tuberculosis H37Rv
ggcgcgcccggaucucggcgu

SEQ ID NO: 3261794 - RNA, 18 nt, Mycobacterium tuberculosis H37Rv
ggcgcgccgaguugcccg

SEQ ID NO: 3261795 - RNA, 21 nt, Mycobacterium tuberculosis H37Rv
ggcgcgccgaugaacguggcg

SEQ ID NO: 3261796 - RNA, 13 nt, Mycobacterium tuberculosis H37Rv
ggcgcgccgcacc

SEQ ID NO: 3261797 - RNA, 12 nt, Mycobacterium tuberculosis H37Rv
ggcgcgccgcau

SEQ ID NO: 3261798 - RNA, 15 nt, Mycobacterium tuberculosis H37Rv
ggcgcgccggccaug

SEQ ID NO: 3261799 - RNA, 18 nt, Mycobacterium tuberculosis H37Rv
ggcgcgccggccaugccu

SEQ ID NO: 3261800 - RNA, 16 nt, Mycobacterium tuberculosis H37Rv
ggcgcgccgggcggcg

SEQ ID NO: 3261801 - RNA, 13 nt, Mycobacterium tuberculosis H37Rv
ggcgcgcgcgccg

SEQ ID NO: 3261802 - RNA, 20 nt, Mycobacterium tuberculosis H37Rv
ggcgcgcggggccucgcgag

SEQ ID NO: 3261803 - RNA, 22 nt, Mycobacterium tuberculosis H37Rv
ggcgcgcggguugucggcgacc

SEQ ID NO: 3261804 - RNA, 17 nt, Mycobacterium tuberculosis H37Rv
ggcgcgcucaucgaccg

SEQ ID NO: 3261805 - RNA, 15 nt, Mycobacterium tuberculosis H37Rv
ggcgcgcucggccgg

SEQ ID NO: 3261806 - RNA, 13 nt, Mycobacterium tuberculosis H37Rv
ggcgcgcugcacg

SEQ ID NO: 3261807 - RNA, 21 nt, Mycobacterium tuberculosis H37Rv
ggcgcgcugcacggaaucgca

SEQ ID NO: 3261808 - RNA, 19 nt, Mycobacterium tuberculosis H37Rv
ggcgcgcuggcgggcggcg

SEQ ID NO: 3261809 - RNA, 19 nt, Mycobacterium tuberculosis H37Rv
ggcgcggaacgcgucgccg

SEQ ID NO: 3261810 - RNA, 22 nt, Mycobacterium tuberculosis H37Rv
ggcgcggaacgcgucgccgacg

SEQ ID NO: 3261811 - RNA, 18 nt, Mycobacterium tuberculosis H37Rv
ggcgcggagagccugcuc

SEQ ID NO: 3261812 - RNA, 23 nt, Mycobacterium tuberculosis H37Rv
ggcgcggagagccugcucgcagc

SEQ ID NO: 3261813 - RNA, 16 nt, Mycobacterium tuberculosis H37Rv
ggcgcggagcugauug

SEQ ID NO: 3261814 - RNA, 22 nt, Mycobacterium tuberculosis H37Rv
ggcgcggagugcccagggccga

SEQ ID NO: 3261815 - RNA, 14 nt, Mycobacterium tuberculosis H37Rv
ggcgcggccgugaa

SEQ ID NO: 3261816 - RNA, 21 nt, Mycobacterium tuberculosis H37Rv
ggcgcggccgugaacggcgcg

SEQ ID NO: 3261817 - RNA, 15 nt, Mycobacterium tuberculosis H37Rv
ggcgcggcgacaagc

SEQ ID NO: 3261818 - RNA, 11 nt, Mycobacterium tuberculosis H37Rv
ggcgcggcgga

SEQ ID NO: 3261819 - RNA, 13 nt, Mycobacterium tuberculosis H37Rv
ggcgcggcggcgu

SEQ ID NO: 3261820 - RNA, 13 nt, Mycobacterium tuberculosis H37Rv
ggcggaucccgag

SEQ ID NO: 3261821 - RNA, 17 nt, Mycobacterium tuberculosis H37Rv
ggcggaucccgaggcgc

SEQ ID NO: 3261822 - RNA, 22 nt, Mycobacterium tuberculosis H37Rv
ggcggaucccgaggcgcccaac

SEQ ID NO: 3261823 - RNA, 18 nt, Mycobacterium tuberculosis H37Rv
ggcggaucgccggggacg

SEQ ID NO: 3261824 - RNA, 13 nt, Mycobacterium tuberculosis H37Rv
ggcggaucgcgag

SEQ ID NO: 3261825 - RNA, 16 nt, Mycobacterium tuberculosis H37Rv
ggcggaucgcgagcgc

SEQ ID NO: 3261826 - RNA, 20 nt, Mycobacterium tuberculosis H37Rv
ggcggaucgcgagcgccgcu

SEQ ID NO: 3261827 - RNA, 15 nt, Mycobacterium tuberculosis H37Rv
ggcggauggccgccu

SEQ ID NO: 3261828 - RNA, 18 nt, Mycobacterium tuberculosis H37Rv
ggcggauggcgucgacca

SEQ ID NO: 3261829 - RNA, 21 nt, Mycobacterium tuberculosis H37Rv
ggcggcaaacacugcggccug

SEQ ID NO: 3261830 - RNA, 19 nt, Mycobacterium tuberculosis H37Rv
ggcggcaaagagcagccgg

SEQ ID NO: 3261831 - RNA, 19 nt, Mycobacterium tuberculosis H37Rv
ggcggcaacccugcccggc

SEQ ID NO: 3261832 - RNA, 22 nt, Mycobacterium tuberculosis H37Rv
ggcggcaaccucaugcacgccg

SEQ ID NO: 3261833 - RNA, 17 nt, Mycobacterium tuberculosis H37Rv
ggcggcacccggguggc

SEQ ID NO: 3261834 - RNA, 15 nt, Mycobacterium tuberculosis H37Rv
ggcggcacgcucgcg

SEQ ID NO: 3261835 - RNA, 17 nt, Mycobacterium tuberculosis H37Rv
ggcggcacgcucgcgca

SEQ ID NO: 3261836 - RNA, 18 nt, Mycobacterium tuberculosis H37Rv
ggcggcacuacgcagccg

SEQ ID NO: 3261837 - RNA, 16 nt, Mycobacterium tuberculosis H37Rv
ggcggcacuggauccg

SEQ ID NO: 3261838 - RNA, 21 nt, Mycobacterium tuberculosis H37Rv
ggcggcacuggauccgggagu

SEQ ID NO: 3261839 - RNA, 14 nt, Mycobacterium tuberculosis H37Rv
ggcggcagcgaggc

SEQ ID NO: 3261840 - RNA, 16 nt, Mycobacterium tuberculosis H37Rv
ggcggcagcggcgauc

SEQ ID NO: 3261841 - RNA, 22 nt, Mycobacterium tuberculosis H37Rv
ggcggcaggaaucgggucagca

SEQ ID NO: 3261842 - RNA, 15 nt, Mycobacterium tuberculosis H37Rv
ggcggcauccccagu

SEQ ID NO: 3261843 - RNA, 16 nt, Mycobacterium tuberculosis H37Rv
ggcggcauccugcacg

SEQ ID NO: 3261844 - RNA, 16 nt, Mycobacterium tuberculosis H37Rv
ggcggcaucgaggcca

SEQ ID NO: 3261845 - RNA, 20 nt, Mycobacterium tuberculosis H37Rv
ggcggcaucgaggccagcag

SEQ ID NO: 3261846 - RNA, 21 nt, Mycobacterium tuberculosis H37Rv
ggcggcaucgaguucggcccg

SEQ ID NO: 3261847 - RNA, 13 nt, Mycobacterium tuberculosis H37Rv
ggcggcaucgccg

SEQ ID NO: 3261848 - RNA, 14 nt, Mycobacterium tuberculosis H37Rv
ggcggcaucgccga

SEQ ID NO: 3261849 - RNA, 21 nt, Mycobacterium tuberculosis H37Rv
ggcggcauuggcggugccggu

SEQ ID NO: 3261850 - RNA, 13 nt, Mycobacterium tuberculosis H37Rv
ggcggccaacgac

SEQ ID NO: 3261851 - RNA, 20 nt, Mycobacterium tuberculosis H37Rv
ggcggccaacgacgacccgu

SEQ ID NO: 3261852 - RNA, 14 nt, Mycobacterium tuberculosis H37Rv
ggcggccaccaugu

SEQ ID NO: 3261853 - RNA, 16 nt, Mycobacterium tuberculosis H37Rv
ggcggccaccgucagc

SEQ ID NO: 3261854 - RNA, 19 nt, Mycobacterium tuberculosis H37Rv
ggcggccaccgucagcgcg

SEQ ID NO: 3261855 - RNA, 19 nt, Mycobacterium tuberculosis H37Rv
ggcggccaccucuucucgg

SEQ ID NO: 3261856 - RNA, 12 nt, Mycobacterium tuberculosis H37Rv
ggcggccacguc

SEQ ID NO: 3261857 - RNA, 19 nt, Mycobacterium tuberculosis H37Rv
ggcggccacguggucggcg

SEQ ID NO: 3261858 - RNA, 11 nt, Mycobacterium tuberculosis H37Rv
ggcggccagca

SEQ ID NO: 3261859 - RNA, 13 nt, Mycobacterium tuberculosis H37Rv
ggcggccagcauc

SEQ ID NO: 3261860 - RNA, 21 nt, Mycobacterium tuberculosis H37Rv
ggcggccagcaucgcgguggu

SEQ ID NO: 3261861 - RNA, 11 nt, Mycobacterium tuberculosis H37Rv
ggcggccagcg

SEQ ID NO: 3261862 - RNA, 14 nt, Mycobacterium tuberculosis H37Rv
ggcggccagcgaac

SEQ ID NO: 3261863 - RNA, 16 nt, Mycobacterium tuberculosis H37Rv
ggcggccagcgagauc

SEQ ID NO: 3261864 - RNA, 13 nt, Mycobacterium tuberculosis H37Rv
ggcggccagcgca

SEQ ID NO: 3261865 - RNA, 14 nt, Mycobacterium tuberculosis H37Rv
ggcggccagcgcgc

SEQ ID NO: 3261866 - RNA, 15 nt, Mycobacterium tuberculosis H37Rv
ggcggccagcuccag

SEQ ID NO: 3261867 - RNA, 21 nt, Mycobacterium tuberculosis H37Rv
ggcggccagcuccagcgccgc

SEQ ID NO: 3261868 - RNA, 13 nt, Mycobacterium tuberculosis H37Rv
ggcggccagcucg

SEQ ID NO: 3261869 - RNA, 14 nt, Mycobacterium tuberculosis H37Rv
ggcggccagcucgg

SEQ ID NO: 3261870 - RNA, 16 nt, Mycobacterium tuberculosis H37Rv
ggcggccagcugcagc

SEQ ID NO: 3261871 - RNA, 14 nt, Mycobacterium tuberculosis H37Rv
ggcggccaguucgg

SEQ ID NO: 3261872 - RNA, 16 nt, Mycobacterium tuberculosis H37Rv
ggcggccaguucggcg

SEQ ID NO: 3261873 - RNA, 20 nt, Mycobacterium tuberculosis H37Rv
ggcggccauucggucagcca

SEQ ID NO: 3261874 - RNA, 24 nt, Mycobacterium tuberculosis H37Rv
ggcggccauucuugucggugggcg

SEQ ID NO: 3261875 - RNA, 22 nt, Mycobacterium tuberculosis H37Rv
ggcggccccaggggcaccagcg

SEQ ID NO: 3261876 - RNA, 17 nt, Mycobacterium tuberculosis H37Rv
ggcggcccccggcagcg

SEQ ID NO: 3261877 - RNA, 14 nt, Mycobacterium tuberculosis H37Rv
ggcggccccggcau

SEQ ID NO: 3261878 - RNA, 14 nt, Mycobacterium tuberculosis H37Rv
ggcggcccgcagcc

SEQ ID NO: 3261879 - RNA, 14 nt, Mycobacterium tuberculosis H37Rv
ggcggcccgcucgg

SEQ ID NO: 3261880 - RNA, 14 nt, Mycobacterium tuberculosis H37Rv
ggcggccgagcgca

SEQ ID NO: 3261881 - RNA, 20 nt, Mycobacterium tuberculosis H37Rv
ggcggccgccaucagccgcu

SEQ ID NO: 3261882 - RNA, 23 nt, Mycobacterium tuberculosis H37Rv
ggcggccgcgucgucgagaaucg

SEQ ID NO: 3261883 - RNA, 21 nt, Mycobacterium tuberculosis H37Rv
ggcggccggacucguucaugu

SEQ ID NO: 3261884 - RNA, 14 nt, Mycobacterium tuberculosis H37Rv
ggcggccgggcucc

SEQ ID NO: 3261885 - RNA, 20 nt, Mycobacterium tuberculosis H37Rv
ggcggccgggucggugacga

SEQ ID NO: 3261886 - RNA, 14 nt, Mycobacterium tuberculosis H37Rv
ggcggccgucaccg

SEQ ID NO: 3261887 - RNA, 18 nt, Mycobacterium tuberculosis H37Rv
ggcggccgucgucggcca

SEQ ID NO: 3261888 - RNA, 19 nt, Mycobacterium tuberculosis H37Rv
ggcggccgucgucggccag

SEQ ID NO: 3261889 - RNA, 22 nt, Mycobacterium tuberculosis H37Rv
ggcggccguggcuggacccgca

SEQ ID NO: 3261890 - RNA, 15 nt, Mycobacterium tuberculosis H37Rv
ggcggccgugucggg

SEQ ID NO: 3261891 - RNA, 19 nt, Mycobacterium tuberculosis H37Rv
ggcggccgugucgggcgcg

SEQ ID NO: 3261892 - RNA, 19 nt, Mycobacterium tuberculosis H37Rv
ggcggccucccgggccgcc

SEQ ID NO: 3261893 - RNA, 13 nt, Mycobacterium tuberculosis H37Rv
ggcggccuccgcg

SEQ ID NO: 3261894 - RNA, 13 nt, Mycobacterium tuberculosis H37Rv
ggcggccuccucc

SEQ ID NO: 3261895 - RNA, 14 nt, Mycobacterium tuberculosis H37Rv
ggcggccucggucu

SEQ ID NO: 3261896 - RNA, 20 nt, Mycobacterium tuberculosis H37Rv
ggcggccugagcgucgucgc

SEQ ID NO: 3261897 - RNA, 16 nt, Mycobacterium tuberculosis H37Rv
ggcggccugcucgcag

SEQ ID NO: 3261898 - RNA, 17 nt, Mycobacterium tuberculosis H37Rv
ggcggccugggccagcc

SEQ ID NO: 3261899 - RNA, 20 nt, Mycobacterium tuberculosis H37Rv
ggcggccuggucggccaggu

SEQ ID NO: 3261900 - RNA, 23 nt, Mycobacterium tuberculosis H37Rv
ggcggccuggucggccaggucga

SEQ ID NO: 3261901 - RNA, 18 nt, Mycobacterium tuberculosis H37Rv
ggcggccuucggccggcg

SEQ ID NO: 3261902 - RNA, 22 nt, Mycobacterium tuberculosis H37Rv
ggcggccuugccgggccgcgcg

SEQ ID NO: 3261903 - RNA, 17 nt, Mycobacterium tuberculosis H37Rv
ggcggccuugcucagca

SEQ ID NO: 3261904 - RNA, 17 nt, Mycobacterium tuberculosis H37Rv
ggcggccuuuuccgggu

SEQ ID NO: 3261905 - RNA, 17 nt, Mycobacterium tuberculosis H37Rv
ggcggcgaacagcccca

SEQ ID NO: 3261906 - RNA, 18 nt, Mycobacterium tuberculosis H37Rv
ggcggcgaacagccccag

SEQ ID NO: 3261907 - RNA, 19 nt, Mycobacterium tuberculosis H37Rv
ggcggcgaacucggcgaug

SEQ ID NO: 3261908 - RNA, 21 nt, Mycobacterium tuberculosis H37Rv
ggcggcgaccucggcggcggc

SEQ ID NO: 3261909 - RNA, 15 nt, Mycobacterium tuberculosis H37Rv
ggcggcgacgagcgc

SEQ ID NO: 3261910 - RNA, 16 nt, Mycobacterium tuberculosis H37Rv
ggcggcgacgagcgca

SEQ ID NO: 3261911 - RNA, 15 nt, Mycobacterium tuberculosis H37Rv
ggcggcgagcagcag

SEQ ID NO: 3261912 - RNA, 22 nt, Mycobacterium tuberculosis H37Rv
ggcggcgagcgcgaugcagugc

SEQ ID NO: 3261913 - RNA, 20 nt, Mycobacterium tuberculosis H37Rv
ggcggcgauacccaucgauc

SEQ ID NO: 3261914 - RNA, 18 nt, Mycobacterium tuberculosis H37Rv
ggcggcgccccgguuggc

SEQ ID NO: 3261915 - RNA, 20 nt, Mycobacterium tuberculosis H37Rv
ggcggcgccgcagaucaccg

SEQ ID NO: 3261916 - RNA, 22 nt, Mycobacterium tuberculosis H37Rv
ggcgucccgcccggaugcgaug

SEQ ID NO: 3261917 - RNA, 15 nt, Mycobacterium tuberculosis H37Rv
ggcgucccggcgguc

SEQ ID NO: 3261918 - RNA, 15 nt, Mycobacterium tuberculosis H37Rv
ggcguccgcccagca

SEQ ID NO: 3261919 - RNA, 15 nt, Mycobacterium tuberculosis H37Rv
ggcguccgccggcga

SEQ ID NO: 3261920 - RNA, 13 nt, Mycobacterium tuberculosis H37Rv
ggcguccgggauc

SEQ ID NO: 3261921 - RNA, 15 nt, Mycobacterium tuberculosis H37Rv
ggcguccuugcgcag

SEQ ID NO: 3261922 - RNA, 18 nt, Mycobacterium tuberculosis H37Rv
ggcguccuugcgcagcac

SEQ ID NO: 3261923 - RNA, 22 nt, Mycobacterium tuberculosis H37Rv
ggcgucgaacagugccucgcgu

SEQ ID NO: 3261924 - RNA, 15 nt, Mycobacterium tuberculosis H37Rv
ggcgucgaagcacau

SEQ ID NO: 3261925 - RNA, 21 nt, Mycobacterium tuberculosis H37Rv
ggcgucgacaacacgccgucg

SEQ ID NO: 3261926 - RNA, 22 nt, Mycobacterium tuberculosis H37Rv
ggcgucgacagauugcucggug

SEQ ID NO: 3261927 - RNA, 22 nt, Mycobacterium tuberculosis H37Rv
ggcgucgaccacaggcaucgga

SEQ ID NO: 3261928 - RNA, 13 nt, Mycobacterium tuberculosis H37Rv
ggcgucgaccacg

SEQ ID NO: 3261929 - RNA, 14 nt, Mycobacterium tuberculosis H37Rv
ggcgucgacccaga

SEQ ID NO: 3261930 - RNA, 18 nt, Mycobacterium tuberculosis H37Rv
ggcgucgacccugcccag

SEQ ID NO: 3261931 - RNA, 22 nt, Mycobacterium tuberculosis H37Rv
ggcgucgacccugcccagcacc

SEQ ID NO: 3261932 - RNA, 21 nt, Mycobacterium tuberculosis H37Rv
ggcgucgaccuuauugccgag

SEQ ID NO: 3261933 - RNA, 23 nt, Mycobacterium tuberculosis H37Rv
ggcgucgaccuuauugccgagcu

SEQ ID NO: 3261934 - RNA, 23 nt, Mycobacterium tuberculosis H37Rv
ggcgucgacgauucccgcggaca

SEQ ID NO: 3261935 - RNA, 15 nt, Mycobacterium tuberculosis H37Rv
ggcgucgacgucgac

SEQ ID NO: 3261936 - RNA, 19 nt, Mycobacterium tuberculosis H37Rv
ggcgucgacgucgacggcg

SEQ ID NO: 3261937 - RNA, 22 nt, Mycobacterium tuberculosis H37Rv
ggcgucgacgucgacggcgaug

SEQ ID NO: 3261938 - RNA, 13 nt, Mycobacterium tuberculosis H37Rv
ggcgucgagcucg

SEQ ID NO: 3261939 - RNA, 16 nt, Mycobacterium tuberculosis H37Rv
ggcgucgaguucgguu

SEQ ID NO: 3261940 - RNA, 23 nt, Mycobacterium tuberculosis H37Rv
ggcgucgaucaacaacagccgca

SEQ ID NO: 3261941 - RNA, 14 nt, Mycobacterium tuberculosis H37Rv
ggcgucgaucucga

SEQ ID NO: 3261942 - RNA, 16 nt, Mycobacterium tuberculosis H37Rv
ggcgucgaugacgacg

SEQ ID NO: 3261943 - RNA, 21 nt, Mycobacterium tuberculosis H37Rv
ggcgucgaugacgacgccguc

SEQ ID NO: 3261944 - RNA, 19 nt, Mycobacterium tuberculosis H37Rv
ggcgucgaugccggcugcc

SEQ ID NO: 3261945 - RNA, 18 nt, Mycobacterium tuberculosis H37Rv
ggcgucgaugucauccga

SEQ ID NO: 3261946 - RNA, 22 nt, Mycobacterium tuberculosis H37Rv
ggcgucgaugucgccgcccaca

SEQ ID NO: 3261947 - RNA, 14 nt, Mycobacterium tuberculosis H37Rv
ggcgucgccgccgu

SEQ ID NO: 3261948 - RNA, 15 nt, Mycobacterium tuberculosis H37Rv
ggcgucgccgccguu

SEQ ID NO: 3261949 - RNA, 18 nt, Mycobacterium tuberculosis H37Rv
ggcgucgccgccguugcc

SEQ ID NO: 3261950 - RNA, 21 nt, Mycobacterium tuberculosis H37Rv
ggcgucgccgccguugccgcc

SEQ ID NO: 3261951 - RNA, 22 nt, Mycobacterium tuberculosis H37Rv
ggcgucgccgccguugccgcca

SEQ ID NO: 3261952 - RNA, 11 nt, Mycobacterium tuberculosis H37Rv
ggcgucgccgu

SEQ ID NO: 3261953 - RNA, 23 nt, Mycobacterium tuberculosis H37Rv
ggcgucgcgguuguggcugaucc

SEQ ID NO: 3261954 - RNA, 15 nt, Mycobacterium tuberculosis H37Rv
ggcgucgcucgucgu

SEQ ID NO: 3261955 - RNA, 17 nt, Mycobacterium tuberculosis H37Rv
ggcgucgcugcgcuggu

SEQ ID NO: 3261956 - RNA, 17 nt, Mycobacterium tuberculosis H37Rv
ggcgucggacaugccga

SEQ ID NO: 3261957 - RNA, 16 nt, Mycobacterium tuberculosis H37Rv
ggcgucggccaccgcc

SEQ ID NO: 3261958 - RNA, 12 nt, Mycobacterium tuberculosis H37Rv
ggcgucggcgac

SEQ ID NO: 3261959 - RNA, 15 nt, Mycobacterium tuberculosis H37Rv
ggcgucggcgcggcc

SEQ ID NO: 3261960 - RNA, 16 nt, Mycobacterium tuberculosis H37Rv
ggcgucguagucgucg

SEQ ID NO: 3261961 - RNA, 16 nt, Mycobacterium tuberculosis H37Rv
ggcgucguccgcgcca

SEQ ID NO: 3261962 - RNA, 17 nt, Mycobacterium tuberculosis H37Rv
ggcgucgucgaguuggc

SEQ ID NO: 3261963 - RNA, 15 nt, Mycobacterium tuberculosis H37Rv
ggcgucgucgaugau

SEQ ID NO: 3261964 - RNA, 20 nt, Mycobacterium tuberculosis H37Rv
ggcgucgucgauggcugcgc

SEQ ID NO: 3261965 - RNA, 22 nt, Mycobacterium tuberculosis H37Rv
ggcgucgucgauggcugcgccg

SEQ ID NO: 3261966 - RNA, 14 nt, Mycobacterium tuberculosis H37Rv
ggcgucgucggcgg

SEQ ID NO: 3261967 - RNA, 18 nt, Mycobacterium tuberculosis H37Rv
ggcgucgucggcggcgac

SEQ ID NO: 3261968 - RNA, 12 nt, Mycobacterium tuberculosis H37Rv
ggcgucgucggu

SEQ ID NO: 3261969 - RNA, 18 nt, Mycobacterium tuberculosis H37Rv
ggcgucgugcgcggccgg

SEQ ID NO: 3261970 - RNA, 19 nt, Mycobacterium tuberculosis H37Rv
ggcgucgugguggccacgg

SEQ ID NO: 3261971 - RNA, 16 nt, Mycobacterium tuberculosis H37Rv
ggcgucgugguggcua

SEQ ID NO: 3261972 - RNA, 23 nt, Mycobacterium tuberculosis H37Rv
ggcgucguucgagaccccgacga

SEQ ID NO: 3261973 - RNA, 23 nt, Mycobacterium tuberculosis H37Rv
ggcgucucgcagcaacggcggcg

SEQ ID NO: 3261974 - RNA, 16 nt, Mycobacterium tuberculosis H37Rv
ggcgucugagcgagcu

SEQ ID NO: 3261975 - RNA, 18 nt, Mycobacterium tuberculosis H37Rv
ggcgucuguaccacgggc

SEQ ID NO: 3261976 - RNA, 23 nt, Mycobacterium tuberculosis H37Rv
ggcgucuuaccugaagccgcgcu

SEQ ID NO: 3261977 - RNA, 16 nt, Mycobacterium tuberculosis H37Rv
ggcgucuuccucggcc

SEQ ID NO: 3261978 - RNA, 21 nt, Mycobacterium tuberculosis H37Rv
ggcgucuuucggguccgacag

SEQ ID NO: 3261979 - RNA, 15 nt, Mycobacterium tuberculosis H37Rv
ggcgugaacguucuu

SEQ ID NO: 3261980 - RNA, 15 nt, Mycobacterium tuberculosis H37Rv
ggcgugacagggcgg

SEQ ID NO: 3261981 - RNA, 21 nt, Mycobacterium tuberculosis H37Rv
ggcgugacagggcggcaaccu

SEQ ID NO: 3261982 - RNA, 17 nt, Mycobacterium tuberculosis H37Rv
ggcgugacgucgucggu

SEQ ID NO: 3261983 - RNA, 15 nt, Mycobacterium tuberculosis H37Rv
ggcgugagcgcgcgc

SEQ ID NO: 3261984 - RNA, 16 nt, Mycobacterium tuberculosis H37Rv
ggcgugagcgcgcgca

SEQ ID NO: 3261985 - RNA, 22 nt, Mycobacterium tuberculosis H37Rv
ggcgugagcuaugcuggcagcu

SEQ ID NO: 3261986 - RNA, 14 nt, Mycobacterium tuberculosis H37Rv
ggcgugaguggcuc

SEQ ID NO: 3261987 - RNA, 17 nt, Mycobacterium tuberculosis H37Rv
ggcgugauagcccuugc

SEQ ID NO: 3261988 - RNA, 23 nt, Mycobacterium tuberculosis H37Rv
ggcgugcagaauccguucgacga

SEQ ID NO: 3261989 - RNA, 16 nt, Mycobacterium tuberculosis H37Rv
ggcgugcagcacuugg

SEQ ID NO: 3261990 - RNA, 13 nt, Mycobacterium tuberculosis H37Rv
ggcgugcagcagc

SEQ ID NO: 3261991 - RNA, 14 nt, Mycobacterium tuberculosis H37Rv
ggcgugcaguacac

SEQ ID NO: 3261992 - RNA, 14 nt, Mycobacterium tuberculosis H37Rv
ggcgugcccgucgu

SEQ ID NO: 3261993 - RNA, 15 nt, Mycobacterium tuberculosis H37Rv
ggcgugccgaccagc

SEQ ID NO: 3261994 - RNA, 16 nt, Mycobacterium tuberculosis H37Rv
ggcgugccgaccagca

SEQ ID NO: 3261995 - RNA, 12 nt, Mycobacterium tuberculosis H37Rv
ggcgugcgugga

SEQ ID NO: 3261996 - RNA, 13 nt, Mycobacterium tuberculosis H37Rv
ggcgugcucgaca

SEQ ID NO: 3261997 - RNA, 16 nt, Mycobacterium tuberculosis H37Rv
ggcgugcucggaggcg

SEQ ID NO: 3261998 - RNA, 19 nt, Mycobacterium tuberculosis H37Rv
ggcgugcucggaggcgauc

SEQ ID NO: 3261999 - RNA, 11 nt, Mycobacterium tuberculosis H37Rv
ggcgugcuggc

SEQ ID NO: 3262000 - RNA, 23 nt, Mycobacterium tuberculosis H37Rv
ggcguggaucuuggccagcagcg

SEQ ID NO: 3262001 - RNA, 19 nt, Mycobacterium tuberculosis H37Rv
ggcgugggugucggcuagc

SEQ ID NO: 3262002 - RNA, 16 nt, Mycobacterium tuberculosis H37Rv
ggcgugguaucgccgg

SEQ ID NO: 3262003 - RNA, 22 nt, Mycobacterium tuberculosis H37Rv
ggcguggucaccccuucgccag

SEQ ID NO: 3262004 - RNA, 22 nt, Mycobacterium tuberculosis H37Rv
ggcguggugagccucggcgagc

SEQ ID NO: 3262005 - RNA, 23 nt, Mycobacterium tuberculosis H37Rv
ggcgugguggaaacugaugucgc

SEQ ID NO: 3262006 - RNA, 13 nt, Mycobacterium tuberculosis H37Rv
ggcguguacgucg

SEQ ID NO: 3262007 - RNA, 18 nt, Mycobacterium tuberculosis H37Rv
ggcguguagccugcggcg

SEQ ID NO: 3262008 - RNA, 18 nt, Mycobacterium tuberculosis H37Rv
ggcgugucgccgccacca

SEQ ID NO: 3262009 - RNA, 15 nt, Mycobacterium tuberculosis H37Rv
ggcgugucgcgucgc

SEQ ID NO: 3262010 - RNA, 15 nt, Mycobacterium tuberculosis H37Rv
ggcgugucgcgucgu

SEQ ID NO: 3262011 - RNA, 20 nt, Mycobacterium tuberculosis H37Rv
ggcguguucgacggcaagcg

SEQ ID NO: 3262012 - RNA, 13 nt, Mycobacterium tuberculosis H37Rv
ggcucgggcagcg

SEQ ID NO: 3262013 - RNA, 18 nt, Mycobacterium tuberculosis H37Rv
ggcucgggugcgcccggc

SEQ ID NO: 3262014 - RNA, 23 nt, Mycobacterium tuberculosis H37Rv
ggcucggucccgcuacaccugcg

SEQ ID NO: 3262015 - RNA, 12 nt, Mycobacterium tuberculosis H37Rv
ggcucggugcgc

SEQ ID NO: 3262016 - RNA, 20 nt, Mycobacterium tuberculosis H37Rv
ggcucgguggcgccggggcg

SEQ ID NO: 3262017 - RNA, 13 nt, Mycobacterium tuberculosis H37Rv
ggcucgguggcgg

SEQ ID NO: 3262018 - RNA, 19 nt, Mycobacterium tuberculosis H37Rv
ggcucgucgaugucgacgu

SEQ ID NO: 3262019 - RNA, 15 nt, Mycobacterium tuberculosis H37Rv
ggcucuacguaagcg

SEQ ID NO: 3262020 - RNA, 19 nt, Mycobacterium tuberculosis H37Rv
ggcucuagaucgccgagcg

SEQ ID NO: 3262021 - RNA, 14 nt, Mycobacterium tuberculosis H37Rv
ggcucuaucagacg

SEQ ID NO: 3262022 - RNA, 17 nt, Mycobacterium tuberculosis H37Rv
ggcucucagcgacagcu

SEQ ID NO: 3262023 - RNA, 21 nt, Mycobacterium tuberculosis H37Rv
ggcucucggugguccagcgcu

SEQ ID NO: 3262024 - RNA, 23 nt, Mycobacterium tuberculosis H37Rv
ggcucucguagcgcucagcugag

SEQ ID NO: 3262025 - RNA, 21 nt, Mycobacterium tuberculosis H37Rv
ggcucugaggucaccggcgac

SEQ ID NO: 3262026 - RNA, 22 nt, Mycobacterium tuberculosis H37Rv
ggcucugaggucaccggcgacc

SEQ ID NO: 3262027 - RNA, 15 nt, Mycobacterium tuberculosis H37Rv
ggcucuguagcgucg

SEQ ID NO: 3262028 - RNA, 16 nt, Mycobacterium tuberculosis H37Rv
ggcucuguagcgucgc

SEQ ID NO: 3262029 - RNA, 19 nt, Mycobacterium tuberculosis H37Rv
ggcucuguagcgucgcacc

SEQ ID NO: 3262030 - RNA, 18 nt, Mycobacterium tuberculosis H37Rv
ggcugaaacauccccgag

SEQ ID NO: 3262031 - RNA, 18 nt, Mycobacterium tuberculosis H37Rv
ggcugaaacguccuugaa

SEQ ID NO: 3262032 - RNA, 13 nt, Mycobacterium tuberculosis H37Rv
ggcugaacaccgc

SEQ ID NO: 3262033 - RNA, 15 nt, Mycobacterium tuberculosis H37Rv
ggcugaacggcagcc

SEQ ID NO: 3262034 - RNA, 22 nt, Mycobacterium tuberculosis H37Rv
ggcugaagacgaauaacgccgc

SEQ ID NO: 3262035 - RNA, 18 nt, Mycobacterium tuberculosis H37Rv
ggcugaaggacggcagcu

SEQ ID NO: 3262036 - RNA, 14 nt, Mycobacterium tuberculosis H37Rv
ggcugacaccgauc

SEQ ID NO: 3262037 - RNA, 20 nt, Mycobacterium tuberculosis H37Rv
ggcugaccgaagaagcccga

SEQ ID NO: 3262038 - RNA, 20 nt, Mycobacterium tuberculosis H37Rv
ggcugaccggggcgcccggc

SEQ ID NO: 3262039 - RNA, 21 nt, Mycobacterium tuberculosis H37Rv
ggcugaccggggucggccugc

SEQ ID NO: 3262040 - RNA, 19 nt, Mycobacterium tuberculosis H37Rv
ggcugaccucccacccccg

SEQ ID NO: 3262041 - RNA, 23 nt, Mycobacterium tuberculosis H37Rv
ggcugagacgguguugcucgccg

SEQ ID NO: 3262042 - RNA, 14 nt, Mycobacterium tuberculosis H37Rv
ggcugagcaggucu

SEQ ID NO: 3262043 - RNA, 15 nt, Mycobacterium tuberculosis H37Rv
ggcugagcaggucuc

SEQ ID NO: 3262044 - RNA, 13 nt, Mycobacterium tuberculosis H37Rv
ggcugagcccgcc

SEQ ID NO: 3262045 - RNA, 15 nt, Mycobacterium tuberculosis H37Rv
ggcugagcccgccgc

SEQ ID NO: 3262046 - RNA, 18 nt, Mycobacterium tuberculosis H37Rv
ggcugagcccgccgcgac

SEQ ID NO: 3262047 - RNA, 17 nt, Mycobacterium tuberculosis H37Rv
ggcugaggaacgccggc

SEQ ID NO: 3262048 - RNA, 23 nt, Mycobacterium tuberculosis H37Rv
ggcugaggcuuuuggagcggcuc

SEQ ID NO: 3262049 - RNA, 14 nt, Mycobacterium tuberculosis H37Rv
ggcugaucccggcc

SEQ ID NO: 3262050 - RNA, 22 nt, Mycobacterium tuberculosis H37Rv
ggcugaucccggccaggccgac

SEQ ID NO: 3262051 - RNA, 16 nt, Mycobacterium tuberculosis H37Rv
ggcugaucuaccagug

SEQ ID NO: 3262052 - RNA, 15 nt, Mycobacterium tuberculosis H37Rv
ggcugauucgagcca

SEQ ID NO: 3262053 - RNA, 18 nt, Mycobacterium tuberculosis H37Rv
ggcugcaaccagcggcac

SEQ ID NO: 3262054 - RNA, 19 nt, Mycobacterium tuberculosis H37Rv
ggcugcaccggcuugggcc

SEQ ID NO: 3262055 - RNA, 15 nt, Mycobacterium tuberculosis H37Rv
ggcugcacgcucguu

SEQ ID NO: 3262056 - RNA, 12 nt, Mycobacterium tuberculosis H37Rv
ggcugcaggugc

SEQ ID NO: 3262057 - RNA, 15 nt, Mycobacterium tuberculosis H37Rv
ggcugcauccuccuc

SEQ ID NO: 3262058 - RNA, 16 nt, Mycobacterium tuberculosis H37Rv
ggcugcauccuccucg

SEQ ID NO: 3262059 - RNA, 20 nt, Mycobacterium tuberculosis H37Rv
ggcugcauccuccucgucga

SEQ ID NO: 3262060 - RNA, 14 nt, Mycobacterium tuberculosis H37Rv
ggcugccaccgcag

SEQ ID NO: 3262061 - RNA, 12 nt, Mycobacterium tuberculosis H37Rv
ggcugccacggc

SEQ ID NO: 3262062 - RNA, 15 nt, Mycobacterium tuberculosis H37Rv
ggcugccacggccuu

SEQ ID NO: 3262063 - RNA, 13 nt, Mycobacterium tuberculosis H37Rv
ggcugccagaaug

SEQ ID NO: 3262064 - RNA, 21 nt, Mycobacterium tuberculosis H37Rv
ggcugccagaaugggcggcau

SEQ ID NO: 3262065 - RNA, 14 nt, Mycobacterium tuberculosis H37Rv
ggcugccaggagca

SEQ ID NO: 3262066 - RNA, 16 nt, Mycobacterium tuberculosis H37Rv
ggcugccaggagcacg

SEQ ID NO: 3262067 - RNA, 21 nt, Mycobacterium tuberculosis H37Rv
ggcugccagugccgcccacca

SEQ ID NO: 3262068 - RNA, 14 nt, Mycobacterium tuberculosis H37Rv
ggcugccccuccgg

SEQ ID NO: 3262069 - RNA, 16 nt, Mycobacterium tuberculosis H37Rv
ggcugcccgagaucgc

SEQ ID NO: 3262070 - RNA, 22 nt, Mycobacterium tuberculosis H37Rv
ggcugccgaacaguucggcgag

SEQ ID NO: 3262071 - RNA, 20 nt, Mycobacterium tuberculosis H37Rv
ggcugccgaaguugaagaag

SEQ ID NO: 3262072 - RNA, 21 nt, Mycobacterium tuberculosis H37Rv
ggcugccgcccaugccgggau

SEQ ID NO: 3262073 - RNA, 14 nt, Mycobacterium tuberculosis H37Rv
ggcugccgccguug

SEQ ID NO: 3262074 - RNA, 19 nt, Mycobacterium tuberculosis H37Rv
ggcugccgcgcgcugccgc

SEQ ID NO: 3262075 - RNA, 17 nt, Mycobacterium tuberculosis H37Rv
ggcugccgcggugccaa

SEQ ID NO: 3262076 - RNA, 18 nt, Mycobacterium tuberculosis H37Rv
ggcugccgcggugccaac

SEQ ID NO: 3262077 - RNA, 22 nt, Mycobacterium tuberculosis H37Rv
ggcugccggcaacagcucgccu

SEQ ID NO: 3262078 - RNA, 19 nt, Mycobacterium tuberculosis H37Rv
ggcugccgguucaccaugu

SEQ ID NO: 3262079 - RNA, 16 nt, Mycobacterium tuberculosis H37Rv
ggcugcgaccggcucc

SEQ ID NO: 3262080 - RNA, 16 nt, Mycobacterium tuberculosis H37Rv
ggcugcgcagugacgc

SEQ ID NO: 3262081 - RNA, 19 nt, Mycobacterium tuberculosis H37Rv
ggcugcgccgaacaccaca

SEQ ID NO: 3262082 - RNA, 21 nt, Mycobacterium tuberculosis H37Rv
ggcugcgccgaacaccacacc

SEQ ID NO: 3262083 - RNA, 13 nt, Mycobacterium tuberculosis H37Rv
ggcugcgccggaa

SEQ ID NO: 3262084 - RNA, 22 nt, Mycobacterium tuberculosis H37Rv
ggcugcgccggaaccccucgau

SEQ ID NO: 3262085 - RNA, 14 nt, Mycobacterium tuberculosis H37Rv
ggcugcgccgggcu

SEQ ID NO: 3262086 - RNA, 19 nt, Mycobacterium tuberculosis H37Rv
ggcugcgccgggcucgcga

SEQ ID NO: 3262087 - RNA, 14 nt, Mycobacterium tuberculosis H37Rv
ggcugcgcgcucgg

SEQ ID NO: 3262088 - RNA, 20 nt, Mycobacterium tuberculosis H37Rv
ggcugcgcgcucggccagca

SEQ ID NO: 3262089 - RNA, 22 nt, Mycobacterium tuberculosis H37Rv
ggcugcgcgcucggccagcauc

SEQ ID NO: 3262090 - RNA, 18 nt, Mycobacterium tuberculosis H37Rv
ggcugcgcuucgaccgag

SEQ ID NO: 3262091 - RNA, 22 nt, Mycobacterium tuberculosis H37Rv
ggcugcgcuuugcacagcggca

SEQ ID NO: 3262092 - RNA, 17 nt, Mycobacterium tuberculosis H37Rv
ggcugcgggcccggcgg

SEQ ID NO: 3262093 - RNA, 17 nt, Mycobacterium tuberculosis H37Rv
ggcugcguucgccggaa

SEQ ID NO: 3262094 - RNA, 16 nt, Mycobacterium tuberculosis H37Rv
ggcugcguuggcuggu

SEQ ID NO: 3262095 - RNA, 12 nt, Mycobacterium tuberculosis H37Rv
ggcugcuccugg

SEQ ID NO: 3262096 - RNA, 13 nt, Mycobacterium tuberculosis H37Rv
ggcugcucgacgg

SEQ ID NO: 3262097 - RNA, 21 nt, Mycobacterium tuberculosis H37Rv
ggcugcuuggucgcccagcca

SEQ ID NO: 3262098 - RNA, 18 nt, Mycobacterium tuberculosis H37Rv
ggcuggaccacucgccgg

SEQ ID NO: 3262099 - RNA, 19 nt, Mycobacterium tuberculosis H37Rv
ggcuggaccacucgccggc

SEQ ID NO: 3262100 - RNA, 14 nt, Mycobacterium tuberculosis H37Rv
ggcuggacggcgcc

SEQ ID NO: 3262101 - RNA, 20 nt, Mycobacterium tuberculosis H37Rv
ggcuggcaugccggcgugcg

SEQ ID NO: 3262102 - RNA, 16 nt, Mycobacterium tuberculosis H37Rv
ggcuggccagcacgcc

SEQ ID NO: 3262103 - RNA, 22 nt, Mycobacterium tuberculosis H37Rv
ggcuggcccaccuccucgccgg

SEQ ID NO: 3262104 - RNA, 15 nt, Mycobacterium tuberculosis H37Rv
ggcuggcccagcgac

SEQ ID NO: 3262105 - RNA, 22 nt, Mycobacterium tuberculosis H37Rv
ggcuggccgccuccgcggcauu

SEQ ID NO: 3262106 - RNA, 15 nt, Mycobacterium tuberculosis H37Rv
ggcuggccgcgccuc

SEQ ID NO: 3262107 - RNA, 17 nt, Mycobacterium tuberculosis H37Rv
ggcuggccgcgccucgg

SEQ ID NO: 3262108 - RNA, 20 nt, Mycobacterium tuberculosis H37Rv
gggaacguccgcgccgagcc

SEQ ID NO: 3262109 - RNA, 18 nt, Mycobacterium tuberculosis H37Rv
gggaagaacaucaccucg

SEQ ID NO: 3262110 - RNA, 20 nt, Mycobacterium tuberculosis H37Rv
gggaagacgaccgugcuggg

SEQ ID NO: 3262111 - RNA, 16 nt, Mycobacterium tuberculosis H37Rv
gggaagcccggcagau

SEQ ID NO: 3262112 - RNA, 22 nt, Mycobacterium tuberculosis H37Rv
gggaagcccggcagaugcagcg

SEQ ID NO: 3262113 - RNA, 21 nt, Mycobacterium tuberculosis H37Rv
gggaagccguuuucgaaacug

SEQ ID NO: 3262114 - RNA, 18 nt, Mycobacterium tuberculosis H37Rv
gggaagcgcguccaacca

SEQ ID NO: 3262115 - RNA, 14 nt, Mycobacterium tuberculosis H37Rv
gggaaggaaccggg

SEQ ID NO: 3262116 - RNA, 17 nt, Mycobacterium tuberculosis H37Rv
gggaaggaaccgggcaa

SEQ ID NO: 3262117 - RNA, 18 nt, Mycobacterium tuberculosis H37Rv
gggaauggcccuugcucg

SEQ ID NO: 3262118 - RNA, 19 nt, Mycobacterium tuberculosis H37Rv
gggacaaucucggccgcau

SEQ ID NO: 3262119 - RNA, 17 nt, Mycobacterium tuberculosis H37Rv
gggacaccaucuccgcc

SEQ ID NO: 3262120 - RNA, 16 nt, Mycobacterium tuberculosis H37Rv
gggacacgucgcgcca

SEQ ID NO: 3262121 - RNA, 20 nt, Mycobacterium tuberculosis H37Rv
gggacagauggcggccgagg

SEQ ID NO: 3262122 - RNA, 12 nt, Mycobacterium tuberculosis H37Rv
gggacaucaccg

SEQ ID NO: 3262123 - RNA, 22 nt, Mycobacterium tuberculosis H37Rv
gggaccacccgguccugcucgc

SEQ ID NO: 3262124 - RNA, 11 nt, Mycobacterium tuberculosis H37Rv
gggaccaccga

SEQ ID NO: 3262125 - RNA, 21 nt, Mycobacterium tuberculosis H37Rv
gggaccagugcgguggcaggu

SEQ ID NO: 3262126 - RNA, 17 nt, Mycobacterium tuberculosis H37Rv
gggaccccgccagccgg

SEQ ID NO: 3262127 - RNA, 18 nt, Mycobacterium tuberculosis H37Rv
gggaccccgcugcgacgu

SEQ ID NO: 3262128 - RNA, 17 nt, Mycobacterium tuberculosis H37Rv
gggacccgagaucaccg

SEQ ID NO: 3262129 - RNA, 17 nt, Mycobacterium tuberculosis H37Rv
gggacccgcuccaagcg

SEQ ID NO: 3262130 - RNA, 17 nt, Mycobacterium tuberculosis H37Rv
gggacccggaccuucgg

SEQ ID NO: 3262131 - RNA, 14 nt, Mycobacterium tuberculosis H37Rv
gggaccgccccggc

SEQ ID NO: 3262132 - RNA, 17 nt, Mycobacterium tuberculosis H37Rv
gggaccgccccggccag

SEQ ID NO: 3262133 - RNA, 21 nt, Mycobacterium tuberculosis H37Rv
gggaccgcgaacccgugggcg

SEQ ID NO: 3262134 - RNA, 14 nt, Mycobacterium tuberculosis H37Rv
gggaccgcgccagg

SEQ ID NO: 3262135 - RNA, 13 nt, Mycobacterium tuberculosis H37Rv
gggaccggggacg

SEQ ID NO: 3262136 - RNA, 19 nt, Mycobacterium tuberculosis H37Rv
gggaccucggcgcgcucgg

SEQ ID NO: 3262137 - RNA, 20 nt, Mycobacterium tuberculosis H37Rv
gggaccuugaucgagcaggg

SEQ ID NO: 3262138 - RNA, 22 nt, Mycobacterium tuberculosis H37Rv
gggacgaaucccgcgcccggcc

SEQ ID NO: 3262139 - RNA, 24 nt, Mycobacterium tuberculosis H37Rv
gggacgacgccaccugacgugcgg

SEQ ID NO: 3262140 - RNA, 14 nt, Mycobacterium tuberculosis H37Rv
gggacgacggcaag

SEQ ID NO: 3262141 - RNA, 18 nt, Mycobacterium tuberculosis H37Rv
gggacggucgcucggcau

SEQ ID NO: 3262142 - RNA, 14 nt, Mycobacterium tuberculosis H37Rv
gggacgucuccacc

SEQ ID NO: 3262143 - RNA, 23 nt, Mycobacterium tuberculosis H37Rv
gggacgucuccaccgcgaugacg

SEQ ID NO: 3262144 - RNA, 16 nt, Mycobacterium tuberculosis H37Rv
gggacguuguccaccg

SEQ ID NO: 3262145 - RNA, 22 nt, Mycobacterium tuberculosis H37Rv
gggacucauggccggucugcug

SEQ ID NO: 3262146 - RNA, 23 nt, Mycobacterium tuberculosis H37Rv
gggacucugccacccagcacgcg

SEQ ID NO: 3262147 - RNA, 16 nt, Mycobacterium tuberculosis H37Rv
gggacuggcaggccgg

SEQ ID NO: 3262148 - RNA, 19 nt, Mycobacterium tuberculosis H37Rv
gggacuggcaggccggcgu

SEQ ID NO: 3262149 - RNA, 16 nt, Mycobacterium tuberculosis H37Rv
gggacugugggggcgc

SEQ ID NO: 3262150 - RNA, 19 nt, Mycobacterium tuberculosis H37Rv
gggagcaccgaccagggcc

SEQ ID NO: 3262151 - RNA, 20 nt, Mycobacterium tuberculosis H37Rv
gggagcaccgaccagggccg

SEQ ID NO: 3262152 - RNA, 15 nt, Mycobacterium tuberculosis H37Rv
gggagcacuacccca

SEQ ID NO: 3262153 - RNA, 14 nt, Mycobacterium tuberculosis H37Rv
gggagcagccgaac

SEQ ID NO: 3262154 - RNA, 13 nt, Mycobacterium tuberculosis H37Rv
gggagccaccggc

SEQ ID NO: 3262155 - RNA, 21 nt, Mycobacterium tuberculosis H37Rv
gggagccaccggcgucgacgu

SEQ ID NO: 3262156 - RNA, 13 nt, Mycobacterium tuberculosis H37Rv
gggagcgaacggc

SEQ ID NO: 3262157 - RNA, 18 nt, Mycobacterium tuberculosis H37Rv
gggagcgaacggcgcagu

SEQ ID NO: 3262158 - RNA, 18 nt, Mycobacterium tuberculosis H37Rv
gggagcgcagcgccggca

SEQ ID NO: 3262159 - RNA, 15 nt, Mycobacterium tuberculosis H37Rv
gggagcggcugcacg

SEQ ID NO: 3262160 - RNA, 18 nt, Mycobacterium tuberculosis H37Rv
gggagcggcugcggcaac

SEQ ID NO: 3262161 - RNA, 20 nt, Mycobacterium tuberculosis H37Rv
gggaggccaacccugcggcg

SEQ ID NO: 3262162 - RNA, 12 nt, Mycobacterium tuberculosis H37Rv
gggaggcggcgc

SEQ ID NO: 3262163 - RNA, 22 nt, Mycobacterium tuberculosis H37Rv
gggaggcggcgccgcacccaca

SEQ ID NO: 3262164 - RNA, 19 nt, Mycobacterium tuberculosis H37Rv
gggagguacccccagcacc

SEQ ID NO: 3262165 - RNA, 23 nt, Mycobacterium tuberculosis H37Rv
gggaguaguggugggcguggcug

SEQ ID NO: 3262166 - RNA, 20 nt, Mycobacterium tuberculosis H37Rv
gggagucaucgcggcggcga

SEQ ID NO: 3262167 - RNA, 21 nt, Mycobacterium tuberculosis H37Rv
gggagucaucgcggcggcgac

SEQ ID NO: 3262168 - RNA, 20 nt, Mycobacterium tuberculosis H37Rv
gggaguccggccgacccgga

SEQ ID NO: 3262169 - RNA, 23 nt, Mycobacterium tuberculosis H37Rv
gggagucgucguguuggccgggu

SEQ ID NO: 3262170 - RNA, 13 nt, Mycobacterium tuberculosis H37Rv
gggaguucgcgca

SEQ ID NO: 3262171 - RNA, 20 nt, Mycobacterium tuberculosis H37Rv
gggaguugcuugcagggcca

SEQ ID NO: 3262172 - RNA, 21 nt, Mycobacterium tuberculosis H37Rv
gggauacucgucgucggcagg

SEQ ID NO: 3262173 - RNA, 21 nt, Mycobacterium tuberculosis H37Rv
gggauaggccguggucgaggg

SEQ ID NO: 3262174 - RNA, 16 nt, Mycobacterium tuberculosis H37Rv
gggauaucgucgacgc

SEQ ID NO: 3262175 - RNA, 15 nt, Mycobacterium tuberculosis H37Rv
gggaucaugaccauc

SEQ ID NO: 3262176 - RNA, 17 nt, Mycobacterium tuberculosis H37Rv
gggauccagcaggccgg

SEQ ID NO: 3262177 - RNA, 17 nt, Mycobacterium tuberculosis H37Rv
gggaucccagcgcagcg

SEQ ID NO: 3262178 - RNA, 13 nt, Mycobacterium tuberculosis H37Rv
gggaucccccgcg

SEQ ID NO: 3262179 - RNA, 21 nt, Mycobacterium tuberculosis H37Rv
gggauccgaagagccagcaac

SEQ ID NO: 3262180 - RNA, 15 nt, Mycobacterium tuberculosis H37Rv
gggauccgcgcgcug

SEQ ID NO: 3262181 - RNA, 17 nt, Mycobacterium tuberculosis H37Rv
gggauccgcgcgcugga

SEQ ID NO: 3262182 - RNA, 14 nt, Mycobacterium tuberculosis H37Rv
gggaucgaccaugg

SEQ ID NO: 3262183 - RNA, 14 nt, Mycobacterium tuberculosis H37Rv
gggaucgacccgcc

SEQ ID NO: 3262184 - RNA, 19 nt, Mycobacterium tuberculosis H37Rv
gggaucgacgucgcggcgc

SEQ ID NO: 3262185 - RNA, 16 nt, Mycobacterium tuberculosis H37Rv
gggaucgagagccgac

SEQ ID NO: 3262186 - RNA, 13 nt, Mycobacterium tuberculosis H37Rv
gggaucgcccagg

SEQ ID NO: 3262187 - RNA, 14 nt, Mycobacterium tuberculosis H37Rv
gggaucgcccaggc

SEQ ID NO: 3262188 - RNA, 21 nt, Mycobacterium tuberculosis H37Rv
gggaucgcccaggcgcgacgu

SEQ ID NO: 3262189 - RNA, 19 nt, Mycobacterium tuberculosis H37Rv
gggaucgccguccagcaau

SEQ ID NO: 3262190 - RNA, 14 nt, Mycobacterium tuberculosis H37Rv
gggaucgcugccag

SEQ ID NO: 3262191 - RNA, 15 nt, Mycobacterium tuberculosis H37Rv
gggaucgcugccagc

SEQ ID NO: 3262192 - RNA, 17 nt, Mycobacterium tuberculosis H37Rv
gggaucgguggcggcac

SEQ ID NO: 3262193 - RNA, 18 nt, Mycobacterium tuberculosis H37Rv
gggaucgugccggcgaac

SEQ ID NO: 3262194 - RNA, 20 nt, Mycobacterium tuberculosis H37Rv
gggaucugagggcucggugg

SEQ ID NO: 3262195 - RNA, 15 nt, Mycobacterium tuberculosis H37Rv
gggaugccggcgaag

SEQ ID NO: 3262196 - RNA, 15 nt, Mycobacterium tuberculosis H37Rv
gggaugcggccggau

SEQ ID NO: 3262197 - RNA, 21 nt, Mycobacterium tuberculosis H37Rv
gggauggacggcagccagcca

SEQ ID NO: 3262198 - RNA, 17 nt, Mycobacterium tuberculosis H37Rv
gggauguagugcugcuc

SEQ ID NO: 3262199 - RNA, 18 nt, Mycobacterium tuberculosis H37Rv
gggauguagugcugcucg

SEQ ID NO: 3262200 - RNA, 14 nt, Mycobacterium tuberculosis H37Rv
gggauucggcagcg

SEQ ID NO: 3262201 - RNA, 13 nt, Mycobacterium tuberculosis H37Rv
gggauucggccag

SEQ ID NO: 3262202 - RNA, 13 nt, Mycobacterium tuberculosis H37Rv
gggauucuggaug

SEQ ID NO: 3262203 - RNA, 16 nt, Mycobacterium tuberculosis H37Rv
gggauuggaggcgggc

SEQ ID NO: 3262204 - RNA, 14 nt, Mycobacterium tuberculosis H37Rv
gggccagcgcgcca

SEQ ID NO: 3262205 - RNA, 13 nt, Mycobacterium tuberculosis H37Rv
gggccagcggcag

SEQ ID NO: 3262206 - RNA, 14 nt, Mycobacterium tuberculosis H37Rv
gggccagcggcagc

SEQ ID NO: 3262207 - RNA, 17 nt, Mycobacterium tuberculosis H37Rv
gggccagcggcagccug

SEQ ID NO: 3262208 - RNA, 16 nt, Mycobacterium tuberculosis H37Rv
gggccaggcgcccagc

SEQ ID NO: 3262209 - RNA, 13 nt, Mycobacterium tuberculosis H37Rv
gggccaggcugcg

SEQ ID NO: 3262210 - RNA, 23 nt, Mycobacterium tuberculosis H37Rv
gggccaggucagccgcgcggguc

SEQ ID NO: 3262211 - RNA, 19 nt, Mycobacterium tuberculosis H37Rv
gggccauaaaugcgcguuc

SEQ ID NO: 3262212 - RNA, 13 nt, Mycobacterium tuberculosis H37Rv
gggccaucacggu

SEQ ID NO: 3262213 - RNA, 18 nt, Mycobacterium tuberculosis H37Rv
gggccauggguagccgcc

SEQ ID NO: 3262214 - RNA, 22 nt, Mycobacterium tuberculosis H37Rv
gggccauggguagccgcccagc

SEQ ID NO: 3262215 - RNA, 21 nt, Mycobacterium tuberculosis H37Rv
gggccauguggacggcauagc

SEQ ID NO: 3262216 - RNA, 15 nt, Mycobacterium tuberculosis H37Rv
gggcccagccggacc

SEQ ID NO: 3262217 - RNA, 15 nt, Mycobacterium tuberculosis H37Rv
gggcccagcgcgcgg

SEQ ID NO: 3262218 - RNA, 16 nt, Mycobacterium tuberculosis H37Rv
gggcccagcgcgcgga

SEQ ID NO: 3262219 - RNA, 21 nt, Mycobacterium tuberculosis H37Rv
gggcccccaaucagugcagcg

SEQ ID NO: 3262220 - RNA, 16 nt, Mycobacterium tuberculosis H37Rv
gggccccgccgaugcg

SEQ ID NO: 3262221 - RNA, 21 nt, Mycobacterium tuberculosis H37Rv
gggcccgaccuguccacccag

SEQ ID NO: 3262222 - RNA, 18 nt, Mycobacterium tuberculosis H37Rv
gggcccgccggccccgcc

SEQ ID NO: 3262223 - RNA, 11 nt, Mycobacterium tuberculosis H37Rv
gggcccgccgu

SEQ ID NO: 3262224 - RNA, 18 nt, Mycobacterium tuberculosis H37Rv
gggcccgccgucaccgcc

SEQ ID NO: 3262225 - RNA, 20 nt, Mycobacterium tuberculosis H37Rv
gggcccgccgucaccgccgu

SEQ ID NO: 3262226 - RNA, 18 nt, Mycobacterium tuberculosis H37Rv
gggcccgccguccccgcc

SEQ ID NO: 3262227 - RNA, 19 nt, Mycobacterium tuberculosis H37Rv
gggcccgccguccccgccg

SEQ ID NO: 3262228 - RNA, 14 nt, Mycobacterium tuberculosis H37Rv
gggcccgcgcggcg

SEQ ID NO: 3262229 - RNA, 22 nt, Mycobacterium tuberculosis H37Rv
gggcccgcguucucggcacccu

SEQ ID NO: 3262230 - RNA, 22 nt, Mycobacterium tuberculosis H37Rv
gggcccgucgucgucgacacgg

SEQ ID NO: 3262231 - RNA, 20 nt, Mycobacterium tuberculosis H37Rv
gggcccucuaugcgggcagc

SEQ ID NO: 3262232 - RNA, 21 nt, Mycobacterium tuberculosis H37Rv
gggcccucuaugcgggcagcg

SEQ ID NO: 3262233 - RNA, 19 nt, Mycobacterium tuberculosis H37Rv
gggcccuggcggcccgggu

SEQ ID NO: 3262234 - RNA, 22 nt, Mycobacterium tuberculosis H37Rv
gggcccuucacuguugcccuug

SEQ ID NO: 3262235 - RNA, 22 nt, Mycobacterium tuberculosis H37Rv
gggccgaacacaccgggcgggc

SEQ ID NO: 3262236 - RNA, 20 nt, Mycobacterium tuberculosis H37Rv
gggccgaagcgcgcgcguga

SEQ ID NO: 3262237 - RNA, 21 nt, Mycobacterium tuberculosis H37Rv
gggccgaauccgauagcccgg

SEQ ID NO: 3262238 - RNA, 21 nt, Mycobacterium tuberculosis H37Rv
gggccgacagcacgccaggca

SEQ ID NO: 3262239 - RNA, 15 nt, Mycobacterium tuberculosis H37Rv
gggccgaccagucga

SEQ ID NO: 3262240 - RNA, 19 nt, Mycobacterium tuberculosis H37Rv
gggccgaccagucgacguc

SEQ ID NO: 3262241 - RNA, 17 nt, Mycobacterium tuberculosis H37Rv
gggccgacgggacaacc

SEQ ID NO: 3262242 - RNA, 19 nt, Mycobacterium tuberculosis H37Rv
gggccgacgggacaacccg

SEQ ID NO: 3262243 - RNA, 12 nt, Mycobacterium tuberculosis H37Rv
gggccgagcgca

SEQ ID NO: 3262244 - RNA, 16 nt, Mycobacterium tuberculosis H37Rv
gggccgagcgcgccgu

SEQ ID NO: 3262245 - RNA, 19 nt, Mycobacterium tuberculosis H37Rv
gggccgcacggucagcgcg

SEQ ID NO: 3262246 - RNA, 23 nt, Mycobacterium tuberculosis H37Rv
gggccgcacguauccacggucga

SEQ ID NO: 3262247 - RNA, 22 nt, Mycobacterium tuberculosis H37Rv
gggccgccagcugcgcagcgca

SEQ ID NO: 3262248 - RNA, 13 nt, Mycobacterium tuberculosis H37Rv
gggccgccagggc

SEQ ID NO: 3262249 - RNA, 15 nt, Mycobacterium tuberculosis H37Rv
gggccgccaucucgu

SEQ ID NO: 3262250 - RNA, 17 nt, Mycobacterium tuberculosis H37Rv
gggccgccgagcggacc

SEQ ID NO: 3262251 - RNA, 13 nt, Mycobacterium tuberculosis H37Rv
gggccgccgagcu

SEQ ID NO: 3262252 - RNA, 16 nt, Mycobacterium tuberculosis H37Rv
gggccgccgccccggc

SEQ ID NO: 3262253 - RNA, 13 nt, Mycobacterium tuberculosis H37Rv
gggccgccgcccu

SEQ ID NO: 3262254 - RNA, 22 nt, Mycobacterium tuberculosis H37Rv
gggccgccgcccugguccaggc

SEQ ID NO: 3262255 - RNA, 19 nt, Mycobacterium tuberculosis H37Rv
gggccgccucgaucgacuc

SEQ ID NO: 3262256 - RNA, 16 nt, Mycobacterium tuberculosis H37Rv
gggccgcgaaacccug

SEQ ID NO: 3262257 - RNA, 15 nt, Mycobacterium tuberculosis H37Rv
gggccgcgcccuggc

SEQ ID NO: 3262258 - RNA, 13 nt, Mycobacterium tuberculosis H37Rv
gggccgcgcggcg

SEQ ID NO: 3262259 - RNA, 14 nt, Mycobacterium tuberculosis H37Rv
gggccgcggccaca

SEQ ID NO: 3262260 - RNA, 17 nt, Mycobacterium tuberculosis H37Rv
gggccgcggcggccagc

SEQ ID NO: 3262261 - RNA, 23 nt, Mycobacterium tuberculosis H37Rv
gggccgcucacaagccgugcagc

SEQ ID NO: 3262262 - RNA, 22 nt, Mycobacterium tuberculosis H37Rv
gggccggacugaagccgcgagc

SEQ ID NO: 3262263 - RNA, 20 nt, Mycobacterium tuberculosis H37Rv
gggccggaugacgcccaggg

SEQ ID NO: 3262264 - RNA, 19 nt, Mycobacterium tuberculosis H37Rv
gggccggaugucgacgagc

SEQ ID NO: 3262265 - RNA, 23 nt, Mycobacterium tuberculosis H37Rv
gggccggaugucgacgagcaccg

SEQ ID NO: 3262266 - RNA, 20 nt, Mycobacterium tuberculosis H37Rv
gggccggcagcggcugggac

SEQ ID NO: 3262267 - RNA, 14 nt, Mycobacterium tuberculosis H37Rv
gggccggccgagcg

SEQ ID NO: 3262268 - RNA, 16 nt, Mycobacterium tuberculosis H37Rv
gggccggccgagcgca

SEQ ID NO: 3262269 - RNA, 15 nt, Mycobacterium tuberculosis H37Rv
gggccggcggcucgg

SEQ ID NO: 3262270 - RNA, 19 nt, Mycobacterium tuberculosis H37Rv
gggccggcguagcggcgau

SEQ ID NO: 3262271 - RNA, 14 nt, Mycobacterium tuberculosis H37Rv
gggccggcuagggc

SEQ ID NO: 3262272 - RNA, 22 nt, Mycobacterium tuberculosis H37Rv
gggccgggcggugucugaaccg

SEQ ID NO: 3262273 - RNA, 19 nt, Mycobacterium tuberculosis H37Rv
gggccgguccggggcaacg

SEQ ID NO: 3262274 - RNA, 16 nt, Mycobacterium tuberculosis H37Rv
gggccggugaacacgu

SEQ ID NO: 3262275 - RNA, 17 nt, Mycobacterium tuberculosis H37Rv
gggccggugcagcacgu

SEQ ID NO: 3262276 - RNA, 23 nt, Mycobacterium tuberculosis H37Rv
gggccgguggaaaagccacggcu

SEQ ID NO: 3262277 - RNA, 21 nt, Mycobacterium tuberculosis H37Rv
gggccguacaacagcgcgcgc

SEQ ID NO: 3262278 - RNA, 19 nt, Mycobacterium tuberculosis H37Rv
gggccguccggcgccugcu

SEQ ID NO: 3262279 - RNA, 23 nt, Mycobacterium tuberculosis H37Rv
gggccguccggcgccugcugcgg

SEQ ID NO: 3262280 - RNA, 21 nt, Mycobacterium tuberculosis H37Rv
gggccguccggcuuggcggcg

SEQ ID NO: 3262281 - RNA, 22 nt, Mycobacterium tuberculosis H37Rv
gggccguccggcuuggcggcga

SEQ ID NO: 3262282 - RNA, 23 nt, Mycobacterium tuberculosis H37Rv
gggccguccggcuuggcggcgau

SEQ ID NO: 3262283 - RNA, 13 nt, Mycobacterium tuberculosis H37Rv
gggccguccuccc

SEQ ID NO: 3262284 - RNA, 21 nt, Mycobacterium tuberculosis H37Rv
gggccguccucccacagguag

SEQ ID NO: 3262285 - RNA, 12 nt, Mycobacterium tuberculosis H37Rv
gggccgucggca

SEQ ID NO: 3262286 - RNA, 21 nt, Mycobacterium tuberculosis H37Rv
gggccgucuugccggccagga

SEQ ID NO: 3262287 - RNA, 23 nt, Mycobacterium tuberculosis H37Rv
gggccucaaguugguucaccgcg

SEQ ID NO: 3262288 - RNA, 17 nt, Mycobacterium tuberculosis H37Rv
gggccucagacaacggg

SEQ ID NO: 3262289 - RNA, 12 nt, Mycobacterium tuberculosis H37Rv
gggccuccugcu

SEQ ID NO: 3262290 - RNA, 15 nt, Mycobacterium tuberculosis H37Rv
gggccucgaccgcca

SEQ ID NO: 3262291 - RNA, 21 nt, Mycobacterium tuberculosis H37Rv
gggccucgaccgccagccgcg

SEQ ID NO: 3262292 - RNA, 19 nt, Mycobacterium tuberculosis H37Rv
gggccucgaucagcgccgg

SEQ ID NO: 3262293 - RNA, 17 nt, Mycobacterium tuberculosis H37Rv
gggccucggcgaccauc

SEQ ID NO: 3262294 - RNA, 20 nt, Mycobacterium tuberculosis H37Rv
gggccucggcgccgucggag

SEQ ID NO: 3262295 - RNA, 23 nt, Mycobacterium tuberculosis H37Rv
gggccucguugaccagaaccugg

SEQ ID NO: 3262296 - RNA, 17 nt, Mycobacterium tuberculosis H37Rv
gggccugacgcgucagc

SEQ ID NO: 3262297 - RNA, 15 nt, Mycobacterium tuberculosis H37Rv
gggccugcacgccgg

SEQ ID NO: 3262298 - RNA, 20 nt, Mycobacterium tuberculosis H37Rv
gggccuggccugcccagcac

SEQ ID NO: 3262299 - RNA, 14 nt, Mycobacterium tuberculosis H37Rv
gggcuccaacaggu

SEQ ID NO: 3262300 - RNA, 14 nt, Mycobacterium tuberculosis H37Rv
gggcuccagcagcg

SEQ ID NO: 3262301 - RNA, 22 nt, Mycobacterium tuberculosis H37Rv
gggcuccccggauuccucguca

SEQ ID NO: 3262302 - RNA, 20 nt, Mycobacterium tuberculosis H37Rv
gggcucgcuucaggcaccgg

SEQ ID NO: 3262303 - RNA, 13 nt, Mycobacterium tuberculosis H37Rv
gggcucggcggcc

SEQ ID NO: 3262304 - RNA, 17 nt, Mycobacterium tuberculosis H37Rv
gggcucggcggcccggc

SEQ ID NO: 3262305 - RNA, 18 nt, Mycobacterium tuberculosis H37Rv
gggcucggcggcccggcc

SEQ ID NO: 3262306 - RNA, 19 nt, Mycobacterium tuberculosis H37Rv
gggcucguaggugggcucg

SEQ ID NO: 3262307 - RNA, 14 nt, Mycobacterium tuberculosis H37Rv
gggcucguccagca

SEQ ID NO: 3262308 - RNA, 16 nt, Mycobacterium tuberculosis H37Rv
gggcucguccagcaac

SEQ ID NO: 3262309 - RNA, 19 nt, Mycobacterium tuberculosis H37Rv
gggcucuacucgcggccgg

SEQ ID NO: 3262310 - RNA, 19 nt, Mycobacterium tuberculosis H37Rv
gggcucucgaguccaggca

SEQ ID NO: 3262311 - RNA, 14 nt, Mycobacterium tuberculosis H37Rv
gggcucuggccagu

SEQ ID NO: 3262312 - RNA, 20 nt, Mycobacterium tuberculosis H37Rv
gggcucuucgcagcgguggu

SEQ ID NO: 3262313 - RNA, 18 nt, Mycobacterium tuberculosis H37Rv
gggcugaccgaagaagcc

SEQ ID NO: 3262314 - RNA, 21 nt, Mycobacterium tuberculosis H37Rv
gggcugccacggccuucagcg

SEQ ID NO: 3262315 - RNA, 19 nt, Mycobacterium tuberculosis H37Rv
gggcugcugcucggccugg

SEQ ID NO: 3262316 - RNA, 19 nt, Mycobacterium tuberculosis H37Rv
gggcuggauaugagccaac

SEQ ID NO: 3262317 - RNA, 13 nt, Mycobacterium tuberculosis H37Rv
gggcuggcaaccg

SEQ ID NO: 3262318 - RNA, 16 nt, Mycobacterium tuberculosis H37Rv
gggcuggccgacucga

SEQ ID NO: 3262319 - RNA, 13 nt, Mycobacterium tuberculosis H37Rv
gggcuggcgacga

SEQ ID NO: 3262320 - RNA, 18 nt, Mycobacterium tuberculosis H37Rv
gggcugggauagcgcggu

SEQ ID NO: 3262321 - RNA, 22 nt, Mycobacterium tuberculosis H37Rv
gggcuggguaugcacccaggca

SEQ ID NO: 3262322 - RNA, 15 nt, Mycobacterium tuberculosis H37Rv
gggcugguaucgagc

SEQ ID NO: 3262323 - RNA, 16 nt, Mycobacterium tuberculosis H37Rv
gggcugguaucgagca

SEQ ID NO: 3262324 - RNA, 18 nt, Mycobacterium tuberculosis H37Rv
gggcuguacucgcggcgc

SEQ ID NO: 3262325 - RNA, 14 nt, Mycobacterium tuberculosis H37Rv
gggcuguccaccga

SEQ ID NO: 3262326 - RNA, 18 nt, Mycobacterium tuberculosis H37Rv
gggcuguccgaccucgcc

SEQ ID NO: 3262327 - RNA, 19 nt, Mycobacterium tuberculosis H37Rv
gggcuguccgaccucgccg

SEQ ID NO: 3262328 - RNA, 21 nt, Mycobacterium tuberculosis H37Rv
gggcuguccgaccucgccgcg

SEQ ID NO: 3262329 - RNA, 21 nt, Mycobacterium tuberculosis H37Rv
gggcuguugacgccacgacgc

SEQ ID NO: 3262330 - RNA, 17 nt, Mycobacterium tuberculosis H37Rv
gggcuuaggccgcggca

SEQ ID NO: 3262331 - RNA, 18 nt, Mycobacterium tuberculosis H37Rv
gggcuuaugcgucugcuc

SEQ ID NO: 3262332 - RNA, 19 nt, Mycobacterium tuberculosis H37Rv
gggcuuaugcgucugcucg

SEQ ID NO: 3262333 - RNA, 15 nt, Mycobacterium tuberculosis H37Rv
gggcuucgagugcga

SEQ ID NO: 3262334 - RNA, 14 nt, Mycobacterium tuberculosis H37Rv
gggcuucggccaga

SEQ ID NO: 3262335 - RNA, 17 nt, Mycobacterium tuberculosis H37Rv
gggcuucugcgucugcu

SEQ ID NO: 3262336 - RNA, 14 nt, Mycobacterium tuberculosis H37Rv
gggcuugagcgccg

SEQ ID NO: 3262337 - RNA, 17 nt, Mycobacterium tuberculosis H37Rv
gggcuugccgcgcacca

SEQ ID NO: 3262338 - RNA, 13 nt, Mycobacterium tuberculosis H37Rv
gggcuugccgggu

SEQ ID NO: 3262339 - RNA, 20 nt, Mycobacterium tuberculosis H37Rv
gggcuuggcgucgacgucga

SEQ ID NO: 3262340 - RNA, 13 nt, Mycobacterium tuberculosis H37Rv
gggcuuggcugug

SEQ ID NO: 3262341 - RNA, 16 nt, Mycobacterium tuberculosis H37Rv
gggcuugucgccggca

SEQ ID NO: 3262342 - RNA, 18 nt, Mycobacterium tuberculosis H37Rv
gggcuuuagugucugcuc

SEQ ID NO: 3262343 - RNA, 20 nt, Mycobacterium tuberculosis H37Rv
gggcuuuagugucugcucgc

SEQ ID NO: 3262344 - RNA, 23 nt, Mycobacterium tuberculosis H37Rv
gggcuuucgcgugcggcugccag

SEQ ID NO: 3262345 - RNA, 15 nt, Mycobacterium tuberculosis H37Rv
gggcuuugccgucga

SEQ ID NO: 3262346 - RNA, 18 nt, Mycobacterium tuberculosis H37Rv
gggcuuuuacgucugcuc

SEQ ID NO: 3262347 - RNA, 17 nt, Mycobacterium tuberculosis H37Rv
gggcuuuugcgucugcu

SEQ ID NO: 3262348 - RNA, 22 nt, Mycobacterium tuberculosis H37Rv
gggcuuuugcgucugcucgcca

SEQ ID NO: 3262349 - RNA, 20 nt, Mycobacterium tuberculosis H37Rv
gggcuuuugcgucugcugac

SEQ ID NO: 3262350 - RNA, 20 nt, Mycobacterium tuberculosis H37Rv
ggggaaaccggccagccgac

SEQ ID NO: 3262351 - RNA, 21 nt, Mycobacterium tuberculosis H37Rv
ggggaaaccggccagccgacg

SEQ ID NO: 3262352 - RNA, 16 nt, Mycobacterium tuberculosis H37Rv
ggggaacagcagcgca

SEQ ID NO: 3262353 - RNA, 21 nt, Mycobacterium tuberculosis H37Rv
ggggaacguccgcgccgagcc

SEQ ID NO: 3262354 - RNA, 24 nt, Mycobacterium tuberculosis H37Rv
ggggaaguuggcugagcagcgcgg

SEQ ID NO: 3262355 - RNA, 12 nt, Mycobacterium tuberculosis H37Rv
ggggaccccgcc

SEQ ID NO: 3262356 - RNA, 16 nt, Mycobacterium tuberculosis H37Rv
ggggaccccgccagcc

SEQ ID NO: 3262357 - RNA, 22 nt, Mycobacterium tuberculosis H37Rv
ggggaccccgccagccggagcg

SEQ ID NO: 3262358 - RNA, 22 nt, Mycobacterium tuberculosis H37Rv
ggggacccgcuccaagcgcggu

SEQ ID NO: 3262359 - RNA, 21 nt, Mycobacterium tuberculosis H37Rv
ggggaccucggcgaucaagcc

SEQ ID NO: 3262360 - RNA, 19 nt, Mycobacterium tuberculosis H37Rv
ggggacgccgcggcgccgg

SEQ ID NO: 3262361 - RNA, 14 nt, Mycobacterium tuberculosis H37Rv
ggggacgggcggcc

SEQ ID NO: 3262362 - RNA, 17 nt, Mycobacterium tuberculosis H37Rv
ggggacgggcggccagg

SEQ ID NO: 3262363 - RNA, 14 nt, Mycobacterium tuberculosis H37Rv
ggggagcggccgcc

SEQ ID NO: 3262364 - RNA, 19 nt, Mycobacterium tuberculosis H37Rv
ggggagcuauucggugucg

SEQ ID NO: 3262365 - RNA, 15 nt, Mycobacterium tuberculosis H37Rv
ggggaguaguggugg

SEQ ID NO: 3262366 - RNA, 20 nt, Mycobacterium tuberculosis H37Rv
ggggaguuccaaaucggugg

SEQ ID NO: 3262367 - RNA, 20 nt, Mycobacterium tuberculosis H37Rv
ggggaguucgcgcagcaccg

SEQ ID NO: 3262368 - RNA, 21 nt, Mycobacterium tuberculosis H37Rv
ggggaguucgcgcagcaccgg

SEQ ID NO: 3262369 - RNA, 12 nt, Mycobacterium tuberculosis H37Rv
ggggaucaccgg

SEQ ID NO: 3262370 - RNA, 14 nt, Mycobacterium tuberculosis H37Rv
ggggaucagcgagu

SEQ ID NO: 3262371 - RNA, 12 nt, Mycobacterium tuberculosis H37Rv
ggggaucagcgu

SEQ ID NO: 3262372 - RNA, 19 nt, Mycobacterium tuberculosis H37Rv
ggggauccagcaggccggg

SEQ ID NO: 3262373 - RNA, 18 nt, Mycobacterium tuberculosis H37Rv
ggggaucgcuggccgcga

SEQ ID NO: 3262374 - RNA, 19 nt, Mycobacterium tuberculosis H37Rv
ggggaucgcuggccgcgag

SEQ ID NO: 3262375 - RNA, 12 nt, Mycobacterium tuberculosis H37Rv
ggggaucggugg

SEQ ID NO: 3262376 - RNA, 17 nt, Mycobacterium tuberculosis H37Rv
ggggaucucgagccgcg

SEQ ID NO: 3262377 - RNA, 21 nt, Mycobacterium tuberculosis H37Rv
ggggaugccgaaccgcugcgg

SEQ ID NO: 3262378 - RNA, 18 nt, Mycobacterium tuberculosis H37Rv
ggggauguuuuuggccgc

SEQ ID NO: 3262379 - RNA, 21 nt, Mycobacterium tuberculosis H37Rv
ggggauuuauugagucggcug

SEQ ID NO: 3262380 - RNA, 19 nt, Mycobacterium tuberculosis H37Rv
ggggauuucgcgucugcuc

SEQ ID NO: 3262381 - RNA, 17 nt, Mycobacterium tuberculosis H37Rv
ggggauuuugcgucugc

SEQ ID NO: 3262382 - RNA, 19 nt, Mycobacterium tuberculosis H37Rv
ggggauuuugcgucugcuc

SEQ ID NO: 3262383 - RNA, 21 nt, Mycobacterium tuberculosis H37Rv
ggggcaacgaucagguuggcg

SEQ ID NO: 3262384 - RNA, 16 nt, Mycobacterium tuberculosis H37Rv
ggggcaauccccugga

SEQ ID NO: 3262385 - RNA, 15 nt, Mycobacterium tuberculosis H37Rv
ggggcaauugccugc

SEQ ID NO: 3262386 - RNA, 17 nt, Mycobacterium tuberculosis H37Rv
ggggcaccacgccagcc

SEQ ID NO: 3262387 - RNA, 20 nt, Mycobacterium tuberculosis H37Rv
ggggcaccacgcugugcucg

SEQ ID NO: 3262388 - RNA, 18 nt, Mycobacterium tuberculosis H37Rv
ggggcaccgagcugagcg

SEQ ID NO: 3262389 - RNA, 18 nt, Mycobacterium tuberculosis H37Rv
ggggcacuuccagcccgg

SEQ ID NO: 3262390 - RNA, 23 nt, Mycobacterium tuberculosis H37Rv
ggggcagcacgucacgcaaccgg

SEQ ID NO: 3262391 - RNA, 12 nt, Mycobacterium tuberculosis H37Rv
ggggcagcgcgg

SEQ ID NO: 3262392 - RNA, 13 nt, Mycobacterium tuberculosis H37Rv
ggggcagcgcggc

SEQ ID NO: 3262393 - RNA, 20 nt, Mycobacterium tuberculosis H37Rv
ggggcagguccgccccguug

SEQ ID NO: 3262394 - RNA, 24 nt, Mycobacterium tuberculosis H37Rv
ggggcccaguuccgcugcggugcc

SEQ ID NO: 3262395 - RNA, 21 nt, Mycobacterium tuberculosis H37Rv
gggguguucgaugggugcacc

SEQ ID NO: 3262396 - RNA, 16 nt, Mycobacterium tuberculosis H37Rv
gggguguucgucgacc

SEQ ID NO: 3262397 - RNA, 18 nt, Mycobacterium tuberculosis H37Rv
gggguguugaggccggug

SEQ ID NO: 3262398 - RNA, 21 nt, Mycobacterium tuberculosis H37Rv
gggguuaggaguggccgggcg

SEQ ID NO: 3262399 - RNA, 15 nt, Mycobacterium tuberculosis H37Rv
gggguugcggcagcu

SEQ ID NO: 3262400 - RNA, 16 nt, Mycobacterium tuberculosis H37Rv
gggguugcggcagcug

SEQ ID NO: 3262401 - RNA, 17 nt, Mycobacterium tuberculosis H37Rv
gggguugcggcagcugg

SEQ ID NO: 3262402 - RNA, 13 nt, Mycobacterium tuberculosis H37Rv
gggguuggcguca

SEQ ID NO: 3262403 - RNA, 17 nt, Mycobacterium tuberculosis H37Rv
gggguuggcucggcgca

SEQ ID NO: 3262404 - RNA, 18 nt, Mycobacterium tuberculosis H37Rv
gggguuguccucggcgau

SEQ ID NO: 3262405 - RNA, 16 nt, Mycobacterium tuberculosis H37Rv
ggguaaaguucuccaa

SEQ ID NO: 3262406 - RNA, 12 nt, Mycobacterium tuberculosis H37Rv
ggguaacguguu

SEQ ID NO: 3262407 - RNA, 16 nt, Mycobacterium tuberculosis H37Rv
ggguacacccgcucgc

SEQ ID NO: 3262408 - RNA, 16 nt, Mycobacterium tuberculosis H37Rv
ggguacccaucugcuc

SEQ ID NO: 3262409 - RNA, 17 nt, Mycobacterium tuberculosis H37Rv
ggguacccgggaaugga

SEQ ID NO: 3262410 - RNA, 11 nt, Mycobacterium tuberculosis H37Rv
ggguaccuccc

SEQ ID NO: 3262411 - RNA, 23 nt, Mycobacterium tuberculosis H37Rv
ggguaccucccgcuugcggggga

SEQ ID NO: 3262412 - RNA, 19 nt, Mycobacterium tuberculosis H37Rv
ggguacgacaccgcagcgg

SEQ ID NO: 3262413 - RNA, 14 nt, Mycobacterium tuberculosis H37Rv
ggguacgccgggca

SEQ ID NO: 3262414 - RNA, 16 nt, Mycobacterium tuberculosis H37Rv
ggguacugcggcucgc

SEQ ID NO: 3262415 - RNA, 15 nt, Mycobacterium tuberculosis H37Rv
ggguagccgcccagc

SEQ ID NO: 3262416 - RNA, 13 nt, Mycobacterium tuberculosis H37Rv
ggguagcggcgcc

SEQ ID NO: 3262417 - RNA, 13 nt, Mycobacterium tuberculosis H37Rv
ggguaggccgccg

SEQ ID NO: 3262418 - RNA, 23 nt, Mycobacterium tuberculosis H37Rv
ggguagggcaucgucgccgagcg

SEQ ID NO: 3262419 - RNA, 16 nt, Mycobacterium tuberculosis H37Rv
ggguagugcccacaac

SEQ ID NO: 3262420 - RNA, 16 nt, Mycobacterium tuberculosis H37Rv
ggguaguugaggccgu

SEQ ID NO: 3262421 - RNA, 20 nt, Mycobacterium tuberculosis H37Rv
ggguaucgacccuccagcac

SEQ ID NO: 3262422 - RNA, 17 nt, Mycobacterium tuberculosis H37Rv
ggguaugcacccaggca

SEQ ID NO: 3262423 - RNA, 20 nt, Mycobacterium tuberculosis H37Rv
ggguauugauugacugcuug

SEQ ID NO: 3262424 - RNA, 21 nt, Mycobacterium tuberculosis H37Rv
gggucaaugcuggcagcggcc

SEQ ID NO: 3262425 - RNA, 15 nt, Mycobacterium tuberculosis H37Rv
gggucacaaaaccug

SEQ ID NO: 3262426 - RNA, 23 nt, Mycobacterium tuberculosis H37Rv
gggucaccagcgcaucggccagc

SEQ ID NO: 3262427 - RNA, 12 nt, Mycobacterium tuberculosis H37Rv
gggucacccccg

SEQ ID NO: 3262428 - RNA, 16 nt, Mycobacterium tuberculosis H37Rv
gggucaccgugcggau

SEQ ID NO: 3262429 - RNA, 21 nt, Mycobacterium tuberculosis H37Rv
gggucaccucgucgccuagcc

SEQ ID NO: 3262430 - RNA, 13 nt, Mycobacterium tuberculosis H37Rv
gggucagcccagc

SEQ ID NO: 3262431 - RNA, 12 nt, Mycobacterium tuberculosis H37Rv
gggucagcucga

SEQ ID NO: 3262432 - RNA, 17 nt, Mycobacterium tuberculosis H37Rv
gggucagcucgccagcc

SEQ ID NO: 3262433 - RNA, 14 nt, Mycobacterium tuberculosis H37Rv
gggucaggccgacg

SEQ ID NO: 3262434 - RNA, 17 nt, Mycobacterium tuberculosis H37Rv
gggucaguaggcggauc

SEQ ID NO: 3262435 - RNA, 14 nt, Mycobacterium tuberculosis H37Rv
gggucaucagccgc

SEQ ID NO: 3262436 - RNA, 18 nt, Mycobacterium tuberculosis H37Rv
gggucaucgccagcggca

SEQ ID NO: 3262437 - RNA, 20 nt, Mycobacterium tuberculosis H37Rv
ggguccaagaaccacgacgu

SEQ ID NO: 3262438 - RNA, 20 nt, Mycobacterium tuberculosis H37Rv
ggguccagcggccgccgcgg

SEQ ID NO: 3262439 - RNA, 15 nt, Mycobacterium tuberculosis H37Rv
ggguccagcgggauc

SEQ ID NO: 3262440 - RNA, 22 nt, Mycobacterium tuberculosis H37Rv
ggguccagcgggaucugaccca

SEQ ID NO: 3262441 - RNA, 16 nt, Mycobacterium tuberculosis H37Rv
ggguccaucggggccg

SEQ ID NO: 3262442 - RNA, 23 nt, Mycobacterium tuberculosis H37Rv
ggguccgaaguacuggccgccgc

SEQ ID NO: 3262443 - RNA, 21 nt, Mycobacterium tuberculosis H37Rv
ggguccgacagccccggcagg

SEQ ID NO: 3262444 - RNA, 19 nt, Mycobacterium tuberculosis H37Rv
ggguccgaugcgugccgac

SEQ ID NO: 3262445 - RNA, 20 nt, Mycobacterium tuberculosis H37Rv
ggguccguuuuaccucggcc

SEQ ID NO: 3262446 - RNA, 16 nt, Mycobacterium tuberculosis H37Rv
ggguccuugcggccgg

SEQ ID NO: 3262447 - RNA, 19 nt, Mycobacterium tuberculosis H37Rv
gggucgaccccggccagga

SEQ ID NO: 3262448 - RNA, 20 nt, Mycobacterium tuberculosis H37Rv
gggucgaccggaaugcccgg

SEQ ID NO: 3262449 - RNA, 22 nt, Mycobacterium tuberculosis H37Rv
gggucgacguaggacugccagc

SEQ ID NO: 3262450 - RNA, 19 nt, Mycobacterium tuberculosis H37Rv
gggucgacguuaccgaccg

SEQ ID NO: 3262451 - RNA, 16 nt, Mycobacterium tuberculosis H37Rv
gggucgaucaccgaca

SEQ ID NO: 3262452 - RNA, 14 nt, Mycobacterium tuberculosis H37Rv
gggucgauuucgcc

SEQ ID NO: 3262453 - RNA, 23 nt, Mycobacterium tuberculosis H37Rv
gggucgcaauauccggccgagcc

SEQ ID NO: 3262454 - RNA, 18 nt, Mycobacterium tuberculosis H37Rv
gggucgccgccaucagcc

SEQ ID NO: 3262455 - RNA, 22 nt, Mycobacterium tuberculosis H37Rv
gggucgccgccaucagcccuuc

SEQ ID NO: 3262456 - RNA, 14 nt, Mycobacterium tuberculosis H37Rv
gggucgccggcacc

SEQ ID NO: 3262457 - RNA, 22 nt, Mycobacterium tuberculosis H37Rv
gggucgcgagcccgccacagcc

SEQ ID NO: 3262458 - RNA, 17 nt, Mycobacterium tuberculosis H37Rv
gggucgcgcugccaguu

SEQ ID NO: 3262459 - RNA, 18 nt, Mycobacterium tuberculosis H37Rv
gggucggcacgacccggg

SEQ ID NO: 3262460 - RNA, 23 nt, Mycobacterium tuberculosis H37Rv
gggucggccggguugcccuggug

SEQ ID NO: 3262461 - RNA, 12 nt, Mycobacterium tuberculosis H37Rv
gggucggcgaug

SEQ ID NO: 3262462 - RNA, 22 nt, Mycobacterium tuberculosis H37Rv
gggucgggcaaccugccgggcc

SEQ ID NO: 3262463 - RNA, 13 nt, Mycobacterium tuberculosis H37Rv
gggucgggcaccg

SEQ ID NO: 3262464 - RNA, 15 nt, Mycobacterium tuberculosis H37Rv
gggucggggcggcau

SEQ ID NO: 3262465 - RNA, 14 nt, Mycobacterium tuberculosis H37Rv
gggucgggucccag

SEQ ID NO: 3262466 - RNA, 21 nt, Mycobacterium tuberculosis H37Rv
gggucgguuuccuccggcagc

SEQ ID NO: 3262467 - RNA, 18 nt, Mycobacterium tuberculosis H37Rv
gggucgucauacagcgcc

SEQ ID NO: 3262468 - RNA, 20 nt, Mycobacterium tuberculosis H37Rv
gggucgucauacagcgcccu

SEQ ID NO: 3262469 - RNA, 17 nt, Mycobacterium tuberculosis H37Rv
gggucgucaugccaguc

SEQ ID NO: 3262470 - RNA, 18 nt, Mycobacterium tuberculosis H37Rv
gggucgucauugcccuug

SEQ ID NO: 3262471 - RNA, 22 nt, Mycobacterium tuberculosis H37Rv
gggucgucguugggauccggug

SEQ ID NO: 3262472 - RNA, 14 nt, Mycobacterium tuberculosis H37Rv
gggucgugccagca

SEQ ID NO: 3262473 - RNA, 14 nt, Mycobacterium tuberculosis H37Rv
gggucguucgccga

SEQ ID NO: 3262474 - RNA, 16 nt, Mycobacterium tuberculosis H37Rv
gggucguuggcggcgg

SEQ ID NO: 3262475 - RNA, 21 nt, Mycobacterium tuberculosis H37Rv
gggucugacaucggccaaggu

SEQ ID NO: 3262476 - RNA, 16 nt, Mycobacterium tuberculosis H37Rv
gggucugcgccgccgg

SEQ ID NO: 3262477 - RNA, 16 nt, Mycobacterium tuberculosis H37Rv
gggucuggcaggccag

SEQ ID NO: 3262478 - RNA, 18 nt, Mycobacterium tuberculosis H37Rv
gggucuggcaggccagca

SEQ ID NO: 3262479 - RNA, 20 nt, Mycobacterium tuberculosis H37Rv
gggucuugacggcgccaggc

SEQ ID NO: 3262480 - RNA, 21 nt, Mycobacterium tuberculosis H37Rv
gggugaagacaccggcgucga

SEQ ID NO: 3262481 - RNA, 22 nt, Mycobacterium tuberculosis H37Rv
gggugaagagaagucucgcggc

SEQ ID NO: 3262482 - RNA, 21 nt, Mycobacterium tuberculosis H37Rv
gggugacaucgcgaggcguca

SEQ ID NO: 3262483 - RNA, 19 nt, Mycobacterium tuberculosis H37Rv
gggugaccaacaccccccc

SEQ ID NO: 3262484 - RNA, 18 nt, Mycobacterium tuberculosis H37Rv
gggugaccaggccgagcu

SEQ ID NO: 3262485 - RNA, 17 nt, Mycobacterium tuberculosis H37Rv
gggugaccaggcggcgc

SEQ ID NO: 3262486 - RNA, 15 nt, Mycobacterium tuberculosis H37Rv
gggugacgggaaacu

SEQ ID NO: 3262487 - RNA, 12 nt, Mycobacterium tuberculosis H37Rv
gggugacugcgg

SEQ ID NO: 3262488 - RNA, 20 nt, Mycobacterium tuberculosis H37Rv
gggugagcacccagcggcgu

SEQ ID NO: 3262489 - RNA, 19 nt, Mycobacterium tuberculosis H37Rv
gggugagcauggcuagggc

SEQ ID NO: 3262490 - RNA, 17 nt, Mycobacterium tuberculosis H37Rv
gggugagcgaccugggu

SEQ ID NO: 3262491 - RNA, 22 nt, Mycobacterium tuberculosis H37Rv
gguacugcgaugugcgugaaca

SEQ ID NO: 3262492 - RNA, 14 nt, Mycobacterium tuberculosis H37Rv
gguacugcgcagcg

SEQ ID NO: 3262493 - RNA, 21 nt, Mycobacterium tuberculosis H37Rv
gguagaacuccucgcugucga

SEQ ID NO: 3262494 - RNA, 15 nt, Mycobacterium tuberculosis H37Rv
gguagacauggguga

SEQ ID NO: 3262495 - RNA, 17 nt, Mycobacterium tuberculosis H37Rv
gguagaucagcgccugg

SEQ ID NO: 3262496 - RNA, 23 nt, Mycobacterium tuberculosis H37Rv
gguagcaccgauuuuggcaagcu

SEQ ID NO: 3262497 - RNA, 17 nt, Mycobacterium tuberculosis H37Rv
gguagcacugucgaggu

SEQ ID NO: 3262498 - RNA, 16 nt, Mycobacterium tuberculosis H37Rv
gguagccauccgugaa

SEQ ID NO: 3262499 - RNA, 16 nt, Mycobacterium tuberculosis H37Rv
gguagccaucggugcg

SEQ ID NO: 3262500 - RNA, 18 nt, Mycobacterium tuberculosis H37Rv
gguagccauucggugugg

SEQ ID NO: 3262501 - RNA, 14 nt, Mycobacterium tuberculosis H37Rv
gguagccgaccagc

SEQ ID NO: 3262502 - RNA, 13 nt, Mycobacterium tuberculosis H37Rv
gguagccgcggcc

SEQ ID NO: 3262503 - RNA, 13 nt, Mycobacterium tuberculosis H37Rv
gguagccggcgac

SEQ ID NO: 3262504 - RNA, 12 nt, Mycobacterium tuberculosis H37Rv
gguagccggcgu

SEQ ID NO: 3262505 - RNA, 15 nt, Mycobacterium tuberculosis H37Rv
gguagccugaccagc

SEQ ID NO: 3262506 - RNA, 21 nt, Mycobacterium tuberculosis H37Rv
gguagcgcggguggcucgggu

SEQ ID NO: 3262507 - RNA, 20 nt, Mycobacterium tuberculosis H37Rv
gguagcggaccugcgagauc

SEQ ID NO: 3262508 - RNA, 18 nt, Mycobacterium tuberculosis H37Rv
gguagcggaucgcgguca

SEQ ID NO: 3262509 - RNA, 12 nt, Mycobacterium tuberculosis H37Rv
gguagcggcggc

SEQ ID NO: 3262510 - RNA, 18 nt, Mycobacterium tuberculosis H37Rv
gguagcgguucaucaccg

SEQ ID NO: 3262511 - RNA, 17 nt, Mycobacterium tuberculosis H37Rv
gguagcucauugccgau

SEQ ID NO: 3262512 - RNA, 18 nt, Mycobacterium tuberculosis H37Rv
gguagcugcccagcguca

SEQ ID NO: 3262513 - RNA, 17 nt, Mycobacterium tuberculosis H37Rv
gguaggccaucugcucg

SEQ ID NO: 3262514 - RNA, 14 nt, Mycobacterium tuberculosis H37Rv
gguaggccggugcg

SEQ ID NO: 3262515 - RNA, 14 nt, Mycobacterium tuberculosis H37Rv
gguaggcggccagc

SEQ ID NO: 3262516 - RNA, 14 nt, Mycobacterium tuberculosis H37Rv
gguagucgacgauc

SEQ ID NO: 3262517 - RNA, 16 nt, Mycobacterium tuberculosis H37Rv
gguagucggccuccuc

SEQ ID NO: 3262518 - RNA, 21 nt, Mycobacterium tuberculosis H37Rv
gguagucgggcaaggcggcgg

SEQ ID NO: 3262519 - RNA, 16 nt, Mycobacterium tuberculosis H37Rv
gguagucguugccgau

SEQ ID NO: 3262520 - RNA, 13 nt, Mycobacterium tuberculosis H37Rv
gguaguggggugc

SEQ ID NO: 3262521 - RNA, 15 nt, Mycobacterium tuberculosis H37Rv
gguaguggggugcgg

SEQ ID NO: 3262522 - RNA, 23 nt, Mycobacterium tuberculosis H37Rv
gguaguggggugcgggucggcgc

SEQ ID NO: 3262523 - RNA, 14 nt, Mycobacterium tuberculosis H37Rv
gguaguugaggccg

SEQ ID NO: 3262524 - RNA, 15 nt, Mycobacterium tuberculosis H37Rv
gguaguugcucggcu

SEQ ID NO: 3262525 - RNA, 17 nt, Mycobacterium tuberculosis H37Rv
gguaguugucccgccgc

SEQ ID NO: 3262526 - RNA, 17 nt, Mycobacterium tuberculosis H37Rv
gguauccacgccgggca

SEQ ID NO: 3262527 - RNA, 21 nt, Mycobacterium tuberculosis H37Rv
gguaucccggucuacgacguc

SEQ ID NO: 3262528 - RNA, 19 nt, Mycobacterium tuberculosis H37Rv
gguaucgagaugccaucgg

SEQ ID NO: 3262529 - RNA, 16 nt, Mycobacterium tuberculosis H37Rv
gguaucgagggcagcc

SEQ ID NO: 3262530 - RNA, 18 nt, Mycobacterium tuberculosis H37Rv
gguaucgagggcagccgc

SEQ ID NO: 3262531 - RNA, 17 nt, Mycobacterium tuberculosis H37Rv
gguaucggcagaugguc

SEQ ID NO: 3262532 - RNA, 17 nt, Mycobacterium tuberculosis H37Rv
gguaucggcgaccagcu

SEQ ID NO: 3262533 - RNA, 15 nt, Mycobacterium tuberculosis H37Rv
gguaucggcgugcug

SEQ ID NO: 3262534 - RNA, 16 nt, Mycobacterium tuberculosis H37Rv
gguaucgucauugcga

SEQ ID NO: 3262535 - RNA, 14 nt, Mycobacterium tuberculosis H37Rv
gguaugccgcccgc

SEQ ID NO: 3262536 - RNA, 16 nt, Mycobacterium tuberculosis H37Rv
ggucaaacgcgcgcgc

SEQ ID NO: 3262537 - RNA, 21 nt, Mycobacterium tuberculosis H37Rv
ggucaaccccggaccgcggcc

SEQ ID NO: 3262538 - RNA, 21 nt, Mycobacterium tuberculosis H37Rv
ggucaacgacguugaucccca

SEQ ID NO: 3262539 - RNA, 19 nt, Mycobacterium tuberculosis H37Rv
ggucaacgaguugcggaua

SEQ ID NO: 3262540 - RNA, 22 nt, Mycobacterium tuberculosis H37Rv
ggucaacgcuagcgucgugucg

SEQ ID NO: 3262541 - RNA, 13 nt, Mycobacterium tuberculosis H37Rv
ggucaacgcugac

SEQ ID NO: 3262542 - RNA, 14 nt, Mycobacterium tuberculosis H37Rv
ggucaacggcagau

SEQ ID NO: 3262543 - RNA, 21 nt, Mycobacterium tuberculosis H37Rv
ggucaacggcagaucccacgc

SEQ ID NO: 3262544 - RNA, 21 nt, Mycobacterium tuberculosis H37Rv
ggucaacgggaugccggcgaa

SEQ ID NO: 3262545 - RNA, 14 nt, Mycobacterium tuberculosis H37Rv
ggucaacgugaacu

SEQ ID NO: 3262546 - RNA, 21 nt, Mycobacterium tuberculosis H37Rv
ggucaacgugaugcguucggc

SEQ ID NO: 3262547 - RNA, 18 nt, Mycobacterium tuberculosis H37Rv
ggucaagacccgcaucca

SEQ ID NO: 3262548 - RNA, 15 nt, Mycobacterium tuberculosis H37Rv
ggucaagccggcgcc

SEQ ID NO: 3262549 - RNA, 14 nt, Mycobacterium tuberculosis H37Rv
ggucaaggucgucg

SEQ ID NO: 3262550 - RNA, 19 nt, Mycobacterium tuberculosis H37Rv
ggucaagucccucggcggc

SEQ ID NO: 3262551 - RNA, 22 nt, Mycobacterium tuberculosis H37Rv
ggucaaucggguuugucgucgu

SEQ ID NO: 3262552 - RNA, 14 nt, Mycobacterium tuberculosis H37Rv
ggucacaaacggca

SEQ ID NO: 3262553 - RNA, 17 nt, Mycobacterium tuberculosis H37Rv
ggucacacgccagccgg

SEQ ID NO: 3262554 - RNA, 20 nt, Mycobacterium tuberculosis H37Rv
ggucacacucccauccgccu

SEQ ID NO: 3262555 - RNA, 21 nt, Mycobacterium tuberculosis H37Rv
ggucaccagcuggaacggcag

SEQ ID NO: 3262556 - RNA, 21 nt, Mycobacterium tuberculosis H37Rv
ggucaccaggccgaaauccag

SEQ ID NO: 3262557 - RNA, 20 nt, Mycobacterium tuberculosis H37Rv
ggucaccauggcgccgcgcc

SEQ ID NO: 3262558 - RNA, 21 nt, Mycobacterium tuberculosis H37Rv
ggucaccccuucgccagcgcc

SEQ ID NO: 3262559 - RNA, 17 nt, Mycobacterium tuberculosis H37Rv
ggucacccgguagacgu

SEQ ID NO: 3262560 - RNA, 17 nt, Mycobacterium tuberculosis H37Rv
ggucaccggccgccgac

SEQ ID NO: 3262561 - RNA, 20 nt, Mycobacterium tuberculosis H37Rv
ggucaccggcgcaccggagu

SEQ ID NO: 3262562 - RNA, 20 nt, Mycobacterium tuberculosis H37Rv
ggucaccggcuucuccucca

SEQ ID NO: 3262563 - RNA, 12 nt, Mycobacterium tuberculosis H37Rv
ggucaccgucga

SEQ ID NO: 3262564 - RNA, 17 nt, Mycobacterium tuberculosis H37Rv
ggucaccucgucgccua

SEQ ID NO: 3262565 - RNA, 13 nt, Mycobacterium tuberculosis H37Rv
ggucaccugcugc

SEQ ID NO: 3262566 - RNA, 14 nt, Mycobacterium tuberculosis H37Rv
ggucacgcagcacc

SEQ ID NO: 3262567 - RNA, 14 nt, Mycobacterium tuberculosis H37Rv
ggucacgcagucgg

SEQ ID NO: 3262568 - RNA, 17 nt, Mycobacterium tuberculosis H37Rv
ggucacgcagucgggca

SEQ ID NO: 3262569 - RNA, 22 nt, Mycobacterium tuberculosis H37Rv
ggucacgcagucgggcagcgcu

SEQ ID NO: 3262570 - RNA, 20 nt, Mycobacterium tuberculosis H37Rv
ggucacgccgucaccgcuga

SEQ ID NO: 3262571 - RNA, 23 nt, Mycobacterium tuberculosis H37Rv
ggucacgccgugugugcggcggu

SEQ ID NO: 3262572 - RNA, 14 nt, Mycobacterium tuberculosis H37Rv
ggucacguccgcgg

SEQ ID NO: 3262573 - RNA, 18 nt, Mycobacterium tuberculosis H37Rv
ggucacgugggccaugcu

SEQ ID NO: 3262574 - RNA, 20 nt, Mycobacterium tuberculosis H37Rv
ggucagacgccggccgccga

SEQ ID NO: 3262575 - RNA, 20 nt, Mycobacterium tuberculosis H37Rv
ggucagauguuguacggccc

SEQ ID NO: 3262576 - RNA, 14 nt, Mycobacterium tuberculosis H37Rv
ggucagcaccacca

SEQ ID NO: 3262577 - RNA, 17 nt, Mycobacterium tuberculosis H37Rv
ggucagcaccaccagca

SEQ ID NO: 3262578 - RNA, 15 nt, Mycobacterium tuberculosis H37Rv
ggucagcacgcugac

SEQ ID NO: 3262579 - RNA, 11 nt, Mycobacterium tuberculosis H37Rv
ggucagcagcg

SEQ ID NO: 3262580 - RNA, 21 nt, Mycobacterium tuberculosis H37Rv
ggucagccgcgcgggucacga

SEQ ID NO: 3262581 - RNA, 12 nt, Mycobacterium tuberculosis H37Rv
ggucagccgcgg

SEQ ID NO: 3262582 - RNA, 16 nt, Mycobacterium tuberculosis H37Rv
ggucagccgcggcggc

SEQ ID NO: 3262583 - RNA, 15 nt, Mycobacterium tuberculosis H37Rv
ggucagccgugccgu

SEQ ID NO: 3262584 - RNA, 15 nt, Mycobacterium tuberculosis H37Rv
ggucagccuuuccac

SEQ ID NO: 3262585 - RNA, 14 nt, Mycobacterium tuberculosis H37Rv
ggucagcgaccuca

SEQ ID NO: 3262586 - RNA, 11 nt, Mycobacterium tuberculosis H37Rv
ggucagcgacu

SEQ ID NO: 3262587 - RNA, 21 nt, Mycobacterium tuberculosis H37Rv
ggucagcgaguuucugcucga

SEQ ID NO: 3262588 - RNA, 18 nt, Mycobacterium tuberculosis H37Rv
gguccugcggucgcggag

SEQ ID NO: 3262589 - RNA, 16 nt, Mycobacterium tuberculosis H37Rv
gguccugcucgcacag

SEQ ID NO: 3262590 - RNA, 22 nt, Mycobacterium tuberculosis H37Rv
gguccuucuccagauccacgcc

SEQ ID NO: 3262591 - RNA, 12 nt, Mycobacterium tuberculosis H37Rv
gguccuugccgu

SEQ ID NO: 3262592 - RNA, 19 nt, Mycobacterium tuberculosis H37Rv
gguccuugucggccccggc

SEQ ID NO: 3262593 - RNA, 20 nt, Mycobacterium tuberculosis H37Rv
gguccuugucggccccggcc

SEQ ID NO: 3262594 - RNA, 18 nt, Mycobacterium tuberculosis H37Rv
ggucgaacagcucgaaca

SEQ ID NO: 3262595 - RNA, 18 nt, Mycobacterium tuberculosis H37Rv
ggucgaacaucaucgggu

SEQ ID NO: 3262596 - RNA, 21 nt, Mycobacterium tuberculosis H37Rv
ggucgaacucgccccgcgugu

SEQ ID NO: 3262597 - RNA, 23 nt, Mycobacterium tuberculosis H37Rv
ggucgaagagguggggcaggauc

SEQ ID NO: 3262598 - RNA, 23 nt, Mycobacterium tuberculosis H37Rv
ggucgaauaguugaccaggccga

SEQ ID NO: 3262599 - RNA, 21 nt, Mycobacterium tuberculosis H37Rv
ggucgaaucgcugccgccgau

SEQ ID NO: 3262600 - RNA, 21 nt, Mycobacterium tuberculosis H37Rv
ggucgaaugggggcuggucgc

SEQ ID NO: 3262601 - RNA, 12 nt, Mycobacterium tuberculosis H37Rv
ggucgacaccgc

SEQ ID NO: 3262602 - RNA, 13 nt, Mycobacterium tuberculosis H37Rv
ggucgacaccgcg

SEQ ID NO: 3262603 - RNA, 20 nt, Mycobacterium tuberculosis H37Rv
ggucgacaugggucggcugu

SEQ ID NO: 3262604 - RNA, 19 nt, Mycobacterium tuberculosis H37Rv
ggucgacgaacaccccggg

SEQ ID NO: 3262605 - RNA, 20 nt, Mycobacterium tuberculosis H37Rv
ggucgacgagauccagcgcc

SEQ ID NO: 3262606 - RNA, 11 nt, Mycobacterium tuberculosis H37Rv
ggucgacgauc

SEQ ID NO: 3262607 - RNA, 20 nt, Mycobacterium tuberculosis H37Rv
ggucgacgaucucuccugga

SEQ ID NO: 3262608 - RNA, 22 nt, Mycobacterium tuberculosis H37Rv
ggucgacgccgaccacccggau

SEQ ID NO: 3262609 - RNA, 13 nt, Mycobacterium tuberculosis H37Rv
ggucgacgccgag

SEQ ID NO: 3262610 - RNA, 15 nt, Mycobacterium tuberculosis H37Rv
ggucgacgggcucgu

SEQ ID NO: 3262611 - RNA, 16 nt, Mycobacterium tuberculosis H37Rv
ggucgacgggucggcg

SEQ ID NO: 3262612 - RNA, 18 nt, Mycobacterium tuberculosis H37Rv
ggucgacgggucggcgcc

SEQ ID NO: 3262613 - RNA, 20 nt, Mycobacterium tuberculosis H37Rv
ggucgacgggucggcgccga

SEQ ID NO: 3262614 - RNA, 15 nt, Mycobacterium tuberculosis H37Rv
ggucgacgucggugu

SEQ ID NO: 3262615 - RNA, 18 nt, Mycobacterium tuberculosis H37Rv
ggucgacuccagcaccag

SEQ ID NO: 3262616 - RNA, 20 nt, Mycobacterium tuberculosis H37Rv
ggucgacuccagcaccagca

SEQ ID NO: 3262617 - RNA, 23 nt, Mycobacterium tuberculosis H37Rv
ggucgacuccagcaccagcacgg

SEQ ID NO: 3262618 - RNA, 18 nt, Mycobacterium tuberculosis H37Rv
ggucgacugggacgacgc

SEQ ID NO: 3262619 - RNA, 23 nt, Mycobacterium tuberculosis H37Rv
ggucgagcacgcugcugcgggug

SEQ ID NO: 3262620 - RNA, 21 nt, Mycobacterium tuberculosis H37Rv
ggucgagcagugccucggcga

SEQ ID NO: 3262621 - RNA, 13 nt, Mycobacterium tuberculosis H37Rv
ggucgagcgccuu

SEQ ID NO: 3262622 - RNA, 14 nt, Mycobacterium tuberculosis H37Rv
ggucgagcggucgc

SEQ ID NO: 3262623 - RNA, 18 nt, Mycobacterium tuberculosis H37Rv
ggucgagguggcgggcga

SEQ ID NO: 3262624 - RNA, 19 nt, Mycobacterium tuberculosis H37Rv
ggucgagguggcgggcgau

SEQ ID NO: 3262625 - RNA, 16 nt, Mycobacterium tuberculosis H37Rv
ggucgagguggggugg

SEQ ID NO: 3262626 - RNA, 13 nt, Mycobacterium tuberculosis H37Rv
ggucgaucaccga

SEQ ID NO: 3262627 - RNA, 15 nt, Mycobacterium tuberculosis H37Rv
ggucgaucagcggcg

SEQ ID NO: 3262628 - RNA, 23 nt, Mycobacterium tuberculosis H37Rv
ggucgaucaugacgagccgagcc

SEQ ID NO: 3262629 - RNA, 13 nt, Mycobacterium tuberculosis H37Rv
ggucgaugccgau

SEQ ID NO: 3262630 - RNA, 12 nt, Mycobacterium tuberculosis H37Rv
ggucgaugcugc

SEQ ID NO: 3262631 - RNA, 20 nt, Mycobacterium tuberculosis H37Rv
ggucgauggcguacagcacc

SEQ ID NO: 3262632 - RNA, 15 nt, Mycobacterium tuberculosis H37Rv
ggucgauguccgcag

SEQ ID NO: 3262633 - RNA, 15 nt, Mycobacterium tuberculosis H37Rv
ggucgaugucggcga

SEQ ID NO: 3262634 - RNA, 20 nt, Mycobacterium tuberculosis H37Rv
ggucgcaccacagugccaau

SEQ ID NO: 3262635 - RNA, 16 nt, Mycobacterium tuberculosis H37Rv
ggucgcaccgccggcc

SEQ ID NO: 3262636 - RNA, 15 nt, Mycobacterium tuberculosis H37Rv
ggucgccaacccgau

SEQ ID NO: 3262637 - RNA, 18 nt, Mycobacterium tuberculosis H37Rv
ggucgccaacgccagcac

SEQ ID NO: 3262638 - RNA, 21 nt, Mycobacterium tuberculosis H37Rv
ggucgccaacgccagcaccag

SEQ ID NO: 3262639 - RNA, 22 nt, Mycobacterium tuberculosis H37Rv
ggucgccaacgccagcaccagc

SEQ ID NO: 3262640 - RNA, 23 nt, Mycobacterium tuberculosis H37Rv
ggucgccaacgccagcaccagcg

SEQ ID NO: 3262641 - RNA, 13 nt, Mycobacterium tuberculosis H37Rv
ggucgccaagauc

SEQ ID NO: 3262642 - RNA, 18 nt, Mycobacterium tuberculosis H37Rv
ggucgccaccuucgacga

SEQ ID NO: 3262643 - RNA, 12 nt, Mycobacterium tuberculosis H37Rv
ggucgcccaggc

SEQ ID NO: 3262644 - RNA, 14 nt, Mycobacterium tuberculosis H37Rv
ggucgcccgugucg

SEQ ID NO: 3262645 - RNA, 21 nt, Mycobacterium tuberculosis H37Rv
ggucgcccgugucguaccagc

SEQ ID NO: 3262646 - RNA, 17 nt, Mycobacterium tuberculosis H37Rv
ggucgccgaccacucga

SEQ ID NO: 3262647 - RNA, 21 nt, Mycobacterium tuberculosis H37Rv
ggucgccgcauugcagaaccg

SEQ ID NO: 3262648 - RNA, 17 nt, Mycobacterium tuberculosis H37Rv
ggucgccgccgccacgg

SEQ ID NO: 3262649 - RNA, 18 nt, Mycobacterium tuberculosis H37Rv
ggucgccggaccagagcc

SEQ ID NO: 3262650 - RNA, 12 nt, Mycobacterium tuberculosis H37Rv
ggucgccggcgu

SEQ ID NO: 3262651 - RNA, 13 nt, Mycobacterium tuberculosis H37Rv
ggucgccggcguc

SEQ ID NO: 3262652 - RNA, 13 nt, Mycobacterium tuberculosis H37Rv
ggucgccggggcc

SEQ ID NO: 3262653 - RNA, 14 nt, Mycobacterium tuberculosis H37Rv
ggucgccgguggcc

SEQ ID NO: 3262654 - RNA, 16 nt, Mycobacterium tuberculosis H37Rv
ggucgccucaccggcg

SEQ ID NO: 3262655 - RNA, 13 nt, Mycobacterium tuberculosis H37Rv
ggucgccuccucg

SEQ ID NO: 3262656 - RNA, 17 nt, Mycobacterium tuberculosis H37Rv
ggucgccuccucgugca

SEQ ID NO: 3262657 - RNA, 18 nt, Mycobacterium tuberculosis H37Rv
ggucgccuccucgugcag

SEQ ID NO: 3262658 - RNA, 19 nt, Mycobacterium tuberculosis H37Rv
ggucgccuggaagaucacg

SEQ ID NO: 3262659 - RNA, 15 nt, Mycobacterium tuberculosis H37Rv
ggucgcgcgacggcc

SEQ ID NO: 3262660 - RNA, 15 nt, Mycobacterium tuberculosis H37Rv
ggucgcgcgauggac

SEQ ID NO: 3262661 - RNA, 14 nt, Mycobacterium tuberculosis H37Rv
ggucgcgcggcacc

SEQ ID NO: 3262662 - RNA, 14 nt, Mycobacterium tuberculosis H37Rv
ggucgcgcucgcga

SEQ ID NO: 3262663 - RNA, 13 nt, Mycobacterium tuberculosis H37Rv
ggucgcggcgguc

SEQ ID NO: 3262664 - RNA, 22 nt, Mycobacterium tuberculosis H37Rv
ggucgcggucccacggccggcc

SEQ ID NO: 3262665 - RNA, 17 nt, Mycobacterium tuberculosis H37Rv
ggucgcguccacccacg

SEQ ID NO: 3262666 - RNA, 13 nt, Mycobacterium tuberculosis H37Rv
ggucgcucgacga

SEQ ID NO: 3262667 - RNA, 22 nt, Mycobacterium tuberculosis H37Rv
ggucgcucgacgaccacggugu

SEQ ID NO: 3262668 - RNA, 21 nt, Mycobacterium tuberculosis H37Rv
ggucgcugauccgggcgccga

SEQ ID NO: 3262669 - RNA, 18 nt, Mycobacterium tuberculosis H37Rv
ggucgcugcccgcggugu

SEQ ID NO: 3262670 - RNA, 22 nt, Mycobacterium tuberculosis H37Rv
ggucgcugcccgcggugugcac

SEQ ID NO: 3262671 - RNA, 23 nt, Mycobacterium tuberculosis H37Rv
ggucgcugcgaugcugaucaccg

SEQ ID NO: 3262672 - RNA, 15 nt, Mycobacterium tuberculosis H37Rv
ggucgcugcugccgc

SEQ ID NO: 3262673 - RNA, 16 nt, Mycobacterium tuberculosis H37Rv
ggucgcugcugccgca

SEQ ID NO: 3262674 - RNA, 16 nt, Mycobacterium tuberculosis H37Rv
ggucgcugcugcgauc

SEQ ID NO: 3262675 - RNA, 12 nt, Mycobacterium tuberculosis H37Rv
ggucgcugucca

SEQ ID NO: 3262676 - RNA, 15 nt, Mycobacterium tuberculosis H37Rv
ggucgcuucagcgcc

SEQ ID NO: 3262677 - RNA, 16 nt, Mycobacterium tuberculosis H37Rv
ggucgcuucagcgcca

SEQ ID NO: 3262678 - RNA, 16 nt, Mycobacterium tuberculosis H37Rv
ggucggaacuagccag

SEQ ID NO: 3262679 - RNA, 17 nt, Mycobacterium tuberculosis H37Rv
ggucggaaugccgucgc

SEQ ID NO: 3262680 - RNA, 15 nt, Mycobacterium tuberculosis H37Rv
ggucggacagcgucu

SEQ ID NO: 3262681 - RNA, 23 nt, Mycobacterium tuberculosis H37Rv
ggucggacagcgucucggaggcg

SEQ ID NO: 3262682 - RNA, 22 nt, Mycobacterium tuberculosis H37Rv
ggucggacggccaucgccagcc

SEQ ID NO: 3262683 - RNA, 19 nt, Mycobacterium tuberculosis H37Rv
ggucggagacgucuucggg

SEQ ID NO: 3262684 - RNA, 18 nt, Mycobacterium tuberculosis H37Rv
ggugaacgcggacaccgc

SEQ ID NO: 3262685 - RNA, 15 nt, Mycobacterium tuberculosis H37Rv
ggugaacgguagcac

SEQ ID NO: 3262686 - RNA, 22 nt, Mycobacterium tuberculosis H37Rv
ggugaacgucacguggucggcc

SEQ ID NO: 3262687 - RNA, 17 nt, Mycobacterium tuberculosis H37Rv
ggugaacugguugacgu

SEQ ID NO: 3262688 - RNA, 17 nt, Mycobacterium tuberculosis H37Rv
ggugaauaaggcugcag

SEQ ID NO: 3262689 - RNA, 16 nt, Mycobacterium tuberculosis H37Rv
ggugaaucgacaccgc

SEQ ID NO: 3262690 - RNA, 19 nt, Mycobacterium tuberculosis H37Rv
ggugaaucgucugacgaaa

SEQ ID NO: 3262691 - RNA, 22 nt, Mycobacterium tuberculosis H37Rv
ggugacaaguggugcccuugaa

SEQ ID NO: 3262692 - RNA, 13 nt, Mycobacterium tuberculosis H37Rv
ggugacacgacgu

SEQ ID NO: 3262693 - RNA, 22 nt, Mycobacterium tuberculosis H37Rv
ggugacagagcggguucgacgu

SEQ ID NO: 3262694 - RNA, 13 nt, Mycobacterium tuberculosis H37Rv
ggugacaucgcga

SEQ ID NO: 3262695 - RNA, 16 nt, Mycobacterium tuberculosis H37Rv
ggugacaucgcgaggc

SEQ ID NO: 3262696 - RNA, 12 nt, Mycobacterium tuberculosis H37Rv
ggugaccaacac

SEQ ID NO: 3262697 - RNA, 21 nt, Mycobacterium tuberculosis H37Rv
ggugaccacgccguggcccgc

SEQ ID NO: 3262698 - RNA, 16 nt, Mycobacterium tuberculosis H37Rv
ggugaccagcaggccg

SEQ ID NO: 3262699 - RNA, 17 nt, Mycobacterium tuberculosis H37Rv
ggugaccagcaggccgg

SEQ ID NO: 3262700 - RNA, 17 nt, Mycobacterium tuberculosis H37Rv
ggugaccaggaucgaca

SEQ ID NO: 3262701 - RNA, 17 nt, Mycobacterium tuberculosis H37Rv
ggugaccaggccgagcu

SEQ ID NO: 3262702 - RNA, 18 nt, Mycobacterium tuberculosis H37Rv
ggugaccagggugacgga

SEQ ID NO: 3262703 - RNA, 17 nt, Mycobacterium tuberculosis H37Rv
ggugacccccgagaucc

SEQ ID NO: 3262704 - RNA, 14 nt, Mycobacterium tuberculosis H37Rv
ggugaccgagaucg

SEQ ID NO: 3262705 - RNA, 18 nt, Mycobacterium tuberculosis H37Rv
ggugaccgagaucgucgc

SEQ ID NO: 3262706 - RNA, 14 nt, Mycobacterium tuberculosis H37Rv
ggugaccgcgggcg

SEQ ID NO: 3262707 - RNA, 20 nt, Mycobacterium tuberculosis H37Rv
ggugaccgugaacggcucgg

SEQ ID NO: 3262708 - RNA, 14 nt, Mycobacterium tuberculosis H37Rv
ggugaccguucggc

SEQ ID NO: 3262709 - RNA, 21 nt, Mycobacterium tuberculosis H37Rv
ggugaccucgucgaccgggaa

SEQ ID NO: 3262710 - RNA, 23 nt, Mycobacterium tuberculosis H37Rv
ggugaccucgugguucugcaggu

SEQ ID NO: 3262711 - RNA, 22 nt, Mycobacterium tuberculosis H37Rv
ggugaccuucgcuauggcggcu

SEQ ID NO: 3262712 - RNA, 22 nt, Mycobacterium tuberculosis H37Rv
ggugacgaagagcaccgcgccc

SEQ ID NO: 3262713 - RNA, 19 nt, Mycobacterium tuberculosis H37Rv
ggugacgacaugguuggug

SEQ ID NO: 3262714 - RNA, 17 nt, Mycobacterium tuberculosis H37Rv
ggugacgacgucgccgc

SEQ ID NO: 3262715 - RNA, 23 nt, Mycobacterium tuberculosis H37Rv
ggugacgagcacaugcucgacgc

SEQ ID NO: 3262716 - RNA, 13 nt, Mycobacterium tuberculosis H37Rv
ggugacgaucagg

SEQ ID NO: 3262717 - RNA, 17 nt, Mycobacterium tuberculosis H37Rv
ggugacgaucgacagcc

SEQ ID NO: 3262718 - RNA, 16 nt, Mycobacterium tuberculosis H37Rv
ggugacgauugccacc

SEQ ID NO: 3262719 - RNA, 13 nt, Mycobacterium tuberculosis H37Rv
ggugacgccagcc

SEQ ID NO: 3262720 - RNA, 17 nt, Mycobacterium tuberculosis H37Rv
ggugacgccgccagcac

SEQ ID NO: 3262721 - RNA, 15 nt, Mycobacterium tuberculosis H37Rv
ggugacggcggcugu

SEQ ID NO: 3262722 - RNA, 22 nt, Mycobacterium tuberculosis H37Rv
ggugacggcggcugucggccgg

SEQ ID NO: 3262723 - RNA, 19 nt, Mycobacterium tuberculosis H37Rv
ggugacgguggccggcaac

SEQ ID NO: 3262724 - RNA, 23 nt, Mycobacterium tuberculosis H37Rv
ggugacgguguugguggucgggu

SEQ ID NO: 3262725 - RNA, 14 nt, Mycobacterium tuberculosis H37Rv
ggugacgugguggg

SEQ ID NO: 3262726 - RNA, 19 nt, Mycobacterium tuberculosis H37Rv
ggugacguggugggcuugg

SEQ ID NO: 3262727 - RNA, 23 nt, Mycobacterium tuberculosis H37Rv
ggugacuccgcgcgcggacagca

SEQ ID NO: 3262728 - RNA, 23 nt, Mycobacterium tuberculosis H37Rv
ggugacuucgcugcggugggcca

SEQ ID NO: 3262729 - RNA, 20 nt, Mycobacterium tuberculosis H37Rv
ggugagaucaugaggugagc

SEQ ID NO: 3262730 - RNA, 18 nt, Mycobacterium tuberculosis H37Rv
ggugagcauggcuagggc

SEQ ID NO: 3262731 - RNA, 13 nt, Mycobacterium tuberculosis H37Rv
ggugagccgagcc

SEQ ID NO: 3262732 - RNA, 23 nt, Mycobacterium tuberculosis H37Rv
ggugagccgugccgccagcaacc

SEQ ID NO: 3262733 - RNA, 18 nt, Mycobacterium tuberculosis H37Rv
ggugagccucggcgagcc

SEQ ID NO: 3262734 - RNA, 21 nt, Mycobacterium tuberculosis H37Rv
ggugagccucggcgagccgug

SEQ ID NO: 3262735 - RNA, 15 nt, Mycobacterium tuberculosis H37Rv
ggugagcgagcgcgc

SEQ ID NO: 3262736 - RNA, 17 nt, Mycobacterium tuberculosis H37Rv
ggugagcgagcgcgcgu

SEQ ID NO: 3262737 - RNA, 16 nt, Mycobacterium tuberculosis H37Rv
ggugagcugcacgccg

SEQ ID NO: 3262738 - RNA, 16 nt, Mycobacterium tuberculosis H37Rv
ggugagcugcgccaga

SEQ ID NO: 3262739 - RNA, 20 nt, Mycobacterium tuberculosis H37Rv
ggugaggaucauggcgucga

SEQ ID NO: 3262740 - RNA, 18 nt, Mycobacterium tuberculosis H37Rv
ggugaggcgggucgccgc

SEQ ID NO: 3262741 - RNA, 20 nt, Mycobacterium tuberculosis H37Rv
ggugagggaacccacagugg

SEQ ID NO: 3262742 - RNA, 23 nt, Mycobacterium tuberculosis H37Rv
ggugagggaacccacaguggcuc

SEQ ID NO: 3262743 - RNA, 23 nt, Mycobacterium tuberculosis H37Rv
ggugagguugacccccggguaga

SEQ ID NO: 3262744 - RNA, 19 nt, Mycobacterium tuberculosis H37Rv
ggugaguccgcugagcggg

SEQ ID NO: 3262745 - RNA, 23 nt, Mycobacterium tuberculosis H37Rv
ggugaguucgccggaggcaagca

SEQ ID NO: 3262746 - RNA, 23 nt, Mycobacterium tuberculosis H37Rv
ggugaucagcaggaucggcagca

SEQ ID NO: 3262747 - RNA, 18 nt, Mycobacterium tuberculosis H37Rv
ggugaucagcucagugau

SEQ ID NO: 3262748 - RNA, 19 nt, Mycobacterium tuberculosis H37Rv
ggugaucccgauggucacu

SEQ ID NO: 3262749 - RNA, 13 nt, Mycobacterium tuberculosis H37Rv
ggugaucgauccg

SEQ ID NO: 3262750 - RNA, 16 nt, Mycobacterium tuberculosis H37Rv
ggugaucuucuucagg

SEQ ID NO: 3262751 - RNA, 17 nt, Mycobacterium tuberculosis H37Rv
ggugaucuugccggcca

SEQ ID NO: 3262752 - RNA, 20 nt, Mycobacterium tuberculosis H37Rv
ggugaucuugccggccagca

SEQ ID NO: 3262753 - RNA, 22 nt, Mycobacterium tuberculosis H37Rv
ggugaugacgccgucggcgcgc

SEQ ID NO: 3262754 - RNA, 14 nt, Mycobacterium tuberculosis H37Rv
ggugaugaucgcgc

SEQ ID NO: 3262755 - RNA, 16 nt, Mycobacterium tuberculosis H37Rv
ggugaugccaucaacg

SEQ ID NO: 3262756 - RNA, 12 nt, Mycobacterium tuberculosis H37Rv
ggugaugccgau

SEQ ID NO: 3262757 - RNA, 22 nt, Mycobacterium tuberculosis H37Rv
ggugauggaugggucgaccgga

SEQ ID NO: 3262758 - RNA, 16 nt, Mycobacterium tuberculosis H37Rv
ggugaugggccaggcg

SEQ ID NO: 3262759 - RNA, 18 nt, Mycobacterium tuberculosis H37Rv
ggugaugggggagccggu

SEQ ID NO: 3262760 - RNA, 23 nt, Mycobacterium tuberculosis H37Rv
ggugaugggggagccggugacgg

SEQ ID NO: 3262761 - RNA, 17 nt, Mycobacterium tuberculosis H37Rv
ggugauggugaccagca

SEQ ID NO: 3262762 - RNA, 13 nt, Mycobacterium tuberculosis H37Rv
ggugaugguggcg

SEQ ID NO: 3262763 - RNA, 18 nt, Mycobacterium tuberculosis H37Rv
ggugauguagggcugcuc

SEQ ID NO: 3262764 - RNA, 22 nt, Mycobacterium tuberculosis H37Rv
ggugauguuggccgccacaccg

SEQ ID NO: 3262765 - RNA, 17 nt, Mycobacterium tuberculosis H37Rv
ggugcacaacccgugca

SEQ ID NO: 3262766 - RNA, 20 nt, Mycobacterium tuberculosis H37Rv
ggugcacaccgucgcaccca

SEQ ID NO: 3262767 - RNA, 24 nt, Mycobacterium tuberculosis H37Rv
ggugcacaccgucgcgcucgcacc

SEQ ID NO: 3262768 - RNA, 19 nt, Mycobacterium tuberculosis H37Rv
ggugcaccgaagauggcca

SEQ ID NO: 3262769 - RNA, 20 nt, Mycobacterium tuberculosis H37Rv
ggugcaccgaagauggccag

SEQ ID NO: 3262770 - RNA, 13 nt, Mycobacterium tuberculosis H37Rv
ggugcaccgauuc

SEQ ID NO: 3262771 - RNA, 17 nt, Mycobacterium tuberculosis H37Rv
ggugcaccgucgucacc

SEQ ID NO: 3262772 - RNA, 16 nt, Mycobacterium tuberculosis H37Rv
ggugcacgccuugagc

SEQ ID NO: 3262773 - RNA, 22 nt, Mycobacterium tuberculosis H37Rv
ggugcacgccuugagccgaggc

SEQ ID NO: 3262774 - RNA, 18 nt, Mycobacterium tuberculosis H37Rv
ggugcagaauucggcgcg

SEQ ID NO: 3262775 - RNA, 16 nt, Mycobacterium tuberculosis H37Rv
ggugcagaccaccgcc

SEQ ID NO: 3262776 - RNA, 18 nt, Mycobacterium tuberculosis H37Rv
ggugcagaucggcucacc

SEQ ID NO: 3262777 - RNA, 22 nt, Mycobacterium tuberculosis H37Rv
ggugcagcaccagccacgccag

SEQ ID NO: 3262778 - RNA, 19 nt, Mycobacterium tuberculosis H37Rv
ggugcagcacggcgccgcc

SEQ ID NO: 3262779 - RNA, 21 nt, Mycobacterium tuberculosis H37Rv
ggugcuaccggcuuggcggga

SEQ ID NO: 3262780 - RNA, 15 nt, Mycobacterium tuberculosis H37Rv
ggugcuacugggugg

SEQ ID NO: 3262781 - RNA, 18 nt, Mycobacterium tuberculosis H37Rv
ggugcuagcgccgccagu

SEQ ID NO: 3262782 - RNA, 21 nt, Mycobacterium tuberculosis H37Rv
ggugcuagcgccgccagucgu

SEQ ID NO: 3262783 - RNA, 22 nt, Mycobacterium tuberculosis H37Rv
ggugcuagcgccgccagucguc

SEQ ID NO: 3262784 - RNA, 16 nt, Mycobacterium tuberculosis H37Rv
ggugcucaccuccacg

SEQ ID NO: 3262785 - RNA, 17 nt, Mycobacterium tuberculosis H37Rv
ggugcucgggcggcgau

SEQ ID NO: 3262786 - RNA, 22 nt, Mycobacterium tuberculosis H37Rv
ggugcucgucaccaaacccgau

SEQ ID NO: 3262787 - RNA, 15 nt, Mycobacterium tuberculosis H37Rv
ggugcucgucgagca

SEQ ID NO: 3262788 - RNA, 16 nt, Mycobacterium tuberculosis H37Rv
ggugcugaccccgccg

SEQ ID NO: 3262789 - RNA, 22 nt, Mycobacterium tuberculosis H37Rv
ggugcugaccccgccggcugcg

SEQ ID NO: 3262790 - RNA, 17 nt, Mycobacterium tuberculosis H37Rv
ggugcugaccgcgccgg

SEQ ID NO: 3262791 - RNA, 22 nt, Mycobacterium tuberculosis H37Rv
ggugcugccgauagggauggcg

SEQ ID NO: 3262792 - RNA, 18 nt, Mycobacterium tuberculosis H37Rv
ggugcugcgcgggugugg

SEQ ID NO: 3262793 - RNA, 13 nt, Mycobacterium tuberculosis H37Rv
ggugcuggcagga

SEQ ID NO: 3262794 - RNA, 23 nt, Mycobacterium tuberculosis H37Rv
ggugcuggucaacagcggcaaga

SEQ ID NO: 3262795 - RNA, 15 nt, Mycobacterium tuberculosis H37Rv
ggugcuggucgccgc

SEQ ID NO: 3262796 - RNA, 19 nt, Mycobacterium tuberculosis H37Rv
ggugcuggucgccgcggca

SEQ ID NO: 3262797 - RNA, 20 nt, Mycobacterium tuberculosis H37Rv
ggugcuggugaucugcuggg

SEQ ID NO: 3262798 - RNA, 16 nt, Mycobacterium tuberculosis H37Rv
ggugcugguggcggca

SEQ ID NO: 3262799 - RNA, 14 nt, Mycobacterium tuberculosis H37Rv
ggugcugucgacgu

SEQ ID NO: 3262800 - RNA, 19 nt, Mycobacterium tuberculosis H37Rv
ggugcugucgacgucggca

SEQ ID NO: 3262801 - RNA, 16 nt, Mycobacterium tuberculosis H37Rv
ggugcuguuugguugc

SEQ ID NO: 3262802 - RNA, 13 nt, Mycobacterium tuberculosis H37Rv
ggugcuuggccgc

SEQ ID NO: 3262803 - RNA, 20 nt, Mycobacterium tuberculosis H37Rv
ggugcuuucgcgucugcucg

SEQ ID NO: 3262804 - RNA, 23 nt, Mycobacterium tuberculosis H37Rv
gguggaaaaagcccgacacgaaa

SEQ ID NO: 3262805 - RNA, 15 nt, Mycobacterium tuberculosis H37Rv
gguggaaacccugca

SEQ ID NO: 3262806 - RNA, 20 nt, Mycobacterium tuberculosis H37Rv
gguggaacuccggguggcgg

SEQ ID NO: 3262807 - RNA, 22 nt, Mycobacterium tuberculosis H37Rv
gguggaacuccggguggcggcg

SEQ ID NO: 3262808 - RNA, 21 nt, Mycobacterium tuberculosis H37Rv
gguggaagugugauuccgggu

SEQ ID NO: 3262809 - RNA, 14 nt, Mycobacterium tuberculosis H37Rv
gguggaaucagggu

SEQ ID NO: 3262810 - RNA, 15 nt, Mycobacterium tuberculosis H37Rv
gguggaccgccgauc

SEQ ID NO: 3262811 - RNA, 23 nt, Mycobacterium tuberculosis H37Rv
gguggacgaccgcgcggcacuug

SEQ ID NO: 3262812 - RNA, 18 nt, Mycobacterium tuberculosis H37Rv
gguggacgaggcggucga

SEQ ID NO: 3262813 - RNA, 21 nt, Mycobacterium tuberculosis H37Rv
gguggacgugcagccgcaggu

SEQ ID NO: 3262814 - RNA, 20 nt, Mycobacterium tuberculosis H37Rv
gguggaguuuccgaagcccg

SEQ ID NO: 3262815 - RNA, 21 nt, Mycobacterium tuberculosis H37Rv
gguggaguuuccgaagcccgg

SEQ ID NO: 3262816 - RNA, 22 nt, Mycobacterium tuberculosis H37Rv
gguggaguuuccgaagcccggg

SEQ ID NO: 3262817 - RNA, 22 nt, Mycobacterium tuberculosis H37Rv
gguggaugugugagucccacgc

SEQ ID NO: 3262818 - RNA, 21 nt, Mycobacterium tuberculosis H37Rv
gguggauguuugcucggccua

SEQ ID NO: 3262819 - RNA, 19 nt, Mycobacterium tuberculosis H37Rv
gguggauucgaucaggccu

SEQ ID NO: 3262820 - RNA, 22 nt, Mycobacterium tuberculosis H37Rv
gguggauuggugccggucaccu

SEQ ID NO: 3262821 - RNA, 23 nt, Mycobacterium tuberculosis H37Rv
gguggcaaucgaggaaggugugc

SEQ ID NO: 3262822 - RNA, 15 nt, Mycobacterium tuberculosis H37Rv
gguggcacccgcguc

SEQ ID NO: 3262823 - RNA, 19 nt, Mycobacterium tuberculosis H37Rv
gguggcacgcugagcgucc

SEQ ID NO: 3262824 - RNA, 14 nt, Mycobacterium tuberculosis H37Rv
gguggcacggcccc

SEQ ID NO: 3262825 - RNA, 16 nt, Mycobacterium tuberculosis H37Rv
gguggcacggccccug

SEQ ID NO: 3262826 - RNA, 14 nt, Mycobacterium tuberculosis H37Rv
gguggcagcacagc

SEQ ID NO: 3262827 - RNA, 12 nt, Mycobacterium tuberculosis H37Rv
gguggcagcgca

SEQ ID NO: 3262828 - RNA, 13 nt, Mycobacterium tuberculosis H37Rv
gguggcagcgcac

SEQ ID NO: 3262829 - RNA, 15 nt, Mycobacterium tuberculosis H37Rv
gguggcagcggcgau

SEQ ID NO: 3262830 - RNA, 20 nt, Mycobacterium tuberculosis H37Rv
gguggcaucggcggccugcu

SEQ ID NO: 3262831 - RNA, 21 nt, Mycobacterium tuberculosis H37Rv
gguggcaucggcggccugcuc

SEQ ID NO: 3262832 - RNA, 18 nt, Mycobacterium tuberculosis H37Rv
gguggcauucgucgagua

SEQ ID NO: 3262833 - RNA, 16 nt, Mycobacterium tuberculosis H37Rv
gguggccaacucgaca

SEQ ID NO: 3262834 - RNA, 14 nt, Mycobacterium tuberculosis H37Rv
gguggccaccacgg

SEQ ID NO: 3262835 - RNA, 15 nt, Mycobacterium tuberculosis H37Rv
gguggccaccagcgg

SEQ ID NO: 3262836 - RNA, 16 nt, Mycobacterium tuberculosis H37Rv
gguggccagcacgugc

SEQ ID NO: 3262837 - RNA, 14 nt, Mycobacterium tuberculosis H37Rv
gguggccagcaggc

SEQ ID NO: 3262838 - RNA, 16 nt, Mycobacterium tuberculosis H37Rv
gguggccagcgcggcg

SEQ ID NO: 3262839 - RNA, 13 nt, Mycobacterium tuberculosis H37Rv
gguggccaucgcg

SEQ ID NO: 3262840 - RNA, 14 nt, Mycobacterium tuberculosis H37Rv
gguggccaucgcgc

SEQ ID NO: 3262841 - RNA, 15 nt, Mycobacterium tuberculosis H37Rv
gguggccaucgcgcg

SEQ ID NO: 3262842 - RNA, 22 nt, Mycobacterium tuberculosis H37Rv
gguggccaucgcgcggaccaga

SEQ ID NO: 3262843 - RNA, 21 nt, Mycobacterium tuberculosis H37Rv
gguggccaugacggcuccgau

SEQ ID NO: 3262844 - RNA, 18 nt, Mycobacterium tuberculosis H37Rv
gguggcccgaccgggaac

SEQ ID NO: 3262845 - RNA, 21 nt, Mycobacterium tuberculosis H37Rv
gguggcccgccggcagugagu

SEQ ID NO: 3262846 - RNA, 12 nt, Mycobacterium tuberculosis H37Rv
gguggccgacga

SEQ ID NO: 3262847 - RNA, 19 nt, Mycobacterium tuberculosis H37Rv
gguggccgcaucgacgcuc

SEQ ID NO: 3262848 - RNA, 15 nt, Mycobacterium tuberculosis H37Rv
gguggccggggugcc

SEQ ID NO: 3262849 - RNA, 15 nt, Mycobacterium tuberculosis H37Rv
gguggccucauccac

SEQ ID NO: 3262850 - RNA, 17 nt, Mycobacterium tuberculosis H37Rv
gguggccucauccaccg

SEQ ID NO: 3262851 - RNA, 21 nt, Mycobacterium tuberculosis H37Rv
gguggcgaucaucggccccga

SEQ ID NO: 3262852 - RNA, 22 nt, Mycobacterium tuberculosis H37Rv
gguggcgccaugaagccgggcg

SEQ ID NO: 3262853 - RNA, 18 nt, Mycobacterium tuberculosis H37Rv
gguggcgccggccgguca

SEQ ID NO: 3262854 - RNA, 17 nt, Mycobacterium tuberculosis H37Rv
gguggcgccggggcgca

SEQ ID NO: 3262855 - RNA, 10 nt, Mycobacterium tuberculosis H37Rv
gguggcggca

SEQ ID NO: 3262856 - RNA, 15 nt, Mycobacterium tuberculosis H37Rv
gguggcggcagcagc

SEQ ID NO: 3262857 - RNA, 17 nt, Mycobacterium tuberculosis H37Rv
gguggcggcgagcagca

SEQ ID NO: 3262858 - RNA, 14 nt, Mycobacterium tuberculosis H37Rv
gguggcgggcuugc

SEQ ID NO: 3262859 - RNA, 21 nt, Mycobacterium tuberculosis H37Rv
gguggcgguaccuagccgcag

SEQ ID NO: 3262860 - RNA, 14 nt, Mycobacterium tuberculosis H37Rv
gguggcgucaccgc

SEQ ID NO: 3262861 - RNA, 22 nt, Mycobacterium tuberculosis H37Rv
gguggcguccagggcgccgauc

SEQ ID NO: 3262862 - RNA, 23 nt, Mycobacterium tuberculosis H37Rv
gguggcguccagggcgccgaucg

SEQ ID NO: 3262863 - RNA, 14 nt, Mycobacterium tuberculosis H37Rv
gguggcgugcgcgu

SEQ ID NO: 3262864 - RNA, 15 nt, Mycobacterium tuberculosis H37Rv
gguggcucggguggu

SEQ ID NO: 3262865 - RNA, 15 nt, Mycobacterium tuberculosis H37Rv
gguggcugguguuga

SEQ ID NO: 3262866 - RNA, 16 nt, Mycobacterium tuberculosis H37Rv
gguggcuuugcucgcc

SEQ ID NO: 3262867 - RNA, 20 nt, Mycobacterium tuberculosis H37Rv
gguggcuuuugcgucugcuc

SEQ ID NO: 3262868 - RNA, 19 nt, Mycobacterium tuberculosis H37Rv
ggugggacaggucggggcg

SEQ ID NO: 3262869 - RNA, 14 nt, Mycobacterium tuberculosis H37Rv
ggugggagcagccg

SEQ ID NO: 3262870 - RNA, 15 nt, Mycobacterium tuberculosis H37Rv
ggugggagcagccga

SEQ ID NO: 3262871 - RNA, 17 nt, Mycobacterium tuberculosis H37Rv
ggugggaucgcagcgcc

SEQ ID NO: 3262872 - RNA, 18 nt, Mycobacterium tuberculosis H37Rv
ggugggaucgcagcgcca

SEQ ID NO: 3262873 - RNA, 14 nt, Mycobacterium tuberculosis H37Rv
ggugggcacagcga

SEQ ID NO: 3262874 - RNA, 17 nt, Mycobacterium tuberculosis H37Rv
ggugggcagcaggccca

SEQ ID NO: 3262875 - RNA, 18 nt, Mycobacterium tuberculosis H37Rv
gguucagccacgcagcac

SEQ ID NO: 3262876 - RNA, 19 nt, Mycobacterium tuberculosis H37Rv
gguucaucgccggcgcgcc

SEQ ID NO: 3262877 - RNA, 21 nt, Mycobacterium tuberculosis H37Rv
gguucaucgccggcgcgccga

SEQ ID NO: 3262878 - RNA, 16 nt, Mycobacterium tuberculosis H37Rv
gguuccacgcugccca

SEQ ID NO: 3262879 - RNA, 15 nt, Mycobacterium tuberculosis H37Rv
gguuccacggccagg

SEQ ID NO: 3262880 - RNA, 14 nt, Mycobacterium tuberculosis H37Rv
gguucccgggcagc

SEQ ID NO: 3262881 - RNA, 19 nt, Mycobacterium tuberculosis H37Rv
gguucccgggcagccgcac

SEQ ID NO: 3262882 - RNA, 22 nt, Mycobacterium tuberculosis H37Rv
gguuccgaucgcguuagccagg

SEQ ID NO: 3262883 - RNA, 18 nt, Mycobacterium tuberculosis H37Rv
gguuccgaucucaagggc

SEQ ID NO: 3262884 - RNA, 16 nt, Mycobacterium tuberculosis H37Rv
gguuccguggauggac

SEQ ID NO: 3262885 - RNA, 17 nt, Mycobacterium tuberculosis H37Rv
gguucgaacgcgaucga

SEQ ID NO: 3262886 - RNA, 17 nt, Mycobacterium tuberculosis H37Rv
gguucgacgucugccca

SEQ ID NO: 3262887 - RNA, 14 nt, Mycobacterium tuberculosis H37Rv
gguucgaguccugg

SEQ ID NO: 3262888 - RNA, 17 nt, Mycobacterium tuberculosis H37Rv
gguucgcacaccuccuc

SEQ ID NO: 3262889 - RNA, 13 nt, Mycobacterium tuberculosis H37Rv
gguucgcccagcc

SEQ ID NO: 3262890 - RNA, 16 nt, Mycobacterium tuberculosis H37Rv
gguucgccccugcaca

SEQ ID NO: 3262891 - RNA, 20 nt, Mycobacterium tuberculosis H37Rv
gguucgccccugcacagcag

SEQ ID NO: 3262892 - RNA, 24 nt, Mycobacterium tuberculosis H37Rv
gguucgccccugcacagcaggcuc

SEQ ID NO: 3262893 - RNA, 15 nt, Mycobacterium tuberculosis H37Rv
gguucgcgguugucc

SEQ ID NO: 3262894 - RNA, 15 nt, Mycobacterium tuberculosis H37Rv
gguucgcucggggac

SEQ ID NO: 3262895 - RNA, 19 nt, Mycobacterium tuberculosis H37Rv
gguucggacacacaggcgg

SEQ ID NO: 3262896 - RNA, 21 nt, Mycobacterium tuberculosis H37Rv
gguucggacacacaggcggcg

SEQ ID NO: 3262897 - RNA, 14 nt, Mycobacterium tuberculosis H37Rv
gguucggccagaac

SEQ ID NO: 3262898 - RNA, 14 nt, Mycobacterium tuberculosis H37Rv
gguucgggacgcga

SEQ ID NO: 3262899 - RNA, 22 nt, Mycobacterium tuberculosis H37Rv
gguucuggauccccugauggac

SEQ ID NO: 3262900 - RNA, 18 nt, Mycobacterium tuberculosis H37Rv
gguucugggccugcggca

SEQ ID NO: 3262901 - RNA, 23 nt, Mycobacterium tuberculosis H37Rv
gguucuguuccagaaggccgcac

SEQ ID NO: 3262902 - RNA, 17 nt, Mycobacterium tuberculosis H37Rv
gguucuuccacagcgcg

SEQ ID NO: 3262903 - RNA, 14 nt, Mycobacterium tuberculosis H37Rv
gguucuucgaauag

SEQ ID NO: 3262904 - RNA, 15 nt, Mycobacterium tuberculosis H37Rv
gguucuugaccagca

SEQ ID NO: 3262905 - RNA, 23 nt, Mycobacterium tuberculosis H37Rv
gguugaaaacgcccggcacacgg

SEQ ID NO: 3262906 - RNA, 15 nt, Mycobacterium tuberculosis H37Rv
gguugaccaccagcg

SEQ ID NO: 3262907 - RNA, 19 nt, Mycobacterium tuberculosis H37Rv
gguugacccggcagcccgg

SEQ ID NO: 3262908 - RNA, 15 nt, Mycobacterium tuberculosis H37Rv
gguugaccgaguuga

SEQ ID NO: 3262909 - RNA, 15 nt, Mycobacterium tuberculosis H37Rv
gguugacgggcucgg

SEQ ID NO: 3262910 - RNA, 16 nt, Mycobacterium tuberculosis H37Rv
gguugacgggcucggc

SEQ ID NO: 3262911 - RNA, 18 nt, Mycobacterium tuberculosis H37Rv
gguugagcgugucgagcg

SEQ ID NO: 3262912 - RNA, 21 nt, Mycobacterium tuberculosis H37Rv
gguugaguugcagaccgggug

SEQ ID NO: 3262913 - RNA, 12 nt, Mycobacterium tuberculosis H37Rv
gguugaucagcc

SEQ ID NO: 3262914 - RNA, 22 nt, Mycobacterium tuberculosis H37Rv
gguugaucagccagaccaacau

SEQ ID NO: 3262915 - RNA, 15 nt, Mycobacterium tuberculosis H37Rv
gguugaucuuguccu

SEQ ID NO: 3262916 - RNA, 18 nt, Mycobacterium tuberculosis H37Rv
gguugaugacggcgucga

SEQ ID NO: 3262917 - RNA, 16 nt, Mycobacterium tuberculosis H37Rv
gguugaugaguuccuu

SEQ ID NO: 3262918 - RNA, 14 nt, Mycobacterium tuberculosis H37Rv
gguugaugcccuug

SEQ ID NO: 3262919 - RNA, 16 nt, Mycobacterium tuberculosis H37Rv
gguugcccccagggcc

SEQ ID NO: 3262920 - RNA, 16 nt, Mycobacterium tuberculosis H37Rv
gguugccccgcagcau

SEQ ID NO: 3262921 - RNA, 11 nt, Mycobacterium tuberculosis H37Rv
gguugcccuug

SEQ ID NO: 3262922 - RNA, 13 nt, Mycobacterium tuberculosis H37Rv
gguugccgcgauc

SEQ ID NO: 3262923 - RNA, 14 nt, Mycobacterium tuberculosis H37Rv
gguugccggcggcg

SEQ ID NO: 3262924 - RNA, 18 nt, Mycobacterium tuberculosis H37Rv
gguugccugugcggcggg

SEQ ID NO: 3262925 - RNA, 16 nt, Mycobacterium tuberculosis H37Rv
gguugcgaacucggcc

SEQ ID NO: 3262926 - RNA, 14 nt, Mycobacterium tuberculosis H37Rv
gguugcgccaggaa

SEQ ID NO: 3262927 - RNA, 19 nt, Mycobacterium tuberculosis H37Rv
gguugcggcagcuggcgca

SEQ ID NO: 3262928 - RNA, 20 nt, Mycobacterium tuberculosis H37Rv
gguuggagcgccagccgcug

SEQ ID NO: 3262929 - RNA, 15 nt, Mycobacterium tuberculosis H37Rv
gguuggaugccugcc

SEQ ID NO: 3262930 - RNA, 23 nt, Mycobacterium tuberculosis H37Rv
gguuggcauccaaaaucgccuga

SEQ ID NO: 3262931 - RNA, 15 nt, Mycobacterium tuberculosis H37Rv
gguuggccaccagcu

SEQ ID NO: 3262932 - RNA, 15 nt, Mycobacterium tuberculosis H37Rv
gguuggccgggcugg

SEQ ID NO: 3262933 - RNA, 16 nt, Mycobacterium tuberculosis H37Rv
gguuggccgggcuggc

SEQ ID NO: 3262934 - RNA, 16 nt, Mycobacterium tuberculosis H37Rv
gguuggcguugguggu

SEQ ID NO: 3262935 - RNA, 14 nt, Mycobacterium tuberculosis H37Rv
gguuggcuccggug

SEQ ID NO: 3262936 - RNA, 15 nt, Mycobacterium tuberculosis H37Rv
gguuggcucggcgca

SEQ ID NO: 3262937 - RNA, 12 nt, Mycobacterium tuberculosis H37Rv
gguugggguggc

SEQ ID NO: 3262938 - RNA, 19 nt, Mycobacterium tuberculosis H37Rv
gguugggguggcggugccg

SEQ ID NO: 3262939 - RNA, 20 nt, Mycobacterium tuberculosis H37Rv
gguuggugauugcggccgcc

SEQ ID NO: 3262940 - RNA, 13 nt, Mycobacterium tuberculosis H37Rv
gguuguccucggc

SEQ ID NO: 3262941 - RNA, 16 nt, Mycobacterium tuberculosis H37Rv
gguugucgucgguggg

SEQ ID NO: 3262942 - RNA, 21 nt, Mycobacterium tuberculosis H37Rv
gguugucgucggugggcguga

SEQ ID NO: 3262943 - RNA, 20 nt, Mycobacterium tuberculosis H37Rv
gguugucguugcuggugugc

SEQ ID NO: 3262944 - RNA, 15 nt, Mycobacterium tuberculosis H37Rv
gguuguggucagcug

SEQ ID NO: 3262945 - RNA, 17 nt, Mycobacterium tuberculosis H37Rv
gguugugucggccuggc

SEQ ID NO: 3262946 - RNA, 15 nt, Mycobacterium tuberculosis H37Rv
gguuguucggcagcc

SEQ ID NO: 3262947 - RNA, 17 nt, Mycobacterium tuberculosis H37Rv
gguuuccggccugcacg

SEQ ID NO: 3262948 - RNA, 18 nt, Mycobacterium tuberculosis H37Rv
gguuuccuccggcagcag

SEQ ID NO: 3262949 - RNA, 22 nt, Mycobacterium tuberculosis H37Rv
gguuucgaauguuucggcgaua

SEQ ID NO: 3262950 - RNA, 14 nt, Mycobacterium tuberculosis H37Rv
gguuugcagcgaua

SEQ ID NO: 3262951 - RNA, 17 nt, Mycobacterium tuberculosis H37Rv
gguuugcagcgggauca

SEQ ID NO: 3262952 - RNA, 12 nt, Mycobacterium tuberculosis H37Rv
gguuugccggcg

SEQ ID NO: 3262953 - RNA, 12 nt, Mycobacterium tuberculosis H37Rv
gguuugcggugc

SEQ ID NO: 3262954 - RNA, 17 nt, Mycobacterium tuberculosis H37Rv
gguuuucccgucgccgc

SEQ ID NO: 3262955 - RNA, 14 nt, Mycobacterium tuberculosis H37Rv
guaaaagccgauga

SEQ ID NO: 3262956 - RNA, 21 nt, Mycobacterium tuberculosis H37Rv
guaaaagccgaugacgguccc

SEQ ID NO: 3262957 - RNA, 15 nt, Mycobacterium tuberculosis H37Rv
guaaacaacgcgaua

SEQ ID NO: 3262958 - RNA, 19 nt, Mycobacterium tuberculosis H37Rv
guaaaccagguggccaggc

SEQ ID NO: 3262959 - RNA, 15 nt, Mycobacterium tuberculosis H37Rv
guaaaccggcugacc

SEQ ID NO: 3262960 - RNA, 22 nt, Mycobacterium tuberculosis H37Rv
guaaagaucuugucgcguucgg

SEQ ID NO: 3262961 - RNA, 15 nt, Mycobacterium tuberculosis H37Rv
guaaagccaacuggu

SEQ ID NO: 3262962 - RNA, 18 nt, Mycobacterium tuberculosis H37Rv
guaaagcucaccacaucg

SEQ ID NO: 3262963 - RNA, 18 nt, Mycobacterium tuberculosis H37Rv
guaacacccggccgccga

SEQ ID NO: 3262964 - RNA, 13 nt, Mycobacterium tuberculosis H37Rv
guaaccagcgcca

SEQ ID NO: 3262965 - RNA, 16 nt, Mycobacterium tuberculosis H37Rv
guaaccagcgccacga

SEQ ID NO: 3262966 - RNA, 23 nt, Mycobacterium tuberculosis H37Rv
guaacccguuaccgauuggcccg

SEQ ID NO: 3262967 - RNA, 22 nt, Mycobacterium tuberculosis H37Rv
guaaccgcgcguaggccgcuau

SEQ ID NO: 3262968 - RNA, 14 nt, Mycobacterium tuberculosis H37Rv
guaaccggcagcgg

SEQ ID NO: 3262969 - RNA, 17 nt, Mycobacterium tuberculosis H37Rv
guaaccggcagcgguaa

SEQ ID NO: 3262970 - RNA, 12 nt, Mycobacterium tuberculosis H37Rv
guaaccuccucg

SEQ ID NO: 3262971 - RNA, 13 nt, Mycobacterium tuberculosis H37Rv
guaaccuccucga

SEQ ID NO: 3262972 - RNA, 21 nt, Mycobacterium tuberculosis H37Rv
guacucccgcgaucgcgacac

SEQ ID NO: 3262973 - RNA, 17 nt, Mycobacterium tuberculosis H37Rv
guacucgcggcgcggcc

SEQ ID NO: 3262974 - RNA, 17 nt, Mycobacterium tuberculosis H37Rv
guacucggcauccaggc

SEQ ID NO: 3262975 - RNA, 19 nt, Mycobacterium tuberculosis H37Rv
guacucggcauccaggcug

SEQ ID NO: 3262976 - RNA, 15 nt, Mycobacterium tuberculosis H37Rv
guacucggccagcgc

SEQ ID NO: 3262977 - RNA, 16 nt, Mycobacterium tuberculosis H37Rv
guacucggccagcgcc

SEQ ID NO: 3262978 - RNA, 17 nt, Mycobacterium tuberculosis H37Rv
guacucggccagcucgu

SEQ ID NO: 3262979 - RNA, 15 nt, Mycobacterium tuberculosis H37Rv
guacugagccgcgaa

SEQ ID NO: 3262980 - RNA, 23 nt, Mycobacterium tuberculosis H37Rv
guacugcugcuugagcucgcuga

SEQ ID NO: 3262981 - RNA, 22 nt, Mycobacterium tuberculosis H37Rv
guacuggcguugccaccggagc

SEQ ID NO: 3262982 - RNA, 19 nt, Mycobacterium tuberculosis H37Rv
guacugucgucgcccugac

SEQ ID NO: 3262983 - RNA, 16 nt, Mycobacterium tuberculosis H37Rv
guacuugaccguccac

SEQ ID NO: 3262984 - RNA, 18 nt, Mycobacterium tuberculosis H37Rv
guacuugagggucuugaa

SEQ ID NO: 3262985 - RNA, 13 nt, Mycobacterium tuberculosis H37Rv
guacuugccaccc

SEQ ID NO: 3262986 - RNA, 15 nt, Mycobacterium tuberculosis H37Rv
guacuugccacggcg

SEQ ID NO: 3262987 - RNA, 23 nt, Mycobacterium tuberculosis H37Rv
guagaaacccucggggguccagu

SEQ ID NO: 3262988 - RNA, 15 nt, Mycobacterium tuberculosis H37Rv
guagaacccaggccg

SEQ ID NO: 3262989 - RNA, 15 nt, Mycobacterium tuberculosis H37Rv
guagaagcccaggac

SEQ ID NO: 3262990 - RNA, 14 nt, Mycobacterium tuberculosis H37Rv
guagaagcgcucca

SEQ ID NO: 3262991 - RNA, 19 nt, Mycobacterium tuberculosis H37Rv
guagaagcgcuccagcuga

SEQ ID NO: 3262992 - RNA, 13 nt, Mycobacterium tuberculosis H37Rv
guagaagcgggcg

SEQ ID NO: 3262993 - RNA, 21 nt, Mycobacterium tuberculosis H37Rv
guagaaugcgccgucgguggg

SEQ ID NO: 3262994 - RNA, 15 nt, Mycobacterium tuberculosis H37Rv
guagacaacagucga

SEQ ID NO: 3262995 - RNA, 23 nt, Mycobacterium tuberculosis H37Rv
guagacaagucggcgcuggccgu

SEQ ID NO: 3262996 - RNA, 19 nt, Mycobacterium tuberculosis H37Rv
guagacaccccaccacaga

SEQ ID NO: 3262997 - RNA, 20 nt, Mycobacterium tuberculosis H37Rv
guagacaccgcgaucaccac

SEQ ID NO: 3262998 - RNA, 18 nt, Mycobacterium tuberculosis H37Rv
guagacaggaccgguggg

SEQ ID NO: 3262999 - RNA, 21 nt, Mycobacterium tuberculosis H37Rv
guagacagucugcgacuggau

SEQ ID NO: 3263000 - RNA, 13 nt, Mycobacterium tuberculosis H37Rv
guagaccagcagg

SEQ ID NO: 3263001 - RNA, 14 nt, Mycobacterium tuberculosis H37Rv
guagaccaggccca

SEQ ID NO: 3263002 - RNA, 15 nt, Mycobacterium tuberculosis H37Rv
guagaccaggcccag

SEQ ID NO: 3263003 - RNA, 19 nt, Mycobacterium tuberculosis H37Rv
guagacccacagucgccgg

SEQ ID NO: 3263004 - RNA, 23 nt, Mycobacterium tuberculosis H37Rv
guagacccacaucaggucggcga

SEQ ID NO: 3263005 - RNA, 20 nt, Mycobacterium tuberculosis H37Rv
guagaccggaaaccacagcg

SEQ ID NO: 3263006 - RNA, 22 nt, Mycobacterium tuberculosis H37Rv
guagaccuccagugcggccuug

SEQ ID NO: 3263007 - RNA, 17 nt, Mycobacterium tuberculosis H37Rv
guagacggcacccccga

SEQ ID NO: 3263008 - RNA, 13 nt, Mycobacterium tuberculosis H37Rv
guagacggggcga

SEQ ID NO: 3263009 - RNA, 12 nt, Mycobacterium tuberculosis H37Rv
guagacgguccg

SEQ ID NO: 3263010 - RNA, 18 nt, Mycobacterium tuberculosis H37Rv
guagacguugccaacacc

SEQ ID NO: 3263011 - RNA, 23 nt, Mycobacterium tuberculosis H37Rv
guagagauacgggaacguccagc

SEQ ID NO: 3263012 - RNA, 14 nt, Mycobacterium tuberculosis H37Rv
guagagcgcaccgc

SEQ ID NO: 3263013 - RNA, 19 nt, Mycobacterium tuberculosis H37Rv
guagaucagcgccuggucc

SEQ ID NO: 3263014 - RNA, 15 nt, Mycobacterium tuberculosis H37Rv
guagaucaucagcga

SEQ ID NO: 3263015 - RNA, 20 nt, Mycobacterium tuberculosis H37Rv
guagaucuucggccgcacug

SEQ ID NO: 3263016 - RNA, 20 nt, Mycobacterium tuberculosis H37Rv
guagaugguggucaccacca

SEQ ID NO: 3263017 - RNA, 14 nt, Mycobacterium tuberculosis H37Rv
guagcaacccagga

SEQ ID NO: 3263018 - RNA, 14 nt, Mycobacterium tuberculosis H37Rv
guagcacagcagca

SEQ ID NO: 3263019 - RNA, 15 nt, Mycobacterium tuberculosis H37Rv
guagcaccacaucgg

SEQ ID NO: 3263020 - RNA, 23 nt, Mycobacterium tuberculosis H37Rv
guagcacucgggauucggcagcg

SEQ ID NO: 3263021 - RNA, 15 nt, Mycobacterium tuberculosis H37Rv
guagcagcgccagca

SEQ ID NO: 3263022 - RNA, 14 nt, Mycobacterium tuberculosis H37Rv
guagcagcgcggcu

SEQ ID NO: 3263023 - RNA, 22 nt, Mycobacterium tuberculosis H37Rv
guagcaggucgacggccacggu

SEQ ID NO: 3263024 - RNA, 19 nt, Mycobacterium tuberculosis H37Rv
guagcaggucgugaaacca

SEQ ID NO: 3263025 - RNA, 13 nt, Mycobacterium tuberculosis H37Rv
guagccaaccgug

SEQ ID NO: 3263026 - RNA, 22 nt, Mycobacterium tuberculosis H37Rv
guagccaaccugaagccagcgc

SEQ ID NO: 3263027 - RNA, 22 nt, Mycobacterium tuberculosis H37Rv
guagccaaugcccuuggccagc

SEQ ID NO: 3263028 - RNA, 14 nt, Mycobacterium tuberculosis H37Rv
guagccagcgcgcu

SEQ ID NO: 3263029 - RNA, 13 nt, Mycobacterium tuberculosis H37Rv
guagcccaucggc

SEQ ID NO: 3263030 - RNA, 19 nt, Mycobacterium tuberculosis H37Rv
guagcccgcgucgacgagc

SEQ ID NO: 3263031 - RNA, 13 nt, Mycobacterium tuberculosis H37Rv
guagcccggaccg

SEQ ID NO: 3263032 - RNA, 13 nt, Mycobacterium tuberculosis H37Rv
guagccgaccagg

SEQ ID NO: 3263033 - RNA, 13 nt, Mycobacterium tuberculosis H37Rv
guagccgaccggc

SEQ ID NO: 3263034 - RNA, 22 nt, Mycobacterium tuberculosis H37Rv
guagccgagguucaaagcagcg

SEQ ID NO: 3263035 - RNA, 15 nt, Mycobacterium tuberculosis H37Rv
guagccgcccucccu

SEQ ID NO: 3263036 - RNA, 18 nt, Mycobacterium tuberculosis H37Rv
guagccgcggccacaaug

SEQ ID NO: 3263037 - RNA, 14 nt, Mycobacterium tuberculosis H37Rv
guagccggucggca

SEQ ID NO: 3263038 - RNA, 16 nt, Mycobacterium tuberculosis H37Rv
guagccgucgucgucg

SEQ ID NO: 3263039 - RNA, 22 nt, Mycobacterium tuberculosis H37Rv
guagccguugccgccgaacagc

SEQ ID NO: 3263040 - RNA, 14 nt, Mycobacterium tuberculosis H37Rv
guagccugaccagc

SEQ ID NO: 3263041 - RNA, 15 nt, Mycobacterium tuberculosis H37Rv
guagccugaccagcc

SEQ ID NO: 3263042 - RNA, 17 nt, Mycobacterium tuberculosis H37Rv
guagccugcggcgguca

SEQ ID NO: 3263043 - RNA, 23 nt, Mycobacterium tuberculosis H37Rv
guagcgaccgcggucgcugcgau

SEQ ID NO: 3263044 - RNA, 13 nt, Mycobacterium tuberculosis H37Rv
guagcgacgccau

SEQ ID NO: 3263045 - RNA, 18 nt, Mycobacterium tuberculosis H37Rv
guagcgagcccacguggg

SEQ ID NO: 3263046 - RNA, 14 nt, Mycobacterium tuberculosis H37Rv
guagcgcagcgccu

SEQ ID NO: 3263047 - RNA, 17 nt, Mycobacterium tuberculosis H37Rv
guagcgccgcacuucuu

SEQ ID NO: 3263048 - RNA, 14 nt, Mycobacterium tuberculosis H37Rv
guagcgccucguga

SEQ ID NO: 3263049 - RNA, 18 nt, Mycobacterium tuberculosis H37Rv
guagcggcccuucgacga

SEQ ID NO: 3263050 - RNA, 19 nt, Mycobacterium tuberculosis H37Rv
guagcggcggcgcccggcu

SEQ ID NO: 3263051 - RNA, 14 nt, Mycobacterium tuberculosis H37Rv
guagcgggggagcg

SEQ ID NO: 3263052 - RNA, 14 nt, Mycobacterium tuberculosis H37Rv
guagcgguccagcg

SEQ ID NO: 3263053 - RNA, 21 nt, Mycobacterium tuberculosis H37Rv
guagcggucguagacagucug

SEQ ID NO: 3263054 - RNA, 22 nt, Mycobacterium tuberculosis H37Rv
guagcggucguagacagucugc

SEQ ID NO: 3263055 - RNA, 16 nt, Mycobacterium tuberculosis H37Rv
guagcguccaggucau

SEQ ID NO: 3263056 - RNA, 19 nt, Mycobacterium tuberculosis H37Rv
guagcgucgcacccagggc

SEQ ID NO: 3263057 - RNA, 19 nt, Mycobacterium tuberculosis H37Rv
guagcugacggccugcaac

SEQ ID NO: 3263058 - RNA, 19 nt, Mycobacterium tuberculosis H37Rv
guagcuggcgaucuggucg

SEQ ID NO: 3263059 - RNA, 19 nt, Mycobacterium tuberculosis H37Rv
guagcuggucccacaccuc

SEQ ID NO: 3263060 - RNA, 22 nt, Mycobacterium tuberculosis H37Rv
guagcuggugcguagcccaccc

SEQ ID NO: 3263061 - RNA, 18 nt, Mycobacterium tuberculosis H37Rv
guagcuguggcccgcggu

SEQ ID NO: 3263062 - RNA, 18 nt, Mycobacterium tuberculosis H37Rv
guagcuucggguccagcg

SEQ ID NO: 3263063 - RNA, 19 nt, Mycobacterium tuberculosis H37Rv
guaggaacuacccgccagc

SEQ ID NO: 3263064 - RNA, 13 nt, Mycobacterium tuberculosis H37Rv
guaggcaccccgg

SEQ ID NO: 3263065 - RNA, 20 nt, Mycobacterium tuberculosis H37Rv
guaggccaccacugcgcccg

SEQ ID NO: 3263066 - RNA, 14 nt, Mycobacterium tuberculosis H37Rv
guaggccgccggac

SEQ ID NO: 3263067 - RNA, 17 nt, Mycobacterium tuberculosis H37Rv
guaggccgcuaugcagg

SEQ ID NO: 3263068 - RNA, 15 nt, Mycobacterium tuberculosis H37Rv
gucaacgcaaucgac

SEQ ID NO: 3263069 - RNA, 16 nt, Mycobacterium tuberculosis H37Rv
gucaacgcaaucgacu

SEQ ID NO: 3263070 - RNA, 23 nt, Mycobacterium tuberculosis H37Rv
gucaacgcuagcgucgugucggg

SEQ ID NO: 3263071 - RNA, 14 nt, Mycobacterium tuberculosis H37Rv
gucaacgcugacgu

SEQ ID NO: 3263072 - RNA, 20 nt, Mycobacterium tuberculosis H37Rv
gucaacgggaugccggcgaa

SEQ ID NO: 3263073 - RNA, 14 nt, Mycobacterium tuberculosis H37Rv
gucaacgugaacug

SEQ ID NO: 3263074 - RNA, 15 nt, Mycobacterium tuberculosis H37Rv
gucaacguggauguc

SEQ ID NO: 3263075 - RNA, 15 nt, Mycobacterium tuberculosis H37Rv
gucaacucaccgucg

SEQ ID NO: 3263076 - RNA, 22 nt, Mycobacterium tuberculosis H37Rv
gucaacuccacgcggaccucga

SEQ ID NO: 3263077 - RNA, 14 nt, Mycobacterium tuberculosis H37Rv
gucaagaucagcgg

SEQ ID NO: 3263078 - RNA, 17 nt, Mycobacterium tuberculosis H37Rv
gucaagcaaguccaccg

SEQ ID NO: 3263079 - RNA, 22 nt, Mycobacterium tuberculosis H37Rv
gucaagcaaguccaccggaucg

SEQ ID NO: 3263080 - RNA, 18 nt, Mycobacterium tuberculosis H37Rv
gucaagcagcagcagcuu

SEQ ID NO: 3263081 - RNA, 19 nt, Mycobacterium tuberculosis H37Rv
gucaagccacacccggcgu

SEQ ID NO: 3263082 - RNA, 17 nt, Mycobacterium tuberculosis H37Rv
gucaaggucgucgugga

SEQ ID NO: 3263083 - RNA, 16 nt, Mycobacterium tuberculosis H37Rv
gucaaggugcgccgcc

SEQ ID NO: 3263084 - RNA, 18 nt, Mycobacterium tuberculosis H37Rv
gucaagucuggcugagca

SEQ ID NO: 3263085 - RNA, 15 nt, Mycobacterium tuberculosis H37Rv
gucaagucugugcuc

SEQ ID NO: 3263086 - RNA, 17 nt, Mycobacterium tuberculosis H37Rv
gucaaguggcaaccgca

SEQ ID NO: 3263087 - RNA, 18 nt, Mycobacterium tuberculosis H37Rv
gucaaguucgccagcaac

SEQ ID NO: 3263088 - RNA, 19 nt, Mycobacterium tuberculosis H37Rv
gucaaucgcaaugaccugc

SEQ ID NO: 3263089 - RNA, 23 nt, Mycobacterium tuberculosis H37Rv
gucaaucgcaaugaccugcagcg

SEQ ID NO: 3263090 - RNA, 16 nt, Mycobacterium tuberculosis H37Rv
gucaaucgcgucauca

SEQ ID NO: 3263091 - RNA, 16 nt, Mycobacterium tuberculosis H37Rv
gucaaugacaccgggg

SEQ ID NO: 3263092 - RNA, 17 nt, Mycobacterium tuberculosis H37Rv
gucaaugcgcuggcgcc

SEQ ID NO: 3263093 - RNA, 13 nt, Mycobacterium tuberculosis H37Rv
gucacaaacccag

SEQ ID NO: 3263094 - RNA, 19 nt, Mycobacterium tuberculosis H37Rv
gucacaacgcgugaccagg

SEQ ID NO: 3263095 - RNA, 17 nt, Mycobacterium tuberculosis H37Rv
gucacaagccugccggc

SEQ ID NO: 3263096 - RNA, 21 nt, Mycobacterium tuberculosis H37Rv
gucacaagucgacacgccgaa

SEQ ID NO: 3263097 - RNA, 18 nt, Mycobacterium tuberculosis H37Rv
gucacaccagcgggcauc

SEQ ID NO: 3263098 - RNA, 14 nt, Mycobacterium tuberculosis H37Rv
gucacacccacacc

SEQ ID NO: 3263099 - RNA, 14 nt, Mycobacterium tuberculosis H37Rv
gucacaccgaugcg

SEQ ID NO: 3263100 - RNA, 17 nt, Mycobacterium tuberculosis H37Rv
gucacacguuggcagcc

SEQ ID NO: 3263101 - RNA, 13 nt, Mycobacterium tuberculosis H37Rv
gucacaguucugc

SEQ ID NO: 3263102 - RNA, 15 nt, Mycobacterium tuberculosis H37Rv
gucacaguucugccu

SEQ ID NO: 3263103 - RNA, 15 nt, Mycobacterium tuberculosis H37Rv
gucacauagcucaac

SEQ ID NO: 3263104 - RNA, 18 nt, Mycobacterium tuberculosis H37Rv
gucacauccgacagcagc

SEQ ID NO: 3263105 - RNA, 20 nt, Mycobacterium tuberculosis H37Rv
gucaccaccaccgccgcacg

SEQ ID NO: 3263106 - RNA, 18 nt, Mycobacterium tuberculosis H37Rv
gucaccaccuggugcaac

SEQ ID NO: 3263107 - RNA, 12 nt, Mycobacterium tuberculosis H37Rv
gucaccacgauc

SEQ ID NO: 3263108 - RNA, 13 nt, Mycobacterium tuberculosis H37Rv
gucaccagcgcau

SEQ ID NO: 3263109 - RNA, 18 nt, Mycobacterium tuberculosis H37Rv
gucaccaggccgaaaucc

SEQ ID NO: 3263110 - RNA, 17 nt, Mycobacterium tuberculosis H37Rv
gucaccaggcugcaguc

SEQ ID NO: 3263111 - RNA, 23 nt, Mycobacterium tuberculosis H37Rv
gucacccaauucacgacgccgag

SEQ ID NO: 3263112 - RNA, 19 nt, Mycobacterium tuberculosis H37Rv
gucaccccgauucgugucg

SEQ ID NO: 3263113 - RNA, 17 nt, Mycobacterium tuberculosis H37Rv
gucaccccuucgccagc

SEQ ID NO: 3263114 - RNA, 22 nt, Mycobacterium tuberculosis H37Rv
gucaccccuucgccagcgccac

SEQ ID NO: 3263115 - RNA, 13 nt, Mycobacterium tuberculosis H37Rv
gucacccgcccga

SEQ ID NO: 3263116 - RNA, 22 nt, Mycobacterium tuberculosis H37Rv
gucaccgaugcgccggaccagc

SEQ ID NO: 3263117 - RNA, 15 nt, Mycobacterium tuberculosis H37Rv
gucaccgcaaccgag

SEQ ID NO: 3263118 - RNA, 18 nt, Mycobacterium tuberculosis H37Rv
gucaccgccgaccaggcc

SEQ ID NO: 3263119 - RNA, 14 nt, Mycobacterium tuberculosis H37Rv
gucaccgccggcac

SEQ ID NO: 3263120 - RNA, 18 nt, Mycobacterium tuberculosis H37Rv
gucaccgccguugccgau

SEQ ID NO: 3263121 - RNA, 18 nt, Mycobacterium tuberculosis H37Rv
gucaccgccguugccgcc

SEQ ID NO: 3263122 - RNA, 15 nt, Mycobacterium tuberculosis H37Rv
gucaccgcgaccagc

SEQ ID NO: 3263123 - RNA, 17 nt, Mycobacterium tuberculosis H37Rv
gucaccgcgacggaacc

SEQ ID NO: 3263124 - RNA, 18 nt, Mycobacterium tuberculosis H37Rv
gucaccgcggguggaugu

SEQ ID NO: 3263125 - RNA, 18 nt, Mycobacterium tuberculosis H37Rv
gucaccggaggccgccgc

SEQ ID NO: 3263126 - RNA, 13 nt, Mycobacterium tuberculosis H37Rv
gucaccggccgcc

SEQ ID NO: 3263127 - RNA, 14 nt, Mycobacterium tuberculosis H37Rv
gucaccggcgcacc

SEQ ID NO: 3263128 - RNA, 15 nt, Mycobacterium tuberculosis H37Rv
gucaccgggugcacc

SEQ ID NO: 3263129 - RNA, 21 nt, Mycobacterium tuberculosis H37Rv
gucaccggucaccgcgcagcg

SEQ ID NO: 3263130 - RNA, 14 nt, Mycobacterium tuberculosis H37Rv
gucaccggucggcc

SEQ ID NO: 3263131 - RNA, 18 nt, Mycobacterium tuberculosis H37Rv
gucaccguccacgacagc

SEQ ID NO: 3263132 - RNA, 19 nt, Mycobacterium tuberculosis H37Rv
gucaccgucugcaccggca

SEQ ID NO: 3263133 - RNA, 22 nt, Mycobacterium tuberculosis H37Rv
gucaccgucugcaccggcaggc

SEQ ID NO: 3263134 - RNA, 23 nt, Mycobacterium tuberculosis H37Rv
gucaccgucuugcacguccaagc

SEQ ID NO: 3263135 - RNA, 15 nt, Mycobacterium tuberculosis H37Rv
gucaccguuggccgc

SEQ ID NO: 3263136 - RNA, 17 nt, Mycobacterium tuberculosis H37Rv
gucaccguuggccgcgc

SEQ ID NO: 3263137 - RNA, 23 nt, Mycobacterium tuberculosis H37Rv
gucaccugcaucgucgccaagcc

SEQ ID NO: 3263138 - RNA, 17 nt, Mycobacterium tuberculosis H37Rv
gucaccugggccagcag

SEQ ID NO: 3263139 - RNA, 16 nt, Mycobacterium tuberculosis H37Rv
gucaccuucaccgggu

SEQ ID NO: 3263140 - RNA, 20 nt, Mycobacterium tuberculosis H37Rv
gucaccuucuuggcggguga

SEQ ID NO: 3263141 - RNA, 15 nt, Mycobacterium tuberculosis H37Rv
gucaccuuggccggg

SEQ ID NO: 3263142 - RNA, 19 nt, Mycobacterium tuberculosis H37Rv
gucacgaagaccaggccgg

SEQ ID NO: 3263143 - RNA, 16 nt, Mycobacterium tuberculosis H37Rv
gucacgaucacgaugu

SEQ ID NO: 3263144 - RNA, 19 nt, Mycobacterium tuberculosis H37Rv
gucacgaucacgauguccu

SEQ ID NO: 3263145 - RNA, 16 nt, Mycobacterium tuberculosis H37Rv
gucacgaucgugccgg

SEQ ID NO: 3263146 - RNA, 13 nt, Mycobacterium tuberculosis H37Rv
gucacgcaccgcg

SEQ ID NO: 3263147 - RNA, 20 nt, Mycobacterium tuberculosis H37Rv
gucacgcacucccgagccac

SEQ ID NO: 3263148 - RNA, 16 nt, Mycobacterium tuberculosis H37Rv
gucacgcagcacccug

SEQ ID NO: 3263149 - RNA, 20 nt, Mycobacterium tuberculosis H37Rv
gucacgcagccgcgcgguga

SEQ ID NO: 3263150 - RNA, 15 nt, Mycobacterium tuberculosis H37Rv
gucacgccaccgcaa

SEQ ID NO: 3263151 - RNA, 16 nt, Mycobacterium tuberculosis H37Rv
gucacgccccucacgu

SEQ ID NO: 3263152 - RNA, 13 nt, Mycobacterium tuberculosis H37Rv
gucacgcccgcga

SEQ ID NO: 3263153 - RNA, 18 nt, Mycobacterium tuberculosis H37Rv
gucacgccgucaccgcug

SEQ ID NO: 3263154 - RNA, 16 nt, Mycobacterium tuberculosis H37Rv
gucacgccugccaccg

SEQ ID NO: 3263155 - RNA, 15 nt, Mycobacterium tuberculosis H37Rv
gucacgcgaccaccg

SEQ ID NO: 3263156 - RNA, 19 nt, Mycobacterium tuberculosis H37Rv
gucacggaccgccaccuug

SEQ ID NO: 3263157 - RNA, 14 nt, Mycobacterium tuberculosis H37Rv
gucacggaccugga

SEQ ID NO: 3263158 - RNA, 15 nt, Mycobacterium tuberculosis H37Rv
gucacggaugcggcc

SEQ ID NO: 3263159 - RNA, 18 nt, Mycobacterium tuberculosis H37Rv
gucacgggguccgaugcg

SEQ ID NO: 3263160 - RNA, 12 nt, Mycobacterium tuberculosis H37Rv
gucacggugcgu

SEQ ID NO: 3263161 - RNA, 18 nt, Mycobacterium tuberculosis H37Rv
gucacggugcguucgugc

SEQ ID NO: 3263162 - RNA, 13 nt, Mycobacterium tuberculosis H37Rv
gucacgguggugu

SEQ ID NO: 3263163 - RNA, 17 nt, Mycobacterium tuberculosis H37Rv
gucacgguggugucagc

SEQ ID NO: 3263164 - RNA, 17 nt, Mycobacterium tuberculosis H37Rv
gucacguaauuccccag

SEQ ID NO: 3263165 - RNA, 17 nt, Mycobacterium tuberculosis H37Rv
gucaugaaaucgaugac

SEQ ID NO: 3263166 - RNA, 15 nt, Mycobacterium tuberculosis H37Rv
gucauggcccgaucg

SEQ ID NO: 3263167 - RNA, 21 nt, Mycobacterium tuberculosis H37Rv
gucaugggaucaggcugggca

SEQ ID NO: 3263168 - RNA, 22 nt, Mycobacterium tuberculosis H37Rv
gucaugggaucaggcugggcag

SEQ ID NO: 3263169 - RNA, 18 nt, Mycobacterium tuberculosis H37Rv
gucauguccauagccggc

SEQ ID NO: 3263170 - RNA, 13 nt, Mycobacterium tuberculosis H37Rv
gucauugcccuug

SEQ ID NO: 3263171 - RNA, 21 nt, Mycobacterium tuberculosis H37Rv
guccaaaacaccgccagcuca

SEQ ID NO: 3263172 - RNA, 13 nt, Mycobacterium tuberculosis H37Rv
guccaacagcgcc

SEQ ID NO: 3263173 - RNA, 17 nt, Mycobacterium tuberculosis H37Rv
guccaaccgggccggcu

SEQ ID NO: 3263174 - RNA, 17 nt, Mycobacterium tuberculosis H37Rv
guccaacucggcccggg

SEQ ID NO: 3263175 - RNA, 18 nt, Mycobacterium tuberculosis H37Rv
guccaacucggcccgggu

SEQ ID NO: 3263176 - RNA, 17 nt, Mycobacterium tuberculosis H37Rv
guccaagaaccacgacg

SEQ ID NO: 3263177 - RNA, 18 nt, Mycobacterium tuberculosis H37Rv
guccaagaaccacgacgu

SEQ ID NO: 3263178 - RNA, 22 nt, Mycobacterium tuberculosis H37Rv
guccaagccggcugcauccucc

SEQ ID NO: 3263179 - RNA, 20 nt, Mycobacterium tuberculosis H37Rv
guccaagccguagaccaggc

SEQ ID NO: 3263180 - RNA, 21 nt, Mycobacterium tuberculosis H37Rv
guccaagcugucaagcgggcu

SEQ ID NO: 3263181 - RNA, 17 nt, Mycobacterium tuberculosis H37Rv
guccaauacucgccauc

SEQ ID NO: 3263182 - RNA, 17 nt, Mycobacterium tuberculosis H37Rv
guccaauuccgcagaga

SEQ ID NO: 3263183 - RNA, 19 nt, Mycobacterium tuberculosis H37Rv
guccaauuccgcagagacc

SEQ ID NO: 3263184 - RNA, 16 nt, Mycobacterium tuberculosis H37Rv
guccaauuggcgucgu

SEQ ID NO: 3263185 - RNA, 14 nt, Mycobacterium tuberculosis H37Rv
guccacagccggcg

SEQ ID NO: 3263186 - RNA, 20 nt, Mycobacterium tuberculosis H37Rv
guccacaugguacggacgcu

SEQ ID NO: 3263187 - RNA, 13 nt, Mycobacterium tuberculosis H37Rv
guccaccaccugg

SEQ ID NO: 3263188 - RNA, 17 nt, Mycobacterium tuberculosis H37Rv
guccaccacgacgucgg

SEQ ID NO: 3263189 - RNA, 14 nt, Mycobacterium tuberculosis H37Rv
guccacccacgauc

SEQ ID NO: 3263190 - RNA, 14 nt, Mycobacterium tuberculosis H37Rv
guccaccccgccga

SEQ ID NO: 3263191 - RNA, 23 nt, Mycobacterium tuberculosis H37Rv
guccaccgacguggccagcccgc

SEQ ID NO: 3263192 - RNA, 19 nt, Mycobacterium tuberculosis H37Rv
guccaccgaugccacaucg

SEQ ID NO: 3263193 - RNA, 14 nt, Mycobacterium tuberculosis H37Rv
guccaccgcacgga

SEQ ID NO: 3263194 - RNA, 14 nt, Mycobacterium tuberculosis H37Rv
guccaccgccacca

SEQ ID NO: 3263195 - RNA, 20 nt, Mycobacterium tuberculosis H37Rv
guccaccgccgacauggcgg

SEQ ID NO: 3263196 - RNA, 20 nt, Mycobacterium tuberculosis H37Rv
guccaccgcggcgucgccgu

SEQ ID NO: 3263197 - RNA, 14 nt, Mycobacterium tuberculosis H37Rv
guccacgacagcag

SEQ ID NO: 3263198 - RNA, 15 nt, Mycobacterium tuberculosis H37Rv
guccacgcacugccg

SEQ ID NO: 3263199 - RNA, 22 nt, Mycobacterium tuberculosis H37Rv
guccacggcguuacguggugga

SEQ ID NO: 3263200 - RNA, 14 nt, Mycobacterium tuberculosis H37Rv
guccacgggccggg

SEQ ID NO: 3263201 - RNA, 14 nt, Mycobacterium tuberculosis H37Rv
guccacugccaccg

SEQ ID NO: 3263202 - RNA, 20 nt, Mycobacterium tuberculosis H37Rv
guccagaacgguggcgcggu

SEQ ID NO: 3263203 - RNA, 22 nt, Mycobacterium tuberculosis H37Rv
guccagaauccagguggucauc

SEQ ID NO: 3263204 - RNA, 16 nt, Mycobacterium tuberculosis H37Rv
guccagacccagcucg

SEQ ID NO: 3263205 - RNA, 17 nt, Mycobacterium tuberculosis H37Rv
guccagacccagcucgu

SEQ ID NO: 3263206 - RNA, 20 nt, Mycobacterium tuberculosis H37Rv
guccagauaggccaaccggu

SEQ ID NO: 3263207 - RNA, 23 nt, Mycobacterium tuberculosis H37Rv
guccagauagugcuccacguccg

SEQ ID NO: 3263208 - RNA, 20 nt, Mycobacterium tuberculosis H37Rv
guccagcaaaugcggcgcgu

SEQ ID NO: 3263209 - RNA, 19 nt, Mycobacterium tuberculosis H37Rv
guccagcaacagcgagcgg

SEQ ID NO: 3263210 - RNA, 19 nt, Mycobacterium tuberculosis H37Rv
guccagcaccugccguucc

SEQ ID NO: 3263211 - RNA, 22 nt, Mycobacterium tuberculosis H37Rv
guccagcagcgaaaaccgucgc

SEQ ID NO: 3263212 - RNA, 15 nt, Mycobacterium tuberculosis H37Rv
guccagcagcgacgc

SEQ ID NO: 3263213 - RNA, 20 nt, Mycobacterium tuberculosis H37Rv
guccagcagcgacgcugccg

SEQ ID NO: 3263214 - RNA, 11 nt, Mycobacterium tuberculosis H37Rv
guccagcagcu

SEQ ID NO: 3263215 - RNA, 17 nt, Mycobacterium tuberculosis H37Rv
guccagcagcucggccg

SEQ ID NO: 3263216 - RNA, 22 nt, Mycobacterium tuberculosis H37Rv
guccagcagcucggccgaggcg

SEQ ID NO: 3263217 - RNA, 15 nt, Mycobacterium tuberculosis H37Rv
guccagccaacggga

SEQ ID NO: 3263218 - RNA, 15 nt, Mycobacterium tuberculosis H37Rv
guccagccacgcugu

SEQ ID NO: 3263219 - RNA, 15 nt, Mycobacterium tuberculosis H37Rv
guccagccaggcgau

SEQ ID NO: 3263220 - RNA, 20 nt, Mycobacterium tuberculosis H37Rv
guccagcgaggagcagggcu

SEQ ID NO: 3263221 - RNA, 23 nt, Mycobacterium tuberculosis H37Rv
guccagcgcaucguugccgcaga

SEQ ID NO: 3263222 - RNA, 16 nt, Mycobacterium tuberculosis H37Rv
guccagcgccgcggcc

SEQ ID NO: 3263223 - RNA, 23 nt, Mycobacterium tuberculosis H37Rv
guccagcgccgcggcccgcucga

SEQ ID NO: 3263224 - RNA, 20 nt, Mycobacterium tuberculosis H37Rv
guccagcgcgacguccacca

SEQ ID NO: 3263225 - RNA, 21 nt, Mycobacterium tuberculosis H37Rv
guccagcgcgacguccaccag

SEQ ID NO: 3263226 - RNA, 20 nt, Mycobacterium tuberculosis H37Rv
guccagcgcgccacccagca

SEQ ID NO: 3263227 - RNA, 15 nt, Mycobacterium tuberculosis H37Rv
guccagcgcggccuu

SEQ ID NO: 3263228 - RNA, 16 nt, Mycobacterium tuberculosis H37Rv
guccagcgcggccuug

SEQ ID NO: 3263229 - RNA, 14 nt, Mycobacterium tuberculosis H37Rv
guccagcggccgcc

SEQ ID NO: 3263230 - RNA, 15 nt, Mycobacterium tuberculosis H37Rv
guccagcggccgccg

SEQ ID NO: 3263231 - RNA, 16 nt, Mycobacterium tuberculosis H37Rv
guccaggacggucgcc

SEQ ID NO: 3263232 - RNA, 20 nt, Mycobacterium tuberculosis H37Rv
guccaggcacuccagcggcg

SEQ ID NO: 3263233 - RNA, 16 nt, Mycobacterium tuberculosis H37Rv
guccaggcccuggcca

SEQ ID NO: 3263234 - RNA, 22 nt, Mycobacterium tuberculosis H37Rv
guccaggcccuggccagcccga

SEQ ID NO: 3263235 - RNA, 15 nt, Mycobacterium tuberculosis H37Rv
guccaggcgcugcag

SEQ ID NO: 3263236 - RNA, 13 nt, Mycobacterium tuberculosis H37Rv
guccagggccugu

SEQ ID NO: 3263237 - RNA, 20 nt, Mycobacterium tuberculosis H37Rv
guccaggguggucgucgucu

SEQ ID NO: 3263238 - RNA, 16 nt, Mycobacterium tuberculosis H37Rv
guccaggucggccgcc

SEQ ID NO: 3263239 - RNA, 16 nt, Mycobacterium tuberculosis H37Rv
guccagguggcgcgga

SEQ ID NO: 3263240 - RNA, 19 nt, Mycobacterium tuberculosis H37Rv
guccaguccaugugcccag

SEQ ID NO: 3263241 - RNA, 15 nt, Mycobacterium tuberculosis H37Rv
guccagugcauuccc

SEQ ID NO: 3263242 - RNA, 21 nt, Mycobacterium tuberculosis H37Rv
guccagugcauucccgccuuc

SEQ ID NO: 3263243 - RNA, 18 nt, Mycobacterium tuberculosis H37Rv
guccaguggcagccagcg

SEQ ID NO: 3263244 - RNA, 15 nt, Mycobacterium tuberculosis H37Rv
guccauaccugaaug

SEQ ID NO: 3263245 - RNA, 15 nt, Mycobacterium tuberculosis H37Rv
guccauagccggcau

SEQ ID NO: 3263246 - RNA, 20 nt, Mycobacterium tuberculosis H37Rv
guccaucaccggcggcccca

SEQ ID NO: 3263247 - RNA, 22 nt, Mycobacterium tuberculosis H37Rv
guccaucaccggcggccccagg

SEQ ID NO: 3263248 - RNA, 19 nt, Mycobacterium tuberculosis H37Rv
guccaucgcgcggcugugc

SEQ ID NO: 3263249 - RNA, 24 nt, Mycobacterium tuberculosis H37Rv
guccaucgcgcggcugugcccgau

SEQ ID NO: 3263250 - RNA, 23 nt, Mycobacterium tuberculosis H37Rv
guccaucgcgcugcggcccacac

SEQ ID NO: 3263251 - RNA, 16 nt, Mycobacterium tuberculosis H37Rv
guccaugugcccaggu

SEQ ID NO: 3263252 - RNA, 15 nt, Mycobacterium tuberculosis H37Rv
gucccaaggcguugg

SEQ ID NO: 3263253 - RNA, 19 nt, Mycobacterium tuberculosis H37Rv
gucccacaccuccucgagc

SEQ ID NO: 3263254 - RNA, 20 nt, Mycobacterium tuberculosis H37Rv
gucccacaccuucggcuggu

SEQ ID NO: 3263255 - RNA, 18 nt, Mycobacterium tuberculosis H37Rv
gucccaccagguacgcga

SEQ ID NO: 3263256 - RNA, 20 nt, Mycobacterium tuberculosis H37Rv
gucccaccagguacgcgauc

SEQ ID NO: 3263257 - RNA, 15 nt, Mycobacterium tuberculosis H37Rv
gucccacgccagcgc

SEQ ID NO: 3263258 - RNA, 18 nt, Mycobacterium tuberculosis H37Rv
gucccacugccggugcug

SEQ ID NO: 3263259 - RNA, 20 nt, Mycobacterium tuberculosis H37Rv
gucccacugcgcgucgagcg

SEQ ID NO: 3263260 - RNA, 15 nt, Mycobacterium tuberculosis H37Rv
gucccacugggccgg

SEQ ID NO: 3263261 - RNA, 19 nt, Mycobacterium tuberculosis H37Rv
guccggcccaccagcgcag

SEQ ID NO: 3263262 - RNA, 20 nt, Mycobacterium tuberculosis H37Rv
guccggcccaccagcgcagc

SEQ ID NO: 3263263 - RNA, 22 nt, Mycobacterium tuberculosis H37Rv
guccggccccccgacuccggca

SEQ ID NO: 3263264 - RNA, 19 nt, Mycobacterium tuberculosis H37Rv
guccggcccuacgcagcgc

SEQ ID NO: 3263265 - RNA, 20 nt, Mycobacterium tuberculosis H37Rv
guccggccgggggaacggga

SEQ ID NO: 3263266 - RNA, 13 nt, Mycobacterium tuberculosis H37Rv
guccggccggucc

SEQ ID NO: 3263267 - RNA, 20 nt, Mycobacterium tuberculosis H37Rv
guccggcgcccacaucgucg

SEQ ID NO: 3263268 - RNA, 19 nt, Mycobacterium tuberculosis H37Rv
guccggcggacccucgccg

SEQ ID NO: 3263269 - RNA, 14 nt, Mycobacterium tuberculosis H37Rv
guccggcggccgcc

SEQ ID NO: 3263270 - RNA, 22 nt, Mycobacterium tuberculosis H37Rv
guccggcggccgccaucagccg

SEQ ID NO: 3263271 - RNA, 14 nt, Mycobacterium tuberculosis H37Rv
guccggcgucguga

SEQ ID NO: 3263272 - RNA, 15 nt, Mycobacterium tuberculosis H37Rv
guccggcucauccga

SEQ ID NO: 3263273 - RNA, 19 nt, Mycobacterium tuberculosis H37Rv
guccggcucauccgacggg

SEQ ID NO: 3263274 - RNA, 23 nt, Mycobacterium tuberculosis H37Rv
guccggggcaacgaucagguugg

SEQ ID NO: 3263275 - RNA, 14 nt, Mycobacterium tuberculosis H37Rv
guccggggcgcagg

SEQ ID NO: 3263276 - RNA, 18 nt, Mycobacterium tuberculosis H37Rv
guccggguagacaugggu

SEQ ID NO: 3263277 - RNA, 18 nt, Mycobacterium tuberculosis H37Rv
guccggguagcggcgccg

SEQ ID NO: 3263278 - RNA, 15 nt, Mycobacterium tuberculosis H37Rv
guccgguccgucggg

SEQ ID NO: 3263279 - RNA, 17 nt, Mycobacterium tuberculosis H37Rv
guccggucgcggcgguc

SEQ ID NO: 3263280 - RNA, 14 nt, Mycobacterium tuberculosis H37Rv
guccggugcaccag

SEQ ID NO: 3263281 - RNA, 19 nt, Mycobacterium tuberculosis H37Rv
guccgguggaauccaccag

SEQ ID NO: 3263282 - RNA, 17 nt, Mycobacterium tuberculosis H37Rv
guccgguguggcgcuga

SEQ ID NO: 3263283 - RNA, 14 nt, Mycobacterium tuberculosis H37Rv
guccguccaugagg

SEQ ID NO: 3263284 - RNA, 19 nt, Mycobacterium tuberculosis H37Rv
guccgucgcguccgcgauc

SEQ ID NO: 3263285 - RNA, 14 nt, Mycobacterium tuberculosis H37Rv
guccgucggggaca

SEQ ID NO: 3263286 - RNA, 16 nt, Mycobacterium tuberculosis H37Rv
guccgucggucgccgg

SEQ ID NO: 3263287 - RNA, 16 nt, Mycobacterium tuberculosis H37Rv
guccgucgucggcguc

SEQ ID NO: 3263288 - RNA, 18 nt, Mycobacterium tuberculosis H37Rv
guccgugccgaugccggc

SEQ ID NO: 3263289 - RNA, 14 nt, Mycobacterium tuberculosis H37Rv
guccguggacaagc

SEQ ID NO: 3263290 - RNA, 19 nt, Mycobacterium tuberculosis H37Rv
guccguggacaagcacagc

SEQ ID NO: 3263291 - RNA, 15 nt, Mycobacterium tuberculosis H37Rv
guccguucaccgucu

SEQ ID NO: 3263292 - RNA, 20 nt, Mycobacterium tuberculosis H37Rv
guccuauccgggccccugau

SEQ ID NO: 3263293 - RNA, 23 nt, Mycobacterium tuberculosis H37Rv
guccucaucguuccacgagucgu

SEQ ID NO: 3263294 - RNA, 13 nt, Mycobacterium tuberculosis H37Rv
guccuccagaucc

SEQ ID NO: 3263295 - RNA, 15 nt, Mycobacterium tuberculosis H37Rv
guccuccagauccgg

SEQ ID NO: 3263296 - RNA, 20 nt, Mycobacterium tuberculosis H37Rv
guccuccccgagcgugucac

SEQ ID NO: 3263297 - RNA, 11 nt, Mycobacterium tuberculosis H37Rv
guccuccucgg

SEQ ID NO: 3263298 - RNA, 22 nt, Mycobacterium tuberculosis H37Rv
guccucgaaacgcuuacccagc

SEQ ID NO: 3263299 - RNA, 21 nt, Mycobacterium tuberculosis H37Rv
guccucgacccggcgcagcaa

SEQ ID NO: 3263300 - RNA, 20 nt, Mycobacterium tuberculosis H37Rv
guccucgacgaucagcacgu

SEQ ID NO: 3263301 - RNA, 21 nt, Mycobacterium tuberculosis H37Rv
guccucgagcggcagaugaau

SEQ ID NO: 3263302 - RNA, 19 nt, Mycobacterium tuberculosis H37Rv
guccucgagguccucgucg

SEQ ID NO: 3263303 - RNA, 21 nt, Mycobacterium tuberculosis H37Rv
guccucgagguccucgucggc

SEQ ID NO: 3263304 - RNA, 21 nt, Mycobacterium tuberculosis H37Rv
guccucgagugccgccgucgc

SEQ ID NO: 3263305 - RNA, 22 nt, Mycobacterium tuberculosis H37Rv
guccucgagugccgccgucgcc

SEQ ID NO: 3263306 - RNA, 14 nt, Mycobacterium tuberculosis H37Rv
guccucgccgcacg

SEQ ID NO: 3263307 - RNA, 19 nt, Mycobacterium tuberculosis H37Rv
guccucgcggagccgucgc

SEQ ID NO: 3263308 - RNA, 22 nt, Mycobacterium tuberculosis H37Rv
guccucgcuauugggugcagug

SEQ ID NO: 3263309 - RNA, 15 nt, Mycobacterium tuberculosis H37Rv
guccucgucggcguc

SEQ ID NO: 3263310 - RNA, 13 nt, Mycobacterium tuberculosis H37Rv
guccucgucgucg

SEQ ID NO: 3263311 - RNA, 23 nt, Mycobacterium tuberculosis H37Rv
guccucgucuucgucgguguccu

SEQ ID NO: 3263312 - RNA, 21 nt, Mycobacterium tuberculosis H37Rv
guccugaaucgguucggccag

SEQ ID NO: 3263313 - RNA, 22 nt, Mycobacterium tuberculosis H37Rv
guccugaugacucaucccgaga

SEQ ID NO: 3263314 - RNA, 16 nt, Mycobacterium tuberculosis H37Rv
guccugcagcuggcga

SEQ ID NO: 3263315 - RNA, 19 nt, Mycobacterium tuberculosis H37Rv
guccugccaguccgcagcg

SEQ ID NO: 3263316 - RNA, 19 nt, Mycobacterium tuberculosis H37Rv
guccugcgagaggugcugc

SEQ ID NO: 3263317 - RNA, 17 nt, Mycobacterium tuberculosis H37Rv
guccugcgggaggcagc

SEQ ID NO: 3263318 - RNA, 17 nt, Mycobacterium tuberculosis H37Rv
guccugcggguagguga

SEQ ID NO: 3263319 - RNA, 16 nt, Mycobacterium tuberculosis H37Rv
guccugcucgcacagc

SEQ ID NO: 3263320 - RNA, 21 nt, Mycobacterium tuberculosis H37Rv
guccugggcccgaaucgccug

SEQ ID NO: 3263321 - RNA, 15 nt, Mycobacterium tuberculosis H37Rv
guccugggccgccgc

SEQ ID NO: 3263322 - RNA, 20 nt, Mycobacterium tuberculosis H37Rv
guccuugaugcgccccauga

SEQ ID NO: 3263323 - RNA, 17 nt, Mycobacterium tuberculosis H37Rv
guccuuggacaggucga

SEQ ID NO: 3263324 - RNA, 16 nt, Mycobacterium tuberculosis H37Rv
guccuuguuguggugg

SEQ ID NO: 3263325 - RNA, 17 nt, Mycobacterium tuberculosis H37Rv
guccuuguuguggugga

SEQ ID NO: 3263326 - RNA, 18 nt, Mycobacterium tuberculosis H37Rv
gucgaaacccacguacgc

SEQ ID NO: 3263327 - RNA, 18 nt, Mycobacterium tuberculosis H37Rv
gucgaaacgguacgccgc

SEQ ID NO: 3263328 - RNA, 23 nt, Mycobacterium tuberculosis H37Rv
gucgaaacgguacgccgccgcga

SEQ ID NO: 3263329 - RNA, 13 nt, Mycobacterium tuberculosis H37Rv
gucgaaauacccg

SEQ ID NO: 3263330 - RNA, 22 nt, Mycobacterium tuberculosis H37Rv
gucgaacagcgaaccggcuggg

SEQ ID NO: 3263331 - RNA, 14 nt, Mycobacterium tuberculosis H37Rv
gucgaacaucaccg

SEQ ID NO: 3263332 - RNA, 14 nt, Mycobacterium tuberculosis H37Rv
gucgaacaugaucc

SEQ ID NO: 3263333 - RNA, 19 nt, Mycobacterium tuberculosis H37Rv
gucgaacauggcacgcggg

SEQ ID NO: 3263334 - RNA, 18 nt, Mycobacterium tuberculosis H37Rv
gucgaaccgccggcugcg

SEQ ID NO: 3263335 - RNA, 17 nt, Mycobacterium tuberculosis H37Rv
gucgaacgcaugcucga

SEQ ID NO: 3263336 - RNA, 13 nt, Mycobacterium tuberculosis H37Rv
gucgaacgguagc

SEQ ID NO: 3263337 - RNA, 15 nt, Mycobacterium tuberculosis H37Rv
gucgaacugccggac

SEQ ID NO: 3263338 - RNA, 13 nt, Mycobacterium tuberculosis H37Rv
gucgaacugggcg

SEQ ID NO: 3263339 - RNA, 22 nt, Mycobacterium tuberculosis H37Rv
gucgaacuugaucaccgcguag

SEQ ID NO: 3263340 - RNA, 19 nt, Mycobacterium tuberculosis H37Rv
gucgaagaaccggccgacg

SEQ ID NO: 3263341 - RNA, 22 nt, Mycobacterium tuberculosis H37Rv
gucgaagaaccggccgacgaac

SEQ ID NO: 3263342 - RNA, 22 nt, Mycobacterium tuberculosis H37Rv
gucgaagaauaugccgaugacc

SEQ ID NO: 3263343 - RNA, 20 nt, Mycobacterium tuberculosis H37Rv
gucgaagagguggggcagga

SEQ ID NO: 3263344 - RNA, 16 nt, Mycobacterium tuberculosis H37Rv
gucgaagauccagcgc

SEQ ID NO: 3263345 - RNA, 18 nt, Mycobacterium tuberculosis H37Rv
gucgaagaugaccugauc

SEQ ID NO: 3263346 - RNA, 22 nt, Mycobacterium tuberculosis H37Rv
gucgaagggaucacgaccgcgc

SEQ ID NO: 3263347 - RNA, 13 nt, Mycobacterium tuberculosis H37Rv
gucgaaggugacc

SEQ ID NO: 3263348 - RNA, 17 nt, Mycobacterium tuberculosis H37Rv
gucgaaguagccgacgu

SEQ ID NO: 3263349 - RNA, 20 nt, Mycobacterium tuberculosis H37Rv
gucgaagugguaguccaggg

SEQ ID NO: 3263350 - RNA, 21 nt, Mycobacterium tuberculosis H37Rv
gucgaaguuggcgaagcccga

SEQ ID NO: 3263351 - RNA, 22 nt, Mycobacterium tuberculosis H37Rv
gucgaauaguugaccaggccga

SEQ ID NO: 3263352 - RNA, 21 nt, Mycobacterium tuberculosis H37Rv
gucgaaucgcugccgccgauc

SEQ ID NO: 3263353 - RNA, 22 nt, Mycobacterium tuberculosis H37Rv
gucgaaucgcugccgccgaucg

SEQ ID NO: 3263354 - RNA, 21 nt, Mycobacterium tuberculosis H37Rv
gucgaaucuucugagacugcc

SEQ ID NO: 3263355 - RNA, 19 nt, Mycobacterium tuberculosis H37Rv
gucgacaaacagcgccauc

SEQ ID NO: 3263356 - RNA, 22 nt, Mycobacterium tuberculosis H37Rv
gucgaguucgcagucgaugagu

SEQ ID NO: 3263357 - RNA, 17 nt, Mycobacterium tuberculosis H37Rv
gucgaguuucucggcgu

SEQ ID NO: 3263358 - RNA, 17 nt, Mycobacterium tuberculosis H37Rv
gucgaguuuugcggcca

SEQ ID NO: 3263359 - RNA, 22 nt, Mycobacterium tuberculosis H37Rv
gucgaucaacaacagccgcagc

SEQ ID NO: 3263360 - RNA, 14 nt, Mycobacterium tuberculosis H37Rv
gucgaucaccugca

SEQ ID NO: 3263361 - RNA, 18 nt, Mycobacterium tuberculosis H37Rv
gucgaucacggccgucga

SEQ ID NO: 3263362 - RNA, 16 nt, Mycobacterium tuberculosis H37Rv
gucgaucacguggucc

SEQ ID NO: 3263363 - RNA, 22 nt, Mycobacterium tuberculosis H37Rv
gucgaucagaacgugacggucc

SEQ ID NO: 3263364 - RNA, 20 nt, Mycobacterium tuberculosis H37Rv
gucgaucagcgcgacggucc

SEQ ID NO: 3263365 - RNA, 17 nt, Mycobacterium tuberculosis H37Rv
gucgaucagcggcgaaa

SEQ ID NO: 3263366 - RNA, 14 nt, Mycobacterium tuberculosis H37Rv
gucgaucauggcgg

SEQ ID NO: 3263367 - RNA, 16 nt, Mycobacterium tuberculosis H37Rv
gucgauccggccagag

SEQ ID NO: 3263368 - RNA, 16 nt, Mycobacterium tuberculosis H37Rv
gucgauccggcgccau

SEQ ID NO: 3263369 - RNA, 23 nt, Mycobacterium tuberculosis H37Rv
gucgaucgccgcgauggcggucc

SEQ ID NO: 3263370 - RNA, 18 nt, Mycobacterium tuberculosis H37Rv
gucgaucguugccgcuga

SEQ ID NO: 3263371 - RNA, 13 nt, Mycobacterium tuberculosis H37Rv
gucgaucucccag

SEQ ID NO: 3263372 - RNA, 23 nt, Mycobacterium tuberculosis H37Rv
gucgaucuccgucggugagcugc

SEQ ID NO: 3263373 - RNA, 13 nt, Mycobacterium tuberculosis H37Rv
gucgaucugcccc

SEQ ID NO: 3263374 - RNA, 16 nt, Mycobacterium tuberculosis H37Rv
gucgaugacgaacgga

SEQ ID NO: 3263375 - RNA, 14 nt, Mycobacterium tuberculosis H37Rv
gucgaugacgccgu

SEQ ID NO: 3263376 - RNA, 18 nt, Mycobacterium tuberculosis H37Rv
gucgaugaggaucaucga

SEQ ID NO: 3263377 - RNA, 19 nt, Mycobacterium tuberculosis H37Rv
gucgaugaggaucaucgag

SEQ ID NO: 3263378 - RNA, 18 nt, Mycobacterium tuberculosis H37Rv
gucgaugagugacggucc

SEQ ID NO: 3263379 - RNA, 15 nt, Mycobacterium tuberculosis H37Rv
gucgaugaugccgga

SEQ ID NO: 3263380 - RNA, 12 nt, Mycobacterium tuberculosis H37Rv
gucgaugccggc

SEQ ID NO: 3263381 - RNA, 17 nt, Mycobacterium tuberculosis H37Rv
gucgaugccggcugccg

SEQ ID NO: 3263382 - RNA, 21 nt, Mycobacterium tuberculosis H37Rv
gucgaugccggcuggcggcgu

SEQ ID NO: 3263383 - RNA, 16 nt, Mycobacterium tuberculosis H37Rv
gucgaugcgcgccggc

SEQ ID NO: 3263384 - RNA, 21 nt, Mycobacterium tuberculosis H37Rv
gucgaugcgcugcucacgcag

SEQ ID NO: 3263385 - RNA, 17 nt, Mycobacterium tuberculosis H37Rv
gucgauggcugcgccga

SEQ ID NO: 3263386 - RNA, 15 nt, Mycobacterium tuberculosis H37Rv
gucgauguccgugag

SEQ ID NO: 3263387 - RNA, 15 nt, Mycobacterium tuberculosis H37Rv
gucgaugucgucgac

SEQ ID NO: 3263388 - RNA, 18 nt, Mycobacterium tuberculosis H37Rv
gucgaugucgucgacauc

SEQ ID NO: 3263389 - RNA, 21 nt, Mycobacterium tuberculosis H37Rv
gucgaugugcgguacaucgac

SEQ ID NO: 3263390 - RNA, 18 nt, Mycobacterium tuberculosis H37Rv
gucgauucgucgaaggga

SEQ ID NO: 3263391 - RNA, 20 nt, Mycobacterium tuberculosis H37Rv
gucgauugccaccgagauca

SEQ ID NO: 3263392 - RNA, 16 nt, Mycobacterium tuberculosis H37Rv
gucgauuggcucgccg

SEQ ID NO: 3263393 - RNA, 15 nt, Mycobacterium tuberculosis H37Rv
gucgauuucgaugac

SEQ ID NO: 3263394 - RNA, 15 nt, Mycobacterium tuberculosis H37Rv
gucgauuucgccguc

SEQ ID NO: 3263395 - RNA, 16 nt, Mycobacterium tuberculosis H37Rv
gucgauuucggcggcg

SEQ ID NO: 3263396 - RNA, 21 nt, Mycobacterium tuberculosis H37Rv
gucgcaaacuucgcgcacgcc

SEQ ID NO: 3263397 - RNA, 18 nt, Mycobacterium tuberculosis H37Rv
gucgcaacgcgaucaccu

SEQ ID NO: 3263398 - RNA, 16 nt, Mycobacterium tuberculosis H37Rv
gucgcaccacagugcc

SEQ ID NO: 3263399 - RNA, 15 nt, Mycobacterium tuberculosis H37Rv
gucgcaccagcgaac

SEQ ID NO: 3263400 - RNA, 20 nt, Mycobacterium tuberculosis H37Rv
gucgcaccagcgaacgcugc

SEQ ID NO: 3263401 - RNA, 23 nt, Mycobacterium tuberculosis H37Rv
gucgcacccaacuccaucagcgc

SEQ ID NO: 3263402 - RNA, 17 nt, Mycobacterium tuberculosis H37Rv
gucgcagaccagacugc

SEQ ID NO: 3263403 - RNA, 20 nt, Mycobacterium tuberculosis H37Rv
gucgcagcagaccacaacgc

SEQ ID NO: 3263404 - RNA, 16 nt, Mycobacterium tuberculosis H37Rv
gucgcaggaucggcgg

SEQ ID NO: 3263405 - RNA, 15 nt, Mycobacterium tuberculosis H37Rv
gucgcagugcacccg

SEQ ID NO: 3263406 - RNA, 22 nt, Mycobacterium tuberculosis H37Rv
gucgcauacgcccacuccagca

SEQ ID NO: 3263407 - RNA, 15 nt, Mycobacterium tuberculosis H37Rv
gucgcauucugcugc

SEQ ID NO: 3263408 - RNA, 19 nt, Mycobacterium tuberculosis H37Rv
gucgcauucugcugccagc

SEQ ID NO: 3263409 - RNA, 22 nt, Mycobacterium tuberculosis H37Rv
gucgccaacgccagcaccagcg

SEQ ID NO: 3263410 - RNA, 16 nt, Mycobacterium tuberculosis H37Rv
gucgccaagugcaggg

SEQ ID NO: 3263411 - RNA, 13 nt, Mycobacterium tuberculosis H37Rv
gucgccaccaucg

SEQ ID NO: 3263412 - RNA, 21 nt, Mycobacterium tuberculosis H37Rv
gucgccaccaucguugccggu

SEQ ID NO: 3263413 - RNA, 18 nt, Mycobacterium tuberculosis H37Rv
gucgccacccgacaugcg

SEQ ID NO: 3263414 - RNA, 14 nt, Mycobacterium tuberculosis H37Rv
gucgccaccgccgg

SEQ ID NO: 3263415 - RNA, 14 nt, Mycobacterium tuberculosis H37Rv
gucgccaccgguac

SEQ ID NO: 3263416 - RNA, 23 nt, Mycobacterium tuberculosis H37Rv
gucgccagguuaggcaauagccg

SEQ ID NO: 3263417 - RNA, 19 nt, Mycobacterium tuberculosis H37Rv
gucgccauaccugccggac

SEQ ID NO: 3263418 - RNA, 22 nt, Mycobacterium tuberculosis H37Rv
gucgcccaacaccgcgccgacg

SEQ ID NO: 3263419 - RNA, 17 nt, Mycobacterium tuberculosis H37Rv
gucgcccagccgagcgu

SEQ ID NO: 3263420 - RNA, 20 nt, Mycobacterium tuberculosis H37Rv
gucgcccagccgagcguggc

SEQ ID NO: 3263421 - RNA, 14 nt, Mycobacterium tuberculosis H37Rv
gucgccccaagcgc

SEQ ID NO: 3263422 - RNA, 17 nt, Mycobacterium tuberculosis H37Rv
gucgccccaagcgccug

SEQ ID NO: 3263423 - RNA, 14 nt, Mycobacterium tuberculosis H37Rv
gucgccccaugcgg

SEQ ID NO: 3263424 - RNA, 21 nt, Mycobacterium tuberculosis H37Rv
gucgccccguuucggucgaca

SEQ ID NO: 3263425 - RNA, 18 nt, Mycobacterium tuberculosis H37Rv
gucgcccggucucgacgg

SEQ ID NO: 3263426 - RNA, 20 nt, Mycobacterium tuberculosis H37Rv
gucgcccgugucguaccagc

SEQ ID NO: 3263427 - RNA, 17 nt, Mycobacterium tuberculosis H37Rv
gucgcccucgaucgcca

SEQ ID NO: 3263428 - RNA, 20 nt, Mycobacterium tuberculosis H37Rv
gucgcccuguucggcccgag

SEQ ID NO: 3263429 - RNA, 17 nt, Mycobacterium tuberculosis H37Rv
gucgcccuuagggucgc

SEQ ID NO: 3263430 - RNA, 18 nt, Mycobacterium tuberculosis H37Rv
gucgccgaacaccgagug

SEQ ID NO: 3263431 - RNA, 17 nt, Mycobacterium tuberculosis H37Rv
gucgccgaacagcagcc

SEQ ID NO: 3263432 - RNA, 19 nt, Mycobacterium tuberculosis H37Rv
gucgccgaacagcagcccg

SEQ ID NO: 3263433 - RNA, 16 nt, Mycobacterium tuberculosis H37Rv
gucgccgaacagcgac

SEQ ID NO: 3263434 - RNA, 21 nt, Mycobacterium tuberculosis H37Rv
gucgccgaacgccaccaccuc

SEQ ID NO: 3263435 - RNA, 18 nt, Mycobacterium tuberculosis H37Rv
gucgccgaaguuccagcc

SEQ ID NO: 3263436 - RNA, 16 nt, Mycobacterium tuberculosis H37Rv
gucgccgaccacucga

SEQ ID NO: 3263437 - RNA, 19 nt, Mycobacterium tuberculosis H37Rv
gucgccgaccacucgagcg

SEQ ID NO: 3263438 - RNA, 15 nt, Mycobacterium tuberculosis H37Rv
gucgccgacgccggu

SEQ ID NO: 3263439 - RNA, 20 nt, Mycobacterium tuberculosis H37Rv
gucgccgaggacgccggcgc

SEQ ID NO: 3263440 - RNA, 20 nt, Mycobacterium tuberculosis H37Rv
gucgccgaguaccggccagc

SEQ ID NO: 3263441 - RNA, 21 nt, Mycobacterium tuberculosis H37Rv
gucgccgaguaccggccagcc

SEQ ID NO: 3263442 - RNA, 23 nt, Mycobacterium tuberculosis H37Rv
gucgccgaguaccggccagccgc

SEQ ID NO: 3263443 - RNA, 17 nt, Mycobacterium tuberculosis H37Rv
gucgccgauaucgguga

SEQ ID NO: 3263444 - RNA, 15 nt, Mycobacterium tuberculosis H37Rv
gucgccgaucaccgc

SEQ ID NO: 3263445 - RNA, 20 nt, Mycobacterium tuberculosis H37Rv
gucgccgaucaccgcaucgg

SEQ ID NO: 3263446 - RNA, 18 nt, Mycobacterium tuberculosis H37Rv
gucgccgcaucggcggug

SEQ ID NO: 3263447 - RNA, 14 nt, Mycobacterium tuberculosis H37Rv
gucgccgccaaagc

SEQ ID NO: 3263448 - RNA, 17 nt, Mycobacterium tuberculosis H37Rv
gucgccgccaccagcgc

SEQ ID NO: 3263449 - RNA, 17 nt, Mycobacterium tuberculosis H37Rv
gucgccgccagguugcc

SEQ ID NO: 3263450 - RNA, 16 nt, Mycobacterium tuberculosis H37Rv
gucgccgcccacauga

SEQ ID NO: 3263451 - RNA, 17 nt, Mycobacterium tuberculosis H37Rv
gucgccgcccacaugaa

SEQ ID NO: 3263452 - RNA, 19 nt, Mycobacterium tuberculosis H37Rv
gucggagaacauguagguc

SEQ ID NO: 3263453 - RNA, 15 nt, Mycobacterium tuberculosis H37Rv
gucggagaacgcccg

SEQ ID NO: 3263454 - RNA, 15 nt, Mycobacterium tuberculosis H37Rv
gucggagccggccac

SEQ ID NO: 3263455 - RNA, 17 nt, Mycobacterium tuberculosis H37Rv
gucggagcggugccgac

SEQ ID NO: 3263456 - RNA, 22 nt, Mycobacterium tuberculosis H37Rv
gucggagcuagacccgucaccg

SEQ ID NO: 3263457 - RNA, 16 nt, Mycobacterium tuberculosis H37Rv
gucggaucggcgccgc

SEQ ID NO: 3263458 - RNA, 15 nt, Mycobacterium tuberculosis H37Rv
gucggcaacgacccg

SEQ ID NO: 3263459 - RNA, 22 nt, Mycobacterium tuberculosis H37Rv
gucggcaauacuccgcugacga

SEQ ID NO: 3263460 - RNA, 19 nt, Mycobacterium tuberculosis H37Rv
gucggcaaugacguacggg

SEQ ID NO: 3263461 - RNA, 22 nt, Mycobacterium tuberculosis H37Rv
gucggcaaugacguacgggguc

SEQ ID NO: 3263462 - RNA, 19 nt, Mycobacterium tuberculosis H37Rv
gucggcaccaccacgccga

SEQ ID NO: 3263463 - RNA, 14 nt, Mycobacterium tuberculosis H37Rv
gucggcacgacccg

SEQ ID NO: 3263464 - RNA, 15 nt, Mycobacterium tuberculosis H37Rv
gucggcagaccgacc

SEQ ID NO: 3263465 - RNA, 13 nt, Mycobacterium tuberculosis H37Rv
gucggcagcagcg

SEQ ID NO: 3263466 - RNA, 17 nt, Mycobacterium tuberculosis H37Rv
gucggcagcagcggugc

SEQ ID NO: 3263467 - RNA, 20 nt, Mycobacterium tuberculosis H37Rv
gucggcagcagcggugcagc

SEQ ID NO: 3263468 - RNA, 17 nt, Mycobacterium tuberculosis H37Rv
gucggcagcgacgccgg

SEQ ID NO: 3263469 - RNA, 13 nt, Mycobacterium tuberculosis H37Rv
gucggcagcgucc

SEQ ID NO: 3263470 - RNA, 15 nt, Mycobacterium tuberculosis H37Rv
gucggcagcuggggc

SEQ ID NO: 3263471 - RNA, 20 nt, Mycobacterium tuberculosis H37Rv
gucggcagcuucucgccgac

SEQ ID NO: 3263472 - RNA, 22 nt, Mycobacterium tuberculosis H37Rv
gucggcagguaccaccgcggug

SEQ ID NO: 3263473 - RNA, 21 nt, Mycobacterium tuberculosis H37Rv
gucggcauccucugaaccugc

SEQ ID NO: 3263474 - RNA, 16 nt, Mycobacterium tuberculosis H37Rv
gucggcaucggagaua

SEQ ID NO: 3263475 - RNA, 17 nt, Mycobacterium tuberculosis H37Rv
gucggcaugggccggcg

SEQ ID NO: 3263476 - RNA, 23 nt, Mycobacterium tuberculosis H37Rv
gucggccacccggacauagccgc

SEQ ID NO: 3263477 - RNA, 14 nt, Mycobacterium tuberculosis H37Rv
gucggccagcagau

SEQ ID NO: 3263478 - RNA, 22 nt, Mycobacterium tuberculosis H37Rv
gucggccagcagaucagguccu

SEQ ID NO: 3263479 - RNA, 14 nt, Mycobacterium tuberculosis H37Rv
gucggccaggccgu

SEQ ID NO: 3263480 - RNA, 17 nt, Mycobacterium tuberculosis H37Rv
gucggccaggucgagca

SEQ ID NO: 3263481 - RNA, 15 nt, Mycobacterium tuberculosis H37Rv
gucggccauccaccg

SEQ ID NO: 3263482 - RNA, 19 nt, Mycobacterium tuberculosis H37Rv
gucggccaucgaguccacc

SEQ ID NO: 3263483 - RNA, 17 nt, Mycobacterium tuberculosis H37Rv
gucggcccacggugucc

SEQ ID NO: 3263484 - RNA, 19 nt, Mycobacterium tuberculosis H37Rv
gucggcccauaacagcugg

SEQ ID NO: 3263485 - RNA, 20 nt, Mycobacterium tuberculosis H37Rv
gucggccccacaagucgcgc

SEQ ID NO: 3263486 - RNA, 20 nt, Mycobacterium tuberculosis H37Rv
gucggccccuuugucgagca

SEQ ID NO: 3263487 - RNA, 18 nt, Mycobacterium tuberculosis H37Rv
gucggcccgcucaccuug

SEQ ID NO: 3263488 - RNA, 21 nt, Mycobacterium tuberculosis H37Rv
gucggcccggugcucaagcgc

SEQ ID NO: 3263489 - RNA, 15 nt, Mycobacterium tuberculosis H37Rv
gucggcccuccaccg

SEQ ID NO: 3263490 - RNA, 21 nt, Mycobacterium tuberculosis H37Rv
gucggccgaacaaccuucggg

SEQ ID NO: 3263491 - RNA, 21 nt, Mycobacterium tuberculosis H37Rv
gucggccggaugagcgaacgc

SEQ ID NO: 3263492 - RNA, 16 nt, Mycobacterium tuberculosis H37Rv
gucggccggcggucgc

SEQ ID NO: 3263493 - RNA, 19 nt, Mycobacterium tuberculosis H37Rv
gucggccggcucguccggg

SEQ ID NO: 3263494 - RNA, 19 nt, Mycobacterium tuberculosis H37Rv
gucggccggggccacccgc

SEQ ID NO: 3263495 - RNA, 17 nt, Mycobacterium tuberculosis H37Rv
gucggccugaccgguca

SEQ ID NO: 3263496 - RNA, 20 nt, Mycobacterium tuberculosis H37Rv
gucggccugcgccggcgcug

SEQ ID NO: 3263497 - RNA, 22 nt, Mycobacterium tuberculosis H37Rv
gucggccugguacucccgcgau

SEQ ID NO: 3263498 - RNA, 15 nt, Mycobacterium tuberculosis H37Rv
gucggccuugggucg

SEQ ID NO: 3263499 - RNA, 19 nt, Mycobacterium tuberculosis H37Rv
gucggcgaacgcguccagc

SEQ ID NO: 3263500 - RNA, 21 nt, Mycobacterium tuberculosis H37Rv
gucggcgaacgcguccagcgc

SEQ ID NO: 3263501 - RNA, 23 nt, Mycobacterium tuberculosis H37Rv
gucggcgaagguguccuccagcu

SEQ ID NO: 3263502 - RNA, 17 nt, Mycobacterium tuberculosis H37Rv
gucggcgaauccgccgc

SEQ ID NO: 3263503 - RNA, 16 nt, Mycobacterium tuberculosis H37Rv
gucggcgaauuccucg

SEQ ID NO: 3263504 - RNA, 19 nt, Mycobacterium tuberculosis H37Rv
gucggcgaccaccagcgcc

SEQ ID NO: 3263505 - RNA, 14 nt, Mycobacterium tuberculosis H37Rv
gucggcgaccaggu

SEQ ID NO: 3263506 - RNA, 22 nt, Mycobacterium tuberculosis H37Rv
gucggcgaccaggucggcuucg

SEQ ID NO: 3263507 - RNA, 14 nt, Mycobacterium tuberculosis H37Rv
gucggcgacgaacc

SEQ ID NO: 3263508 - RNA, 16 nt, Mycobacterium tuberculosis H37Rv
gucggcgacggccagc

SEQ ID NO: 3263509 - RNA, 17 nt, Mycobacterium tuberculosis H37Rv
gucggcgacguccaguc

SEQ ID NO: 3263510 - RNA, 20 nt, Mycobacterium tuberculosis H37Rv
gucggcgagcaauuccucag

SEQ ID NO: 3263511 - RNA, 12 nt, Mycobacterium tuberculosis H37Rv
gucggcgagcgc

SEQ ID NO: 3263512 - RNA, 15 nt, Mycobacterium tuberculosis H37Rv
gucggcgaucaacgc

SEQ ID NO: 3263513 - RNA, 21 nt, Mycobacterium tuberculosis H37Rv
gucggcgaugaacagcgacgc

SEQ ID NO: 3263514 - RNA, 19 nt, Mycobacterium tuberculosis H37Rv
gucggcgauggccagcacg

SEQ ID NO: 3263515 - RNA, 16 nt, Mycobacterium tuberculosis H37Rv
gucggcgauggcggca

SEQ ID NO: 3263516 - RNA, 16 nt, Mycobacterium tuberculosis H37Rv
gucggcgaugucgaag

SEQ ID NO: 3263517 - RNA, 13 nt, Mycobacterium tuberculosis H37Rv
gucggcgccgagc

SEQ ID NO: 3263518 - RNA, 21 nt, Mycobacterium tuberculosis H37Rv
gucggcgccggcggccgcggu

SEQ ID NO: 3263519 - RNA, 19 nt, Mycobacterium tuberculosis H37Rv
gucggcgccucggaccaga

SEQ ID NO: 3263520 - RNA, 16 nt, Mycobacterium tuberculosis H37Rv
gucggcgcgccgcaca

SEQ ID NO: 3263521 - RNA, 14 nt, Mycobacterium tuberculosis H37Rv
gucggcgcggcugc

SEQ ID NO: 3263522 - RNA, 16 nt, Mycobacterium tuberculosis H37Rv
gucggcgcggcugccg

SEQ ID NO: 3263523 - RNA, 20 nt, Mycobacterium tuberculosis H37Rv
gucggcgcggcugccgcggu

SEQ ID NO: 3263524 - RNA, 14 nt, Mycobacterium tuberculosis H37Rv
gucggcgcggcugu

SEQ ID NO: 3263525 - RNA, 15 nt, Mycobacterium tuberculosis H37Rv
gucggcgcggcuguc

SEQ ID NO: 3263526 - RNA, 19 nt, Mycobacterium tuberculosis H37Rv
gucggcgcugcgcgcgauc

SEQ ID NO: 3263527 - RNA, 17 nt, Mycobacterium tuberculosis H37Rv
gucggcgcuggccgucg

SEQ ID NO: 3263528 - RNA, 17 nt, Mycobacterium tuberculosis H37Rv
gucggcggauucacgca

SEQ ID NO: 3263529 - RNA, 16 nt, Mycobacterium tuberculosis H37Rv
gucggcggccuccgcg

SEQ ID NO: 3263530 - RNA, 16 nt, Mycobacterium tuberculosis H37Rv
gucggcggcgaacagc

SEQ ID NO: 3263531 - RNA, 22 nt, Mycobacterium tuberculosis H37Rv
gucggcggcgaacagccccagg

SEQ ID NO: 3263532 - RNA, 18 nt, Mycobacterium tuberculosis H37Rv
gucggcggggcgccggau

SEQ ID NO: 3263533 - RNA, 13 nt, Mycobacterium tuberculosis H37Rv
gucggcggugccg

SEQ ID NO: 3263534 - RNA, 20 nt, Mycobacterium tuberculosis H37Rv
gucggcgucgaaguggguga

SEQ ID NO: 3263535 - RNA, 24 nt, Mycobacterium tuberculosis H37Rv
gucggcgucgaagugggugaaccg

SEQ ID NO: 3263536 - RNA, 22 nt, Mycobacterium tuberculosis H37Rv
gucggcgucgaauucagcugca

SEQ ID NO: 3263537 - RNA, 13 nt, Mycobacterium tuberculosis H37Rv
gucggcgucgagc

SEQ ID NO: 3263538 - RNA, 13 nt, Mycobacterium tuberculosis H37Rv
gucggcgugcagg

SEQ ID NO: 3263539 - RNA, 19 nt, Mycobacterium tuberculosis H37Rv
gucggcgugucgcgucgca

SEQ ID NO: 3263540 - RNA, 18 nt, Mycobacterium tuberculosis H37Rv
gucggcguugaucgacau

SEQ ID NO: 3263541 - RNA, 16 nt, Mycobacterium tuberculosis H37Rv
gucggcuaccgccgac

SEQ ID NO: 3263542 - RNA, 20 nt, Mycobacterium tuberculosis H37Rv
gucggcuaccgccgaccgga

SEQ ID NO: 3263543 - RNA, 13 nt, Mycobacterium tuberculosis H37Rv
gucggcuccaggu

SEQ ID NO: 3263544 - RNA, 21 nt, Mycobacterium tuberculosis H37Rv
gucggcugauuggcccaccgc

SEQ ID NO: 3263545 - RNA, 14 nt, Mycobacterium tuberculosis H37Rv
gucggcugccgcaa

SEQ ID NO: 3263546 - RNA, 13 nt, Mycobacterium tuberculosis H37Rv
gucggcugccgcg

SEQ ID NO: 3263547 - RNA, 16 nt, Mycobacterium tuberculosis H37Rv
gucggcuggacggcgc

SEQ ID NO: 3263548 - RNA, 18 nt, Mycobacterium tuberculosis H37Rv
gucguaggacaccaccgu

SEQ ID NO: 3263549 - RNA, 13 nt, Mycobacterium tuberculosis H37Rv
gucguaggccgca

SEQ ID NO: 3263550 - RNA, 18 nt, Mycobacterium tuberculosis H37Rv
gucguagucgguagcuga

SEQ ID NO: 3263551 - RNA, 20 nt, Mycobacterium tuberculosis H37Rv
gucgucaccgaugcgccgga

SEQ ID NO: 3263552 - RNA, 19 nt, Mycobacterium tuberculosis H37Rv
gucgucaccguacgggacg

SEQ ID NO: 3263553 - RNA, 19 nt, Mycobacterium tuberculosis H37Rv
gucgucaucgagcgggauc

SEQ ID NO: 3263554 - RNA, 20 nt, Mycobacterium tuberculosis H37Rv
gucgucaucgagcgggaucg

SEQ ID NO: 3263555 - RNA, 17 nt, Mycobacterium tuberculosis H37Rv
gucgucaugccagucgc

SEQ ID NO: 3263556 - RNA, 16 nt, Mycobacterium tuberculosis H37Rv
gucguccagggcgacg

SEQ ID NO: 3263557 - RNA, 23 nt, Mycobacterium tuberculosis H37Rv
gucguccaucgcgucgucuucuu

SEQ ID NO: 3263558 - RNA, 17 nt, Mycobacterium tuberculosis H37Rv
gucguccgccgcagcgc

SEQ ID NO: 3263559 - RNA, 15 nt, Mycobacterium tuberculosis H37Rv
gucguccgccugcac

SEQ ID NO: 3263560 - RNA, 18 nt, Mycobacterium tuberculosis H37Rv
gucguccgcgccaguggc

SEQ ID NO: 3263561 - RNA, 20 nt, Mycobacterium tuberculosis H37Rv
gucguccggaucggucggca

SEQ ID NO: 3263562 - RNA, 14 nt, Mycobacterium tuberculosis H37Rv
gucguccggccacg

SEQ ID NO: 3263563 - RNA, 23 nt, Mycobacterium tuberculosis H37Rv
gucgucgaaguuggcgaagcccg

SEQ ID NO: 3263564 - RNA, 18 nt, Mycobacterium tuberculosis H37Rv
gucgucgacaaacagcgc

SEQ ID NO: 3263565 - RNA, 18 nt, Mycobacterium tuberculosis H37Rv
gucgucgacacggugauc

SEQ ID NO: 3263566 - RNA, 22 nt, Mycobacterium tuberculosis H37Rv
gucgucgaccacgacguucgac

SEQ ID NO: 3263567 - RNA, 20 nt, Mycobacterium tuberculosis H37Rv
gucgucgagcaccacccggg

SEQ ID NO: 3263568 - RNA, 14 nt, Mycobacterium tuberculosis H37Rv
gucgucgagcugac

SEQ ID NO: 3263569 - RNA, 13 nt, Mycobacterium tuberculosis H37Rv
gucgucgagguca

SEQ ID NO: 3263570 - RNA, 16 nt, Mycobacterium tuberculosis H37Rv
gucgucgaggucacgc

SEQ ID NO: 3263571 - RNA, 21 nt, Mycobacterium tuberculosis H37Rv
gucgucgcaaacuucgcgcac

SEQ ID NO: 3263572 - RNA, 17 nt, Mycobacterium tuberculosis H37Rv
gucgucgcagugcaagc

SEQ ID NO: 3263573 - RNA, 22 nt, Mycobacterium tuberculosis H37Rv
gucgucgccggcggcggugcgc

SEQ ID NO: 3263574 - RNA, 16 nt, Mycobacterium tuberculosis H37Rv
gucgucgcggccgcuc

SEQ ID NO: 3263575 - RNA, 22 nt, Mycobacterium tuberculosis H37Rv
gucgucggccccacaagucgcg

SEQ ID NO: 3263576 - RNA, 23 nt, Mycobacterium tuberculosis H37Rv
gucgucggcggcgaacagcccca

SEQ ID NO: 3263577 - RNA, 13 nt, Mycobacterium tuberculosis H37Rv
gucgucggcgucg

SEQ ID NO: 3263578 - RNA, 23 nt, Mycobacterium tuberculosis H37Rv
gucgucggcgucgguggaggcgu

SEQ ID NO: 3263579 - RNA, 22 nt, Mycobacterium tuberculosis H37Rv
gucgucggugaucaccgcggcg

SEQ ID NO: 3263580 - RNA, 19 nt, Mycobacterium tuberculosis H37Rv
gucgucguagcuggcgauc

SEQ ID NO: 3263581 - RNA, 14 nt, Mycobacterium tuberculosis H37Rv
gucgucgugcaggc

SEQ ID NO: 3263582 - RNA, 23 nt, Mycobacterium tuberculosis H37Rv
gucgucguugggauccgguggug

SEQ ID NO: 3263583 - RNA, 18 nt, Mycobacterium tuberculosis H37Rv
gucgucguugugugccag

SEQ ID NO: 3263584 - RNA, 19 nt, Mycobacterium tuberculosis H37Rv
gucgucguugugugccagc

SEQ ID NO: 3263585 - RNA, 17 nt, Mycobacterium tuberculosis H37Rv
gucgucguuucgccagc

SEQ ID NO: 3263586 - RNA, 17 nt, Mycobacterium tuberculosis H37Rv
gucgugagccagcuugc

SEQ ID NO: 3263587 - RNA, 17 nt, Mycobacterium tuberculosis H37Rv
gucgugauacagcucgg

SEQ ID NO: 3263588 - RNA, 15 nt, Mycobacterium tuberculosis H37Rv
gucgugaucagcagg

SEQ ID NO: 3263589 - RNA, 16 nt, Mycobacterium tuberculosis H37Rv
gucgugaucagcagga

SEQ ID NO: 3263590 - RNA, 14 nt, Mycobacterium tuberculosis H37Rv
gucgugaucggcgu

SEQ ID NO: 3263591 - RNA, 21 nt, Mycobacterium tuberculosis H37Rv
gucgugccacuuccacggcgu

SEQ ID NO: 3263592 - RNA, 21 nt, Mycobacterium tuberculosis H37Rv
gucgugccccggcgcggucau

SEQ ID NO: 3263593 - RNA, 15 nt, Mycobacterium tuberculosis H37Rv
gucgugcccgggacc

SEQ ID NO: 3263594 - RNA, 20 nt, Mycobacterium tuberculosis H37Rv
gucgugcgacaacacgaccu

SEQ ID NO: 3263595 - RNA, 20 nt, Mycobacterium tuberculosis H37Rv
gucgugcgcggccggcacga

SEQ ID NO: 3263596 - RNA, 17 nt, Mycobacterium tuberculosis H37Rv
gucgugcucucggcgaa

SEQ ID NO: 3263597 - RNA, 18 nt, Mycobacterium tuberculosis H37Rv
gucgugcucucggcgaau

SEQ ID NO: 3263598 - RNA, 21 nt, Mycobacterium tuberculosis H37Rv
gucguggacuuuauggcuagu

SEQ ID NO: 3263599 - RNA, 14 nt, Mycobacterium tuberculosis H37Rv
gucguggagcucac

SEQ ID NO: 3263600 - RNA, 18 nt, Mycobacterium tuberculosis H37Rv
gucguggcgcucggcgag

SEQ ID NO: 3263601 - RNA, 15 nt, Mycobacterium tuberculosis H37Rv
gucguggcgguggcc

SEQ ID NO: 3263602 - RNA, 21 nt, Mycobacterium tuberculosis H37Rv
gucguggugcaacacgccggc

SEQ ID NO: 3263603 - RNA, 13 nt, Mycobacterium tuberculosis H37Rv
gucgugucgccgc

SEQ ID NO: 3263604 - RNA, 14 nt, Mycobacterium tuberculosis H37Rv
gucguuaccaggcg

SEQ ID NO: 3263605 - RNA, 17 nt, Mycobacterium tuberculosis H37Rv
gucguucccgccggcac

SEQ ID NO: 3263606 - RNA, 12 nt, Mycobacterium tuberculosis H37Rv
gucguucgccga

SEQ ID NO: 3263607 - RNA, 22 nt, Mycobacterium tuberculosis H37Rv
gucguucuccgcgccgccgaug

SEQ ID NO: 3263608 - RNA, 21 nt, Mycobacterium tuberculosis H37Rv
gucguugccggacaaccuggg

SEQ ID NO: 3263609 - RNA, 22 nt, Mycobacterium tuberculosis H37Rv
gucguugccgggucaaccggug

SEQ ID NO: 3263610 - RNA, 15 nt, Mycobacterium tuberculosis H37Rv
gucguugccguccac

SEQ ID NO: 3263611 - RNA, 13 nt, Mycobacterium tuberculosis H37Rv
gucguugcgcggu

SEQ ID NO: 3263612 - RNA, 20 nt, Mycobacterium tuberculosis H37Rv
gucguuggaaaucccuggcc

SEQ ID NO: 3263613 - RNA, 18 nt, Mycobacterium tuberculosis H37Rv
gucguuggcggcggucgg

SEQ ID NO: 3263614 - RNA, 18 nt, Mycobacterium tuberculosis H37Rv
gucguuggcucgugcccg

SEQ ID NO: 3263615 - RNA, 22 nt, Mycobacterium tuberculosis H37Rv
gucguuggcucgugcccgacca

SEQ ID NO: 3263616 - RNA, 16 nt, Mycobacterium tuberculosis H37Rv
gucucagugcucgccc

SEQ ID NO: 3263617 - RNA, 14 nt, Mycobacterium tuberculosis H37Rv
gucuccacgccguu

SEQ ID NO: 3263618 - RNA, 14 nt, Mycobacterium tuberculosis H37Rv
gucuccagcugggu

SEQ ID NO: 3263619 - RNA, 17 nt, Mycobacterium tuberculosis H37Rv
gucuccaguagccggug

SEQ ID NO: 3263620 - RNA, 19 nt, Mycobacterium tuberculosis H37Rv
gucucccagaggucgagcg

SEQ ID NO: 3263621 - RNA, 17 nt, Mycobacterium tuberculosis H37Rv
gucuccggacgcacgau

SEQ ID NO: 3263622 - RNA, 17 nt, Mycobacterium tuberculosis H37Rv
gucuccggaucgccgaa

SEQ ID NO: 3263623 - RNA, 15 nt, Mycobacterium tuberculosis H37Rv
gucuccggcaacagc

SEQ ID NO: 3263624 - RNA, 22 nt, Mycobacterium tuberculosis H37Rv
gucuccuccggaaagcucucgg

SEQ ID NO: 3263625 - RNA, 23 nt, Mycobacterium tuberculosis H37Rv
gucucgagcgcgccgcgcucgcc

SEQ ID NO: 3263626 - RNA, 19 nt, Mycobacterium tuberculosis H37Rv
gucucgcagcaacggcggc

SEQ ID NO: 3263627 - RNA, 15 nt, Mycobacterium tuberculosis H37Rv
gucucgccgaccuug

SEQ ID NO: 3263628 - RNA, 17 nt, Mycobacterium tuberculosis H37Rv
gucucgccgcgcaccga

SEQ ID NO: 3263629 - RNA, 21 nt, Mycobacterium tuberculosis H37Rv
gucucggaaacggaccuccuc

SEQ ID NO: 3263630 - RNA, 13 nt, Mycobacterium tuberculosis H37Rv
gucucggccacga

SEQ ID NO: 3263631 - RNA, 15 nt, Mycobacterium tuberculosis H37Rv
gucucggcgguggcg

SEQ ID NO: 3263632 - RNA, 22 nt, Mycobacterium tuberculosis H37Rv
gucucgggcgcgggugaccagg

SEQ ID NO: 3263633 - RNA, 15 nt, Mycobacterium tuberculosis H37Rv
gucucggucagcccc

SEQ ID NO: 3263634 - RNA, 16 nt, Mycobacterium tuberculosis H37Rv
gucucggugcagcagc

SEQ ID NO: 3263635 - RNA, 20 nt, Mycobacterium tuberculosis H37Rv
gucucgguggcugcgccgga

SEQ ID NO: 3263636 - RNA, 15 nt, Mycobacterium tuberculosis H37Rv
gucucgucaaccugc

SEQ ID NO: 3263637 - RNA, 13 nt, Mycobacterium tuberculosis H37Rv
gucucgucggcaa

SEQ ID NO: 3263638 - RNA, 18 nt, Mycobacterium tuberculosis H37Rv
gucucugucauugcugcc

SEQ ID NO: 3263639 - RNA, 17 nt, Mycobacterium tuberculosis H37Rv
gucugaaccgccccggu

SEQ ID NO: 3263640 - RNA, 15 nt, Mycobacterium tuberculosis H37Rv
gucugagcgccggca

SEQ ID NO: 3263641 - RNA, 15 nt, Mycobacterium tuberculosis H37Rv
gucugcagugcagcg

SEQ ID NO: 3263642 - RNA, 17 nt, Mycobacterium tuberculosis H37Rv
gucugcagugcagcgau

SEQ ID NO: 3263643 - RNA, 12 nt, Mycobacterium tuberculosis H37Rv
gucugccagcac

SEQ ID NO: 3263644 - RNA, 21 nt, Mycobacterium tuberculosis H37Rv
gugacccccagcagggugugc

SEQ ID NO: 3263645 - RNA, 23 nt, Mycobacterium tuberculosis H37Rv
gugacccgacaugguccgaccag

SEQ ID NO: 3263646 - RNA, 23 nt, Mycobacterium tuberculosis H37Rv
gugacccgcuauucggcggcaug

SEQ ID NO: 3263647 - RNA, 17 nt, Mycobacterium tuberculosis H37Rv
gugacccgugcggccac

SEQ ID NO: 3263648 - RNA, 15 nt, Mycobacterium tuberculosis H37Rv
gugacccucagcacc

SEQ ID NO: 3263649 - RNA, 19 nt, Mycobacterium tuberculosis H37Rv
gugacccucagcaccgcug

SEQ ID NO: 3263650 - RNA, 23 nt, Mycobacterium tuberculosis H37Rv
gugacccugggguugcaucaugc

SEQ ID NO: 3263651 - RNA, 17 nt, Mycobacterium tuberculosis H37Rv
gugaccgaacaacagcg

SEQ ID NO: 3263652 - RNA, 17 nt, Mycobacterium tuberculosis H37Rv
gugaccgacugcggguu

SEQ ID NO: 3263653 - RNA, 13 nt, Mycobacterium tuberculosis H37Rv
gugaccgccgaug

SEQ ID NO: 3263654 - RNA, 16 nt, Mycobacterium tuberculosis H37Rv
gugaccgccgcgccgg

SEQ ID NO: 3263655 - RNA, 22 nt, Mycobacterium tuberculosis H37Rv
gugaccgcuggugugucccggg

SEQ ID NO: 3263656 - RNA, 19 nt, Mycobacterium tuberculosis H37Rv
gugaccggcaaugccacgg

SEQ ID NO: 3263657 - RNA, 23 nt, Mycobacterium tuberculosis H37Rv
gugaccggcgaucgggcggguga

SEQ ID NO: 3263658 - RNA, 18 nt, Mycobacterium tuberculosis H37Rv
gugaccguauuucgucca

SEQ ID NO: 3263659 - RNA, 16 nt, Mycobacterium tuberculosis H37Rv
gugaccgucagcccga

SEQ ID NO: 3263660 - RNA, 16 nt, Mycobacterium tuberculosis H37Rv
gugaccuaccuccucg

SEQ ID NO: 3263661 - RNA, 21 nt, Mycobacterium tuberculosis H37Rv
gugaccucaccaaccgcccga

SEQ ID NO: 3263662 - RNA, 15 nt, Mycobacterium tuberculosis H37Rv
gugaccucggcgacc

SEQ ID NO: 3263663 - RNA, 20 nt, Mycobacterium tuberculosis H37Rv
gugaccuguuuggggcugug

SEQ ID NO: 3263664 - RNA, 20 nt, Mycobacterium tuberculosis H37Rv
gugacgaaagagcgguacgg

SEQ ID NO: 3263665 - RNA, 13 nt, Mycobacterium tuberculosis H37Rv
gugacgaucccca

SEQ ID NO: 3263666 - RNA, 16 nt, Mycobacterium tuberculosis H37Rv
gugacgaucgacagcc

SEQ ID NO: 3263667 - RNA, 17 nt, Mycobacterium tuberculosis H37Rv
gugacgauucgagcaac

SEQ ID NO: 3263668 - RNA, 16 nt, Mycobacterium tuberculosis H37Rv
gugacgauugccacca

SEQ ID NO: 3263669 - RNA, 16 nt, Mycobacterium tuberculosis H37Rv
gugacgcgcgccggau

SEQ ID NO: 3263670 - RNA, 24 nt, Mycobacterium tuberculosis H37Rv
gugacggaguuggcccgacgcagc

SEQ ID NO: 3263671 - RNA, 14 nt, Mycobacterium tuberculosis H37Rv
gugacggcggcugu

SEQ ID NO: 3263672 - RNA, 14 nt, Mycobacterium tuberculosis H37Rv
gugacgggacccgg

SEQ ID NO: 3263673 - RNA, 17 nt, Mycobacterium tuberculosis H37Rv
gugacgguccacgacgu

SEQ ID NO: 3263674 - RNA, 18 nt, Mycobacterium tuberculosis H37Rv
gugacgguggccggcaac

SEQ ID NO: 3263675 - RNA, 14 nt, Mycobacterium tuberculosis H37Rv
gugacguaccacgg

SEQ ID NO: 3263676 - RNA, 16 nt, Mycobacterium tuberculosis H37Rv
gugacguagggcagcg

SEQ ID NO: 3263677 - RNA, 19 nt, Mycobacterium tuberculosis H37Rv
gugacguagggcagcgcca

SEQ ID NO: 3263678 - RNA, 21 nt, Mycobacterium tuberculosis H37Rv
gugacguagggcagcgccagg

SEQ ID NO: 3263679 - RNA, 14 nt, Mycobacterium tuberculosis H37Rv
gugacgucgccggg

SEQ ID NO: 3263680 - RNA, 16 nt, Mycobacterium tuberculosis H37Rv
gugacgucgccgggcg

SEQ ID NO: 3263681 - RNA, 13 nt, Mycobacterium tuberculosis H37Rv
gugacgugguggg

SEQ ID NO: 3263682 - RNA, 17 nt, Mycobacterium tuberculosis H37Rv
gugacguggugggcuug

SEQ ID NO: 3263683 - RNA, 17 nt, Mycobacterium tuberculosis H37Rv
gugacguuccgcucgcc

SEQ ID NO: 3263684 - RNA, 16 nt, Mycobacterium tuberculosis H37Rv
gugacguugucgccaa

SEQ ID NO: 3263685 - RNA, 15 nt, Mycobacterium tuberculosis H37Rv
gugacguugugccuu

SEQ ID NO: 3263686 - RNA, 19 nt, Mycobacterium tuberculosis H37Rv
gugacuccgcgcgcggaca

SEQ ID NO: 3263687 - RNA, 19 nt, Mycobacterium tuberculosis H37Rv
gugacucgggcacggguga

SEQ ID NO: 3263688 - RNA, 19 nt, Mycobacterium tuberculosis H37Rv
gugacugcgcgcguugcgg

SEQ ID NO: 3263689 - RNA, 24 nt, Mycobacterium tuberculosis H37Rv
gugagaucaugaggugagcugcgg

SEQ ID NO: 3263690 - RNA, 15 nt, Mycobacterium tuberculosis H37Rv
gugagauggcgguga

SEQ ID NO: 3263691 - RNA, 17 nt, Mycobacterium tuberculosis H37Rv
gugagauggcggugagc

SEQ ID NO: 3263692 - RNA, 19 nt, Mycobacterium tuberculosis H37Rv
gugagcaccagcagcacca

SEQ ID NO: 3263693 - RNA, 15 nt, Mycobacterium tuberculosis H37Rv
gugagcauggcuagg

SEQ ID NO: 3263694 - RNA, 14 nt, Mycobacterium tuberculosis H37Rv
gugagccacgcgca

SEQ ID NO: 3263695 - RNA, 20 nt, Mycobacterium tuberculosis H37Rv
gugagccauacgcgcugacc

SEQ ID NO: 3263696 - RNA, 15 nt, Mycobacterium tuberculosis H37Rv
gugagcccguugacc

SEQ ID NO: 3263697 - RNA, 19 nt, Mycobacterium tuberculosis H37Rv
gugagcccguugaccugcg

SEQ ID NO: 3263698 - RNA, 17 nt, Mycobacterium tuberculosis H37Rv
gugagccgguggcccgc

SEQ ID NO: 3263699 - RNA, 20 nt, Mycobacterium tuberculosis H37Rv
gugagccgguggcccgccgg

SEQ ID NO: 3263700 - RNA, 18 nt, Mycobacterium tuberculosis H37Rv
gugagcgaucgggugcac

SEQ ID NO: 3263701 - RNA, 19 nt, Mycobacterium tuberculosis H37Rv
gugagcgcagcuugauccc

SEQ ID NO: 3263702 - RNA, 11 nt, Mycobacterium tuberculosis H37Rv
gugagcgggca

SEQ ID NO: 3263703 - RNA, 20 nt, Mycobacterium tuberculosis H37Rv
gugagcuacucacggugauc

SEQ ID NO: 3263704 - RNA, 18 nt, Mycobacterium tuberculosis H37Rv
gugagcuaugcuggcagc

SEQ ID NO: 3263705 - RNA, 15 nt, Mycobacterium tuberculosis H37Rv
gugagcucggcugcu

SEQ ID NO: 3263706 - RNA, 16 nt, Mycobacterium tuberculosis H37Rv
gugagcucggcugcuc

SEQ ID NO: 3263707 - RNA, 20 nt, Mycobacterium tuberculosis H37Rv
gugagcucggcugcucgacg

SEQ ID NO: 3263708 - RNA, 14 nt, Mycobacterium tuberculosis H37Rv
gugagcugcggggu

SEQ ID NO: 3263709 - RNA, 14 nt, Mycobacterium tuberculosis H37Rv
gugagcugcucacg

SEQ ID NO: 3263710 - RNA, 14 nt, Mycobacterium tuberculosis H37Rv
gugagcuuagcgca

SEQ ID NO: 3263711 - RNA, 23 nt, Mycobacterium tuberculosis H37Rv
gugagcuuagcgcaugggccuug

SEQ ID NO: 3263712 - RNA, 18 nt, Mycobacterium tuberculosis H37Rv
gugaggaaccccggucgg

SEQ ID NO: 3263713 - RNA, 15 nt, Mycobacterium tuberculosis H37Rv
gugaggccaaccaca

SEQ ID NO: 3263714 - RNA, 12 nt, Mycobacterium tuberculosis H37Rv
gugaggcccccc

SEQ ID NO: 3263715 - RNA, 17 nt, Mycobacterium tuberculosis H37Rv
gugaggccgaccagcac

SEQ ID NO: 3263716 - RNA, 14 nt, Mycobacterium tuberculosis H37Rv
gugaggcgaccgga

SEQ ID NO: 3263717 - RNA, 19 nt, Mycobacterium tuberculosis H37Rv
gugaguaccaauccaggcc

SEQ ID NO: 3263718 - RNA, 15 nt, Mycobacterium tuberculosis H37Rv
gugaguacggugugc

SEQ ID NO: 3263719 - RNA, 15 nt, Mycobacterium tuberculosis H37Rv
gugagucccacgcca

SEQ ID NO: 3263720 - RNA, 16 nt, Mycobacterium tuberculosis H37Rv
gugagucccacgccag

SEQ ID NO: 3263721 - RNA, 23 nt, Mycobacterium tuberculosis H37Rv
gugauacagcgccaggggugugc

SEQ ID NO: 3263722 - RNA, 17 nt, Mycobacterium tuberculosis H37Rv
gugauacagcucggugc

SEQ ID NO: 3263723 - RNA, 12 nt, Mycobacterium tuberculosis H37Rv
gugaucagcgca

SEQ ID NO: 3263724 - RNA, 18 nt, Mycobacterium tuberculosis H37Rv
gugaucagcgcaucgccg

SEQ ID NO: 3263725 - RNA, 17 nt, Mycobacterium tuberculosis H37Rv
gugaucccgauggucac

SEQ ID NO: 3263726 - RNA, 14 nt, Mycobacterium tuberculosis H37Rv
gugaucccgcccaa

SEQ ID NO: 3263727 - RNA, 16 nt, Mycobacterium tuberculosis H37Rv
gugauccgagaccaug

SEQ ID NO: 3263728 - RNA, 16 nt, Mycobacterium tuberculosis H37Rv
gugaucgaggcggcgg

SEQ ID NO: 3263729 - RNA, 18 nt, Mycobacterium tuberculosis H37Rv
gugaucgcauuggcggcg

SEQ ID NO: 3263730 - RNA, 14 nt, Mycobacterium tuberculosis H37Rv
gugaucuuguccgg

SEQ ID NO: 3263731 - RNA, 18 nt, Mycobacterium tuberculosis H37Rv
gugaugaacgacauccgg

SEQ ID NO: 3263732 - RNA, 19 nt, Mycobacterium tuberculosis H37Rv
gugaugaauucgcuugcag

SEQ ID NO: 3263733 - RNA, 14 nt, Mycobacterium tuberculosis H37Rv
gugaugagucaggc

SEQ ID NO: 3263734 - RNA, 17 nt, Mycobacterium tuberculosis H37Rv
gugaugcaugcuaggca

SEQ ID NO: 3263735 - RNA, 12 nt, Mycobacterium tuberculosis H37Rv
gugaugccacgg

SEQ ID NO: 3263736 - RNA, 16 nt, Mycobacterium tuberculosis H37Rv
gugaugccaucaacga

SEQ ID NO: 3263737 - RNA, 13 nt, Mycobacterium tuberculosis H37Rv
gugaugcccuggg

SEQ ID NO: 3263738 - RNA, 17 nt, Mycobacterium tuberculosis H37Rv
gugaugcccugggggug

SEQ ID NO: 3263739 - RNA, 19 nt, Mycobacterium tuberculosis H37Rv
gugaugcccuggggguggc

SEQ ID NO: 3263740 - RNA, 13 nt, Mycobacterium tuberculosis H37Rv
gugaugccgauga

SEQ ID NO: 3263741 - RNA, 12 nt, Mycobacterium tuberculosis H37Rv
gugccagcugcc

SEQ ID NO: 3263742 - RNA, 21 nt, Mycobacterium tuberculosis H37Rv
gugccaggucggcgggcgcgg

SEQ ID NO: 3263743 - RNA, 14 nt, Mycobacterium tuberculosis H37Rv
gugccaguccgaug

SEQ ID NO: 3263744 - RNA, 22 nt, Mycobacterium tuberculosis H37Rv
gugccauccuuaugcgcgguga

SEQ ID NO: 3263745 - RNA, 15 nt, Mycobacterium tuberculosis H37Rv
gugccaucgggcgcg

SEQ ID NO: 3263746 - RNA, 22 nt, Mycobacterium tuberculosis H37Rv
gugccaucuacaucgucgagcg

SEQ ID NO: 3263747 - RNA, 19 nt, Mycobacterium tuberculosis H37Rv
gugcccaaggccaggaucu

SEQ ID NO: 3263748 - RNA, 16 nt, Mycobacterium tuberculosis H37Rv
gugcccaccaccgaca

SEQ ID NO: 3263749 - RNA, 18 nt, Mycobacterium tuberculosis H37Rv
gugcccaccaccgacagc

SEQ ID NO: 3263750 - RNA, 16 nt, Mycobacterium tuberculosis H37Rv
gugcccagcagcgcga

SEQ ID NO: 3263751 - RNA, 15 nt, Mycobacterium tuberculosis H37Rv
gugcccaggaaggcg

SEQ ID NO: 3263752 - RNA, 18 nt, Mycobacterium tuberculosis H37Rv
gugcccaggaaggcgacg

SEQ ID NO: 3263753 - RNA, 18 nt, Mycobacterium tuberculosis H37Rv
gugcccccggugccgccc

SEQ ID NO: 3263754 - RNA, 15 nt, Mycobacterium tuberculosis H37Rv
gugccccgagcugcc

SEQ ID NO: 3263755 - RNA, 11 nt, Mycobacterium tuberculosis H37Rv
gugccccgccg

SEQ ID NO: 3263756 - RNA, 15 nt, Mycobacterium tuberculosis H37Rv
gugccccgccgagcg

SEQ ID NO: 3263757 - RNA, 12 nt, Mycobacterium tuberculosis H37Rv
gugcccgaccac

SEQ ID NO: 3263758 - RNA, 23 nt, Mycobacterium tuberculosis H37Rv
gugcccgaccacaagcagugugg

SEQ ID NO: 3263759 - RNA, 13 nt, Mycobacterium tuberculosis H37Rv
gugcccgaucagc

SEQ ID NO: 3263760 - RNA, 12 nt, Mycobacterium tuberculosis H37Rv
gugcccgcacca

SEQ ID NO: 3263761 - RNA, 17 nt, Mycobacterium tuberculosis H37Rv
gugcccgcacugccgcc

SEQ ID NO: 3263762 - RNA, 21 nt, Mycobacterium tuberculosis H37Rv
gugcccgcacugccgccgguu

SEQ ID NO: 3263763 - RNA, 21 nt, Mycobacterium tuberculosis H37Rv
gugcccgcgcggcgcauuccg

SEQ ID NO: 3263764 - RNA, 19 nt, Mycobacterium tuberculosis H37Rv
gugcccgcguugccaaagc

SEQ ID NO: 3263765 - RNA, 20 nt, Mycobacterium tuberculosis H37Rv
gugcccggcuccuccccggc

SEQ ID NO: 3263766 - RNA, 17 nt, Mycobacterium tuberculosis H37Rv
gugcccgggaccauagc

SEQ ID NO: 3263767 - RNA, 15 nt, Mycobacterium tuberculosis H37Rv
gugcccgggcgucaa

SEQ ID NO: 3263768 - RNA, 19 nt, Mycobacterium tuberculosis H37Rv
gugcccguauaaccggcca

SEQ ID NO: 3263769 - RNA, 14 nt, Mycobacterium tuberculosis H37Rv
gugccgaacaggga

SEQ ID NO: 3263770 - RNA, 16 nt, Mycobacterium tuberculosis H37Rv
gugccgaacgccagac

SEQ ID NO: 3263771 - RNA, 20 nt, Mycobacterium tuberculosis H37Rv
gugccgaagaugaccgcucg

SEQ ID NO: 3263772 - RNA, 21 nt, Mycobacterium tuberculosis H37Rv
gugccgaagaugaccgcucgu

SEQ ID NO: 3263773 - RNA, 13 nt, Mycobacterium tuberculosis H37Rv
gugccgaccagca

SEQ ID NO: 3263774 - RNA, 20 nt, Mycobacterium tuberculosis H37Rv
gugccgacccgcuucgcccg

SEQ ID NO: 3263775 - RNA, 22 nt, Mycobacterium tuberculosis H37Rv
gugccgacccgcuucgcccggc

SEQ ID NO: 3263776 - RNA, 13 nt, Mycobacterium tuberculosis H37Rv
gugccgaccgcgu

SEQ ID NO: 3263777 - RNA, 20 nt, Mycobacterium tuberculosis H37Rv
gugccgaccgcguuuugcag

SEQ ID NO: 3263778 - RNA, 16 nt, Mycobacterium tuberculosis H37Rv
gugccgacgccccgau

SEQ ID NO: 3263779 - RNA, 13 nt, Mycobacterium tuberculosis H37Rv
gugccgacggcgc

SEQ ID NO: 3263780 - RNA, 22 nt, Mycobacterium tuberculosis H37Rv
gugccgagaauuccccagccgc

SEQ ID NO: 3263781 - RNA, 21 nt, Mycobacterium tuberculosis H37Rv
gugccgagaucccagcgggac

SEQ ID NO: 3263782 - RNA, 13 nt, Mycobacterium tuberculosis H37Rv
gugccgagcuggc

SEQ ID NO: 3263783 - RNA, 19 nt, Mycobacterium tuberculosis H37Rv
gugccgagcuugucgagca

SEQ ID NO: 3263784 - RNA, 16 nt, Mycobacterium tuberculosis H37Rv
gugccgaguuccugca

SEQ ID NO: 3263785 - RNA, 22 nt, Mycobacterium tuberculosis H37Rv
gugccgaguuccugcacgguca

SEQ ID NO: 3263786 - RNA, 14 nt, Mycobacterium tuberculosis H37Rv
gugccgaugaccga

SEQ ID NO: 3263787 - RNA, 18 nt, Mycobacterium tuberculosis H37Rv
gugccgaugccggcgagg

SEQ ID NO: 3263788 - RNA, 18 nt, Mycobacterium tuberculosis H37Rv
gugccgauuggccugcca

SEQ ID NO: 3263789 - RNA, 13 nt, Mycobacterium tuberculosis H37Rv
gugccgcacagcg

SEQ ID NO: 3263790 - RNA, 14 nt, Mycobacterium tuberculosis H37Rv
gugccgcacagcgg

SEQ ID NO: 3263791 - RNA, 22 nt, Mycobacterium tuberculosis H37Rv
gugccgcacagcggauucggcg

SEQ ID NO: 3263792 - RNA, 12 nt, Mycobacterium tuberculosis H37Rv
gugccgcagcag

SEQ ID NO: 3263793 - RNA, 14 nt, Mycobacterium tuberculosis H37Rv
gugccgccaccacc

SEQ ID NO: 3263794 - RNA, 20 nt, Mycobacterium tuberculosis H37Rv
gugccgccaccgccaccgcg

SEQ ID NO: 3263795 - RNA, 15 nt, Mycobacterium tuberculosis H37Rv
gugccgccaccggcg

SEQ ID NO: 3263796 - RNA, 14 nt, Mycobacterium tuberculosis H37Rv
gugccgccagcaac

SEQ ID NO: 3263797 - RNA, 15 nt, Mycobacterium tuberculosis H37Rv
gugccgccaucgccg

SEQ ID NO: 3263798 - RNA, 23 nt, Mycobacterium tuberculosis H37Rv
gugccgccaucgccgccggugcc

SEQ ID NO: 3263799 - RNA, 19 nt, Mycobacterium tuberculosis H37Rv
gugccgcccaccacacagc

SEQ ID NO: 3263800 - RNA, 11 nt, Mycobacterium tuberculosis H37Rv
gugccgcccag

SEQ ID NO: 3263801 - RNA, 17 nt, Mycobacterium tuberculosis H37Rv
gugccgcccucaccgcc

SEQ ID NO: 3263802 - RNA, 13 nt, Mycobacterium tuberculosis H37Rv
gugccgccgacac

SEQ ID NO: 3263803 - RNA, 17 nt, Mycobacterium tuberculosis H37Rv
gugccgccgacaccacc

SEQ ID NO: 3263804 - RNA, 13 nt, Mycobacterium tuberculosis H37Rv
gugccgccgaugu

SEQ ID NO: 3263805 - RNA, 20 nt, Mycobacterium tuberculosis H37Rv
gugccgccgaugucgacgac

SEQ ID NO: 3263806 - RNA, 13 nt, Mycobacterium tuberculosis H37Rv
gugccgccgcaga

SEQ ID NO: 3263807 - RNA, 14 nt, Mycobacterium tuberculosis H37Rv
gugccgccgcagau

SEQ ID NO: 3263808 - RNA, 16 nt, Mycobacterium tuberculosis H37Rv
gugccgccgcggccac

SEQ ID NO: 3263809 - RNA, 15 nt, Mycobacterium tuberculosis H37Rv
gugccgccggccagu

SEQ ID NO: 3263810 - RNA, 17 nt, Mycobacterium tuberculosis H37Rv
gugccgccgggggacga

SEQ ID NO: 3263811 - RNA, 17 nt, Mycobacterium tuberculosis H37Rv
gugccgccuccgccugc

SEQ ID NO: 3263812 - RNA, 18 nt, Mycobacterium tuberculosis H37Rv
gugccgccugcgccgcca

SEQ ID NO: 3263813 - RNA, 14 nt, Mycobacterium tuberculosis H37Rv
gugccgcgcagcug

SEQ ID NO: 3263814 - RNA, 12 nt, Mycobacterium tuberculosis H37Rv
gugccgcggcca

SEQ ID NO: 3263815 - RNA, 13 nt, Mycobacterium tuberculosis H37Rv
gugccgcggccac

SEQ ID NO: 3263816 - RNA, 15 nt, Mycobacterium tuberculosis H37Rv
gugccgcggccaccg

SEQ ID NO: 3263817 - RNA, 18 nt, Mycobacterium tuberculosis H37Rv
gugccgcggcuaggccaa

SEQ ID NO: 3263818 - RNA, 23 nt, Mycobacterium tuberculosis H37Rv
gugccgcgucaaccgaucggucg

SEQ ID NO: 3263819 - RNA, 18 nt, Mycobacterium tuberculosis H37Rv
gugccgcugcauccgcag

SEQ ID NO: 3263820 - RNA, 12 nt, Mycobacterium tuberculosis H37Rv
gugccggcagcg

SEQ ID NO: 3263821 - RNA, 13 nt, Mycobacterium tuberculosis H37Rv
gugccggcagcgg

SEQ ID NO: 3263822 - RNA, 22 nt, Mycobacterium tuberculosis H37Rv
gugccggcagcgguggcaagcc

SEQ ID NO: 3263823 - RNA, 18 nt, Mycobacterium tuberculosis H37Rv
gugccggcauagaucggg

SEQ ID NO: 3263824 - RNA, 16 nt, Mycobacterium tuberculosis H37Rv
gugccggcccugcucg

SEQ ID NO: 3263825 - RNA, 19 nt, Mycobacterium tuberculosis H37Rv
gugccggcgaaccccagcg

SEQ ID NO: 3263826 - RNA, 15 nt, Mycobacterium tuberculosis H37Rv
gugccggcgacgcua

SEQ ID NO: 3263827 - RNA, 16 nt, Mycobacterium tuberculosis H37Rv
gugccggcgccgcccu

SEQ ID NO: 3263828 - RNA, 22 nt, Mycobacterium tuberculosis H37Rv
gugccggcggaucugaucggcg

SEQ ID NO: 3263829 - RNA, 12 nt, Mycobacterium tuberculosis H37Rv
gugccggcguua

SEQ ID NO: 3263830 - RNA, 15 nt, Mycobacterium tuberculosis H37Rv
gugccgggaucgccg

SEQ ID NO: 3263831 - RNA, 21 nt, Mycobacterium tuberculosis H37Rv
gugccgggccauucaccgcgc

SEQ ID NO: 3263832 - RNA, 22 nt, Mycobacterium tuberculosis H37Rv
gugccgggccauucaccgcgca

SEQ ID NO: 3263833 - RNA, 19 nt, Mycobacterium tuberculosis H37Rv
gugccggggauaucacgac

SEQ ID NO: 3263834 - RNA, 21 nt, Mycobacterium tuberculosis H37Rv
gugccggggauaucacgacgc

SEQ ID NO: 3263835 - RNA, 16 nt, Mycobacterium tuberculosis H37Rv
gugccggggccccaug

SEQ ID NO: 3263836 - RNA, 22 nt, Mycobacterium tuberculosis H37Rv
gugccggggccccaugccgacc

SEQ ID NO: 3263837 - RNA, 20 nt, Mycobacterium tuberculosis H37Rv
gugccggggcugccgccguu

SEQ ID NO: 3263838 - RNA, 19 nt, Mycobacterium tuberculosis H37Rv
gugcgguaucggucagcca

SEQ ID NO: 3263839 - RNA, 23 nt, Mycobacterium tuberculosis H37Rv
gugcgguauuugaacgcccgcuu

SEQ ID NO: 3263840 - RNA, 14 nt, Mycobacterium tuberculosis H37Rv
gugcggucaaagga

SEQ ID NO: 3263841 - RNA, 15 nt, Mycobacterium tuberculosis H37Rv
gugcggucgucaccg

SEQ ID NO: 3263842 - RNA, 14 nt, Mycobacterium tuberculosis H37Rv
gugcggucucgacc

SEQ ID NO: 3263843 - RNA, 16 nt, Mycobacterium tuberculosis H37Rv
gugcggugagauggcg

SEQ ID NO: 3263844 - RNA, 18 nt, Mycobacterium tuberculosis H37Rv
gugcggugccguggugga

SEQ ID NO: 3263845 - RNA, 13 nt, Mycobacterium tuberculosis H37Rv
gugcgguggugcg

SEQ ID NO: 3263846 - RNA, 17 nt, Mycobacterium tuberculosis H37Rv
gugcggugucacaacgc

SEQ ID NO: 3263847 - RNA, 15 nt, Mycobacterium tuberculosis H37Rv
gugcgguugcgcgga

SEQ ID NO: 3263848 - RNA, 18 nt, Mycobacterium tuberculosis H37Rv
gugcgguuucaccgacga

SEQ ID NO: 3263849 - RNA, 22 nt, Mycobacterium tuberculosis H37Rv
gugcguacugguccgcacgguu

SEQ ID NO: 3263850 - RNA, 15 nt, Mycobacterium tuberculosis H37Rv
gugcgucacagccgg

SEQ ID NO: 3263851 - RNA, 15 nt, Mycobacterium tuberculosis H37Rv
gugcgucgacccagc

SEQ ID NO: 3263852 - RNA, 18 nt, Mycobacterium tuberculosis H37Rv
gugcgucgaugccggugu

SEQ ID NO: 3263853 - RNA, 20 nt, Mycobacterium tuberculosis H37Rv
gugcgucgaugccggugugc

SEQ ID NO: 3263854 - RNA, 13 nt, Mycobacterium tuberculosis H37Rv
gugcgucucggug

SEQ ID NO: 3263855 - RNA, 18 nt, Mycobacterium tuberculosis H37Rv
gugcguguaccuguccag

SEQ ID NO: 3263856 - RNA, 17 nt, Mycobacterium tuberculosis H37Rv
gugcguuggaugaaguc

SEQ ID NO: 3263857 - RNA, 21 nt, Mycobacterium tuberculosis H37Rv
gugcuacccauucggcggcgg

SEQ ID NO: 3263858 - RNA, 20 nt, Mycobacterium tuberculosis H37Rv
gugcuaccggcuuggcggga

SEQ ID NO: 3263859 - RNA, 15 nt, Mycobacterium tuberculosis H37Rv
gugcuauggccgcac

SEQ ID NO: 3263860 - RNA, 17 nt, Mycobacterium tuberculosis H37Rv
gugcucaaggcuucggc

SEQ ID NO: 3263861 - RNA, 17 nt, Mycobacterium tuberculosis H37Rv
gugcucacauccgguca

SEQ ID NO: 3263862 - RNA, 13 nt, Mycobacterium tuberculosis H37Rv
gugcucacggcgg

SEQ ID NO: 3263863 - RNA, 20 nt, Mycobacterium tuberculosis H37Rv
gugcucagcgcgcgccgcug

SEQ ID NO: 3263864 - RNA, 22 nt, Mycobacterium tuberculosis H37Rv
gugcucagcgcgcgccgcuggg

SEQ ID NO: 3263865 - RNA, 17 nt, Mycobacterium tuberculosis H37Rv
gugcuccaccucgguac

SEQ ID NO: 3263866 - RNA, 21 nt, Mycobacterium tuberculosis H37Rv
gugcucgcaaucguuggccau

SEQ ID NO: 3263867 - RNA, 17 nt, Mycobacterium tuberculosis H37Rv
gugcucgccgaccagcu

SEQ ID NO: 3263868 - RNA, 12 nt, Mycobacterium tuberculosis H37Rv
gugcucgccgau

SEQ ID NO: 3263869 - RNA, 20 nt, Mycobacterium tuberculosis H37Rv
gugcucgccguaagcaccag

SEQ ID NO: 3263870 - RNA, 21 nt, Mycobacterium tuberculosis H37Rv
gugcucggaggcgaucaggau

SEQ ID NO: 3263871 - RNA, 20 nt, Mycobacterium tuberculosis H37Rv
gugcucggaucggcucgcca

SEQ ID NO: 3263872 - RNA, 12 nt, Mycobacterium tuberculosis H37Rv
gugcucggugac

SEQ ID NO: 3263873 - RNA, 15 nt, Mycobacterium tuberculosis H37Rv
gugcucucgcucgug

SEQ ID NO: 3263874 - RNA, 17 nt, Mycobacterium tuberculosis H37Rv
gugcugaccccgccggc

SEQ ID NO: 3263875 - RNA, 14 nt, Mycobacterium tuberculosis H37Rv
gugcugaccgcgcc

SEQ ID NO: 3263876 - RNA, 20 nt, Mycobacterium tuberculosis H37Rv
gugcugagucgguucagcca

SEQ ID NO: 3263877 - RNA, 21 nt, Mycobacterium tuberculosis H37Rv
gugcugagucgguucagccac

SEQ ID NO: 3263878 - RNA, 17 nt, Mycobacterium tuberculosis H37Rv
gugcugaugggucaggc

SEQ ID NO: 3263879 - RNA, 14 nt, Mycobacterium tuberculosis H37Rv
gugcugcaccgauu

SEQ ID NO: 3263880 - RNA, 18 nt, Mycobacterium tuberculosis H37Rv
gugcugcaccgauucggg

SEQ ID NO: 3263881 - RNA, 19 nt, Mycobacterium tuberculosis H37Rv
gugcugcaccguuuccggc

SEQ ID NO: 3263882 - RNA, 17 nt, Mycobacterium tuberculosis H37Rv
gugcugccauugccgca

SEQ ID NO: 3263883 - RNA, 23 nt, Mycobacterium tuberculosis H37Rv
gugcugccggagacacccgccag

SEQ ID NO: 3263884 - RNA, 14 nt, Mycobacterium tuberculosis H37Rv
gugcugcgcgcggc

SEQ ID NO: 3263885 - RNA, 17 nt, Mycobacterium tuberculosis H37Rv
gugcugcgcugucuugc

SEQ ID NO: 3263886 - RNA, 12 nt, Mycobacterium tuberculosis H37Rv
gugcugcggcug

SEQ ID NO: 3263887 - RNA, 13 nt, Mycobacterium tuberculosis H37Rv
gugcugcucgaca

SEQ ID NO: 3263888 - RNA, 21 nt, Mycobacterium tuberculosis H37Rv
gugcuggaaguaguccccaac

SEQ ID NO: 3263889 - RNA, 11 nt, Mycobacterium tuberculosis H37Rv
gugcuggcagg

SEQ ID NO: 3263890 - RNA, 15 nt, Mycobacterium tuberculosis H37Rv
gugcuggcgcaacca

SEQ ID NO: 3263891 - RNA, 20 nt, Mycobacterium tuberculosis H37Rv
gugcugggcaucaccgacgc

SEQ ID NO: 3263892 - RNA, 20 nt, Mycobacterium tuberculosis H37Rv
gugcuggggguaccucccgc

SEQ ID NO: 3263893 - RNA, 14 nt, Mycobacterium tuberculosis H37Rv
gugcugguccaggc

SEQ ID NO: 3263894 - RNA, 14 nt, Mycobacterium tuberculosis H37Rv
gugcuggucgccgc

SEQ ID NO: 3263895 - RNA, 18 nt, Mycobacterium tuberculosis H37Rv
gugcuggugguaucggcg

SEQ ID NO: 3263896 - RNA, 20 nt, Mycobacterium tuberculosis H37Rv
gugcuguggaugccgacggc

SEQ ID NO: 3263897 - RNA, 21 nt, Mycobacterium tuberculosis H37Rv
gugcuguggucggugccagca

SEQ ID NO: 3263898 - RNA, 17 nt, Mycobacterium tuberculosis H37Rv
gugcuugcccgguugug

SEQ ID NO: 3263899 - RNA, 14 nt, Mycobacterium tuberculosis H37Rv
gugcuuggggucac

SEQ ID NO: 3263900 - RNA, 22 nt, Mycobacterium tuberculosis H37Rv
guggaaacugaugucgccgauu

SEQ ID NO: 3263901 - RNA, 14 nt, Mycobacterium tuberculosis H37Rv
guggaacaccgcgg

SEQ ID NO: 3263902 - RNA, 18 nt, Mycobacterium tuberculosis H37Rv
guggaacauccgcacugg

SEQ ID NO: 3263903 - RNA, 22 nt, Mycobacterium tuberculosis H37Rv
guggaagauguugccgccgguc

SEQ ID NO: 3263904 - RNA, 19 nt, Mycobacterium tuberculosis H37Rv
guggaagguguuggugcgg

SEQ ID NO: 3263905 - RNA, 23 nt, Mycobacterium tuberculosis H37Rv
guggacaaaucgaugaccgucgc

SEQ ID NO: 3263906 - RNA, 18 nt, Mycobacterium tuberculosis H37Rv
guggacaccugcugcacc

SEQ ID NO: 3263907 - RNA, 17 nt, Mycobacterium tuberculosis H37Rv
guggacagaaucgaccg

SEQ ID NO: 3263908 - RNA, 19 nt, Mycobacterium tuberculosis H37Rv
guggacagaugcauccagc

SEQ ID NO: 3263909 - RNA, 22 nt, Mycobacterium tuberculosis H37Rv
guggacaucgggcggcaccgcu

SEQ ID NO: 3263910 - RNA, 12 nt, Mycobacterium tuberculosis H37Rv
guggaccgccga

SEQ ID NO: 3263911 - RNA, 14 nt, Mycobacterium tuberculosis H37Rv
guggaccggccugg

SEQ ID NO: 3263912 - RNA, 22 nt, Mycobacterium tuberculosis H37Rv
guggacggcauagcagccagcg

SEQ ID NO: 3263913 - RNA, 22 nt, Mycobacterium tuberculosis H37Rv
guggacgugucaucacggucag

SEQ ID NO: 3263914 - RNA, 21 nt, Mycobacterium tuberculosis H37Rv
guggacuucagcaggcccagc

SEQ ID NO: 3263915 - RNA, 16 nt, Mycobacterium tuberculosis H37Rv
guggagcucgcggcgc

SEQ ID NO: 3263916 - RNA, 19 nt, Mycobacterium tuberculosis H37Rv
guggagggcccggccggac

SEQ ID NO: 3263917 - RNA, 12 nt, Mycobacterium tuberculosis H37Rv
guggaucaccau

SEQ ID NO: 3263918 - RNA, 13 nt, Mycobacterium tuberculosis H37Rv
guggaucugaaga

SEQ ID NO: 3263919 - RNA, 23 nt, Mycobacterium tuberculosis H37Rv
guggaugcgccgcacggcgacgc

SEQ ID NO: 3263920 - RNA, 19 nt, Mycobacterium tuberculosis H37Rv
guggauggccgccaggcgc

SEQ ID NO: 3263921 - RNA, 17 nt, Mycobacterium tuberculosis H37Rv
guggaugucgcggucga

SEQ ID NO: 3263922 - RNA, 21 nt, Mycobacterium tuberculosis H37Rv
guggauucgaucaggccuugg

SEQ ID NO: 3263923 - RNA, 15 nt, Mycobacterium tuberculosis H37Rv
guggcaaccgcaccg

SEQ ID NO: 3263924 - RNA, 13 nt, Mycobacterium tuberculosis H37Rv
guggcaacgguac

SEQ ID NO: 3263925 - RNA, 20 nt, Mycobacterium tuberculosis H37Rv
guggcaacgguacgcgcuga

SEQ ID NO: 3263926 - RNA, 21 nt, Mycobacterium tuberculosis H37Rv
guggcaagccuaaaaccccga

SEQ ID NO: 3263927 - RNA, 12 nt, Mycobacterium tuberculosis H37Rv
guggcaaucccg

SEQ ID NO: 3263928 - RNA, 14 nt, Mycobacterium tuberculosis H37Rv
guggcagagccgcc

SEQ ID NO: 3263929 - RNA, 17 nt, Mycobacterium tuberculosis H37Rv
guggcagagccgccguu

SEQ ID NO: 3263930 - RNA, 12 nt, Mycobacterium tuberculosis H37Rv
guggcagccagc

SEQ ID NO: 3263931 - RNA, 14 nt, Mycobacterium tuberculosis H37Rv
guggcagccugcug

SEQ ID NO: 3263932 - RNA, 15 nt, Mycobacterium tuberculosis H37Rv
guggcagccugcugc

SEQ ID NO: 3263933 - RNA, 18 nt, Mycobacterium tuberculosis H37Rv
guggcagccugcugcaca

SEQ ID NO: 3263934 - RNA, 22 nt, Mycobacterium tuberculosis H37Rv
gugggaacuggaccacagccgc

SEQ ID NO: 3263935 - RNA, 22 nt, Mycobacterium tuberculosis H37Rv
gugggacaccaucuccgccguc

SEQ ID NO: 3263936 - RNA, 13 nt, Mycobacterium tuberculosis H37Rv
gugggacaggucg

SEQ ID NO: 3263937 - RNA, 15 nt, Mycobacterium tuberculosis H37Rv
gugggacaggucggc

SEQ ID NO: 3263938 - RNA, 16 nt, Mycobacterium tuberculosis H37Rv
gugggacuggcgugaa

SEQ ID NO: 3263939 - RNA, 18 nt, Mycobacterium tuberculosis H37Rv
gugggacuggcgugaacg

SEQ ID NO: 3263940 - RNA, 21 nt, Mycobacterium tuberculosis H37Rv
gugggagcuacccgggccagg

SEQ ID NO: 3263941 - RNA, 17 nt, Mycobacterium tuberculosis H37Rv
gugggagguggcgcggg

SEQ ID NO: 3263942 - RNA, 18 nt, Mycobacterium tuberculosis H37Rv
gugggauucugacgaccg

SEQ ID NO: 3263943 - RNA, 21 nt, Mycobacterium tuberculosis H37Rv
gugggcaauccggucagcgcg

SEQ ID NO: 3263944 - RNA, 15 nt, Mycobacterium tuberculosis H37Rv
gugggcacagcgacc

SEQ ID NO: 3263945 - RNA, 11 nt, Mycobacterium tuberculosis H37Rv
gugggcagcag

SEQ ID NO: 3263946 - RNA, 18 nt, Mycobacterium tuberculosis H37Rv
gugggcagcagcuggucg

SEQ ID NO: 3263947 - RNA, 20 nt, Mycobacterium tuberculosis H37Rv
gugggcagcgcgaucaccga

SEQ ID NO: 3263948 - RNA, 21 nt, Mycobacterium tuberculosis H37Rv
gugggcauugcggcgcgggug

SEQ ID NO: 3263949 - RNA, 14 nt, Mycobacterium tuberculosis H37Rv
gugggccagcagca

SEQ ID NO: 3263950 - RNA, 15 nt, Mycobacterium tuberculosis H37Rv
gugggccagcagcaa

SEQ ID NO: 3263951 - RNA, 21 nt, Mycobacterium tuberculosis H37Rv
gugggccagguuuugccgcgu

SEQ ID NO: 3263952 - RNA, 14 nt, Mycobacterium tuberculosis H37Rv
gugggccggcggua

SEQ ID NO: 3263953 - RNA, 16 nt, Mycobacterium tuberculosis H37Rv
gugggccguggguguc

SEQ ID NO: 3263954 - RNA, 19 nt, Mycobacterium tuberculosis H37Rv
gugggccucgaucagcgcc

SEQ ID NO: 3263955 - RNA, 15 nt, Mycobacterium tuberculosis H37Rv
gugggcgacgaggca

SEQ ID NO: 3263956 - RNA, 17 nt, Mycobacterium tuberculosis H37Rv
gugggcgacggcggcgu

SEQ ID NO: 3263957 - RNA, 23 nt, Mycobacterium tuberculosis H37Rv
gugggcgacggcggcgucgauga

SEQ ID NO: 3263958 - RNA, 16 nt, Mycobacterium tuberculosis H37Rv
gugggcgacgucaucg

SEQ ID NO: 3263959 - RNA, 22 nt, Mycobacterium tuberculosis H37Rv
gugggcgagucgggggccgcgu

SEQ ID NO: 3263960 - RNA, 14 nt, Mycobacterium tuberculosis H37Rv
gugggcgaucggcg

SEQ ID NO: 3263961 - RNA, 15 nt, Mycobacterium tuberculosis H37Rv
gugggcgccgacacc

SEQ ID NO: 3263962 - RNA, 21 nt, Mycobacterium tuberculosis H37Rv
gugggcgccgacaccggcuga

SEQ ID NO: 3263963 - RNA, 13 nt, Mycobacterium tuberculosis H37Rv
gugggcgccgcaa

SEQ ID NO: 3263964 - RNA, 22 nt, Mycobacterium tuberculosis H37Rv
gugggcgccgcaaccgccgcgu

SEQ ID NO: 3263965 - RNA, 13 nt, Mycobacterium tuberculosis H37Rv
gugggcgcuguca

SEQ ID NO: 3263966 - RNA, 20 nt, Mycobacterium tuberculosis H37Rv
gugggcggaacgaugccggc

SEQ ID NO: 3263967 - RNA, 13 nt, Mycobacterium tuberculosis H37Rv
gugggcggccggg

SEQ ID NO: 3263968 - RNA, 18 nt, Mycobacterium tuberculosis H37Rv
gugggcggcgagcgcgau

SEQ ID NO: 3263969 - RNA, 23 nt, Mycobacterium tuberculosis H37Rv
gugggcggguucggacgagguca

SEQ ID NO: 3263970 - RNA, 18 nt, Mycobacterium tuberculosis H37Rv
gugggcgugacgggcagg

SEQ ID NO: 3263971 - RNA, 19 nt, Mycobacterium tuberculosis H37Rv
gugggcgugacguagugca

SEQ ID NO: 3263972 - RNA, 15 nt, Mycobacterium tuberculosis H37Rv
gugggcgugagcgcg

SEQ ID NO: 3263973 - RNA, 18 nt, Mycobacterium tuberculosis H37Rv
gugggcgugagcgcgcgc

SEQ ID NO: 3263974 - RNA, 17 nt, Mycobacterium tuberculosis H37Rv
gugggcguggcugguca

SEQ ID NO: 3263975 - RNA, 19 nt, Mycobacterium tuberculosis H37Rv
gugggcguggcuggucaug

SEQ ID NO: 3263976 - RNA, 21 nt, Mycobacterium tuberculosis H37Rv
gugggcguugucuagcuggug

SEQ ID NO: 3263977 - RNA, 19 nt, Mycobacterium tuberculosis H37Rv
gugggcuaggucgcgcuga

SEQ ID NO: 3263978 - RNA, 15 nt, Mycobacterium tuberculosis H37Rv
gugggcuuggcugug

SEQ ID NO: 3263979 - RNA, 16 nt, Mycobacterium tuberculosis H37Rv
gugggcuuggugccca

SEQ ID NO: 3263980 - RNA, 21 nt, Mycobacterium tuberculosis H37Rv
gugggcuuuugcgucugcucg

SEQ ID NO: 3263981 - RNA, 13 nt, Mycobacterium tuberculosis H37Rv
guggggaucgacc

SEQ ID NO: 3263982 - RNA, 17 nt, Mycobacterium tuberculosis H37Rv
guggggccggggucggc

SEQ ID NO: 3263983 - RNA, 22 nt, Mycobacterium tuberculosis H37Rv
guggggccguguucuaccugca

SEQ ID NO: 3263984 - RNA, 17 nt, Mycobacterium tuberculosis H37Rv
guggggcggcuugggcg

SEQ ID NO: 3263985 - RNA, 21 nt, Mycobacterium tuberculosis H37Rv
guggggcguuagggccgccau

SEQ ID NO: 3263986 - RNA, 17 nt, Mycobacterium tuberculosis H37Rv
guggggguccggcggcc

SEQ ID NO: 3263987 - RNA, 16 nt, Mycobacterium tuberculosis H37Rv
guggggucgccgucga

SEQ ID NO: 3263988 - RNA, 15 nt, Mycobacterium tuberculosis H37Rv
gugggguugcgcggu

SEQ ID NO: 3263989 - RNA, 20 nt, Mycobacterium tuberculosis H37Rv
gugggucaacgucaggcccu

SEQ ID NO: 3263990 - RNA, 17 nt, Mycobacterium tuberculosis H37Rv
gugggucaagaucggug

SEQ ID NO: 3263991 - RNA, 19 nt, Mycobacterium tuberculosis H37Rv
gugggucaagaucggugcc

SEQ ID NO: 3263992 - RNA, 20 nt, Mycobacterium tuberculosis H37Rv
gugggugaaccggaccuggg

SEQ ID NO: 3263993 - RNA, 17 nt, Mycobacterium tuberculosis H37Rv
gugggugagcgaccugg

SEQ ID NO: 3263994 - RNA, 13 nt, Mycobacterium tuberculosis H37Rv
gugggugaggcca

SEQ ID NO: 3263995 - RNA, 19 nt, Mycobacterium tuberculosis H37Rv
guggguguugaugggcagc

SEQ ID NO: 3263996 - RNA, 22 nt, Mycobacterium tuberculosis H37Rv
guggguguuguugugggugguc

SEQ ID NO: 3263997 - RNA, 16 nt, Mycobacterium tuberculosis H37Rv
gugguaacaccggcga

SEQ ID NO: 3263998 - RNA, 20 nt, Mycobacterium tuberculosis H37Rv
gugguaacaccggcgagugc

SEQ ID NO: 3263999 - RNA, 16 nt, Mycobacterium tuberculosis H37Rv
gugguaaccagggcag

SEQ ID NO: 3264000 - RNA, 16 nt, Mycobacterium tuberculosis H37Rv
gugguaccggcggcgc

SEQ ID NO: 3264001 - RNA, 23 nt, Mycobacterium tuberculosis H37Rv
gugguaggucuuagcggcccgug

SEQ ID NO: 3264002 - RNA, 13 nt, Mycobacterium tuberculosis H37Rv
gugguaucgccgg

SEQ ID NO: 3264003 - RNA, 15 nt, Mycobacterium tuberculosis H37Rv
guggucaacggccga

SEQ ID NO: 3264004 - RNA, 14 nt, Mycobacterium tuberculosis H37Rv
guggucagcaccca

SEQ ID NO: 3264005 - RNA, 14 nt, Mycobacterium tuberculosis H37Rv
guggucagccggug

SEQ ID NO: 3264006 - RNA, 14 nt, Mycobacterium tuberculosis H37Rv
guggucagcugcug

SEQ ID NO: 3264007 - RNA, 22 nt, Mycobacterium tuberculosis H37Rv
guggucagucaccaaccacaug

SEQ ID NO: 3264008 - RNA, 21 nt, Mycobacterium tuberculosis H37Rv
guggucaucgccacgccugcu

SEQ ID NO: 3264009 - RNA, 14 nt, Mycobacterium tuberculosis H37Rv
gugguccaaccggg

SEQ ID NO: 3264010 - RNA, 11 nt, Mycobacterium tuberculosis H37Rv
gugguccagcc

SEQ ID NO: 3264011 - RNA, 20 nt, Mycobacterium tuberculosis H37Rv
gugguccuuguuguggugga

SEQ ID NO: 3264012 - RNA, 21 nt, Mycobacterium tuberculosis H37Rv
guggucgaacucgccccgcgu

SEQ ID NO: 3264013 - RNA, 21 nt, Mycobacterium tuberculosis H37Rv
guggucgguggcuacgcccca

SEQ ID NO: 3264014 - RNA, 16 nt, Mycobacterium tuberculosis H37Rv
guggucguaggugacg

SEQ ID NO: 3264015 - RNA, 17 nt, Mycobacterium tuberculosis H37Rv
guggucuccggcaccga

SEQ ID NO: 3264016 - RNA, 13 nt, Mycobacterium tuberculosis H37Rv
guggucucgacgg

SEQ ID NO: 3264017 - RNA, 19 nt, Mycobacterium tuberculosis H37Rv
guggucucgauaucaguga

SEQ ID NO: 3264018 - RNA, 18 nt, Mycobacterium tuberculosis H37Rv
guggucugccaaaagggc

SEQ ID NO: 3264019 - RNA, 15 nt, Mycobacterium tuberculosis H37Rv
guggucugcgcggug

SEQ ID NO: 3264020 - RNA, 16 nt, Mycobacterium tuberculosis H37Rv
guggucuuggcccggc

SEQ ID NO: 3264021 - RNA, 17 nt, Mycobacterium tuberculosis H37Rv
guggucuuggcgguggc

SEQ ID NO: 3264022 - RNA, 21 nt, Mycobacterium tuberculosis H37Rv
guggucuuggcgguggcccga

SEQ ID NO: 3264023 - RNA, 20 nt, Mycobacterium tuberculosis H37Rv
guggugaccgacgcggacag

SEQ ID NO: 3264024 - RNA, 13 nt, Mycobacterium tuberculosis H37Rv
guggugaguacca

SEQ ID NO: 3264025 - RNA, 14 nt, Mycobacterium tuberculosis H37Rv
guggugcgcuggcc

SEQ ID NO: 3264026 - RNA, 21 nt, Mycobacterium tuberculosis H37Rv
guggugcugaccgcgccggac

SEQ ID NO: 3264027 - RNA, 18 nt, Mycobacterium tuberculosis H37Rv
gugguggaacuccgggug

SEQ ID NO: 3264028 - RNA, 16 nt, Mycobacterium tuberculosis H37Rv
gugguggacgaugcgg

SEQ ID NO: 3264029 - RNA, 21 nt, Mycobacterium tuberculosis H37Rv
gugguggcgaucugggugccg

SEQ ID NO: 3264030 - RNA, 17 nt, Mycobacterium tuberculosis H37Rv
guguugagcggcagcca

SEQ ID NO: 3264031 - RNA, 23 nt, Mycobacterium tuberculosis H37Rv
guguugcacguacgggcaguggu

SEQ ID NO: 3264032 - RNA, 13 nt, Mycobacterium tuberculosis H37Rv
guguugcaguggc

SEQ ID NO: 3264033 - RNA, 19 nt, Mycobacterium tuberculosis H37Rv
guguugccagaucagcacc

SEQ ID NO: 3264034 - RNA, 21 nt, Mycobacterium tuberculosis H37Rv
guguugcgcugcggccagcgc

SEQ ID NO: 3264035 - RNA, 13 nt, Mycobacterium tuberculosis H37Rv
guguugcgguggg

SEQ ID NO: 3264036 - RNA, 14 nt, Mycobacterium tuberculosis H37Rv
guguugcucccggc

SEQ ID NO: 3264037 - RNA, 23 nt, Mycobacterium tuberculosis H37Rv
guguuggaaaagaucuucgccga

SEQ ID NO: 3264038 - RNA, 23 nt, Mycobacterium tuberculosis H37Rv
guguugggagccaccggcgucga

SEQ ID NO: 3264039 - RNA, 16 nt, Mycobacterium tuberculosis H37Rv
guguuguugaagcccg

SEQ ID NO: 3264040 - RNA, 22 nt, Mycobacterium tuberculosis H37Rv
guguuguugaagggggcgucgu

SEQ ID NO: 3264041 - RNA, 15 nt, Mycobacterium tuberculosis H37Rv
guguuucaggcagcg

SEQ ID NO: 3264042 - RNA, 16 nt, Mycobacterium tuberculosis H37Rv
guguuuggguuuuguu

SEQ ID NO: 3264043 - RNA, 17 nt, Mycobacterium tuberculosis H37Rv
guuaacacccugggcaa

SEQ ID NO: 3264044 - RNA, 18 nt, Mycobacterium tuberculosis H37Rv
guuaacacccugggcaaa

SEQ ID NO: 3264045 - RNA, 22 nt, Mycobacterium tuberculosis H37Rv
guuacaccaucaaggacucgga

SEQ ID NO: 3264046 - RNA, 17 nt, Mycobacterium tuberculosis H37Rv
guuaccaggcguggacg

SEQ ID NO: 3264047 - RNA, 21 nt, Mycobacterium tuberculosis H37Rv
guuaccgaccgcgugcaccga

SEQ ID NO: 3264048 - RNA, 21 nt, Mycobacterium tuberculosis H37Rv
guuaccgccaaacgcugcgcc

SEQ ID NO: 3264049 - RNA, 18 nt, Mycobacterium tuberculosis H37Rv
guuaccgccgucgccgaa

SEQ ID NO: 3264050 - RNA, 12 nt, Mycobacterium tuberculosis H37Rv
guuacucaccaa

SEQ ID NO: 3264051 - RNA, 18 nt, Mycobacterium tuberculosis H37Rv
guuacucaccaaccgcau

SEQ ID NO: 3264052 - RNA, 19 nt, Mycobacterium tuberculosis H37Rv
guuagaucacccgcagccg

SEQ ID NO: 3264053 - RNA, 18 nt, Mycobacterium tuberculosis H37Rv
guuagccgcggcccgcgu

SEQ ID NO: 3264054 - RNA, 23 nt, Mycobacterium tuberculosis H37Rv
guuagcgcggccagcagcagaug

SEQ ID NO: 3264055 - RNA, 22 nt, Mycobacterium tuberculosis H37Rv
guuagcguagcccgaguuguug

SEQ ID NO: 3264056 - RNA, 14 nt, Mycobacterium tuberculosis H37Rv
guuaggguccaggu

SEQ ID NO: 3264057 - RNA, 21 nt, Mycobacterium tuberculosis H37Rv
guuagguggcuggcugugccg

SEQ ID NO: 3264058 - RNA, 21 nt, Mycobacterium tuberculosis H37Rv
guuaucccagacugucgagcg

SEQ ID NO: 3264059 - RNA, 14 nt, Mycobacterium tuberculosis H37Rv
guuauccccuggcc

SEQ ID NO: 3264060 - RNA, 15 nt, Mycobacterium tuberculosis H37Rv
guuauugaugcccga

SEQ ID NO: 3264061 - RNA, 20 nt, Mycobacterium tuberculosis H37Rv
guucaaccggacgaccggaa

SEQ ID NO: 3264062 - RNA, 20 nt, Mycobacterium tuberculosis H37Rv
guucaacgcgcgcacgccac

SEQ ID NO: 3264063 - RNA, 14 nt, Mycobacterium tuberculosis H37Rv
guucacccagcggc

SEQ ID NO: 3264064 - RNA, 21 nt, Mycobacterium tuberculosis H37Rv
guucaccgaggugccgcgcag

SEQ ID NO: 3264065 - RNA, 18 nt, Mycobacterium tuberculosis H37Rv
guucacgccgccggagau

SEQ ID NO: 3264066 - RNA, 17 nt, Mycobacterium tuberculosis H37Rv
guucacggggaccagau

SEQ ID NO: 3264067 - RNA, 13 nt, Mycobacterium tuberculosis H37Rv
guucagcaggccc

SEQ ID NO: 3264068 - RNA, 17 nt, Mycobacterium tuberculosis H37Rv
guucagccaggccgcaa

SEQ ID NO: 3264069 - RNA, 17 nt, Mycobacterium tuberculosis H37Rv
guucagcgaccaaugca

SEQ ID NO: 3264070 - RNA, 20 nt, Mycobacterium tuberculosis H37Rv
guucagcgcuggcaggccgg

SEQ ID NO: 3264071 - RNA, 17 nt, Mycobacterium tuberculosis H37Rv
guucagcggccagcagu

SEQ ID NO: 3264072 - RNA, 15 nt, Mycobacterium tuberculosis H37Rv
guucagcgucgacug

SEQ ID NO: 3264073 - RNA, 23 nt, Mycobacterium tuberculosis H37Rv
guucaucacgccgccggagguga

SEQ ID NO: 3264074 - RNA, 14 nt, Mycobacterium tuberculosis H37Rv
guucauccacuccg

SEQ ID NO: 3264075 - RNA, 18 nt, Mycobacterium tuberculosis H37Rv
guucauccgcaguccggg

SEQ ID NO: 3264076 - RNA, 20 nt, Mycobacterium tuberculosis H37Rv
guucaugcaaaagccgcgau

SEQ ID NO: 3264077 - RNA, 16 nt, Mycobacterium tuberculosis H37Rv
guucaugcggcggcgc

SEQ ID NO: 3264078 - RNA, 23 nt, Mycobacterium tuberculosis H37Rv
guucaugcggcggcgcucgucga

SEQ ID NO: 3264079 - RNA, 24 nt, Mycobacterium tuberculosis H37Rv
guucauguagcagcgcggcuuggc

SEQ ID NO: 3264080 - RNA, 16 nt, Mycobacterium tuberculosis H37Rv
guuccaaaucgguggc

SEQ ID NO: 3264081 - RNA, 14 nt, Mycobacterium tuberculosis H37Rv
guuccaacuccugc

SEQ ID NO: 3264082 - RNA, 17 nt, Mycobacterium tuberculosis H37Rv
guuccaacuccugcagc

SEQ ID NO: 3264083 - RNA, 20 nt, Mycobacterium tuberculosis H37Rv
guuccaacuccugcagcccg

SEQ ID NO: 3264084 - RNA, 15 nt, Mycobacterium tuberculosis H37Rv
guuccacaccaggcc

SEQ ID NO: 3264085 - RNA, 17 nt, Mycobacterium tuberculosis H37Rv
guuccaccagcgcccgu

SEQ ID NO: 3264086 - RNA, 20 nt, Mycobacterium tuberculosis H37Rv
guuccacccggugccgcagc

SEQ ID NO: 3264087 - RNA, 15 nt, Mycobacterium tuberculosis H37Rv
guuccacccgguggc

SEQ ID NO: 3264088 - RNA, 19 nt, Mycobacterium tuberculosis H37Rv
guuccaccgcgcaggugcc

SEQ ID NO: 3264089 - RNA, 21 nt, Mycobacterium tuberculosis H37Rv
guuccacgagucgucguccga

SEQ ID NO: 3264090 - RNA, 19 nt, Mycobacterium tuberculosis H37Rv
guuccacggacggucgggc

SEQ ID NO: 3264091 - RNA, 18 nt, Mycobacterium tuberculosis H37Rv
guuccacggguggugcca

SEQ ID NO: 3264092 - RNA, 20 nt, Mycobacterium tuberculosis H37Rv
guuccagaaggccgcaccgc

SEQ ID NO: 3264093 - RNA, 22 nt, Mycobacterium tuberculosis H37Rv
guuccagccgacggcagugcug

SEQ ID NO: 3264094 - RNA, 15 nt, Mycobacterium tuberculosis H37Rv
guuccagcgcaucga

SEQ ID NO: 3264095 - RNA, 14 nt, Mycobacterium tuberculosis H37Rv
guuccagcggcacc

SEQ ID NO: 3264096 - RNA, 17 nt, Mycobacterium tuberculosis H37Rv
guuccagcgucugcacg

SEQ ID NO: 3264097 - RNA, 19 nt, Mycobacterium tuberculosis H37Rv
guuccaucacggaccaggc

SEQ ID NO: 3264098 - RNA, 18 nt, Mycobacterium tuberculosis H37Rv
guucccaccaccaccgcc

SEQ ID NO: 3264099 - RNA, 15 nt, Mycobacterium tuberculosis H37Rv
guucccacccacgcc

SEQ ID NO: 3264100 - RNA, 16 nt, Mycobacterium tuberculosis H37Rv
guucccccggcaccgc

SEQ ID NO: 3264101 - RNA, 21 nt, Mycobacterium tuberculosis H37Rv
guuccccgagaacggcgggcg

SEQ ID NO: 3264102 - RNA, 14 nt, Mycobacterium tuberculosis H37Rv
guucccgccggccc

SEQ ID NO: 3264103 - RNA, 18 nt, Mycobacterium tuberculosis H37Rv
guucccgccggccccgcc

SEQ ID NO: 3264104 - RNA, 16 nt, Mycobacterium tuberculosis H37Rv
guucccgcucgggcaa

SEQ ID NO: 3264105 - RNA, 14 nt, Mycobacterium tuberculosis H37Rv
guucccgcuugauc

SEQ ID NO: 3264106 - RNA, 22 nt, Mycobacterium tuberculosis H37Rv
guucccggugaccacuugcagc

SEQ ID NO: 3264107 - RNA, 20 nt, Mycobacterium tuberculosis H37Rv
guucccuuguucccgaaacc

SEQ ID NO: 3264108 - RNA, 19 nt, Mycobacterium tuberculosis H37Rv
guuccgaucgcguuagcca

SEQ ID NO: 3264109 - RNA, 18 nt, Mycobacterium tuberculosis H37Rv
guuccgaucggcaaucga

SEQ ID NO: 3264110 - RNA, 13 nt, Mycobacterium tuberculosis H37Rv
guuccgcaaugac

SEQ ID NO: 3264111 - RNA, 18 nt, Mycobacterium tuberculosis H37Rv
guuccgcacgaucaggga

SEQ ID NO: 3264112 - RNA, 22 nt, Mycobacterium tuberculosis H37Rv
guuccgccaggccgaccgcgca

SEQ ID NO: 3264113 - RNA, 16 nt, Mycobacterium tuberculosis H37Rv
guuccgccggccccac

SEQ ID NO: 3264114 - RNA, 22 nt, Mycobacterium tuberculosis H37Rv
guuccgccggccccaccgguac

SEQ ID NO: 3264115 - RNA, 13 nt, Mycobacterium tuberculosis H37Rv
guuccgcgacagc

SEQ ID NO: 3264116 - RNA, 19 nt, Mycobacterium tuberculosis H37Rv
guuccgcugcggugccggc

SEQ ID NO: 3264117 - RNA, 21 nt, Mycobacterium tuberculosis H37Rv
guuccgcugcggugccggccc

SEQ ID NO: 3264118 - RNA, 16 nt, Mycobacterium tuberculosis H37Rv
guuccggcggucaaga

SEQ ID NO: 3264119 - RNA, 16 nt, Mycobacterium tuberculosis H37Rv
guuccggcuucgucca

SEQ ID NO: 3264120 - RNA, 16 nt, Mycobacterium tuberculosis H37Rv
guuccgggcgcgugga

SEQ ID NO: 3264121 - RNA, 18 nt, Mycobacterium tuberculosis H37Rv
guuccgggguggacggcg

SEQ ID NO: 3264122 - RNA, 19 nt, Mycobacterium tuberculosis H37Rv
guuccgggugccgcgccgu

SEQ ID NO: 3264123 - RNA, 19 nt, Mycobacterium tuberculosis H37Rv
guuccgugcgggucguccg

SEQ ID NO: 3264124 - RNA, 19 nt, Mycobacterium tuberculosis H37Rv
guuccguugaugccgccgg

SEQ ID NO: 3264125 - RNA, 14 nt, Mycobacterium tuberculosis H37Rv
guugagguagguga

SEQ ID NO: 3264126 - RNA, 14 nt, Mycobacterium tuberculosis H37Rv
guugauccugcagu

SEQ ID NO: 3264127 - RNA, 19 nt, Mycobacterium tuberculosis H37Rv
guugaucgacaucaccacc

SEQ ID NO: 3264128 - RNA, 16 nt, Mycobacterium tuberculosis H37Rv
guugaucgccggccug

SEQ ID NO: 3264129 - RNA, 23 nt, Mycobacterium tuberculosis H37Rv
guugaucgccggccugcucggcg

SEQ ID NO: 3264130 - RNA, 14 nt, Mycobacterium tuberculosis H37Rv
guugaucgcggaca

SEQ ID NO: 3264131 - RNA, 13 nt, Mycobacterium tuberculosis H37Rv
guugaucggccac

SEQ ID NO: 3264132 - RNA, 16 nt, Mycobacterium tuberculosis H37Rv
guugaugaagauggcg

SEQ ID NO: 3264133 - RNA, 13 nt, Mycobacterium tuberculosis H37Rv
guugaugaccagg

SEQ ID NO: 3264134 - RNA, 20 nt, Mycobacterium tuberculosis H37Rv
guugaugccgccggagucga

SEQ ID NO: 3264135 - RNA, 17 nt, Mycobacterium tuberculosis H37Rv
guugauuucggcggcga

SEQ ID NO: 3264136 - RNA, 18 nt, Mycobacterium tuberculosis H37Rv
guugauuucggcggcgau

SEQ ID NO: 3264137 - RNA, 18 nt, Mycobacterium tuberculosis H37Rv
guugcacaccgaucggca

SEQ ID NO: 3264138 - RNA, 15 nt, Mycobacterium tuberculosis H37Rv
guugcacggccggga

SEQ ID NO: 3264139 - RNA, 13 nt, Mycobacterium tuberculosis H37Rv
guugcagaccacc

SEQ ID NO: 3264140 - RNA, 17 nt, Mycobacterium tuberculosis H37Rv
guugccaacaccggcga

SEQ ID NO: 3264141 - RNA, 15 nt, Mycobacterium tuberculosis H37Rv
guugccaacgaaccg

SEQ ID NO: 3264142 - RNA, 18 nt, Mycobacterium tuberculosis H37Rv
guugccaacgaaccgcuc

SEQ ID NO: 3264143 - RNA, 19 nt, Mycobacterium tuberculosis H37Rv
guugccagaucagcaccga

SEQ ID NO: 3264144 - RNA, 19 nt, Mycobacterium tuberculosis H37Rv
guugccagcgacgcgguca

SEQ ID NO: 3264145 - RNA, 23 nt, Mycobacterium tuberculosis H37Rv
guugccagcgacgcggucaucga

SEQ ID NO: 3264146 - RNA, 14 nt, Mycobacterium tuberculosis H37Rv
guugccaggugcug

SEQ ID NO: 3264147 - RNA, 17 nt, Mycobacterium tuberculosis H37Rv
guugccaucaaggccac

SEQ ID NO: 3264148 - RNA, 20 nt, Mycobacterium tuberculosis H37Rv
guugcccccauugccgccgu

SEQ ID NO: 3264149 - RNA, 14 nt, Mycobacterium tuberculosis H37Rv
guugccccgaccgc

SEQ ID NO: 3264150 - RNA, 17 nt, Mycobacterium tuberculosis H37Rv
guugccccgaccgccgu

SEQ ID NO: 3264151 - RNA, 22 nt, Mycobacterium tuberculosis H37Rv
guugccccgcagcaucgccagc

SEQ ID NO: 3264152 - RNA, 19 nt, Mycobacterium tuberculosis H37Rv
guugccccggucggcgacg

SEQ ID NO: 3264153 - RNA, 18 nt, Mycobacterium tuberculosis H37Rv
guugccccgucguucucc

SEQ ID NO: 3264154 - RNA, 14 nt, Mycobacterium tuberculosis H37Rv
guugcccgacccgc

SEQ ID NO: 3264155 - RNA, 16 nt, Mycobacterium tuberculosis H37Rv
guugcccgacccgccg

SEQ ID NO: 3264156 - RNA, 17 nt, Mycobacterium tuberculosis H37Rv
guugcccguucaugcgg

SEQ ID NO: 3264157 - RNA, 20 nt, Mycobacterium tuberculosis H37Rv
guugcccuggugugccgcgu

SEQ ID NO: 3264158 - RNA, 17 nt, Mycobacterium tuberculosis H37Rv
guugccgaaacccgagu

SEQ ID NO: 3264159 - RNA, 22 nt, Mycobacterium tuberculosis H37Rv
guugccgaacgucgcggccagc

SEQ ID NO: 3264160 - RNA, 23 nt, Mycobacterium tuberculosis H37Rv
guugccgaagccggaugcgcuuc

SEQ ID NO: 3264161 - RNA, 23 nt, Mycobacterium tuberculosis H37Rv
guugccgacgaucgacgccgcca

SEQ ID NO: 3264162 - RNA, 18 nt, Mycobacterium tuberculosis H37Rv
guugccgaucaacccccc

SEQ ID NO: 3264163 - RNA, 20 nt, Mycobacterium tuberculosis H37Rv
guugccgccgaagccgacga

SEQ ID NO: 3264164 - RNA, 22 nt, Mycobacterium tuberculosis H37Rv
guugccgccgaagccgacgaac

SEQ ID NO: 3264165 - RNA, 14 nt, Mycobacterium tuberculosis H37Rv
guugccgccgccuc

SEQ ID NO: 3264166 - RNA, 20 nt, Mycobacterium tuberculosis H37Rv
guugccgccgucaccgccgu

SEQ ID NO: 3264167 - RNA, 23 nt, Mycobacterium tuberculosis H37Rv
guugccgccguccccaccgacgc

SEQ ID NO: 3264168 - RNA, 20 nt, Mycobacterium tuberculosis H37Rv
guugccgcugaauuggcgcc

SEQ ID NO: 3264169 - RNA, 16 nt, Mycobacterium tuberculosis H37Rv
guugccggacaaccug

SEQ ID NO: 3264170 - RNA, 18 nt, Mycobacterium tuberculosis H37Rv
guugccggacaaccuggg

SEQ ID NO: 3264171 - RNA, 21 nt, Mycobacterium tuberculosis H37Rv
guugccggagacgucgccgca

SEQ ID NO: 3264172 - RNA, 18 nt, Mycobacterium tuberculosis H37Rv
guugccggaucgacguuc

SEQ ID NO: 3264173 - RNA, 16 nt, Mycobacterium tuberculosis H37Rv
guugccggcggcgacg

SEQ ID NO: 3264174 - RNA, 22 nt, Mycobacterium tuberculosis H37Rv
guugccgggucgauuucgccgg

SEQ ID NO: 3264175 - RNA, 23 nt, Mycobacterium tuberculosis H37Rv
guugccguuaccgccaaacgcug

SEQ ID NO: 3264176 - RNA, 19 nt, Mycobacterium tuberculosis H37Rv
guugccguuggugccgccu

SEQ ID NO: 3264177 - RNA, 19 nt, Mycobacterium tuberculosis H37Rv
guugccuagguucgccacg

SEQ ID NO: 3264178 - RNA, 23 nt, Mycobacterium tuberculosis H37Rv
guugccucggcgaggucagagaa

SEQ ID NO: 3264179 - RNA, 13 nt, Mycobacterium tuberculosis H37Rv
guugccucgucgc

SEQ ID NO: 3264180 - RNA, 19 nt, Mycobacterium tuberculosis H37Rv
guugccugcgcgagugcca

SEQ ID NO: 3264181 - RNA, 19 nt, Mycobacterium tuberculosis H37Rv
guugcgaagaagaaggcga

SEQ ID NO: 3264182 - RNA, 15 nt, Mycobacterium tuberculosis H37Rv
guugcgacggcguug

SEQ ID NO: 3264183 - RNA, 17 nt, Mycobacterium tuberculosis H37Rv
guugcgcgaugggagcc

SEQ ID NO: 3264184 - RNA, 19 nt, Mycobacterium tuberculosis H37Rv
guugcgcggcuugggcaga

SEQ ID NO: 3264185 - RNA, 13 nt, Mycobacterium tuberculosis H37Rv
guugcgcgguagc

SEQ ID NO: 3264186 - RNA, 16 nt, Mycobacterium tuberculosis H37Rv
guugcggagcucacgc

SEQ ID NO: 3264187 - RNA, 15 nt, Mycobacterium tuberculosis H37Rv
guugcggaucgagca

SEQ ID NO: 3264188 - RNA, 14 nt, Mycobacterium tuberculosis H37Rv
guugcggcugaccu

SEQ ID NO: 3264189 - RNA, 21 nt, Mycobacterium tuberculosis H37Rv
guugcggcugcguuggcuggu

SEQ ID NO: 3264190 - RNA, 14 nt, Mycobacterium tuberculosis H37Rv
guugcgggcgugga

SEQ ID NO: 3264191 - RNA, 17 nt, Mycobacterium tuberculosis H37Rv
guugcggucaucggcgc

SEQ ID NO: 3264192 - RNA, 14 nt, Mycobacterium tuberculosis H37Rv
guugcggugugccg

SEQ ID NO: 3264193 - RNA, 17 nt, Mycobacterium tuberculosis H37Rv
guugcuaaacuccgugc

SEQ ID NO: 3264194 - RNA, 18 nt, Mycobacterium tuberculosis H37Rv
guugcucggucucgucgc

SEQ ID NO: 3264195 - RNA, 12 nt, Mycobacterium tuberculosis H37Rv
guugcucgucca

SEQ ID NO: 3264196 - RNA, 16 nt, Mycobacterium tuberculosis H37Rv
guugcucguugugcag

SEQ ID NO: 3264197 - RNA, 18 nt, Mycobacterium tuberculosis H37Rv
guugcuggcgcccccgcc

SEQ ID NO: 3264198 - RNA, 17 nt, Mycobacterium tuberculosis H37Rv
guugcuggcuggguggc

SEQ ID NO: 3264199 - RNA, 17 nt, Mycobacterium tuberculosis H37Rv
guuggaagucccgccgu

SEQ ID NO: 3264200 - RNA, 19 nt, Mycobacterium tuberculosis H37Rv
guuggaagucccgccguug

SEQ ID NO: 3264201 - RNA, 23 nt, Mycobacterium tuberculosis H37Rv
guuggagccgccaccgaggccgc

SEQ ID NO: 3264202 - RNA, 20 nt, Mycobacterium tuberculosis H37Rv
guuggcaaugaccccggcgu

SEQ ID NO: 3264203 - RNA, 18 nt, Mycobacterium tuberculosis H37Rv
guuggcaccagccgguga

SEQ ID NO: 3264204 - RNA, 22 nt, Mycobacterium tuberculosis H37Rv
guuggcagcgggacugcggaag

SEQ ID NO: 3264205 - RNA, 18 nt, Mycobacterium tuberculosis H37Rv
guuggcagggccagcggc

SEQ ID NO: 3264206 - RNA, 13 nt, Mycobacterium tuberculosis H37Rv
guuggcaguggcg

SEQ ID NO: 3264207 - RNA, 19 nt, Mycobacterium tuberculosis H37Rv
guuggcaguggcgcggcga

SEQ ID NO: 3264208 - RNA, 20 nt, Mycobacterium tuberculosis H37Rv
guuggccacacagucacgga

SEQ ID NO: 3264209 - RNA, 13 nt, Mycobacterium tuberculosis H37Rv
guuggcccgacgc

SEQ ID NO: 3264210 - RNA, 14 nt, Mycobacterium tuberculosis H37Rv
guuggcccgccuga

SEQ ID NO: 3264211 - RNA, 18 nt, Mycobacterium tuberculosis H37Rv
guuggccgagcagggccg

SEQ ID NO: 3264212 - RNA, 22 nt, Mycobacterium tuberculosis H37Rv
guuggccgcccgaaugcgguga

SEQ ID NO: 3264213 - RNA, 20 nt, Mycobacterium tuberculosis H37Rv
guuggccggcgccaccgagu

SEQ ID NO: 3264214 - RNA, 23 nt, Mycobacterium tuberculosis H37Rv
guuggccguggucgagguggggu

SEQ ID NO: 3264215 - RNA, 19 nt, Mycobacterium tuberculosis H37Rv
guuggccucgagcgcugug

SEQ ID NO: 3264216 - RNA, 14 nt, Mycobacterium tuberculosis H37Rv
guuggccugcaacg

SEQ ID NO: 3264217 - RNA, 18 nt, Mycobacterium tuberculosis H37Rv
guuggcgaacugguagcc

SEQ ID NO: 3264218 - RNA, 16 nt, Mycobacterium tuberculosis H37Rv
guuggcgaagcccgag

SEQ ID NO: 3264219 - RNA, 16 nt, Mycobacterium tuberculosis H37Rv
guuggcgaucaucagg

SEQ ID NO: 3264220 - RNA, 18 nt, Mycobacterium tuberculosis H37Rv
guuggcgauccgcggcgu

SEQ ID NO: 3264221 - RNA, 20 nt, Mycobacterium tuberculosis H37Rv
guuuucgcgcuugaaacuga

SEQ ID NO: 3264222 - RNA, 21 nt, Mycobacterium tuberculosis H37Rv
guuuugcggccagggcgucga

SEQ ID NO: 3264223 - RNA, 14 nt, Mycobacterium tuberculosis H37Rv
guuuugcugcaugc

SEQ ID NO: 3264224 - RNA, 15 nt, Mycobacterium tuberculosis H37Rv
uaaaaaccaccccca

SEQ ID NO: 3264225 - RNA, 19 nt, Mycobacterium tuberculosis H37Rv
uaaaaaccacccccaccga

SEQ ID NO: 3264226 - RNA, 21 nt, Mycobacterium tuberculosis H37Rv
uaaaccaagaaucaccggcaa

SEQ ID NO: 3264227 - RNA, 12 nt, Mycobacterium tuberculosis H37Rv
uaaaccccuggc

SEQ ID NO: 3264228 - RNA, 16 nt, Mycobacterium tuberculosis H37Rv
uaaaccucgccgguga

SEQ ID NO: 3264229 - RNA, 17 nt, Mycobacterium tuberculosis H37Rv
uaaaccucgccggugac

SEQ ID NO: 3264230 - RNA, 13 nt, Mycobacterium tuberculosis H37Rv
uaaacgcggcgcg

SEQ ID NO: 3264231 - RNA, 18 nt, Mycobacterium tuberculosis H37Rv
uaaacugccgcggcaccg

SEQ ID NO: 3264232 - RNA, 20 nt, Mycobacterium tuberculosis H37Rv
uaaacugccgcggcaccgcc

SEQ ID NO: 3264233 - RNA, 22 nt, Mycobacterium tuberculosis H37Rv
uaaagaucguugccucgucgcc

SEQ ID NO: 3264234 - RNA, 15 nt, Mycobacterium tuberculosis H37Rv
uaaagcccggcggca

SEQ ID NO: 3264235 - RNA, 15 nt, Mycobacterium tuberculosis H37Rv
uaaagcucaccacau

SEQ ID NO: 3264236 - RNA, 18 nt, Mycobacterium tuberculosis H37Rv
uaaaggccuugggcggca

SEQ ID NO: 3264237 - RNA, 19 nt, Mycobacterium tuberculosis H37Rv
uaaauaucggggccacuga

SEQ ID NO: 3264238 - RNA, 20 nt, Mycobacterium tuberculosis H37Rv
uaaaugccugcccaccuucg

SEQ ID NO: 3264239 - RNA, 22 nt, Mycobacterium tuberculosis H37Rv
uaaaugguggcguguucgacgg

SEQ ID NO: 3264240 - RNA, 17 nt, Mycobacterium tuberculosis H37Rv
uaacaacaccaccagca

SEQ ID NO: 3264241 - RNA, 13 nt, Mycobacterium tuberculosis H37Rv
uaacccagcacca

SEQ ID NO: 3264242 - RNA, 15 nt, Mycobacterium tuberculosis H37Rv
uaacccagcaccaca

SEQ ID NO: 3264243 - RNA, 19 nt, Mycobacterium tuberculosis H37Rv
uaacccggcuccagcaccg

SEQ ID NO: 3264244 - RNA, 21 nt, Mycobacterium tuberculosis H37Rv
uaacccuggcggaacagcuuc

SEQ ID NO: 3264245 - RNA, 17 nt, Mycobacterium tuberculosis H37Rv
uaaccggcaugccgcca

SEQ ID NO: 3264246 - RNA, 21 nt, Mycobacterium tuberculosis H37Rv
uaacgacugacaacggccaca

SEQ ID NO: 3264247 - RNA, 14 nt, Mycobacterium tuberculosis H37Rv
uaacgagccgucca

SEQ ID NO: 3264248 - RNA, 14 nt, Mycobacterium tuberculosis H37Rv
uaacgcaggcagug

SEQ ID NO: 3264249 - RNA, 19 nt, Mycobacterium tuberculosis H37Rv
uaacgccaagcucggccca

SEQ ID NO: 3264250 - RNA, 16 nt, Mycobacterium tuberculosis H37Rv
uaacgcggaucgggca

SEQ ID NO: 3264251 - RNA, 19 nt, Mycobacterium tuberculosis H37Rv
uaacgcggcaccacgucga

SEQ ID NO: 3264252 - RNA, 18 nt, Mycobacterium tuberculosis H37Rv
uaacguguucacggccgc

SEQ ID NO: 3264253 - RNA, 14 nt, Mycobacterium tuberculosis H37Rv
uaacuggcccggac

SEQ ID NO: 3264254 - RNA, 14 nt, Mycobacterium tuberculosis H37Rv
uaacuucaccggcu

SEQ ID NO: 3264255 - RNA, 21 nt, Mycobacterium tuberculosis H37Rv
uaagcagccagcaacaccaga

SEQ ID NO: 3264256 - RNA, 22 nt, Mycobacterium tuberculosis H37Rv
uaagcagcucgguggcaucggc

SEQ ID NO: 3264257 - RNA, 19 nt, Mycobacterium tuberculosis H37Rv
uaagcccggucgcugaucc

SEQ ID NO: 3264258 - RNA, 10 nt, Mycobacterium tuberculosis H37Rv
uaagcggaug

SEQ ID NO: 3264259 - RNA, 18 nt, Mycobacterium tuberculosis H37Rv
uaagcggauguccccgac

SEQ ID NO: 3264260 - RNA, 19 nt, Mycobacterium tuberculosis H37Rv
uaaggcugcagugccgcac

SEQ ID NO: 3264261 - RNA, 15 nt, Mycobacterium tuberculosis H37Rv
uaagggacaccagcu

SEQ ID NO: 3264262 - RNA, 14 nt, Mycobacterium tuberculosis H37Rv
uaagggcacuccac

SEQ ID NO: 3264263 - RNA, 22 nt, Mycobacterium tuberculosis H37Rv
uaagggcgggcuuggggucccg

SEQ ID NO: 3264264 - RNA, 21 nt, Mycobacterium tuberculosis H37Rv
uaagggucaucgccagcggca

SEQ ID NO: 3264265 - RNA, 15 nt, Mycobacterium tuberculosis H37Rv
uaagucuggagugag

SEQ ID NO: 3264266 - RNA, 22 nt, Mycobacterium tuberculosis H37Rv
uaauauugccgccuccggugca

SEQ ID NO: 3264267 - RNA, 16 nt, Mycobacterium tuberculosis H37Rv
uaaucuccucaagcga

SEQ ID NO: 3264268 - RNA, 14 nt, Mycobacterium tuberculosis H37Rv
uaaugaugauguca

SEQ ID NO: 3264269 - RNA, 16 nt, Mycobacterium tuberculosis H37Rv
uaauucaacagcaccg

SEQ ID NO: 3264270 - RNA, 13 nt, Mycobacterium tuberculosis H37Rv
uaauugccagccu

SEQ ID NO: 3264271 - RNA, 15 nt, Mycobacterium tuberculosis H37Rv
uaauuggcaacacag

SEQ ID NO: 3264272 - RNA, 21 nt, Mycobacterium tuberculosis H37Rv
uacaacacagaacucaccgac

SEQ ID NO: 3264273 - RNA, 22 nt, Mycobacterium tuberculosis H37Rv
uacaacacagaacucaccgacg

SEQ ID NO: 3264274 - RNA, 21 nt, Mycobacterium tuberculosis H37Rv
uacaaccacccacccgcacca

SEQ ID NO: 3264275 - RNA, 19 nt, Mycobacterium tuberculosis H37Rv
uacacaccagcggucggcg

SEQ ID NO: 3264276 - RNA, 17 nt, Mycobacterium tuberculosis H37Rv
uacacauucauccaccc

SEQ ID NO: 3264277 - RNA, 15 nt, Mycobacterium tuberculosis H37Rv
uacaccgcccggccc

SEQ ID NO: 3264278 - RNA, 14 nt, Mycobacterium tuberculosis H37Rv
uacaccggcaccga

SEQ ID NO: 3264279 - RNA, 18 nt, Mycobacterium tuberculosis H37Rv
uacaccggccgguccacg

SEQ ID NO: 3264280 - RNA, 16 nt, Mycobacterium tuberculosis H37Rv
uacaccgugcgccgaa

SEQ ID NO: 3264281 - RNA, 15 nt, Mycobacterium tuberculosis H37Rv
uacagcaauccgcaa

SEQ ID NO: 3264282 - RNA, 23 nt, Mycobacterium tuberculosis H37Rv
uacagcgcaaagcccuccucgau

SEQ ID NO: 3264283 - RNA, 22 nt, Mycobacterium tuberculosis H37Rv
uacagcgcccggauguccgccg

SEQ ID NO: 3264284 - RNA, 16 nt, Mycobacterium tuberculosis H37Rv
uacagcgccuggguga

SEQ ID NO: 3264285 - RNA, 14 nt, Mycobacterium tuberculosis H37Rv
uacagcgggauccc

SEQ ID NO: 3264286 - RNA, 20 nt, Mycobacterium tuberculosis H37Rv
uacagcuugaucgccgaggc

SEQ ID NO: 3264287 - RNA, 21 nt, Mycobacterium tuberculosis H37Rv
uacagcuugaucgccgaggcc

SEQ ID NO: 3264288 - RNA, 19 nt, Mycobacterium tuberculosis H37Rv
uacaggaagucgcggacgu

SEQ ID NO: 3264289 - RNA, 17 nt, Mycobacterium tuberculosis H37Rv
uacaggccacgcaccgg

SEQ ID NO: 3264290 - RNA, 23 nt, Mycobacterium tuberculosis H37Rv
uacaggcccgccagcagggccag

SEQ ID NO: 3264291 - RNA, 18 nt, Mycobacterium tuberculosis H37Rv
uacaggucggcccacggu

SEQ ID NO: 3264292 - RNA, 17 nt, Mycobacterium tuberculosis H37Rv
uacagucgaccggacac

SEQ ID NO: 3264293 - RNA, 21 nt, Mycobacterium tuberculosis H37Rv
uacagucgaccggacacuccu

SEQ ID NO: 3264294 - RNA, 23 nt, Mycobacterium tuberculosis H37Rv
uacagugcgcggaucaacaggcc

SEQ ID NO: 3264295 - RNA, 15 nt, Mycobacterium tuberculosis H37Rv
uacaucgccuugccc

SEQ ID NO: 3264296 - RNA, 19 nt, Mycobacterium tuberculosis H37Rv
uacaucgccuugcccagcg

SEQ ID NO: 3264297 - RNA, 20 nt, Mycobacterium tuberculosis H37Rv
uaccaacaggauggugcggc

SEQ ID NO: 3264298 - RNA, 19 nt, Mycobacterium tuberculosis H37Rv
uaccaaccugcgcggcgau

SEQ ID NO: 3264299 - RNA, 20 nt, Mycobacterium tuberculosis H37Rv
uaccaauucccgcgcggcgu

SEQ ID NO: 3264300 - RNA, 15 nt, Mycobacterium tuberculosis H37Rv
uaccacauaccccga

SEQ ID NO: 3264301 - RNA, 15 nt, Mycobacterium tuberculosis H37Rv
uaccaccacguggcc

SEQ ID NO: 3264302 - RNA, 12 nt, Mycobacterium tuberculosis H37Rv
uaccaccgccgc

SEQ ID NO: 3264303 - RNA, 16 nt, Mycobacterium tuberculosis H37Rv
uaccaccggcacggug

SEQ ID NO: 3264304 - RNA, 20 nt, Mycobacterium tuberculosis H37Rv
uaccaccgucuccggcgcca

SEQ ID NO: 3264305 - RNA, 21 nt, Mycobacterium tuberculosis H37Rv
uaccacggcgauccggucggc

SEQ ID NO: 3264306 - RNA, 22 nt, Mycobacterium tuberculosis H37Rv
uaccacuguuacggccacaccg

SEQ ID NO: 3264307 - RNA, 22 nt, Mycobacterium tuberculosis H37Rv
uaccacuuugcguucccauccc

SEQ ID NO: 3264308 - RNA, 20 nt, Mycobacterium tuberculosis H37Rv
uaccagaccggccgacguga

SEQ ID NO: 3264309 - RNA, 22 nt, Mycobacterium tuberculosis H37Rv
uaccagccgaagaaccggucgc

SEQ ID NO: 3264310 - RNA, 18 nt, Mycobacterium tuberculosis H37Rv
uaccagccgccccggcuu

SEQ ID NO: 3264311 - RNA, 14 nt, Mycobacterium tuberculosis H37Rv
uaccagcggcaccg

SEQ ID NO: 3264312 - RNA, 22 nt, Mycobacterium tuberculosis H37Rv
uaccagcuggccacuuucagau

SEQ ID NO: 3264313 - RNA, 15 nt, Mycobacterium tuberculosis H37Rv
uaccagcugggcgac

SEQ ID NO: 3264314 - RNA, 21 nt, Mycobacterium tuberculosis H37Rv
uaccaggucggaacuagccag

SEQ ID NO: 3264315 - RNA, 14 nt, Mycobacterium tuberculosis H37Rv
uaccauauccggac

SEQ ID NO: 3264316 - RNA, 19 nt, Mycobacterium tuberculosis H37Rv
uacccaccucccgcagccg

SEQ ID NO: 3264317 - RNA, 21 nt, Mycobacterium tuberculosis H37Rv
uacugagccgcgaaaucaccg

SEQ ID NO: 3264318 - RNA, 13 nt, Mycobacterium tuberculosis H37Rv
uacugagcuucca

SEQ ID NO: 3264319 - RNA, 21 nt, Mycobacterium tuberculosis H37Rv
uacugaggaaagucaccgucc

SEQ ID NO: 3264320 - RNA, 21 nt, Mycobacterium tuberculosis H37Rv
uacuggcgucgaugucgccgc

SEQ ID NO: 3264321 - RNA, 18 nt, Mycobacterium tuberculosis H37Rv
uacuggcguugccaccgg

SEQ ID NO: 3264322 - RNA, 19 nt, Mycobacterium tuberculosis H37Rv
uacuggcguugccaccgga

SEQ ID NO: 3264323 - RNA, 16 nt, Mycobacterium tuberculosis H37Rv
uacuggcuauccaccu

SEQ ID NO: 3264324 - RNA, 17 nt, Mycobacterium tuberculosis H37Rv
uacuggcucucgggcgc

SEQ ID NO: 3264325 - RNA, 16 nt, Mycobacterium tuberculosis H37Rv
uacugguuagagacuu

SEQ ID NO: 3264326 - RNA, 22 nt, Mycobacterium tuberculosis H37Rv
uacugucgucgcccugacacaa

SEQ ID NO: 3264327 - RNA, 21 nt, Mycobacterium tuberculosis H37Rv
uacuguucugcuggcuguggc

SEQ ID NO: 3264328 - RNA, 22 nt, Mycobacterium tuberculosis H37Rv
uacuuccauccacaucgauguc

SEQ ID NO: 3264329 - RNA, 16 nt, Mycobacterium tuberculosis H37Rv
uacuucgcuggaaacc

SEQ ID NO: 3264330 - RNA, 14 nt, Mycobacterium tuberculosis H37Rv
uacuugagggucuu

SEQ ID NO: 3264331 - RNA, 19 nt, Mycobacterium tuberculosis H37Rv
uacuugccuuuggucgcgg

SEQ ID NO: 3264332 - RNA, 13 nt, Mycobacterium tuberculosis H37Rv
uacuuggcuuccg

SEQ ID NO: 3264333 - RNA, 17 nt, Mycobacterium tuberculosis H37Rv
uagaacgucuggguugc

SEQ ID NO: 3264334 - RNA, 17 nt, Mycobacterium tuberculosis H37Rv
uagacaggaccgguggg

SEQ ID NO: 3264335 - RNA, 20 nt, Mycobacterium tuberculosis H37Rv
uagacagucugcgacuggau

SEQ ID NO: 3264336 - RNA, 18 nt, Mycobacterium tuberculosis H37Rv
uagacauuggcuccgaac

SEQ ID NO: 3264337 - RNA, 18 nt, Mycobacterium tuberculosis H37Rv
uagacccgucaccgccga

SEQ ID NO: 3264338 - RNA, 16 nt, Mycobacterium tuberculosis H37Rv
uagaccgagcccgaug

SEQ ID NO: 3264339 - RNA, 19 nt, Mycobacterium tuberculosis H37Rv
uagaccgcuacccgcgcga

SEQ ID NO: 3264340 - RNA, 23 nt, Mycobacterium tuberculosis H37Rv
uagacgacaucgucaucagcgcg

SEQ ID NO: 3264341 - RNA, 21 nt, Mycobacterium tuberculosis H37Rv
uagacggcgaaaaucccgcuc

SEQ ID NO: 3264342 - RNA, 19 nt, Mycobacterium tuberculosis H37Rv
uagacguagaaugcgccgu

SEQ ID NO: 3264343 - RNA, 13 nt, Mycobacterium tuberculosis H37Rv
uagacgugcacca

SEQ ID NO: 3264344 - RNA, 20 nt, Mycobacterium tuberculosis H37Rv
uagacuagccgauccagcag

SEQ ID NO: 3264345 - RNA, 15 nt, Mycobacterium tuberculosis H37Rv
uagacuugcugcucc

SEQ ID NO: 3264346 - RNA, 13 nt, Mycobacterium tuberculosis H37Rv
uagagcgcaccgc

SEQ ID NO: 3264347 - RNA, 18 nt, Mycobacterium tuberculosis H37Rv
uagaggacugcggucugg

SEQ ID NO: 3264348 - RNA, 19 nt, Mycobacterium tuberculosis H37Rv
uagaggacugcggucugga

SEQ ID NO: 3264349 - RNA, 16 nt, Mycobacterium tuberculosis H37Rv
uagaggauggucagca

SEQ ID NO: 3264350 - RNA, 19 nt, Mycobacterium tuberculosis H37Rv
uagaggauggucagcagcu

SEQ ID NO: 3264351 - RNA, 16 nt, Mycobacterium tuberculosis H37Rv
uagaucaagaucugcu

SEQ ID NO: 3264352 - RNA, 16 nt, Mycobacterium tuberculosis H37Rv
uagaucaucuggcugg

SEQ ID NO: 3264353 - RNA, 19 nt, Mycobacterium tuberculosis H37Rv
uagaucgcguggaucgcgc

SEQ ID NO: 3264354 - RNA, 14 nt, Mycobacterium tuberculosis H37Rv
uagaucugggcugg

SEQ ID NO: 3264355 - RNA, 16 nt, Mycobacterium tuberculosis H37Rv
uagaugacgggcucgu

SEQ ID NO: 3264356 - RNA, 17 nt, Mycobacterium tuberculosis H37Rv
uagauggugguggcccg

SEQ ID NO: 3264357 - RNA, 19 nt, Mycobacterium tuberculosis H37Rv
uagauggugguggcccggc

SEQ ID NO: 3264358 - RNA, 20 nt, Mycobacterium tuberculosis H37Rv
uagauggugguggcccggcu

SEQ ID NO: 3264359 - RNA, 16 nt, Mycobacterium tuberculosis H37Rv
uagcaacucgaucgcc

SEQ ID NO: 3264360 - RNA, 13 nt, Mycobacterium tuberculosis H37Rv
uagcaaucggcag

SEQ ID NO: 3264361 - RNA, 11 nt, Mycobacterium tuberculosis H37Rv
uagcacaccga

SEQ ID NO: 3264362 - RNA, 12 nt, Mycobacterium tuberculosis H37Rv
uagcaccacauc

SEQ ID NO: 3264363 - RNA, 18 nt, Mycobacterium tuberculosis H37Rv
uagcaccacaucggugcc

SEQ ID NO: 3264364 - RNA, 11 nt, Mycobacterium tuberculosis H37Rv
uagcacccacg

SEQ ID NO: 3264365 - RNA, 16 nt, Mycobacterium tuberculosis H37Rv
uagcaccgcgccgaac

SEQ ID NO: 3264366 - RNA, 21 nt, Mycobacterium tuberculosis H37Rv
uagcaccgcgccgaacacgca

SEQ ID NO: 3264367 - RNA, 22 nt, Mycobacterium tuberculosis H37Rv
uagcacggcgauccccgacguc

SEQ ID NO: 3264368 - RNA, 13 nt, Mycobacterium tuberculosis H37Rv
uagcagccgcuga

SEQ ID NO: 3264369 - RNA, 15 nt, Mycobacterium tuberculosis H37Rv
uagcagcgcggcuug

SEQ ID NO: 3264370 - RNA, 20 nt, Mycobacterium tuberculosis H37Rv
uagcagcgcggcuuggccaa

SEQ ID NO: 3264371 - RNA, 12 nt, Mycobacterium tuberculosis H37Rv
uagcagcgcugc

SEQ ID NO: 3264372 - RNA, 13 nt, Mycobacterium tuberculosis H37Rv
uagcaugaggccc

SEQ ID NO: 3264373 - RNA, 17 nt, Mycobacterium tuberculosis H37Rv
uagcauugucgccggau

SEQ ID NO: 3264374 - RNA, 16 nt, Mycobacterium tuberculosis H37Rv
uagccaccaagcacaa

SEQ ID NO: 3264375 - RNA, 20 nt, Mycobacterium tuberculosis H37Rv
uagccacgcaugggccaggu

SEQ ID NO: 3264376 - RNA, 14 nt, Mycobacterium tuberculosis H37Rv
uagccacgcccaca

SEQ ID NO: 3264377 - RNA, 20 nt, Mycobacterium tuberculosis H37Rv
uagccagcaggaacgccgug

SEQ ID NO: 3264378 - RNA, 17 nt, Mycobacterium tuberculosis H37Rv
uagccaggcaaccgguc

SEQ ID NO: 3264379 - RNA, 18 nt, Mycobacterium tuberculosis H37Rv
uagccaggugugcggaac

SEQ ID NO: 3264380 - RNA, 22 nt, Mycobacterium tuberculosis H37Rv
uagccaugggauucggccagac

SEQ ID NO: 3264381 - RNA, 23 nt, Mycobacterium tuberculosis H37Rv
uagccauucgguguggccguggg

SEQ ID NO: 3264382 - RNA, 22 nt, Mycobacterium tuberculosis H37Rv
uagccauuuccuuggcgcugag

SEQ ID NO: 3264383 - RNA, 12 nt, Mycobacterium tuberculosis H37Rv
uagcccaucggc

SEQ ID NO: 3264384 - RNA, 22 nt, Mycobacterium tuberculosis H37Rv
uagccccgcagagucgccgaac

SEQ ID NO: 3264385 - RNA, 18 nt, Mycobacterium tuberculosis H37Rv
uagcccgaccgguccagc

SEQ ID NO: 3264386 - RNA, 15 nt, Mycobacterium tuberculosis H37Rv
uagcccgauggugcc

SEQ ID NO: 3264387 - RNA, 20 nt, Mycobacterium tuberculosis H37Rv
uagcccgauggugccgaccc

SEQ ID NO: 3264388 - RNA, 22 nt, Mycobacterium tuberculosis H37Rv
uagcccgauggugccgacccgc

SEQ ID NO: 3264389 - RNA, 21 nt, Mycobacterium tuberculosis H37Rv
uagcccgccacccuuggcccg

SEQ ID NO: 3264390 - RNA, 21 nt, Mycobacterium tuberculosis H37Rv
uagcccgcgaucucggagcgc

SEQ ID NO: 3264391 - RNA, 16 nt, Mycobacterium tuberculosis H37Rv
uagcccgcgucgacga

SEQ ID NO: 3264392 - RNA, 15 nt, Mycobacterium tuberculosis H37Rv
uagcccggcagcacg

SEQ ID NO: 3264393 - RNA, 12 nt, Mycobacterium tuberculosis H37Rv
uagcccugcuca

SEQ ID NO: 3264394 - RNA, 14 nt, Mycobacterium tuberculosis H37Rv
uagccgaacagcgg

SEQ ID NO: 3264395 - RNA, 19 nt, Mycobacterium tuberculosis H37Rv
uagccgaagcgcccggaga

SEQ ID NO: 3264396 - RNA, 15 nt, Mycobacterium tuberculosis H37Rv
uagccgaccagcgcu

SEQ ID NO: 3264397 - RNA, 14 nt, Mycobacterium tuberculosis H37Rv
uagccgaccaggac

SEQ ID NO: 3264398 - RNA, 16 nt, Mycobacterium tuberculosis H37Rv
uagccgacuaucggcc

SEQ ID NO: 3264399 - RNA, 22 nt, Mycobacterium tuberculosis H37Rv
uagccgacuaucggccgccgga

SEQ ID NO: 3264400 - RNA, 21 nt, Mycobacterium tuberculosis H37Rv
uagccgagaagagauccugga

SEQ ID NO: 3264401 - RNA, 13 nt, Mycobacterium tuberculosis H37Rv
uagccgagccagu

SEQ ID NO: 3264402 - RNA, 23 nt, Mycobacterium tuberculosis H37Rv
uagccgauccagcaggccgucga

SEQ ID NO: 3264403 - RNA, 13 nt, Mycobacterium tuberculosis H37Rv
uagccgccgcggu

SEQ ID NO: 3264404 - RNA, 15 nt, Mycobacterium tuberculosis H37Rv
uagccgccggugccg

SEQ ID NO: 3264405 - RNA, 14 nt, Mycobacterium tuberculosis H37Rv
uagccgcgacccgc

SEQ ID NO: 3264406 - RNA, 23 nt, Mycobacterium tuberculosis H37Rv
uagccgcugcacguggccacggc

SEQ ID NO: 3264407 - RNA, 17 nt, Mycobacterium tuberculosis H37Rv
uagccgcugccuggccg

SEQ ID NO: 3264408 - RNA, 16 nt, Mycobacterium tuberculosis H37Rv
uagccggaucccgguc

SEQ ID NO: 3264409 - RNA, 17 nt, Mycobacterium tuberculosis H37Rv
uagccggcucaucgcag

SEQ ID NO: 3264410 - RNA, 19 nt, Mycobacterium tuberculosis H37Rv
uagccggcucaucgcagcc

SEQ ID NO: 3264411 - RNA, 22 nt, Mycobacterium tuberculosis H37Rv
uagccggucaguauggcgacga

SEQ ID NO: 3264412 - RNA, 16 nt, Mycobacterium tuberculosis H37Rv
uagccgugggccacga

SEQ ID NO: 3264413 - RNA, 23 nt, Mycobacterium tuberculosis H37Rv
uagucucgacaaagcggcugccc

SEQ ID NO: 3264414 - RNA, 18 nt, Mycobacterium tuberculosis H37Rv
uagugacugguauuuccc

SEQ ID NO: 3264415 - RNA, 13 nt, Mycobacterium tuberculosis H37Rv
uagugcaggugcc

SEQ ID NO: 3264416 - RNA, 18 nt, Mycobacterium tuberculosis H37Rv
uagugcaucggcagcccc

SEQ ID NO: 3264417 - RNA, 15 nt, Mycobacterium tuberculosis H37Rv
uagugcucgcagcca

SEQ ID NO: 3264418 - RNA, 18 nt, Mycobacterium tuberculosis H37Rv
uagugcucgccggcaccg

SEQ ID NO: 3264419 - RNA, 16 nt, Mycobacterium tuberculosis H37Rv
uaguggaagccgacca

SEQ ID NO: 3264420 - RNA, 22 nt, Mycobacterium tuberculosis H37Rv
uaguggcgaucugcugcucgau

SEQ ID NO: 3264421 - RNA, 13 nt, Mycobacterium tuberculosis H37Rv
uaguguguuuggu

SEQ ID NO: 3264422 - RNA, 17 nt, Mycobacterium tuberculosis H37Rv
uaguucagcgccguccu

SEQ ID NO: 3264423 - RNA, 19 nt, Mycobacterium tuberculosis H37Rv
uaguugcgcggcaucccgc

SEQ ID NO: 3264424 - RNA, 19 nt, Mycobacterium tuberculosis H37Rv
uaguugguccaggugaccg

SEQ ID NO: 3264425 - RNA, 11 nt, Mycobacterium tuberculosis H37Rv
uauagaagccg

SEQ ID NO: 3264426 - RNA, 20 nt, Mycobacterium tuberculosis H37Rv
uauaggcccgggcggccagc

SEQ ID NO: 3264427 - RNA, 19 nt, Mycobacterium tuberculosis H37Rv
uaucagccgagacaccacg

SEQ ID NO: 3264428 - RNA, 15 nt, Mycobacterium tuberculosis H37Rv
uauccagucgauccu

SEQ ID NO: 3264429 - RNA, 19 nt, Mycobacterium tuberculosis H37Rv
uaucccgaaucucacccac

SEQ ID NO: 3264430 - RNA, 20 nt, Mycobacterium tuberculosis H37Rv
uauccggaucggccugucca

SEQ ID NO: 3264431 - RNA, 18 nt, Mycobacterium tuberculosis H37Rv
uauccguacaguccacgc

SEQ ID NO: 3264432 - RNA, 21 nt, Mycobacterium tuberculosis H37Rv
uauccguguguuaggcccgca

SEQ ID NO: 3264433 - RNA, 19 nt, Mycobacterium tuberculosis H37Rv
uaucgaaaaguagaccgag

SEQ ID NO: 3264434 - RNA, 14 nt, Mycobacterium tuberculosis H37Rv
uaucgaaggcgaca

SEQ ID NO: 3264435 - RNA, 23 nt, Mycobacterium tuberculosis H37Rv
uaucgaaggcgacaucaccaccg

SEQ ID NO: 3264436 - RNA, 16 nt, Mycobacterium tuberculosis H37Rv
uaucgaugcggcgacc

SEQ ID NO: 3264437 - RNA, 17 nt, Mycobacterium tuberculosis H37Rv
uaucgcagcaucugcgg

SEQ ID NO: 3264438 - RNA, 10 nt, Mycobacterium tuberculosis H37Rv
uaucgccagu

SEQ ID NO: 3264439 - RNA, 15 nt, Mycobacterium tuberculosis H37Rv
uaucggcgugucucg

SEQ ID NO: 3264440 - RNA, 21 nt, Mycobacterium tuberculosis H37Rv
uaucggugcuggucgccgcgg

SEQ ID NO: 3264441 - RNA, 13 nt, Mycobacterium tuberculosis H37Rv
uaucguacuggcu

SEQ ID NO: 3264442 - RNA, 17 nt, Mycobacterium tuberculosis H37Rv
uaucguuggcgaccacc

SEQ ID NO: 3264443 - RNA, 24 nt, Mycobacterium tuberculosis H37Rv
uaucuauggaugaccgaaccuggu

SEQ ID NO: 3264444 - RNA, 13 nt, Mycobacterium tuberculosis H37Rv
uaucucggugacg

SEQ ID NO: 3264445 - RNA, 19 nt, Mycobacterium tuberculosis H37Rv
uaucuguugacucugcguc

SEQ ID NO: 3264446 - RNA, 12 nt, Mycobacterium tuberculosis H37Rv
uaugccacaggc

SEQ ID NO: 3264447 - RNA, 18 nt, Mycobacterium tuberculosis H37Rv
uaugccaggacuggcacc

SEQ ID NO: 3264448 - RNA, 23 nt, Mycobacterium tuberculosis H37Rv
uaugcccacgaaccgugcugggc

SEQ ID NO: 3264449 - RNA, 14 nt, Mycobacterium tuberculosis H37Rv
uaugcgcacucuag

SEQ ID NO: 3264450 - RNA, 22 nt, Mycobacterium tuberculosis H37Rv
uaugcgggacugacccugaucg

SEQ ID NO: 3264451 - RNA, 13 nt, Mycobacterium tuberculosis H37Rv
uaugcuggcagcu

SEQ ID NO: 3264452 - RNA, 13 nt, Mycobacterium tuberculosis H37Rv
uauggaccgccgc

SEQ ID NO: 3264453 - RNA, 13 nt, Mycobacterium tuberculosis H37Rv
uauggccaccacg

SEQ ID NO: 3264454 - RNA, 15 nt, Mycobacterium tuberculosis H37Rv
uauggcccgggccga

SEQ ID NO: 3264455 - RNA, 22 nt, Mycobacterium tuberculosis H37Rv
uauggcccgggccgaagcgcgc

SEQ ID NO: 3264456 - RNA, 14 nt, Mycobacterium tuberculosis H37Rv
uauggguccucgag

SEQ ID NO: 3264457 - RNA, 16 nt, Mycobacterium tuberculosis H37Rv
uaugugcccggcgcga

SEQ ID NO: 3264458 - RNA, 13 nt, Mycobacterium tuberculosis H37Rv
uauguucggcaau

SEQ ID NO: 3264459 - RNA, 19 nt, Mycobacterium tuberculosis H37Rv
uauucgccagcgccggaug

SEQ ID NO: 3264460 - RNA, 12 nt, Mycobacterium tuberculosis H37Rv
uauucggcggca

SEQ ID NO: 3264461 - RNA, 14 nt, Mycobacterium tuberculosis H37Rv
uauucguuggcgaa

SEQ ID NO: 3264462 - RNA, 18 nt, Mycobacterium tuberculosis H37Rv
uauugaacccguguucug

SEQ ID NO: 3264463 - RNA, 23 nt, Mycobacterium tuberculosis H37Rv
uauugcaggaaaucguccuugga

SEQ ID NO: 3264464 - RNA, 14 nt, Mycobacterium tuberculosis H37Rv
uauugccaaagccc

SEQ ID NO: 3264465 - RNA, 18 nt, Mycobacterium tuberculosis H37Rv
uauugcgcccggccauga

SEQ ID NO: 3264466 - RNA, 21 nt, Mycobacterium tuberculosis H37Rv
uauugggauacucgucgucgg

SEQ ID NO: 3264467 - RNA, 13 nt, Mycobacterium tuberculosis H37Rv
ucaaaaagcucgg

SEQ ID NO: 3264468 - RNA, 19 nt, Mycobacterium tuberculosis H37Rv
ucaaacccgaaaacccaac

SEQ ID NO: 3264469 - RNA, 20 nt, Mycobacterium tuberculosis H37Rv
ucaaacccgaaaacccaaca

SEQ ID NO: 3264470 - RNA, 21 nt, Mycobacterium tuberculosis H37Rv
ucaaacccgaaaacccaacac

SEQ ID NO: 3264471 - RNA, 18 nt, Mycobacterium tuberculosis H37Rv
ucaaaccggaaacagcau

SEQ ID NO: 3264472 - RNA, 19 nt, Mycobacterium tuberculosis H37Rv
ucaaacuaccgaacagugg

SEQ ID NO: 3264473 - RNA, 13 nt, Mycobacterium tuberculosis H37Rv
ucaaagcagcgca

SEQ ID NO: 3264474 - RNA, 20 nt, Mycobacterium tuberculosis H37Rv
ucaaauccuuugcugcccag

SEQ ID NO: 3264475 - RNA, 16 nt, Mycobacterium tuberculosis H37Rv
ucaacaccagcaagug

SEQ ID NO: 3264476 - RNA, 22 nt, Mycobacterium tuberculosis H37Rv
ucaacaccagcaagugugagca

SEQ ID NO: 3264477 - RNA, 17 nt, Mycobacterium tuberculosis H37Rv
ucaacaccgaguuccuc

SEQ ID NO: 3264478 - RNA, 20 nt, Mycobacterium tuberculosis H37Rv
ucaacaccgccgaccuaguc

SEQ ID NO: 3264479 - RNA, 13 nt, Mycobacterium tuberculosis H37Rv
ucaacagccaggg

SEQ ID NO: 3264480 - RNA, 19 nt, Mycobacterium tuberculosis H37Rv
ucaacagcggcaagaaguu

SEQ ID NO: 3264481 - RNA, 17 nt, Mycobacterium tuberculosis H37Rv
ucaacauugugcucgcc

SEQ ID NO: 3264482 - RNA, 13 nt, Mycobacterium tuberculosis H37Rv
ucaacauuucuga

SEQ ID NO: 3264483 - RNA, 18 nt, Mycobacterium tuberculosis H37Rv
ucaaccggacgaccggaa

SEQ ID NO: 3264484 - RNA, 16 nt, Mycobacterium tuberculosis H37Rv
ucaaccugcgcaucac

SEQ ID NO: 3264485 - RNA, 14 nt, Mycobacterium tuberculosis H37Rv
ucaacgacaccaga

SEQ ID NO: 3264486 - RNA, 23 nt, Mycobacterium tuberculosis H37Rv
ucaacgacaccauaggccgacgg

SEQ ID NO: 3264487 - RNA, 19 nt, Mycobacterium tuberculosis H37Rv
ucaacgcaaucgacugauc

SEQ ID NO: 3264488 - RNA, 21 nt, Mycobacterium tuberculosis H37Rv
ucaacgcacggcagacacgcu

SEQ ID NO: 3264489 - RNA, 19 nt, Mycobacterium tuberculosis H37Rv
ucaacgcaucgguggcacg

SEQ ID NO: 3264490 - RNA, 18 nt, Mycobacterium tuberculosis H37Rv
ucaacgccucugcucagc

SEQ ID NO: 3264491 - RNA, 21 nt, Mycobacterium tuberculosis H37Rv
ucaacgccucugcucagccgu

SEQ ID NO: 3264492 - RNA, 15 nt, Mycobacterium tuberculosis H37Rv
ucaacgcgcgcacgc

SEQ ID NO: 3264493 - RNA, 21 nt, Mycobacterium tuberculosis H37Rv
ucaacggaagaagcaguagcu

SEQ ID NO: 3264494 - RNA, 21 nt, Mycobacterium tuberculosis H37Rv
ucaacggaaugaaggcaccga

SEQ ID NO: 3264495 - RNA, 22 nt, Mycobacterium tuberculosis H37Rv
ucaacggcagaucccacgccag

SEQ ID NO: 3264496 - RNA, 21 nt, Mycobacterium tuberculosis H37Rv
ucaacggucucaacgcaucgg

SEQ ID NO: 3264497 - RNA, 17 nt, Mycobacterium tuberculosis H37Rv
ucaacgugucccaagcc

SEQ ID NO: 3264498 - RNA, 13 nt, Mycobacterium tuberculosis H37Rv
ucaacuccacgcg

SEQ ID NO: 3264499 - RNA, 23 nt, Mycobacterium tuberculosis H37Rv
ucaacucccgaacacuuugcgca

SEQ ID NO: 3264500 - RNA, 20 nt, Mycobacterium tuberculosis H37Rv
ucaacucgggcagcgcggcc

SEQ ID NO: 3264501 - RNA, 19 nt, Mycobacterium tuberculosis H37Rv
ucaacuucuuggugcccau

SEQ ID NO: 3264502 - RNA, 17 nt, Mycobacterium tuberculosis H37Rv
ucaagaagaacucggug

SEQ ID NO: 3264503 - RNA, 15 nt, Mycobacterium tuberculosis H37Rv
ucaagaucggugcca

SEQ ID NO: 3264504 - RNA, 18 nt, Mycobacterium tuberculosis H37Rv
ucaagaucggugccagca

SEQ ID NO: 3264505 - RNA, 20 nt, Mycobacterium tuberculosis H37Rv
ucaagaucggugccagcacu

SEQ ID NO: 3264506 - RNA, 23 nt, Mycobacterium tuberculosis H37Rv
ucaagcaaguccaccggaucguc

SEQ ID NO: 3264507 - RNA, 13 nt, Mycobacterium tuberculosis H37Rv
ucaagcacagccc

SEQ ID NO: 3264508 - RNA, 13 nt, Mycobacterium tuberculosis H37Rv
ucaagcagcgugg

SEQ ID NO: 3264509 - RNA, 18 nt, Mycobacterium tuberculosis H37Rv
ucaccgcgauuagcaaac

SEQ ID NO: 3264510 - RNA, 16 nt, Mycobacterium tuberculosis H37Rv
ucaccgcgcggcucac

SEQ ID NO: 3264511 - RNA, 22 nt, Mycobacterium tuberculosis H37Rv
ucaccgcguugaugaccagguc

SEQ ID NO: 3264512 - RNA, 19 nt, Mycobacterium tuberculosis H37Rv
ucaccggcgcccagcgccu

SEQ ID NO: 3264513 - RNA, 16 nt, Mycobacterium tuberculosis H37Rv
ucaccgggcccgacga

SEQ ID NO: 3264514 - RNA, 12 nt, Mycobacterium tuberculosis H37Rv
ucaccggguugg

SEQ ID NO: 3264515 - RNA, 18 nt, Mycobacterium tuberculosis H37Rv
ucaccggucaccgcgcag

SEQ ID NO: 3264516 - RNA, 17 nt, Mycobacterium tuberculosis H37Rv
ucaccggucagcgacgc

SEQ ID NO: 3264517 - RNA, 14 nt, Mycobacterium tuberculosis H37Rv
ucaccgguucggug

SEQ ID NO: 3264518 - RNA, 17 nt, Mycobacterium tuberculosis H37Rv
ucaccguaauuucuuca

SEQ ID NO: 3264519 - RNA, 24 nt, Mycobacterium tuberculosis H37Rv
ucaccguaauuucuucacggucga

SEQ ID NO: 3264520 - RNA, 15 nt, Mycobacterium tuberculosis H37Rv
ucaccguacggccac

SEQ ID NO: 3264521 - RNA, 17 nt, Mycobacterium tuberculosis H37Rv
ucaccgucgagucgacg

SEQ ID NO: 3264522 - RNA, 21 nt, Mycobacterium tuberculosis H37Rv
ucaccgucgagucgacggcau

SEQ ID NO: 3264523 - RNA, 19 nt, Mycobacterium tuberculosis H37Rv
ucaccgucugcaccggcag

SEQ ID NO: 3264524 - RNA, 16 nt, Mycobacterium tuberculosis H37Rv
ucaccgugcggaucgc

SEQ ID NO: 3264525 - RNA, 18 nt, Mycobacterium tuberculosis H37Rv
ucaccguguugcacgcgg

SEQ ID NO: 3264526 - RNA, 23 nt, Mycobacterium tuberculosis H37Rv
ucaccguguugcacgcgggugcc

SEQ ID NO: 3264527 - RNA, 17 nt, Mycobacterium tuberculosis H37Rv
ucaccguuggccgcgcu

SEQ ID NO: 3264528 - RNA, 21 nt, Mycobacterium tuberculosis H37Rv
ucaccucgcacgacaccucga

SEQ ID NO: 3264529 - RNA, 14 nt, Mycobacterium tuberculosis H37Rv
ucaccucggcgacg

SEQ ID NO: 3264530 - RNA, 16 nt, Mycobacterium tuberculosis H37Rv
ucaccucggugccggc

SEQ ID NO: 3264531 - RNA, 19 nt, Mycobacterium tuberculosis H37Rv
ucaccucgucgacaaacca

SEQ ID NO: 3264532 - RNA, 21 nt, Mycobacterium tuberculosis H37Rv
ucaccugacacgcccgcgagc

SEQ ID NO: 3264533 - RNA, 21 nt, Mycobacterium tuberculosis H37Rv
ucaccugcaucgucgccaagc

SEQ ID NO: 3264534 - RNA, 21 nt, Mycobacterium tuberculosis H37Rv
ucaccuggcgugucgccgcca

SEQ ID NO: 3264535 - RNA, 23 nt, Mycobacterium tuberculosis H37Rv
ucaccuggcgugucgccgccacc

SEQ ID NO: 3264536 - RNA, 20 nt, Mycobacterium tuberculosis H37Rv
ucaccuggugugcgggagac

SEQ ID NO: 3264537 - RNA, 20 nt, Mycobacterium tuberculosis H37Rv
ucaccuucaccgggugaccc

SEQ ID NO: 3264538 - RNA, 20 nt, Mycobacterium tuberculosis H37Rv
ucaccuugucaaaggugcac

SEQ ID NO: 3264539 - RNA, 17 nt, Mycobacterium tuberculosis H37Rv
ucacgaccugcucaucc

SEQ ID NO: 3264540 - RNA, 14 nt, Mycobacterium tuberculosis H37Rv
ucacgacgccgaau

SEQ ID NO: 3264541 - RNA, 21 nt, Mycobacterium tuberculosis H37Rv
ucacgacgccgagcagauacu

SEQ ID NO: 3264542 - RNA, 12 nt, Mycobacterium tuberculosis H37Rv
ucacgacggcac

SEQ ID NO: 3264543 - RNA, 21 nt, Mycobacterium tuberculosis H37Rv
ucacgacguccgaucgguguc

SEQ ID NO: 3264544 - RNA, 23 nt, Mycobacterium tuberculosis H37Rv
ucacgacuggcgcccagccggaa

SEQ ID NO: 3264545 - RNA, 15 nt, Mycobacterium tuberculosis H37Rv
ucacgagcaaaccag

SEQ ID NO: 3264546 - RNA, 16 nt, Mycobacterium tuberculosis H37Rv
ucacgaucacgauguc

SEQ ID NO: 3264547 - RNA, 16 nt, Mycobacterium tuberculosis H37Rv
ucacgaucacgucguc

SEQ ID NO: 3264548 - RNA, 15 nt, Mycobacterium tuberculosis H37Rv
ucacgaugcucgccg

SEQ ID NO: 3264549 - RNA, 16 nt, Mycobacterium tuberculosis H37Rv
ucacgcacaagccucg

SEQ ID NO: 3264550 - RNA, 11 nt, Mycobacterium tuberculosis H37Rv
ucacgcaccgc

SEQ ID NO: 3264551 - RNA, 22 nt, Mycobacterium tuberculosis H37Rv
ucacgcagcacccugcgggccg

SEQ ID NO: 3264552 - RNA, 15 nt, Mycobacterium tuberculosis H37Rv
ucacgcagcagugcg

SEQ ID NO: 3264553 - RNA, 23 nt, Mycobacterium tuberculosis H37Rv
ucacgcaggaaaaccccggccac

SEQ ID NO: 3264554 - RNA, 21 nt, Mycobacterium tuberculosis H37Rv
ucacgccaccgcaacucgccg

SEQ ID NO: 3264555 - RNA, 15 nt, Mycobacterium tuberculosis H37Rv
ucacgccccucacgu

SEQ ID NO: 3264556 - RNA, 14 nt, Mycobacterium tuberculosis H37Rv
ucacgccgccggag

SEQ ID NO: 3264557 - RNA, 15 nt, Mycobacterium tuberculosis H37Rv
ucacgccgucaccgc

SEQ ID NO: 3264558 - RNA, 17 nt, Mycobacterium tuberculosis H37Rv
ucacgccgucaccgcug

SEQ ID NO: 3264559 - RNA, 13 nt, Mycobacterium tuberculosis H37Rv
ucacgccugccac

SEQ ID NO: 3264560 - RNA, 18 nt, Mycobacterium tuberculosis H37Rv
ucacgccugccaccggcg

SEQ ID NO: 3264561 - RNA, 17 nt, Mycobacterium tuberculosis H37Rv
ucacgcgaaugacgauc

SEQ ID NO: 3264562 - RNA, 18 nt, Mycobacterium tuberculosis H37Rv
ucacgcgaaugacgaucc

SEQ ID NO: 3264563 - RNA, 19 nt, Mycobacterium tuberculosis H37Rv
ucacgcguuccauggcccg

SEQ ID NO: 3264564 - RNA, 19 nt, Mycobacterium tuberculosis H37Rv
ucacgcugaagccgcugga

SEQ ID NO: 3264565 - RNA, 13 nt, Mycobacterium tuberculosis H37Rv
ucacggaccaggc

SEQ ID NO: 3264566 - RNA, 14 nt, Mycobacterium tuberculosis H37Rv
ucacggaccgccac

SEQ ID NO: 3264567 - RNA, 18 nt, Mycobacterium tuberculosis H37Rv
ucacggacgcugggcggu

SEQ ID NO: 3264568 - RNA, 14 nt, Mycobacterium tuberculosis H37Rv
ucacggcaccgaag

SEQ ID NO: 3264569 - RNA, 16 nt, Mycobacterium tuberculosis H37Rv
ucacggcgcgagccug

SEQ ID NO: 3264570 - RNA, 13 nt, Mycobacterium tuberculosis H37Rv
ucacggcggggau

SEQ ID NO: 3264571 - RNA, 17 nt, Mycobacterium tuberculosis H37Rv
ucacgggcuaccggcag

SEQ ID NO: 3264572 - RNA, 21 nt, Mycobacterium tuberculosis H37Rv
ucacgggcuaccggcagcugc

SEQ ID NO: 3264573 - RNA, 22 nt, Mycobacterium tuberculosis H37Rv
ucacggggcgugacagggcggc

SEQ ID NO: 3264574 - RNA, 15 nt, Mycobacterium tuberculosis H37Rv
ucacgggugcuggca

SEQ ID NO: 3264575 - RNA, 18 nt, Mycobacterium tuberculosis H37Rv
ucacgguagcguucgucg

SEQ ID NO: 3264576 - RNA, 13 nt, Mycobacterium tuberculosis H37Rv
ucacggucgacga

SEQ ID NO: 3264577 - RNA, 17 nt, Mycobacterium tuberculosis H37Rv
ucacgguggccgcaucg

SEQ ID NO: 3264578 - RNA, 21 nt, Mycobacterium tuberculosis H37Rv
ucacggugggcgccgacaccg

SEQ ID NO: 3264579 - RNA, 22 nt, Mycobacterium tuberculosis H37Rv
ucacgguggugucagccaccgg

SEQ ID NO: 3264580 - RNA, 16 nt, Mycobacterium tuberculosis H37Rv
ucacgguugccgcgau

SEQ ID NO: 3264581 - RNA, 16 nt, Mycobacterium tuberculosis H37Rv
ucacguaacgccgcgg

SEQ ID NO: 3264582 - RNA, 15 nt, Mycobacterium tuberculosis H37Rv
ucacguaauccucgc

SEQ ID NO: 3264583 - RNA, 13 nt, Mycobacterium tuberculosis H37Rv
ucacguaauuccc

SEQ ID NO: 3264584 - RNA, 21 nt, Mycobacterium tuberculosis H37Rv
ucacguagcgaccgcggucgc

SEQ ID NO: 3264585 - RNA, 22 nt, Mycobacterium tuberculosis H37Rv
ucacguagcgaccgcggucgcu

SEQ ID NO: 3264586 - RNA, 17 nt, Mycobacterium tuberculosis H37Rv
ucacguagcgagcccac

SEQ ID NO: 3264587 - RNA, 21 nt, Mycobacterium tuberculosis H37Rv
ucacguagcgagcccacgugg

SEQ ID NO: 3264588 - RNA, 17 nt, Mycobacterium tuberculosis H37Rv
ucacgucuaacacgcgg

SEQ ID NO: 3264589 - RNA, 22 nt, Mycobacterium tuberculosis H37Rv
ucacguucagcccaugcccggc

SEQ ID NO: 3264590 - RNA, 21 nt, Mycobacterium tuberculosis H37Rv
ucacguugugagccacgcgca

SEQ ID NO: 3264591 - RNA, 14 nt, Mycobacterium tuberculosis H37Rv
ucacuaccgaucac

SEQ ID NO: 3264592 - RNA, 14 nt, Mycobacterium tuberculosis H37Rv
ucacuacuccgguc

SEQ ID NO: 3264593 - RNA, 13 nt, Mycobacterium tuberculosis H37Rv
ucacuccaugauc

SEQ ID NO: 3264594 - RNA, 16 nt, Mycobacterium tuberculosis H37Rv
ucacuccaugauccag

SEQ ID NO: 3264595 - RNA, 11 nt, Mycobacterium tuberculosis H37Rv
ucacugagauc

SEQ ID NO: 3264596 - RNA, 14 nt, Mycobacterium tuberculosis H37Rv
ucacugaugggccg

SEQ ID NO: 3264597 - RNA, 20 nt, Mycobacterium tuberculosis H37Rv
ucacugguccaacgaucagu

SEQ ID NO: 3264598 - RNA, 18 nt, Mycobacterium tuberculosis H37Rv
ucacugugccgcugcauc

SEQ ID NO: 3264599 - RNA, 15 nt, Mycobacterium tuberculosis H37Rv
ucacuguuccgggug

SEQ ID NO: 3264600 - RNA, 21 nt, Mycobacterium tuberculosis H37Rv
ucacuguugcccuugggacug

SEQ ID NO: 3264601 - RNA, 23 nt, Mycobacterium tuberculosis H37Rv
ucacuucgcguuucacgaaaccc

SEQ ID NO: 3264602 - RNA, 21 nt, Mycobacterium tuberculosis H37Rv
ucacuugcgccaccguggccg

SEQ ID NO: 3264603 - RNA, 14 nt, Mycobacterium tuberculosis H37Rv
ucagaacgcggccu

SEQ ID NO: 3264604 - RNA, 13 nt, Mycobacterium tuberculosis H37Rv
ucagaacggcggc

SEQ ID NO: 3264605 - RNA, 20 nt, Mycobacterium tuberculosis H37Rv
ucagcggccaacccaucccg

SEQ ID NO: 3264606 - RNA, 16 nt, Mycobacterium tuberculosis H37Rv
ucagcggccagcagug

SEQ ID NO: 3264607 - RNA, 17 nt, Mycobacterium tuberculosis H37Rv
ucagcggccagcagugc

SEQ ID NO: 3264608 - RNA, 20 nt, Mycobacterium tuberculosis H37Rv
ucagcggcccgcugcgcggc

SEQ ID NO: 3264609 - RNA, 21 nt, Mycobacterium tuberculosis H37Rv
ucagcggcccgcugcgcggcc

SEQ ID NO: 3264610 - RNA, 20 nt, Mycobacterium tuberculosis H37Rv
ucagcggcggccacggccau

SEQ ID NO: 3264611 - RNA, 14 nt, Mycobacterium tuberculosis H37Rv
ucagcggcucggcg

SEQ ID NO: 3264612 - RNA, 20 nt, Mycobacterium tuberculosis H37Rv
ucagcgggcagcaggcgaug

SEQ ID NO: 3264613 - RNA, 14 nt, Mycobacterium tuberculosis H37Rv
ucagcggucgcagc

SEQ ID NO: 3264614 - RNA, 16 nt, Mycobacterium tuberculosis H37Rv
ucagcgguggcguggu

SEQ ID NO: 3264615 - RNA, 23 nt, Mycobacterium tuberculosis H37Rv
ucagcguauuggacgcugccgca

SEQ ID NO: 3264616 - RNA, 21 nt, Mycobacterium tuberculosis H37Rv
ucagcgucaggccuccaaaau

SEQ ID NO: 3264617 - RNA, 22 nt, Mycobacterium tuberculosis H37Rv
ucagcgucaggccuccaaaauc

SEQ ID NO: 3264618 - RNA, 15 nt, Mycobacterium tuberculosis H37Rv
ucagcgucugagcgc

SEQ ID NO: 3264619 - RNA, 20 nt, Mycobacterium tuberculosis H37Rv
ucagcgucugagcgccggca

SEQ ID NO: 3264620 - RNA, 17 nt, Mycobacterium tuberculosis H37Rv
ucagcgugcauggcggu

SEQ ID NO: 3264621 - RNA, 19 nt, Mycobacterium tuberculosis H37Rv
ucagcguggcgcccgugcc

SEQ ID NO: 3264622 - RNA, 13 nt, Mycobacterium tuberculosis H37Rv
ucagcgugucgcc

SEQ ID NO: 3264623 - RNA, 12 nt, Mycobacterium tuberculosis H37Rv
ucagcucaccac

SEQ ID NO: 3264624 - RNA, 22 nt, Mycobacterium tuberculosis H37Rv
ucagcucgaccccggugcccau

SEQ ID NO: 3264625 - RNA, 19 nt, Mycobacterium tuberculosis H37Rv
ucagcucgaggaccaccug

SEQ ID NO: 3264626 - RNA, 13 nt, Mycobacterium tuberculosis H37Rv
ucagcucgccagg

SEQ ID NO: 3264627 - RNA, 14 nt, Mycobacterium tuberculosis H37Rv
ucagcucggguugc

SEQ ID NO: 3264628 - RNA, 22 nt, Mycobacterium tuberculosis H37Rv
ucagcugauuaccgacaccgug

SEQ ID NO: 3264629 - RNA, 12 nt, Mycobacterium tuberculosis H37Rv
ucagcugcugcc

SEQ ID NO: 3264630 - RNA, 13 nt, Mycobacterium tuberculosis H37Rv
ucagcugcugcca

SEQ ID NO: 3264631 - RNA, 14 nt, Mycobacterium tuberculosis H37Rv
ucagcugcugccac

SEQ ID NO: 3264632 - RNA, 15 nt, Mycobacterium tuberculosis H37Rv
ucagcugcugccacc

SEQ ID NO: 3264633 - RNA, 17 nt, Mycobacterium tuberculosis H37Rv
ucaggaaccacccaccg

SEQ ID NO: 3264634 - RNA, 22 nt, Mycobacterium tuberculosis H37Rv
ucaggaaccacccaccggccac

SEQ ID NO: 3264635 - RNA, 14 nt, Mycobacterium tuberculosis H37Rv
ucaggacaugcagg

SEQ ID NO: 3264636 - RNA, 20 nt, Mycobacterium tuberculosis H37Rv
ucaggacgcgaucggcguca

SEQ ID NO: 3264637 - RNA, 21 nt, Mycobacterium tuberculosis H37Rv
ucaggaucccgguggcagcac

SEQ ID NO: 3264638 - RNA, 14 nt, Mycobacterium tuberculosis H37Rv
ucaggaucgcaccg

SEQ ID NO: 3264639 - RNA, 17 nt, Mycobacterium tuberculosis H37Rv
ucaggcagcuccgccgc

SEQ ID NO: 3264640 - RNA, 13 nt, Mycobacterium tuberculosis H37Rv
ucaggccagggug

SEQ ID NO: 3264641 - RNA, 18 nt, Mycobacterium tuberculosis H37Rv
ucaggcccauggcagccc

SEQ ID NO: 3264642 - RNA, 21 nt, Mycobacterium tuberculosis H37Rv
ucaggcccugccgacgcucca

SEQ ID NO: 3264643 - RNA, 15 nt, Mycobacterium tuberculosis H37Rv
ucaggcccuuuuccc

SEQ ID NO: 3264644 - RNA, 22 nt, Mycobacterium tuberculosis H37Rv
ucaggcccuuuucccugccuuc

SEQ ID NO: 3264645 - RNA, 20 nt, Mycobacterium tuberculosis H37Rv
ucaggccgacuaaccacugu

SEQ ID NO: 3264646 - RNA, 21 nt, Mycobacterium tuberculosis H37Rv
ucaggccgaugcgggucucga

SEQ ID NO: 3264647 - RNA, 17 nt, Mycobacterium tuberculosis H37Rv
ucaggccgccgcggcga

SEQ ID NO: 3264648 - RNA, 14 nt, Mycobacterium tuberculosis H37Rv
ucaggcgccgcuau

SEQ ID NO: 3264649 - RNA, 19 nt, Mycobacterium tuberculosis H37Rv
ucaggcgggcaacgcagca

SEQ ID NO: 3264650 - RNA, 16 nt, Mycobacterium tuberculosis H37Rv
ucaggcucauccgccg

SEQ ID NO: 3264651 - RNA, 15 nt, Mycobacterium tuberculosis H37Rv
ucaggcucgccgaug

SEQ ID NO: 3264652 - RNA, 16 nt, Mycobacterium tuberculosis H37Rv
ucagggccccaccgag

SEQ ID NO: 3264653 - RNA, 16 nt, Mycobacterium tuberculosis H37Rv
ucagggcucgcucgcc

SEQ ID NO: 3264654 - RNA, 22 nt, Mycobacterium tuberculosis H37Rv
ucaggggcgccuuaggcguccg

SEQ ID NO: 3264655 - RNA, 17 nt, Mycobacterium tuberculosis H37Rv
ucagguagcggcccuuc

SEQ ID NO: 3264656 - RNA, 12 nt, Mycobacterium tuberculosis H37Rv
ucaggucaccgg

SEQ ID NO: 3264657 - RNA, 14 nt, Mycobacterium tuberculosis H37Rv
ucagguccaccgcu

SEQ ID NO: 3264658 - RNA, 19 nt, Mycobacterium tuberculosis H37Rv
ucagguccuggguguagca

SEQ ID NO: 3264659 - RNA, 18 nt, Mycobacterium tuberculosis H37Rv
ucaggucgcagaccagac

SEQ ID NO: 3264660 - RNA, 20 nt, Mycobacterium tuberculosis H37Rv
ucaggucgguggucucgacg

SEQ ID NO: 3264661 - RNA, 17 nt, Mycobacterium tuberculosis H37Rv
ucaggucgucacgcccc

SEQ ID NO: 3264662 - RNA, 20 nt, Mycobacterium tuberculosis H37Rv
ucaggucguuugugaacacc

SEQ ID NO: 3264663 - RNA, 20 nt, Mycobacterium tuberculosis H37Rv
ucaggucuucgauggccaug

SEQ ID NO: 3264664 - RNA, 20 nt, Mycobacterium tuberculosis H37Rv
ucaggugauucgcgcagcgc

SEQ ID NO: 3264665 - RNA, 15 nt, Mycobacterium tuberculosis H37Rv
ucagguucgcaccgg

SEQ ID NO: 3264666 - RNA, 17 nt, Mycobacterium tuberculosis H37Rv
ucaguagccacgcccac

SEQ ID NO: 3264667 - RNA, 22 nt, Mycobacterium tuberculosis H37Rv
ucaguagccacgcccacagggg

SEQ ID NO: 3264668 - RNA, 16 nt, Mycobacterium tuberculosis H37Rv
ucagucaacucaccgu

SEQ ID NO: 3264669 - RNA, 18 nt, Mycobacterium tuberculosis H37Rv
ucagugaagacaccaggc

SEQ ID NO: 3264670 - RNA, 20 nt, Mycobacterium tuberculosis H37Rv
ucagugaagacaccaggccc

SEQ ID NO: 3264671 - RNA, 20 nt, Mycobacterium tuberculosis H37Rv
ucagugcguuggcgccggcc

SEQ ID NO: 3264672 - RNA, 20 nt, Mycobacterium tuberculosis H37Rv
ucaguucggugugcggcgca

SEQ ID NO: 3264673 - RNA, 23 nt, Mycobacterium tuberculosis H37Rv
ucaguugcgcuccaacaacucca

SEQ ID NO: 3264674 - RNA, 13 nt, Mycobacterium tuberculosis H37Rv
ucaguugugcguu

SEQ ID NO: 3264675 - RNA, 20 nt, Mycobacterium tuberculosis H37Rv
ucauaaaugggugugcugcc

SEQ ID NO: 3264676 - RNA, 15 nt, Mycobacterium tuberculosis H37Rv
ucauacucgacaccg

SEQ ID NO: 3264677 - RNA, 23 nt, Mycobacterium tuberculosis H37Rv
ucauagccccgcagagucgccga

SEQ ID NO: 3264678 - RNA, 16 nt, Mycobacterium tuberculosis H37Rv
ucauagcgcaccaccg

SEQ ID NO: 3264679 - RNA, 12 nt, Mycobacterium tuberculosis H37Rv
ucauagugcagg

SEQ ID NO: 3264680 - RNA, 19 nt, Mycobacterium tuberculosis H37Rv
ucauauccgccccagcugc

SEQ ID NO: 3264681 - RNA, 20 nt, Mycobacterium tuberculosis H37Rv
ucauaucucgagcccucguu

SEQ ID NO: 3264682 - RNA, 15 nt, Mycobacterium tuberculosis H37Rv
ucaucaagguguugc

SEQ ID NO: 3264683 - RNA, 13 nt, Mycobacterium tuberculosis H37Rv
ucaucacccagcg

SEQ ID NO: 3264684 - RNA, 12 nt, Mycobacterium tuberculosis H37Rv
ucaucaccggca

SEQ ID NO: 3264685 - RNA, 17 nt, Mycobacterium tuberculosis H37Rv
ucaucaccggcgcaccg

SEQ ID NO: 3264686 - RNA, 21 nt, Mycobacterium tuberculosis H37Rv
ucaucaccucuccguccucgu

SEQ ID NO: 3264687 - RNA, 16 nt, Mycobacterium tuberculosis H37Rv
ucaucaccucucgcuu

SEQ ID NO: 3264688 - RNA, 18 nt, Mycobacterium tuberculosis H37Rv
ucaucauccacaccggau

SEQ ID NO: 3264689 - RNA, 15 nt, Mycobacterium tuberculosis H37Rv
ucauccacaccggau

SEQ ID NO: 3264690 - RNA, 13 nt, Mycobacterium tuberculosis H37Rv
ucauccaccgaug

SEQ ID NO: 3264691 - RNA, 20 nt, Mycobacterium tuberculosis H37Rv
ucauccacuccgccaacauc

SEQ ID NO: 3264692 - RNA, 13 nt, Mycobacterium tuberculosis H37Rv
ucauccagccagc

SEQ ID NO: 3264693 - RNA, 18 nt, Mycobacterium tuberculosis H37Rv
ucaucccgagaucaccuu

SEQ ID NO: 3264694 - RNA, 20 nt, Mycobacterium tuberculosis H37Rv
ucaucccgauguaccccagc

SEQ ID NO: 3264695 - RNA, 18 nt, Mycobacterium tuberculosis H37Rv
ucauccgggcgaccacca

SEQ ID NO: 3264696 - RNA, 15 nt, Mycobacterium tuberculosis H37Rv
ucaucgaccuggcca

SEQ ID NO: 3264697 - RNA, 18 nt, Mycobacterium tuberculosis H37Rv
ucaucgaccuggccacgg

SEQ ID NO: 3264698 - RNA, 22 nt, Mycobacterium tuberculosis H37Rv
ucaucgacgagccgcggucggc

SEQ ID NO: 3264699 - RNA, 16 nt, Mycobacterium tuberculosis H37Rv
ucaucgacgccugcgg

SEQ ID NO: 3264700 - RNA, 16 nt, Mycobacterium tuberculosis H37Rv
ucaucgagcugaccug

SEQ ID NO: 3264701 - RNA, 20 nt, Mycobacterium tuberculosis H37Rv
uccagaaguaggcgaccgcc

SEQ ID NO: 3264702 - RNA, 22 nt, Mycobacterium tuberculosis H37Rv
uccagaaugucgcggguggcuu

SEQ ID NO: 3264703 - RNA, 21 nt, Mycobacterium tuberculosis H37Rv
uccagacgccacugccagccg

SEQ ID NO: 3264704 - RNA, 20 nt, Mycobacterium tuberculosis H37Rv
uccagagacaugucgcugcc

SEQ ID NO: 3264705 - RNA, 22 nt, Mycobacterium tuberculosis H37Rv
uccagaggccggcgggcucgcc

SEQ ID NO: 3264706 - RNA, 16 nt, Mycobacterium tuberculosis H37Rv
uccagauacaggaaca

SEQ ID NO: 3264707 - RNA, 16 nt, Mycobacterium tuberculosis H37Rv
uccagauaccaccgcc

SEQ ID NO: 3264708 - RNA, 22 nt, Mycobacterium tuberculosis H37Rv
uccagauaccaccgccgcugcc

SEQ ID NO: 3264709 - RNA, 15 nt, Mycobacterium tuberculosis H37Rv
uccagaucaacgcgu

SEQ ID NO: 3264710 - RNA, 22 nt, Mycobacterium tuberculosis H37Rv
uccagauccgggcaugcgccgu

SEQ ID NO: 3264711 - RNA, 21 nt, Mycobacterium tuberculosis H37Rv
uccagcaacagcgagcgguug

SEQ ID NO: 3264712 - RNA, 16 nt, Mycobacterium tuberculosis H37Rv
uccagcaaccucgguu

SEQ ID NO: 3264713 - RNA, 22 nt, Mycobacterium tuberculosis H37Rv
uccagcaaggccagcacggcuu

SEQ ID NO: 3264714 - RNA, 15 nt, Mycobacterium tuberculosis H37Rv
uccagcaccaccgga

SEQ ID NO: 3264715 - RNA, 18 nt, Mycobacterium tuberculosis H37Rv
uccagcaccagcacggca

SEQ ID NO: 3264716 - RNA, 18 nt, Mycobacterium tuberculosis H37Rv
uccagcacgccguccagg

SEQ ID NO: 3264717 - RNA, 19 nt, Mycobacterium tuberculosis H37Rv
uccagcagcgacgcugccg

SEQ ID NO: 3264718 - RNA, 13 nt, Mycobacterium tuberculosis H37Rv
uccagcagcgagu

SEQ ID NO: 3264719 - RNA, 19 nt, Mycobacterium tuberculosis H37Rv
uccagcagguccgcggccg

SEQ ID NO: 3264720 - RNA, 18 nt, Mycobacterium tuberculosis H37Rv
uccagcaggucgccugcc

SEQ ID NO: 3264721 - RNA, 15 nt, Mycobacterium tuberculosis H37Rv
uccagcaugcccgcc

SEQ ID NO: 3264722 - RNA, 13 nt, Mycobacterium tuberculosis H37Rv
uccagccaacggg

SEQ ID NO: 3264723 - RNA, 18 nt, Mycobacterium tuberculosis H37Rv
uccagccaacgggaacaa

SEQ ID NO: 3264724 - RNA, 12 nt, Mycobacterium tuberculosis H37Rv
uccagccaggcg

SEQ ID NO: 3264725 - RNA, 19 nt, Mycobacterium tuberculosis H37Rv
uccagccaggcgauugccc

SEQ ID NO: 3264726 - RNA, 16 nt, Mycobacterium tuberculosis H37Rv
uccagcccaacucggc

SEQ ID NO: 3264727 - RNA, 20 nt, Mycobacterium tuberculosis H37Rv
uccagcccaacucggccagc

SEQ ID NO: 3264728 - RNA, 20 nt, Mycobacterium tuberculosis H37Rv
uccagcccguccaggcgcug

SEQ ID NO: 3264729 - RNA, 22 nt, Mycobacterium tuberculosis H37Rv
uccagccgacguaccagggugu

SEQ ID NO: 3264730 - RNA, 16 nt, Mycobacterium tuberculosis H37Rv
uccagccgcgcguccg

SEQ ID NO: 3264731 - RNA, 22 nt, Mycobacterium tuberculosis H37Rv
uccagccgcgcguccgggcagc

SEQ ID NO: 3264732 - RNA, 20 nt, Mycobacterium tuberculosis H37Rv
uccagccggcgcgccggaug

SEQ ID NO: 3264733 - RNA, 19 nt, Mycobacterium tuberculosis H37Rv
uccagccgggugccggcau

SEQ ID NO: 3264734 - RNA, 13 nt, Mycobacterium tuberculosis H37Rv
uccagccguggcg

SEQ ID NO: 3264735 - RNA, 20 nt, Mycobacterium tuberculosis H37Rv
uccagcgaggagcagggcuc

SEQ ID NO: 3264736 - RNA, 12 nt, Mycobacterium tuberculosis H37Rv
uccagcgcaccg

SEQ ID NO: 3264737 - RNA, 13 nt, Mycobacterium tuberculosis H37Rv
uccagcgcaccgg

SEQ ID NO: 3264738 - RNA, 13 nt, Mycobacterium tuberculosis H37Rv
uccagcgcaucga

SEQ ID NO: 3264739 - RNA, 17 nt, Mycobacterium tuberculosis H37Rv
uccagcgcccggucacg

SEQ ID NO: 3264740 - RNA, 18 nt, Mycobacterium tuberculosis H37Rv
uccagcgcccggucacgc

SEQ ID NO: 3264741 - RNA, 14 nt, Mycobacterium tuberculosis H37Rv
uccagcgccgaccu

SEQ ID NO: 3264742 - RNA, 16 nt, Mycobacterium tuberculosis H37Rv
uccagcgccgcggccc

SEQ ID NO: 3264743 - RNA, 14 nt, Mycobacterium tuberculosis H37Rv
uccagcgccgcggu

SEQ ID NO: 3264744 - RNA, 17 nt, Mycobacterium tuberculosis H37Rv
uccagcgcgcgccgcag

SEQ ID NO: 3264745 - RNA, 14 nt, Mycobacterium tuberculosis H37Rv
uccagcgcggccuu

SEQ ID NO: 3264746 - RNA, 21 nt, Mycobacterium tuberculosis H37Rv
uccagcggaucgucguuguca

SEQ ID NO: 3264747 - RNA, 13 nt, Mycobacterium tuberculosis H37Rv
uccagcggcaccg

SEQ ID NO: 3264748 - RNA, 18 nt, Mycobacterium tuberculosis H37Rv
uccagcggcauggugacg

SEQ ID NO: 3264749 - RNA, 23 nt, Mycobacterium tuberculosis H37Rv
uccagcggcgggggcgucgccgc

SEQ ID NO: 3264750 - RNA, 19 nt, Mycobacterium tuberculosis H37Rv
uccagcgggaucugaccca

SEQ ID NO: 3264751 - RNA, 19 nt, Mycobacterium tuberculosis H37Rv
uccagcggguggccaucac

SEQ ID NO: 3264752 - RNA, 17 nt, Mycobacterium tuberculosis H37Rv
uccagcgucccgaugua

SEQ ID NO: 3264753 - RNA, 23 nt, Mycobacterium tuberculosis H37Rv
uccagcgucugcacguacucggc

SEQ ID NO: 3264754 - RNA, 14 nt, Mycobacterium tuberculosis H37Rv
uccagcgugccugg

SEQ ID NO: 3264755 - RNA, 13 nt, Mycobacterium tuberculosis H37Rv
uccagcgugucgu

SEQ ID NO: 3264756 - RNA, 17 nt, Mycobacterium tuberculosis H37Rv
uccagcucggccagugc

SEQ ID NO: 3264757 - RNA, 21 nt, Mycobacterium tuberculosis H37Rv
uccagcucggccagugccggu

SEQ ID NO: 3264758 - RNA, 14 nt, Mycobacterium tuberculosis H37Rv
uccagcugcgcggg

SEQ ID NO: 3264759 - RNA, 16 nt, Mycobacterium tuberculosis H37Rv
uccagcugcgcgggcg

SEQ ID NO: 3264760 - RNA, 15 nt, Mycobacterium tuberculosis H37Rv
uccagcugcugccga

SEQ ID NO: 3264761 - RNA, 15 nt, Mycobacterium tuberculosis H37Rv
uccaggaauucccca

SEQ ID NO: 3264762 - RNA, 15 nt, Mycobacterium tuberculosis H37Rv
uccaggacggaucgu

SEQ ID NO: 3264763 - RNA, 21 nt, Mycobacterium tuberculosis H37Rv
uccaggagccccagguagucg

SEQ ID NO: 3264764 - RNA, 15 nt, Mycobacterium tuberculosis H37Rv
uccaggagccgagga

SEQ ID NO: 3264765 - RNA, 21 nt, Mycobacterium tuberculosis H37Rv
uccaggaggcauugguguagc

SEQ ID NO: 3264766 - RNA, 13 nt, Mycobacterium tuberculosis H37Rv
uccaggccggcag

SEQ ID NO: 3264767 - RNA, 23 nt, Mycobacterium tuberculosis H37Rv
uccaggccuaguccggcacugcg

SEQ ID NO: 3264768 - RNA, 13 nt, Mycobacterium tuberculosis H37Rv
uccaggcgccacc

SEQ ID NO: 3264769 - RNA, 16 nt, Mycobacterium tuberculosis H37Rv
uccaggcgcgcaccac

SEQ ID NO: 3264770 - RNA, 17 nt, Mycobacterium tuberculosis H37Rv
uccaggcgcgcaccacc

SEQ ID NO: 3264771 - RNA, 20 nt, Mycobacterium tuberculosis H37Rv
uccaggcgcgccgcacccgg

SEQ ID NO: 3264772 - RNA, 21 nt, Mycobacterium tuberculosis H37Rv
uccaggcguuggaucccagcc

SEQ ID NO: 3264773 - RNA, 14 nt, Mycobacterium tuberculosis H37Rv
uccaggcugucgcg

SEQ ID NO: 3264774 - RNA, 14 nt, Mycobacterium tuberculosis H37Rv
uccagggccacgau

SEQ ID NO: 3264775 - RNA, 16 nt, Mycobacterium tuberculosis H37Rv
uccagggcccugcugg

SEQ ID NO: 3264776 - RNA, 16 nt, Mycobacterium tuberculosis H37Rv
uccagggccgacgcga

SEQ ID NO: 3264777 - RNA, 17 nt, Mycobacterium tuberculosis H37Rv
uccagggccgacgcgaa

SEQ ID NO: 3264778 - RNA, 21 nt, Mycobacterium tuberculosis H37Rv
uccaggguccggacgaaaucg

SEQ ID NO: 3264779 - RNA, 16 nt, Mycobacterium tuberculosis H37Rv
uccaggguggucgucg

SEQ ID NO: 3264780 - RNA, 22 nt, Mycobacterium tuberculosis H37Rv
uccaggguggucgucgucucga

SEQ ID NO: 3264781 - RNA, 21 nt, Mycobacterium tuberculosis H37Rv
uccagguggcgcggacccgcc

SEQ ID NO: 3264782 - RNA, 19 nt, Mycobacterium tuberculosis H37Rv
uccagguucuucuccacca

SEQ ID NO: 3264783 - RNA, 21 nt, Mycobacterium tuberculosis H37Rv
uccagguucuucuccaccacc

SEQ ID NO: 3264784 - RNA, 22 nt, Mycobacterium tuberculosis H37Rv
uccagguucuucuccaccaccg

SEQ ID NO: 3264785 - RNA, 14 nt, Mycobacterium tuberculosis H37Rv
uccaguaaccgucc

SEQ ID NO: 3264786 - RNA, 19 nt, Mycobacterium tuberculosis H37Rv
uccaguaaccguccgcgga

SEQ ID NO: 3264787 - RNA, 17 nt, Mycobacterium tuberculosis H37Rv
uccaguccaugugccca

SEQ ID NO: 3264788 - RNA, 23 nt, Mycobacterium tuberculosis H37Rv
uccaguccuaucagugagccgcc

SEQ ID NO: 3264789 - RNA, 12 nt, Mycobacterium tuberculosis H37Rv
uccagucuggga

SEQ ID NO: 3264790 - RNA, 20 nt, Mycobacterium tuberculosis H37Rv
uccagugcgguggccagugc

SEQ ID NO: 3264791 - RNA, 18 nt, Mycobacterium tuberculosis H37Rv
uccaguggcagccagcgg

SEQ ID NO: 3264792 - RNA, 14 nt, Mycobacterium tuberculosis H37Rv
uccaucaaggucau

SEQ ID NO: 3264793 - RNA, 13 nt, Mycobacterium tuberculosis H37Rv
uccaucacaucca

SEQ ID NO: 3264794 - RNA, 19 nt, Mycobacterium tuberculosis H37Rv
uccaucacauccacgcacu

SEQ ID NO: 3264795 - RNA, 19 nt, Mycobacterium tuberculosis H37Rv
uccaucaccacaccggcag

SEQ ID NO: 3264796 - RNA, 15 nt, Mycobacterium tuberculosis H37Rv
uccaucagagacagc

SEQ ID NO: 3264797 - RNA, 19 nt, Mycobacterium tuberculosis H37Rv
uccaucagagacagcagcg

SEQ ID NO: 3264798 - RNA, 13 nt, Mycobacterium tuberculosis H37Rv
uccaucaugugcg

SEQ ID NO: 3264799 - RNA, 14 nt, Mycobacterium tuberculosis H37Rv
uccaucgcgcaccg

SEQ ID NO: 3264800 - RNA, 18 nt, Mycobacterium tuberculosis H37Rv
uccaucgcgcgccgaccg

SEQ ID NO: 3264801 - RNA, 15 nt, Mycobacterium tuberculosis H37Rv
uccaugacaaaccug

SEQ ID NO: 3264802 - RNA, 16 nt, Mycobacterium tuberculosis H37Rv
uccaugacaaaccugc

SEQ ID NO: 3264803 - RNA, 18 nt, Mycobacterium tuberculosis H37Rv
uccaugacaaaccugcau

SEQ ID NO: 3264804 - RNA, 22 nt, Mycobacterium tuberculosis H37Rv
uccaugauggccgucagccagg

SEQ ID NO: 3264805 - RNA, 13 nt, Mycobacterium tuberculosis H37Rv
uccaugcgacuuc

SEQ ID NO: 3264806 - RNA, 17 nt, Mycobacterium tuberculosis H37Rv
uccauggacggccaggu

SEQ ID NO: 3264807 - RNA, 21 nt, Mycobacterium tuberculosis H37Rv
uccauggacggccaggugcag

SEQ ID NO: 3264808 - RNA, 14 nt, Mycobacterium tuberculosis H37Rv
uccaugugcccagg

SEQ ID NO: 3264809 - RNA, 19 nt, Mycobacterium tuberculosis H37Rv
uccauguuuugcugcaugc

SEQ ID NO: 3264810 - RNA, 18 nt, Mycobacterium tuberculosis H37Rv
uccauucauggccgcgau

SEQ ID NO: 3264811 - RNA, 17 nt, Mycobacterium tuberculosis H37Rv
uccauugugggacgcga

SEQ ID NO: 3264812 - RNA, 15 nt, Mycobacterium tuberculosis H37Rv
ucccaacgccacugc

SEQ ID NO: 3264813 - RNA, 21 nt, Mycobacterium tuberculosis H37Rv
ucccaacggcagcgccaccga

SEQ ID NO: 3264814 - RNA, 20 nt, Mycobacterium tuberculosis H37Rv
ucccacagguagaccgucuc

SEQ ID NO: 3264815 - RNA, 14 nt, Mycobacterium tuberculosis H37Rv
ucccaccaccaccg

SEQ ID NO: 3264816 - RNA, 22 nt, Mycobacterium tuberculosis H37Rv
ucccaccaccgcucgucguccg

SEQ ID NO: 3264817 - RNA, 18 nt, Mycobacterium tuberculosis H37Rv
ucccaccgcuuccagguu

SEQ ID NO: 3264818 - RNA, 20 nt, Mycobacterium tuberculosis H37Rv
ucccacgagcggguccgacg

SEQ ID NO: 3264819 - RNA, 17 nt, Mycobacterium tuberculosis H37Rv
ucccacgaguuggccaa

SEQ ID NO: 3264820 - RNA, 15 nt, Mycobacterium tuberculosis H37Rv
ucccacgccgccguu

SEQ ID NO: 3264821 - RNA, 14 nt, Mycobacterium tuberculosis H37Rv
ucccacucacccag

SEQ ID NO: 3264822 - RNA, 12 nt, Mycobacterium tuberculosis H37Rv
ucccacucccgc

SEQ ID NO: 3264823 - RNA, 14 nt, Mycobacterium tuberculosis H37Rv
ucccacucgucguc

SEQ ID NO: 3264824 - RNA, 18 nt, Mycobacterium tuberculosis H37Rv
ucccacugcaucacgccg

SEQ ID NO: 3264825 - RNA, 16 nt, Mycobacterium tuberculosis H37Rv
ucccagaggcccgcgg

SEQ ID NO: 3264826 - RNA, 13 nt, Mycobacterium tuberculosis H37Rv
ucccagccaaccc

SEQ ID NO: 3264827 - RNA, 14 nt, Mycobacterium tuberculosis H37Rv
ucccagccaacccg

SEQ ID NO: 3264828 - RNA, 17 nt, Mycobacterium tuberculosis H37Rv
ucccagcucccgcggcg

SEQ ID NO: 3264829 - RNA, 19 nt, Mycobacterium tuberculosis H37Rv
ucccagcucccgcggcgcc

SEQ ID NO: 3264830 - RNA, 17 nt, Mycobacterium tuberculosis H37Rv
ucccaggacuccggccg

SEQ ID NO: 3264831 - RNA, 16 nt, Mycobacterium tuberculosis H37Rv
ucccagggcugccggu

SEQ ID NO: 3264832 - RNA, 18 nt, Mycobacterium tuberculosis H37Rv
ucccaguccaggacgguc

SEQ ID NO: 3264833 - RNA, 16 nt, Mycobacterium tuberculosis H37Rv
ucccagugagcaugcg

SEQ ID NO: 3264834 - RNA, 13 nt, Mycobacterium tuberculosis H37Rv
ucccauacgccgg

SEQ ID NO: 3264835 - RNA, 15 nt, Mycobacterium tuberculosis H37Rv
ucccauaucgaucgg

SEQ ID NO: 3264836 - RNA, 19 nt, Mycobacterium tuberculosis H37Rv
ucccaucaguugcacaccg

SEQ ID NO: 3264837 - RNA, 15 nt, Mycobacterium tuberculosis H37Rv
ucccaucccaugucg

SEQ ID NO: 3264838 - RNA, 16 nt, Mycobacterium tuberculosis H37Rv
ucccaugcugcgcaac

SEQ ID NO: 3264839 - RNA, 14 nt, Mycobacterium tuberculosis H37Rv
ucccauucccaaca

SEQ ID NO: 3264840 - RNA, 17 nt, Mycobacterium tuberculosis H37Rv
ucccauucccaacacag

SEQ ID NO: 3264841 - RNA, 12 nt, Mycobacterium tuberculosis H37Rv
ucccauuugccu

SEQ ID NO: 3264842 - RNA, 19 nt, Mycobacterium tuberculosis H37Rv
uccccaagucgacgguggc

SEQ ID NO: 3264843 - RNA, 15 nt, Mycobacterium tuberculosis H37Rv
uccccacauggcccg

SEQ ID NO: 3264844 - RNA, 16 nt, Mycobacterium tuberculosis H37Rv
uccccaccacaccucg

SEQ ID NO: 3264845 - RNA, 14 nt, Mycobacterium tuberculosis H37Rv
uccccaccgucguc

SEQ ID NO: 3264846 - RNA, 15 nt, Mycobacterium tuberculosis H37Rv
uccccaccgucgucg

SEQ ID NO: 3264847 - RNA, 18 nt, Mycobacterium tuberculosis H37Rv
uccccagacagaccccca

SEQ ID NO: 3264848 - RNA, 14 nt, Mycobacterium tuberculosis H37Rv
uccccagcgccacc

SEQ ID NO: 3264849 - RNA, 16 nt, Mycobacterium tuberculosis H37Rv
uccccaggugggcagc

SEQ ID NO: 3264850 - RNA, 22 nt, Mycobacterium tuberculosis H37Rv
uccccaggugggcagcaggccc

SEQ ID NO: 3264851 - RNA, 23 nt, Mycobacterium tuberculosis H37Rv
uccccaggugugugccucagugg

SEQ ID NO: 3264852 - RNA, 21 nt, Mycobacterium tuberculosis H37Rv
ucccccaaaucaacagggugg

SEQ ID NO: 3264853 - RNA, 14 nt, Mycobacterium tuberculosis H37Rv
ucccccacacaccc

SEQ ID NO: 3264854 - RNA, 22 nt, Mycobacterium tuberculosis H37Rv
ucccccagaugcugguguugau

SEQ ID NO: 3264855 - RNA, 18 nt, Mycobacterium tuberculosis H37Rv
ucccccagccgcggcgcc

SEQ ID NO: 3264856 - RNA, 16 nt, Mycobacterium tuberculosis H37Rv
uccccccguugccgcc

SEQ ID NO: 3264857 - RNA, 12 nt, Mycobacterium tuberculosis H37Rv
ucccccgcagcc

SEQ ID NO: 3264858 - RNA, 17 nt, Mycobacterium tuberculosis H37Rv
ucccccgccaaccccaa

SEQ ID NO: 3264859 - RNA, 18 nt, Mycobacterium tuberculosis H37Rv
ucccccggguccgccguu

SEQ ID NO: 3264860 - RNA, 22 nt, Mycobacterium tuberculosis H37Rv
uccccgacaacgaaaccgaccu

SEQ ID NO: 3264861 - RNA, 18 nt, Mycobacterium tuberculosis H37Rv
uccccgacaucgcugcga

SEQ ID NO: 3264862 - RNA, 21 nt, Mycobacterium tuberculosis H37Rv
uccccgacaucgcugcgacug

SEQ ID NO: 3264863 - RNA, 16 nt, Mycobacterium tuberculosis H37Rv
uccccgaccgcgcccg

SEQ ID NO: 3264864 - RNA, 20 nt, Mycobacterium tuberculosis H37Rv
uccccgacggacuccggccg

SEQ ID NO: 3264865 - RNA, 14 nt, Mycobacterium tuberculosis H37Rv
uccccgcagcgccu

SEQ ID NO: 3264866 - RNA, 22 nt, Mycobacterium tuberculosis H37Rv
uccccgcccuugccgccagccc

SEQ ID NO: 3264867 - RNA, 12 nt, Mycobacterium tuberculosis H37Rv
uccccgccgccg

SEQ ID NO: 3264868 - RNA, 13 nt, Mycobacterium tuberculosis H37Rv
uccccgccgccgu

SEQ ID NO: 3264869 - RNA, 12 nt, Mycobacterium tuberculosis H37Rv
uccccgccggaa

SEQ ID NO: 3264870 - RNA, 13 nt, Mycobacterium tuberculosis H37Rv
uccccgccggcgg

SEQ ID NO: 3264871 - RNA, 16 nt, Mycobacterium tuberculosis H37Rv
uccccgccgucgccac

SEQ ID NO: 3264872 - RNA, 14 nt, Mycobacterium tuberculosis H37Rv
uccccgcggcggua

SEQ ID NO: 3264873 - RNA, 20 nt, Mycobacterium tuberculosis H37Rv
uccccgcggcgguaaaccug

SEQ ID NO: 3264874 - RNA, 13 nt, Mycobacterium tuberculosis H37Rv
uccccgucgggac

SEQ ID NO: 3264875 - RNA, 21 nt, Mycobacterium tuberculosis H37Rv
uccccguugacccagaccggc

SEQ ID NO: 3264876 - RNA, 16 nt, Mycobacterium tuberculosis H37Rv
uccccucgacacgccg

SEQ ID NO: 3264877 - RNA, 13 nt, Mycobacterium tuberculosis H37Rv
uccccucgcaacc

SEQ ID NO: 3264878 - RNA, 14 nt, Mycobacterium tuberculosis H37Rv
uccccucgcaaccg

SEQ ID NO: 3264879 - RNA, 17 nt, Mycobacterium tuberculosis H37Rv
uccccugauggacccga

SEQ ID NO: 3264880 - RNA, 16 nt, Mycobacterium tuberculosis H37Rv
uccccugcgcugcagc

SEQ ID NO: 3264881 - RNA, 17 nt, Mycobacterium tuberculosis H37Rv
uccccugcgcugcagcu

SEQ ID NO: 3264882 - RNA, 14 nt, Mycobacterium tuberculosis H37Rv
uccccuuagcucca

SEQ ID NO: 3264883 - RNA, 23 nt, Mycobacterium tuberculosis H37Rv
ucccgaacaauucacgcaccaca

SEQ ID NO: 3264884 - RNA, 15 nt, Mycobacterium tuberculosis H37Rv
ucccgaacuggcugu

SEQ ID NO: 3264885 - RNA, 14 nt, Mycobacterium tuberculosis H37Rv
ucccgaaucgugcg

SEQ ID NO: 3264886 - RNA, 22 nt, Mycobacterium tuberculosis H37Rv
ucccgaccaccucagcugcgga

SEQ ID NO: 3264887 - RNA, 13 nt, Mycobacterium tuberculosis H37Rv
ucccgagccacaa

SEQ ID NO: 3264888 - RNA, 18 nt, Mycobacterium tuberculosis H37Rv
ucccgagcuccgcggcga

SEQ ID NO: 3264889 - RNA, 15 nt, Mycobacterium tuberculosis H37Rv
ucccgaggcgcccaa

SEQ ID NO: 3264890 - RNA, 13 nt, Mycobacterium tuberculosis H37Rv
ucccgaucccggc

SEQ ID NO: 3264891 - RNA, 17 nt, Mycobacterium tuberculosis H37Rv
ucccgaucccggccagc

SEQ ID NO: 3264892 - RNA, 14 nt, Mycobacterium tuberculosis H37Rv
ucccgaugcuggca

SEQ ID NO: 3264893 - RNA, 16 nt, Mycobacterium tuberculosis H37Rv
ucccgaugcuggcaaa

SEQ ID NO: 3264894 - RNA, 22 nt, Mycobacterium tuberculosis H37Rv
uccgaugaccagggucugcuca

SEQ ID NO: 3264895 - RNA, 19 nt, Mycobacterium tuberculosis H37Rv
uccgaugcgugccgacccg

SEQ ID NO: 3264896 - RNA, 22 nt, Mycobacterium tuberculosis H37Rv
uccgauggcccggcucacagca

SEQ ID NO: 3264897 - RNA, 12 nt, Mycobacterium tuberculosis H37Rv
uccgcacaacga

SEQ ID NO: 3264898 - RNA, 12 nt, Mycobacterium tuberculosis H37Rv
uccgcacagcaa

SEQ ID NO: 3264899 - RNA, 14 nt, Mycobacterium tuberculosis H37Rv
uccgcacagcaaca

SEQ ID NO: 3264900 - RNA, 15 nt, Mycobacterium tuberculosis H37Rv
uccgcacagcgacga

SEQ ID NO: 3264901 - RNA, 19 nt, Mycobacterium tuberculosis H37Rv
uccgcaccccauacucggc

SEQ ID NO: 3264902 - RNA, 14 nt, Mycobacterium tuberculosis H37Rv
uccgcacccggccg

SEQ ID NO: 3264903 - RNA, 12 nt, Mycobacterium tuberculosis H37Rv
uccgcaccggcg

SEQ ID NO: 3264904 - RNA, 21 nt, Mycobacterium tuberculosis H37Rv
uccgcaccggcggcgccgaaa

SEQ ID NO: 3264905 - RNA, 23 nt, Mycobacterium tuberculosis H37Rv
uccgcacgaucagggaagccugc

SEQ ID NO: 3264906 - RNA, 15 nt, Mycobacterium tuberculosis H37Rv
uccgcacgaucgccc

SEQ ID NO: 3264907 - RNA, 20 nt, Mycobacterium tuberculosis H37Rv
uccgcacgguucuuggcguc

SEQ ID NO: 3264908 - RNA, 15 nt, Mycobacterium tuberculosis H37Rv
uccgcagcgccaccc

SEQ ID NO: 3264909 - RNA, 15 nt, Mycobacterium tuberculosis H37Rv
uccgcagcggugcgc

SEQ ID NO: 3264910 - RNA, 20 nt, Mycobacterium tuberculosis H37Rv
uccgcagcguccagcgccug

SEQ ID NO: 3264911 - RNA, 13 nt, Mycobacterium tuberculosis H37Rv
uccgcaggcccgc

SEQ ID NO: 3264912 - RNA, 19 nt, Mycobacterium tuberculosis H37Rv
uccgcagugagcaaugcca

SEQ ID NO: 3264913 - RNA, 21 nt, Mycobacterium tuberculosis H37Rv
uccgcagugagcaaugccaac

SEQ ID NO: 3264914 - RNA, 23 nt, Mycobacterium tuberculosis H37Rv
uccgcagugagcaaugccaacgg

SEQ ID NO: 3264915 - RNA, 17 nt, Mycobacterium tuberculosis H37Rv
uccgcaguucggucguc

SEQ ID NO: 3264916 - RNA, 18 nt, Mycobacterium tuberculosis H37Rv
uccgcaucaugucgaaga

SEQ ID NO: 3264917 - RNA, 14 nt, Mycobacterium tuberculosis H37Rv
uccgccaacaucuc

SEQ ID NO: 3264918 - RNA, 22 nt, Mycobacterium tuberculosis H37Rv
uccgccaaggaggccaucaucc

SEQ ID NO: 3264919 - RNA, 24 nt, Mycobacterium tuberculosis H37Rv
uccgccaccgcgagcagaggauca

SEQ ID NO: 3264920 - RNA, 17 nt, Mycobacterium tuberculosis H37Rv
uccgccagaccgcggcg

SEQ ID NO: 3264921 - RNA, 15 nt, Mycobacterium tuberculosis H37Rv
uccgccagaucucgc

SEQ ID NO: 3264922 - RNA, 16 nt, Mycobacterium tuberculosis H37Rv
uccgccagaucucgcg

SEQ ID NO: 3264923 - RNA, 16 nt, Mycobacterium tuberculosis H37Rv
uccgccagcgccgccg

SEQ ID NO: 3264924 - RNA, 18 nt, Mycobacterium tuberculosis H37Rv
uccgccagcgccgccgag

SEQ ID NO: 3264925 - RNA, 19 nt, Mycobacterium tuberculosis H37Rv
uccgccaggccgaccgcgc

SEQ ID NO: 3264926 - RNA, 19 nt, Mycobacterium tuberculosis H37Rv
uccgccauuucucguaccc

SEQ ID NO: 3264927 - RNA, 14 nt, Mycobacterium tuberculosis H37Rv
uccgcccagcaccc

SEQ ID NO: 3264928 - RNA, 14 nt, Mycobacterium tuberculosis H37Rv
uccgcccagccgca

SEQ ID NO: 3264929 - RNA, 15 nt, Mycobacterium tuberculosis H37Rv
uccgcccagccgcag

SEQ ID NO: 3264930 - RNA, 14 nt, Mycobacterium tuberculosis H37Rv
uccgcccagcgagg

SEQ ID NO: 3264931 - RNA, 18 nt, Mycobacterium tuberculosis H37Rv
uccgcccucaguucacgc

SEQ ID NO: 3264932 - RNA, 14 nt, Mycobacterium tuberculosis H37Rv
uccgccgaggccgc

SEQ ID NO: 3264933 - RNA, 18 nt, Mycobacterium tuberculosis H37Rv
uccgccgauagcaccgga

SEQ ID NO: 3264934 - RNA, 20 nt, Mycobacterium tuberculosis H37Rv
uccgccgcagacgccgacuc

SEQ ID NO: 3264935 - RNA, 13 nt, Mycobacterium tuberculosis H37Rv
uccgccgccgccg

SEQ ID NO: 3264936 - RNA, 18 nt, Mycobacterium tuberculosis H37Rv
uccgccgccgccgggucg

SEQ ID NO: 3264937 - RNA, 18 nt, Mycobacterium tuberculosis H37Rv
uccgccgccucgucgucg

SEQ ID NO: 3264938 - RNA, 15 nt, Mycobacterium tuberculosis H37Rv
uccgccgccugcgca

SEQ ID NO: 3264939 - RNA, 20 nt, Mycobacterium tuberculosis H37Rv
uccgccggauagcaccggca

SEQ ID NO: 3264940 - RNA, 11 nt, Mycobacterium tuberculosis H37Rv
uccgccggcaa

SEQ ID NO: 3264941 - RNA, 13 nt, Mycobacterium tuberculosis H37Rv
uccgccggcaccu

SEQ ID NO: 3264942 - RNA, 18 nt, Mycobacterium tuberculosis H37Rv
uccgccggcaccuccggc

SEQ ID NO: 3264943 - RNA, 22 nt, Mycobacterium tuberculosis H37Rv
uccgccggcaccuccggcaccg

SEQ ID NO: 3264944 - RNA, 13 nt, Mycobacterium tuberculosis H37Rv
uccgccggcgaca

SEQ ID NO: 3264945 - RNA, 20 nt, Mycobacterium tuberculosis H37Rv
uccgccgggccaggccgaug

SEQ ID NO: 3264946 - RNA, 22 nt, Mycobacterium tuberculosis H37Rv
uccgccgggccaggccgaugcc

SEQ ID NO: 3264947 - RNA, 18 nt, Mycobacterium tuberculosis H37Rv
uccgccgggcucagcugg

SEQ ID NO: 3264948 - RNA, 16 nt, Mycobacterium tuberculosis H37Rv
uccgccgucgccaccg

SEQ ID NO: 3264949 - RNA, 16 nt, Mycobacterium tuberculosis H37Rv
uccgccgucgccgccg

SEQ ID NO: 3264950 - RNA, 15 nt, Mycobacterium tuberculosis H37Rv
uccgccguucucgcg

SEQ ID NO: 3264951 - RNA, 17 nt, Mycobacterium tuberculosis H37Rv
uccgccguugccgaucc

SEQ ID NO: 3264952 - RNA, 15 nt, Mycobacterium tuberculosis H37Rv
uccgccguugccgcc

SEQ ID NO: 3264953 - RNA, 13 nt, Mycobacterium tuberculosis H37Rv
uccgcgaaauagc

SEQ ID NO: 3264954 - RNA, 15 nt, Mycobacterium tuberculosis H37Rv
uccgcgacagcggcg

SEQ ID NO: 3264955 - RNA, 17 nt, Mycobacterium tuberculosis H37Rv
uccgcgacagcggcguc

SEQ ID NO: 3264956 - RNA, 19 nt, Mycobacterium tuberculosis H37Rv
uccgcgacguaguggaagc

SEQ ID NO: 3264957 - RNA, 14 nt, Mycobacterium tuberculosis H37Rv
uccgcgaucggcug

SEQ ID NO: 3264958 - RNA, 20 nt, Mycobacterium tuberculosis H37Rv
uccgcgaucugcagcgcgga

SEQ ID NO: 3264959 - RNA, 12 nt, Mycobacterium tuberculosis H37Rv
uccgcgaugugg

SEQ ID NO: 3264960 - RNA, 15 nt, Mycobacterium tuberculosis H37Rv
uccgcgcccgagccg

SEQ ID NO: 3264961 - RNA, 18 nt, Mycobacterium tuberculosis H37Rv
uccgcgcccgagccggua

SEQ ID NO: 3264962 - RNA, 15 nt, Mycobacterium tuberculosis H37Rv
uccgcgccgccgaug

SEQ ID NO: 3264963 - RNA, 14 nt, Mycobacterium tuberculosis H37Rv
uccgcgcgccggcg

SEQ ID NO: 3264964 - RNA, 16 nt, Mycobacterium tuberculosis H37Rv
uccgcgcgccggcggu

SEQ ID NO: 3264965 - RNA, 15 nt, Mycobacterium tuberculosis H37Rv
uccgcgcucaaccgc

SEQ ID NO: 3264966 - RNA, 22 nt, Mycobacterium tuberculosis H37Rv
uccgcgcucaaccgcaaucgga

SEQ ID NO: 3264967 - RNA, 22 nt, Mycobacterium tuberculosis H37Rv
uccgcggacgauuacgccggag

SEQ ID NO: 3264968 - RNA, 23 nt, Mycobacterium tuberculosis H37Rv
uccgcggagaacaucccccggcu

SEQ ID NO: 3264969 - RNA, 16 nt, Mycobacterium tuberculosis H37Rv
uccgcggaucaccauc

SEQ ID NO: 3264970 - RNA, 23 nt, Mycobacterium tuberculosis H37Rv
uccgcggaucaccaucgccgccg

SEQ ID NO: 3264971 - RNA, 13 nt, Mycobacterium tuberculosis H37Rv
uccgcggcacgcu

SEQ ID NO: 3264972 - RNA, 22 nt, Mycobacterium tuberculosis H37Rv
uccgcggcaugcaaugcuggcg

SEQ ID NO: 3264973 - RNA, 18 nt, Mycobacterium tuberculosis H37Rv
uccgcggcauuggcgucg

SEQ ID NO: 3264974 - RNA, 20 nt, Mycobacterium tuberculosis H37Rv
uccgcggccaccaccaggcu

SEQ ID NO: 3264975 - RNA, 19 nt, Mycobacterium tuberculosis H37Rv
uccgcggcgagcuccgaug

SEQ ID NO: 3264976 - RNA, 19 nt, Mycobacterium tuberculosis H37Rv
uccgcggcgcagcacggcg

SEQ ID NO: 3264977 - RNA, 15 nt, Mycobacterium tuberculosis H37Rv
uccgcggcgcgcaac

SEQ ID NO: 3264978 - RNA, 21 nt, Mycobacterium tuberculosis H37Rv
uccgcggguuugaucuccacc

SEQ ID NO: 3264979 - RNA, 19 nt, Mycobacterium tuberculosis H37Rv
uccgcggucgcagcagacc

SEQ ID NO: 3264980 - RNA, 16 nt, Mycobacterium tuberculosis H37Rv
uccgcgucgccggccu

SEQ ID NO: 3264981 - RNA, 17 nt, Mycobacterium tuberculosis H37Rv
uccgcgucugcucgcga

SEQ ID NO: 3264982 - RNA, 17 nt, Mycobacterium tuberculosis H37Rv
uccgcguguacggcggc

SEQ ID NO: 3264983 - RNA, 14 nt, Mycobacterium tuberculosis H37Rv
uccgcuacggcguc

SEQ ID NO: 3264984 - RNA, 16 nt, Mycobacterium tuberculosis H37Rv
uccgcucguucgugca

SEQ ID NO: 3264985 - RNA, 14 nt, Mycobacterium tuberculosis H37Rv
uccgcugacccgcc

SEQ ID NO: 3264986 - RNA, 15 nt, Mycobacterium tuberculosis H37Rv
uccgcugcaggucca

SEQ ID NO: 3264987 - RNA, 20 nt, Mycobacterium tuberculosis H37Rv
uccgcuugcccgaagagcac

SEQ ID NO: 3264988 - RNA, 17 nt, Mycobacterium tuberculosis H37Rv
uccgcuugcucucgcag

SEQ ID NO: 3264989 - RNA, 22 nt, Mycobacterium tuberculosis H37Rv
uccgcuugggcggugucgucga

SEQ ID NO: 3264990 - RNA, 18 nt, Mycobacterium tuberculosis H37Rv
uccgguguugagaucgcc

SEQ ID NO: 3264991 - RNA, 18 nt, Mycobacterium tuberculosis H37Rv
uccgguuauggcaagccg

SEQ ID NO: 3264992 - RNA, 16 nt, Mycobacterium tuberculosis H37Rv
uccgguucaucggcau

SEQ ID NO: 3264993 - RNA, 16 nt, Mycobacterium tuberculosis H37Rv
uccguacuugccaccc

SEQ ID NO: 3264994 - RNA, 13 nt, Mycobacterium tuberculosis H37Rv
uccguaucacggu

SEQ ID NO: 3264995 - RNA, 16 nt, Mycobacterium tuberculosis H37Rv
uccguccccgcagcgc

SEQ ID NO: 3264996 - RNA, 19 nt, Mycobacterium tuberculosis H37Rv
uccgucgaaccuaccgugu

SEQ ID NO: 3264997 - RNA, 13 nt, Mycobacterium tuberculosis H37Rv
uccgucgcggccg

SEQ ID NO: 3264998 - RNA, 14 nt, Mycobacterium tuberculosis H37Rv
uccgucggccaggc

SEQ ID NO: 3264999 - RNA, 22 nt, Mycobacterium tuberculosis H37Rv
uccgucggucgccgguggccua

SEQ ID NO: 3265000 - RNA, 15 nt, Mycobacterium tuberculosis H37Rv
uccgugccagcugcc

SEQ ID NO: 3265001 - RNA, 17 nt, Mycobacterium tuberculosis H37Rv
uccgugccagcugccga

SEQ ID NO: 3265002 - RNA, 22 nt, Mycobacterium tuberculosis H37Rv
uccgugccgagcgugcgcuggu

SEQ ID NO: 3265003 - RNA, 17 nt, Mycobacterium tuberculosis H37Rv
uccgugccgaugccggc

SEQ ID NO: 3265004 - RNA, 14 nt, Mycobacterium tuberculosis H37Rv
uccguucgaugcca

SEQ ID NO: 3265005 - RNA, 13 nt, Mycobacterium tuberculosis H37Rv
uccguugccccca

SEQ ID NO: 3265006 - RNA, 14 nt, Mycobacterium tuberculosis H37Rv
uccguuuuaccucg

SEQ ID NO: 3265007 - RNA, 16 nt, Mycobacterium tuberculosis H37Rv
uccucacgggucggca

SEQ ID NO: 3265008 - RNA, 21 nt, Mycobacterium tuberculosis H37Rv
uccucagccaccgcggucagc

SEQ ID NO: 3265009 - RNA, 15 nt, Mycobacterium tuberculosis H37Rv
uccucagcggcccgc

SEQ ID NO: 3265010 - RNA, 16 nt, Mycobacterium tuberculosis H37Rv
uccucagcggcccgcu

SEQ ID NO: 3265011 - RNA, 18 nt, Mycobacterium tuberculosis H37Rv
uccucccauucccaacac

SEQ ID NO: 3265012 - RNA, 17 nt, Mycobacterium tuberculosis H37Rv
uccuccggaaagcucuc

SEQ ID NO: 3265013 - RNA, 16 nt, Mycobacterium tuberculosis H37Rv
uccuccggguuggcga

SEQ ID NO: 3265014 - RNA, 21 nt, Mycobacterium tuberculosis H37Rv
uccuccggguuggcgacgauc

SEQ ID NO: 3265015 - RNA, 19 nt, Mycobacterium tuberculosis H37Rv
uccuccguuuggcugccga

SEQ ID NO: 3265016 - RNA, 15 nt, Mycobacterium tuberculosis H37Rv
uccuccugcgccgca

SEQ ID NO: 3265017 - RNA, 14 nt, Mycobacterium tuberculosis H37Rv
uccuccugugcgau

SEQ ID NO: 3265018 - RNA, 18 nt, Mycobacterium tuberculosis H37Rv
uccucgaaugucacaccg

SEQ ID NO: 3265019 - RNA, 14 nt, Mycobacterium tuberculosis H37Rv
uccucgacacccau

SEQ ID NO: 3265020 - RNA, 16 nt, Mycobacterium tuberculosis H37Rv
uccucgacgaggagcc

SEQ ID NO: 3265021 - RNA, 20 nt, Mycobacterium tuberculosis H37Rv
uccucgacguaggccagguc

SEQ ID NO: 3265022 - RNA, 17 nt, Mycobacterium tuberculosis H37Rv
uccucgacgucggcgag

SEQ ID NO: 3265023 - RNA, 17 nt, Mycobacterium tuberculosis H37Rv
uccucgagccagcuccg

SEQ ID NO: 3265024 - RNA, 16 nt, Mycobacterium tuberculosis H37Rv
uccucgagguccucgu

SEQ ID NO: 3265025 - RNA, 22 nt, Mycobacterium tuberculosis H37Rv
uccucgaucacuguuccgggug

SEQ ID NO: 3265026 - RNA, 20 nt, Mycobacterium tuberculosis H37Rv
uccucgaucgucgacgcguc

SEQ ID NO: 3265027 - RNA, 20 nt, Mycobacterium tuberculosis H37Rv
uccucgaugaggcgcagcgc

SEQ ID NO: 3265028 - RNA, 17 nt, Mycobacterium tuberculosis H37Rv
uccucgaugcgggcgcc

SEQ ID NO: 3265029 - RNA, 20 nt, Mycobacterium tuberculosis H37Rv
uccucgaugcgggcgcccca

SEQ ID NO: 3265030 - RNA, 14 nt, Mycobacterium tuberculosis H37Rv
uccucgauggaccg

SEQ ID NO: 3265031 - RNA, 21 nt, Mycobacterium tuberculosis H37Rv
uccucgauggaccgccagggc

SEQ ID NO: 3265032 - RNA, 19 nt, Mycobacterium tuberculosis H37Rv
uccucgccgcacgccggca

SEQ ID NO: 3265033 - RNA, 15 nt, Mycobacterium tuberculosis H37Rv
uccucgcgagcuccc

SEQ ID NO: 3265034 - RNA, 21 nt, Mycobacterium tuberculosis H37Rv
uccucggauaacgucacaccg

SEQ ID NO: 3265035 - RNA, 15 nt, Mycobacterium tuberculosis H37Rv
uccucggccacccgc

SEQ ID NO: 3265036 - RNA, 20 nt, Mycobacterium tuberculosis H37Rv
uccucgggcaggcggccagc

SEQ ID NO: 3265037 - RNA, 15 nt, Mycobacterium tuberculosis H37Rv
uccucggguucguca

SEQ ID NO: 3265038 - RNA, 13 nt, Mycobacterium tuberculosis H37Rv
uccucggugucau

SEQ ID NO: 3265039 - RNA, 16 nt, Mycobacterium tuberculosis H37Rv
uccucgguguccucga

SEQ ID NO: 3265040 - RNA, 21 nt, Mycobacterium tuberculosis H37Rv
uccucggugugcucgccgacc

SEQ ID NO: 3265041 - RNA, 20 nt, Mycobacterium tuberculosis H37Rv
uccucguagacgaaacggcc

SEQ ID NO: 3265042 - RNA, 14 nt, Mycobacterium tuberculosis H37Rv
uccucgucggcgaa

SEQ ID NO: 3265043 - RNA, 14 nt, Mycobacterium tuberculosis H37Rv
uccucgucggcguc

SEQ ID NO: 3265044 - RNA, 15 nt, Mycobacterium tuberculosis H37Rv
uccucgucuucgucg

SEQ ID NO: 3265045 - RNA, 13 nt, Mycobacterium tuberculosis H37Rv
uccucgugcagca

SEQ ID NO: 3265046 - RNA, 16 nt, Mycobacterium tuberculosis H37Rv
uccucugguugggagc

SEQ ID NO: 3265047 - RNA, 22 nt, Mycobacterium tuberculosis H37Rv
uccucuugcaccagggccucga

SEQ ID NO: 3265048 - RNA, 21 nt, Mycobacterium tuberculosis H37Rv
uccugaaucgguucggccaga

SEQ ID NO: 3265049 - RNA, 14 nt, Mycobacterium tuberculosis H37Rv
uccugaguuccggu

SEQ ID NO: 3265050 - RNA, 19 nt, Mycobacterium tuberculosis H37Rv
uccugcacacaggacuugu

SEQ ID NO: 3265051 - RNA, 14 nt, Mycobacterium tuberculosis H37Rv
uccugcagcccggg

SEQ ID NO: 3265052 - RNA, 17 nt, Mycobacterium tuberculosis H37Rv
uccugcagcucgggcag

SEQ ID NO: 3265053 - RNA, 15 nt, Mycobacterium tuberculosis H37Rv
uccugcagcuggcga

SEQ ID NO: 3265054 - RNA, 19 nt, Mycobacterium tuberculosis H37Rv
uccugcaggaucaaaaccu

SEQ ID NO: 3265055 - RNA, 17 nt, Mycobacterium tuberculosis H37Rv
uccugccagaagaccug

SEQ ID NO: 3265056 - RNA, 14 nt, Mycobacterium tuberculosis H37Rv
uccugcgcugcacc

SEQ ID NO: 3265057 - RNA, 17 nt, Mycobacterium tuberculosis H37Rv
uccuggccacucccagc

SEQ ID NO: 3265058 - RNA, 18 nt, Mycobacterium tuberculosis H37Rv
uccuggccacucccagcc

SEQ ID NO: 3265059 - RNA, 20 nt, Mycobacterium tuberculosis H37Rv
uccuggcccgauaaaugccg

SEQ ID NO: 3265060 - RNA, 18 nt, Mycobacterium tuberculosis H37Rv
uccuggcggcugcagccg

SEQ ID NO: 3265061 - RNA, 16 nt, Mycobacterium tuberculosis H37Rv
uccuggcggguggcga

SEQ ID NO: 3265062 - RNA, 17 nt, Mycobacterium tuberculosis H37Rv
uccuggcguagugcagc

SEQ ID NO: 3265063 - RNA, 14 nt, Mycobacterium tuberculosis H37Rv
uccuggcgugagcc

SEQ ID NO: 3265064 - RNA, 19 nt, Mycobacterium tuberculosis H37Rv
uccugggauccggcggcag

SEQ ID NO: 3265065 - RNA, 17 nt, Mycobacterium tuberculosis H37Rv
uccuggguuggcaucca

SEQ ID NO: 3265066 - RNA, 18 nt, Mycobacterium tuberculosis H37Rv
uccugguaggugucgugg

SEQ ID NO: 3265067 - RNA, 15 nt, Mycobacterium tuberculosis H37Rv
uccuggucaaccgcg

SEQ ID NO: 3265068 - RNA, 15 nt, Mycobacterium tuberculosis H37Rv
uccuggucaccagcc

SEQ ID NO: 3265069 - RNA, 15 nt, Mycobacterium tuberculosis H37Rv
uccuggucgacgcgu

SEQ ID NO: 3265070 - RNA, 16 nt, Mycobacterium tuberculosis H37Rv
uccuggucgagcacgc

SEQ ID NO: 3265071 - RNA, 18 nt, Mycobacterium tuberculosis H37Rv
uccugguguucgggcagc

SEQ ID NO: 3265072 - RNA, 17 nt, Mycobacterium tuberculosis H37Rv
uccuguugaucugcccu

SEQ ID NO: 3265073 - RNA, 14 nt, Mycobacterium tuberculosis H37Rv
uccuuaugcgcggu

SEQ ID NO: 3265074 - RNA, 18 nt, Mycobacterium tuberculosis H37Rv
uccuucgaaugccgugcc

SEQ ID NO: 3265075 - RNA, 18 nt, Mycobacterium tuberculosis H37Rv
uccuucgcguuggcccgc

SEQ ID NO: 3265076 - RNA, 20 nt, Mycobacterium tuberculosis H37Rv
uccuugaacguucuuaaacg

SEQ ID NO: 3265077 - RNA, 16 nt, Mycobacterium tuberculosis H37Rv
uccuugaccucguccc

SEQ ID NO: 3265078 - RNA, 21 nt, Mycobacterium tuberculosis H37Rv
uccuugagccgggcaaccagc

SEQ ID NO: 3265079 - RNA, 14 nt, Mycobacterium tuberculosis H37Rv
uccuugaugccuuc

SEQ ID NO: 3265080 - RNA, 22 nt, Mycobacterium tuberculosis H37Rv
uccuugcgcagcaccagggugg

SEQ ID NO: 3265081 - RNA, 17 nt, Mycobacterium tuberculosis H37Rv
uccuugcgguccaggcc

SEQ ID NO: 3265082 - RNA, 18 nt, Mycobacterium tuberculosis H37Rv
uccuugcgguccaggccg

SEQ ID NO: 3265083 - RNA, 22 nt, Mycobacterium tuberculosis H37Rv
uccuuggcccagcgguaguccg

SEQ ID NO: 3265084 - RNA, 17 nt, Mycobacterium tuberculosis H37Rv
uccuugggcgucaagca

SEQ ID NO: 3265085 - RNA, 22 nt, Mycobacterium tuberculosis H37Rv
uccuugucggccccggccgcgu

SEQ ID NO: 3265086 - RNA, 18 nt, Mycobacterium tuberculosis H37Rv
ucgacgccaaaucggcca

SEQ ID NO: 3265087 - RNA, 13 nt, Mycobacterium tuberculosis H37Rv
ucgacgccgacca

SEQ ID NO: 3265088 - RNA, 15 nt, Mycobacterium tuberculosis H37Rv
ucgacgccgagaccg

SEQ ID NO: 3265089 - RNA, 19 nt, Mycobacterium tuberculosis H37Rv
ucgacgccgcagcguccgc

SEQ ID NO: 3265090 - RNA, 16 nt, Mycobacterium tuberculosis H37Rv
ucgacgccgcgcagcc

SEQ ID NO: 3265091 - RNA, 15 nt, Mycobacterium tuberculosis H37Rv
ucgacgccggccagc

SEQ ID NO: 3265092 - RNA, 17 nt, Mycobacterium tuberculosis H37Rv
ucgacgccggccagcgg

SEQ ID NO: 3265093 - RNA, 14 nt, Mycobacterium tuberculosis H37Rv
ucgacgcggcaggc

SEQ ID NO: 3265094 - RNA, 18 nt, Mycobacterium tuberculosis H37Rv
ucgacggccagugcgcag

SEQ ID NO: 3265095 - RNA, 17 nt, Mycobacterium tuberculosis H37Rv
ucgacggccucgucgau

SEQ ID NO: 3265096 - RNA, 17 nt, Mycobacterium tuberculosis H37Rv
ucgacgggcacgcggcg

SEQ ID NO: 3265097 - RNA, 18 nt, Mycobacterium tuberculosis H37Rv
ucgacggucaccggcgca

SEQ ID NO: 3265098 - RNA, 14 nt, Mycobacterium tuberculosis H37Rv
ucgacggucauccc

SEQ ID NO: 3265099 - RNA, 18 nt, Mycobacterium tuberculosis H37Rv
ucgacggugccgucugcg

SEQ ID NO: 3265100 - RNA, 13 nt, Mycobacterium tuberculosis H37Rv
ucgacggugucau

SEQ ID NO: 3265101 - RNA, 16 nt, Mycobacterium tuberculosis H37Rv
ucgacguaagugugcc

SEQ ID NO: 3265102 - RNA, 21 nt, Mycobacterium tuberculosis H37Rv
ucgacguaaugcgcugccgcc

SEQ ID NO: 3265103 - RNA, 16 nt, Mycobacterium tuberculosis H37Rv
ucgacguaggccaggu

SEQ ID NO: 3265104 - RNA, 18 nt, Mycobacterium tuberculosis H37Rv
ucgacgucgauuucggcg

SEQ ID NO: 3265105 - RNA, 21 nt, Mycobacterium tuberculosis H37Rv
ucgacgucgauuucggcgacc

SEQ ID NO: 3265106 - RNA, 18 nt, Mycobacterium tuberculosis H37Rv
ucgacgucgcggcgccug

SEQ ID NO: 3265107 - RNA, 15 nt, Mycobacterium tuberculosis H37Rv
ucgacgucggcgacc

SEQ ID NO: 3265108 - RNA, 16 nt, Mycobacterium tuberculosis H37Rv
ucgacgucggcgagca

SEQ ID NO: 3265109 - RNA, 20 nt, Mycobacterium tuberculosis H37Rv
ucgacgucgguaagcgccaa

SEQ ID NO: 3265110 - RNA, 15 nt, Mycobacterium tuberculosis H37Rv
ucgacgucguagacc

SEQ ID NO: 3265111 - RNA, 20 nt, Mycobacterium tuberculosis H37Rv
ucgacgucguagaccuccag

SEQ ID NO: 3265112 - RNA, 16 nt, Mycobacterium tuberculosis H37Rv
ucgacgucugcccagu

SEQ ID NO: 3265113 - RNA, 16 nt, Mycobacterium tuberculosis H37Rv
ucgacgugaucgcggu

SEQ ID NO: 3265114 - RNA, 16 nt, Mycobacterium tuberculosis H37Rv
ucgacguggccgacgu

SEQ ID NO: 3265115 - RNA, 14 nt, Mycobacterium tuberculosis H37Rv
ucgacguuccagca

SEQ ID NO: 3265116 - RNA, 17 nt, Mycobacterium tuberculosis H37Rv
ucgacguuccagcagua

SEQ ID NO: 3265117 - RNA, 11 nt, Mycobacterium tuberculosis H37Rv
ucgacguucgg

SEQ ID NO: 3265118 - RNA, 17 nt, Mycobacterium tuberculosis H37Rv
ucgacguucgguggcga

SEQ ID NO: 3265119 - RNA, 17 nt, Mycobacterium tuberculosis H37Rv
ucgacguugcggacggc

SEQ ID NO: 3265120 - RNA, 20 nt, Mycobacterium tuberculosis H37Rv
ucgacuacacauucauccac

SEQ ID NO: 3265121 - RNA, 13 nt, Mycobacterium tuberculosis H37Rv
ucgacucacacac

SEQ ID NO: 3265122 - RNA, 15 nt, Mycobacterium tuberculosis H37Rv
ucgacucacacaccg

SEQ ID NO: 3265123 - RNA, 15 nt, Mycobacterium tuberculosis H37Rv
ucgacucagcccggc

SEQ ID NO: 3265124 - RNA, 15 nt, Mycobacterium tuberculosis H37Rv
ucgacuccggaugga

SEQ ID NO: 3265125 - RNA, 17 nt, Mycobacterium tuberculosis H37Rv
ucgacucgaccgcgacg

SEQ ID NO: 3265126 - RNA, 16 nt, Mycobacterium tuberculosis H37Rv
ucgacugaucgccacc

SEQ ID NO: 3265127 - RNA, 15 nt, Mycobacterium tuberculosis H37Rv
ucgacuucagcggcc

SEQ ID NO: 3265128 - RNA, 19 nt, Mycobacterium tuberculosis H37Rv
ucgagaccccgacgaugcg

SEQ ID NO: 3265129 - RNA, 21 nt, Mycobacterium tuberculosis H37Rv
ucgagaccccgacgaugcgca

SEQ ID NO: 3265130 - RNA, 22 nt, Mycobacterium tuberculosis H37Rv
ucgagagcgaucaacggaucga

SEQ ID NO: 3265131 - RNA, 17 nt, Mycobacterium tuberculosis H37Rv
ucgagagggaucacgcc

SEQ ID NO: 3265132 - RNA, 17 nt, Mycobacterium tuberculosis H37Rv
ucgagauaaccaccauc

SEQ ID NO: 3265133 - RNA, 14 nt, Mycobacterium tuberculosis H37Rv
ucgagaucucacgu

SEQ ID NO: 3265134 - RNA, 12 nt, Mycobacterium tuberculosis H37Rv
ucgagcacaccg

SEQ ID NO: 3265135 - RNA, 14 nt, Mycobacterium tuberculosis H37Rv
ucgagcacaccgag

SEQ ID NO: 3265136 - RNA, 16 nt, Mycobacterium tuberculosis H37Rv
ucgagcaccgacaccg

SEQ ID NO: 3265137 - RNA, 14 nt, Mycobacterium tuberculosis H37Rv
ucgagcaccucggc

SEQ ID NO: 3265138 - RNA, 15 nt, Mycobacterium tuberculosis H37Rv
ucgagcagcaccacc

SEQ ID NO: 3265139 - RNA, 11 nt, Mycobacterium tuberculosis H37Rv
ucgagcagcag

SEQ ID NO: 3265140 - RNA, 14 nt, Mycobacterium tuberculosis H37Rv
ucgagcagcauguc

SEQ ID NO: 3265141 - RNA, 18 nt, Mycobacterium tuberculosis H37Rv
ucgagcaggcuggcugcc

SEQ ID NO: 3265142 - RNA, 19 nt, Mycobacterium tuberculosis H37Rv
ucgagcaguuccagcucgc

SEQ ID NO: 3265143 - RNA, 17 nt, Mycobacterium tuberculosis H37Rv
ucgagccacccaccgac

SEQ ID NO: 3265144 - RNA, 14 nt, Mycobacterium tuberculosis H37Rv
ucgagccagcuccg

SEQ ID NO: 3265145 - RNA, 18 nt, Mycobacterium tuberculosis H37Rv
ucgagcccggacgagugc

SEQ ID NO: 3265146 - RNA, 19 nt, Mycobacterium tuberculosis H37Rv
ucgagcccgucgaguaggu

SEQ ID NO: 3265147 - RNA, 22 nt, Mycobacterium tuberculosis H37Rv
ucgagcccucguuaucgaccgc

SEQ ID NO: 3265148 - RNA, 20 nt, Mycobacterium tuberculosis H37Rv
ucgagcgcgccgcgcucgcc

SEQ ID NO: 3265149 - RNA, 16 nt, Mycobacterium tuberculosis H37Rv
ucgagcgcgcgacgga

SEQ ID NO: 3265150 - RNA, 12 nt, Mycobacterium tuberculosis H37Rv
ucgagcgcugcu

SEQ ID NO: 3265151 - RNA, 20 nt, Mycobacterium tuberculosis H37Rv
ucgagcgcuucgucgccgaa

SEQ ID NO: 3265152 - RNA, 23 nt, Mycobacterium tuberculosis H37Rv
ucgagcguaacgguaaccggccc

SEQ ID NO: 3265153 - RNA, 19 nt, Mycobacterium tuberculosis H37Rv
ucgagcgucugcgaucccg

SEQ ID NO: 3265154 - RNA, 13 nt, Mycobacterium tuberculosis H37Rv
ucgagcgugcgca

SEQ ID NO: 3265155 - RNA, 13 nt, Mycobacterium tuberculosis H37Rv
ucgagcucggcga

SEQ ID NO: 3265156 - RNA, 22 nt, Mycobacterium tuberculosis H37Rv
ucgagcucggcgaugcugagcc

SEQ ID NO: 3265157 - RNA, 22 nt, Mycobacterium tuberculosis H37Rv
ucgagcucguaggugaagagca

SEQ ID NO: 3265158 - RNA, 17 nt, Mycobacterium tuberculosis H37Rv
ucgagcucguccucguc

SEQ ID NO: 3265159 - RNA, 19 nt, Mycobacterium tuberculosis H37Rv
ucgagcucguccucgucuu

SEQ ID NO: 3265160 - RNA, 16 nt, Mycobacterium tuberculosis H37Rv
ucgagcugacgauggc

SEQ ID NO: 3265161 - RNA, 21 nt, Mycobacterium tuberculosis H37Rv
ucgagcuuuucgaccuucacc

SEQ ID NO: 3265162 - RNA, 19 nt, Mycobacterium tuberculosis H37Rv
ucgaggaagaucaccuccc

SEQ ID NO: 3265163 - RNA, 19 nt, Mycobacterium tuberculosis H37Rv
ucgaggaaggugugcgucu

SEQ ID NO: 3265164 - RNA, 14 nt, Mycobacterium tuberculosis H37Rv
ucgaggaccaccac

SEQ ID NO: 3265165 - RNA, 20 nt, Mycobacterium tuberculosis H37Rv
ucgaggaccaccacuagguc

SEQ ID NO: 3265166 - RNA, 15 nt, Mycobacterium tuberculosis H37Rv
ucgaggccagcagcu

SEQ ID NO: 3265167 - RNA, 16 nt, Mycobacterium tuberculosis H37Rv
ucgaggccagcagcug

SEQ ID NO: 3265168 - RNA, 21 nt, Mycobacterium tuberculosis H37Rv
ucgaggcgaaagauggccuca

SEQ ID NO: 3265169 - RNA, 17 nt, Mycobacterium tuberculosis H37Rv
ucgaggcgaucaccgcg

SEQ ID NO: 3265170 - RNA, 18 nt, Mycobacterium tuberculosis H37Rv
ucgaggcugaccguggcg

SEQ ID NO: 3265171 - RNA, 11 nt, Mycobacterium tuberculosis H37Rv
ucgagggcuuu

SEQ ID NO: 3265172 - RNA, 16 nt, Mycobacterium tuberculosis H37Rv
ucgagggggacgcuga

SEQ ID NO: 3265173 - RNA, 15 nt, Mycobacterium tuberculosis H37Rv
ucgagggugaccccc

SEQ ID NO: 3265174 - RNA, 22 nt, Mycobacterium tuberculosis H37Rv
ucgaggguuuccauggcgugcc

SEQ ID NO: 3265175 - RNA, 23 nt, Mycobacterium tuberculosis H37Rv
ucgagguacaacgggcacgcuau

SEQ ID NO: 3265176 - RNA, 16 nt, Mycobacterium tuberculosis H37Rv
ucgagguccucagcga

SEQ ID NO: 3265177 - RNA, 17 nt, Mycobacterium tuberculosis H37Rv
ucgagguccuugaggau

SEQ ID NO: 3265178 - RNA, 21 nt, Mycobacterium tuberculosis H37Rv
ucgaggugacuugcacgcugu

SEQ ID NO: 3265179 - RNA, 19 nt, Mycobacterium tuberculosis H37Rv
ucgagguggcgcacaucgc

SEQ ID NO: 3265180 - RNA, 18 nt, Mycobacterium tuberculosis H37Rv
ucgagguguagcccuccg

SEQ ID NO: 3265181 - RNA, 15 nt, Mycobacterium tuberculosis H37Rv
ucgagguucccgcau

SEQ ID NO: 3265182 - RNA, 23 nt, Mycobacterium tuberculosis H37Rv
ucgagguucucccgcgcuuggcu

SEQ ID NO: 3265183 - RNA, 18 nt, Mycobacterium tuberculosis H37Rv
ucgcaggauucccagucc

SEQ ID NO: 3265184 - RNA, 22 nt, Mycobacterium tuberculosis H37Rv
ucgcaguauucacagucgcucg

SEQ ID NO: 3265185 - RNA, 20 nt, Mycobacterium tuberculosis H37Rv
ucgcaguccgguuacgcucg

SEQ ID NO: 3265186 - RNA, 14 nt, Mycobacterium tuberculosis H37Rv
ucgcagugagcagc

SEQ ID NO: 3265187 - RNA, 20 nt, Mycobacterium tuberculosis H37Rv
ucgcaguggcguuacgcucg

SEQ ID NO: 3265188 - RNA, 17 nt, Mycobacterium tuberculosis H37Rv
ucgcaguuggcggugaa

SEQ ID NO: 3265189 - RNA, 18 nt, Mycobacterium tuberculosis H37Rv
ucgcauagugcggcugca

SEQ ID NO: 3265190 - RNA, 21 nt, Mycobacterium tuberculosis H37Rv
ucgcaucaggucgguggucuc

SEQ ID NO: 3265191 - RNA, 19 nt, Mycobacterium tuberculosis H37Rv
ucgcaucgacgugcgcggc

SEQ ID NO: 3265192 - RNA, 14 nt, Mycobacterium tuberculosis H37Rv
ucgcauggcggcug

SEQ ID NO: 3265193 - RNA, 15 nt, Mycobacterium tuberculosis H37Rv
ucgcauggucgacga

SEQ ID NO: 3265194 - RNA, 22 nt, Mycobacterium tuberculosis H37Rv
ucgcauguucuccacgccgauc

SEQ ID NO: 3265195 - RNA, 16 nt, Mycobacterium tuberculosis H37Rv
ucgcauucugcugcca

SEQ ID NO: 3265196 - RNA, 22 nt, Mycobacterium tuberculosis H37Rv
ucgcauuuguacugguuagaga

SEQ ID NO: 3265197 - RNA, 18 nt, Mycobacterium tuberculosis H37Rv
ucgccaacgccagcacca

SEQ ID NO: 3265198 - RNA, 17 nt, Mycobacterium tuberculosis H37Rv
ucgccaaggccgucgac

SEQ ID NO: 3265199 - RNA, 21 nt, Mycobacterium tuberculosis H37Rv
ucgccaagugcagggcugcua

SEQ ID NO: 3265200 - RNA, 19 nt, Mycobacterium tuberculosis H37Rv
ucgccaaucgaguagcuga

SEQ ID NO: 3265201 - RNA, 14 nt, Mycobacterium tuberculosis H37Rv
ucgccaaugcccag

SEQ ID NO: 3265202 - RNA, 13 nt, Mycobacterium tuberculosis H37Rv
ucgccacaccaug

SEQ ID NO: 3265203 - RNA, 15 nt, Mycobacterium tuberculosis H37Rv
ucgccacaccaugau

SEQ ID NO: 3265204 - RNA, 16 nt, Mycobacterium tuberculosis H37Rv
ucgccacaccggggcg

SEQ ID NO: 3265205 - RNA, 21 nt, Mycobacterium tuberculosis H37Rv
ucgccacauuucaccaccgug

SEQ ID NO: 3265206 - RNA, 22 nt, Mycobacterium tuberculosis H37Rv
ucgccacauuucaccaccgugg

SEQ ID NO: 3265207 - RNA, 16 nt, Mycobacterium tuberculosis H37Rv
ucgccaccagagucaa

SEQ ID NO: 3265208 - RNA, 17 nt, Mycobacterium tuberculosis H37Rv
ucgccaccagagucaac

SEQ ID NO: 3265209 - RNA, 15 nt, Mycobacterium tuberculosis H37Rv
ucgccaccaucaccg

SEQ ID NO: 3265210 - RNA, 16 nt, Mycobacterium tuberculosis H37Rv
ucgccaccaucaccgc

SEQ ID NO: 3265211 - RNA, 18 nt, Mycobacterium tuberculosis H37Rv
ucgccaccgccggcagca

SEQ ID NO: 3265212 - RNA, 12 nt, Mycobacterium tuberculosis H37Rv
ucgccaccggcg

SEQ ID NO: 3265213 - RNA, 18 nt, Mycobacterium tuberculosis H37Rv
ucgccaccgguaccggcg

SEQ ID NO: 3265214 - RNA, 14 nt, Mycobacterium tuberculosis H37Rv
ucgccacgcccagc

SEQ ID NO: 3265215 - RNA, 21 nt, Mycobacterium tuberculosis H37Rv
ucgccacgcucggcggccagc

SEQ ID NO: 3265216 - RNA, 18 nt, Mycobacterium tuberculosis H37Rv
ucgccacuguugaagaag

SEQ ID NO: 3265217 - RNA, 21 nt, Mycobacterium tuberculosis H37Rv
ucgccacuguugaagaagccc

SEQ ID NO: 3265218 - RNA, 22 nt, Mycobacterium tuberculosis H37Rv
ucgccacuguugaagaagcccg

SEQ ID NO: 3265219 - RNA, 15 nt, Mycobacterium tuberculosis H37Rv
ucgccagaccgcacc

SEQ ID NO: 3265220 - RNA, 13 nt, Mycobacterium tuberculosis H37Rv
ucgccagagucgg

SEQ ID NO: 3265221 - RNA, 13 nt, Mycobacterium tuberculosis H37Rv
ucgccagauggcc

SEQ ID NO: 3265222 - RNA, 12 nt, Mycobacterium tuberculosis H37Rv
ucgccagcagca

SEQ ID NO: 3265223 - RNA, 18 nt, Mycobacterium tuberculosis H37Rv
ucgccagcaggaagccga

SEQ ID NO: 3265224 - RNA, 20 nt, Mycobacterium tuberculosis H37Rv
ucgccagcaggaagccgaag

SEQ ID NO: 3265225 - RNA, 22 nt, Mycobacterium tuberculosis H37Rv
ucgccagcaggaagccgaagau

SEQ ID NO: 3265226 - RNA, 21 nt, Mycobacterium tuberculosis H37Rv
ucgccagccugugcugccaac

SEQ ID NO: 3265227 - RNA, 18 nt, Mycobacterium tuberculosis H37Rv
ucgccagcgccggccagg

SEQ ID NO: 3265228 - RNA, 12 nt, Mycobacterium tuberculosis H37Rv
ucgccagcggcg

SEQ ID NO: 3265229 - RNA, 14 nt, Mycobacterium tuberculosis H37Rv
ucgccagcggcgcg

SEQ ID NO: 3265230 - RNA, 19 nt, Mycobacterium tuberculosis H37Rv
ucgccagcggcgcgaccgu

SEQ ID NO: 3265231 - RNA, 19 nt, Mycobacterium tuberculosis H37Rv
ucgccagcggggcuagucg

SEQ ID NO: 3265232 - RNA, 21 nt, Mycobacterium tuberculosis H37Rv
ucgccagggagcgcagcgccg

SEQ ID NO: 3265233 - RNA, 18 nt, Mycobacterium tuberculosis H37Rv
ucgcccaacaccgcgccg

SEQ ID NO: 3265234 - RNA, 23 nt, Mycobacterium tuberculosis H37Rv
ucgcccagagccgcugcggcacc

SEQ ID NO: 3265235 - RNA, 12 nt, Mycobacterium tuberculosis H37Rv
ucgcccagcaag

SEQ ID NO: 3265236 - RNA, 11 nt, Mycobacterium tuberculosis H37Rv
ucgcccaggcg

SEQ ID NO: 3265237 - RNA, 18 nt, Mycobacterium tuberculosis H37Rv
ucgcccaggcgugucguc

SEQ ID NO: 3265238 - RNA, 16 nt, Mycobacterium tuberculosis H37Rv
ucgcccagugcgcaac

SEQ ID NO: 3265239 - RNA, 19 nt, Mycobacterium tuberculosis H37Rv
ucgcccagugugcgccgug

SEQ ID NO: 3265240 - RNA, 17 nt, Mycobacterium tuberculosis H37Rv
ucgcccauuggccaggu

SEQ ID NO: 3265241 - RNA, 21 nt, Mycobacterium tuberculosis H37Rv
ucgcccccuggauggcgcccu

SEQ ID NO: 3265242 - RNA, 18 nt, Mycobacterium tuberculosis H37Rv
ucgccccgaggaugccga

SEQ ID NO: 3265243 - RNA, 16 nt, Mycobacterium tuberculosis H37Rv
ucgccccugcacagca

SEQ ID NO: 3265244 - RNA, 18 nt, Mycobacterium tuberculosis H37Rv
ucgcccgagucgaaaccg

SEQ ID NO: 3265245 - RNA, 14 nt, Mycobacterium tuberculosis H37Rv
ucgcccgcacacag

SEQ ID NO: 3265246 - RNA, 17 nt, Mycobacterium tuberculosis H37Rv
ucgcccgcacacagacc

SEQ ID NO: 3265247 - RNA, 17 nt, Mycobacterium tuberculosis H37Rv
ucgcccgccgccaccag

SEQ ID NO: 3265248 - RNA, 19 nt, Mycobacterium tuberculosis H37Rv
ucgcccgccgccaccagcu

SEQ ID NO: 3265249 - RNA, 16 nt, Mycobacterium tuberculosis H37Rv
ucgcccgcuacggcag

SEQ ID NO: 3265250 - RNA, 15 nt, Mycobacterium tuberculosis H37Rv
ucgcccgcugagcac

SEQ ID NO: 3265251 - RNA, 14 nt, Mycobacterium tuberculosis H37Rv
ucgcccggaugauc

SEQ ID NO: 3265252 - RNA, 16 nt, Mycobacterium tuberculosis H37Rv
ucgcccggcgcgguuu

SEQ ID NO: 3265253 - RNA, 13 nt, Mycobacterium tuberculosis H37Rv
ucgcccggcugcg

SEQ ID NO: 3265254 - RNA, 16 nt, Mycobacterium tuberculosis H37Rv
ucgcccggcugcgccg

SEQ ID NO: 3265255 - RNA, 21 nt, Mycobacterium tuberculosis H37Rv
ucgcccggguggcgucgaucu

SEQ ID NO: 3265256 - RNA, 20 nt, Mycobacterium tuberculosis H37Rv
ucgcccgguccgccgcagac

SEQ ID NO: 3265257 - RNA, 18 nt, Mycobacterium tuberculosis H37Rv
ucgcccgugagcagcggg

SEQ ID NO: 3265258 - RNA, 16 nt, Mycobacterium tuberculosis H37Rv
ucgcccucccgggccc

SEQ ID NO: 3265259 - RNA, 15 nt, Mycobacterium tuberculosis H37Rv
ucgcccugacaccca

SEQ ID NO: 3265260 - RNA, 20 nt, Mycobacterium tuberculosis H37Rv
ucgcccugagaacacguucg

SEQ ID NO: 3265261 - RNA, 15 nt, Mycobacterium tuberculosis H37Rv
ucgccgaaaccggga

SEQ ID NO: 3265262 - RNA, 23 nt, Mycobacterium tuberculosis H37Rv
ucgccgaaagccuugccgucgag

SEQ ID NO: 3265263 - RNA, 18 nt, Mycobacterium tuberculosis H37Rv
ucgccgaaagggucgacg

SEQ ID NO: 3265264 - RNA, 15 nt, Mycobacterium tuberculosis H37Rv
ucgccgaacaccgag

SEQ ID NO: 3265265 - RNA, 17 nt, Mycobacterium tuberculosis H37Rv
ucgccgaagccggaccg

SEQ ID NO: 3265266 - RNA, 21 nt, Mycobacterium tuberculosis H37Rv
ucgccgaagcgccgcuuggcg

SEQ ID NO: 3265267 - RNA, 22 nt, Mycobacterium tuberculosis H37Rv
ucgccgaaguuccagccgacgg

SEQ ID NO: 3265268 - RNA, 20 nt, Mycobacterium tuberculosis H37Rv
ucgccgaaucgcugaccgcg

SEQ ID NO: 3265269 - RNA, 15 nt, Mycobacterium tuberculosis H37Rv
ucgccgaaucggcag

SEQ ID NO: 3265270 - RNA, 20 nt, Mycobacterium tuberculosis H37Rv
ucgccgacagcgccuuguug

SEQ ID NO: 3265271 - RNA, 17 nt, Mycobacterium tuberculosis H37Rv
ucgccgaccgucacuga

SEQ ID NO: 3265272 - RNA, 13 nt, Mycobacterium tuberculosis H37Rv
ucgccgacgccgg

SEQ ID NO: 3265273 - RNA, 15 nt, Mycobacterium tuberculosis H37Rv
ucgccgacgguuacc

SEQ ID NO: 3265274 - RNA, 17 nt, Mycobacterium tuberculosis H37Rv
ucgccgacgucgacgcc

SEQ ID NO: 3265275 - RNA, 21 nt, Mycobacterium tuberculosis H37Rv
ucgccgagauagggccgcguc

SEQ ID NO: 3265276 - RNA, 16 nt, Mycobacterium tuberculosis H37Rv
ucgccgaggacgccgg

SEQ ID NO: 3265277 - RNA, 21 nt, Mycobacterium tuberculosis H37Rv
ucgccgaggacgccggcgccg

SEQ ID NO: 3265278 - RNA, 19 nt, Mycobacterium tuberculosis H37Rv
ucgccgaggcagcgucguc

SEQ ID NO: 3265279 - RNA, 23 nt, Mycobacterium tuberculosis H37Rv
ucgcuaaagcuaaacccccaccg

SEQ ID NO: 3265280 - RNA, 17 nt, Mycobacterium tuberculosis H37Rv
ucgcuaccuucuuggcu

SEQ ID NO: 3265281 - RNA, 13 nt, Mycobacterium tuberculosis H37Rv
ucgcucagggugu

SEQ ID NO: 3265282 - RNA, 20 nt, Mycobacterium tuberculosis H37Rv
ucgcucccccgcuacgcgcg

SEQ ID NO: 3265283 - RNA, 19 nt, Mycobacterium tuberculosis H37Rv
ucgcucccgguuggggugg

SEQ ID NO: 3265284 - RNA, 20 nt, Mycobacterium tuberculosis H37Rv
ucgcuccgaccgguggcguc

SEQ ID NO: 3265285 - RNA, 18 nt, Mycobacterium tuberculosis H37Rv
ucgcuccgcggcgcagca

SEQ ID NO: 3265286 - RNA, 20 nt, Mycobacterium tuberculosis H37Rv
ucgcuccgcggcgcagcacg

SEQ ID NO: 3265287 - RNA, 16 nt, Mycobacterium tuberculosis H37Rv
ucgcucguugcguugc

SEQ ID NO: 3265288 - RNA, 13 nt, Mycobacterium tuberculosis H37Rv
ucgcucucgguca

SEQ ID NO: 3265289 - RNA, 14 nt, Mycobacterium tuberculosis H37Rv
ucgcucugcgcggc

SEQ ID NO: 3265290 - RNA, 16 nt, Mycobacterium tuberculosis H37Rv
ucgcucugugucgccg

SEQ ID NO: 3265291 - RNA, 17 nt, Mycobacterium tuberculosis H37Rv
ucgcucugugucgccga

SEQ ID NO: 3265292 - RNA, 20 nt, Mycobacterium tuberculosis H37Rv
ucgcugaaugcgccguggau

SEQ ID NO: 3265293 - RNA, 20 nt, Mycobacterium tuberculosis H37Rv
ucgcugacccgggccgggcc

SEQ ID NO: 3265294 - RNA, 19 nt, Mycobacterium tuberculosis H37Rv
ucgcugaccgcguagacca

SEQ ID NO: 3265295 - RNA, 22 nt, Mycobacterium tuberculosis H37Rv
ucgcugaccgcguagaccagug

SEQ ID NO: 3265296 - RNA, 18 nt, Mycobacterium tuberculosis H37Rv
ucgcugacggcaaacgac

SEQ ID NO: 3265297 - RNA, 15 nt, Mycobacterium tuberculosis H37Rv
ucgcugagcacggcg

SEQ ID NO: 3265298 - RNA, 15 nt, Mycobacterium tuberculosis H37Rv
ucgcugauccgggcg

SEQ ID NO: 3265299 - RNA, 14 nt, Mycobacterium tuberculosis H37Rv
ucgcugaugcaucc

SEQ ID NO: 3265300 - RNA, 14 nt, Mycobacterium tuberculosis H37Rv
ucgcugcaccagcu

SEQ ID NO: 3265301 - RNA, 21 nt, Mycobacterium tuberculosis H37Rv
ucgcugcccaucacacccggu

SEQ ID NO: 3265302 - RNA, 13 nt, Mycobacterium tuberculosis H37Rv
ucgcugccgccga

SEQ ID NO: 3265303 - RNA, 18 nt, Mycobacterium tuberculosis H37Rv
ucgcugcucagcaacggc

SEQ ID NO: 3265304 - RNA, 18 nt, Mycobacterium tuberculosis H37Rv
ucgcugcugccgcaccgg

SEQ ID NO: 3265305 - RNA, 14 nt, Mycobacterium tuberculosis H37Rv
ucgcuggccgcgag

SEQ ID NO: 3265306 - RNA, 21 nt, Mycobacterium tuberculosis H37Rv
ucgcuggcgacccaaaaugcc

SEQ ID NO: 3265307 - RNA, 16 nt, Mycobacterium tuberculosis H37Rv
ucgcuggcgaugccga

SEQ ID NO: 3265308 - RNA, 15 nt, Mycobacterium tuberculosis H37Rv
ucgcugggacgggcg

SEQ ID NO: 3265309 - RNA, 18 nt, Mycobacterium tuberculosis H37Rv
ucgcuggguggcgggccg

SEQ ID NO: 3265310 - RNA, 22 nt, Mycobacterium tuberculosis H37Rv
ucgcugguauagcucacggugg

SEQ ID NO: 3265311 - RNA, 16 nt, Mycobacterium tuberculosis H37Rv
ucgcuggucgauggcc

SEQ ID NO: 3265312 - RNA, 16 nt, Mycobacterium tuberculosis H37Rv
ucgcuggugcacggcu

SEQ ID NO: 3265313 - RNA, 22 nt, Mycobacterium tuberculosis H37Rv
ucgcuguaggccagcccggcgu

SEQ ID NO: 3265314 - RNA, 18 nt, Mycobacterium tuberculosis H37Rv
ucgcuguccacugccacc

SEQ ID NO: 3265315 - RNA, 17 nt, Mycobacterium tuberculosis H37Rv
ucgcugugcgcuggucg

SEQ ID NO: 3265316 - RNA, 22 nt, Mycobacterium tuberculosis H37Rv
ucgcuucagcgccaaugucagc

SEQ ID NO: 3265317 - RNA, 13 nt, Mycobacterium tuberculosis H37Rv
ucgcuucgcaagu

SEQ ID NO: 3265318 - RNA, 13 nt, Mycobacterium tuberculosis H37Rv
ucgcuugcgcacg

SEQ ID NO: 3265319 - RNA, 23 nt, Mycobacterium tuberculosis H37Rv
ucggaaacggaccuccucgccca

SEQ ID NO: 3265320 - RNA, 19 nt, Mycobacterium tuberculosis H37Rv
ucggaacgaucauuccugc

SEQ ID NO: 3265321 - RNA, 23 nt, Mycobacterium tuberculosis H37Rv
ucggaacuagccaguuacguugu

SEQ ID NO: 3265322 - RNA, 16 nt, Mycobacterium tuberculosis H37Rv
ucggaagagucgacgc

SEQ ID NO: 3265323 - RNA, 19 nt, Mycobacterium tuberculosis H37Rv
ucggaagagucgacgcugu

SEQ ID NO: 3265324 - RNA, 15 nt, Mycobacterium tuberculosis H37Rv
ucggaaucggcggau

SEQ ID NO: 3265325 - RNA, 20 nt, Mycobacterium tuberculosis H37Rv
ucggaaucggcggaugaugc

SEQ ID NO: 3265326 - RNA, 23 nt, Mycobacterium tuberculosis H37Rv
ucggacaaggacugaccgucugc

SEQ ID NO: 3265327 - RNA, 21 nt, Mycobacterium tuberculosis H37Rv
ucggacagcgccuggccggaa

SEQ ID NO: 3265328 - RNA, 14 nt, Mycobacterium tuberculosis H37Rv
ucggacagggugcg

SEQ ID NO: 3265329 - RNA, 19 nt, Mycobacterium tuberculosis H37Rv
ucggacagguaacgcgguu

SEQ ID NO: 3265330 - RNA, 21 nt, Mycobacterium tuberculosis H37Rv
ucggacaugccgagguaacgc

SEQ ID NO: 3265331 - RNA, 21 nt, Mycobacterium tuberculosis H37Rv
ucggaccacaucuggucacgg

SEQ ID NO: 3265332 - RNA, 14 nt, Mycobacterium tuberculosis H37Rv
ucggaccacccggc

SEQ ID NO: 3265333 - RNA, 21 nt, Mycobacterium tuberculosis H37Rv
ucggaccagcugccggcgacc

SEQ ID NO: 3265334 - RNA, 13 nt, Mycobacterium tuberculosis H37Rv
ucggacccacccu

SEQ ID NO: 3265335 - RNA, 16 nt, Mycobacterium tuberculosis H37Rv
ucggaccuuccgggug

SEQ ID NO: 3265336 - RNA, 18 nt, Mycobacterium tuberculosis H37Rv
ucggaccuuccgggugaa

SEQ ID NO: 3265337 - RNA, 18 nt, Mycobacterium tuberculosis H37Rv
ucggacggccaucgccag

SEQ ID NO: 3265338 - RNA, 21 nt, Mycobacterium tuberculosis H37Rv
ucggacgggaugcuuggucuc

SEQ ID NO: 3265339 - RNA, 12 nt, Mycobacterium tuberculosis H37Rv
ucggacugaaga

SEQ ID NO: 3265340 - RNA, 20 nt, Mycobacterium tuberculosis H37Rv
ucggacuggggcacgccaug

SEQ ID NO: 3265341 - RNA, 14 nt, Mycobacterium tuberculosis H37Rv
ucggagacgucuuc

SEQ ID NO: 3265342 - RNA, 17 nt, Mycobacterium tuberculosis H37Rv
ucggagacgucuucggg

SEQ ID NO: 3265343 - RNA, 23 nt, Mycobacterium tuberculosis H37Rv
ucggagauacucgaguggcgaac

SEQ ID NO: 3265344 - RNA, 18 nt, Mycobacterium tuberculosis H37Rv
ucggagauuucgucgcug

SEQ ID NO: 3265345 - RNA, 18 nt, Mycobacterium tuberculosis H37Rv
ucggagccggccaccucg

SEQ ID NO: 3265346 - RNA, 19 nt, Mycobacterium tuberculosis H37Rv
ucggagcgggcuccggcuc

SEQ ID NO: 3265347 - RNA, 23 nt, Mycobacterium tuberculosis H37Rv
ucggaggaaccccgcgcggugcc

SEQ ID NO: 3265348 - RNA, 21 nt, Mycobacterium tuberculosis H37Rv
ucggaggcccgccacaacggc

SEQ ID NO: 3265349 - RNA, 13 nt, Mycobacterium tuberculosis H37Rv
ucggaggcgacca

SEQ ID NO: 3265350 - RNA, 21 nt, Mycobacterium tuberculosis H37Rv
ucggaggcgaccacgucggcg

SEQ ID NO: 3265351 - RNA, 15 nt, Mycobacterium tuberculosis H37Rv
ucggagucgacgguc

SEQ ID NO: 3265352 - RNA, 22 nt, Mycobacterium tuberculosis H37Rv
ucggagucgacggucacggugg

SEQ ID NO: 3265353 - RNA, 13 nt, Mycobacterium tuberculosis H37Rv
ucggauagccccg

SEQ ID NO: 3265354 - RNA, 21 nt, Mycobacterium tuberculosis H37Rv
ucggauccggacggugucagc

SEQ ID NO: 3265355 - RNA, 18 nt, Mycobacterium tuberculosis H37Rv
ucggaucgauuccgccgc

SEQ ID NO: 3265356 - RNA, 15 nt, Mycobacterium tuberculosis H37Rv
ucggaucgccaggcc

SEQ ID NO: 3265357 - RNA, 19 nt, Mycobacterium tuberculosis H37Rv
ucggaugcaacccggugau

SEQ ID NO: 3265358 - RNA, 18 nt, Mycobacterium tuberculosis H37Rv
ucggaugucucggcacca

SEQ ID NO: 3265359 - RNA, 19 nt, Mycobacterium tuberculosis H37Rv
ucggaugucucggcaccac

SEQ ID NO: 3265360 - RNA, 20 nt, Mycobacterium tuberculosis H37Rv
ucggaugucucggcaccaca

SEQ ID NO: 3265361 - RNA, 20 nt, Mycobacterium tuberculosis H37Rv
ucggcaaccaccucgugggc

SEQ ID NO: 3265362 - RNA, 22 nt, Mycobacterium tuberculosis H37Rv
ucggcaacgacccgccgcccca

SEQ ID NO: 3265363 - RNA, 13 nt, Mycobacterium tuberculosis H37Rv
ucggcaacgcugg

SEQ ID NO: 3265364 - RNA, 17 nt, Mycobacterium tuberculosis H37Rv
ucggcaaggacguggcg

SEQ ID NO: 3265365 - RNA, 19 nt, Mycobacterium tuberculosis H37Rv
ucggcaauacuccgcugac

SEQ ID NO: 3265366 - RNA, 18 nt, Mycobacterium tuberculosis H37Rv
ucggcaaugucuucgaua

SEQ ID NO: 3265367 - RNA, 13 nt, Mycobacterium tuberculosis H37Rv
ucggcaccaccgc

SEQ ID NO: 3265368 - RNA, 18 nt, Mycobacterium tuberculosis H37Rv
ucggcaccaccgcgaccu

SEQ ID NO: 3265369 - RNA, 15 nt, Mycobacterium tuberculosis H37Rv
ucggcaccagcagcc

SEQ ID NO: 3265370 - RNA, 12 nt, Mycobacterium tuberculosis H37Rv
ucggcaccccac

SEQ ID NO: 3265371 - RNA, 18 nt, Mycobacterium tuberculosis H37Rv
ucggcacccggcagagca

SEQ ID NO: 3265372 - RNA, 15 nt, Mycobacterium tuberculosis H37Rv
ucggcaccgcggccg

SEQ ID NO: 3265373 - RNA, 16 nt, Mycobacterium tuberculosis H37Rv
ucggcaccgcggccgc

SEQ ID NO: 3265374 - RNA, 22 nt, Mycobacterium tuberculosis H37Rv
ucggcaccgugcggggggcagc

SEQ ID NO: 3265375 - RNA, 20 nt, Mycobacterium tuberculosis H37Rv
ucggcgagcacgucacgcgc

SEQ ID NO: 3265376 - RNA, 19 nt, Mycobacterium tuberculosis H37Rv
ucggcgagccgcucgcuga

SEQ ID NO: 3265377 - RNA, 16 nt, Mycobacterium tuberculosis H37Rv
ucggcgagcgcaucgg

SEQ ID NO: 3265378 - RNA, 14 nt, Mycobacterium tuberculosis H37Rv
ucggcgagcgcggc

SEQ ID NO: 3265379 - RNA, 14 nt, Mycobacterium tuberculosis H37Rv
ucggcgagcgucgg

SEQ ID NO: 3265380 - RNA, 22 nt, Mycobacterium tuberculosis H37Rv
ucggcgaggacggcggccagga

SEQ ID NO: 3265381 - RNA, 19 nt, Mycobacterium tuberculosis H37Rv
ucggcgaguagaccucgag

SEQ ID NO: 3265382 - RNA, 16 nt, Mycobacterium tuberculosis H37Rv
ucggcgaucaacgcgc

SEQ ID NO: 3265383 - RNA, 21 nt, Mycobacterium tuberculosis H37Rv
ucggcgaucaacgcgcacgcg

SEQ ID NO: 3265384 - RNA, 24 nt, Mycobacterium tuberculosis H37Rv
ucggcgaucgucaagccgggcacg

SEQ ID NO: 3265385 - RNA, 15 nt, Mycobacterium tuberculosis H37Rv
ucggcgaucucgucg

SEQ ID NO: 3265386 - RNA, 16 nt, Mycobacterium tuberculosis H37Rv
ucggcgaucucgucgc

SEQ ID NO: 3265387 - RNA, 19 nt, Mycobacterium tuberculosis H37Rv
ucggcgaugggccgguccg

SEQ ID NO: 3265388 - RNA, 16 nt, Mycobacterium tuberculosis H37Rv
ucggcgaugucgaagc

SEQ ID NO: 3265389 - RNA, 13 nt, Mycobacterium tuberculosis H37Rv
ucggcgcacagcg

SEQ ID NO: 3265390 - RNA, 14 nt, Mycobacterium tuberculosis H37Rv
ucggcgcacagcga

SEQ ID NO: 3265391 - RNA, 17 nt, Mycobacterium tuberculosis H37Rv
ucggcgcagccggugag

SEQ ID NO: 3265392 - RNA, 19 nt, Mycobacterium tuberculosis H37Rv
ucggcgccagaucgacgcc

SEQ ID NO: 3265393 - RNA, 16 nt, Mycobacterium tuberculosis H37Rv
ucggcgcccgggaucg

SEQ ID NO: 3265394 - RNA, 20 nt, Mycobacterium tuberculosis H37Rv
ucggcgcccgggaucggguc

SEQ ID NO: 3265395 - RNA, 20 nt, Mycobacterium tuberculosis H37Rv
ucggcgccgccguccagcgc

SEQ ID NO: 3265396 - RNA, 21 nt, Mycobacterium tuberculosis H37Rv
ucggcgccgccguccagcgcc

SEQ ID NO: 3265397 - RNA, 23 nt, Mycobacterium tuberculosis H37Rv
ucggcgccgccguccagcgccgc

SEQ ID NO: 3265398 - RNA, 20 nt, Mycobacterium tuberculosis H37Rv
ucggcgccucggaccagacc

SEQ ID NO: 3265399 - RNA, 21 nt, Mycobacterium tuberculosis H37Rv
ucggcgcgcaccucggcgaag

SEQ ID NO: 3265400 - RNA, 17 nt, Mycobacterium tuberculosis H37Rv
ucggcgcgccgcacacg

SEQ ID NO: 3265401 - RNA, 23 nt, Mycobacterium tuberculosis H37Rv
ucggcgcgcggguugucggcgac

SEQ ID NO: 3265402 - RNA, 21 nt, Mycobacterium tuberculosis H37Rv
ucggcgcugaucgcgcgcacc

SEQ ID NO: 3265403 - RNA, 18 nt, Mycobacterium tuberculosis H37Rv
ucggcgcugcgcaccgcc

SEQ ID NO: 3265404 - RNA, 17 nt, Mycobacterium tuberculosis H37Rv
ucggcgcuggccgucga

SEQ ID NO: 3265405 - RNA, 13 nt, Mycobacterium tuberculosis H37Rv
ucggcggaagacc

SEQ ID NO: 3265406 - RNA, 14 nt, Mycobacterium tuberculosis H37Rv
ucggcggacccggu

SEQ ID NO: 3265407 - RNA, 19 nt, Mycobacterium tuberculosis H37Rv
ucggcggcauguucaucgc

SEQ ID NO: 3265408 - RNA, 14 nt, Mycobacterium tuberculosis H37Rv
ucggcggccagcgc

SEQ ID NO: 3265409 - RNA, 21 nt, Mycobacterium tuberculosis H37Rv
ucggcggcccggccgaacgcc

SEQ ID NO: 3265410 - RNA, 19 nt, Mycobacterium tuberculosis H37Rv
ucggcggccgagcgcaccg

SEQ ID NO: 3265411 - RNA, 20 nt, Mycobacterium tuberculosis H37Rv
ucggcggccgagcgcaccgc

SEQ ID NO: 3265412 - RNA, 21 nt, Mycobacterium tuberculosis H37Rv
ucggcggccgagcgcaccgcu

SEQ ID NO: 3265413 - RNA, 14 nt, Mycobacterium tuberculosis H37Rv
ucggcggccgcgac

SEQ ID NO: 3265414 - RNA, 23 nt, Mycobacterium tuberculosis H37Rv
ucggcggccgcgaccagcgccgc

SEQ ID NO: 3265415 - RNA, 20 nt, Mycobacterium tuberculosis H37Rv
ucggcggccgugucgggcgc

SEQ ID NO: 3265416 - RNA, 22 nt, Mycobacterium tuberculosis H37Rv
ucggcggccugcucgcagaucg

SEQ ID NO: 3265417 - RNA, 18 nt, Mycobacterium tuberculosis H37Rv
ucggcggcgcgccgaucg

SEQ ID NO: 3265418 - RNA, 19 nt, Mycobacterium tuberculosis H37Rv
ucggcggcguccagcagcg

SEQ ID NO: 3265419 - RNA, 14 nt, Mycobacterium tuberculosis H37Rv
ucggcggcgucuuc

SEQ ID NO: 3265420 - RNA, 18 nt, Mycobacterium tuberculosis H37Rv
ucggcggcucuagaucgc

SEQ ID NO: 3265421 - RNA, 14 nt, Mycobacterium tuberculosis H37Rv
ucggcggcugccag

SEQ ID NO: 3265422 - RNA, 17 nt, Mycobacterium tuberculosis H37Rv
ucggcggcuucguggcg

SEQ ID NO: 3265423 - RNA, 15 nt, Mycobacterium tuberculosis H37Rv
ucggcgggauccucg

SEQ ID NO: 3265424 - RNA, 17 nt, Mycobacterium tuberculosis H37Rv
ucggcggggaccgcggu

SEQ ID NO: 3265425 - RNA, 21 nt, Mycobacterium tuberculosis H37Rv
ucggcggguagaaccagcccg

SEQ ID NO: 3265426 - RNA, 13 nt, Mycobacterium tuberculosis H37Rv
ucggcgggucagg

SEQ ID NO: 3265427 - RNA, 23 nt, Mycobacterium tuberculosis H37Rv
ucggcgggucaggccagggugac

SEQ ID NO: 3265428 - RNA, 23 nt, Mycobacterium tuberculosis H37Rv
ucggcgguaaaugccugcccacc

SEQ ID NO: 3265429 - RNA, 23 nt, Mycobacterium tuberculosis H37Rv
ucggcggugaaaucgcacagcgc

SEQ ID NO: 3265430 - RNA, 20 nt, Mycobacterium tuberculosis H37Rv
ucggcggugaacgacggguc

SEQ ID NO: 3265431 - RNA, 21 nt, Mycobacterium tuberculosis H37Rv
ucggcggugaacuucuccacc

SEQ ID NO: 3265432 - RNA, 13 nt, Mycobacterium tuberculosis H37Rv
ucggcggugcaga

SEQ ID NO: 3265433 - RNA, 20 nt, Mycobacterium tuberculosis H37Rv
ucggcggugcagaucggcuc

SEQ ID NO: 3265434 - RNA, 20 nt, Mycobacterium tuberculosis H37Rv
ucggcggugcccagcagcgc

SEQ ID NO: 3265435 - RNA, 17 nt, Mycobacterium tuberculosis H37Rv
ucggcggugcgcugaug

SEQ ID NO: 3265436 - RNA, 22 nt, Mycobacterium tuberculosis H37Rv
ucggcggugucgaccucauguu

SEQ ID NO: 3265437 - RNA, 15 nt, Mycobacterium tuberculosis H37Rv
ucggcgguucgaucc

SEQ ID NO: 3265438 - RNA, 19 nt, Mycobacterium tuberculosis H37Rv
ucggcgucaccguguugca

SEQ ID NO: 3265439 - RNA, 19 nt, Mycobacterium tuberculosis H37Rv
ucggcgucacgguggacga

SEQ ID NO: 3265440 - RNA, 16 nt, Mycobacterium tuberculosis H37Rv
ucggcguccaggcagc

SEQ ID NO: 3265441 - RNA, 16 nt, Mycobacterium tuberculosis H37Rv
ucggcgucccagggca

SEQ ID NO: 3265442 - RNA, 17 nt, Mycobacterium tuberculosis H37Rv
ucggcguccuugcgcag

SEQ ID NO: 3265443 - RNA, 19 nt, Mycobacterium tuberculosis H37Rv
ucggcguccuugcgcagca

SEQ ID NO: 3265444 - RNA, 21 nt, Mycobacterium tuberculosis H37Rv
ucggcguccuugcgcagcacc

SEQ ID NO: 3265445 - RNA, 14 nt, Mycobacterium tuberculosis H37Rv
ucggcgucgaagac

SEQ ID NO: 3265446 - RNA, 19 nt, Mycobacterium tuberculosis H37Rv
ucggcgucguauucgaugc

SEQ ID NO: 3265447 - RNA, 21 nt, Mycobacterium tuberculosis H37Rv
ucggcgucguggcuuccggug

SEQ ID NO: 3265448 - RNA, 20 nt, Mycobacterium tuberculosis H37Rv
ucggcgucgugguggccacg

SEQ ID NO: 3265449 - RNA, 16 nt, Mycobacterium tuberculosis H37Rv
ucggcgugcagcagcu

SEQ ID NO: 3265450 - RNA, 19 nt, Mycobacterium tuberculosis H37Rv
ucggcgugguguccaccgc

SEQ ID NO: 3265451 - RNA, 15 nt, Mycobacterium tuberculosis H37Rv
ucggcgugucgcguc

SEQ ID NO: 3265452 - RNA, 17 nt, Mycobacterium tuberculosis H37Rv
ucggcgugucgcgucgc

SEQ ID NO: 3265453 - RNA, 15 nt, Mycobacterium tuberculosis H37Rv
ucggcguuggggcuc

SEQ ID NO: 3265454 - RNA, 18 nt, Mycobacterium tuberculosis H37Rv
ucggcuaccuuguccggc

SEQ ID NO: 3265455 - RNA, 17 nt, Mycobacterium tuberculosis H37Rv
ucggcuagugcauuguc

SEQ ID NO: 3265456 - RNA, 18 nt, Mycobacterium tuberculosis H37Rv
ucggcuagugugaccguc

SEQ ID NO: 3265457 - RNA, 19 nt, Mycobacterium tuberculosis H37Rv
ucggcuauggguucgcggu

SEQ ID NO: 3265458 - RNA, 17 nt, Mycobacterium tuberculosis H37Rv
ucggcucaccgaacgcg

SEQ ID NO: 3265459 - RNA, 21 nt, Mycobacterium tuberculosis H37Rv
ucggcucagcaacgucacguc

SEQ ID NO: 3265460 - RNA, 22 nt, Mycobacterium tuberculosis H37Rv
ucggcucagcaacgucacgucg

SEQ ID NO: 3265461 - RNA, 12 nt, Mycobacterium tuberculosis H37Rv
ucggcuccaccc

SEQ ID NO: 3265462 - RNA, 12 nt, Mycobacterium tuberculosis H37Rv
ucggcuccacgc

SEQ ID NO: 3265463 - RNA, 22 nt, Mycobacterium tuberculosis H37Rv
ucggcucgagucgcagcacggg

SEQ ID NO: 3265464 - RNA, 20 nt, Mycobacterium tuberculosis H37Rv
ucggcugauuggcccaccgc

SEQ ID NO: 3265465 - RNA, 19 nt, Mycobacterium tuberculosis H37Rv
ucggcugccaccgcagacg

SEQ ID NO: 3265466 - RNA, 16 nt, Mycobacterium tuberculosis H37Rv
ucggcugccgcggcug

SEQ ID NO: 3265467 - RNA, 18 nt, Mycobacterium tuberculosis H37Rv
ucggcugccgcggcugcc

SEQ ID NO: 3265468 - RNA, 22 nt, Mycobacterium tuberculosis H37Rv
ucggcugcgacaggacgucggc

SEQ ID NO: 3265469 - RNA, 15 nt, Mycobacterium tuberculosis H37Rv
ucggcugcgcgcucg

SEQ ID NO: 3265470 - RNA, 22 nt, Mycobacterium tuberculosis H37Rv
ucggguauugaaguucgggcaa

SEQ ID NO: 3265471 - RNA, 20 nt, Mycobacterium tuberculosis H37Rv
ucgggucaccgugcggaucg

SEQ ID NO: 3265472 - RNA, 21 nt, Mycobacterium tuberculosis H37Rv
ucgggucaccgugcggaucgc

SEQ ID NO: 3265473 - RNA, 12 nt, Mycobacterium tuberculosis H37Rv
ucgggucagcac

SEQ ID NO: 3265474 - RNA, 13 nt, Mycobacterium tuberculosis H37Rv
ucgggucagcacc

SEQ ID NO: 3265475 - RNA, 13 nt, Mycobacterium tuberculosis H37Rv
ucggguccaacgc

SEQ ID NO: 3265476 - RNA, 19 nt, Mycobacterium tuberculosis H37Rv
ucgggucccuuguggucug

SEQ ID NO: 3265477 - RNA, 21 nt, Mycobacterium tuberculosis H37Rv
ucgggugagcacccagcggcg

SEQ ID NO: 3265478 - RNA, 11 nt, Mycobacterium tuberculosis H37Rv
ucgggugcagc

SEQ ID NO: 3265479 - RNA, 12 nt, Mycobacterium tuberculosis H37Rv
ucgggugcagcc

SEQ ID NO: 3265480 - RNA, 13 nt, Mycobacterium tuberculosis H37Rv
ucgggugcugaug

SEQ ID NO: 3265481 - RNA, 16 nt, Mycobacterium tuberculosis H37Rv
ucggguguggucacca

SEQ ID NO: 3265482 - RNA, 17 nt, Mycobacterium tuberculosis H37Rv
ucggguuccgaucucaa

SEQ ID NO: 3265483 - RNA, 12 nt, Mycobacterium tuberculosis H37Rv
ucggguucguca

SEQ ID NO: 3265484 - RNA, 12 nt, Mycobacterium tuberculosis H37Rv
ucggguugcagc

SEQ ID NO: 3265485 - RNA, 14 nt, Mycobacterium tuberculosis H37Rv
ucggguugcgacga

SEQ ID NO: 3265486 - RNA, 16 nt, Mycobacterium tuberculosis H37Rv
ucggguuugucgucgu

SEQ ID NO: 3265487 - RNA, 18 nt, Mycobacterium tuberculosis H37Rv
ucgguaaacguugggaaa

SEQ ID NO: 3265488 - RNA, 19 nt, Mycobacterium tuberculosis H37Rv
ucgguaccccagcgcuguc

SEQ ID NO: 3265489 - RNA, 18 nt, Mycobacterium tuberculosis H37Rv
ucgguaccgacggcacca

SEQ ID NO: 3265490 - RNA, 21 nt, Mycobacterium tuberculosis H37Rv
ucggucaaccccggaccgcgg

SEQ ID NO: 3265491 - RNA, 19 nt, Mycobacterium tuberculosis H37Rv
ucggucacgacggcacgcc

SEQ ID NO: 3265492 - RNA, 18 nt, Mycobacterium tuberculosis H37Rv
ucggucagagccgucgaa

SEQ ID NO: 3265493 - RNA, 19 nt, Mycobacterium tuberculosis H37Rv
ucggucagcgggcacgccg

SEQ ID NO: 3265494 - RNA, 24 nt, Mycobacterium tuberculosis H37Rv
ucggucagcgucaggugcgcgacc

SEQ ID NO: 3265495 - RNA, 17 nt, Mycobacterium tuberculosis H37Rv
ucggucagggugggcuc

SEQ ID NO: 3265496 - RNA, 19 nt, Mycobacterium tuberculosis H37Rv
ucggucccgccggucacga

SEQ ID NO: 3265497 - RNA, 13 nt, Mycobacterium tuberculosis H37Rv
ucgguccugccaa

SEQ ID NO: 3265498 - RNA, 14 nt, Mycobacterium tuberculosis H37Rv
ucggucgccaccgc

SEQ ID NO: 3265499 - RNA, 22 nt, Mycobacterium tuberculosis H37Rv
ucggucgccaccgccggcagca

SEQ ID NO: 3265500 - RNA, 21 nt, Mycobacterium tuberculosis H37Rv
ucggucgccauguugaagcga

SEQ ID NO: 3265501 - RNA, 21 nt, Mycobacterium tuberculosis H37Rv
ucggucgcgcgacggccggga

SEQ ID NO: 3265502 - RNA, 17 nt, Mycobacterium tuberculosis H37Rv
ucggucggcaccagguu

SEQ ID NO: 3265503 - RNA, 15 nt, Mycobacterium tuberculosis H37Rv
ucggucguccggauc

SEQ ID NO: 3265504 - RNA, 15 nt, Mycobacterium tuberculosis H37Rv
ucggucgucucgggc

SEQ ID NO: 3265505 - RNA, 19 nt, Mycobacterium tuberculosis H37Rv
ucggucguuggugcagacc

SEQ ID NO: 3265506 - RNA, 20 nt, Mycobacterium tuberculosis H37Rv
ucggucucauagugcagguc

SEQ ID NO: 3265507 - RNA, 13 nt, Mycobacterium tuberculosis H37Rv
ucggucucgaucc

SEQ ID NO: 3265508 - RNA, 20 nt, Mycobacterium tuberculosis H37Rv
ucggucugcaugcgcuggaa

SEQ ID NO: 3265509 - RNA, 21 nt, Mycobacterium tuberculosis H37Rv
ucggucugguggucggcgacg

SEQ ID NO: 3265510 - RNA, 23 nt, Mycobacterium tuberculosis H37Rv
ucggugaaaaaggcgacucggug

SEQ ID NO: 3265511 - RNA, 19 nt, Mycobacterium tuberculosis H37Rv
ucggugaacccgccggcaa

SEQ ID NO: 3265512 - RNA, 16 nt, Mycobacterium tuberculosis H37Rv
ucggugaacgccgccc

SEQ ID NO: 3265513 - RNA, 17 nt, Mycobacterium tuberculosis H37Rv
ucggugaaggucaccgu

SEQ ID NO: 3265514 - RNA, 22 nt, Mycobacterium tuberculosis H37Rv
ucggugaaggucaccgucgagu

SEQ ID NO: 3265515 - RNA, 19 nt, Mycobacterium tuberculosis H37Rv
ucggugacccccgagaucc

SEQ ID NO: 3265516 - RNA, 20 nt, Mycobacterium tuberculosis H37Rv
ucggugaccguggcggggaa

SEQ ID NO: 3265517 - RNA, 17 nt, Mycobacterium tuberculosis H37Rv
ucggugaccuguuuggg

SEQ ID NO: 3265518 - RNA, 22 nt, Mycobacterium tuberculosis H37Rv
ucggugacgaagagcaccgcgc

SEQ ID NO: 3265519 - RNA, 14 nt, Mycobacterium tuberculosis H37Rv
ucggugacgucgcc

SEQ ID NO: 3265520 - RNA, 15 nt, Mycobacterium tuberculosis H37Rv
ucggugagccgugcc

SEQ ID NO: 3265521 - RNA, 17 nt, Mycobacterium tuberculosis H37Rv
ucggugaggucgaugcc

SEQ ID NO: 3265522 - RNA, 18 nt, Mycobacterium tuberculosis H37Rv
ucggugaggucgaugccg

SEQ ID NO: 3265523 - RNA, 14 nt, Mycobacterium tuberculosis H37Rv
ucggugaucaccgc

SEQ ID NO: 3265524 - RNA, 22 nt, Mycobacterium tuberculosis H37Rv
ucggugaucucguacuccccgc

SEQ ID NO: 3265525 - RNA, 13 nt, Mycobacterium tuberculosis H37Rv
ucggugcacggcg

SEQ ID NO: 3265526 - RNA, 14 nt, Mycobacterium tuberculosis H37Rv
ucggugcagcccgc

SEQ ID NO: 3265527 - RNA, 21 nt, Mycobacterium tuberculosis H37Rv
ucggugccagcacuccaccgc

SEQ ID NO: 3265528 - RNA, 17 nt, Mycobacterium tuberculosis H37Rv
ucggugccggggcugcc

SEQ ID NO: 3265529 - RNA, 22 nt, Mycobacterium tuberculosis H37Rv
ucggugccggggcugccgccgu

SEQ ID NO: 3265530 - RNA, 19 nt, Mycobacterium tuberculosis H37Rv
ucggugccgugaucggcgc

SEQ ID NO: 3265531 - RNA, 19 nt, Mycobacterium tuberculosis H37Rv
ucggugcgcgcagacucgc

SEQ ID NO: 3265532 - RNA, 15 nt, Mycobacterium tuberculosis H37Rv
ucggugcgcgcggcg

SEQ ID NO: 3265533 - RNA, 14 nt, Mycobacterium tuberculosis H37Rv
ucggugcgcuggcg

SEQ ID NO: 3265534 - RNA, 23 nt, Mycobacterium tuberculosis H37Rv
ucggugcggaacaccgcccggcc

SEQ ID NO: 3265535 - RNA, 24 nt, Mycobacterium tuberculosis H37Rv
ucggugcggaacacgaugcgcggu

SEQ ID NO: 3265536 - RNA, 23 nt, Mycobacterium tuberculosis H37Rv
ucggugcgguucgcugcggcggu

SEQ ID NO: 3265537 - RNA, 22 nt, Mycobacterium tuberculosis H37Rv
ucgguggcgaugcgauaggccc

SEQ ID NO: 3265538 - RNA, 22 nt, Mycobacterium tuberculosis H37Rv
ucggugggcuugccgcgcacca

SEQ ID NO: 3265539 - RNA, 17 nt, Mycobacterium tuberculosis H37Rv
ucggugggugccagccg

SEQ ID NO: 3265540 - RNA, 18 nt, Mycobacterium tuberculosis H37Rv
ucggugguaacaccggcg

SEQ ID NO: 3265541 - RNA, 19 nt, Mycobacterium tuberculosis H37Rv
ucggugguggguugaucgc

SEQ ID NO: 3265542 - RNA, 14 nt, Mycobacterium tuberculosis H37Rv
ucggugucgccacc

SEQ ID NO: 3265543 - RNA, 19 nt, Mycobacterium tuberculosis H37Rv
ucggugucuuccuccucga

SEQ ID NO: 3265544 - RNA, 20 nt, Mycobacterium tuberculosis H37Rv
ucggugucuuccuccucgac

SEQ ID NO: 3265545 - RNA, 13 nt, Mycobacterium tuberculosis H37Rv
ucggugugcaucg

SEQ ID NO: 3265546 - RNA, 18 nt, Mycobacterium tuberculosis H37Rv
ucggugugcggcgcaugc

SEQ ID NO: 3265547 - RNA, 12 nt, Mycobacterium tuberculosis H37Rv
ucgguguggacu

SEQ ID NO: 3265548 - RNA, 13 nt, Mycobacterium tuberculosis H37Rv
ucgguguggccgu

SEQ ID NO: 3265549 - RNA, 19 nt, Mycobacterium tuberculosis H37Rv
ucgguuggcucgggccaga

SEQ ID NO: 3265550 - RNA, 13 nt, Mycobacterium tuberculosis H37Rv
ucgguuuccucga

SEQ ID NO: 3265551 - RNA, 19 nt, Mycobacterium tuberculosis H37Rv
ucgguuucgaccugcggga

SEQ ID NO: 3265552 - RNA, 19 nt, Mycobacterium tuberculosis H37Rv
ucgguuugggaauccgcau

SEQ ID NO: 3265553 - RNA, 20 nt, Mycobacterium tuberculosis H37Rv
ucguaaucggcaaugagcua

SEQ ID NO: 3265554 - RNA, 14 nt, Mycobacterium tuberculosis H37Rv
ucguaccgggcgag

SEQ ID NO: 3265555 - RNA, 19 nt, Mycobacterium tuberculosis H37Rv
ucguaccgguugacgggcu

SEQ ID NO: 3265556 - RNA, 14 nt, Mycobacterium tuberculosis H37Rv
ucguaccguucggg

SEQ ID NO: 3265557 - RNA, 19 nt, Mycobacterium tuberculosis H37Rv
ucguacgggucggcgacga

SEQ ID NO: 3265558 - RNA, 15 nt, Mycobacterium tuberculosis H37Rv
ucguacucccaggcc

SEQ ID NO: 3265559 - RNA, 22 nt, Mycobacterium tuberculosis H37Rv
ucguacucccaggccgccgcca

SEQ ID NO: 3265560 - RNA, 13 nt, Mycobacterium tuberculosis H37Rv
ucguacucggcgg

SEQ ID NO: 3265561 - RNA, 15 nt, Mycobacterium tuberculosis H37Rv
ucguagacggcgaaa

SEQ ID NO: 3265562 - RNA, 20 nt, Mycobacterium tuberculosis H37Rv
ucguagcgcgcauagggcug

SEQ ID NO: 3265563 - RNA, 13 nt, Mycobacterium tuberculosis H37Rv
ucguaggccgcau

SEQ ID NO: 3265564 - RNA, 21 nt, Mycobacterium tuberculosis H37Rv
ucguauccgguucugggccug

SEQ ID NO: 3265565 - RNA, 18 nt, Mycobacterium tuberculosis H37Rv
ucguaugauucacgcucg

SEQ ID NO: 3265566 - RNA, 19 nt, Mycobacterium tuberculosis H37Rv
ucgugagcuuuaucugcau

SEQ ID NO: 3265567 - RNA, 14 nt, Mycobacterium tuberculosis H37Rv
ucgugaucagcagg

SEQ ID NO: 3265568 - RNA, 22 nt, Mycobacterium tuberculosis H37Rv
ucgugaugucaacgugucccaa

SEQ ID NO: 3265569 - RNA, 12 nt, Mycobacterium tuberculosis H37Rv
ucgugcaaucgc

SEQ ID NO: 3265570 - RNA, 22 nt, Mycobacterium tuberculosis H37Rv
ucgugcaaugcuuccagcauca

SEQ ID NO: 3265571 - RNA, 19 nt, Mycobacterium tuberculosis H37Rv
ucgugcacggcggccaggg

SEQ ID NO: 3265572 - RNA, 11 nt, Mycobacterium tuberculosis H37Rv
ucgugccaccg

SEQ ID NO: 3265573 - RNA, 18 nt, Mycobacterium tuberculosis H37Rv
ucgugccacuuccacggc

SEQ ID NO: 3265574 - RNA, 18 nt, Mycobacterium tuberculosis H37Rv
ucgugccgccgucgucgu

SEQ ID NO: 3265575 - RNA, 20 nt, Mycobacterium tuberculosis H37Rv
ucgugccgggaccggugugc

SEQ ID NO: 3265576 - RNA, 16 nt, Mycobacterium tuberculosis H37Rv
ucgugccggggcugcc

SEQ ID NO: 3265577 - RNA, 20 nt, Mycobacterium tuberculosis H37Rv
ucgugcgcuuggucgaccgc

SEQ ID NO: 3265578 - RNA, 15 nt, Mycobacterium tuberculosis H37Rv
ucgugcggcacuccc

SEQ ID NO: 3265579 - RNA, 22 nt, Mycobacterium tuberculosis H37Rv
ucgugcggggguggucucgaua

SEQ ID NO: 3265580 - RNA, 16 nt, Mycobacterium tuberculosis H37Rv
ucgugcucucggcgaa

SEQ ID NO: 3265581 - RNA, 15 nt, Mycobacterium tuberculosis H37Rv
ucgugcuugcccggu

SEQ ID NO: 3265582 - RNA, 20 nt, Mycobacterium tuberculosis H37Rv
ucguggagcucacgugcugc

SEQ ID NO: 3265583 - RNA, 15 nt, Mycobacterium tuberculosis H37Rv
ucguggaucugccuc

SEQ ID NO: 3265584 - RNA, 16 nt, Mycobacterium tuberculosis H37Rv
ucguggaucugccucu

SEQ ID NO: 3265585 - RNA, 22 nt, Mycobacterium tuberculosis H37Rv
ucguggcgccgccccauacuug

SEQ ID NO: 3265586 - RNA, 15 nt, Mycobacterium tuberculosis H37Rv
ucguggcgcucggcg

SEQ ID NO: 3265587 - RNA, 20 nt, Mycobacterium tuberculosis H37Rv
ucguggcgguggccgucggg

SEQ ID NO: 3265588 - RNA, 16 nt, Mycobacterium tuberculosis H37Rv
ucgugggaaccaccag

SEQ ID NO: 3265589 - RNA, 23 nt, Mycobacterium tuberculosis H37Rv
ucgugggccacuugaugcucgau

SEQ ID NO: 3265590 - RNA, 16 nt, Mycobacterium tuberculosis H37Rv
ucguggggaccucggc

SEQ ID NO: 3265591 - RNA, 14 nt, Mycobacterium tuberculosis H37Rv
ucgugggucaacgu

SEQ ID NO: 3265592 - RNA, 13 nt, Mycobacterium tuberculosis H37Rv
ucgugguaaccau

SEQ ID NO: 3265593 - RNA, 13 nt, Mycobacterium tuberculosis H37Rv
ucguggucgaucc

SEQ ID NO: 3265594 - RNA, 19 nt, Mycobacterium tuberculosis H37Rv
ucguggugcaacacgccgg

SEQ ID NO: 3265595 - RNA, 22 nt, Mycobacterium tuberculosis H37Rv
ucguguccggggaccucggcga

SEQ ID NO: 3265596 - RNA, 16 nt, Mycobacterium tuberculosis H37Rv
ucguguuggccggguc

SEQ ID NO: 3265597 - RNA, 13 nt, Mycobacterium tuberculosis H37Rv
ucguuaccaggcg

SEQ ID NO: 3265598 - RNA, 12 nt, Mycobacterium tuberculosis H37Rv
ucguucaauguc

SEQ ID NO: 3265599 - RNA, 14 nt, Mycobacterium tuberculosis H37Rv
ucguucagcgucga

SEQ ID NO: 3265600 - RNA, 18 nt, Mycobacterium tuberculosis H37Rv
ucguucgcgucacaccag

SEQ ID NO: 3265601 - RNA, 15 nt, Mycobacterium tuberculosis H37Rv
ucguucuccauccgc

SEQ ID NO: 3265602 - RNA, 16 nt, Mycobacterium tuberculosis H37Rv
ucguugaggccgguga

SEQ ID NO: 3265603 - RNA, 14 nt, Mycobacterium tuberculosis H37Rv
ucguugccagggcg

SEQ ID NO: 3265604 - RNA, 20 nt, Mycobacterium tuberculosis H37Rv
ucguugccggacaaccuggg

SEQ ID NO: 3265605 - RNA, 17 nt, Mycobacterium tuberculosis H37Rv
ucguugccguccaccga

SEQ ID NO: 3265606 - RNA, 12 nt, Mycobacterium tuberculosis H37Rv
ucguugcgcggu

SEQ ID NO: 3265607 - RNA, 15 nt, Mycobacterium tuberculosis H37Rv
ucguugcgcggucuc

SEQ ID NO: 3265608 - RNA, 19 nt, Mycobacterium tuberculosis H37Rv
ucguugcuggcggccagca

SEQ ID NO: 3265609 - RNA, 21 nt, Mycobacterium tuberculosis H37Rv
ucguuggcaaagacgcuggcc

SEQ ID NO: 3265610 - RNA, 15 nt, Mycobacterium tuberculosis H37Rv
ucguuggcucgugcc

SEQ ID NO: 3265611 - RNA, 19 nt, Mycobacterium tuberculosis H37Rv
ucguugggcaugucgccga

SEQ ID NO: 3265612 - RNA, 13 nt, Mycobacterium tuberculosis H37Rv
ucguugugccggu

SEQ ID NO: 3265613 - RNA, 23 nt, Mycobacterium tuberculosis H37Rv
ucguugugcggacaucaccggca

SEQ ID NO: 3265614 - RNA, 20 nt, Mycobacterium tuberculosis H37Rv
ucguuuucgccgaucccggc

SEQ ID NO: 3265615 - RNA, 18 nt, Mycobacterium tuberculosis H37Rv
ucuaccagccgccccggc

SEQ ID NO: 3265616 - RNA, 13 nt, Mycobacterium tuberculosis H37Rv
ucuaccuccgcca

SEQ ID NO: 3265617 - RNA, 15 nt, Mycobacterium tuberculosis H37Rv
ucuaccuuagcgccg

SEQ ID NO: 3265618 - RNA, 14 nt, Mycobacterium tuberculosis H37Rv
ucuacgccaccgag

SEQ ID NO: 3265619 - RNA, 21 nt, Mycobacterium tuberculosis H37Rv
ucuacgccgggaauuucgaca

SEQ ID NO: 3265620 - RNA, 19 nt, Mycobacterium tuberculosis H37Rv
ucuacgucguccagcacca

SEQ ID NO: 3265621 - RNA, 14 nt, Mycobacterium tuberculosis H37Rv
ucuagcaaagccag

SEQ ID NO: 3265622 - RNA, 16 nt, Mycobacterium tuberculosis H37Rv
ucuagcaaagccagcg

SEQ ID NO: 3265623 - RNA, 22 nt, Mycobacterium tuberculosis H37Rv
ucuagcgccucgccggccaccc

SEQ ID NO: 3265624 - RNA, 15 nt, Mycobacterium tuberculosis H37Rv
ucuagcggccuagga

SEQ ID NO: 3265625 - RNA, 16 nt, Mycobacterium tuberculosis H37Rv
ucuaggccucagaacc

SEQ ID NO: 3265626 - RNA, 24 nt, Mycobacterium tuberculosis H37Rv
ucuagguucaguuccaccgcgcag

SEQ ID NO: 3265627 - RNA, 19 nt, Mycobacterium tuberculosis H37Rv
ucuauccggcgcagguucu

SEQ ID NO: 3265628 - RNA, 21 nt, Mycobacterium tuberculosis H37Rv
ucucaagggcaucaaccaacu

SEQ ID NO: 3265629 - RNA, 13 nt, Mycobacterium tuberculosis H37Rv
ucucaccgggccc

SEQ ID NO: 3265630 - RNA, 14 nt, Mycobacterium tuberculosis H37Rv
ucuccaccgcgaug

SEQ ID NO: 3265631 - RNA, 17 nt, Mycobacterium tuberculosis H37Rv
ucuccaccgucgccgcc

SEQ ID NO: 3265632 - RNA, 12 nt, Mycobacterium tuberculosis H37Rv
ucuccaccuucu

SEQ ID NO: 3265633 - RNA, 13 nt, Mycobacterium tuberculosis H37Rv
ucuccaccuucug

SEQ ID NO: 3265634 - RNA, 19 nt, Mycobacterium tuberculosis H37Rv
ucuccagauccacgccgac

SEQ ID NO: 3265635 - RNA, 17 nt, Mycobacterium tuberculosis H37Rv
ucuccagcaccaaaagg

SEQ ID NO: 3265636 - RNA, 20 nt, Mycobacterium tuberculosis H37Rv
ucuccccguccugccagucc

SEQ ID NO: 3265637 - RNA, 15 nt, Mycobacterium tuberculosis H37Rv
ucucccgcacggccg

SEQ ID NO: 3265638 - RNA, 18 nt, Mycobacterium tuberculosis H37Rv
ucucccggcugaugccug

SEQ ID NO: 3265639 - RNA, 18 nt, Mycobacterium tuberculosis H37Rv
ucucccgguauucccgcu

SEQ ID NO: 3265640 - RNA, 23 nt, Mycobacterium tuberculosis H37Rv
ucucccguuuggcugucugcccg

SEQ ID NO: 3265641 - RNA, 11 nt, Mycobacterium tuberculosis H37Rv
ucucccuugcc

SEQ ID NO: 3265642 - RNA, 14 nt, Mycobacterium tuberculosis H37Rv
ucuccgacauuggc

SEQ ID NO: 3265643 - RNA, 23 nt, Mycobacterium tuberculosis H37Rv
ucuccgccaacaacuucucgucg

SEQ ID NO: 3265644 - RNA, 16 nt, Mycobacterium tuberculosis H37Rv
ucuccgccgucgccac

SEQ ID NO: 3265645 - RNA, 20 nt, Mycobacterium tuberculosis H37Rv
ucuccgccgucgccaccggu

SEQ ID NO: 3265646 - RNA, 14 nt, Mycobacterium tuberculosis H37Rv
ucuccggcgccacc

SEQ ID NO: 3265647 - RNA, 17 nt, Mycobacterium tuberculosis H37Rv
ucuccuccaccagugcc

SEQ ID NO: 3265648 - RNA, 10 nt, Mycobacterium tuberculosis H37Rv
ucuccuccug

SEQ ID NO: 3265649 - RNA, 20 nt, Mycobacterium tuberculosis H37Rv
ucuccucuugcaccagggcc

SEQ ID NO: 3265650 - RNA, 21 nt, Mycobacterium tuberculosis H37Rv
ucuccugcugugggauucggg

SEQ ID NO: 3265651 - RNA, 15 nt, Mycobacterium tuberculosis H37Rv
ucuccuggaaaggac

SEQ ID NO: 3265652 - RNA, 22 nt, Mycobacterium tuberculosis H37Rv
ucuccuggaaaggacggccggc

SEQ ID NO: 3265653 - RNA, 15 nt, Mycobacterium tuberculosis H37Rv
ucucgacaaagcggc

SEQ ID NO: 3265654 - RNA, 19 nt, Mycobacterium tuberculosis H37Rv
ucucgaccguauugaccag

SEQ ID NO: 3265655 - RNA, 22 nt, Mycobacterium tuberculosis H37Rv
ucucgaccguauugaccagcgg

SEQ ID NO: 3265656 - RNA, 23 nt, Mycobacterium tuberculosis H37Rv
ucucgaccguugcauacagcgga

SEQ ID NO: 3265657 - RNA, 18 nt, Mycobacterium tuberculosis H37Rv
ucucgacggccucgucga

SEQ ID NO: 3265658 - RNA, 14 nt, Mycobacterium tuberculosis H37Rv
ucucgaguccaggc

SEQ ID NO: 3265659 - RNA, 13 nt, Mycobacterium tuberculosis H37Rv
ucucgaucaccuc

SEQ ID NO: 3265660 - RNA, 21 nt, Mycobacterium tuberculosis H37Rv
ucucgaucuggucaagacccg

SEQ ID NO: 3265661 - RNA, 14 nt, Mycobacterium tuberculosis H37Rv
ucucgcaccgcguu

SEQ ID NO: 3265662 - RNA, 19 nt, Mycobacterium tuberculosis H37Rv
ucucgcccccagugcacgc

SEQ ID NO: 3265663 - RNA, 17 nt, Mycobacterium tuberculosis H37Rv
ucugggcuuucagcacc

SEQ ID NO: 3265664 - RNA, 22 nt, Mycobacterium tuberculosis H37Rv
ucugggcuuucgcgugcggcug

SEQ ID NO: 3265665 - RNA, 14 nt, Mycobacterium tuberculosis H37Rv
ucugggcuuugcag

SEQ ID NO: 3265666 - RNA, 16 nt, Mycobacterium tuberculosis H37Rv
ucugggguccggugac

SEQ ID NO: 3265667 - RNA, 20 nt, Mycobacterium tuberculosis H37Rv
ucugguaggcggccauguca

SEQ ID NO: 3265668 - RNA, 16 nt, Mycobacterium tuberculosis H37Rv
ucuggucggcggccuc

SEQ ID NO: 3265669 - RNA, 14 nt, Mycobacterium tuberculosis H37Rv
ucuggucgggucgc

SEQ ID NO: 3265670 - RNA, 20 nt, Mycobacterium tuberculosis H37Rv
ucugguguuucaggcagcgg

SEQ ID NO: 3265671 - RNA, 19 nt, Mycobacterium tuberculosis H37Rv
ucugguugggccagcuccu

SEQ ID NO: 3265672 - RNA, 15 nt, Mycobacterium tuberculosis H37Rv
ucuguaaccuccucg

SEQ ID NO: 3265673 - RNA, 18 nt, Mycobacterium tuberculosis H37Rv
ucugugcgcggacaccuu

SEQ ID NO: 3265674 - RNA, 17 nt, Mycobacterium tuberculosis H37Rv
ucugugucccgucgaug

SEQ ID NO: 3265675 - RNA, 18 nt, Mycobacterium tuberculosis H37Rv
ucuguugacucugcgucc

SEQ ID NO: 3265676 - RNA, 17 nt, Mycobacterium tuberculosis H37Rv
ucuuacucgucacgggg

SEQ ID NO: 3265677 - RNA, 13 nt, Mycobacterium tuberculosis H37Rv
ucuuagccagcag

SEQ ID NO: 3265678 - RNA, 15 nt, Mycobacterium tuberculosis H37Rv
ucuuagccagcagca

SEQ ID NO: 3265679 - RNA, 23 nt, Mycobacterium tuberculosis H37Rv
ucuucaacgucgagauccucguc

SEQ ID NO: 3265680 - RNA, 18 nt, Mycobacterium tuberculosis H37Rv
ucuucaccggccggugcc

SEQ ID NO: 3265681 - RNA, 15 nt, Mycobacterium tuberculosis H37Rv
ucuuccagccaggcc

SEQ ID NO: 3265682 - RNA, 18 nt, Mycobacterium tuberculosis H37Rv
ucuucccauuucggcaaa

SEQ ID NO: 3265683 - RNA, 15 nt, Mycobacterium tuberculosis H37Rv
ucuuccccucggccg

SEQ ID NO: 3265684 - RNA, 15 nt, Mycobacterium tuberculosis H37Rv
ucuuccggugcgccg

SEQ ID NO: 3265685 - RNA, 14 nt, Mycobacterium tuberculosis H37Rv
ucuuccucggccac

SEQ ID NO: 3265686 - RNA, 16 nt, Mycobacterium tuberculosis H37Rv
ucuuccucggccaccc

SEQ ID NO: 3265687 - RNA, 19 nt, Mycobacterium tuberculosis H37Rv
ucuucgcagcgguggucgg

SEQ ID NO: 3265688 - RNA, 18 nt, Mycobacterium tuberculosis H37Rv
ucuucgcuaccuucuugg

SEQ ID NO: 3265689 - RNA, 15 nt, Mycobacterium tuberculosis H37Rv
ucuucggccagcucc

SEQ ID NO: 3265690 - RNA, 21 nt, Mycobacterium tuberculosis H37Rv
ucuucgggcucguccagcaac

SEQ ID NO: 3265691 - RNA, 15 nt, Mycobacterium tuberculosis H37Rv
ucuugaccagcagcu

SEQ ID NO: 3265692 - RNA, 14 nt, Mycobacterium tuberculosis H37Rv
ucuugccaccgcug

SEQ ID NO: 3265693 - RNA, 19 nt, Mycobacterium tuberculosis H37Rv
ucuugccgucggccggcaa

SEQ ID NO: 3265694 - RNA, 19 nt, Mycobacterium tuberculosis H37Rv
ucuugcugucgaaguggua

SEQ ID NO: 3265695 - RNA, 16 nt, Mycobacterium tuberculosis H37Rv
ucuuggacagcagcag

SEQ ID NO: 3265696 - RNA, 18 nt, Mycobacterium tuberculosis H37Rv
ucuuggcgcgguccucca

SEQ ID NO: 3265697 - RNA, 15 nt, Mycobacterium tuberculosis H37Rv
ucuuggcgggagccu

SEQ ID NO: 3265698 - RNA, 23 nt, Mycobacterium tuberculosis H37Rv
ucuuggcgggagccuugguagcc

SEQ ID NO: 3265699 - RNA, 16 nt, Mycobacterium tuberculosis H37Rv
ucuuggcgggcgccuu

SEQ ID NO: 3265700 - RNA, 15 nt, Mycobacterium tuberculosis H37Rv
ucuuggcgggugacu

SEQ ID NO: 3265701 - RNA, 21 nt, Mycobacterium tuberculosis H37Rv
ucuuggcguugaugucggcca

SEQ ID NO: 3265702 - RNA, 23 nt, Mycobacterium tuberculosis H37Rv
ucuugggccgggaugaagccacc

SEQ ID NO: 3265703 - RNA, 15 nt, Mycobacterium tuberculosis H37Rv
ucuuggguuucgucg

SEQ ID NO: 3265704 - RNA, 13 nt, Mycobacterium tuberculosis H37Rv
ucuuggucaccgg

SEQ ID NO: 3265705 - RNA, 19 nt, Mycobacterium tuberculosis H37Rv
ucuuguugugcugcaccgu

SEQ ID NO: 3265706 - RNA, 22 nt, Mycobacterium tuberculosis H37Rv
ucuuucccgccaccaaacccca

SEQ ID NO: 3265707 - RNA, 22 nt, Mycobacterium tuberculosis H37Rv
ucuuugcucucggucugcaugc

SEQ ID NO: 3265708 - RNA, 14 nt, Mycobacterium tuberculosis H37Rv
ugaaaaagcaucaa

SEQ ID NO: 3265709 - RNA, 21 nt, Mycobacterium tuberculosis H37Rv
ugaaaauaggccgggcagugc

SEQ ID NO: 3265710 - RNA, 23 nt, Mycobacterium tuberculosis H37Rv
ugaaacgauugcugcggcuuuca

SEQ ID NO: 3265711 - RNA, 20 nt, Mycobacterium tuberculosis H37Rv
ugaaacggugucucgcccac

SEQ ID NO: 3265712 - RNA, 22 nt, Mycobacterium tuberculosis H37Rv
ugaaacguaugacgcccaccga

SEQ ID NO: 3265713 - RNA, 21 nt, Mycobacterium tuberculosis H37Rv
ugaaauccuaggguggcgauc

SEQ ID NO: 3265714 - RNA, 16 nt, Mycobacterium tuberculosis H37Rv
ugaaaucgaugaccgc

SEQ ID NO: 3265715 - RNA, 18 nt, Mycobacterium tuberculosis H37Rv
ugaaaucuguugauacac

SEQ ID NO: 3265716 - RNA, 13 nt, Mycobacterium tuberculosis H37Rv
ugaacaacagcgc

SEQ ID NO: 3265717 - RNA, 23 nt, Mycobacterium tuberculosis H37Rv
ugaacaagauucgcucaccaccg

SEQ ID NO: 3265718 - RNA, 14 nt, Mycobacterium tuberculosis H37Rv
ugaacaguugcaca

SEQ ID NO: 3265719 - RNA, 17 nt, Mycobacterium tuberculosis H37Rv
ugaacaguugcacaccg

SEQ ID NO: 3265720 - RNA, 15 nt, Mycobacterium tuberculosis H37Rv
ugaaccagaugggug

SEQ ID NO: 3265721 - RNA, 19 nt, Mycobacterium tuberculosis H37Rv
ugaaccagucgacccagcg

SEQ ID NO: 3265722 - RNA, 22 nt, Mycobacterium tuberculosis H37Rv
ugaaccaguucgugggucaacg

SEQ ID NO: 3265723 - RNA, 14 nt, Mycobacterium tuberculosis H37Rv
ugaaccggccgcga

SEQ ID NO: 3265724 - RNA, 22 nt, Mycobacterium tuberculosis H37Rv
ugaaccggccgcgacgacacgc

SEQ ID NO: 3265725 - RNA, 15 nt, Mycobacterium tuberculosis H37Rv
ugaaccgggacacca

SEQ ID NO: 3265726 - RNA, 14 nt, Mycobacterium tuberculosis H37Rv
ugaaccuggcgacg

SEQ ID NO: 3265727 - RNA, 17 nt, Mycobacterium tuberculosis H37Rv
ugaacgacauccggccg

SEQ ID NO: 3265728 - RNA, 17 nt, Mycobacterium tuberculosis H37Rv
ugaacgaccaccgcuga

SEQ ID NO: 3265729 - RNA, 22 nt, Mycobacterium tuberculosis H37Rv
ugaacgacgggucguucuccgc

SEQ ID NO: 3265730 - RNA, 16 nt, Mycobacterium tuberculosis H37Rv
ugaacgagaugccgcg

SEQ ID NO: 3265731 - RNA, 18 nt, Mycobacterium tuberculosis H37Rv
ugaacgaucggaccacca

SEQ ID NO: 3265732 - RNA, 23 nt, Mycobacterium tuberculosis H37Rv
ugaacgcaccaacguugugccgc

SEQ ID NO: 3265733 - RNA, 15 nt, Mycobacterium tuberculosis H37Rv
ugaacgccagcagcg

SEQ ID NO: 3265734 - RNA, 16 nt, Mycobacterium tuberculosis H37Rv
ugaacgcccgcuucag

SEQ ID NO: 3265735 - RNA, 22 nt, Mycobacterium tuberculosis H37Rv
ugaacgcgaauaccagaccggc

SEQ ID NO: 3265736 - RNA, 21 nt, Mycobacterium tuberculosis H37Rv
ugaacgcggacaccgcggcga

SEQ ID NO: 3265737 - RNA, 18 nt, Mycobacterium tuberculosis H37Rv
ugaacgcuguaagcaugc

SEQ ID NO: 3265738 - RNA, 17 nt, Mycobacterium tuberculosis H37Rv
ugaacgcugucccagcc

SEQ ID NO: 3265739 - RNA, 18 nt, Mycobacterium tuberculosis H37Rv
ugaacgcuuuccggcggu

SEQ ID NO: 3265740 - RNA, 14 nt, Mycobacterium tuberculosis H37Rv
ugaacggcaccagc

SEQ ID NO: 3265741 - RNA, 15 nt, Mycobacterium tuberculosis H37Rv
ugaacggcaccagcg

SEQ ID NO: 3265742 - RNA, 21 nt, Mycobacterium tuberculosis H37Rv
ugaacggcgcgggccaccacg

SEQ ID NO: 3265743 - RNA, 14 nt, Mycobacterium tuberculosis H37Rv
ugaacuccaugaag

SEQ ID NO: 3265744 - RNA, 20 nt, Mycobacterium tuberculosis H37Rv
ugaagaacaugcucacgauc

SEQ ID NO: 3265745 - RNA, 11 nt, Mycobacterium tuberculosis H37Rv
ugaagaagccg

SEQ ID NO: 3265746 - RNA, 16 nt, Mycobacterium tuberculosis H37Rv
ugaagacaccggcguc

SEQ ID NO: 3265747 - RNA, 18 nt, Mycobacterium tuberculosis H37Rv
ugaagaccaccgcccaca

SEQ ID NO: 3265748 - RNA, 22 nt, Mycobacterium tuberculosis H37Rv
ugaagaccaccgcccacagcaa

SEQ ID NO: 3265749 - RNA, 13 nt, Mycobacterium tuberculosis H37Rv
ugaagagaagucu

SEQ ID NO: 3265750 - RNA, 14 nt, Mycobacterium tuberculosis H37Rv
ugaagagaagucuc

SEQ ID NO: 3265751 - RNA, 14 nt, Mycobacterium tuberculosis H37Rv
ugaagcagacguca

SEQ ID NO: 3265752 - RNA, 22 nt, Mycobacterium tuberculosis H37Rv
ugaagcaguugccgcggucgua

SEQ ID NO: 3265753 - RNA, 19 nt, Mycobacterium tuberculosis H37Rv
ugaagccagcgcagcaccg

SEQ ID NO: 3265754 - RNA, 15 nt, Mycobacterium tuberculosis H37Rv
ugaagccgggcgcuu

SEQ ID NO: 3265755 - RNA, 21 nt, Mycobacterium tuberculosis H37Rv
ugaagccgggcgcuugcacca

SEQ ID NO: 3265756 - RNA, 17 nt, Mycobacterium tuberculosis H37Rv
ugaaggcaaacaccagc

SEQ ID NO: 3265757 - RNA, 18 nt, Mycobacterium tuberculosis H37Rv
ugaaggcaaacaccagcc

SEQ ID NO: 3265758 - RNA, 22 nt, Mycobacterium tuberculosis H37Rv
ugaaggcaaacaccagcccggc

SEQ ID NO: 3265759 - RNA, 15 nt, Mycobacterium tuberculosis H37Rv
ugaccgcugcccagu

SEQ ID NO: 3265760 - RNA, 24 nt, Mycobacterium tuberculosis H37Rv
ugaccggcgauuccaccuuggcca

SEQ ID NO: 3265761 - RNA, 13 nt, Mycobacterium tuberculosis H37Rv
ugaccggcucgcc

SEQ ID NO: 3265762 - RNA, 17 nt, Mycobacterium tuberculosis H37Rv
ugaccgggcagguagcu

SEQ ID NO: 3265763 - RNA, 21 nt, Mycobacterium tuberculosis H37Rv
ugaccgggucgaugacgccgu

SEQ ID NO: 3265764 - RNA, 17 nt, Mycobacterium tuberculosis H37Rv
ugaccgggucgccgaug

SEQ ID NO: 3265765 - RNA, 22 nt, Mycobacterium tuberculosis H37Rv
ugaccgguauuaccgccguggc

SEQ ID NO: 3265766 - RNA, 14 nt, Mycobacterium tuberculosis H37Rv
ugaccguccaccga

SEQ ID NO: 3265767 - RNA, 12 nt, Mycobacterium tuberculosis H37Rv
ugaccgugccgu

SEQ ID NO: 3265768 - RNA, 15 nt, Mycobacterium tuberculosis H37Rv
ugaccucgcgcaccg

SEQ ID NO: 3265769 - RNA, 14 nt, Mycobacterium tuberculosis H37Rv
ugaccucggcgacg

SEQ ID NO: 3265770 - RNA, 17 nt, Mycobacterium tuberculosis H37Rv
ugaccucgucggcgacg

SEQ ID NO: 3265771 - RNA, 19 nt, Mycobacterium tuberculosis H37Rv
ugaccucgugguucugcag

SEQ ID NO: 3265772 - RNA, 21 nt, Mycobacterium tuberculosis H37Rv
ugaccucuucgggcagcgcgu

SEQ ID NO: 3265773 - RNA, 14 nt, Mycobacterium tuberculosis H37Rv
ugaccugcagaaac

SEQ ID NO: 3265774 - RNA, 17 nt, Mycobacterium tuberculosis H37Rv
ugaccugcuggcgcacg

SEQ ID NO: 3265775 - RNA, 13 nt, Mycobacterium tuberculosis H37Rv
ugaccuguuuggg

SEQ ID NO: 3265776 - RNA, 15 nt, Mycobacterium tuberculosis H37Rv
ugaccuucaccugga

SEQ ID NO: 3265777 - RNA, 23 nt, Mycobacterium tuberculosis H37Rv
ugaccuucaggcccugccgacgc

SEQ ID NO: 3265778 - RNA, 16 nt, Mycobacterium tuberculosis H37Rv
ugaccuucccgucgac

SEQ ID NO: 3265779 - RNA, 18 nt, Mycobacterium tuberculosis H37Rv
ugaccuucccgucgacga

SEQ ID NO: 3265780 - RNA, 15 nt, Mycobacterium tuberculosis H37Rv
ugaccuugcccacca

SEQ ID NO: 3265781 - RNA, 22 nt, Mycobacterium tuberculosis H37Rv
ugaccuugcccugcgugcagau

SEQ ID NO: 3265782 - RNA, 18 nt, Mycobacterium tuberculosis H37Rv
ugaccuuggccgugcccg

SEQ ID NO: 3265783 - RNA, 15 nt, Mycobacterium tuberculosis H37Rv
ugacgaaagcgccca

SEQ ID NO: 3265784 - RNA, 15 nt, Mycobacterium tuberculosis H37Rv
ugacgaacccaccgu

SEQ ID NO: 3265785 - RNA, 17 nt, Mycobacterium tuberculosis H37Rv
ugacgaacuucgaugcc

SEQ ID NO: 3265786 - RNA, 17 nt, Mycobacterium tuberculosis H37Rv
ugacgaagagcaccgcg

SEQ ID NO: 3265787 - RNA, 20 nt, Mycobacterium tuberculosis H37Rv
ugacgaaggguauccgugug

SEQ ID NO: 3265788 - RNA, 17 nt, Mycobacterium tuberculosis H37Rv
ugacgaaguccaccacg

SEQ ID NO: 3265789 - RNA, 23 nt, Mycobacterium tuberculosis H37Rv
ugacgaauccacuggucaacggg

SEQ ID NO: 3265790 - RNA, 14 nt, Mycobacterium tuberculosis H37Rv
ugacgaaucgccua

SEQ ID NO: 3265791 - RNA, 22 nt, Mycobacterium tuberculosis H37Rv
ugacgacaaacggcgacccagc

SEQ ID NO: 3265792 - RNA, 15 nt, Mycobacterium tuberculosis H37Rv
ugacgaccagccccg

SEQ ID NO: 3265793 - RNA, 17 nt, Mycobacterium tuberculosis H37Rv
ugacgacgagggccagc

SEQ ID NO: 3265794 - RNA, 22 nt, Mycobacterium tuberculosis H37Rv
ugacgacgagggccagcagccg

SEQ ID NO: 3265795 - RNA, 17 nt, Mycobacterium tuberculosis H37Rv
ugacgacgagggcggga

SEQ ID NO: 3265796 - RNA, 20 nt, Mycobacterium tuberculosis H37Rv
ugacgacgagggcgggaccc

SEQ ID NO: 3265797 - RNA, 15 nt, Mycobacterium tuberculosis H37Rv
ugacgacggugaccg

SEQ ID NO: 3265798 - RNA, 17 nt, Mycobacterium tuberculosis H37Rv
ugacgacgucgccgccg

SEQ ID NO: 3265799 - RNA, 14 nt, Mycobacterium tuberculosis H37Rv
ugacgagacgacga

SEQ ID NO: 3265800 - RNA, 23 nt, Mycobacterium tuberculosis H37Rv
ugacgagcagcuagcccggcagc

SEQ ID NO: 3265801 - RNA, 14 nt, Mycobacterium tuberculosis H37Rv
ugacgagccgacca

SEQ ID NO: 3265802 - RNA, 19 nt, Mycobacterium tuberculosis H37Rv
ugacgaguucgcgcaucaa

SEQ ID NO: 3265803 - RNA, 21 nt, Mycobacterium tuberculosis H37Rv
ugacgaguucgcgcaucaacg

SEQ ID NO: 3265804 - RNA, 18 nt, Mycobacterium tuberculosis H37Rv
ugacgaucgacagccccg

SEQ ID NO: 3265805 - RNA, 17 nt, Mycobacterium tuberculosis H37Rv
ugacgaucggcggcgcg

SEQ ID NO: 3265806 - RNA, 15 nt, Mycobacterium tuberculosis H37Rv
ugacgaugccgccga

SEQ ID NO: 3265807 - RNA, 13 nt, Mycobacterium tuberculosis H37Rv
ugacgcaacaucg

SEQ ID NO: 3265808 - RNA, 14 nt, Mycobacterium tuberculosis H37Rv
ugacgcaacaucgg

SEQ ID NO: 3265809 - RNA, 16 nt, Mycobacterium tuberculosis H37Rv
ugacgcagucgcccac

SEQ ID NO: 3265810 - RNA, 16 nt, Mycobacterium tuberculosis H37Rv
ugacgcccaucucaug

SEQ ID NO: 3265811 - RNA, 18 nt, Mycobacterium tuberculosis H37Rv
ugacgccgaugaagccaa

SEQ ID NO: 3265812 - RNA, 16 nt, Mycobacterium tuberculosis H37Rv
ugacgccgguccccgc

SEQ ID NO: 3265813 - RNA, 14 nt, Mycobacterium tuberculosis H37Rv
ugacgccgucagcg

SEQ ID NO: 3265814 - RNA, 16 nt, Mycobacterium tuberculosis H37Rv
ugacgccgucggcgcg

SEQ ID NO: 3265815 - RNA, 20 nt, Mycobacterium tuberculosis H37Rv
ugacgccucgacacccagcc

SEQ ID NO: 3265816 - RNA, 24 nt, Mycobacterium tuberculosis H37Rv
ugacgcgcaacgccgccagccugg

SEQ ID NO: 3265817 - RNA, 21 nt, Mycobacterium tuberculosis H37Rv
ugacgcgcgccggauacaccg

SEQ ID NO: 3265818 - RNA, 12 nt, Mycobacterium tuberculosis H37Rv
ugacgcgcucgc

SEQ ID NO: 3265819 - RNA, 17 nt, Mycobacterium tuberculosis H37Rv
ugacgcgucagcggcga

SEQ ID NO: 3265820 - RNA, 18 nt, Mycobacterium tuberculosis H37Rv
ugacgcuacgacaguguu

SEQ ID NO: 3265821 - RNA, 22 nt, Mycobacterium tuberculosis H37Rv
ugacgcucggucgccaccgccg

SEQ ID NO: 3265822 - RNA, 18 nt, Mycobacterium tuberculosis H37Rv
ugacggcagaccaugguc

SEQ ID NO: 3265823 - RNA, 20 nt, Mycobacterium tuberculosis H37Rv
ugacggcgaacccgccgaug

SEQ ID NO: 3265824 - RNA, 23 nt, Mycobacterium tuberculosis H37Rv
ugacggcgucgaccucgcgggcg

SEQ ID NO: 3265825 - RNA, 13 nt, Mycobacterium tuberculosis H37Rv
ugacgggccgcug

SEQ ID NO: 3265826 - RNA, 17 nt, Mycobacterium tuberculosis H37Rv
ugacggggcugaccgcc

SEQ ID NO: 3265827 - RNA, 20 nt, Mycobacterium tuberculosis H37Rv
ugacggggcugaccgccacc

SEQ ID NO: 3265828 - RNA, 19 nt, Mycobacterium tuberculosis H37Rv
ugacgggguugaccgccac

SEQ ID NO: 3265829 - RNA, 13 nt, Mycobacterium tuberculosis H37Rv
ugacgguacagcu

SEQ ID NO: 3265830 - RNA, 19 nt, Mycobacterium tuberculosis H37Rv
ugacgguccacgacgucga

SEQ ID NO: 3265831 - RNA, 21 nt, Mycobacterium tuberculosis H37Rv
ugacgguccguucgaugccag

SEQ ID NO: 3265832 - RNA, 19 nt, Mycobacterium tuberculosis H37Rv
ugacggugaauucacgaug

SEQ ID NO: 3265833 - RNA, 17 nt, Mycobacterium tuberculosis H37Rv
ugacggugccgaccgcg

SEQ ID NO: 3265834 - RNA, 22 nt, Mycobacterium tuberculosis H37Rv
ugacggugcgauaccgacaccc

SEQ ID NO: 3265835 - RNA, 21 nt, Mycobacterium tuberculosis H37Rv
ugacgguggggucgccgucga

SEQ ID NO: 3265836 - RNA, 21 nt, Mycobacterium tuberculosis H37Rv
ugacgguuccggucggguugg

SEQ ID NO: 3265837 - RNA, 22 nt, Mycobacterium tuberculosis H37Rv
ugacguagggcagcgccaggcc

SEQ ID NO: 3265838 - RNA, 20 nt, Mycobacterium tuberculosis H37Rv
ugacguagucgucuucguca

SEQ ID NO: 3265839 - RNA, 18 nt, Mycobacterium tuberculosis H37Rv
ugacgucaccacgaucgc

SEQ ID NO: 3265840 - RNA, 12 nt, Mycobacterium tuberculosis H37Rv
ugacguccaaca

SEQ ID NO: 3265841 - RNA, 15 nt, Mycobacterium tuberculosis H37Rv
ugacgucgccgggcg

SEQ ID NO: 3265842 - RNA, 16 nt, Mycobacterium tuberculosis H37Rv
ugacgucgccgggcgg

SEQ ID NO: 3265843 - RNA, 17 nt, Mycobacterium tuberculosis H37Rv
ugacgugcucucgcucg

SEQ ID NO: 3265844 - RNA, 12 nt, Mycobacterium tuberculosis H37Rv
ugacgugguggg

SEQ ID NO: 3265845 - RNA, 15 nt, Mycobacterium tuberculosis H37Rv
ugacguuagcauuga

SEQ ID NO: 3265846 - RNA, 18 nt, Mycobacterium tuberculosis H37Rv
ugacguugcagccggcau

SEQ ID NO: 3265847 - RNA, 15 nt, Mycobacterium tuberculosis H37Rv
ugacguugucgccaa

SEQ ID NO: 3265848 - RNA, 15 nt, Mycobacterium tuberculosis H37Rv
ugacguugugccuua

SEQ ID NO: 3265849 - RNA, 22 nt, Mycobacterium tuberculosis H37Rv
ugacguuguuggauccggccac

SEQ ID NO: 3265850 - RNA, 22 nt, Mycobacterium tuberculosis H37Rv
ugacguuuggauggcuggccag

SEQ ID NO: 3265851 - RNA, 14 nt, Mycobacterium tuberculosis H37Rv
ugacuccgcgcgcg

SEQ ID NO: 3265852 - RNA, 16 nt, Mycobacterium tuberculosis H37Rv
ugacucgaucaccaug

SEQ ID NO: 3265853 - RNA, 20 nt, Mycobacterium tuberculosis H37Rv
ugacucgggcacgggugacg

SEQ ID NO: 3265854 - RNA, 17 nt, Mycobacterium tuberculosis H37Rv
ugacucugcguccacca

SEQ ID NO: 3265855 - RNA, 23 nt, Mycobacterium tuberculosis H37Rv
ugagguacuucauauaccgcucg

SEQ ID NO: 3265856 - RNA, 16 nt, Mycobacterium tuberculosis H37Rv
ugagguaggggcaggc

SEQ ID NO: 3265857 - RNA, 18 nt, Mycobacterium tuberculosis H37Rv
ugagguaggugagcgcgc

SEQ ID NO: 3265858 - RNA, 20 nt, Mycobacterium tuberculosis H37Rv
ugaggucacccaucaacgcc

SEQ ID NO: 3265859 - RNA, 23 nt, Mycobacterium tuberculosis H37Rv
ugaggucauuggcgaucaaugcg

SEQ ID NO: 3265860 - RNA, 13 nt, Mycobacterium tuberculosis H37Rv
ugaggucccggcu

SEQ ID NO: 3265861 - RNA, 15 nt, Mycobacterium tuberculosis H37Rv
ugagguggccgcgca

SEQ ID NO: 3265862 - RNA, 17 nt, Mycobacterium tuberculosis H37Rv
ugagguucaucgccggc

SEQ ID NO: 3265863 - RNA, 17 nt, Mycobacterium tuberculosis H37Rv
ugagguuggagcgccag

SEQ ID NO: 3265864 - RNA, 18 nt, Mycobacterium tuberculosis H37Rv
ugaguaccaauccaggcc

SEQ ID NO: 3265865 - RNA, 16 nt, Mycobacterium tuberculosis H37Rv
ugaguaccauccgggc

SEQ ID NO: 3265866 - RNA, 14 nt, Mycobacterium tuberculosis H37Rv
ugaguccagccggc

SEQ ID NO: 3265867 - RNA, 18 nt, Mycobacterium tuberculosis H37Rv
ugagucgaaaacagcgau

SEQ ID NO: 3265868 - RNA, 22 nt, Mycobacterium tuberculosis H37Rv
ugagucguaguaggcgccgcga

SEQ ID NO: 3265869 - RNA, 22 nt, Mycobacterium tuberculosis H37Rv
ugagucuuucccgccaccaaac

SEQ ID NO: 3265870 - RNA, 17 nt, Mycobacterium tuberculosis H37Rv
ugagugaccacgcugcu

SEQ ID NO: 3265871 - RNA, 21 nt, Mycobacterium tuberculosis H37Rv
ugagugacgguccguucgaug

SEQ ID NO: 3265872 - RNA, 21 nt, Mycobacterium tuberculosis H37Rv
ugagugccggcgugcgcgaga

SEQ ID NO: 3265873 - RNA, 14 nt, Mycobacterium tuberculosis H37Rv
ugagugcggcguau

SEQ ID NO: 3265874 - RNA, 16 nt, Mycobacterium tuberculosis H37Rv
ugagugcgucucggug

SEQ ID NO: 3265875 - RNA, 23 nt, Mycobacterium tuberculosis H37Rv
ugaguggcucgcucugcgcggcu

SEQ ID NO: 3265876 - RNA, 19 nt, Mycobacterium tuberculosis H37Rv
ugaguguggagacguuuug

SEQ ID NO: 3265877 - RNA, 15 nt, Mycobacterium tuberculosis H37Rv
ugaguucggccacca

SEQ ID NO: 3265878 - RNA, 11 nt, Mycobacterium tuberculosis H37Rv
ugaguucggug

SEQ ID NO: 3265879 - RNA, 14 nt, Mycobacterium tuberculosis H37Rv
ugaguuucggcgca

SEQ ID NO: 3265880 - RNA, 17 nt, Mycobacterium tuberculosis H37Rv
ugauacagcgccagggg

SEQ ID NO: 3265881 - RNA, 13 nt, Mycobacterium tuberculosis H37Rv
ugauagccggaca

SEQ ID NO: 3265882 - RNA, 21 nt, Mycobacterium tuberculosis H37Rv
ugauagcggucggucaccaug

SEQ ID NO: 3265883 - RNA, 12 nt, Mycobacterium tuberculosis H37Rv
ugauauccgcgg

SEQ ID NO: 3265884 - RNA, 19 nt, Mycobacterium tuberculosis H37Rv
ugaucaccgaugagccgac

SEQ ID NO: 3265885 - RNA, 23 nt, Mycobacterium tuberculosis H37Rv
ugaucaccgcguaguccaggccg

SEQ ID NO: 3265886 - RNA, 19 nt, Mycobacterium tuberculosis H37Rv
ugaucaccgugguggcgua

SEQ ID NO: 3265887 - RNA, 16 nt, Mycobacterium tuberculosis H37Rv
ugaucacucacccggg

SEQ ID NO: 3265888 - RNA, 17 nt, Mycobacterium tuberculosis H37Rv
ugaucacucacccgggc

SEQ ID NO: 3265889 - RNA, 12 nt, Mycobacterium tuberculosis H37Rv
ugaucagcgcau

SEQ ID NO: 3265890 - RNA, 21 nt, Mycobacterium tuberculosis H37Rv
ugaucagcucgcgcacgucga

SEQ ID NO: 3265891 - RNA, 16 nt, Mycobacterium tuberculosis H37Rv
ugaucagcucggucuu

SEQ ID NO: 3265892 - RNA, 19 nt, Mycobacterium tuberculosis H37Rv
ugaucaggaaccaguccuc

SEQ ID NO: 3265893 - RNA, 18 nt, Mycobacterium tuberculosis H37Rv
ugaucagggucagcgccg

SEQ ID NO: 3265894 - RNA, 19 nt, Mycobacterium tuberculosis H37Rv
ugaucagggucagcgccgc

SEQ ID NO: 3265895 - RNA, 13 nt, Mycobacterium tuberculosis H37Rv
ugaucccauccag

SEQ ID NO: 3265896 - RNA, 19 nt, Mycobacterium tuberculosis H37Rv
ugauccccagcuccggguc

SEQ ID NO: 3265897 - RNA, 18 nt, Mycobacterium tuberculosis H37Rv
ugaucccgccaccgaaca

SEQ ID NO: 3265898 - RNA, 19 nt, Mycobacterium tuberculosis H37Rv
ugaucccggccaggccgac

SEQ ID NO: 3265899 - RNA, 21 nt, Mycobacterium tuberculosis H37Rv
ugauccgccgacagcccacga

SEQ ID NO: 3265900 - RNA, 13 nt, Mycobacterium tuberculosis H37Rv
ugauccgcugggc

SEQ ID NO: 3265901 - RNA, 18 nt, Mycobacterium tuberculosis H37Rv
ugaucgaauacaccugcu

SEQ ID NO: 3265902 - RNA, 18 nt, Mycobacterium tuberculosis H37Rv
ugaucgacaccgagccac

SEQ ID NO: 3265903 - RNA, 16 nt, Mycobacterium tuberculosis H37Rv
ugaucgaccgccuccu

SEQ ID NO: 3265904 - RNA, 14 nt, Mycobacterium tuberculosis H37Rv
ugaucgaccggaca

SEQ ID NO: 3265905 - RNA, 14 nt, Mycobacterium tuberculosis H37Rv
ugaucgagcaguuc

SEQ ID NO: 3265906 - RNA, 19 nt, Mycobacterium tuberculosis H37Rv
ugaucgcauuggcggcggu

SEQ ID NO: 3265907 - RNA, 18 nt, Mycobacterium tuberculosis H37Rv
ugaucgccaccgguaccg

SEQ ID NO: 3265908 - RNA, 21 nt, Mycobacterium tuberculosis H37Rv
ugaucgcccgguucagcgcug

SEQ ID NO: 3265909 - RNA, 17 nt, Mycobacterium tuberculosis H37Rv
ugaucgccgaggccucg

SEQ ID NO: 3265910 - RNA, 23 nt, Mycobacterium tuberculosis H37Rv
ugaucgccggcuucgcccagagc

SEQ ID NO: 3265911 - RNA, 13 nt, Mycobacterium tuberculosis H37Rv
ugaucgcgccggg

SEQ ID NO: 3265912 - RNA, 19 nt, Mycobacterium tuberculosis H37Rv
ugaucgcgccgggcucggc

SEQ ID NO: 3265913 - RNA, 16 nt, Mycobacterium tuberculosis H37Rv
ugaucgcgguccaaca

SEQ ID NO: 3265914 - RNA, 21 nt, Mycobacterium tuberculosis H37Rv
ugaucggcgaacccaccgcau

SEQ ID NO: 3265915 - RNA, 21 nt, Mycobacterium tuberculosis H37Rv
ugaucggguacccaucugcuc

SEQ ID NO: 3265916 - RNA, 15 nt, Mycobacterium tuberculosis H37Rv
ugaucgucucggcua

SEQ ID NO: 3265917 - RNA, 20 nt, Mycobacterium tuberculosis H37Rv
ugaucugccgccgcggccac

SEQ ID NO: 3265918 - RNA, 21 nt, Mycobacterium tuberculosis H37Rv
ugaucugggcugcggccgcga

SEQ ID NO: 3265919 - RNA, 16 nt, Mycobacterium tuberculosis H37Rv
ugaucugugccgcuag

SEQ ID NO: 3265920 - RNA, 18 nt, Mycobacterium tuberculosis H37Rv
ugaucuugccgcccuuga

SEQ ID NO: 3265921 - RNA, 16 nt, Mycobacterium tuberculosis H37Rv
ugaucuuggcccgggc

SEQ ID NO: 3265922 - RNA, 21 nt, Mycobacterium tuberculosis H37Rv
ugaugaccaggucggucaggu

SEQ ID NO: 3265923 - RNA, 22 nt, Mycobacterium tuberculosis H37Rv
ugaugaccgccaucgccaacac

SEQ ID NO: 3265924 - RNA, 13 nt, Mycobacterium tuberculosis H37Rv
ugaugaccgccgc

SEQ ID NO: 3265925 - RNA, 16 nt, Mycobacterium tuberculosis H37Rv
ugaugacguugcagcc

SEQ ID NO: 3265926 - RNA, 21 nt, Mycobacterium tuberculosis H37Rv
ugaugacguugcagccggcau

SEQ ID NO: 3265927 - RNA, 22 nt, Mycobacterium tuberculosis H37Rv
ugaugagggacgaacacgucua

SEQ ID NO: 3265928 - RNA, 22 nt, Mycobacterium tuberculosis H37Rv
ugaugaucgguucgggacgcga

SEQ ID NO: 3265929 - RNA, 14 nt, Mycobacterium tuberculosis H37Rv
ugaugaugaccaca

SEQ ID NO: 3265930 - RNA, 16 nt, Mycobacterium tuberculosis H37Rv
ugaugcaacgccaaaa

SEQ ID NO: 3265931 - RNA, 19 nt, Mycobacterium tuberculosis H37Rv
ugaugcaacgccaaaaugg

SEQ ID NO: 3265932 - RNA, 23 nt, Mycobacterium tuberculosis H37Rv
ugaugcaacgccaaaauggugcc

SEQ ID NO: 3265933 - RNA, 17 nt, Mycobacterium tuberculosis H37Rv
ugaugcaacucggcaga

SEQ ID NO: 3265934 - RNA, 21 nt, Mycobacterium tuberculosis H37Rv
ugaugcaagcgggcaugaucc

SEQ ID NO: 3265935 - RNA, 18 nt, Mycobacterium tuberculosis H37Rv
ugaugccggcgccggccc

SEQ ID NO: 3265936 - RNA, 21 nt, Mycobacterium tuberculosis H37Rv
ugaugccggcgccggcccgca

SEQ ID NO: 3265937 - RNA, 21 nt, Mycobacterium tuberculosis H37Rv
ugaugccuuccgacgaccagg

SEQ ID NO: 3265938 - RNA, 16 nt, Mycobacterium tuberculosis H37Rv
ugaugcgccccggagc

SEQ ID NO: 3265939 - RNA, 14 nt, Mycobacterium tuberculosis H37Rv
ugaugcggcgcagc

SEQ ID NO: 3265940 - RNA, 21 nt, Mycobacterium tuberculosis H37Rv
ugaugcucgacaaccacggca

SEQ ID NO: 3265941 - RNA, 14 nt, Mycobacterium tuberculosis H37Rv
ugaugcucgaugcg

SEQ ID NO: 3265942 - RNA, 17 nt, Mycobacterium tuberculosis H37Rv
ugauggacaccagccag

SEQ ID NO: 3265943 - RNA, 14 nt, Mycobacterium tuberculosis H37Rv
ugauggccagcacc

SEQ ID NO: 3265944 - RNA, 18 nt, Mycobacterium tuberculosis H37Rv
ugauggcgcugcaccgua

SEQ ID NO: 3265945 - RNA, 13 nt, Mycobacterium tuberculosis H37Rv
ugaugggccaggc

SEQ ID NO: 3265946 - RNA, 23 nt, Mycobacterium tuberculosis H37Rv
ugaugggggugcacgccuugagc

SEQ ID NO: 3265947 - RNA, 14 nt, Mycobacterium tuberculosis H37Rv
ugaugggucaccuc

SEQ ID NO: 3265948 - RNA, 20 nt, Mycobacterium tuberculosis H37Rv
ugauggucaaugccggccgc

SEQ ID NO: 3265949 - RNA, 14 nt, Mycobacterium tuberculosis H37Rv
ugaugguccgccag

SEQ ID NO: 3265950 - RNA, 22 nt, Mycobacterium tuberculosis H37Rv
ugaugguggacagcaauuugcc

SEQ ID NO: 3265951 - RNA, 14 nt, Mycobacterium tuberculosis H37Rv
ugcacuacaggguu

SEQ ID NO: 3265952 - RNA, 15 nt, Mycobacterium tuberculosis H37Rv
ugcacugcugguuga

SEQ ID NO: 3265953 - RNA, 15 nt, Mycobacterium tuberculosis H37Rv
ugcacuguggaagaa

SEQ ID NO: 3265954 - RNA, 14 nt, Mycobacterium tuberculosis H37Rv
ugcagaaacagccg

SEQ ID NO: 3265955 - RNA, 15 nt, Mycobacterium tuberculosis H37Rv
ugcagaaaggccaac

SEQ ID NO: 3265956 - RNA, 16 nt, Mycobacterium tuberculosis H37Rv
ugcagaccaucuugcc

SEQ ID NO: 3265957 - RNA, 13 nt, Mycobacterium tuberculosis H37Rv
ugcagaccgggug

SEQ ID NO: 3265958 - RNA, 18 nt, Mycobacterium tuberculosis H37Rv
ugcagacggguggcccga

SEQ ID NO: 3265959 - RNA, 21 nt, Mycobacterium tuberculosis H37Rv
ugcagauaggacccagccagc

SEQ ID NO: 3265960 - RNA, 19 nt, Mycobacterium tuberculosis H37Rv
ugcagaucgccccagccau

SEQ ID NO: 3265961 - RNA, 20 nt, Mycobacterium tuberculosis H37Rv
ugcagaucguagugcgcgcc

SEQ ID NO: 3265962 - RNA, 21 nt, Mycobacterium tuberculosis H37Rv
ugcagauggaaccucggcggu

SEQ ID NO: 3265963 - RNA, 19 nt, Mycobacterium tuberculosis H37Rv
ugcagcacccccucggcuu

SEQ ID NO: 3265964 - RNA, 12 nt, Mycobacterium tuberculosis H37Rv
ugcagcacgcgu

SEQ ID NO: 3265965 - RNA, 17 nt, Mycobacterium tuberculosis H37Rv
ugcagcacguccgcgga

SEQ ID NO: 3265966 - RNA, 18 nt, Mycobacterium tuberculosis H37Rv
ugcagcacuuggccagcu

SEQ ID NO: 3265967 - RNA, 16 nt, Mycobacterium tuberculosis H37Rv
ugcagcagcauccggc

SEQ ID NO: 3265968 - RNA, 18 nt, Mycobacterium tuberculosis H37Rv
ugcagcagcauccggccg

SEQ ID NO: 3265969 - RNA, 14 nt, Mycobacterium tuberculosis H37Rv
ugcagcagggcuuc

SEQ ID NO: 3265970 - RNA, 20 nt, Mycobacterium tuberculosis H37Rv
ugcagcaggucgaugcugcc

SEQ ID NO: 3265971 - RNA, 13 nt, Mycobacterium tuberculosis H37Rv
ugcagccacauac

SEQ ID NO: 3265972 - RNA, 17 nt, Mycobacterium tuberculosis H37Rv
ugcagcccaaggcgacg

SEQ ID NO: 3265973 - RNA, 23 nt, Mycobacterium tuberculosis H37Rv
ugcagcccgccggauccgccaga

SEQ ID NO: 3265974 - RNA, 17 nt, Mycobacterium tuberculosis H37Rv
ugcagcccgggcagcac

SEQ ID NO: 3265975 - RNA, 19 nt, Mycobacterium tuberculosis H37Rv
ugcagcccgggcagcacca

SEQ ID NO: 3265976 - RNA, 20 nt, Mycobacterium tuberculosis H37Rv
ugcagcccgggcagcaccag

SEQ ID NO: 3265977 - RNA, 17 nt, Mycobacterium tuberculosis H37Rv
ugcagcccugcgcagcc

SEQ ID NO: 3265978 - RNA, 17 nt, Mycobacterium tuberculosis H37Rv
ugcagccgcaggugggc

SEQ ID NO: 3265979 - RNA, 12 nt, Mycobacterium tuberculosis H37Rv
ugcagccgggaa

SEQ ID NO: 3265980 - RNA, 20 nt, Mycobacterium tuberculosis H37Rv
ugcagcgacgacgcccacca

SEQ ID NO: 3265981 - RNA, 16 nt, Mycobacterium tuberculosis H37Rv
ugcagcgauaucacaa

SEQ ID NO: 3265982 - RNA, 19 nt, Mycobacterium tuberculosis H37Rv
ugcagcgauaucacaacug

SEQ ID NO: 3265983 - RNA, 17 nt, Mycobacterium tuberculosis H37Rv
ugcagcgaucccggcaa

SEQ ID NO: 3265984 - RNA, 20 nt, Mycobacterium tuberculosis H37Rv
ugcagcgcaggauucugcug

SEQ ID NO: 3265985 - RNA, 21 nt, Mycobacterium tuberculosis H37Rv
ugcagcgcgguggucagcacc

SEQ ID NO: 3265986 - RNA, 21 nt, Mycobacterium tuberculosis H37Rv
ugcagcggcgccgccaagggc

SEQ ID NO: 3265987 - RNA, 14 nt, Mycobacterium tuberculosis H37Rv
ugcagcgggaucau

SEQ ID NO: 3265988 - RNA, 20 nt, Mycobacterium tuberculosis H37Rv
ugcagcgucaagggcugggu

SEQ ID NO: 3265989 - RNA, 17 nt, Mycobacterium tuberculosis H37Rv
ugcagcuccccgccgga

SEQ ID NO: 3265990 - RNA, 15 nt, Mycobacterium tuberculosis H37Rv
ugcagcucgauccgc

SEQ ID NO: 3265991 - RNA, 15 nt, Mycobacterium tuberculosis H37Rv
ugcagcucgggcagg

SEQ ID NO: 3265992 - RNA, 23 nt, Mycobacterium tuberculosis H37Rv
ugcagcuguaauuccucggauaa

SEQ ID NO: 3265993 - RNA, 15 nt, Mycobacterium tuberculosis H37Rv
ugcaggaaaguggcc

SEQ ID NO: 3265994 - RNA, 14 nt, Mycobacterium tuberculosis H37Rv
ugcaggaacaccca

SEQ ID NO: 3265995 - RNA, 13 nt, Mycobacterium tuberculosis H37Rv
ugcaggaccagca

SEQ ID NO: 3265996 - RNA, 15 nt, Mycobacterium tuberculosis H37Rv
ugcaggaccagcacc

SEQ ID NO: 3265997 - RNA, 22 nt, Mycobacterium tuberculosis H37Rv
ugcaggacgcccacaugcucag

SEQ ID NO: 3265998 - RNA, 19 nt, Mycobacterium tuberculosis H37Rv
ugcaggaucggcuugggaa

SEQ ID NO: 3265999 - RNA, 15 nt, Mycobacterium tuberculosis H37Rv
ugcaggauggacucg

SEQ ID NO: 3266000 - RNA, 14 nt, Mycobacterium tuberculosis H37Rv
ugcaggcgcagcug

SEQ ID NO: 3266001 - RNA, 17 nt, Mycobacterium tuberculosis H37Rv
ugcaggcgcagcugggu

SEQ ID NO: 3266002 - RNA, 13 nt, Mycobacterium tuberculosis H37Rv
ugcaggcggccgc

SEQ ID NO: 3266003 - RNA, 23 nt, Mycobacterium tuberculosis H37Rv
ugcaggcggccuugccgggccgc

SEQ ID NO: 3266004 - RNA, 21 nt, Mycobacterium tuberculosis H37Rv
ugcaggcugguuucggccgca

SEQ ID NO: 3266005 - RNA, 18 nt, Mycobacterium tuberculosis H37Rv
ugcagggccacuggccgg

SEQ ID NO: 3266006 - RNA, 18 nt, Mycobacterium tuberculosis H37Rv
ugcaggucggcccagguu

SEQ ID NO: 3266007 - RNA, 19 nt, Mycobacterium tuberculosis H37Rv
ugcaggucguccaucgcgu

SEQ ID NO: 3266008 - RNA, 20 nt, Mycobacterium tuberculosis H37Rv
ugcaggugaacaacagcgcu

SEQ ID NO: 3266009 - RNA, 16 nt, Mycobacterium tuberculosis H37Rv
ugcaggugcgggccgg

SEQ ID NO: 3266010 - RNA, 12 nt, Mycobacterium tuberculosis H37Rv
ugcaggugcugg

SEQ ID NO: 3266011 - RNA, 17 nt, Mycobacterium tuberculosis H37Rv
ugcagguggccgucgcc

SEQ ID NO: 3266012 - RNA, 16 nt, Mycobacterium tuberculosis H37Rv
ugcagguugccaagaa

SEQ ID NO: 3266013 - RNA, 19 nt, Mycobacterium tuberculosis H37Rv
ugcagguugcccucaccga

SEQ ID NO: 3266014 - RNA, 17 nt, Mycobacterium tuberculosis H37Rv
ugcagguuuccggccug

SEQ ID NO: 3266015 - RNA, 16 nt, Mycobacterium tuberculosis H37Rv
ugcaguaguagcgcaa

SEQ ID NO: 3266016 - RNA, 22 nt, Mycobacterium tuberculosis H37Rv
ugcagucggugcggugcacacu

SEQ ID NO: 3266017 - RNA, 23 nt, Mycobacterium tuberculosis H37Rv
ugcagucuuucccggggcugggg

SEQ ID NO: 3266018 - RNA, 17 nt, Mycobacterium tuberculosis H37Rv
ugcagugccgcacccag

SEQ ID NO: 3266019 - RNA, 20 nt, Mycobacterium tuberculosis H37Rv
ugcaguguuuuugcagacuc

SEQ ID NO: 3266020 - RNA, 14 nt, Mycobacterium tuberculosis H37Rv
ugcaucaccacugg

SEQ ID NO: 3266021 - RNA, 16 nt, Mycobacterium tuberculosis H37Rv
ugcaucagcacgucgc

SEQ ID NO: 3266022 - RNA, 18 nt, Mycobacterium tuberculosis H37Rv
ugcauccggcccacucac

SEQ ID NO: 3266023 - RNA, 17 nt, Mycobacterium tuberculosis H37Rv
ugcauccuccucgucga

SEQ ID NO: 3266024 - RNA, 17 nt, Mycobacterium tuberculosis H37Rv
ugcaucggucagcgccg

SEQ ID NO: 3266025 - RNA, 17 nt, Mycobacterium tuberculosis H37Rv
ugcaucggugcagcccg

SEQ ID NO: 3266026 - RNA, 15 nt, Mycobacterium tuberculosis H37Rv
ugcaucugaucaggc

SEQ ID NO: 3266027 - RNA, 17 nt, Mycobacterium tuberculosis H37Rv
ugcaucugaucaggcca

SEQ ID NO: 3266028 - RNA, 23 nt, Mycobacterium tuberculosis H37Rv
ugcaugcccagaaaaccgccgca

SEQ ID NO: 3266029 - RNA, 16 nt, Mycobacterium tuberculosis H37Rv
ugcauggcuugcucug

SEQ ID NO: 3266030 - RNA, 20 nt, Mycobacterium tuberculosis H37Rv
ugcauggcuugcucugcgca

SEQ ID NO: 3266031 - RNA, 16 nt, Mycobacterium tuberculosis H37Rv
ugcauucccgccuucu

SEQ ID NO: 3266032 - RNA, 16 nt, Mycobacterium tuberculosis H37Rv
ugccaacaccggcgau

SEQ ID NO: 3266033 - RNA, 17 nt, Mycobacterium tuberculosis H37Rv
ugccaaccgcgggaacc

SEQ ID NO: 3266034 - RNA, 14 nt, Mycobacterium tuberculosis H37Rv
ugccaaccugggcc

SEQ ID NO: 3266035 - RNA, 23 nt, Mycobacterium tuberculosis H37Rv
ugccaacgcccguguugaagaag

SEQ ID NO: 3266036 - RNA, 15 nt, Mycobacterium tuberculosis H37Rv
ugccaacugcgccgu

SEQ ID NO: 3266037 - RNA, 21 nt, Mycobacterium tuberculosis H37Rv
ugccaaucgccgucagcaccg

SEQ ID NO: 3266038 - RNA, 13 nt, Mycobacterium tuberculosis H37Rv
ugccaaucugcac

SEQ ID NO: 3266039 - RNA, 20 nt, Mycobacterium tuberculosis H37Rv
ugccaaugauucggcacgcc

SEQ ID NO: 3266040 - RNA, 16 nt, Mycobacterium tuberculosis H37Rv
ugccaauuccagcccc

SEQ ID NO: 3266041 - RNA, 15 nt, Mycobacterium tuberculosis H37Rv
ugccacaacccgcuu

SEQ ID NO: 3266042 - RNA, 22 nt, Mycobacterium tuberculosis H37Rv
ugccacacaggcguccaucgcc

SEQ ID NO: 3266043 - RNA, 16 nt, Mycobacterium tuberculosis H37Rv
ugccacagaccgaaca

SEQ ID NO: 3266044 - RNA, 13 nt, Mycobacterium tuberculosis H37Rv
ugccacagcgaca

SEQ ID NO: 3266045 - RNA, 18 nt, Mycobacterium tuberculosis H37Rv
ugccacaggcguuuccgc

SEQ ID NO: 3266046 - RNA, 18 nt, Mycobacterium tuberculosis H37Rv
ugccacaucccacggugg

SEQ ID NO: 3266047 - RNA, 19 nt, Mycobacterium tuberculosis H37Rv
ugcccccauugccgccguc

SEQ ID NO: 3266048 - RNA, 20 nt, Mycobacterium tuberculosis H37Rv
ugcccccguugccgcccguc

SEQ ID NO: 3266049 - RNA, 14 nt, Mycobacterium tuberculosis H37Rv
ugccccgcagcacu

SEQ ID NO: 3266050 - RNA, 15 nt, Mycobacterium tuberculosis H37Rv
ugccccgcagcaucg

SEQ ID NO: 3266051 - RNA, 20 nt, Mycobacterium tuberculosis H37Rv
ugccccgcaucgcccaagcc

SEQ ID NO: 3266052 - RNA, 14 nt, Mycobacterium tuberculosis H37Rv
ugccccgccgagcg

SEQ ID NO: 3266053 - RNA, 21 nt, Mycobacterium tuberculosis H37Rv
ugccccgccguaccgaagcgg

SEQ ID NO: 3266054 - RNA, 14 nt, Mycobacterium tuberculosis H37Rv
ugccccgccuuggc

SEQ ID NO: 3266055 - RNA, 15 nt, Mycobacterium tuberculosis H37Rv
ugccccggagccaga

SEQ ID NO: 3266056 - RNA, 17 nt, Mycobacterium tuberculosis H37Rv
ugccccgggcccagguu

SEQ ID NO: 3266057 - RNA, 14 nt, Mycobacterium tuberculosis H37Rv
ugccccggucggcg

SEQ ID NO: 3266058 - RNA, 17 nt, Mycobacterium tuberculosis H37Rv
ugccccggucggcgacg

SEQ ID NO: 3266059 - RNA, 20 nt, Mycobacterium tuberculosis H37Rv
ugccccuucaaagcggccuc

SEQ ID NO: 3266060 - RNA, 23 nt, Mycobacterium tuberculosis H37Rv
ugcccgaaccaccaccggcaaca

SEQ ID NO: 3266061 - RNA, 19 nt, Mycobacterium tuberculosis H37Rv
ugcccgaagagcacgucaa

SEQ ID NO: 3266062 - RNA, 23 nt, Mycobacterium tuberculosis H37Rv
ugcccgacaccgccccgccgcga

SEQ ID NO: 3266063 - RNA, 23 nt, Mycobacterium tuberculosis H37Rv
ugcccgacccgccgacgccgccg

SEQ ID NO: 3266064 - RNA, 13 nt, Mycobacterium tuberculosis H37Rv
ugcccgacgaugc

SEQ ID NO: 3266065 - RNA, 14 nt, Mycobacterium tuberculosis H37Rv
ugcccgacggcguc

SEQ ID NO: 3266066 - RNA, 18 nt, Mycobacterium tuberculosis H37Rv
ugcccgagcccagccggg

SEQ ID NO: 3266067 - RNA, 21 nt, Mycobacterium tuberculosis H37Rv
ugcccgagcccagcgccucca

SEQ ID NO: 3266068 - RNA, 22 nt, Mycobacterium tuberculosis H37Rv
ugcccgauacccggugauggug

SEQ ID NO: 3266069 - RNA, 22 nt, Mycobacterium tuberculosis H37Rv
ugcccgcaacgccaacacgcgu

SEQ ID NO: 3266070 - RNA, 19 nt, Mycobacterium tuberculosis H37Rv
ugcccgcaccguagccgcu

SEQ ID NO: 3266071 - RNA, 12 nt, Mycobacterium tuberculosis H37Rv
ugcccgcacgcu

SEQ ID NO: 3266072 - RNA, 14 nt, Mycobacterium tuberculosis H37Rv
ugcccgcauugcca

SEQ ID NO: 3266073 - RNA, 16 nt, Mycobacterium tuberculosis H37Rv
ugcccgcauugccaac

SEQ ID NO: 3266074 - RNA, 20 nt, Mycobacterium tuberculosis H37Rv
ugcccgccaccggcgcgacc

SEQ ID NO: 3266075 - RNA, 21 nt, Mycobacterium tuberculosis H37Rv
ugcccgccaccggcgcgaccg

SEQ ID NO: 3266076 - RNA, 17 nt, Mycobacterium tuberculosis H37Rv
ugcccgccacgcucggu

SEQ ID NO: 3266077 - RNA, 18 nt, Mycobacterium tuberculosis H37Rv
ugcccgccagcgccgccg

SEQ ID NO: 3266078 - RNA, 21 nt, Mycobacterium tuberculosis H37Rv
ugcccgccagcgccgccgcga

SEQ ID NO: 3266079 - RNA, 13 nt, Mycobacterium tuberculosis H37Rv
ugcccgccagucc

SEQ ID NO: 3266080 - RNA, 13 nt, Mycobacterium tuberculosis H37Rv
ugcccgcccagcc

SEQ ID NO: 3266081 - RNA, 14 nt, Mycobacterium tuberculosis H37Rv
ugcccgcccagccc

SEQ ID NO: 3266082 - RNA, 13 nt, Mycobacterium tuberculosis H37Rv
ugcccgccgacgc

SEQ ID NO: 3266083 - RNA, 13 nt, Mycobacterium tuberculosis H37Rv
ugcccgccgcguc

SEQ ID NO: 3266084 - RNA, 22 nt, Mycobacterium tuberculosis H37Rv
ugcccgccucgcagcgacacgu

SEQ ID NO: 3266085 - RNA, 20 nt, Mycobacterium tuberculosis H37Rv
ugcccgcgaacgaucccgcc

SEQ ID NO: 3266086 - RNA, 14 nt, Mycobacterium tuberculosis H37Rv
ugcccgcgcggcca

SEQ ID NO: 3266087 - RNA, 13 nt, Mycobacterium tuberculosis H37Rv
ugcccgcgcggcg

SEQ ID NO: 3266088 - RNA, 14 nt, Mycobacterium tuberculosis H37Rv
ugcccgcggugacg

SEQ ID NO: 3266089 - RNA, 19 nt, Mycobacterium tuberculosis H37Rv
ugcccgcgucuacgucguc

SEQ ID NO: 3266090 - RNA, 18 nt, Mycobacterium tuberculosis H37Rv
ugcccgcguugccaaagc

SEQ ID NO: 3266091 - RNA, 19 nt, Mycobacterium tuberculosis H37Rv
ugcccgcguugccaaagcc

SEQ ID NO: 3266092 - RNA, 20 nt, Mycobacterium tuberculosis H37Rv
ugcccggacucuccccuggc

SEQ ID NO: 3266093 - RNA, 17 nt, Mycobacterium tuberculosis H37Rv
ugcccggcaaccuggac

SEQ ID NO: 3266094 - RNA, 18 nt, Mycobacterium tuberculosis H37Rv
ugcccggcaaccuggacu

SEQ ID NO: 3266095 - RNA, 13 nt, Mycobacterium tuberculosis H37Rv
ugcccggccgcca

SEQ ID NO: 3266096 - RNA, 21 nt, Mycobacterium tuberculosis H37Rv
ugcccggccgccagcgcgccg

SEQ ID NO: 3266097 - RNA, 21 nt, Mycobacterium tuberculosis H37Rv
ugcccggcucucagcgacagc

SEQ ID NO: 3266098 - RNA, 17 nt, Mycobacterium tuberculosis H37Rv
ugcccgggaccauagcc

SEQ ID NO: 3266099 - RNA, 19 nt, Mycobacterium tuberculosis H37Rv
ugcccgggcccgucgucgu

SEQ ID NO: 3266100 - RNA, 22 nt, Mycobacterium tuberculosis H37Rv
ugcccgggcccgucgucgucga

SEQ ID NO: 3266101 - RNA, 20 nt, Mycobacterium tuberculosis H37Rv
ugcccgggcgugguaucgcc

SEQ ID NO: 3266102 - RNA, 20 nt, Mycobacterium tuberculosis H37Rv
ugcccgggucggccggguug

SEQ ID NO: 3266103 - RNA, 15 nt, Mycobacterium tuberculosis H37Rv
ugcccgguuucuucu

SEQ ID NO: 3266104 - RNA, 16 nt, Mycobacterium tuberculosis H37Rv
ugcccguggugauggu

SEQ ID NO: 3266105 - RNA, 20 nt, Mycobacterium tuberculosis H37Rv
ugcccguguuaaagaagccu

SEQ ID NO: 3266106 - RNA, 16 nt, Mycobacterium tuberculosis H37Rv
ugcccguucugcccag

SEQ ID NO: 3266107 - RNA, 18 nt, Mycobacterium tuberculosis H37Rv
ugcccguucugcccaggc

SEQ ID NO: 3266108 - RNA, 14 nt, Mycobacterium tuberculosis H37Rv
ugcccuagcccgau

SEQ ID NO: 3266109 - RNA, 16 nt, Mycobacterium tuberculosis H37Rv
ugcccucaacgaucgc

SEQ ID NO: 3266110 - RNA, 20 nt, Mycobacterium tuberculosis H37Rv
ugcccucaacgaucgcgccg

SEQ ID NO: 3266111 - RNA, 12 nt, Mycobacterium tuberculosis H37Rv
ugcccucggccg

SEQ ID NO: 3266112 - RNA, 16 nt, Mycobacterium tuberculosis H37Rv
ugcccugauugaagcc

SEQ ID NO: 3266113 - RNA, 17 nt, Mycobacterium tuberculosis H37Rv
ugcccugauugaagccc

SEQ ID NO: 3266114 - RNA, 21 nt, Mycobacterium tuberculosis H37Rv
ugcccugcacuucgggauaag

SEQ ID NO: 3266115 - RNA, 19 nt, Mycobacterium tuberculosis H37Rv
ugcccugcauaggcgcggu

SEQ ID NO: 3266116 - RNA, 14 nt, Mycobacterium tuberculosis H37Rv
ugcccugcccgaag

SEQ ID NO: 3266117 - RNA, 16 nt, Mycobacterium tuberculosis H37Rv
ugcccuucugacuauc

SEQ ID NO: 3266118 - RNA, 19 nt, Mycobacterium tuberculosis H37Rv
ugcccuucuucgaccgcga

SEQ ID NO: 3266119 - RNA, 14 nt, Mycobacterium tuberculosis H37Rv
ugcccuugaagaaa

SEQ ID NO: 3266120 - RNA, 21 nt, Mycobacterium tuberculosis H37Rv
ugcccuugcggaagaagugcu

SEQ ID NO: 3266121 - RNA, 14 nt, Mycobacterium tuberculosis H37Rv
ugcccuuggccagc

SEQ ID NO: 3266122 - RNA, 16 nt, Mycobacterium tuberculosis H37Rv
ugcccuuggccagcag

SEQ ID NO: 3266123 - RNA, 12 nt, Mycobacterium tuberculosis H37Rv
ugcccuugggac

SEQ ID NO: 3266124 - RNA, 15 nt, Mycobacterium tuberculosis H37Rv
ugccgaaaaucgcag

SEQ ID NO: 3266125 - RNA, 18 nt, Mycobacterium tuberculosis H37Rv
ugccgaacagcgaaccgc

SEQ ID NO: 3266126 - RNA, 17 nt, Mycobacterium tuberculosis H37Rv
ugccgaacccggcggac

SEQ ID NO: 3266127 - RNA, 18 nt, Mycobacterium tuberculosis H37Rv
ugccgaacgucgcggcca

SEQ ID NO: 3266128 - RNA, 16 nt, Mycobacterium tuberculosis H37Rv
ugccgaacuccgcgga

SEQ ID NO: 3266129 - RNA, 12 nt, Mycobacterium tuberculosis H37Rv
ugccgaagccgg

SEQ ID NO: 3266130 - RNA, 16 nt, Mycobacterium tuberculosis H37Rv
ugccgaagcggccacc

SEQ ID NO: 3266131 - RNA, 18 nt, Mycobacterium tuberculosis H37Rv
ugccgaagcggccaccgc

SEQ ID NO: 3266132 - RNA, 21 nt, Mycobacterium tuberculosis H37Rv
ugccgaagcugcccaaccggu

SEQ ID NO: 3266133 - RNA, 19 nt, Mycobacterium tuberculosis H37Rv
ugccgaaguugaagaagcc

SEQ ID NO: 3266134 - RNA, 16 nt, Mycobacterium tuberculosis H37Rv
ugccgaccaccagcau

SEQ ID NO: 3266135 - RNA, 15 nt, Mycobacterium tuberculosis H37Rv
ugccgaccagcgcgc

SEQ ID NO: 3266136 - RNA, 15 nt, Mycobacterium tuberculosis H37Rv
ugccgacccgucgga

SEQ ID NO: 3266137 - RNA, 23 nt, Mycobacterium tuberculosis H37Rv
ugccgaccggucagcgcgcggcu

SEQ ID NO: 3266138 - RNA, 23 nt, Mycobacterium tuberculosis H37Rv
ugccgaccgguuggguagcaccg

SEQ ID NO: 3266139 - RNA, 16 nt, Mycobacterium tuberculosis H37Rv
ugccgaccgucacuga

SEQ ID NO: 3266140 - RNA, 23 nt, Mycobacterium tuberculosis H37Rv
ugccgacgaacgaaccgccgccg

SEQ ID NO: 3266141 - RNA, 21 nt, Mycobacterium tuberculosis H37Rv
ugccgacgaucgacgccgcca

SEQ ID NO: 3266142 - RNA, 18 nt, Mycobacterium tuberculosis H37Rv
ugccgacgccccgaucgg

SEQ ID NO: 3266143 - RNA, 16 nt, Mycobacterium tuberculosis H37Rv
ugccgccgucgccgau

SEQ ID NO: 3266144 - RNA, 17 nt, Mycobacterium tuberculosis H37Rv
ugccgccgucgccgcca

SEQ ID NO: 3266145 - RNA, 19 nt, Mycobacterium tuberculosis H37Rv
ugccgccgucgccgccguu

SEQ ID NO: 3266146 - RNA, 20 nt, Mycobacterium tuberculosis H37Rv
ugccgccgucgccgccguug

SEQ ID NO: 3266147 - RNA, 22 nt, Mycobacterium tuberculosis H37Rv
ugccgccgucguugcccgaccc

SEQ ID NO: 3266148 - RNA, 14 nt, Mycobacterium tuberculosis H37Rv
ugccgccguuaccg

SEQ ID NO: 3266149 - RNA, 20 nt, Mycobacterium tuberculosis H37Rv
ugccgccguuaccgccguug

SEQ ID NO: 3266150 - RNA, 17 nt, Mycobacterium tuberculosis H37Rv
ugccgccguugccaccg

SEQ ID NO: 3266151 - RNA, 17 nt, Mycobacterium tuberculosis H37Rv
ugccgccguugccgcca

SEQ ID NO: 3266152 - RNA, 21 nt, Mycobacterium tuberculosis H37Rv
ugccgccguugccgccauggc

SEQ ID NO: 3266153 - RNA, 20 nt, Mycobacterium tuberculosis H37Rv
ugccgccguugccgccguug

SEQ ID NO: 3266154 - RNA, 18 nt, Mycobacterium tuberculosis H37Rv
ugccgccguugccggcuu

SEQ ID NO: 3266155 - RNA, 16 nt, Mycobacterium tuberculosis H37Rv
ugccgccuccgccugc

SEQ ID NO: 3266156 - RNA, 19 nt, Mycobacterium tuberculosis H37Rv
ugccgccuccgccugcccc

SEQ ID NO: 3266157 - RNA, 17 nt, Mycobacterium tuberculosis H37Rv
ugccgccugcgccgcca

SEQ ID NO: 3266158 - RNA, 21 nt, Mycobacterium tuberculosis H37Rv
ugccgcgcagcugccgcaccc

SEQ ID NO: 3266159 - RNA, 14 nt, Mycobacterium tuberculosis H37Rv
ugccgcgccgacgc

SEQ ID NO: 3266160 - RNA, 13 nt, Mycobacterium tuberculosis H37Rv
ugccgcgcgcccg

SEQ ID NO: 3266161 - RNA, 12 nt, Mycobacterium tuberculosis H37Rv
ugccgcgcggcg

SEQ ID NO: 3266162 - RNA, 19 nt, Mycobacterium tuberculosis H37Rv
ugccgcggaggcggccagc

SEQ ID NO: 3266163 - RNA, 20 nt, Mycobacterium tuberculosis H37Rv
ugccgcggaggcggccagcc

SEQ ID NO: 3266164 - RNA, 21 nt, Mycobacterium tuberculosis H37Rv
ugccgcggccaccgccgccgc

SEQ ID NO: 3266165 - RNA, 20 nt, Mycobacterium tuberculosis H37Rv
ugccgcggccaguacgucga

SEQ ID NO: 3266166 - RNA, 20 nt, Mycobacterium tuberculosis H37Rv
ugccgcggcuaggccaagcc

SEQ ID NO: 3266167 - RNA, 18 nt, Mycobacterium tuberculosis H37Rv
ugccgcgggacaucaccg

SEQ ID NO: 3266168 - RNA, 20 nt, Mycobacterium tuberculosis H37Rv
ugccgcgggacaucaccgca

SEQ ID NO: 3266169 - RNA, 17 nt, Mycobacterium tuberculosis H37Rv
ugccgcgggcagcgugu

SEQ ID NO: 3266170 - RNA, 14 nt, Mycobacterium tuberculosis H37Rv
ugccgcggucggcg

SEQ ID NO: 3266171 - RNA, 15 nt, Mycobacterium tuberculosis H37Rv
ugccgcggucggcga

SEQ ID NO: 3266172 - RNA, 16 nt, Mycobacterium tuberculosis H37Rv
ugccgcggucggcgac

SEQ ID NO: 3266173 - RNA, 13 nt, Mycobacterium tuberculosis H37Rv
ugccgcggucgua

SEQ ID NO: 3266174 - RNA, 20 nt, Mycobacterium tuberculosis H37Rv
ugccgcggugccaaccgcgg

SEQ ID NO: 3266175 - RNA, 19 nt, Mycobacterium tuberculosis H37Rv
ugccgcgguggaugcgaug

SEQ ID NO: 3266176 - RNA, 20 nt, Mycobacterium tuberculosis H37Rv
ugccgcgguugugcugggug

SEQ ID NO: 3266177 - RNA, 19 nt, Mycobacterium tuberculosis H37Rv
ugccgcguagguggccagc

SEQ ID NO: 3266178 - RNA, 14 nt, Mycobacterium tuberculosis H37Rv
ugccgcgucggccg

SEQ ID NO: 3266179 - RNA, 19 nt, Mycobacterium tuberculosis H37Rv
ugccgcguugccgggguug

SEQ ID NO: 3266180 - RNA, 14 nt, Mycobacterium tuberculosis H37Rv
ugccgcugacgguu

SEQ ID NO: 3266181 - RNA, 17 nt, Mycobacterium tuberculosis H37Rv
ugccgcugcauccgcag

SEQ ID NO: 3266182 - RNA, 21 nt, Mycobacterium tuberculosis H37Rv
ugccgcugcauccgcagcacc

SEQ ID NO: 3266183 - RNA, 22 nt, Mycobacterium tuberculosis H37Rv
ugccgcugcgccgucgcagcca

SEQ ID NO: 3266184 - RNA, 21 nt, Mycobacterium tuberculosis H37Rv
ugccgcuuagcaaucggcagg

SEQ ID NO: 3266185 - RNA, 15 nt, Mycobacterium tuberculosis H37Rv
ugccggacaaccugg

SEQ ID NO: 3266186 - RNA, 19 nt, Mycobacterium tuberculosis H37Rv
ugccggacagccacgcaca

SEQ ID NO: 3266187 - RNA, 13 nt, Mycobacterium tuberculosis H37Rv
ugccggaccaccg

SEQ ID NO: 3266188 - RNA, 14 nt, Mycobacterium tuberculosis H37Rv
ugccggaccaccgg

SEQ ID NO: 3266189 - RNA, 21 nt, Mycobacterium tuberculosis H37Rv
ugccggaccaccgggccgaca

SEQ ID NO: 3266190 - RNA, 16 nt, Mycobacterium tuberculosis H37Rv
ugccggacgccaugcc

SEQ ID NO: 3266191 - RNA, 21 nt, Mycobacterium tuberculosis H37Rv
ugccggaggaucgcugguugg

SEQ ID NO: 3266192 - RNA, 13 nt, Mycobacterium tuberculosis H37Rv
ugccggaguugaa

SEQ ID NO: 3266193 - RNA, 18 nt, Mycobacterium tuberculosis H37Rv
ugccggaguugucgacgg

SEQ ID NO: 3266194 - RNA, 17 nt, Mycobacterium tuberculosis H37Rv
ugccggcaacagcucgc

SEQ ID NO: 3266195 - RNA, 15 nt, Mycobacterium tuberculosis H37Rv
ugccggccaggauuu

SEQ ID NO: 3266196 - RNA, 20 nt, Mycobacterium tuberculosis H37Rv
ugccggccaggauuucgcag

SEQ ID NO: 3266197 - RNA, 14 nt, Mycobacterium tuberculosis H37Rv
ugccggccaucgcc

SEQ ID NO: 3266198 - RNA, 16 nt, Mycobacterium tuberculosis H37Rv
ugccggcccaccgccg

SEQ ID NO: 3266199 - RNA, 21 nt, Mycobacterium tuberculosis H37Rv
ugccggcccccacacaggcag

SEQ ID NO: 3266200 - RNA, 22 nt, Mycobacterium tuberculosis H37Rv
ugccggccgcguaaaccggcug

SEQ ID NO: 3266201 - RNA, 19 nt, Mycobacterium tuberculosis H37Rv
ugccggcgaacucgcgccg

SEQ ID NO: 3266202 - RNA, 22 nt, Mycobacterium tuberculosis H37Rv
ugccggcgaagccggccgggaa

SEQ ID NO: 3266203 - RNA, 17 nt, Mycobacterium tuberculosis H37Rv
ugccggcgaaggccagc

SEQ ID NO: 3266204 - RNA, 11 nt, Mycobacterium tuberculosis H37Rv
ugccggcgacc

SEQ ID NO: 3266205 - RNA, 14 nt, Mycobacterium tuberculosis H37Rv
ugccggcgacgaua

SEQ ID NO: 3266206 - RNA, 22 nt, Mycobacterium tuberculosis H37Rv
ugccggcgacgcuaccgccgga

SEQ ID NO: 3266207 - RNA, 21 nt, Mycobacterium tuberculosis H37Rv
ugccggcgagagcgucaacca

SEQ ID NO: 3266208 - RNA, 16 nt, Mycobacterium tuberculosis H37Rv
ugccggcgagggccac

SEQ ID NO: 3266209 - RNA, 20 nt, Mycobacterium tuberculosis H37Rv
ugccggcgauguuggccagc

SEQ ID NO: 3266210 - RNA, 17 nt, Mycobacterium tuberculosis H37Rv
ugccggcgcaccacacc

SEQ ID NO: 3266211 - RNA, 14 nt, Mycobacterium tuberculosis H37Rv
ugccggcgccgcca

SEQ ID NO: 3266212 - RNA, 15 nt, Mycobacterium tuberculosis H37Rv
ugccggcgccgccag

SEQ ID NO: 3266213 - RNA, 24 nt, Mycobacterium tuberculosis H37Rv
ugccggcgccgccagcaccaccgg

SEQ ID NO: 3266214 - RNA, 14 nt, Mycobacterium tuberculosis H37Rv
ugccggcgccgccc

SEQ ID NO: 3266215 - RNA, 18 nt, Mycobacterium tuberculosis H37Rv
ugccggcgccgcccuugc

SEQ ID NO: 3266216 - RNA, 19 nt, Mycobacterium tuberculosis H37Rv
ugccggcgccgcccuugcc

SEQ ID NO: 3266217 - RNA, 21 nt, Mycobacterium tuberculosis H37Rv
ugccggcgccuuggucgccgc

SEQ ID NO: 3266218 - RNA, 19 nt, Mycobacterium tuberculosis H37Rv
ugccggcggaucugaucgg

SEQ ID NO: 3266219 - RNA, 16 nt, Mycobacterium tuberculosis H37Rv
ugccggcggcgacguc

SEQ ID NO: 3266220 - RNA, 22 nt, Mycobacterium tuberculosis H37Rv
ugccggcgguguuggcgccagc

SEQ ID NO: 3266221 - RNA, 20 nt, Mycobacterium tuberculosis H37Rv
ugccggcguugccgaaaccc

SEQ ID NO: 3266222 - RNA, 14 nt, Mycobacterium tuberculosis H37Rv
ugccggcuucggcg

SEQ ID NO: 3266223 - RNA, 21 nt, Mycobacterium tuberculosis H37Rv
ugccggcuuugagccgcucga

SEQ ID NO: 3266224 - RNA, 14 nt, Mycobacterium tuberculosis H37Rv
ugccgggagacgcu

SEQ ID NO: 3266225 - RNA, 15 nt, Mycobacterium tuberculosis H37Rv
ugccgggaucgccgu

SEQ ID NO: 3266226 - RNA, 16 nt, Mycobacterium tuberculosis H37Rv
ugccgggaugccgccg

SEQ ID NO: 3266227 - RNA, 17 nt, Mycobacterium tuberculosis H37Rv
ugccgggccauucaccg

SEQ ID NO: 3266228 - RNA, 15 nt, Mycobacterium tuberculosis H37Rv
ugccgggcgacgguu

SEQ ID NO: 3266229 - RNA, 14 nt, Mycobacterium tuberculosis H37Rv
ugccgggcgcgcgu

SEQ ID NO: 3266230 - RNA, 14 nt, Mycobacterium tuberculosis H37Rv
ugccggggccccau

SEQ ID NO: 3266231 - RNA, 16 nt, Mycobacterium tuberculosis H37Rv
ugccggggccccaugc

SEQ ID NO: 3266232 - RNA, 16 nt, Mycobacterium tuberculosis H37Rv
ugccggggcugccgcc

SEQ ID NO: 3266233 - RNA, 18 nt, Mycobacterium tuberculosis H37Rv
ugccgggguuggucgucg

SEQ ID NO: 3266234 - RNA, 22 nt, Mycobacterium tuberculosis H37Rv
ugccggguuugaucagcucggu

SEQ ID NO: 3266235 - RNA, 17 nt, Mycobacterium tuberculosis H37Rv
ugccgguaacgaacagc

SEQ ID NO: 3266236 - RNA, 17 nt, Mycobacterium tuberculosis H37Rv
ugccgguaugcgccauc

SEQ ID NO: 3266237 - RNA, 13 nt, Mycobacterium tuberculosis H37Rv
ugccggucaggca

SEQ ID NO: 3266238 - RNA, 14 nt, Mycobacterium tuberculosis H37Rv
ugccggucauacca

SEQ ID NO: 3266239 - RNA, 22 nt, Mycobacterium tuberculosis H37Rv
ugcgacuaagggcacuccaccg

SEQ ID NO: 3266240 - RNA, 20 nt, Mycobacterium tuberculosis H37Rv
ugcgacucugcgucugcuca

SEQ ID NO: 3266241 - RNA, 19 nt, Mycobacterium tuberculosis H37Rv
ugcgacugcgaaugcuggg

SEQ ID NO: 3266242 - RNA, 18 nt, Mycobacterium tuberculosis H37Rv
ugcgagaucgcggcgacc

SEQ ID NO: 3266243 - RNA, 20 nt, Mycobacterium tuberculosis H37Rv
ugcgagccggcgaagugcuc

SEQ ID NO: 3266244 - RNA, 22 nt, Mycobacterium tuberculosis H37Rv
ugcgagccggcgaagugcucca

SEQ ID NO: 3266245 - RNA, 20 nt, Mycobacterium tuberculosis H37Rv
ugcgaggccgcacgucgacc

SEQ ID NO: 3266246 - RNA, 21 nt, Mycobacterium tuberculosis H37Rv
ugcgaggggauuuugcgucug

SEQ ID NO: 3266247 - RNA, 14 nt, Mycobacterium tuberculosis H37Rv
ugcgaggggcggca

SEQ ID NO: 3266248 - RNA, 18 nt, Mycobacterium tuberculosis H37Rv
ugcgauauggucaccaag

SEQ ID NO: 3266249 - RNA, 19 nt, Mycobacterium tuberculosis H37Rv
ugcgauccagggccgacgc

SEQ ID NO: 3266250 - RNA, 13 nt, Mycobacterium tuberculosis H37Rv
ugcgaucccaccc

SEQ ID NO: 3266251 - RNA, 14 nt, Mycobacterium tuberculosis H37Rv
ugcgaucccacccu

SEQ ID NO: 3266252 - RNA, 15 nt, Mycobacterium tuberculosis H37Rv
ugcgaucccacccuc

SEQ ID NO: 3266253 - RNA, 15 nt, Mycobacterium tuberculosis H37Rv
ugcgauccccaacac

SEQ ID NO: 3266254 - RNA, 12 nt, Mycobacterium tuberculosis H37Rv
ugcgaucggcac

SEQ ID NO: 3266255 - RNA, 16 nt, Mycobacterium tuberculosis H37Rv
ugcgaucggcacuuag

SEQ ID NO: 3266256 - RNA, 18 nt, Mycobacterium tuberculosis H37Rv
ugcgaucggugcgaucag

SEQ ID NO: 3266257 - RNA, 17 nt, Mycobacterium tuberculosis H37Rv
ugcgaugcugaucaccg

SEQ ID NO: 3266258 - RNA, 14 nt, Mycobacterium tuberculosis H37Rv
ugcgauggcccggg

SEQ ID NO: 3266259 - RNA, 15 nt, Mycobacterium tuberculosis H37Rv
ugcgauggccgacgc

SEQ ID NO: 3266260 - RNA, 18 nt, Mycobacterium tuberculosis H37Rv
ugcgauuccgcgucugcu

SEQ ID NO: 3266261 - RNA, 20 nt, Mycobacterium tuberculosis H37Rv
ugcgauuccgcgucugcucg

SEQ ID NO: 3266262 - RNA, 17 nt, Mycobacterium tuberculosis H37Rv
ugcgauucugcgucugc

SEQ ID NO: 3266263 - RNA, 16 nt, Mycobacterium tuberculosis H37Rv
ugcgauugcgcacacc

SEQ ID NO: 3266264 - RNA, 19 nt, Mycobacterium tuberculosis H37Rv
ugcgauuuugugucugcuc

SEQ ID NO: 3266265 - RNA, 14 nt, Mycobacterium tuberculosis H37Rv
ugcgcaacaccgug

SEQ ID NO: 3266266 - RNA, 21 nt, Mycobacterium tuberculosis H37Rv
ugcgcaacaccgugcaccagc

SEQ ID NO: 3266267 - RNA, 22 nt, Mycobacterium tuberculosis H37Rv
ugcgcaacaccgugcaccagcu

SEQ ID NO: 3266268 - RNA, 14 nt, Mycobacterium tuberculosis H37Rv
ugcgcaacccagcc

SEQ ID NO: 3266269 - RNA, 20 nt, Mycobacterium tuberculosis H37Rv
ugcgcaacccagccgcgcca

SEQ ID NO: 3266270 - RNA, 22 nt, Mycobacterium tuberculosis H37Rv
ugcgcaacccagccgcgccagc

SEQ ID NO: 3266271 - RNA, 21 nt, Mycobacterium tuberculosis H37Rv
ugcgcaauagcgacagcagcg

SEQ ID NO: 3266272 - RNA, 19 nt, Mycobacterium tuberculosis H37Rv
ugcgcaaugccgacgccaa

SEQ ID NO: 3266273 - RNA, 18 nt, Mycobacterium tuberculosis H37Rv
ugcgcacaccgacccgcu

SEQ ID NO: 3266274 - RNA, 12 nt, Mycobacterium tuberculosis H37Rv
ugcgcaccagca

SEQ ID NO: 3266275 - RNA, 15 nt, Mycobacterium tuberculosis H37Rv
ugcgcaccagcaccu

SEQ ID NO: 3266276 - RNA, 12 nt, Mycobacterium tuberculosis H37Rv
ugcgcaccgguc

SEQ ID NO: 3266277 - RNA, 16 nt, Mycobacterium tuberculosis H37Rv
ugcgcaccggucaacg

SEQ ID NO: 3266278 - RNA, 20 nt, Mycobacterium tuberculosis H37Rv
ugcgcaccggucaacgugga

SEQ ID NO: 3266279 - RNA, 18 nt, Mycobacterium tuberculosis H37Rv
ugcgcaccugggucgacg

SEQ ID NO: 3266280 - RNA, 19 nt, Mycobacterium tuberculosis H37Rv
ugcgcaccugggucgacga

SEQ ID NO: 3266281 - RNA, 21 nt, Mycobacterium tuberculosis H37Rv
ugcgcacggauucaucacggg

SEQ ID NO: 3266282 - RNA, 18 nt, Mycobacterium tuberculosis H37Rv
ugcgcacucuagccgggu

SEQ ID NO: 3266283 - RNA, 22 nt, Mycobacterium tuberculosis H37Rv
ugcgcacugaggcucaggugcu

SEQ ID NO: 3266284 - RNA, 20 nt, Mycobacterium tuberculosis H37Rv
ugcgcagaaacgccgagcgc

SEQ ID NO: 3266285 - RNA, 16 nt, Mycobacterium tuberculosis H37Rv
ugcgcagaacaccacc

SEQ ID NO: 3266286 - RNA, 20 nt, Mycobacterium tuberculosis H37Rv
ugcgcagaacaccaccgcca

SEQ ID NO: 3266287 - RNA, 17 nt, Mycobacterium tuberculosis H37Rv
ugcgcagauuugcucca

SEQ ID NO: 3266288 - RNA, 19 nt, Mycobacterium tuberculosis H37Rv
ugcgcagcggcauccacac

SEQ ID NO: 3266289 - RNA, 17 nt, Mycobacterium tuberculosis H37Rv
ugcgcagcuuggccagc

SEQ ID NO: 3266290 - RNA, 19 nt, Mycobacterium tuberculosis H37Rv
ugcgcagguacgccucgac

SEQ ID NO: 3266291 - RNA, 18 nt, Mycobacterium tuberculosis H37Rv
ugcgcagugacgccucga

SEQ ID NO: 3266292 - RNA, 17 nt, Mycobacterium tuberculosis H37Rv
ugcgcagugcaccgcgu

SEQ ID NO: 3266293 - RNA, 17 nt, Mycobacterium tuberculosis H37Rv
ugcgcauaauauuuucc

SEQ ID NO: 3266294 - RNA, 15 nt, Mycobacterium tuberculosis H37Rv
ugcgcaucgagcguc

SEQ ID NO: 3266295 - RNA, 17 nt, Mycobacterium tuberculosis H37Rv
ugcgcaucgccaccauc

SEQ ID NO: 3266296 - RNA, 13 nt, Mycobacterium tuberculosis H37Rv
ugcgcaucgccga

SEQ ID NO: 3266297 - RNA, 21 nt, Mycobacterium tuberculosis H37Rv
ugcgcaucgguccaaagcacg

SEQ ID NO: 3266298 - RNA, 23 nt, Mycobacterium tuberculosis H37Rv
ugcgccaaaauccgcccaccggu

SEQ ID NO: 3266299 - RNA, 13 nt, Mycobacterium tuberculosis H37Rv
ugcgccacacccg

SEQ ID NO: 3266300 - RNA, 16 nt, Mycobacterium tuberculosis H37Rv
ugcgccaccguggccg

SEQ ID NO: 3266301 - RNA, 17 nt, Mycobacterium tuberculosis H37Rv
ugcgccaccguggccgc

SEQ ID NO: 3266302 - RNA, 12 nt, Mycobacterium tuberculosis H37Rv
ugcgccaccucg

SEQ ID NO: 3266303 - RNA, 18 nt, Mycobacterium tuberculosis H37Rv
ugcgccacgaccgcggcg

SEQ ID NO: 3266304 - RNA, 19 nt, Mycobacterium tuberculosis H37Rv
ugcgccagaucaccgucga

SEQ ID NO: 3266305 - RNA, 21 nt, Mycobacterium tuberculosis H37Rv
ugcgccagcaacagcgcggug

SEQ ID NO: 3266306 - RNA, 23 nt, Mycobacterium tuberculosis H37Rv
ugcgccagcgagcgcaaaucgau

SEQ ID NO: 3266307 - RNA, 23 nt, Mycobacterium tuberculosis H37Rv
ugcgccagcgggcuguaggcgau

SEQ ID NO: 3266308 - RNA, 18 nt, Mycobacterium tuberculosis H37Rv
ugcgccaguaggcuucga

SEQ ID NO: 3266309 - RNA, 19 nt, Mycobacterium tuberculosis H37Rv
ugcgccauaauauugccgc

SEQ ID NO: 3266310 - RNA, 22 nt, Mycobacterium tuberculosis H37Rv
ugcgccaucucgacggugaccg

SEQ ID NO: 3266311 - RNA, 17 nt, Mycobacterium tuberculosis H37Rv
ugcgccauugcgggaac

SEQ ID NO: 3266312 - RNA, 19 nt, Mycobacterium tuberculosis H37Rv
ugcgcccaccgaaaccggu

SEQ ID NO: 3266313 - RNA, 21 nt, Mycobacterium tuberculosis H37Rv
ugcgcccgacggaguucgacg

SEQ ID NO: 3266314 - RNA, 16 nt, Mycobacterium tuberculosis H37Rv
ugcgcccugagcagau

SEQ ID NO: 3266315 - RNA, 17 nt, Mycobacterium tuberculosis H37Rv
ugcgcccugagcagaug

SEQ ID NO: 3266316 - RNA, 21 nt, Mycobacterium tuberculosis H37Rv
ugcgccgaacaccacaccgag

SEQ ID NO: 3266317 - RNA, 20 nt, Mycobacterium tuberculosis H37Rv
ugcgccgaacgcuccaggcc

SEQ ID NO: 3266318 - RNA, 21 nt, Mycobacterium tuberculosis H37Rv
ugcgccgaacgcuccaggccu

SEQ ID NO: 3266319 - RNA, 18 nt, Mycobacterium tuberculosis H37Rv
ugcgccgacaccgggccc

SEQ ID NO: 3266320 - RNA, 19 nt, Mycobacterium tuberculosis H37Rv
ugcgccgacccgcgcgccg

SEQ ID NO: 3266321 - RNA, 18 nt, Mycobacterium tuberculosis H37Rv
ugcgccgauacccagcgg

SEQ ID NO: 3266322 - RNA, 16 nt, Mycobacterium tuberculosis H37Rv
ugcgccgaucccgccc

SEQ ID NO: 3266323 - RNA, 16 nt, Mycobacterium tuberculosis H37Rv
ugcgccgcacacucuc

SEQ ID NO: 3266324 - RNA, 14 nt, Mycobacterium tuberculosis H37Rv
ugcgccgcacggcg

SEQ ID NO: 3266325 - RNA, 17 nt, Mycobacterium tuberculosis H37Rv
ugcgccgcacggcgacg

SEQ ID NO: 3266326 - RNA, 15 nt, Mycobacterium tuberculosis H37Rv
ugcgccgccacagca

SEQ ID NO: 3266327 - RNA, 14 nt, Mycobacterium tuberculosis H37Rv
ugcgccgccagcgc

SEQ ID NO: 3266328 - RNA, 19 nt, Mycobacterium tuberculosis H37Rv
ugcgccgccagcgccgccg

SEQ ID NO: 3266329 - RNA, 16 nt, Mycobacterium tuberculosis H37Rv
ugcgccggaugacacc

SEQ ID NO: 3266330 - RNA, 15 nt, Mycobacterium tuberculosis H37Rv
ugcgccggcuggcgg

SEQ ID NO: 3266331 - RNA, 17 nt, Mycobacterium tuberculosis H37Rv
ugcgccggcuggcggcc

SEQ ID NO: 3266332 - RNA, 22 nt, Mycobacterium tuberculosis H37Rv
ugcgccgggcguccgccggcga

SEQ ID NO: 3266333 - RNA, 17 nt, Mycobacterium tuberculosis H37Rv
ugcgccguggcaucgcc

SEQ ID NO: 3266334 - RNA, 21 nt, Mycobacterium tuberculosis H37Rv
ugcgccguggcaucgccucca

SEQ ID NO: 3266335 - RNA, 23 nt, Mycobacterium tuberculosis H37Rv
ugcggcggcgcucgucgaucucc

SEQ ID NO: 3266336 - RNA, 16 nt, Mycobacterium tuberculosis H37Rv
ugcggcggcugccggu

SEQ ID NO: 3266337 - RNA, 19 nt, Mycobacterium tuberculosis H37Rv
ugcggcgucaaauccagcg

SEQ ID NO: 3266338 - RNA, 22 nt, Mycobacterium tuberculosis H37Rv
ugcggcgucguugaggaagccc

SEQ ID NO: 3266339 - RNA, 13 nt, Mycobacterium tuberculosis H37Rv
ugcggcgugccgg

SEQ ID NO: 3266340 - RNA, 17 nt, Mycobacterium tuberculosis H37Rv
ugcggcucgcugaucug

SEQ ID NO: 3266341 - RNA, 14 nt, Mycobacterium tuberculosis H37Rv
ugcggcugccagug

SEQ ID NO: 3266342 - RNA, 13 nt, Mycobacterium tuberculosis H37Rv
ugcggcugcccac

SEQ ID NO: 3266343 - RNA, 22 nt, Mycobacterium tuberculosis H37Rv
ugcggcugguguccagccaggc

SEQ ID NO: 3266344 - RNA, 22 nt, Mycobacterium tuberculosis H37Rv
ugcggcuucggcagaccggcau

SEQ ID NO: 3266345 - RNA, 20 nt, Mycobacterium tuberculosis H37Rv
ugcggcuuggccaucacggc

SEQ ID NO: 3266346 - RNA, 14 nt, Mycobacterium tuberculosis H37Rv
ugcgggaucgccga

SEQ ID NO: 3266347 - RNA, 22 nt, Mycobacterium tuberculosis H37Rv
ugcgggcaaccacaucaccggc

SEQ ID NO: 3266348 - RNA, 20 nt, Mycobacterium tuberculosis H37Rv
ugcgggcagcacucuucgau

SEQ ID NO: 3266349 - RNA, 14 nt, Mycobacterium tuberculosis H37Rv
ugcgggccaucaag

SEQ ID NO: 3266350 - RNA, 22 nt, Mycobacterium tuberculosis H37Rv
ugcgggcccucuaugcgggcag

SEQ ID NO: 3266351 - RNA, 23 nt, Mycobacterium tuberculosis H37Rv
ugcgggcccucuaugcgggcagc

SEQ ID NO: 3266352 - RNA, 16 nt, Mycobacterium tuberculosis H37Rv
ugcgggccgccaggcg

SEQ ID NO: 3266353 - RNA, 19 nt, Mycobacterium tuberculosis H37Rv
ugcgggccgugacccucag

SEQ ID NO: 3266354 - RNA, 18 nt, Mycobacterium tuberculosis H37Rv
ugcgggcgaucucgaugu

SEQ ID NO: 3266355 - RNA, 19 nt, Mycobacterium tuberculosis H37Rv
ugcgggcgccccaccggcc

SEQ ID NO: 3266356 - RNA, 16 nt, Mycobacterium tuberculosis H37Rv
ugcgggcucucggcgu

SEQ ID NO: 3266357 - RNA, 18 nt, Mycobacterium tuberculosis H37Rv
ugcgggcuuugccaacaa

SEQ ID NO: 3266358 - RNA, 20 nt, Mycobacterium tuberculosis H37Rv
ugcggggccgggcgaucgcc

SEQ ID NO: 3266359 - RNA, 22 nt, Mycobacterium tuberculosis H37Rv
ugcggggcgauccccagcacca

SEQ ID NO: 3266360 - RNA, 17 nt, Mycobacterium tuberculosis H37Rv
ugcggggcgccugaugc

SEQ ID NO: 3266361 - RNA, 15 nt, Mycobacterium tuberculosis H37Rv
ugcgggggacacguc

SEQ ID NO: 3266362 - RNA, 20 nt, Mycobacterium tuberculosis H37Rv
ugcgggggacgggucgccgc

SEQ ID NO: 3266363 - RNA, 20 nt, Mycobacterium tuberculosis H37Rv
ugcgggggaguagugguggg

SEQ ID NO: 3266364 - RNA, 19 nt, Mycobacterium tuberculosis H37Rv
ugcgggggcuuaugcgacu

SEQ ID NO: 3266365 - RNA, 19 nt, Mycobacterium tuberculosis H37Rv
ugcgggggcuuaugcgucu

SEQ ID NO: 3266366 - RNA, 24 nt, Mycobacterium tuberculosis H37Rv
ugcggggguacgucaccggguccg

SEQ ID NO: 3266367 - RNA, 17 nt, Mycobacterium tuberculosis H37Rv
ugcgggguugaccgugg

SEQ ID NO: 3266368 - RNA, 15 nt, Mycobacterium tuberculosis H37Rv
ugcgggguuggccgu

SEQ ID NO: 3266369 - RNA, 16 nt, Mycobacterium tuberculosis H37Rv
ugcggguagccgucga

SEQ ID NO: 3266370 - RNA, 20 nt, Mycobacterium tuberculosis H37Rv
ugcggguagccgucgauccc

SEQ ID NO: 3266371 - RNA, 20 nt, Mycobacterium tuberculosis H37Rv
ugcggguaggugacgacguc

SEQ ID NO: 3266372 - RNA, 18 nt, Mycobacterium tuberculosis H37Rv
ugcgggucggcaucggag

SEQ ID NO: 3266373 - RNA, 21 nt, Mycobacterium tuberculosis H37Rv
ugcgggucguccgccugcacc

SEQ ID NO: 3266374 - RNA, 13 nt, Mycobacterium tuberculosis H37Rv
ugcgggucucgcc

SEQ ID NO: 3266375 - RNA, 23 nt, Mycobacterium tuberculosis H37Rv
ugcgggugggacaccaucuccgc

SEQ ID NO: 3266376 - RNA, 21 nt, Mycobacterium tuberculosis H37Rv
ugcggguucacuuccgggcag

SEQ ID NO: 3266377 - RNA, 21 nt, Mycobacterium tuberculosis H37Rv
ugcgguaaucgccaccgcaag

SEQ ID NO: 3266378 - RNA, 13 nt, Mycobacterium tuberculosis H37Rv
ugcgguacccgau

SEQ ID NO: 3266379 - RNA, 18 nt, Mycobacterium tuberculosis H37Rv
ugcgguacugagccgcga

SEQ ID NO: 3266380 - RNA, 15 nt, Mycobacterium tuberculosis H37Rv
ugcgguaucggucga

SEQ ID NO: 3266381 - RNA, 14 nt, Mycobacterium tuberculosis H37Rv
ugcgguauugcccg

SEQ ID NO: 3266382 - RNA, 14 nt, Mycobacterium tuberculosis H37Rv
ugcggucaacgcug

SEQ ID NO: 3266383 - RNA, 14 nt, Mycobacterium tuberculosis H37Rv
ugcgguccaggccg

SEQ ID NO: 3266384 - RNA, 13 nt, Mycobacterium tuberculosis H37Rv
ugcgguccggcuu

SEQ ID NO: 3266385 - RNA, 13 nt, Mycobacterium tuberculosis H37Rv
ugcgguccucgau

SEQ ID NO: 3266386 - RNA, 15 nt, Mycobacterium tuberculosis H37Rv
ugcggucgcccaggc

SEQ ID NO: 3266387 - RNA, 16 nt, Mycobacterium tuberculosis H37Rv
ugcggucgcccaggcc

SEQ ID NO: 3266388 - RNA, 18 nt, Mycobacterium tuberculosis H37Rv
ugcggucgcggcugacaa

SEQ ID NO: 3266389 - RNA, 15 nt, Mycobacterium tuberculosis H37Rv
ugcggucggccacau

SEQ ID NO: 3266390 - RNA, 15 nt, Mycobacterium tuberculosis H37Rv
ugcggucgucaccgu

SEQ ID NO: 3266391 - RNA, 22 nt, Mycobacterium tuberculosis H37Rv
ugcggucuccgcccgcgggccc

SEQ ID NO: 3266392 - RNA, 21 nt, Mycobacterium tuberculosis H37Rv
ugcggugaccgugaacggcuc

SEQ ID NO: 3266393 - RNA, 18 nt, Mycobacterium tuberculosis H37Rv
ugcggugauauccgugaa

SEQ ID NO: 3266394 - RNA, 21 nt, Mycobacterium tuberculosis H37Rv
ugcggugcaggauucggcggu

SEQ ID NO: 3266395 - RNA, 23 nt, Mycobacterium tuberculosis H37Rv
ugcggugccacggugacccuggu

SEQ ID NO: 3266396 - RNA, 19 nt, Mycobacterium tuberculosis H37Rv
ugcggugcccgcaccagaa

SEQ ID NO: 3266397 - RNA, 17 nt, Mycobacterium tuberculosis H37Rv
ugcggugccggcccugc

SEQ ID NO: 3266398 - RNA, 15 nt, Mycobacterium tuberculosis H37Rv
ugcgguggccagugc

SEQ ID NO: 3266399 - RNA, 23 nt, Mycobacterium tuberculosis H37Rv
ugcgguggcuuuugcgucugcuc

SEQ ID NO: 3266400 - RNA, 16 nt, Mycobacterium tuberculosis H37Rv
ugcggugggccagguu

SEQ ID NO: 3266401 - RNA, 14 nt, Mycobacterium tuberculosis H37Rv
ugcggugggugaag

SEQ ID NO: 3266402 - RNA, 19 nt, Mycobacterium tuberculosis H37Rv
ugcggugguaggacgccag

SEQ ID NO: 3266403 - RNA, 14 nt, Mycobacterium tuberculosis H37Rv
ugcgguuagcagcc

SEQ ID NO: 3266404 - RNA, 21 nt, Mycobacterium tuberculosis H37Rv
ugcgguucggacacacaggcg

SEQ ID NO: 3266405 - RNA, 21 nt, Mycobacterium tuberculosis H37Rv
ugcgguucucguagucaacca

SEQ ID NO: 3266406 - RNA, 21 nt, Mycobacterium tuberculosis H37Rv
ugcgguugcauccauccugcc

SEQ ID NO: 3266407 - RNA, 23 nt, Mycobacterium tuberculosis H37Rv
ugcgguugcgcggaugaggaauu

SEQ ID NO: 3266408 - RNA, 20 nt, Mycobacterium tuberculosis H37Rv
ugcguaaggcugugccggcc

SEQ ID NO: 3266409 - RNA, 15 nt, Mycobacterium tuberculosis H37Rv
ugcguacaacgccgg

SEQ ID NO: 3266410 - RNA, 20 nt, Mycobacterium tuberculosis H37Rv
ugcguagacauuggcuccga

SEQ ID NO: 3266411 - RNA, 19 nt, Mycobacterium tuberculosis H37Rv
ugcguagccgugggccacg

SEQ ID NO: 3266412 - RNA, 23 nt, Mycobacterium tuberculosis H37Rv
ugcguagccgugggccacgauga

SEQ ID NO: 3266413 - RNA, 16 nt, Mycobacterium tuberculosis H37Rv
ugcguccaggccaggg

SEQ ID NO: 3266414 - RNA, 21 nt, Mycobacterium tuberculosis H37Rv
ugcgucgaugcgcugcucacg

SEQ ID NO: 3266415 - RNA, 16 nt, Mycobacterium tuberculosis H37Rv
ugcgucgauugccgcg

SEQ ID NO: 3266416 - RNA, 19 nt, Mycobacterium tuberculosis H37Rv
ugcgucgcggacggugcgg

SEQ ID NO: 3266417 - RNA, 20 nt, Mycobacterium tuberculosis H37Rv
ugcgucgcggacggugcggu

SEQ ID NO: 3266418 - RNA, 14 nt, Mycobacterium tuberculosis H37Rv
ugcgucgucgacga

SEQ ID NO: 3266419 - RNA, 13 nt, Mycobacterium tuberculosis H37Rv
ugcgucgucugca

SEQ ID NO: 3266420 - RNA, 20 nt, Mycobacterium tuberculosis H37Rv
ugcgucguucggagcccuga

SEQ ID NO: 3266421 - RNA, 21 nt, Mycobacterium tuberculosis H37Rv
ugcgucguucggagcccugac

SEQ ID NO: 3266422 - RNA, 13 nt, Mycobacterium tuberculosis H37Rv
ugcgucucgauga

SEQ ID NO: 3266423 - RNA, 12 nt, Mycobacterium tuberculosis H37Rv
ugcgucucggug

SEQ ID NO: 3266424 - RNA, 17 nt, Mycobacterium tuberculosis H37Rv
ugcgucucgguggcugc

SEQ ID NO: 3266425 - RNA, 15 nt, Mycobacterium tuberculosis H37Rv
ugcgucugcucgccc

SEQ ID NO: 3266426 - RNA, 16 nt, Mycobacterium tuberculosis H37Rv
ugcgucugcucgcccu

SEQ ID NO: 3266427 - RNA, 17 nt, Mycobacterium tuberculosis H37Rv
ugcgucugcucggcgca

SEQ ID NO: 3266428 - RNA, 20 nt, Mycobacterium tuberculosis H37Rv
ugcgucugcucggcgcggug

SEQ ID NO: 3266429 - RNA, 17 nt, Mycobacterium tuberculosis H37Rv
ugcgugaugguugcucg

SEQ ID NO: 3266430 - RNA, 21 nt, Mycobacterium tuberculosis H37Rv
ugcugcauguccuccccgagc

SEQ ID NO: 3266431 - RNA, 15 nt, Mycobacterium tuberculosis H37Rv
ugcugccagccaugg

SEQ ID NO: 3266432 - RNA, 16 nt, Mycobacterium tuberculosis H37Rv
ugcugccagccauggc

SEQ ID NO: 3266433 - RNA, 16 nt, Mycobacterium tuberculosis H37Rv
ugcugccauugccgca

SEQ ID NO: 3266434 - RNA, 17 nt, Mycobacterium tuberculosis H37Rv
ugcugcccggcaaccug

SEQ ID NO: 3266435 - RNA, 18 nt, Mycobacterium tuberculosis H37Rv
ugcugccgauagcgcggc

SEQ ID NO: 3266436 - RNA, 15 nt, Mycobacterium tuberculosis H37Rv
ugcugccgcacacgc

SEQ ID NO: 3266437 - RNA, 17 nt, Mycobacterium tuberculosis H37Rv
ugcugccgggggcccga

SEQ ID NO: 3266438 - RNA, 22 nt, Mycobacterium tuberculosis H37Rv
ugcugcgcaacaccaucagcga

SEQ ID NO: 3266439 - RNA, 20 nt, Mycobacterium tuberculosis H37Rv
ugcugcgcaauagcgacagc

SEQ ID NO: 3266440 - RNA, 21 nt, Mycobacterium tuberculosis H37Rv
ugcugcgcgcggcggccgcgg

SEQ ID NO: 3266441 - RNA, 20 nt, Mycobacterium tuberculosis H37Rv
ugcugcgcggugccggccgu

SEQ ID NO: 3266442 - RNA, 14 nt, Mycobacterium tuberculosis H37Rv
ugcugcgcugucuu

SEQ ID NO: 3266443 - RNA, 14 nt, Mycobacterium tuberculosis H37Rv
ugcugcggccaggg

SEQ ID NO: 3266444 - RNA, 16 nt, Mycobacterium tuberculosis H37Rv
ugcugcggcuuucagc

SEQ ID NO: 3266445 - RNA, 17 nt, Mycobacterium tuberculosis H37Rv
ugcugcgggaauccggu

SEQ ID NO: 3266446 - RNA, 15 nt, Mycobacterium tuberculosis H37Rv
ugcugcugccguggc

SEQ ID NO: 3266447 - RNA, 16 nt, Mycobacterium tuberculosis H37Rv
ugcugcuugacuccgc

SEQ ID NO: 3266448 - RNA, 14 nt, Mycobacterium tuberculosis H37Rv
ugcuggaacagguu

SEQ ID NO: 3266449 - RNA, 14 nt, Mycobacterium tuberculosis H37Rv
ugcuggcagcggcc

SEQ ID NO: 3266450 - RNA, 17 nt, Mycobacterium tuberculosis H37Rv
ugcuggcagcggccucc

SEQ ID NO: 3266451 - RNA, 14 nt, Mycobacterium tuberculosis H37Rv
ugcuggccgaaccg

SEQ ID NO: 3266452 - RNA, 15 nt, Mycobacterium tuberculosis H37Rv
ugcuggccgcggcug

SEQ ID NO: 3266453 - RNA, 23 nt, Mycobacterium tuberculosis H37Rv
ugcuggcgcccccgccauugccg

SEQ ID NO: 3266454 - RNA, 19 nt, Mycobacterium tuberculosis H37Rv
ugcuggcgcgccugugcca

SEQ ID NO: 3266455 - RNA, 14 nt, Mycobacterium tuberculosis H37Rv
ugcuggcggccagc

SEQ ID NO: 3266456 - RNA, 17 nt, Mycobacterium tuberculosis H37Rv
ugcugggcccgccagcc

SEQ ID NO: 3266457 - RNA, 18 nt, Mycobacterium tuberculosis H37Rv
ugcuggucagcggcgcga

SEQ ID NO: 3266458 - RNA, 15 nt, Mycobacterium tuberculosis H37Rv
ugcuggucgugccgc

SEQ ID NO: 3266459 - RNA, 23 nt, Mycobacterium tuberculosis H37Rv
ugcuggugggccggaccuuguug

SEQ ID NO: 3266460 - RNA, 17 nt, Mycobacterium tuberculosis H37Rv
ugcuggugucggcucga

SEQ ID NO: 3266461 - RNA, 17 nt, Mycobacterium tuberculosis H37Rv
ugcugucgaagugguag

SEQ ID NO: 3266462 - RNA, 18 nt, Mycobacterium tuberculosis H37Rv
ugcugucgauuucgccgu

SEQ ID NO: 3266463 - RNA, 17 nt, Mycobacterium tuberculosis H37Rv
ugcugucgucuuggcga

SEQ ID NO: 3266464 - RNA, 23 nt, Mycobacterium tuberculosis H37Rv
ugcuguugccagucgaucgcggc

SEQ ID NO: 3266465 - RNA, 16 nt, Mycobacterium tuberculosis H37Rv
ugcuguugcgcggucg

SEQ ID NO: 3266466 - RNA, 12 nt, Mycobacterium tuberculosis H37Rv
ugcuuacgugau

SEQ ID NO: 3266467 - RNA, 12 nt, Mycobacterium tuberculosis H37Rv
ugcuuccagcau

SEQ ID NO: 3266468 - RNA, 20 nt, Mycobacterium tuberculosis H37Rv
ugcuucccggaugccgaccu

SEQ ID NO: 3266469 - RNA, 16 nt, Mycobacterium tuberculosis H37Rv
ugcuucgcgucgaccc

SEQ ID NO: 3266470 - RNA, 14 nt, Mycobacterium tuberculosis H37Rv
ugcuucuucggaca

SEQ ID NO: 3266471 - RNA, 14 nt, Mycobacterium tuberculosis H37Rv
ugcuugcagggcca

SEQ ID NO: 3266472 - RNA, 15 nt, Mycobacterium tuberculosis H37Rv
ugcuugcagggccac

SEQ ID NO: 3266473 - RNA, 22 nt, Mycobacterium tuberculosis H37Rv
ugcuugcagggccacuggccgg

SEQ ID NO: 3266474 - RNA, 14 nt, Mycobacterium tuberculosis H37Rv
ugcuugcgcaucgc

SEQ ID NO: 3266475 - RNA, 19 nt, Mycobacterium tuberculosis H37Rv
ugcuugcgcaucgccgaca

SEQ ID NO: 3266476 - RNA, 15 nt, Mycobacterium tuberculosis H37Rv
ugcuuggucgcccag

SEQ ID NO: 3266477 - RNA, 14 nt, Mycobacterium tuberculosis H37Rv
ugcuuugcuggcgc

SEQ ID NO: 3266478 - RNA, 20 nt, Mycobacterium tuberculosis H37Rv
uggaaaaagcccgacacgaa

SEQ ID NO: 3266479 - RNA, 15 nt, Mycobacterium tuberculosis H37Rv
uggaaaccgggcgaa

SEQ ID NO: 3266480 - RNA, 15 nt, Mycobacterium tuberculosis H37Rv
uggaaacugaugucg

SEQ ID NO: 3266481 - RNA, 20 nt, Mycobacterium tuberculosis H37Rv
uggaacuccguccgccguau

SEQ ID NO: 3266482 - RNA, 16 nt, Mycobacterium tuberculosis H37Rv
uggaacugaugaacca

SEQ ID NO: 3266483 - RNA, 21 nt, Mycobacterium tuberculosis H37Rv
uggaagaguuggggcacaacc

SEQ ID NO: 3266484 - RNA, 16 nt, Mycobacterium tuberculosis H37Rv
uggaagccgaccaccg

SEQ ID NO: 3266485 - RNA, 19 nt, Mycobacterium tuberculosis H37Rv
uggaagccgaccaccgccg

SEQ ID NO: 3266486 - RNA, 22 nt, Mycobacterium tuberculosis H37Rv
uggaagccgacgaccagcagau

SEQ ID NO: 3266487 - RNA, 14 nt, Mycobacterium tuberculosis H37Rv
uggaagccgucucu

SEQ ID NO: 3266488 - RNA, 23 nt, Mycobacterium tuberculosis H37Rv
uggaagcggcgacuacccagcca

SEQ ID NO: 3266489 - RNA, 15 nt, Mycobacterium tuberculosis H37Rv
uggaaggcggccagg

SEQ ID NO: 3266490 - RNA, 16 nt, Mycobacterium tuberculosis H37Rv
uggaaggcggccaggu

SEQ ID NO: 3266491 - RNA, 14 nt, Mycobacterium tuberculosis H37Rv
uggaauacgcugcu

SEQ ID NO: 3266492 - RNA, 12 nt, Mycobacterium tuberculosis H37Rv
uggacaacagca

SEQ ID NO: 3266493 - RNA, 13 nt, Mycobacterium tuberculosis H37Rv
uggacaacagcuu

SEQ ID NO: 3266494 - RNA, 17 nt, Mycobacterium tuberculosis H37Rv
uggacaaccucgucgau

SEQ ID NO: 3266495 - RNA, 12 nt, Mycobacterium tuberculosis H37Rv
uggacaccaacc

SEQ ID NO: 3266496 - RNA, 14 nt, Mycobacterium tuberculosis H37Rv
uggacaccaaccca

SEQ ID NO: 3266497 - RNA, 17 nt, Mycobacterium tuberculosis H37Rv
uggacaccaacccaccc

SEQ ID NO: 3266498 - RNA, 12 nt, Mycobacterium tuberculosis H37Rv
uggacaccaccu

SEQ ID NO: 3266499 - RNA, 16 nt, Mycobacterium tuberculosis H37Rv
uggacaccaccucguc

SEQ ID NO: 3266500 - RNA, 12 nt, Mycobacterium tuberculosis H37Rv
uggacaccagcc

SEQ ID NO: 3266501 - RNA, 16 nt, Mycobacterium tuberculosis H37Rv
uggacaccagccagau

SEQ ID NO: 3266502 - RNA, 21 nt, Mycobacterium tuberculosis H37Rv
uggacaggucgcccaacaccg

SEQ ID NO: 3266503 - RNA, 22 nt, Mycobacterium tuberculosis H37Rv
uggaccaccgccgaagcugcgg

SEQ ID NO: 3266504 - RNA, 18 nt, Mycobacterium tuberculosis H37Rv
uggaccacgugaucgacg

SEQ ID NO: 3266505 - RNA, 20 nt, Mycobacterium tuberculosis H37Rv
uggaccgauuucgccugcgg

SEQ ID NO: 3266506 - RNA, 16 nt, Mycobacterium tuberculosis H37Rv
uggaccgcacugacaa

SEQ ID NO: 3266507 - RNA, 15 nt, Mycobacterium tuberculosis H37Rv
uggaccggugccagc

SEQ ID NO: 3266508 - RNA, 19 nt, Mycobacterium tuberculosis H37Rv
uggacgauacgcgcaccgu

SEQ ID NO: 3266509 - RNA, 20 nt, Mycobacterium tuberculosis H37Rv
uggacgaugaaccgggcagc

SEQ ID NO: 3266510 - RNA, 14 nt, Mycobacterium tuberculosis H37Rv
uggacgcagaguca

SEQ ID NO: 3266511 - RNA, 16 nt, Mycobacterium tuberculosis H37Rv
uggacgcccgaguuga

SEQ ID NO: 3266512 - RNA, 20 nt, Mycobacterium tuberculosis H37Rv
uggacgcccgaguugaagaa

SEQ ID NO: 3266513 - RNA, 22 nt, Mycobacterium tuberculosis H37Rv
uggacgcccgcccgcacgacga

SEQ ID NO: 3266514 - RNA, 15 nt, Mycobacterium tuberculosis H37Rv
uggacgccgccggag

SEQ ID NO: 3266515 - RNA, 15 nt, Mycobacterium tuberculosis H37Rv
uggacgccuugcaca

SEQ ID NO: 3266516 - RNA, 19 nt, Mycobacterium tuberculosis H37Rv
uggacgccuugcacaagcu

SEQ ID NO: 3266517 - RNA, 21 nt, Mycobacterium tuberculosis H37Rv
uggacgccuugcacaagcuga

SEQ ID NO: 3266518 - RNA, 15 nt, Mycobacterium tuberculosis H37Rv
uggacgcgaacagcu

SEQ ID NO: 3266519 - RNA, 18 nt, Mycobacterium tuberculosis H37Rv
uggacgcgaacagcucgu

SEQ ID NO: 3266520 - RNA, 13 nt, Mycobacterium tuberculosis H37Rv
uggacgcgcaugc

SEQ ID NO: 3266521 - RNA, 16 nt, Mycobacterium tuberculosis H37Rv
uggacgcgggccgacc

SEQ ID NO: 3266522 - RNA, 15 nt, Mycobacterium tuberculosis H37Rv
uggacggcagccagc

SEQ ID NO: 3266523 - RNA, 12 nt, Mycobacterium tuberculosis H37Rv
uggacggccucc

SEQ ID NO: 3266524 - RNA, 17 nt, Mycobacterium tuberculosis H37Rv
uggacggccuccaucgc

SEQ ID NO: 3266525 - RNA, 20 nt, Mycobacterium tuberculosis H37Rv
uggacgugucaucacgguca

SEQ ID NO: 3266526 - RNA, 22 nt, Mycobacterium tuberculosis H37Rv
uggacuccggucagcgcggcga

SEQ ID NO: 3266527 - RNA, 23 nt, Mycobacterium tuberculosis H37Rv
uggacugggucgccuccugccgc

SEQ ID NO: 3266528 - RNA, 18 nt, Mycobacterium tuberculosis H37Rv
uggacuucagcaggccca

SEQ ID NO: 3266529 - RNA, 20 nt, Mycobacterium tuberculosis H37Rv
uggagaagauuuucucggug

SEQ ID NO: 3266530 - RNA, 18 nt, Mycobacterium tuberculosis H37Rv
uggagaucacgccgacga

SEQ ID NO: 3266531 - RNA, 15 nt, Mycobacterium tuberculosis H37Rv
uggagaucgccgccg

SEQ ID NO: 3266532 - RNA, 11 nt, Mycobacterium tuberculosis H37Rv
uggagcacagc

SEQ ID NO: 3266533 - RNA, 17 nt, Mycobacterium tuberculosis H37Rv
uggagcacagcacggca

SEQ ID NO: 3266534 - RNA, 16 nt, Mycobacterium tuberculosis H37Rv
uggagccgccaccgag

SEQ ID NO: 3266535 - RNA, 19 nt, Mycobacterium tuberculosis H37Rv
uggagccgccaccgaggcc

SEQ ID NO: 3266536 - RNA, 19 nt, Mycobacterium tuberculosis H37Rv
uggagcgccagccgcugcc

SEQ ID NO: 3266537 - RNA, 24 nt, Mycobacterium tuberculosis H37Rv
uggagcgccagccgcugccacagg

SEQ ID NO: 3266538 - RNA, 21 nt, Mycobacterium tuberculosis H37Rv
uggagcgcgccucgcccagca

SEQ ID NO: 3266539 - RNA, 19 nt, Mycobacterium tuberculosis H37Rv
uggagcucaucgacgagcc

SEQ ID NO: 3266540 - RNA, 19 nt, Mycobacterium tuberculosis H37Rv
uggaggccaccaccuucgg

SEQ ID NO: 3266541 - RNA, 22 nt, Mycobacterium tuberculosis H37Rv
uggagggaaucuccggcuggcc

SEQ ID NO: 3266542 - RNA, 22 nt, Mycobacterium tuberculosis H37Rv
uggaguaggugugcgggaagaa

SEQ ID NO: 3266543 - RNA, 17 nt, Mycobacterium tuberculosis H37Rv
uggaguauccggcagac

SEQ ID NO: 3266544 - RNA, 21 nt, Mycobacterium tuberculosis H37Rv
uggaguauccggcagaccggu

SEQ ID NO: 3266545 - RNA, 15 nt, Mycobacterium tuberculosis H37Rv
uggaguucgcgcugg

SEQ ID NO: 3266546 - RNA, 15 nt, Mycobacterium tuberculosis H37Rv
uggaguucucaucgc

SEQ ID NO: 3266547 - RNA, 18 nt, Mycobacterium tuberculosis H37Rv
uggaguuuccgaagcccg

SEQ ID NO: 3266548 - RNA, 11 nt, Mycobacterium tuberculosis H37Rv
uggaucagcgu

SEQ ID NO: 3266549 - RNA, 22 nt, Mycobacterium tuberculosis H37Rv
uggaucaucccgaccagcagau

SEQ ID NO: 3266550 - RNA, 15 nt, Mycobacterium tuberculosis H37Rv
uggauccagcccgac

SEQ ID NO: 3266551 - RNA, 13 nt, Mycobacterium tuberculosis H37Rv
uggaucgcggugg

SEQ ID NO: 3266552 - RNA, 19 nt, Mycobacterium tuberculosis H37Rv
uggaucgucgcuguggcuu

SEQ ID NO: 3266553 - RNA, 13 nt, Mycobacterium tuberculosis H37Rv
uggaucuucaccu

SEQ ID NO: 3266554 - RNA, 19 nt, Mycobacterium tuberculosis H37Rv
uggaugcgccgcacggcga

SEQ ID NO: 3266555 - RNA, 16 nt, Mycobacterium tuberculosis H37Rv
uggauggcgcucacaa

SEQ ID NO: 3266556 - RNA, 22 nt, Mycobacterium tuberculosis H37Rv
uggauguaguuggcgaccugcg

SEQ ID NO: 3266557 - RNA, 17 nt, Mycobacterium tuberculosis H37Rv
uggaugugggcgcucgc

SEQ ID NO: 3266558 - RNA, 14 nt, Mycobacterium tuberculosis H37Rv
uggauguguaggug

SEQ ID NO: 3266559 - RNA, 15 nt, Mycobacterium tuberculosis H37Rv
uggauucgaucaggc

SEQ ID NO: 3266560 - RNA, 21 nt, Mycobacterium tuberculosis H37Rv
uggauuggcgucagcagcaac

SEQ ID NO: 3266561 - RNA, 24 nt, Mycobacterium tuberculosis H37Rv
uggcaaacgcacccaucgugcuga

SEQ ID NO: 3266562 - RNA, 17 nt, Mycobacterium tuberculosis H37Rv
uggcaacgacacgccgc

SEQ ID NO: 3266563 - RNA, 17 nt, Mycobacterium tuberculosis H37Rv
uggcaagggccgacguc

SEQ ID NO: 3266564 - RNA, 21 nt, Mycobacterium tuberculosis H37Rv
uggcaaucgaggaaggugugc

SEQ ID NO: 3266565 - RNA, 22 nt, Mycobacterium tuberculosis H37Rv
uggcacaagcuggggaacagca

SEQ ID NO: 3266566 - RNA, 21 nt, Mycobacterium tuberculosis H37Rv
uggcaccaccccgaggccgac

SEQ ID NO: 3266567 - RNA, 17 nt, Mycobacterium tuberculosis H37Rv
uggcaccagccggugag

SEQ ID NO: 3266568 - RNA, 20 nt, Mycobacterium tuberculosis H37Rv
uggcacccgcgucgagugcc

SEQ ID NO: 3266569 - RNA, 14 nt, Mycobacterium tuberculosis H37Rv
uggcaccucgcccu

SEQ ID NO: 3266570 - RNA, 20 nt, Mycobacterium tuberculosis H37Rv
uggcacgugaaagccgacca

SEQ ID NO: 3266571 - RNA, 22 nt, Mycobacterium tuberculosis H37Rv
uggcagagccgccguugccgcc

SEQ ID NO: 3266572 - RNA, 20 nt, Mycobacterium tuberculosis H37Rv
uggcagcaaaaacgcugccg

SEQ ID NO: 3266573 - RNA, 18 nt, Mycobacterium tuberculosis H37Rv
uggcagcacaggcuggcg

SEQ ID NO: 3266574 - RNA, 15 nt, Mycobacterium tuberculosis H37Rv
uggcagcacgaccug

SEQ ID NO: 3266575 - RNA, 15 nt, Mycobacterium tuberculosis H37Rv
uggcagccagcggcg

SEQ ID NO: 3266576 - RNA, 21 nt, Mycobacterium tuberculosis H37Rv
uggcagccagcggcgaagguc

SEQ ID NO: 3266577 - RNA, 14 nt, Mycobacterium tuberculosis H37Rv
uggcagccugcugc

SEQ ID NO: 3266578 - RNA, 12 nt, Mycobacterium tuberculosis H37Rv
uggcagcgcacc

SEQ ID NO: 3266579 - RNA, 13 nt, Mycobacterium tuberculosis H37Rv
uggcagcgcaccc

SEQ ID NO: 3266580 - RNA, 19 nt, Mycobacterium tuberculosis H37Rv
uggcagcgccgauggccgc

SEQ ID NO: 3266581 - RNA, 13 nt, Mycobacterium tuberculosis H37Rv
uggcagcgcggcc

SEQ ID NO: 3266582 - RNA, 18 nt, Mycobacterium tuberculosis H37Rv
uggcagcgcggccgggcg

SEQ ID NO: 3266583 - RNA, 20 nt, Mycobacterium tuberculosis H37Rv
uggcagcggccuccgggcca

SEQ ID NO: 3266584 - RNA, 15 nt, Mycobacterium tuberculosis H37Rv
uggcaggcagguugg

SEQ ID NO: 3266585 - RNA, 14 nt, Mycobacterium tuberculosis H37Rv
uggcaggccagcau

SEQ ID NO: 3266586 - RNA, 15 nt, Mycobacterium tuberculosis H37Rv
uggcaggccagcaug

SEQ ID NO: 3266587 - RNA, 15 nt, Mycobacterium tuberculosis H37Rv
uggcaggccggcguc

SEQ ID NO: 3266588 - RNA, 16 nt, Mycobacterium tuberculosis H37Rv
uggcaggugaucccga

SEQ ID NO: 3266589 - RNA, 22 nt, Mycobacterium tuberculosis H37Rv
uggcaggugaucccgaugguca

SEQ ID NO: 3266590 - RNA, 13 nt, Mycobacterium tuberculosis H37Rv
uggcaggugccuu

SEQ ID NO: 3266591 - RNA, 19 nt, Mycobacterium tuberculosis H37Rv
uggcauaaccgcugauagc

SEQ ID NO: 3266592 - RNA, 15 nt, Mycobacterium tuberculosis H37Rv
uggcauccagcagcg

SEQ ID NO: 3266593 - RNA, 17 nt, Mycobacterium tuberculosis H37Rv
uggcauccgccccgccc

SEQ ID NO: 3266594 - RNA, 19 nt, Mycobacterium tuberculosis H37Rv
uggcaucgaacgcccugac

SEQ ID NO: 3266595 - RNA, 17 nt, Mycobacterium tuberculosis H37Rv
uggcaucgcgagccagc

SEQ ID NO: 3266596 - RNA, 18 nt, Mycobacterium tuberculosis H37Rv
uggcaucgcgagccagcu

SEQ ID NO: 3266597 - RNA, 16 nt, Mycobacterium tuberculosis H37Rv
uggcaucggccaucuc

SEQ ID NO: 3266598 - RNA, 14 nt, Mycobacterium tuberculosis H37Rv
uggcaugcaggugg

SEQ ID NO: 3266599 - RNA, 17 nt, Mycobacterium tuberculosis H37Rv
uggccaaaaaccgugau

SEQ ID NO: 3266600 - RNA, 19 nt, Mycobacterium tuberculosis H37Rv
uggccaaacuuucgggaca

SEQ ID NO: 3266601 - RNA, 18 nt, Mycobacterium tuberculosis H37Rv
uggccaaccccauggcca

SEQ ID NO: 3266602 - RNA, 19 nt, Mycobacterium tuberculosis H37Rv
uggccaacucuucagcaag

SEQ ID NO: 3266603 - RNA, 22 nt, Mycobacterium tuberculosis H37Rv
uggccaacucuucagcaagcca

SEQ ID NO: 3266604 - RNA, 13 nt, Mycobacterium tuberculosis H37Rv
uggccaauccggc

SEQ ID NO: 3266605 - RNA, 21 nt, Mycobacterium tuberculosis H37Rv
uggccaauccggcggcgacgu

SEQ ID NO: 3266606 - RNA, 16 nt, Mycobacterium tuberculosis H37Rv
uggccacacagucacg

SEQ ID NO: 3266607 - RNA, 24 nt, Mycobacterium tuberculosis H37Rv
uggccaccaaacgcugcuggcaug

SEQ ID NO: 3266608 - RNA, 16 nt, Mycobacterium tuberculosis H37Rv
uggccaccagcuggcg

SEQ ID NO: 3266609 - RNA, 20 nt, Mycobacterium tuberculosis H37Rv
uggccaccaggggaccgcgg

SEQ ID NO: 3266610 - RNA, 13 nt, Mycobacterium tuberculosis H37Rv
uggccaccaucac

SEQ ID NO: 3266611 - RNA, 13 nt, Mycobacterium tuberculosis H37Rv
uggccacccgcgg

SEQ ID NO: 3266612 - RNA, 22 nt, Mycobacterium tuberculosis H37Rv
uggccacccgcggaauccgcgg

SEQ ID NO: 3266613 - RNA, 13 nt, Mycobacterium tuberculosis H37Rv
uggccaccggcgg

SEQ ID NO: 3266614 - RNA, 21 nt, Mycobacterium tuberculosis H37Rv
uggccaccucgggugugguca

SEQ ID NO: 3266615 - RNA, 18 nt, Mycobacterium tuberculosis H37Rv
uggccacgcccaggcaag

SEQ ID NO: 3266616 - RNA, 21 nt, Mycobacterium tuberculosis H37Rv
uggccacucacauuggccagg

SEQ ID NO: 3266617 - RNA, 21 nt, Mycobacterium tuberculosis H37Rv
uggccacucccagccaacccg

SEQ ID NO: 3266618 - RNA, 23 nt, Mycobacterium tuberculosis H37Rv
uggccagaccgcgcgcauaccua

SEQ ID NO: 3266619 - RNA, 14 nt, Mycobacterium tuberculosis H37Rv
uggccagcacaccg

SEQ ID NO: 3266620 - RNA, 12 nt, Mycobacterium tuberculosis H37Rv
uggccagcacca

SEQ ID NO: 3266621 - RNA, 17 nt, Mycobacterium tuberculosis H37Rv
uggccagcagcagcgcu

SEQ ID NO: 3266622 - RNA, 13 nt, Mycobacterium tuberculosis H37Rv
uggccagcagccg

SEQ ID NO: 3266623 - RNA, 22 nt, Mycobacterium tuberculosis H37Rv
uggccgggcuggcgacgacgac

SEQ ID NO: 3266624 - RNA, 14 nt, Mycobacterium tuberculosis H37Rv
uggccgggucgucu

SEQ ID NO: 3266625 - RNA, 19 nt, Mycobacterium tuberculosis H37Rv
uggccgggucgucuuccag

SEQ ID NO: 3266626 - RNA, 22 nt, Mycobacterium tuberculosis H37Rv
uggccggguuccagcggcaccg

SEQ ID NO: 3266627 - RNA, 17 nt, Mycobacterium tuberculosis H37Rv
uggccggugggccgccc

SEQ ID NO: 3266628 - RNA, 15 nt, Mycobacterium tuberculosis H37Rv
uggccguaacgcgga

SEQ ID NO: 3266629 - RNA, 19 nt, Mycobacterium tuberculosis H37Rv
uggccguaacgcggaucgg

SEQ ID NO: 3266630 - RNA, 20 nt, Mycobacterium tuberculosis H37Rv
uggccguaccggugaucgug

SEQ ID NO: 3266631 - RNA, 21 nt, Mycobacterium tuberculosis H37Rv
uggccguagucggcgaugcgc

SEQ ID NO: 3266632 - RNA, 17 nt, Mycobacterium tuberculosis H37Rv
uggccgucagccaggug

SEQ ID NO: 3266633 - RNA, 19 nt, Mycobacterium tuberculosis H37Rv
uggccguccgguccgucgg

SEQ ID NO: 3266634 - RNA, 17 nt, Mycobacterium tuberculosis H37Rv
uggccgucgggugcagc

SEQ ID NO: 3266635 - RNA, 18 nt, Mycobacterium tuberculosis H37Rv
uggccgugcccgaaggaa

SEQ ID NO: 3266636 - RNA, 20 nt, Mycobacterium tuberculosis H37Rv
uggccguucggcgcccgcuc

SEQ ID NO: 3266637 - RNA, 17 nt, Mycobacterium tuberculosis H37Rv
uggccguuggcggcggu

SEQ ID NO: 3266638 - RNA, 19 nt, Mycobacterium tuberculosis H37Rv
uggccuagcaugaggcccg

SEQ ID NO: 3266639 - RNA, 21 nt, Mycobacterium tuberculosis H37Rv
uggccucaacgccagcugcuu

SEQ ID NO: 3266640 - RNA, 13 nt, Mycobacterium tuberculosis H37Rv
uggccugcaacgc

SEQ ID NO: 3266641 - RNA, 17 nt, Mycobacterium tuberculosis H37Rv
uggccugcagcgcgacc

SEQ ID NO: 3266642 - RNA, 23 nt, Mycobacterium tuberculosis H37Rv
uggccugcagcgcgacccguagc

SEQ ID NO: 3266643 - RNA, 20 nt, Mycobacterium tuberculosis H37Rv
uggccugccauaggcccacg

SEQ ID NO: 3266644 - RNA, 13 nt, Mycobacterium tuberculosis H37Rv
uggccugcccagc

SEQ ID NO: 3266645 - RNA, 16 nt, Mycobacterium tuberculosis H37Rv
uggccugcccagcacc

SEQ ID NO: 3266646 - RNA, 21 nt, Mycobacterium tuberculosis H37Rv
uggccugcccagcaccaccgc

SEQ ID NO: 3266647 - RNA, 22 nt, Mycobacterium tuberculosis H37Rv
uggccugcggcaggugcgguca

SEQ ID NO: 3266648 - RNA, 13 nt, Mycobacterium tuberculosis H37Rv
uggccugcucaac

SEQ ID NO: 3266649 - RNA, 22 nt, Mycobacterium tuberculosis H37Rv
uggccugucgaagauccagcgc

SEQ ID NO: 3266650 - RNA, 23 nt, Mycobacterium tuberculosis H37Rv
uggccuguuuguuugcugcggcg

SEQ ID NO: 3266651 - RNA, 21 nt, Mycobacterium tuberculosis H37Rv
uggccuugacagcuuucuugg

SEQ ID NO: 3266652 - RNA, 17 nt, Mycobacterium tuberculosis H37Rv
uggccuugcugcgcgau

SEQ ID NO: 3266653 - RNA, 15 nt, Mycobacterium tuberculosis H37Rv
uggcgaaauccgcga

SEQ ID NO: 3266654 - RNA, 21 nt, Mycobacterium tuberculosis H37Rv
uggcgaacagugacgccacga

SEQ ID NO: 3266655 - RNA, 16 nt, Mycobacterium tuberculosis H37Rv
uggcgaacccggucaa

SEQ ID NO: 3266656 - RNA, 13 nt, Mycobacterium tuberculosis H37Rv
uggcgaaccgcag

SEQ ID NO: 3266657 - RNA, 22 nt, Mycobacterium tuberculosis H37Rv
uggcgaaccgcagacccucguc

SEQ ID NO: 3266658 - RNA, 14 nt, Mycobacterium tuberculosis H37Rv
uggcgaagcccgac

SEQ ID NO: 3266659 - RNA, 18 nt, Mycobacterium tuberculosis H37Rv
uggcgaaggacaacagcc

SEQ ID NO: 3266660 - RNA, 18 nt, Mycobacterium tuberculosis H37Rv
uggcgaaggccgcaauac

SEQ ID NO: 3266661 - RNA, 22 nt, Mycobacterium tuberculosis H37Rv
uggcgaaucuuugguagucugc

SEQ ID NO: 3266662 - RNA, 13 nt, Mycobacterium tuberculosis H37Rv
uggcgaccaccgc

SEQ ID NO: 3266663 - RNA, 15 nt, Mycobacterium tuberculosis H37Rv
uggcgaccaccgcgu

SEQ ID NO: 3266664 - RNA, 16 nt, Mycobacterium tuberculosis H37Rv
uggcgaccaccgcguc

SEQ ID NO: 3266665 - RNA, 12 nt, Mycobacterium tuberculosis H37Rv
uggcgaccuggu

SEQ ID NO: 3266666 - RNA, 16 nt, Mycobacterium tuberculosis H37Rv
uggcgacgaacgccgu

SEQ ID NO: 3266667 - RNA, 18 nt, Mycobacterium tuberculosis H37Rv
uggcgacgacgacaccgc

SEQ ID NO: 3266668 - RNA, 14 nt, Mycobacterium tuberculosis H37Rv
uggcgacggugcgc

SEQ ID NO: 3266669 - RNA, 20 nt, Mycobacterium tuberculosis H37Rv
uggcgacggugcgcuggaug

SEQ ID NO: 3266670 - RNA, 17 nt, Mycobacterium tuberculosis H37Rv
uggcgacguauuucgcc

SEQ ID NO: 3266671 - RNA, 18 nt, Mycobacterium tuberculosis H37Rv
uggcgacgucgcggguga

SEQ ID NO: 3266672 - RNA, 20 nt, Mycobacterium tuberculosis H37Rv
uggcgacucgugucugccuc

SEQ ID NO: 3266673 - RNA, 19 nt, Mycobacterium tuberculosis H37Rv
uggcgagccacggcacugg

SEQ ID NO: 3266674 - RNA, 14 nt, Mycobacterium tuberculosis H37Rv
uggcgagcuggcgu

SEQ ID NO: 3266675 - RNA, 12 nt, Mycobacterium tuberculosis H37Rv
uggcgaggcagc

SEQ ID NO: 3266676 - RNA, 14 nt, Mycobacterium tuberculosis H37Rv
uggcgaggcagcac

SEQ ID NO: 3266677 - RNA, 16 nt, Mycobacterium tuberculosis H37Rv
uggcgaggcagcaccc

SEQ ID NO: 3266678 - RNA, 15 nt, Mycobacterium tuberculosis H37Rv
uggcgagguggucac

SEQ ID NO: 3266679 - RNA, 18 nt, Mycobacterium tuberculosis H37Rv
uggcgagguugcgccgac

SEQ ID NO: 3266680 - RNA, 15 nt, Mycobacterium tuberculosis H37Rv
uggcgaucagcagcc

SEQ ID NO: 3266681 - RNA, 18 nt, Mycobacterium tuberculosis H37Rv
uggcgaucaugagcagca

SEQ ID NO: 3266682 - RNA, 15 nt, Mycobacterium tuberculosis H37Rv
uggcgaucgcgacga

SEQ ID NO: 3266683 - RNA, 15 nt, Mycobacterium tuberculosis H37Rv
uggcgaucggguuga

SEQ ID NO: 3266684 - RNA, 12 nt, Mycobacterium tuberculosis H37Rv
uggcgaucucga

SEQ ID NO: 3266685 - RNA, 16 nt, Mycobacterium tuberculosis H37Rv
uggcgaucucuaccag

SEQ ID NO: 3266686 - RNA, 19 nt, Mycobacterium tuberculosis H37Rv
uggcgaucuggucgccugc

SEQ ID NO: 3266687 - RNA, 17 nt, Mycobacterium tuberculosis H37Rv
uggcgaugacgaucgcg

SEQ ID NO: 3266688 - RNA, 14 nt, Mycobacterium tuberculosis H37Rv
uggcgaugccgaga

SEQ ID NO: 3266689 - RNA, 14 nt, Mycobacterium tuberculosis H37Rv
uggcgauguagccu

SEQ ID NO: 3266690 - RNA, 20 nt, Mycobacterium tuberculosis H37Rv
uggcgauuucggcgccuggc

SEQ ID NO: 3266691 - RNA, 19 nt, Mycobacterium tuberculosis H37Rv
uggcgcaacccccgaagac

SEQ ID NO: 3266692 - RNA, 13 nt, Mycobacterium tuberculosis H37Rv
uggcgcaccggcg

SEQ ID NO: 3266693 - RNA, 19 nt, Mycobacterium tuberculosis H37Rv
uggcgcagccugccgauga

SEQ ID NO: 3266694 - RNA, 15 nt, Mycobacterium tuberculosis H37Rv
uggcgccacggcagc

SEQ ID NO: 3266695 - RNA, 12 nt, Mycobacterium tuberculosis H37Rv
uggcgccagguc

SEQ ID NO: 3266696 - RNA, 16 nt, Mycobacterium tuberculosis H37Rv
uggcgccaggucggcg

SEQ ID NO: 3266697 - RNA, 21 nt, Mycobacterium tuberculosis H37Rv
uggcgccaggucggcgggcgc

SEQ ID NO: 3266698 - RNA, 21 nt, Mycobacterium tuberculosis H37Rv
uggcgccaguucggcgggagc

SEQ ID NO: 3266699 - RNA, 21 nt, Mycobacterium tuberculosis H37Rv
uggcgccaguucggcgggcgc

SEQ ID NO: 3266700 - RNA, 22 nt, Mycobacterium tuberculosis H37Rv
uggcgccaugaagccgggcgcu

SEQ ID NO: 3266701 - RNA, 19 nt, Mycobacterium tuberculosis H37Rv
uggcgcccccgacgacggc

SEQ ID NO: 3266702 - RNA, 13 nt, Mycobacterium tuberculosis H37Rv
uggcgcccgucuc

SEQ ID NO: 3266703 - RNA, 14 nt, Mycobacterium tuberculosis H37Rv
uggcgcccgugccg

SEQ ID NO: 3266704 - RNA, 18 nt, Mycobacterium tuberculosis H37Rv
uggcgcccuugccggcga

SEQ ID NO: 3266705 - RNA, 23 nt, Mycobacterium tuberculosis H37Rv
uggcgccgaaaaggucggggaac

SEQ ID NO: 3266706 - RNA, 13 nt, Mycobacterium tuberculosis H37Rv
uggcgccgacagg

SEQ ID NO: 3266707 - RNA, 15 nt, Mycobacterium tuberculosis H37Rv
uggcgccgaccugga

SEQ ID NO: 3266708 - RNA, 15 nt, Mycobacterium tuberculosis H37Rv
uggcgccgccgacca

SEQ ID NO: 3266709 - RNA, 13 nt, Mycobacterium tuberculosis H37Rv
uggcgccgcgccg

SEQ ID NO: 3266710 - RNA, 23 nt, Mycobacterium tuberculosis H37Rv
uggcgccgcgccgauuccaccgc

SEQ ID NO: 3266711 - RNA, 18 nt, Mycobacterium tuberculosis H37Rv
uggcgccggggccgccga

SEQ ID NO: 3266712 - RNA, 13 nt, Mycobacterium tuberculosis H37Rv
uggcgccggggcg

SEQ ID NO: 3266713 - RNA, 19 nt, Mycobacterium tuberculosis H37Rv
uggcgccggggcgcagguu

SEQ ID NO: 3266714 - RNA, 20 nt, Mycobacterium tuberculosis H37Rv
uggcgccggggcgcagguug

SEQ ID NO: 3266715 - RNA, 22 nt, Mycobacterium tuberculosis H37Rv
uggcgcgaacgucagugccccg

SEQ ID NO: 3266716 - RNA, 17 nt, Mycobacterium tuberculosis H37Rv
uggcgcgaccuccgcga

SEQ ID NO: 3266717 - RNA, 16 nt, Mycobacterium tuberculosis H37Rv
uggcgcgaucggugcc

SEQ ID NO: 3266718 - RNA, 21 nt, Mycobacterium tuberculosis H37Rv
uggcgcgccgcaucggcgaac

SEQ ID NO: 3266719 - RNA, 19 nt, Mycobacterium tuberculosis H37Rv
uggcuccggugaaccggga

SEQ ID NO: 3266720 - RNA, 13 nt, Mycobacterium tuberculosis H37Rv
uggcucgccgaac

SEQ ID NO: 3266721 - RNA, 16 nt, Mycobacterium tuberculosis H37Rv
uggcucgcucugcgcg

SEQ ID NO: 3266722 - RNA, 15 nt, Mycobacterium tuberculosis H37Rv
uggcucggcgcagca

SEQ ID NO: 3266723 - RNA, 22 nt, Mycobacterium tuberculosis H37Rv
uggcucuguagcgucgcaccca

SEQ ID NO: 3266724 - RNA, 19 nt, Mycobacterium tuberculosis H37Rv
uggcugaaauaagggccgg

SEQ ID NO: 3266725 - RNA, 16 nt, Mycobacterium tuberculosis H37Rv
uggcugacgauuucca

SEQ ID NO: 3266726 - RNA, 22 nt, Mycobacterium tuberculosis H37Rv
uggcugacgauuuccaugcugg

SEQ ID NO: 3266727 - RNA, 18 nt, Mycobacterium tuberculosis H37Rv
uggcugagcccgccgcga

SEQ ID NO: 3266728 - RNA, 13 nt, Mycobacterium tuberculosis H37Rv
uggcugaucccgg

SEQ ID NO: 3266729 - RNA, 14 nt, Mycobacterium tuberculosis H37Rv
uggcugaucccggc

SEQ ID NO: 3266730 - RNA, 16 nt, Mycobacterium tuberculosis H37Rv
uggcuggcaugccggc

SEQ ID NO: 3266731 - RNA, 15 nt, Mycobacterium tuberculosis H37Rv
uggcuggcggcgacc

SEQ ID NO: 3266732 - RNA, 14 nt, Mycobacterium tuberculosis H37Rv
uggcugggucguca

SEQ ID NO: 3266733 - RNA, 20 nt, Mycobacterium tuberculosis H37Rv
uggcuguaaaaaugcuucgc

SEQ ID NO: 3266734 - RNA, 18 nt, Mycobacterium tuberculosis H37Rv
uggcuucgaagcgaucgc

SEQ ID NO: 3266735 - RNA, 17 nt, Mycobacterium tuberculosis H37Rv
uggcuugacgcccgggc

SEQ ID NO: 3266736 - RNA, 15 nt, Mycobacterium tuberculosis H37Rv
uggcuuggugcccaa

SEQ ID NO: 3266737 - RNA, 14 nt, Mycobacterium tuberculosis H37Rv
uggcuugugcccaa

SEQ ID NO: 3266738 - RNA, 15 nt, Mycobacterium tuberculosis H37Rv
uggcuuucgguaugc

SEQ ID NO: 3266739 - RNA, 16 nt, Mycobacterium tuberculosis H37Rv
uggcuuuugcgccgaa

SEQ ID NO: 3266740 - RNA, 14 nt, Mycobacterium tuberculosis H37Rv
ugggaaaucccgac

SEQ ID NO: 3266741 - RNA, 23 nt, Mycobacterium tuberculosis H37Rv
ugggacaacgugccgaacgccag

SEQ ID NO: 3266742 - RNA, 18 nt, Mycobacterium tuberculosis H37Rv
ugggacaggucggcaucc

SEQ ID NO: 3266743 - RNA, 14 nt, Mycobacterium tuberculosis H37Rv
ugggacuggcguga

SEQ ID NO: 3266744 - RNA, 11 nt, Mycobacterium tuberculosis H37Rv
ugggagcagcc

SEQ ID NO: 3266745 - RNA, 23 nt, Mycobacterium tuberculosis H37Rv
ugggagcccggcggcccgauaga

SEQ ID NO: 3266746 - RNA, 18 nt, Mycobacterium tuberculosis H37Rv
ugggagcuacccgggcca

SEQ ID NO: 3266747 - RNA, 15 nt, Mycobacterium tuberculosis H37Rv
ugggagcuacgguac

SEQ ID NO: 3266748 - RNA, 14 nt, Mycobacterium tuberculosis H37Rv
ugggaggcggcgcc

SEQ ID NO: 3266749 - RNA, 21 nt, Mycobacterium tuberculosis H37Rv
ugggagguggcgcggggccgc

SEQ ID NO: 3266750 - RNA, 13 nt, Mycobacterium tuberculosis H37Rv
ugggagucgucgu

SEQ ID NO: 3266751 - RNA, 21 nt, Mycobacterium tuberculosis H37Rv
ugggauagcgcgguuggcuga

SEQ ID NO: 3266752 - RNA, 19 nt, Mycobacterium tuberculosis H37Rv
ugggaucaggcugggcaga

SEQ ID NO: 3266753 - RNA, 17 nt, Mycobacterium tuberculosis H37Rv
ugggaucccagcgcagc

SEQ ID NO: 3266754 - RNA, 19 nt, Mycobacterium tuberculosis H37Rv
ugggaucccagcgcagcgg

SEQ ID NO: 3266755 - RNA, 18 nt, Mycobacterium tuberculosis H37Rv
ugggaucggauuuuccgc

SEQ ID NO: 3266756 - RNA, 19 nt, Mycobacterium tuberculosis H37Rv
ugggauugaagcuggccac

SEQ ID NO: 3266757 - RNA, 20 nt, Mycobacterium tuberculosis H37Rv
ugggcaccacccgauuggcc

SEQ ID NO: 3266758 - RNA, 12 nt, Mycobacterium tuberculosis H37Rv
ugggcaccggcg

SEQ ID NO: 3266759 - RNA, 16 nt, Mycobacterium tuberculosis H37Rv
ugggcacggccgucga

SEQ ID NO: 3266760 - RNA, 16 nt, Mycobacterium tuberculosis H37Rv
ugggcacguugugauc

SEQ ID NO: 3266761 - RNA, 14 nt, Mycobacterium tuberculosis H37Rv
ugggcacucaucga

SEQ ID NO: 3266762 - RNA, 19 nt, Mycobacterium tuberculosis H37Rv
ugggcacuugcccgucggc

SEQ ID NO: 3266763 - RNA, 19 nt, Mycobacterium tuberculosis H37Rv
ugggcagauauugccugcc

SEQ ID NO: 3266764 - RNA, 22 nt, Mycobacterium tuberculosis H37Rv
ugggcagauauugccugccacc

SEQ ID NO: 3266765 - RNA, 15 nt, Mycobacterium tuberculosis H37Rv
ugggcagcaggccca

SEQ ID NO: 3266766 - RNA, 21 nt, Mycobacterium tuberculosis H37Rv
ugggcagcgcgcccgacaccc

SEQ ID NO: 3266767 - RNA, 12 nt, Mycobacterium tuberculosis H37Rv
ugggcaucaccg

SEQ ID NO: 3266768 - RNA, 15 nt, Mycobacterium tuberculosis H37Rv
ugggcaucaccgccg

SEQ ID NO: 3266769 - RNA, 22 nt, Mycobacterium tuberculosis H37Rv
ugggcaucacuucauggggcua

SEQ ID NO: 3266770 - RNA, 15 nt, Mycobacterium tuberculosis H37Rv
ugggcaucaggccgc

SEQ ID NO: 3266771 - RNA, 23 nt, Mycobacterium tuberculosis H37Rv
ugggcaugcggauucgcgcuguc

SEQ ID NO: 3266772 - RNA, 16 nt, Mycobacterium tuberculosis H37Rv
ugggcauugcggcgcg

SEQ ID NO: 3266773 - RNA, 16 nt, Mycobacterium tuberculosis H37Rv
ugggccaccggcgccg

SEQ ID NO: 3266774 - RNA, 18 nt, Mycobacterium tuberculosis H37Rv
ugggccacuugaugcucg

SEQ ID NO: 3266775 - RNA, 13 nt, Mycobacterium tuberculosis H37Rv
ugggccagcagca

SEQ ID NO: 3266776 - RNA, 13 nt, Mycobacterium tuberculosis H37Rv
ugggccagcuccu

SEQ ID NO: 3266777 - RNA, 17 nt, Mycobacterium tuberculosis H37Rv
ugggccagugaaaccac

SEQ ID NO: 3266778 - RNA, 21 nt, Mycobacterium tuberculosis H37Rv
ugggccaugcuaggaccacca

SEQ ID NO: 3266779 - RNA, 15 nt, Mycobacterium tuberculosis H37Rv
ugggcccagcggccg

SEQ ID NO: 3266780 - RNA, 18 nt, Mycobacterium tuberculosis H37Rv
ugggcccagcggccgcga

SEQ ID NO: 3266781 - RNA, 21 nt, Mycobacterium tuberculosis H37Rv
ugggcccccaaucagugcagc

SEQ ID NO: 3266782 - RNA, 16 nt, Mycobacterium tuberculosis H37Rv
ugggccccgaucccga

SEQ ID NO: 3266783 - RNA, 15 nt, Mycobacterium tuberculosis H37Rv
ugggcccgccagccc

SEQ ID NO: 3266784 - RNA, 16 nt, Mycobacterium tuberculosis H37Rv
ugggcccgccagccca

SEQ ID NO: 3266785 - RNA, 21 nt, Mycobacterium tuberculosis H37Rv
ugggcccugcacagcagcguc

SEQ ID NO: 3266786 - RNA, 18 nt, Mycobacterium tuberculosis H37Rv
ugggcccuucacuguugc

SEQ ID NO: 3266787 - RNA, 14 nt, Mycobacterium tuberculosis H37Rv
ugggccgagcgcgc

SEQ ID NO: 3266788 - RNA, 19 nt, Mycobacterium tuberculosis H37Rv
ugggccgcccaaagaaaug

SEQ ID NO: 3266789 - RNA, 17 nt, Mycobacterium tuberculosis H37Rv
ugggccggucgaggccc

SEQ ID NO: 3266790 - RNA, 13 nt, Mycobacterium tuberculosis H37Rv
ugggccgguuccu

SEQ ID NO: 3266791 - RNA, 23 nt, Mycobacterium tuberculosis H37Rv
ugggccucaaguugguucaccgc

SEQ ID NO: 3266792 - RNA, 23 nt, Mycobacterium tuberculosis H37Rv
ugggccuccaccgcguccaggug

SEQ ID NO: 3266793 - RNA, 15 nt, Mycobacterium tuberculosis H37Rv
ugggccucgaucagc

SEQ ID NO: 3266794 - RNA, 22 nt, Mycobacterium tuberculosis H37Rv
ugggccucgaucagcgccggau

SEQ ID NO: 3266795 - RNA, 15 nt, Mycobacterium tuberculosis H37Rv
ugggccugccagucc

SEQ ID NO: 3266796 - RNA, 14 nt, Mycobacterium tuberculosis H37Rv
ugggcgacggcgau

SEQ ID NO: 3266797 - RNA, 23 nt, Mycobacterium tuberculosis H37Rv
ugggcgagaaguccgggccccuu

SEQ ID NO: 3266798 - RNA, 13 nt, Mycobacterium tuberculosis H37Rv
ugggcgagaccgc

SEQ ID NO: 3266799 - RNA, 23 nt, Mycobacterium tuberculosis H37Rv
ugggcgagaccgcgagcagcaca

SEQ ID NO: 3266800 - RNA, 23 nt, Mycobacterium tuberculosis H37Rv
ugggcgagcagacgcagaaucgc

SEQ ID NO: 3266801 - RNA, 20 nt, Mycobacterium tuberculosis H37Rv
ugggcgaggugagguugacc

SEQ ID NO: 3266802 - RNA, 19 nt, Mycobacterium tuberculosis H37Rv
ugggcgauucugcgucugc

SEQ ID NO: 3266803 - RNA, 20 nt, Mycobacterium tuberculosis H37Rv
ugggcgauucugcgucugcu

SEQ ID NO: 3266804 - RNA, 20 nt, Mycobacterium tuberculosis H37Rv
ugggcgauucugugucugcu

SEQ ID NO: 3266805 - RNA, 23 nt, Mycobacterium tuberculosis H37Rv
ugggcgauucugugucugcucgc

SEQ ID NO: 3266806 - RNA, 18 nt, Mycobacterium tuberculosis H37Rv
ugggcgauuuugcgucug

SEQ ID NO: 3266807 - RNA, 19 nt, Mycobacterium tuberculosis H37Rv
ugggcgauuuugcgucugc

SEQ ID NO: 3266808 - RNA, 20 nt, Mycobacterium tuberculosis H37Rv
ugggcgauuuugcgucugcu

SEQ ID NO: 3266809 - RNA, 14 nt, Mycobacterium tuberculosis H37Rv
ugggcgccacagcc

SEQ ID NO: 3266810 - RNA, 17 nt, Mycobacterium tuberculosis H37Rv
ugggcgcccgcgguccg

SEQ ID NO: 3266811 - RNA, 19 nt, Mycobacterium tuberculosis H37Rv
ugggcgccgacaccggcug

SEQ ID NO: 3266812 - RNA, 16 nt, Mycobacterium tuberculosis H37Rv
ugggcgccgucgccgu

SEQ ID NO: 3266813 - RNA, 15 nt, Mycobacterium tuberculosis H37Rv
ugggcgcgcucaucg

SEQ ID NO: 3266814 - RNA, 22 nt, Mycobacterium tuberculosis H37Rv
ugggcgcgcucaucgaccgggg

SEQ ID NO: 3266815 - RNA, 17 nt, Mycobacterium tuberculosis H37Rv
ugguacuuucacgcucg

SEQ ID NO: 3266816 - RNA, 19 nt, Mycobacterium tuberculosis H37Rv
ugguaggagaucaccucgg

SEQ ID NO: 3266817 - RNA, 16 nt, Mycobacterium tuberculosis H37Rv
ugguaggccggugcgu

SEQ ID NO: 3266818 - RNA, 22 nt, Mycobacterium tuberculosis H37Rv
ugguagguuacgccgggguaga

SEQ ID NO: 3266819 - RNA, 23 nt, Mycobacterium tuberculosis H37Rv
ugguaugcccgccguagaccagc

SEQ ID NO: 3266820 - RNA, 16 nt, Mycobacterium tuberculosis H37Rv
ugguauggguccucga

SEQ ID NO: 3266821 - RNA, 15 nt, Mycobacterium tuberculosis H37Rv
uggucaacggcagau

SEQ ID NO: 3266822 - RNA, 17 nt, Mycobacterium tuberculosis H37Rv
uggucaaugcgcuggcg

SEQ ID NO: 3266823 - RNA, 13 nt, Mycobacterium tuberculosis H37Rv
uggucaccagcca

SEQ ID NO: 3266824 - RNA, 23 nt, Mycobacterium tuberculosis H37Rv
uggucaccaggccgaaauccaga

SEQ ID NO: 3266825 - RNA, 15 nt, Mycobacterium tuberculosis H37Rv
uggucaccgucugca

SEQ ID NO: 3266826 - RNA, 20 nt, Mycobacterium tuberculosis H37Rv
uggucacgcagucgggcagc

SEQ ID NO: 3266827 - RNA, 23 nt, Mycobacterium tuberculosis H37Rv
uggucacggcgucgacuggccgu

SEQ ID NO: 3266828 - RNA, 21 nt, Mycobacterium tuberculosis H37Rv
uggucacgguucgcccgucgc

SEQ ID NO: 3266829 - RNA, 20 nt, Mycobacterium tuberculosis H37Rv
uggucagccgcggcggcagc

SEQ ID NO: 3266830 - RNA, 24 nt, Mycobacterium tuberculosis H37Rv
uggucagccgcggcggcagcaccc

SEQ ID NO: 3266831 - RNA, 14 nt, Mycobacterium tuberculosis H37Rv
uggucagccgguga

SEQ ID NO: 3266832 - RNA, 16 nt, Mycobacterium tuberculosis H37Rv
uggucagcugcugcca

SEQ ID NO: 3266833 - RNA, 16 nt, Mycobacterium tuberculosis H37Rv
uggucaggaacacucg

SEQ ID NO: 3266834 - RNA, 24 nt, Mycobacterium tuberculosis H37Rv
uggucaggaacacucgcgaauaac

SEQ ID NO: 3266835 - RNA, 16 nt, Mycobacterium tuberculosis H37Rv
uggucaggcuggaggu

SEQ ID NO: 3266836 - RNA, 18 nt, Mycobacterium tuberculosis H37Rv
uggucagucaccaaccac

SEQ ID NO: 3266837 - RNA, 20 nt, Mycobacterium tuberculosis H37Rv
uggucagugugaacuguccc

SEQ ID NO: 3266838 - RNA, 16 nt, Mycobacterium tuberculosis H37Rv
uggucauccagccagc

SEQ ID NO: 3266839 - RNA, 16 nt, Mycobacterium tuberculosis H37Rv
ugguccaaccgggccg

SEQ ID NO: 3266840 - RNA, 18 nt, Mycobacterium tuberculosis H37Rv
ugguccaggcggugacgu

SEQ ID NO: 3266841 - RNA, 16 nt, Mycobacterium tuberculosis H37Rv
ugguccauaccugaau

SEQ ID NO: 3266842 - RNA, 16 nt, Mycobacterium tuberculosis H37Rv
ugguccaucgcgcugc

SEQ ID NO: 3266843 - RNA, 15 nt, Mycobacterium tuberculosis H37Rv
uggucccacaccucc

SEQ ID NO: 3266844 - RNA, 19 nt, Mycobacterium tuberculosis H37Rv
uggucccguucgcccgccc

SEQ ID NO: 3266845 - RNA, 15 nt, Mycobacterium tuberculosis H37Rv
ugguccgaccagcgg

SEQ ID NO: 3266846 - RNA, 17 nt, Mycobacterium tuberculosis H37Rv
ugguccgaccagcggcc

SEQ ID NO: 3266847 - RNA, 15 nt, Mycobacterium tuberculosis H37Rv
ugguccggccgcgga

SEQ ID NO: 3266848 - RNA, 23 nt, Mycobacterium tuberculosis H37Rv
ugguccugauguucugcgggggu

SEQ ID NO: 3266849 - RNA, 20 nt, Mycobacterium tuberculosis H37Rv
ugguccuuguugugguggag

SEQ ID NO: 3266850 - RNA, 23 nt, Mycobacterium tuberculosis H37Rv
uggucgaaacgguacgccgccgc

SEQ ID NO: 3266851 - RNA, 21 nt, Mycobacterium tuberculosis H37Rv
uggucgaacagcgaaccggcu

SEQ ID NO: 3266852 - RNA, 18 nt, Mycobacterium tuberculosis H37Rv
uggucgacgaaucugcgg

SEQ ID NO: 3266853 - RNA, 16 nt, Mycobacterium tuberculosis H37Rv
uggucgacgccgagac

SEQ ID NO: 3266854 - RNA, 22 nt, Mycobacterium tuberculosis H37Rv
uggucgacgccgagaccgccgc

SEQ ID NO: 3266855 - RNA, 23 nt, Mycobacterium tuberculosis H37Rv
uggucgagcagugccucggcgau

SEQ ID NO: 3266856 - RNA, 15 nt, Mycobacterium tuberculosis H37Rv
uggucgagggcggcg

SEQ ID NO: 3266857 - RNA, 14 nt, Mycobacterium tuberculosis H37Rv
uggucgagugcgau

SEQ ID NO: 3266858 - RNA, 17 nt, Mycobacterium tuberculosis H37Rv
uggucgaguugaagaau

SEQ ID NO: 3266859 - RNA, 23 nt, Mycobacterium tuberculosis H37Rv
uggucgaugaaccaaucgcacgc

SEQ ID NO: 3266860 - RNA, 18 nt, Mycobacterium tuberculosis H37Rv
uggucgauggcguacagc

SEQ ID NO: 3266861 - RNA, 22 nt, Mycobacterium tuberculosis H37Rv
uggucgaugugaucaccgauga

SEQ ID NO: 3266862 - RNA, 19 nt, Mycobacterium tuberculosis H37Rv
uggucgauucgucgaaggg

SEQ ID NO: 3266863 - RNA, 18 nt, Mycobacterium tuberculosis H37Rv
uggucgcaggauucccag

SEQ ID NO: 3266864 - RNA, 20 nt, Mycobacterium tuberculosis H37Rv
uggucgcaggauucccaguc

SEQ ID NO: 3266865 - RNA, 22 nt, Mycobacterium tuberculosis H37Rv
uggucgccgccuuacgcaccga

SEQ ID NO: 3266866 - RNA, 18 nt, Mycobacterium tuberculosis H37Rv
uggucgccgcggcagcgu

SEQ ID NO: 3266867 - RNA, 18 nt, Mycobacterium tuberculosis H37Rv
uggucgccgcuuucuugg

SEQ ID NO: 3266868 - RNA, 19 nt, Mycobacterium tuberculosis H37Rv
uggucgcgaccgaccgcau

SEQ ID NO: 3266869 - RNA, 13 nt, Mycobacterium tuberculosis H37Rv
uggucgcggcugc

SEQ ID NO: 3266870 - RNA, 15 nt, Mycobacterium tuberculosis H37Rv
uggucgcggcugcca

SEQ ID NO: 3266871 - RNA, 19 nt, Mycobacterium tuberculosis H37Rv
uggucgcgguggcggcggu

SEQ ID NO: 3266872 - RNA, 14 nt, Mycobacterium tuberculosis H37Rv
uggucgcugcugcc

SEQ ID NO: 3266873 - RNA, 22 nt, Mycobacterium tuberculosis H37Rv
uggucgcugcugcgaucgccgc

SEQ ID NO: 3266874 - RNA, 21 nt, Mycobacterium tuberculosis H37Rv
uggucggagaccagcgucuuc

SEQ ID NO: 3266875 - RNA, 18 nt, Mycobacterium tuberculosis H37Rv
uggucggagguggggugg

SEQ ID NO: 3266876 - RNA, 14 nt, Mycobacterium tuberculosis H37Rv
uggucggccgcaag

SEQ ID NO: 3266877 - RNA, 21 nt, Mycobacterium tuberculosis H37Rv
uggucggcgagcgcccgcagc

SEQ ID NO: 3266878 - RNA, 19 nt, Mycobacterium tuberculosis H37Rv
uggucggcggccucggucu

SEQ ID NO: 3266879 - RNA, 20 nt, Mycobacterium tuberculosis H37Rv
uggucggcggccucggucug

SEQ ID NO: 3266880 - RNA, 18 nt, Mycobacterium tuberculosis H37Rv
uggucggcggugaacgac

SEQ ID NO: 3266881 - RNA, 18 nt, Mycobacterium tuberculosis H37Rv
uggucggugggguauucg

SEQ ID NO: 3266882 - RNA, 14 nt, Mycobacterium tuberculosis H37Rv
uggucguaggugac

SEQ ID NO: 3266883 - RNA, 17 nt, Mycobacterium tuberculosis H37Rv
uggucgugggccaccac

SEQ ID NO: 3266884 - RNA, 14 nt, Mycobacterium tuberculosis H37Rv
uggucuacccgcgg

SEQ ID NO: 3266885 - RNA, 16 nt, Mycobacterium tuberculosis H37Rv
uggucucuagcaaagc

SEQ ID NO: 3266886 - RNA, 20 nt, Mycobacterium tuberculosis H37Rv
uggucucuagcaaagccagc

SEQ ID NO: 3266887 - RNA, 12 nt, Mycobacterium tuberculosis H37Rv
uggucugccaaa

SEQ ID NO: 3266888 - RNA, 14 nt, Mycobacterium tuberculosis H37Rv
uggucugcgcggug

SEQ ID NO: 3266889 - RNA, 16 nt, Mycobacterium tuberculosis H37Rv
uggucuggacugcagc

SEQ ID NO: 3266890 - RNA, 17 nt, Mycobacterium tuberculosis H37Rv
uggugaagucggugccg

SEQ ID NO: 3266891 - RNA, 23 nt, Mycobacterium tuberculosis H37Rv
uggugacagagcggguucgacgu

SEQ ID NO: 3266892 - RNA, 16 nt, Mycobacterium tuberculosis H37Rv
uggugaccgacgcgga

SEQ ID NO: 3266893 - RNA, 14 nt, Mycobacterium tuberculosis H37Rv
uggugaccugacgc

SEQ ID NO: 3266894 - RNA, 21 nt, Mycobacterium tuberculosis H37Rv
uggugacguugucgccaaccc

SEQ ID NO: 3266895 - RNA, 22 nt, Mycobacterium tuberculosis H37Rv
uggugaguaccaauccaggcca

SEQ ID NO: 3266896 - RNA, 15 nt, Mycobacterium tuberculosis H37Rv
uggugagugcgucuc

SEQ ID NO: 3266897 - RNA, 17 nt, Mycobacterium tuberculosis H37Rv
uggugagugcgucucgg

SEQ ID NO: 3266898 - RNA, 16 nt, Mycobacterium tuberculosis H37Rv
uggugauccgagacca

SEQ ID NO: 3266899 - RNA, 17 nt, Mycobacterium tuberculosis H37Rv
uggugauccggucuccg

SEQ ID NO: 3266900 - RNA, 18 nt, Mycobacterium tuberculosis H37Rv
uggugaugcaacucggca

SEQ ID NO: 3266901 - RNA, 16 nt, Mycobacterium tuberculosis H37Rv
uggugauggccgacgu

SEQ ID NO: 3266902 - RNA, 13 nt, Mycobacterium tuberculosis H37Rv
uggugcagaccac

SEQ ID NO: 3266903 - RNA, 10 nt, Mycobacterium tuberculosis H37Rv
uggugccaac

SEQ ID NO: 3266904 - RNA, 13 nt, Mycobacterium tuberculosis H37Rv
uggugccaaccug

SEQ ID NO: 3266905 - RNA, 15 nt, Mycobacterium tuberculosis H37Rv
uggugccaaccuggg

SEQ ID NO: 3266906 - RNA, 22 nt, Mycobacterium tuberculosis H37Rv
uggugccaacgggcagguaggu

SEQ ID NO: 3266907 - RNA, 14 nt, Mycobacterium tuberculosis H37Rv
uggugccaacugcg

SEQ ID NO: 3266908 - RNA, 19 nt, Mycobacterium tuberculosis H37Rv
uggugccaggucggcgggc

SEQ ID NO: 3266909 - RNA, 19 nt, Mycobacterium tuberculosis H37Rv
uggugcccaaggcagaccc

SEQ ID NO: 3266910 - RNA, 22 nt, Mycobacterium tuberculosis H37Rv
uggugcccaaggcagaccccca

SEQ ID NO: 3266911 - RNA, 12 nt, Mycobacterium tuberculosis H37Rv
uguagcacaccg

SEQ ID NO: 3266912 - RNA, 13 nt, Mycobacterium tuberculosis H37Rv
uguagcagcgcgg

SEQ ID NO: 3266913 - RNA, 14 nt, Mycobacterium tuberculosis H37Rv
uguagcagcgcggc

SEQ ID NO: 3266914 - RNA, 22 nt, Mycobacterium tuberculosis H37Rv
uguagccagcggcugcccaucg

SEQ ID NO: 3266915 - RNA, 14 nt, Mycobacterium tuberculosis H37Rv
uguagcccaucggc

SEQ ID NO: 3266916 - RNA, 14 nt, Mycobacterium tuberculosis H37Rv
uguagccgagcacg

SEQ ID NO: 3266917 - RNA, 20 nt, Mycobacterium tuberculosis H37Rv
uguagccgagcacgggcaga

SEQ ID NO: 3266918 - RNA, 15 nt, Mycobacterium tuberculosis H37Rv
uguaggccgggccgg

SEQ ID NO: 3266919 - RNA, 17 nt, Mycobacterium tuberculosis H37Rv
uguaggccucggcagca

SEQ ID NO: 3266920 - RNA, 15 nt, Mycobacterium tuberculosis H37Rv
uguagggccggugac

SEQ ID NO: 3266921 - RNA, 14 nt, Mycobacterium tuberculosis H37Rv
uguaggggcgccuu

SEQ ID NO: 3266922 - RNA, 14 nt, Mycobacterium tuberculosis H37Rv
uguaguacagcgca

SEQ ID NO: 3266923 - RNA, 15 nt, Mycobacterium tuberculosis H37Rv
uguaguacagcgcaa

SEQ ID NO: 3266924 - RNA, 15 nt, Mycobacterium tuberculosis H37Rv
uguaugcauccacug

SEQ ID NO: 3266925 - RNA, 20 nt, Mycobacterium tuberculosis H37Rv
uguaugcguuacgccgcgag

SEQ ID NO: 3266926 - RNA, 13 nt, Mycobacterium tuberculosis H37Rv
ugucaaaggugca

SEQ ID NO: 3266927 - RNA, 23 nt, Mycobacterium tuberculosis H37Rv
ugucaagcgaugucccaucgcgu

SEQ ID NO: 3266928 - RNA, 19 nt, Mycobacterium tuberculosis H37Rv
ugucaaguucgccagcaac

SEQ ID NO: 3266929 - RNA, 15 nt, Mycobacterium tuberculosis H37Rv
ugucaaugacaccgg

SEQ ID NO: 3266930 - RNA, 23 nt, Mycobacterium tuberculosis H37Rv
ugucacaacgcgugaccagggcc

SEQ ID NO: 3266931 - RNA, 17 nt, Mycobacterium tuberculosis H37Rv
ugucacccaauggagcc

SEQ ID NO: 3266932 - RNA, 15 nt, Mycobacterium tuberculosis H37Rv
ugucacccucgggcg

SEQ ID NO: 3266933 - RNA, 20 nt, Mycobacterium tuberculosis H37Rv
ugucaccggcgucgcugccu

SEQ ID NO: 3266934 - RNA, 16 nt, Mycobacterium tuberculosis H37Rv
ugucacguaacgccgc

SEQ ID NO: 3266935 - RNA, 14 nt, Mycobacterium tuberculosis H37Rv
ugucacugggccgg

SEQ ID NO: 3266936 - RNA, 23 nt, Mycobacterium tuberculosis H37Rv
ugucagcaagaucggcagcgugg

SEQ ID NO: 3266937 - RNA, 18 nt, Mycobacterium tuberculosis H37Rv
ugucagccgguuccgcaa

SEQ ID NO: 3266938 - RNA, 14 nt, Mycobacterium tuberculosis H37Rv
ugucagccgucgcc

SEQ ID NO: 3266939 - RNA, 17 nt, Mycobacterium tuberculosis H37Rv
ugucagcgcugagccgc

SEQ ID NO: 3266940 - RNA, 21 nt, Mycobacterium tuberculosis H37Rv
ugucagcgcugagccgcucau

SEQ ID NO: 3266941 - RNA, 11 nt, Mycobacterium tuberculosis H37Rv
ugucagcggcc

SEQ ID NO: 3266942 - RNA, 19 nt, Mycobacterium tuberculosis H37Rv
ugucagcuaauaccugcgg

SEQ ID NO: 3266943 - RNA, 18 nt, Mycobacterium tuberculosis H37Rv
ugucagugaucaccaacc

SEQ ID NO: 3266944 - RNA, 20 nt, Mycobacterium tuberculosis H37Rv
ugucagugaucaccaacccg

SEQ ID NO: 3266945 - RNA, 14 nt, Mycobacterium tuberculosis H37Rv
ugucaguucccgcu

SEQ ID NO: 3266946 - RNA, 21 nt, Mycobacterium tuberculosis H37Rv
ugucauugcugcccaauggcg

SEQ ID NO: 3266947 - RNA, 14 nt, Mycobacterium tuberculosis H37Rv
uguccaagcccucg

SEQ ID NO: 3266948 - RNA, 18 nt, Mycobacterium tuberculosis H37Rv
uguccaccagcguguagc

SEQ ID NO: 3266949 - RNA, 17 nt, Mycobacterium tuberculosis H37Rv
uguccaccgccaccacg

SEQ ID NO: 3266950 - RNA, 19 nt, Mycobacterium tuberculosis H37Rv
uguccaccgcggcgucgcc

SEQ ID NO: 3266951 - RNA, 17 nt, Mycobacterium tuberculosis H37Rv
uguccacguccagcccg

SEQ ID NO: 3266952 - RNA, 22 nt, Mycobacterium tuberculosis H37Rv
uguccagaacgguggcgcggug

SEQ ID NO: 3266953 - RNA, 18 nt, Mycobacterium tuberculosis H37Rv
uguccagaauccaggugg

SEQ ID NO: 3266954 - RNA, 13 nt, Mycobacterium tuberculosis H37Rv
uguccagcaugcc

SEQ ID NO: 3266955 - RNA, 15 nt, Mycobacterium tuberculosis H37Rv
uguccagcaugcccg

SEQ ID NO: 3266956 - RNA, 17 nt, Mycobacterium tuberculosis H37Rv
uguccagcaugcccgcc

SEQ ID NO: 3266957 - RNA, 16 nt, Mycobacterium tuberculosis H37Rv
uguccagccaggcgau

SEQ ID NO: 3266958 - RNA, 22 nt, Mycobacterium tuberculosis H37Rv
uguccagcgcgacguccaccag

SEQ ID NO: 3266959 - RNA, 16 nt, Mycobacterium tuberculosis H37Rv
uguccaggguggucag

SEQ ID NO: 3266960 - RNA, 20 nt, Mycobacterium tuberculosis H37Rv
uguccauauagaucacugcu

SEQ ID NO: 3266961 - RNA, 15 nt, Mycobacterium tuberculosis H37Rv
ugucccaacgccacu

SEQ ID NO: 3266962 - RNA, 11 nt, Mycobacterium tuberculosis H37Rv
uguccccgacg

SEQ ID NO: 3266963 - RNA, 23 nt, Mycobacterium tuberculosis H37Rv
uguccccggcggcagcauauccg

SEQ ID NO: 3266964 - RNA, 17 nt, Mycobacterium tuberculosis H37Rv
ugucccgaugguggccg

SEQ ID NO: 3266965 - RNA, 18 nt, Mycobacterium tuberculosis H37Rv
ugucccgcaugcacguca

SEQ ID NO: 3266966 - RNA, 21 nt, Mycobacterium tuberculosis H37Rv
ugucccgcgggccagcaccuc

SEQ ID NO: 3266967 - RNA, 23 nt, Mycobacterium tuberculosis H37Rv
ugucccggaccaucgccugcaag

SEQ ID NO: 3266968 - RNA, 19 nt, Mycobacterium tuberculosis H37Rv
uguccgacgcaccaacgcg

SEQ ID NO: 3266969 - RNA, 21 nt, Mycobacterium tuberculosis H37Rv
uguccgacgccaccgccacca

SEQ ID NO: 3266970 - RNA, 16 nt, Mycobacterium tuberculosis H37Rv
uguccgauaacccggu

SEQ ID NO: 3266971 - RNA, 23 nt, Mycobacterium tuberculosis H37Rv
uguccgauaccgcgaugauggcg

SEQ ID NO: 3266972 - RNA, 14 nt, Mycobacterium tuberculosis H37Rv
uguccgcagcaccg

SEQ ID NO: 3266973 - RNA, 17 nt, Mycobacterium tuberculosis H37Rv
uguccgcagcggugcgc

SEQ ID NO: 3266974 - RNA, 14 nt, Mycobacterium tuberculosis H37Rv
uguccgccgacgua

SEQ ID NO: 3266975 - RNA, 21 nt, Mycobacterium tuberculosis H37Rv
uguccggcgacgcguagcacg

SEQ ID NO: 3266976 - RNA, 12 nt, Mycobacterium tuberculosis H37Rv
uguccgggaccg

SEQ ID NO: 3266977 - RNA, 15 nt, Mycobacterium tuberculosis H37Rv
uguccgucgcguccg

SEQ ID NO: 3266978 - RNA, 15 nt, Mycobacterium tuberculosis H37Rv
uguccuacuuuucca

SEQ ID NO: 3266979 - RNA, 14 nt, Mycobacterium tuberculosis H37Rv
uguccucccauccc

SEQ ID NO: 3266980 - RNA, 12 nt, Mycobacterium tuberculosis H37Rv
uguccucgaugc

SEQ ID NO: 3266981 - RNA, 22 nt, Mycobacterium tuberculosis H37Rv
uguccuggcccgauaaaugccg

SEQ ID NO: 3266982 - RNA, 23 nt, Mycobacterium tuberculosis H37Rv
uguccuuauuggacugcagcgug

SEQ ID NO: 3266983 - RNA, 21 nt, Mycobacterium tuberculosis H37Rv
uguccuugagagauuucuuga

SEQ ID NO: 3266984 - RNA, 12 nt, Mycobacterium tuberculosis H37Rv
uguccuuugcca

SEQ ID NO: 3266985 - RNA, 12 nt, Mycobacterium tuberculosis H37Rv
ugucgaacuggu

SEQ ID NO: 3266986 - RNA, 15 nt, Mycobacterium tuberculosis H37Rv
ugucgaagaaccggc

SEQ ID NO: 3266987 - RNA, 19 nt, Mycobacterium tuberculosis H37Rv
ugucgaagaauaugccgau

SEQ ID NO: 3266988 - RNA, 13 nt, Mycobacterium tuberculosis H37Rv
ugucgacaucggc

SEQ ID NO: 3266989 - RNA, 22 nt, Mycobacterium tuberculosis H37Rv
ugucgacgacaacgaugucacc

SEQ ID NO: 3266990 - RNA, 14 nt, Mycobacterium tuberculosis H37Rv
ugucgacggccacc

SEQ ID NO: 3266991 - RNA, 21 nt, Mycobacterium tuberculosis H37Rv
ugucgacuugugacggucguc

SEQ ID NO: 3266992 - RNA, 16 nt, Mycobacterium tuberculosis H37Rv
ugucgaguugaauggc

SEQ ID NO: 3266993 - RNA, 19 nt, Mycobacterium tuberculosis H37Rv
ugucgauagcccgccaccc

SEQ ID NO: 3266994 - RNA, 16 nt, Mycobacterium tuberculosis H37Rv
ugucgaucaccugcag

SEQ ID NO: 3266995 - RNA, 15 nt, Mycobacterium tuberculosis H37Rv
ugucgaucagcgcga

SEQ ID NO: 3266996 - RNA, 18 nt, Mycobacterium tuberculosis H37Rv
ugucgcaacgcaucgaug

SEQ ID NO: 3266997 - RNA, 16 nt, Mycobacterium tuberculosis H37Rv
ugucgcacucagucug

SEQ ID NO: 3266998 - RNA, 15 nt, Mycobacterium tuberculosis H37Rv
ugucgccaacccggu

SEQ ID NO: 3266999 - RNA, 19 nt, Mycobacterium tuberculosis H37Rv
ugucgccagggagcgcagc

SEQ ID NO: 3267000 - RNA, 19 nt, Mycobacterium tuberculosis H37Rv
ugucgcccucgaucgccac

SEQ ID NO: 3267001 - RNA, 16 nt, Mycobacterium tuberculosis H37Rv
ugucgccgaucaccgc

SEQ ID NO: 3267002 - RNA, 18 nt, Mycobacterium tuberculosis H37Rv
ugucgccgccgcgacuga

SEQ ID NO: 3267003 - RNA, 21 nt, Mycobacterium tuberculosis H37Rv
ugucgccgccgcgacugacga

SEQ ID NO: 3267004 - RNA, 16 nt, Mycobacterium tuberculosis H37Rv
ugucgccgccguugcc

SEQ ID NO: 3267005 - RNA, 18 nt, Mycobacterium tuberculosis H37Rv
ugucgccgucgcggcacg

SEQ ID NO: 3267006 - RNA, 22 nt, Mycobacterium tuberculosis H37Rv
ugucgccuucuuggcaggugcc

SEQ ID NO: 3267007 - RNA, 23 nt, Mycobacterium tuberculosis H37Rv
uguucgugccggcguugccgaaa

SEQ ID NO: 3267008 - RNA, 12 nt, Mycobacterium tuberculosis H37Rv
uguucugcacgu

SEQ ID NO: 3267009 - RNA, 18 nt, Mycobacterium tuberculosis H37Rv
uguucuggauacccagcg

SEQ ID NO: 3267010 - RNA, 22 nt, Mycobacterium tuberculosis H37Rv
uguucuuggccacccccgucag

SEQ ID NO: 3267011 - RNA, 14 nt, Mycobacterium tuberculosis H37Rv
uguucuuggucacc

SEQ ID NO: 3267012 - RNA, 15 nt, Mycobacterium tuberculosis H37Rv
uguucuuggugacca

SEQ ID NO: 3267013 - RNA, 15 nt, Mycobacterium tuberculosis H37Rv
uguugaagaagcccg

SEQ ID NO: 3267014 - RNA, 16 nt, Mycobacterium tuberculosis H37Rv
uguugacgcccgaguu

SEQ ID NO: 3267015 - RNA, 18 nt, Mycobacterium tuberculosis H37Rv
uguugaggccggugaacg

SEQ ID NO: 3267016 - RNA, 15 nt, Mycobacterium tuberculosis H37Rv
uguugagggugcccg

SEQ ID NO: 3267017 - RNA, 18 nt, Mycobacterium tuberculosis H37Rv
uguugauugaccugcugg

SEQ ID NO: 3267018 - RNA, 14 nt, Mycobacterium tuberculosis H37Rv
uguugcaucgccgc

SEQ ID NO: 3267019 - RNA, 22 nt, Mycobacterium tuberculosis H37Rv
uguugcccaauucgacugcaac

SEQ ID NO: 3267020 - RNA, 15 nt, Mycobacterium tuberculosis H37Rv
uguugccccggucgg

SEQ ID NO: 3267021 - RNA, 21 nt, Mycobacterium tuberculosis H37Rv
uguugccccggucggcgacgu

SEQ ID NO: 3267022 - RNA, 22 nt, Mycobacterium tuberculosis H37Rv
uguugcccugcaacccggucgg

SEQ ID NO: 3267023 - RNA, 20 nt, Mycobacterium tuberculosis H37Rv
uguugcccuugggacugcgg

SEQ ID NO: 3267024 - RNA, 14 nt, Mycobacterium tuberculosis H37Rv
uguugcgcugcggc

SEQ ID NO: 3267025 - RNA, 18 nt, Mycobacterium tuberculosis H37Rv
uguugcggcugaccuccc

SEQ ID NO: 3267026 - RNA, 14 nt, Mycobacterium tuberculosis H37Rv
uguugcugcugccg

SEQ ID NO: 3267027 - RNA, 16 nt, Mycobacterium tuberculosis H37Rv
uguuggcaugccgccc

SEQ ID NO: 3267028 - RNA, 16 nt, Mycobacterium tuberculosis H37Rv
uguuggccaccaaacc

SEQ ID NO: 3267029 - RNA, 18 nt, Mycobacterium tuberculosis H37Rv
uguuggccauguccacca

SEQ ID NO: 3267030 - RNA, 21 nt, Mycobacterium tuberculosis H37Rv
uguuggccguaccggugaucg

SEQ ID NO: 3267031 - RNA, 17 nt, Mycobacterium tuberculosis H37Rv
uguuggccugcaacgcc

SEQ ID NO: 3267032 - RNA, 16 nt, Mycobacterium tuberculosis H37Rv
uguuggcguggaucuu

SEQ ID NO: 3267033 - RNA, 19 nt, Mycobacterium tuberculosis H37Rv
uguuggcguggaucuuggc

SEQ ID NO: 3267034 - RNA, 23 nt, Mycobacterium tuberculosis H37Rv
uguugguggauucgaucaggccu

SEQ ID NO: 3267035 - RNA, 19 nt, Mycobacterium tuberculosis H37Rv
uguuggugugcucggccaa

SEQ ID NO: 3267036 - RNA, 18 nt, Mycobacterium tuberculosis H37Rv
uguuguacggcccgcauc

SEQ ID NO: 3267037 - RNA, 12 nt, Mycobacterium tuberculosis H37Rv
uguugucgauca

SEQ ID NO: 3267038 - RNA, 15 nt, Mycobacterium tuberculosis H37Rv
uguugucggugucgg

SEQ ID NO: 3267039 - RNA, 18 nt, Mycobacterium tuberculosis H37Rv
uguugucgucgagcgcgc

SEQ ID NO: 3267040 - RNA, 19 nt, Mycobacterium tuberculosis H37Rv
uguugugagauuggcagac

SEQ ID NO: 3267041 - RNA, 13 nt, Mycobacterium tuberculosis H37Rv
uguuguugaagcc

SEQ ID NO: 3267042 - RNA, 12 nt, Mycobacterium tuberculosis H37Rv
uguuguuugaga

SEQ ID NO: 3267043 - RNA, 24 nt, Mycobacterium tuberculosis H37Rv
uguuugccggcuuugagccgcucg

SEQ ID NO: 3267044 - RNA, 13 nt, Mycobacterium tuberculosis H37Rv
uguuuggugguuu

SEQ ID NO: 3267045 - RNA, 20 nt, Mycobacterium tuberculosis H37Rv
uuaacacccugggcaaacug

SEQ ID NO: 3267046 - RNA, 17 nt, Mycobacterium tuberculosis H37Rv
uuaacuacggugcccug

SEQ ID NO: 3267047 - RNA, 22 nt, Mycobacterium tuberculosis H37Rv
uuaagcgaacccgagccgccgu

SEQ ID NO: 3267048 - RNA, 17 nt, Mycobacterium tuberculosis H37Rv
uuacaugucacacccac

SEQ ID NO: 3267049 - RNA, 14 nt, Mycobacterium tuberculosis H37Rv
uuaccaccgucucc

SEQ ID NO: 3267050 - RNA, 17 nt, Mycobacterium tuberculosis H37Rv
uuacccaucgccacacc

SEQ ID NO: 3267051 - RNA, 19 nt, Mycobacterium tuberculosis H37Rv
uuacccaucgccacaccca

SEQ ID NO: 3267052 - RNA, 13 nt, Mycobacterium tuberculosis H37Rv
uuaccgacaccgu

SEQ ID NO: 3267053 - RNA, 15 nt, Mycobacterium tuberculosis H37Rv
uuaccgauuggcccg

SEQ ID NO: 3267054 - RNA, 17 nt, Mycobacterium tuberculosis H37Rv
uuaccgccguugccgcc

SEQ ID NO: 3267055 - RNA, 11 nt, Mycobacterium tuberculosis H37Rv
uuaccggugac

SEQ ID NO: 3267056 - RNA, 15 nt, Mycobacterium tuberculosis H37Rv
uuacgcaccgaggcc

SEQ ID NO: 3267057 - RNA, 13 nt, Mycobacterium tuberculosis H37Rv
uuagacuggcagg

SEQ ID NO: 3267058 - RNA, 21 nt, Mycobacterium tuberculosis H37Rv
uuagcacaucgccggcgucga

SEQ ID NO: 3267059 - RNA, 19 nt, Mycobacterium tuberculosis H37Rv
uuagcaccaguucccuaca

SEQ ID NO: 3267060 - RNA, 21 nt, Mycobacterium tuberculosis H37Rv
uuagcccgauggugccgaccc

SEQ ID NO: 3267061 - RNA, 18 nt, Mycobacterium tuberculosis H37Rv
uuaggccgccagccggcg

SEQ ID NO: 3267062 - RNA, 17 nt, Mycobacterium tuberculosis H37Rv
uuagucgccgcaguccg

SEQ ID NO: 3267063 - RNA, 17 nt, Mycobacterium tuberculosis H37Rv
uuaguuucguccccaga

SEQ ID NO: 3267064 - RNA, 15 nt, Mycobacterium tuberculosis H37Rv
uuauccggccaguga

SEQ ID NO: 3267065 - RNA, 14 nt, Mycobacterium tuberculosis H37Rv
uuaucgaagcccga

SEQ ID NO: 3267066 - RNA, 12 nt, Mycobacterium tuberculosis H37Rv
uuaugccaggcg

SEQ ID NO: 3267067 - RNA, 16 nt, Mycobacterium tuberculosis H37Rv
uuaugcgacugcucgc

SEQ ID NO: 3267068 - RNA, 22 nt, Mycobacterium tuberculosis H37Rv
uucaauaauggcaaccagcuuc

SEQ ID NO: 3267069 - RNA, 17 nt, Mycobacterium tuberculosis H37Rv
uucaccacccuguuguu

SEQ ID NO: 3267070 - RNA, 22 nt, Mycobacterium tuberculosis H37Rv
uucaccacccuguuguugcccc

SEQ ID NO: 3267071 - RNA, 14 nt, Mycobacterium tuberculosis H37Rv
uucaccacgaucgc

SEQ ID NO: 3267072 - RNA, 22 nt, Mycobacterium tuberculosis H37Rv
uucaccacucggucguugccgc

SEQ ID NO: 3267073 - RNA, 16 nt, Mycobacterium tuberculosis H37Rv
uucaccaguccaaucu

SEQ ID NO: 3267074 - RNA, 16 nt, Mycobacterium tuberculosis H37Rv
uucaccgccuugguca

SEQ ID NO: 3267075 - RNA, 14 nt, Mycobacterium tuberculosis H37Rv
uucaccucggcgac

SEQ ID NO: 3267076 - RNA, 14 nt, Mycobacterium tuberculosis H37Rv
uucacgacgccgag

SEQ ID NO: 3267077 - RNA, 16 nt, Mycobacterium tuberculosis H37Rv
uucacgcaccacaaac

SEQ ID NO: 3267078 - RNA, 16 nt, Mycobacterium tuberculosis H37Rv
uucacgccagucccac

SEQ ID NO: 3267079 - RNA, 13 nt, Mycobacterium tuberculosis H37Rv
uucacucacgacg

SEQ ID NO: 3267080 - RNA, 17 nt, Mycobacterium tuberculosis H37Rv
uucacucacgacgccgu

SEQ ID NO: 3267081 - RNA, 21 nt, Mycobacterium tuberculosis H37Rv
uucacucguugaccggccgga

SEQ ID NO: 3267082 - RNA, 14 nt, Mycobacterium tuberculosis H37Rv
uucacuggucuccc

SEQ ID NO: 3267083 - RNA, 22 nt, Mycobacterium tuberculosis H37Rv
uucacuuccgggcagcugggca

SEQ ID NO: 3267084 - RNA, 21 nt, Mycobacterium tuberculosis H37Rv
uucagcacccaccgaagcgaa

SEQ ID NO: 3267085 - RNA, 16 nt, Mycobacterium tuberculosis H37Rv
uucagcaccggaucga

SEQ ID NO: 3267086 - RNA, 20 nt, Mycobacterium tuberculosis H37Rv
uucagcacggugaucagcag

SEQ ID NO: 3267087 - RNA, 20 nt, Mycobacterium tuberculosis H37Rv
uucagcgcauuucggaucuc

SEQ ID NO: 3267088 - RNA, 17 nt, Mycobacterium tuberculosis H37Rv
uucagcugcgccaggaa

SEQ ID NO: 3267089 - RNA, 15 nt, Mycobacterium tuberculosis H37Rv
uucaggaugccagga

SEQ ID NO: 3267090 - RNA, 17 nt, Mycobacterium tuberculosis H37Rv
uucaggcccugccgacg

SEQ ID NO: 3267091 - RNA, 20 nt, Mycobacterium tuberculosis H37Rv
uucagggcgucgaacucauc

SEQ ID NO: 3267092 - RNA, 13 nt, Mycobacterium tuberculosis H37Rv
uucagggugcuga

SEQ ID NO: 3267093 - RNA, 21 nt, Mycobacterium tuberculosis H37Rv
uucaggucggggucagaucca

SEQ ID NO: 3267094 - RNA, 17 nt, Mycobacterium tuberculosis H37Rv
uucagguuaagugucgg

SEQ ID NO: 3267095 - RNA, 16 nt, Mycobacterium tuberculosis H37Rv
uucaguuccaccgcgc

SEQ ID NO: 3267096 - RNA, 16 nt, Mycobacterium tuberculosis H37Rv
uucaucacgccgccgg

SEQ ID NO: 3267097 - RNA, 22 nt, Mycobacterium tuberculosis H37Rv
uucaucaucugcgaaaagccuu

SEQ ID NO: 3267098 - RNA, 19 nt, Mycobacterium tuberculosis H37Rv
uucauccguguuucgaaca

SEQ ID NO: 3267099 - RNA, 16 nt, Mycobacterium tuberculosis H37Rv
uucaucgccucgagga

SEQ ID NO: 3267100 - RNA, 19 nt, Mycobacterium tuberculosis H37Rv
uucauggggcuauggcgca

SEQ ID NO: 3267101 - RNA, 16 nt, Mycobacterium tuberculosis H37Rv
uucauguggcgcgggu

SEQ ID NO: 3267102 - RNA, 20 nt, Mycobacterium tuberculosis H37Rv
uuccaaaaucaucugcacau

SEQ ID NO: 3267103 - RNA, 14 nt, Mycobacterium tuberculosis H37Rv
uucgcgcacgucgg

SEQ ID NO: 3267104 - RNA, 21 nt, Mycobacterium tuberculosis H37Rv
uucgcgccgcgaggcaccgac

SEQ ID NO: 3267105 - RNA, 17 nt, Mycobacterium tuberculosis H37Rv
uucgcggccgucuucgg

SEQ ID NO: 3267106 - RNA, 20 nt, Mycobacterium tuberculosis H37Rv
uucgcgggauccaggcccag

SEQ ID NO: 3267107 - RNA, 16 nt, Mycobacterium tuberculosis H37Rv
uucgcgggugcgcugc

SEQ ID NO: 3267108 - RNA, 18 nt, Mycobacterium tuberculosis H37Rv
uucgcgguagccgcggcc

SEQ ID NO: 3267109 - RNA, 16 nt, Mycobacterium tuberculosis H37Rv
uucgcgucgccgauga

SEQ ID NO: 3267110 - RNA, 15 nt, Mycobacterium tuberculosis H37Rv
uucgcuaccuucuug

SEQ ID NO: 3267111 - RNA, 13 nt, Mycobacterium tuberculosis H37Rv
uucgcucaucugu

SEQ ID NO: 3267112 - RNA, 18 nt, Mycobacterium tuberculosis H37Rv
uucgcugacggccaugga

SEQ ID NO: 3267113 - RNA, 16 nt, Mycobacterium tuberculosis H37Rv
uucggaccggcucuuu

SEQ ID NO: 3267114 - RNA, 16 nt, Mycobacterium tuberculosis H37Rv
uucggcagccaugcgg

SEQ ID NO: 3267115 - RNA, 18 nt, Mycobacterium tuberculosis H37Rv
uucggcauaacccuggcc

SEQ ID NO: 3267116 - RNA, 17 nt, Mycobacterium tuberculosis H37Rv
uucggccaacccgggcc

SEQ ID NO: 3267117 - RNA, 21 nt, Mycobacterium tuberculosis H37Rv
uucggccauguagccguugcc

SEQ ID NO: 3267118 - RNA, 23 nt, Mycobacterium tuberculosis H37Rv
uucggccgucauggcccgaucga

SEQ ID NO: 3267119 - RNA, 21 nt, Mycobacterium tuberculosis H37Rv
uucggccugagcggccaucgg

SEQ ID NO: 3267120 - RNA, 12 nt, Mycobacterium tuberculosis H37Rv
uucggccugugc

SEQ ID NO: 3267121 - RNA, 18 nt, Mycobacterium tuberculosis H37Rv
uucggccugugcgggcag

SEQ ID NO: 3267122 - RNA, 22 nt, Mycobacterium tuberculosis H37Rv
uucggcgaccggccggccgcgg

SEQ ID NO: 3267123 - RNA, 19 nt, Mycobacterium tuberculosis H37Rv
uucggcgagcgcaucggcc

SEQ ID NO: 3267124 - RNA, 20 nt, Mycobacterium tuberculosis H37Rv
uucggcgagucgguugucgg

SEQ ID NO: 3267125 - RNA, 20 nt, Mycobacterium tuberculosis H37Rv
uucggcgaucgucucgguga

SEQ ID NO: 3267126 - RNA, 18 nt, Mycobacterium tuberculosis H37Rv
uucggcggccgugucggg

SEQ ID NO: 3267127 - RNA, 18 nt, Mycobacterium tuberculosis H37Rv
uucggcggcgguggcgaa

SEQ ID NO: 3267128 - RNA, 14 nt, Mycobacterium tuberculosis H37Rv
uucggcggcugcca

SEQ ID NO: 3267129 - RNA, 13 nt, Mycobacterium tuberculosis H37Rv
uucggcugccacc

SEQ ID NO: 3267130 - RNA, 20 nt, Mycobacterium tuberculosis H37Rv
uucggcugcgaaagccacuc

SEQ ID NO: 3267131 - RNA, 15 nt, Mycobacterium tuberculosis H37Rv
uucgggagucuucgg

SEQ ID NO: 3267132 - RNA, 19 nt, Mycobacterium tuberculosis H37Rv
uucgggagucuucggcgac

SEQ ID NO: 3267133 - RNA, 18 nt, Mycobacterium tuberculosis H37Rv
uucgggccggagccggug

SEQ ID NO: 3267134 - RNA, 18 nt, Mycobacterium tuberculosis H37Rv
uucgggcucguccagcaa

SEQ ID NO: 3267135 - RNA, 17 nt, Mycobacterium tuberculosis H37Rv
uucgggcugccaggagc

SEQ ID NO: 3267136 - RNA, 14 nt, Mycobacterium tuberculosis H37Rv
uucggggaccacgc

SEQ ID NO: 3267137 - RNA, 21 nt, Mycobacterium tuberculosis H37Rv
uucggguccagcggccgccgc

SEQ ID NO: 3267138 - RNA, 19 nt, Mycobacterium tuberculosis H37Rv
uucgggugguuguucggcc

SEQ ID NO: 3267139 - RNA, 17 nt, Mycobacterium tuberculosis H37Rv
uucggguugggcaucag

SEQ ID NO: 3267140 - RNA, 22 nt, Mycobacterium tuberculosis H37Rv
uucggucagggugggcucguug

SEQ ID NO: 3267141 - RNA, 17 nt, Mycobacterium tuberculosis H37Rv
uucggugagcgggagga

SEQ ID NO: 3267142 - RNA, 17 nt, Mycobacterium tuberculosis H37Rv
uucggugagguccucgg

SEQ ID NO: 3267143 - RNA, 14 nt, Mycobacterium tuberculosis H37Rv
uucggugccagcag

SEQ ID NO: 3267144 - RNA, 14 nt, Mycobacterium tuberculosis H37Rv
uucgguggcggcag

SEQ ID NO: 3267145 - RNA, 13 nt, Mycobacterium tuberculosis H37Rv
uucggugucgccg

SEQ ID NO: 3267146 - RNA, 14 nt, Mycobacterium tuberculosis H37Rv
uucguagucucgac

SEQ ID NO: 3267147 - RNA, 15 nt, Mycobacterium tuberculosis H37Rv
uucguauaggcgaug

SEQ ID NO: 3267148 - RNA, 22 nt, Mycobacterium tuberculosis H37Rv
uucgucgcggguguuccacacc

SEQ ID NO: 3267149 - RNA, 16 nt, Mycobacterium tuberculosis H37Rv
uucgucggagaacgcc

SEQ ID NO: 3267150 - RNA, 22 nt, Mycobacterium tuberculosis H37Rv
uucgucggcggugcgcugauga

SEQ ID NO: 3267151 - RNA, 11 nt, Mycobacterium tuberculosis H37Rv
uucgucgucgc

SEQ ID NO: 3267152 - RNA, 20 nt, Mycobacterium tuberculosis H37Rv
uucgucgucgcugagcagcg

SEQ ID NO: 3267153 - RNA, 17 nt, Mycobacterium tuberculosis H37Rv
uucgucguggagcucac

SEQ ID NO: 3267154 - RNA, 15 nt, Mycobacterium tuberculosis H37Rv
uucgugagcggccag

SEQ ID NO: 3267155 - RNA, 23 nt, Mycobacterium tuberculosis H37Rv
uucgugcaccacauuggcgauca

SEQ ID NO: 3267156 - RNA, 20 nt, Mycobacterium tuberculosis H37Rv
uucgugcacggcgaggccga

SEQ ID NO: 3267157 - RNA, 22 nt, Mycobacterium tuberculosis H37Rv
uucgugcagcccaaggcgacga

SEQ ID NO: 3267158 - RNA, 15 nt, Mycobacterium tuberculosis H37Rv
uucguggccuugaca

SEQ ID NO: 3267159 - RNA, 14 nt, Mycobacterium tuberculosis H37Rv
uucguugagaacau

SEQ ID NO: 3267160 - RNA, 23 nt, Mycobacterium tuberculosis H37Rv
uucuccaacacaaacgccgccgg

SEQ ID NO: 3267161 - RNA, 17 nt, Mycobacterium tuberculosis H37Rv
uucuccagauccacgcc

SEQ ID NO: 3267162 - RNA, 13 nt, Mycobacterium tuberculosis H37Rv
uucuccaggcuga

SEQ ID NO: 3267163 - RNA, 21 nt, Mycobacterium tuberculosis H37Rv
uucuccucgucgcgggcgaug

SEQ ID NO: 3267164 - RNA, 16 nt, Mycobacterium tuberculosis H37Rv
uucuccucgugcagca

SEQ ID NO: 3267165 - RNA, 16 nt, Mycobacterium tuberculosis H37Rv
uucugacggcuugcgu

SEQ ID NO: 3267166 - RNA, 14 nt, Mycobacterium tuberculosis H37Rv
uucugcaccagcuc

SEQ ID NO: 3267167 - RNA, 13 nt, Mycobacterium tuberculosis H37Rv
uucugccuuggcc

SEQ ID NO: 3267168 - RNA, 19 nt, Mycobacterium tuberculosis H37Rv
uucugcgccacgucgacgg

SEQ ID NO: 3267169 - RNA, 18 nt, Mycobacterium tuberculosis H37Rv
uucugcgucugcucgcca

SEQ ID NO: 3267170 - RNA, 13 nt, Mycobacterium tuberculosis H37Rv
uucuggaaccccg

SEQ ID NO: 3267171 - RNA, 13 nt, Mycobacterium tuberculosis H37Rv
uucuggcccgcag

SEQ ID NO: 3267172 - RNA, 16 nt, Mycobacterium tuberculosis H37Rv
uucuggccguagucgg

SEQ ID NO: 3267173 - RNA, 13 nt, Mycobacterium tuberculosis H37Rv
uucuucagcagcg

SEQ ID NO: 3267174 - RNA, 15 nt, Mycobacterium tuberculosis H37Rv
uucuucgcgaagaac

SEQ ID NO: 3267175 - RNA, 17 nt, Mycobacterium tuberculosis H37Rv
uucuucgcuaccuucuu

SEQ ID NO: 3267176 - RNA, 15 nt, Mycobacterium tuberculosis H37Rv
uucuucggccagcuc

SEQ ID NO: 3267177 - RNA, 20 nt, Mycobacterium tuberculosis H37Rv
uucuucggucaccucgaugc

SEQ ID NO: 3267178 - RNA, 18 nt, Mycobacterium tuberculosis H37Rv
uucuuggcaggugccuuc

SEQ ID NO: 3267179 - RNA, 21 nt, Mycobacterium tuberculosis H37Rv
uucuuggcgggcgccuugguc

SEQ ID NO: 3267180 - RNA, 16 nt, Mycobacterium tuberculosis H37Rv
uucuuggcgucuugga

SEQ ID NO: 3267181 - RNA, 15 nt, Mycobacterium tuberculosis H37Rv
uucuuuaaaccccug

SEQ ID NO: 3267182 - RNA, 19 nt, Mycobacterium tuberculosis H37Rv
uucuuuaaaccccuggcga

SEQ ID NO: 3267183 - RNA, 17 nt, Mycobacterium tuberculosis H37Rv
uugaaaacgcccggcac

SEQ ID NO: 3267184 - RNA, 17 nt, Mycobacterium tuberculosis H37Rv
uugaaccagucgaccca

SEQ ID NO: 3267185 - RNA, 19 nt, Mycobacterium tuberculosis H37Rv
uugaacgcccgcuucagca

SEQ ID NO: 3267186 - RNA, 14 nt, Mycobacterium tuberculosis H37Rv
uugaacguucccuc

SEQ ID NO: 3267187 - RNA, 13 nt, Mycobacterium tuberculosis H37Rv
uugaagaagcccg

SEQ ID NO: 3267188 - RNA, 13 nt, Mycobacterium tuberculosis H37Rv
uugacagacacag

SEQ ID NO: 3267189 - RNA, 20 nt, Mycobacterium tuberculosis H37Rv
uugaccaaugugccggucac

SEQ ID NO: 3267190 - RNA, 11 nt, Mycobacterium tuberculosis H37Rv
uugaccaccag

SEQ ID NO: 3267191 - RNA, 13 nt, Mycobacterium tuberculosis H37Rv
uugaccagcagcu

SEQ ID NO: 3267192 - RNA, 14 nt, Mycobacterium tuberculosis H37Rv
uugaccaggccgac

SEQ ID NO: 3267193 - RNA, 13 nt, Mycobacterium tuberculosis H37Rv
uugacccacagca

SEQ ID NO: 3267194 - RNA, 23 nt, Mycobacterium tuberculosis H37Rv
uugacccacgagagcgcuguccc

SEQ ID NO: 3267195 - RNA, 23 nt, Mycobacterium tuberculosis H37Rv
uugacccauggcuccgcccagga

SEQ ID NO: 3267196 - RNA, 24 nt, Mycobacterium tuberculosis H37Rv
uugacccccucguccugcgagagg

SEQ ID NO: 3267197 - RNA, 22 nt, Mycobacterium tuberculosis H37Rv
uugaccgcggucugcgcgucgc

SEQ ID NO: 3267198 - RNA, 14 nt, Mycobacterium tuberculosis H37Rv
uugaccgcggugac

SEQ ID NO: 3267199 - RNA, 23 nt, Mycobacterium tuberculosis H37Rv
uugcuccuggacuuccgguucau

SEQ ID NO: 3267200 - RNA, 20 nt, Mycobacterium tuberculosis H37Rv
uugcucgacgaucugcagca

SEQ ID NO: 3267201 - RNA, 16 nt, Mycobacterium tuberculosis H37Rv
uugcugcgcagcggca

SEQ ID NO: 3267202 - RNA, 20 nt, Mycobacterium tuberculosis H37Rv
uugcugguugcgcucauccg

SEQ ID NO: 3267203 - RNA, 14 nt, Mycobacterium tuberculosis H37Rv
uugcuugcagggcc

SEQ ID NO: 3267204 - RNA, 17 nt, Mycobacterium tuberculosis H37Rv
uuggaaaucccuggccu

SEQ ID NO: 3267205 - RNA, 14 nt, Mycobacterium tuberculosis H37Rv
uuggaagacgccgg

SEQ ID NO: 3267206 - RNA, 14 nt, Mycobacterium tuberculosis H37Rv
uuggagaucgccgc

SEQ ID NO: 3267207 - RNA, 13 nt, Mycobacterium tuberculosis H37Rv
uuggaucacgcga

SEQ ID NO: 3267208 - RNA, 15 nt, Mycobacterium tuberculosis H37Rv
uuggaucccagcccg

SEQ ID NO: 3267209 - RNA, 15 nt, Mycobacterium tuberculosis H37Rv
uuggcaagcacggcg

SEQ ID NO: 3267210 - RNA, 23 nt, Mycobacterium tuberculosis H37Rv
uuggcagcaaaaacgcugccgcc

SEQ ID NO: 3267211 - RNA, 12 nt, Mycobacterium tuberculosis H37Rv
uuggcagcacag

SEQ ID NO: 3267212 - RNA, 18 nt, Mycobacterium tuberculosis H37Rv
uuggcagggccagcggca

SEQ ID NO: 3267213 - RNA, 13 nt, Mycobacterium tuberculosis H37Rv
uuggccaccgccg

SEQ ID NO: 3267214 - RNA, 16 nt, Mycobacterium tuberculosis H37Rv
uuggccagaccgcgcg

SEQ ID NO: 3267215 - RNA, 13 nt, Mycobacterium tuberculosis H37Rv
uuggccagcagca

SEQ ID NO: 3267216 - RNA, 16 nt, Mycobacterium tuberculosis H37Rv
uuggccagcagcgcgg

SEQ ID NO: 3267217 - RNA, 19 nt, Mycobacterium tuberculosis H37Rv
uuggccagccacagccgac

SEQ ID NO: 3267218 - RNA, 15 nt, Mycobacterium tuberculosis H37Rv
uuggccaggaagucc

SEQ ID NO: 3267219 - RNA, 15 nt, Mycobacterium tuberculosis H37Rv
uuggcccagcgguag

SEQ ID NO: 3267220 - RNA, 20 nt, Mycobacterium tuberculosis H37Rv
uuggcccggugcagcaguac

SEQ ID NO: 3267221 - RNA, 16 nt, Mycobacterium tuberculosis H37Rv
uuggccgauguuguug

SEQ ID NO: 3267222 - RNA, 24 nt, Mycobacterium tuberculosis H37Rv
uuggccgauguuguugacgcccga

SEQ ID NO: 3267223 - RNA, 14 nt, Mycobacterium tuberculosis H37Rv
uuggccgcaaggcg

SEQ ID NO: 3267224 - RNA, 16 nt, Mycobacterium tuberculosis H37Rv
uuggccgcaaggcgug

SEQ ID NO: 3267225 - RNA, 13 nt, Mycobacterium tuberculosis H37Rv
uuggccgcgaccg

SEQ ID NO: 3267226 - RNA, 19 nt, Mycobacterium tuberculosis H37Rv
uuggccgcgcaggcuucca

SEQ ID NO: 3267227 - RNA, 19 nt, Mycobacterium tuberculosis H37Rv
uuggccggcuugucgacca

SEQ ID NO: 3267228 - RNA, 21 nt, Mycobacterium tuberculosis H37Rv
uuggccucgagcgcuguggcc

SEQ ID NO: 3267229 - RNA, 15 nt, Mycobacterium tuberculosis H37Rv
uuggcgaagcccgac

SEQ ID NO: 3267230 - RNA, 13 nt, Mycobacterium tuberculosis H37Rv
uuggcgaccaugc

SEQ ID NO: 3267231 - RNA, 20 nt, Mycobacterium tuberculosis H37Rv
uuggcgacgaagaagaacuc

SEQ ID NO: 3267232 - RNA, 13 nt, Mycobacterium tuberculosis H37Rv
uuggcgacgaggc

SEQ ID NO: 3267233 - RNA, 15 nt, Mycobacterium tuberculosis H37Rv
uuggcgacgaggcga

SEQ ID NO: 3267234 - RNA, 14 nt, Mycobacterium tuberculosis H37Rv
uuggcgacugucug

SEQ ID NO: 3267235 - RNA, 13 nt, Mycobacterium tuberculosis H37Rv
uuggcgaucagca

SEQ ID NO: 3267236 - RNA, 22 nt, Mycobacterium tuberculosis H37Rv
uuggcgaucucaccuggagcua

SEQ ID NO: 3267237 - RNA, 15 nt, Mycobacterium tuberculosis H37Rv
uuggcgaucucgacg

SEQ ID NO: 3267238 - RNA, 21 nt, Mycobacterium tuberculosis H37Rv
uuggcgccaccagucacgccc

SEQ ID NO: 3267239 - RNA, 20 nt, Mycobacterium tuberculosis H37Rv
uuggcgcccgccggcaaccg

SEQ ID NO: 3267240 - RNA, 16 nt, Mycobacterium tuberculosis H37Rv
uuggcgcgguccucca

SEQ ID NO: 3267241 - RNA, 22 nt, Mycobacterium tuberculosis H37Rv
uuggcggcggugcagcagggcg

SEQ ID NO: 3267242 - RNA, 19 nt, Mycobacterium tuberculosis H37Rv
uuggcgguaaaccacucgc

SEQ ID NO: 3267243 - RNA, 19 nt, Mycobacterium tuberculosis H37Rv
uuggcgguggcccgauuga

SEQ ID NO: 3267244 - RNA, 19 nt, Mycobacterium tuberculosis H37Rv
uuggcguagcaacccagga

SEQ ID NO: 3267245 - RNA, 16 nt, Mycobacterium tuberculosis H37Rv
uuggcgucagcagcaa

SEQ ID NO: 3267246 - RNA, 13 nt, Mycobacterium tuberculosis H37Rv
uuggcgucgucgg

SEQ ID NO: 3267247 - RNA, 15 nt, Mycobacterium tuberculosis H37Rv
uuggcgugcaccgca

SEQ ID NO: 3267248 - RNA, 18 nt, Mycobacterium tuberculosis H37Rv
uuggcucccuuuuccaaa

SEQ ID NO: 3267249 - RNA, 10 nt, Mycobacterium tuberculosis H37Rv
uuggcugccg

SEQ ID NO: 3267250 - RNA, 17 nt, Mycobacterium tuberculosis H37Rv
uuggcugccuccaucaa

SEQ ID NO: 3267251 - RNA, 14 nt, Mycobacterium tuberculosis H37Rv
uugggaaaagcccg

SEQ ID NO: 3267252 - RNA, 14 nt, Mycobacterium tuberculosis H37Rv
uugggagccaccgg

SEQ ID NO: 3267253 - RNA, 19 nt, Mycobacterium tuberculosis H37Rv
uugggaucgugccggcgaa

SEQ ID NO: 3267254 - RNA, 12 nt, Mycobacterium tuberculosis H37Rv
uugggccagcgc

SEQ ID NO: 3267255 - RNA, 14 nt, Mycobacterium tuberculosis H37Rv
uugggccagcuccu

SEQ ID NO: 3267256 - RNA, 20 nt, Mycobacterium tuberculosis H37Rv
uugggcgauucugcgucugc

SEQ ID NO: 3267257 - RNA, 20 nt, Mycobacterium tuberculosis H37Rv
uugggcgauuuugcgucugc

SEQ ID NO: 3267258 - RNA, 20 nt, Mycobacterium tuberculosis H37Rv
uugggcgcuuaugcgucugc

SEQ ID NO: 3267259 - RNA, 13 nt, Mycobacterium tuberculosis H37Rv
uuggggccagguu

SEQ ID NO: 3267260 - RNA, 15 nt, Mycobacterium tuberculosis H37Rv
uuggggcugugcagg

SEQ ID NO: 3267261 - RNA, 21 nt, Mycobacterium tuberculosis H37Rv
uuggggugcuuucgcgucugc

SEQ ID NO: 3267262 - RNA, 19 nt, Mycobacterium tuberculosis H37Rv
uuggguagcaaaccccgga

SEQ ID NO: 3267263 - RNA, 17 nt, Mycobacterium tuberculosis H37Rv
uugggugccguugcguc

SEQ ID NO: 3267264 - RNA, 21 nt, Mycobacterium tuberculosis H37Rv
uugggugcgccgucagcccag

SEQ ID NO: 3267265 - RNA, 23 nt, Mycobacterium tuberculosis H37Rv
uuggucaccaccuggugcaaccg

SEQ ID NO: 3267266 - RNA, 20 nt, Mycobacterium tuberculosis H37Rv
uuggucaccugcugcaaccg

SEQ ID NO: 3267267 - RNA, 15 nt, Mycobacterium tuberculosis H37Rv
uuggugaggugguca

SEQ ID NO: 3267268 - RNA, 18 nt, Mycobacterium tuberculosis H37Rv
uuggugaguagauugcug

SEQ ID NO: 3267269 - RNA, 18 nt, Mycobacterium tuberculosis H37Rv
uuggugcagaccaccgcc

SEQ ID NO: 3267270 - RNA, 17 nt, Mycobacterium tuberculosis H37Rv
uuggugggccagcagca

SEQ ID NO: 3267271 - RNA, 17 nt, Mycobacterium tuberculosis H37Rv
uugguguggcccaaccg

SEQ ID NO: 3267272 - RNA, 18 nt, Mycobacterium tuberculosis H37Rv
uugguugcgccaggaacc

SEQ ID NO: 3267273 - RNA, 22 nt, Mycobacterium tuberculosis H37Rv
uuguacggcccgcaucgucgcc

SEQ ID NO: 3267274 - RNA, 20 nt, Mycobacterium tuberculosis H37Rv
uuguagcgguccagcgucgc

SEQ ID NO: 3267275 - RNA, 18 nt, Mycobacterium tuberculosis H37Rv
uuguaggacaagugccgg

SEQ ID NO: 3267276 - RNA, 19 nt, Mycobacterium tuberculosis H37Rv
uuguaggccaucgucgugg

SEQ ID NO: 3267277 - RNA, 16 nt, Mycobacterium tuberculosis H37Rv
uuguaugcugcgcgcc

SEQ ID NO: 3267278 - RNA, 23 nt, Mycobacterium tuberculosis H37Rv
uugucagcgaacggccaggacaa

SEQ ID NO: 3267279 - RNA, 13 nt, Mycobacterium tuberculosis H37Rv
uuguccagcgucu

SEQ ID NO: 3267280 - RNA, 18 nt, Mycobacterium tuberculosis H37Rv
uuguccaggaucgcgugg

SEQ ID NO: 3267281 - RNA, 12 nt, Mycobacterium tuberculosis H37Rv
uuguccggugag

SEQ ID NO: 3267282 - RNA, 15 nt, Mycobacterium tuberculosis H37Rv
uuguccucccggacu

SEQ ID NO: 3267283 - RNA, 13 nt, Mycobacterium tuberculosis H37Rv
uuguccucggcga

SEQ ID NO: 3267284 - RNA, 17 nt, Mycobacterium tuberculosis H37Rv
uuguccuucagccaguc

SEQ ID NO: 3267285 - RNA, 22 nt, Mycobacterium tuberculosis H37Rv
uugucgagcaggcccaacgcga

SEQ ID NO: 3267286 - RNA, 22 nt, Mycobacterium tuberculosis H37Rv
uugucgaucagaaucugccucu

SEQ ID NO: 3267287 - RNA, 22 nt, Mycobacterium tuberculosis H37Rv
uugucggcgaaaugaagugcac

SEQ ID NO: 3267288 - RNA, 20 nt, Mycobacterium tuberculosis H37Rv
uugucgguaggugucaauga

SEQ ID NO: 3267289 - RNA, 17 nt, Mycobacterium tuberculosis H37Rv
uugucguagcgacgcca

SEQ ID NO: 3267290 - RNA, 17 nt, Mycobacterium tuberculosis H37Rv
uugucucgcaucggccu

SEQ ID NO: 3267291 - RNA, 21 nt, Mycobacterium tuberculosis H37Rv
uugucugacccccgaccccga

SEQ ID NO: 3267292 - RNA, 22 nt, Mycobacterium tuberculosis H37Rv
uugugaacggugucaacggcac

SEQ ID NO: 3267293 - RNA, 17 nt, Mycobacterium tuberculosis H37Rv
uugugacggugaauuca

SEQ ID NO: 3267294 - RNA, 22 nt, Mycobacterium tuberculosis H37Rv
uugugagcaauggcgcgaccga

SEQ ID NO: 3267295 - RNA, 21 nt, Mycobacterium tuberculosis H37Rv
aucagugaagacaccaggccc

SEQ ID NO: 3267296 - RNA, 16 nt, Mycobacterium tuberculosis H37Rv
aucagugcgccggcga

SEQ ID NO: 3267297 - RNA, 22 nt, Mycobacterium tuberculosis H37Rv
aucagugcgugauggcggcgca

SEQ ID NO: 3267298 - RNA, 17 nt, Mycobacterium tuberculosis H37Rv
aucaguuccuguagccg

SEQ ID NO: 3267299 - RNA, 19 nt, Mycobacterium tuberculosis H37Rv
aucaguucgugacgugcau

SEQ ID NO: 3267300 - RNA, 18 nt, Mycobacterium tuberculosis H37Rv
aucaguugcacaccgauc

SEQ ID NO: 3267301 - RNA, 20 nt, Mycobacterium tuberculosis H37Rv
aucauauccgccccagcugc

SEQ ID NO: 3267302 - RNA, 21 nt, Mycobacterium tuberculosis H37Rv
aucauauccgccccagcugcg

SEQ ID NO: 3267303 - RNA, 23 nt, Mycobacterium tuberculosis H37Rv
aucaucauauccgccccagcugc

SEQ ID NO: 3267304 - RNA, 23 nt, Mycobacterium tuberculosis H37Rv
aucaucgccgcggccagguugau

SEQ ID NO: 3267305 - RNA, 18 nt, Mycobacterium tuberculosis H37Rv
aucaucgcugugcgcugg

SEQ ID NO: 3267306 - RNA, 14 nt, Mycobacterium tuberculosis H37Rv
aucaucgcuuggcc

SEQ ID NO: 3267307 - RNA, 19 nt, Mycobacterium tuberculosis H37Rv
aucaucucccgaccgccga

SEQ ID NO: 3267308 - RNA, 18 nt, Mycobacterium tuberculosis H37Rv
aucaucuuggugggaagc

SEQ ID NO: 3267309 - RNA, 14 nt, Mycobacterium tuberculosis H37Rv
aucaugaacgccag

SEQ ID NO: 3267310 - RNA, 12 nt, Mycobacterium tuberculosis H37Rv
aucaugaccauc

SEQ ID NO: 3267311 - RNA, 13 nt, Mycobacterium tuberculosis H37Rv
aucaugagcagca

SEQ ID NO: 3267312 - RNA, 15 nt, Mycobacterium tuberculosis H37Rv
aucaugagcagcacg

SEQ ID NO: 3267313 - RNA, 20 nt, Mycobacterium tuberculosis H37Rv
aucaugcgauucugcgucug

SEQ ID NO: 3267314 - RNA, 16 nt, Mycobacterium tuberculosis H37Rv
aucauggauaauccau

SEQ ID NO: 3267315 - RNA, 23 nt, Mycobacterium tuberculosis H37Rv
aucauggcgagcguuuggacggg

SEQ ID NO: 3267316 - RNA, 18 nt, Mycobacterium tuberculosis H37Rv
aucaugucgaagaaccgg

SEQ ID NO: 3267317 - RNA, 14 nt, Mycobacterium tuberculosis H37Rv
agcgugccgcccgg

SEQ ID NO: 3267318 - RNA, 16 nt, Mycobacterium tuberculosis H37Rv
agcgugcugccgccuu

SEQ ID NO: 3267319 - RNA, 23 nt, Mycobacterium tuberculosis H37Rv
agcguggacguacugucgucgcc

SEQ ID NO: 3267320 - RNA, 21 nt, Mycobacterium tuberculosis H37Rv
agcguggagcgcaaguugagc

SEQ ID NO: 3267321 - RNA, 23 nt, Mycobacterium tuberculosis H37Rv
agcguggcgcccgugccgcccgc

SEQ ID NO: 3267322 - RNA, 15 nt, Mycobacterium tuberculosis H37Rv
agcgugggcauuccc

SEQ ID NO: 3267323 - RNA, 22 nt, Mycobacterium tuberculosis H37Rv
agcguggugauccggucuccgc

SEQ ID NO: 3267324 - RNA, 13 nt, Mycobacterium tuberculosis H37Rv
agcguguggcgca

SEQ ID NO: 3267325 - RNA, 17 nt, Mycobacterium tuberculosis H37Rv
agcguuaggucgccggc

SEQ ID NO: 3267326 - RNA, 13 nt, Mycobacterium tuberculosis H37Rv
agcguucccacac

SEQ ID NO: 3267327 - RNA, 17 nt, Mycobacterium tuberculosis H37Rv
agcguuccgcucgaauc

SEQ ID NO: 3267328 - RNA, 15 nt, Mycobacterium tuberculosis H37Rv
agcguugaccgcggu

SEQ ID NO: 3267329 - RNA, 17 nt, Mycobacterium tuberculosis H37Rv
agcguuggccgcugucg

SEQ ID NO: 3267330 - RNA, 20 nt, Mycobacterium tuberculosis H37Rv
agcuacuaugccaacgacag

SEQ ID NO: 3267331 - RNA, 16 nt, Mycobacterium tuberculosis H37Rv
agcuagaccgaucacc

SEQ ID NO: 3267332 - RNA, 12 nt, Mycobacterium tuberculosis H37Rv
agcuagaccgcu

SEQ ID NO: 3267333 - RNA, 15 nt, Mycobacterium tuberculosis H37Rv
agcuagcccggcagc

SEQ ID NO: 3267334 - RNA, 18 nt, Mycobacterium tuberculosis H37Rv
agcuagcccucagcuagc

SEQ ID NO: 3267335 - RNA, 19 nt, Mycobacterium tuberculosis H37Rv
agcuagcgcccgcgagaga

SEQ ID NO: 3267336 - RNA, 17 nt, Mycobacterium tuberculosis H37Rv
agcuagcgcgggcucac

SEQ ID NO: 3267337 - RNA, 22 nt, Mycobacterium tuberculosis H37Rv
agcuagcgguggaaaaagcccg

SEQ ID NO: 3267338 - RNA, 19 nt, Mycobacterium tuberculosis H37Rv
agcuaucccaggggcaccg

SEQ ID NO: 3267339 - RNA, 15 nt, Mycobacterium tuberculosis H37Rv
agcucaaccaccucg

SEQ ID NO: 3267340 - RNA, 21 nt, Mycobacterium tuberculosis H37Rv
agcucaauuccaugcaguugu

SEQ ID NO: 3267341 - RNA, 22 nt, Mycobacterium tuberculosis H37Rv
agcucaccacccgcacuccaag

SEQ ID NO: 3267342 - RNA, 11 nt, Mycobacterium tuberculosis H37Rv
agcucacccug

SEQ ID NO: 3267343 - RNA, 22 nt, Mycobacterium tuberculosis H37Rv
agcucaccucaugaucucacca

SEQ ID NO: 3267344 - RNA, 13 nt, Mycobacterium tuberculosis H37Rv
agcucacgccggg

SEQ ID NO: 3267345 - RNA, 17 nt, Mycobacterium tuberculosis H37Rv
agcucacgcugaagccg

SEQ ID NO: 3267346 - RNA, 16 nt, Mycobacterium tuberculosis H37Rv
agcucacgugcugccg

SEQ ID NO: 3267347 - RNA, 12 nt, Mycobacterium tuberculosis H37Rv
agcucagcugcg

SEQ ID NO: 3267348 - RNA, 19 nt, Mycobacterium tuberculosis H37Rv
agcucagugaugcgccccg

SEQ ID NO: 3267349 - RNA, 15 nt, Mycobacterium tuberculosis H37Rv
agcuccaaccaugcg

SEQ ID NO: 3267350 - RNA, 16 nt, Mycobacterium tuberculosis H37Rv
agcucccgccacgucg

SEQ ID NO: 3267351 - RNA, 24 nt, Mycobacterium tuberculosis H37Rv
agcucccgcggcgccacccgcgcc

SEQ ID NO: 3267352 - RNA, 17 nt, Mycobacterium tuberculosis H37Rv
agcuccgccugccgcug

SEQ ID NO: 3267353 - RNA, 18 nt, Mycobacterium tuberculosis H37Rv
agcuccgggucgacgacg

SEQ ID NO: 3267354 - RNA, 19 nt, Mycobacterium tuberculosis H37Rv
agcuccgugacaccgggga

SEQ ID NO: 3267355 - RNA, 24 nt, Mycobacterium tuberculosis H37Rv
agcuccguggugcuagcgccgcca

SEQ ID NO: 3267356 - RNA, 23 nt, Mycobacterium tuberculosis H37Rv
agcuccucacggauccgccggug

SEQ ID NO: 3267357 - RNA, 15 nt, Mycobacterium tuberculosis H37Rv
agcuccuugagcaau

SEQ ID NO: 3267358 - RNA, 22 nt, Mycobacterium tuberculosis H37Rv
agcucgaacagguuggccccgg

SEQ ID NO: 3267359 - RNA, 18 nt, Mycobacterium tuberculosis H37Rv
agcucgacaacugcccga

SEQ ID NO: 3267360 - RNA, 14 nt, Mycobacterium tuberculosis H37Rv
agcucgaccgcccg

SEQ ID NO: 3267361 - RNA, 17 nt, Mycobacterium tuberculosis H37Rv
agcucgaccgcccggcu

SEQ ID NO: 3267362 - RNA, 24 nt, Mycobacterium tuberculosis H37Rv
agcucgacgaauaccgggaugcga

SEQ ID NO: 3267363 - RNA, 22 nt, Mycobacterium tuberculosis H37Rv
agcucgacgaaugugagcgcgc

SEQ ID NO: 3267364 - RNA, 13 nt, Mycobacterium tuberculosis H37Rv
agcucgaggacca

SEQ ID NO: 3267365 - RNA, 19 nt, Mycobacterium tuberculosis H37Rv
agcucgaggaccaccuggu

SEQ ID NO: 3267366 - RNA, 24 nt, Mycobacterium tuberculosis H37Rv
agcucgaggcccgggugcuacugg

SEQ ID NO: 3267367 - RNA, 19 nt, Mycobacterium tuberculosis H37Rv
agcucgauacccaggaugu

SEQ ID NO: 3267368 - RNA, 18 nt, Mycobacterium tuberculosis H37Rv
agcucgccggcacgcagc

SEQ ID NO: 3267369 - RNA, 13 nt, Mycobacterium tuberculosis H37Rv
agcucgccggcga

SEQ ID NO: 3267370 - RNA, 15 nt, Mycobacterium tuberculosis H37Rv
agcucgcggcgcagg

SEQ ID NO: 3267371 - RNA, 23 nt, Mycobacterium tuberculosis H37Rv
agcucgcgguuuuggucgcgaug

SEQ ID NO: 3267372 - RNA, 22 nt, Mycobacterium tuberculosis H37Rv
agcucgcugaccuuguugacca

SEQ ID NO: 3267373 - RNA, 21 nt, Mycobacterium tuberculosis H37Rv
agcucgcugcgcgcccaccgg

SEQ ID NO: 3267374 - RNA, 23 nt, Mycobacterium tuberculosis H37Rv
agcucggccaccagcgcccggcc

SEQ ID NO: 3267375 - RNA, 19 nt, Mycobacterium tuberculosis H37Rv
agcucggccagcacgccgc

SEQ ID NO: 3267376 - RNA, 19 nt, Mycobacterium tuberculosis H37Rv
agcucggcgaacggcacca

SEQ ID NO: 3267377 - RNA, 16 nt, Mycobacterium tuberculosis H37Rv
agcucggcgcccagcu

SEQ ID NO: 3267378 - RNA, 17 nt, Mycobacterium tuberculosis H37Rv
agcucggcgcccagcuc

SEQ ID NO: 3267379 - RNA, 22 nt, Mycobacterium tuberculosis H37Rv
agcucggcuagguagucgacga

SEQ ID NO: 3267380 - RNA, 13 nt, Mycobacterium tuberculosis H37Rv
agcucgggcaggg

SEQ ID NO: 3267381 - RNA, 20 nt, Mycobacterium tuberculosis H37Rv
agcucgggugcgaacaacgc

SEQ ID NO: 3267382 - RNA, 14 nt, Mycobacterium tuberculosis H37Rv
agcucggucagcgu

SEQ ID NO: 3267383 - RNA, 23 nt, Mycobacterium tuberculosis H37Rv
agcucggucagcgucaggugcgc

SEQ ID NO: 3267384 - RNA, 17 nt, Mycobacterium tuberculosis H37Rv
agcucggugcacggcgc

SEQ ID NO: 3267385 - RNA, 21 nt, Mycobacterium tuberculosis H37Rv
agcucgguggcaucggcggcc

SEQ ID NO: 3267386 - RNA, 16 nt, Mycobacterium tuberculosis H37Rv
agcucguccggugcga

SEQ ID NO: 3267387 - RNA, 22 nt, Mycobacterium tuberculosis H37Rv
agcucguugcuggcggccagca

SEQ ID NO: 3267388 - RNA, 22 nt, Mycobacterium tuberculosis H37Rv
agcucucgcggcguucgccggu

SEQ ID NO: 3267389 - RNA, 19 nt, Mycobacterium tuberculosis H37Rv
agcucucggcacccggcag

SEQ ID NO: 3267390 - RNA, 20 nt, Mycobacterium tuberculosis H37Rv
agcucugcgucgugcccgua

SEQ ID NO: 3267391 - RNA, 13 nt, Mycobacterium tuberculosis H37Rv
agcucuucggaca

SEQ ID NO: 3267392 - RNA, 23 nt, Mycobacterium tuberculosis H37Rv
agcucuugcgggcagccgcccgc

SEQ ID NO: 3267393 - RNA, 17 nt, Mycobacterium tuberculosis H37Rv
agcugaccacgguagac

SEQ ID NO: 3267394 - RNA, 21 nt, Mycobacterium tuberculosis H37Rv
agcugaccgagcugauccggg

SEQ ID NO: 3267395 - RNA, 12 nt, Mycobacterium tuberculosis H37Rv
agcugaccgcca

SEQ ID NO: 3267396 - RNA, 19 nt, Mycobacterium tuberculosis H37Rv
agcugacgauggccaggcc

SEQ ID NO: 3267397 - RNA, 16 nt, Mycobacterium tuberculosis H37Rv
agcugacgggccgcug

SEQ ID NO: 3267398 - RNA, 15 nt, Mycobacterium tuberculosis H37Rv
agcugacgucaccac

SEQ ID NO: 3267399 - RNA, 23 nt, Mycobacterium tuberculosis H37Rv
agcugacgugucggcugcuaugg

SEQ ID NO: 3267400 - RNA, 15 nt, Mycobacterium tuberculosis H37Rv
agcugagcggccagc

SEQ ID NO: 3267401 - RNA, 15 nt, Mycobacterium tuberculosis H37Rv
agcugagcggccggc

SEQ ID NO: 3267402 - RNA, 18 nt, Mycobacterium tuberculosis H37Rv
agcugagcggccggcaug

SEQ ID NO: 3267403 - RNA, 17 nt, Mycobacterium tuberculosis H37Rv
agcugauacgcaugcga

SEQ ID NO: 3267404 - RNA, 21 nt, Mycobacterium tuberculosis H37Rv
agcugcaccuccgacggccgc

SEQ ID NO: 3267405 - RNA, 20 nt, Mycobacterium tuberculosis H37Rv
agcugccccgccaccucgcc

SEQ ID NO: 3267406 - RNA, 22 nt, Mycobacterium tuberculosis H37Rv
agcugcccgccagcgccgccgc

SEQ ID NO: 3267407 - RNA, 16 nt, Mycobacterium tuberculosis H37Rv
agcugccgagcgguca

SEQ ID NO: 3267408 - RNA, 17 nt, Mycobacterium tuberculosis H37Rv
agcugccggcccaccag

SEQ ID NO: 3267409 - RNA, 20 nt, Mycobacterium tuberculosis H37Rv
agcugccggcccaccaggcc

SEQ ID NO: 3267410 - RNA, 16 nt, Mycobacterium tuberculosis H37Rv
agcugccugaccggcg

SEQ ID NO: 3267411 - RNA, 16 nt, Mycobacterium tuberculosis H37Rv
agcugcgcaucgccac

SEQ ID NO: 3267412 - RNA, 17 nt, Mycobacterium tuberculosis H37Rv
agcugcgcaucgccacc

SEQ ID NO: 3267413 - RNA, 23 nt, Mycobacterium tuberculosis H37Rv
agcugcgggucgugccccggcgc

SEQ ID NO: 3267414 - RNA, 19 nt, Mycobacterium tuberculosis H37Rv
agcugcgggucucgccgac

SEQ ID NO: 3267415 - RNA, 20 nt, Mycobacterium tuberculosis H37Rv
agcugcgguaagaaucgaag

SEQ ID NO: 3267416 - RNA, 21 nt, Mycobacterium tuberculosis H37Rv
agcugcggucgaacaucaucg

SEQ ID NO: 3267417 - RNA, 18 nt, Mycobacterium tuberculosis H37Rv
agcugcguccggaaccaa

SEQ ID NO: 3267418 - RNA, 22 nt, Mycobacterium tuberculosis H37Rv
agcugcuagcccggcggcgaga

SEQ ID NO: 3267419 - RNA, 15 nt, Mycobacterium tuberculosis H37Rv
agcugcucgagcaga

SEQ ID NO: 3267420 - RNA, 16 nt, Mycobacterium tuberculosis H37Rv
agcugcucgccggcca

SEQ ID NO: 3267421 - RNA, 21 nt, Mycobacterium tuberculosis H37Rv
agcugcucgucuuggcggcgg

SEQ ID NO: 3267422 - RNA, 12 nt, Mycobacterium tuberculosis H37Rv
agcugcugccac

SEQ ID NO: 3267423 - RNA, 14 nt, Mycobacterium tuberculosis H37Rv
agcugcugccaccg

SEQ ID NO: 3267424 - RNA, 22 nt, Mycobacterium tuberculosis H37Rv
agcugcugccgauacagcacau

SEQ ID NO: 3267425 - RNA, 16 nt, Mycobacterium tuberculosis H37Rv
agcugcugcugcuuga

SEQ ID NO: 3267426 - RNA, 16 nt, Mycobacterium tuberculosis H37Rv
agcugcuggcgcgccu

SEQ ID NO: 3267427 - RNA, 15 nt, Mycobacterium tuberculosis H37Rv
agcuggaacggcagc

SEQ ID NO: 3267428 - RNA, 16 nt, Mycobacterium tuberculosis H37Rv
agcuggaacggcagca

SEQ ID NO: 3267429 - RNA, 13 nt, Mycobacterium tuberculosis H37Rv
agcuggaccuccg

SEQ ID NO: 3267430 - RNA, 14 nt, Mycobacterium tuberculosis H37Rv
agcuggacggccuc

SEQ ID NO: 3267431 - RNA, 12 nt, Mycobacterium tuberculosis H37Rv
agcuggccaggu

SEQ ID NO: 3267432 - RNA, 16 nt, Mycobacterium tuberculosis H37Rv
agcuggcgugcagcag

SEQ ID NO: 3267433 - RNA, 17 nt, Mycobacterium tuberculosis H37Rv
agcuggcguucccgcuc

SEQ ID NO: 3267434 - RNA, 13 nt, Mycobacterium tuberculosis H37Rv
agcugggcagcca

SEQ ID NO: 3267435 - RNA, 18 nt, Mycobacterium tuberculosis H37Rv
agcuggggaacagcagcg

SEQ ID NO: 3267436 - RNA, 12 nt, Mycobacterium tuberculosis H37Rv
agcugggucccg

SEQ ID NO: 3267437 - RNA, 22 nt, Mycobacterium tuberculosis H37Rv
agcugggugaccucgucgaccg

SEQ ID NO: 3267438 - RNA, 22 nt, Mycobacterium tuberculosis H37Rv
agcuggugaucagcucagugau

SEQ ID NO: 3267439 - RNA, 21 nt, Mycobacterium tuberculosis H37Rv
agcuggugcagaauucggcgc

SEQ ID NO: 3267440 - RNA, 18 nt, Mycobacterium tuberculosis H37Rv
agcuggugcgcccgacgg

SEQ ID NO: 3267441 - RNA, 22 nt, Mycobacterium tuberculosis H37Rv
agcuguacuugggauugcgggc

SEQ ID NO: 3267442 - RNA, 22 nt, Mycobacterium tuberculosis H37Rv
agcuguaggcgaccagauagaa

SEQ ID NO: 3267443 - RNA, 18 nt, Mycobacterium tuberculosis H37Rv
agcuguccucgcgggcuu

SEQ ID NO: 3267444 - RNA, 20 nt, Mycobacterium tuberculosis H37Rv
agcugucgcaacgcaucgau

SEQ ID NO: 3267445 - RNA, 20 nt, Mycobacterium tuberculosis H37Rv
agcugucggcuuccuccucg

SEQ ID NO: 3267446 - RNA, 20 nt, Mycobacterium tuberculosis H37Rv
agcugugaacaggccgaggc

SEQ ID NO: 3267447 - RNA, 21 nt, Mycobacterium tuberculosis H37Rv
agcuguuggcguggaucuugg

SEQ ID NO: 3267448 - RNA, 22 nt, Mycobacterium tuberculosis H37Rv
agcuguuggcguggaucuuggc

SEQ ID NO: 3267449 - RNA, 23 nt, Mycobacterium tuberculosis H37Rv
agcuuccgcgacgcucgcugcag

SEQ ID NO: 3267450 - RNA, 12 nt, Mycobacterium tuberculosis H37Rv
agcuucgccagg

SEQ ID NO: 3267451 - RNA, 12 nt, Mycobacterium tuberculosis H37Rv
agcuucggccuu

SEQ ID NO: 3267452 - RNA, 18 nt, Mycobacterium tuberculosis H37Rv
agcuugacaucggucagc

SEQ ID NO: 3267453 - RNA, 23 nt, Mycobacterium tuberculosis H37Rv
agcuugacccacgagagcgcugu

SEQ ID NO: 3267454 - RNA, 19 nt, Mycobacterium tuberculosis H37Rv
agcuugaccgaccacgcga

SEQ ID NO: 3267455 - RNA, 19 nt, Mycobacterium tuberculosis H37Rv
agcuugacguugccgggcu

SEQ ID NO: 3267456 - RNA, 21 nt, Mycobacterium tuberculosis H37Rv
agcuugagcgugagcgccgcg

SEQ ID NO: 3267457 - RNA, 16 nt, Mycobacterium tuberculosis H37Rv
agcuugaucgccgagg

SEQ ID NO: 3267458 - RNA, 19 nt, Mycobacterium tuberculosis H37Rv
agcuugcggccgaauuccu

SEQ ID NO: 3267459 - RNA, 15 nt, Mycobacterium tuberculosis H37Rv
agcuuggacucaucg

SEQ ID NO: 3267460 - RNA, 22 nt, Mycobacterium tuberculosis H37Rv
agcuuggagaggcggugcagcu

SEQ ID NO: 3267461 - RNA, 20 nt, Mycobacterium tuberculosis H37Rv
agcuuggagaucgccgccgg

SEQ ID NO: 3267462 - RNA, 12 nt, Mycobacterium tuberculosis H37Rv
agcuuggccagc

SEQ ID NO: 3267463 - RNA, 14 nt, Mycobacterium tuberculosis H37Rv
agcuuggccgccgc

SEQ ID NO: 3267464 - RNA, 18 nt, Mycobacterium tuberculosis H37Rv
agcuuggccucagccacc

SEQ ID NO: 3267465 - RNA, 15 nt, Mycobacterium tuberculosis H37Rv
agcuuggcggccagc

SEQ ID NO: 3267466 - RNA, 15 nt, Mycobacterium tuberculosis H37Rv
agcuuggcgucgaug

SEQ ID NO: 3267467 - RNA, 23 nt, Mycobacterium tuberculosis H37Rv
agcuuggucgccaugucggccag

SEQ ID NO: 3267468 - RNA, 14 nt, Mycobacterium tuberculosis H37Rv
agcuugucgagcag

SEQ ID NO: 3267469 - RNA, 14 nt, Mycobacterium tuberculosis H37Rv
agcuuguugcagcg

SEQ ID NO: 3267470 - RNA, 13 nt, Mycobacterium tuberculosis H37Rv
agcuuguuuucca

SEQ ID NO: 3267471 - RNA, 21 nt, Mycobacterium tuberculosis H37Rv
agcuuucuuggcgggcgccuu

SEQ ID NO: 3267472 - RNA, 20 nt, Mycobacterium tuberculosis H37Rv
aggaaaaccccggccaccag

SEQ ID NO: 3267473 - RNA, 19 nt, Mycobacterium tuberculosis H37Rv
aggaaagucaccguccacg

SEQ ID NO: 3267474 - RNA, 15 nt, Mycobacterium tuberculosis H37Rv
aggaaccacccaccg

SEQ ID NO: 3267475 - RNA, 22 nt, Mycobacterium tuberculosis H37Rv
aggaaccacccaccggccacca

SEQ ID NO: 3267476 - RNA, 23 nt, Mycobacterium tuberculosis H37Rv
aggaaccacccaccggccaccag

SEQ ID NO: 3267477 - RNA, 11 nt, Mycobacterium tuberculosis H37Rv
aggaaccgggc

SEQ ID NO: 3267478 - RNA, 18 nt, Mycobacterium tuberculosis H37Rv
aggaaccgggcaaaucaa

SEQ ID NO: 3267479 - RNA, 19 nt, Mycobacterium tuberculosis H37Rv
aggaaccgggcaaaucaag

SEQ ID NO: 3267480 - RNA, 22 nt, Mycobacterium tuberculosis H37Rv
aggaaccgggcaaaucaagcac

SEQ ID NO: 3267481 - RNA, 15 nt, Mycobacterium tuberculosis H37Rv
aggaaccgucgaaga

SEQ ID NO: 3267482 - RNA, 18 nt, Mycobacterium tuberculosis H37Rv
aggaacgccggcaucgcg

SEQ ID NO: 3267483 - RNA, 19 nt, Mycobacterium tuberculosis H37Rv
aggaacuacccgccagcaa

SEQ ID NO: 3267484 - RNA, 20 nt, Mycobacterium tuberculosis H37Rv
aggaacuacccgccagcaaa

SEQ ID NO: 3267485 - RNA, 15 nt, Mycobacterium tuberculosis H37Rv
aggaacucggaccca

SEQ ID NO: 3267486 - RNA, 18 nt, Mycobacterium tuberculosis H37Rv
aggaacucggacccaccc

SEQ ID NO: 3267487 - RNA, 17 nt, Mycobacterium tuberculosis H37Rv
aggaacucggcccacac

SEQ ID NO: 3267488 - RNA, 21 nt, Mycobacterium tuberculosis H37Rv
aggaacugaaacgcuuggccc

SEQ ID NO: 3267489 - RNA, 23 nt, Mycobacterium tuberculosis H37Rv
aggaacuggaccggugccagcag

SEQ ID NO: 3267490 - RNA, 17 nt, Mycobacterium tuberculosis H37Rv
aggaagaucaccucccg

SEQ ID NO: 3267491 - RNA, 22 nt, Mycobacterium tuberculosis H37Rv
aggaagccgcggccacgguaga

SEQ ID NO: 3267492 - RNA, 14 nt, Mycobacterium tuberculosis H37Rv
aggaagcggccggu

SEQ ID NO: 3267493 - RNA, 22 nt, Mycobacterium tuberculosis H37Rv
aggaaggugugcgucuccagcu

SEQ ID NO: 3267494 - RNA, 22 nt, Mycobacterium tuberculosis H37Rv
aggaaucguucgggguggugga

SEQ ID NO: 3267495 - RNA, 16 nt, Mycobacterium tuberculosis H37Rv
aggaaugccgcgggga

SEQ ID NO: 3267496 - RNA, 16 nt, Mycobacterium tuberculosis H37Rv
aggacaagccgcugau

SEQ ID NO: 3267497 - RNA, 15 nt, Mycobacterium tuberculosis H37Rv
aggacacauugacca

SEQ ID NO: 3267498 - RNA, 13 nt, Mycobacterium tuberculosis H37Rv
aggacaccaccgu

SEQ ID NO: 3267499 - RNA, 20 nt, Mycobacterium tuberculosis H37Rv
aggacaccaccguggccucg

SEQ ID NO: 3267500 - RNA, 18 nt, Mycobacterium tuberculosis H37Rv
aggacaccgucaugccgu

SEQ ID NO: 3267501 - RNA, 23 nt, Mycobacterium tuberculosis H37Rv
aggacacguggugggcgcagagu

SEQ ID NO: 3267502 - RNA, 20 nt, Mycobacterium tuberculosis H37Rv
aggacagcugguugugcugg

SEQ ID NO: 3267503 - RNA, 15 nt, Mycobacterium tuberculosis H37Rv
aggacauucccgagu

SEQ ID NO: 3267504 - RNA, 14 nt, Mycobacterium tuberculosis H37Rv
aggaccagaggcgc

SEQ ID NO: 3267505 - RNA, 16 nt, Mycobacterium tuberculosis H37Rv
aggaccgcgccgauca

SEQ ID NO: 3267506 - RNA, 21 nt, Mycobacterium tuberculosis H37Rv
aggaccgcgccgaucaccacc

SEQ ID NO: 3267507 - RNA, 19 nt, Mycobacterium tuberculosis H37Rv
aggaccgggaucgucaggc

SEQ ID NO: 3267508 - RNA, 19 nt, Mycobacterium tuberculosis H37Rv
aggcccgguugcggucaga

SEQ ID NO: 3267509 - RNA, 16 nt, Mycobacterium tuberculosis H37Rv
aggcccugcggccacg

SEQ ID NO: 3267510 - RNA, 15 nt, Mycobacterium tuberculosis H37Rv
aggcccuggccaccc

SEQ ID NO: 3267511 - RNA, 17 nt, Mycobacterium tuberculosis H37Rv
aggcccuggccacccag

SEQ ID NO: 3267512 - RNA, 13 nt, Mycobacterium tuberculosis H37Rv
aggcccuggccag

SEQ ID NO: 3267513 - RNA, 15 nt, Mycobacterium tuberculosis H37Rv
aggccgaaauccaga

SEQ ID NO: 3267514 - RNA, 22 nt, Mycobacterium tuberculosis H37Rv
aggccgaacagccgagccagca

SEQ ID NO: 3267515 - RNA, 13 nt, Mycobacterium tuberculosis H37Rv
aggccgaccagca

SEQ ID NO: 3267516 - RNA, 21 nt, Mycobacterium tuberculosis H37Rv
aggccgaccucguucgucacc

SEQ ID NO: 3267517 - RNA, 13 nt, Mycobacterium tuberculosis H37Rv
aggccgaccugua

SEQ ID NO: 3267518 - RNA, 12 nt, Mycobacterium tuberculosis H37Rv
aggccgagcaga

SEQ ID NO: 3267519 - RNA, 19 nt, Mycobacterium tuberculosis H37Rv
aggccgagcagauacuugu

SEQ ID NO: 3267520 - RNA, 14 nt, Mycobacterium tuberculosis H37Rv
aggccgagcccggu

SEQ ID NO: 3267521 - RNA, 14 nt, Mycobacterium tuberculosis H37Rv
aggccgagcgcgau

SEQ ID NO: 3267522 - RNA, 13 nt, Mycobacterium tuberculosis H37Rv
aggccgaggaagg

SEQ ID NO: 3267523 - RNA, 13 nt, Mycobacterium tuberculosis H37Rv
aggccgcaaugcg

SEQ ID NO: 3267524 - RNA, 19 nt, Mycobacterium tuberculosis H37Rv
aggccgcaaugcguugacc

SEQ ID NO: 3267525 - RNA, 14 nt, Mycobacterium tuberculosis H37Rv
aggccgcacagcac

SEQ ID NO: 3267526 - RNA, 16 nt, Mycobacterium tuberculosis H37Rv
aggccgcacagcacca

SEQ ID NO: 3267527 - RNA, 13 nt, Mycobacterium tuberculosis H37Rv
aggccgcaccgcc

SEQ ID NO: 3267528 - RNA, 13 nt, Mycobacterium tuberculosis H37Rv
aggccgcacgucg

SEQ ID NO: 3267529 - RNA, 18 nt, Mycobacterium tuberculosis H37Rv
aggccgcaugccacggca

SEQ ID NO: 3267530 - RNA, 16 nt, Mycobacterium tuberculosis H37Rv
aggccgccaucgccgc

SEQ ID NO: 3267531 - RNA, 22 nt, Mycobacterium tuberculosis H37Rv
aggccgccgccgucggcgagca

SEQ ID NO: 3267532 - RNA, 16 nt, Mycobacterium tuberculosis H37Rv
aggccgccggacccgu

SEQ ID NO: 3267533 - RNA, 13 nt, Mycobacterium tuberculosis H37Rv
aggccgccggcca

SEQ ID NO: 3267534 - RNA, 16 nt, Mycobacterium tuberculosis H37Rv
aggccgccguggugau

SEQ ID NO: 3267535 - RNA, 15 nt, Mycobacterium tuberculosis H37Rv
aggccgcgcgcaggg

SEQ ID NO: 3267536 - RNA, 19 nt, Mycobacterium tuberculosis H37Rv
aggccgcgcggacccagca

SEQ ID NO: 3267537 - RNA, 22 nt, Mycobacterium tuberculosis H37Rv
aggccgcgcggacccagcaccc

SEQ ID NO: 3267538 - RNA, 12 nt, Mycobacterium tuberculosis H37Rv
aggccgcgguga

SEQ ID NO: 3267539 - RNA, 15 nt, Mycobacterium tuberculosis H37Rv
aggccgcguugccgg

SEQ ID NO: 3267540 - RNA, 18 nt, Mycobacterium tuberculosis H37Rv
aggccgcguugccggucg

SEQ ID NO: 3267541 - RNA, 14 nt, Mycobacterium tuberculosis H37Rv
aggccgcugccagc

SEQ ID NO: 3267542 - RNA, 16 nt, Mycobacterium tuberculosis H37Rv
aggccgcugccagcau

SEQ ID NO: 3267543 - RNA, 14 nt, Mycobacterium tuberculosis H37Rv
aggccgcugggccg

SEQ ID NO: 3267544 - RNA, 17 nt, Mycobacterium tuberculosis H37Rv
aggccgcuugccccgcc

SEQ ID NO: 3267545 - RNA, 22 nt, Mycobacterium tuberculosis H37Rv
aggccgcuugccccgccuuggc

SEQ ID NO: 3267546 - RNA, 19 nt, Mycobacterium tuberculosis H37Rv
aggccggaagauccgggcc

SEQ ID NO: 3267547 - RNA, 18 nt, Mycobacterium tuberculosis H37Rv
aggccggagucgacgacg

SEQ ID NO: 3267548 - RNA, 20 nt, Mycobacterium tuberculosis H37Rv
aggccggcagcuugcagugc

SEQ ID NO: 3267549 - RNA, 12 nt, Mycobacterium tuberculosis H37Rv
aggccggccacc

SEQ ID NO: 3267550 - RNA, 20 nt, Mycobacterium tuberculosis H37Rv
aggccggccaccaguccgau

SEQ ID NO: 3267551 - RNA, 17 nt, Mycobacterium tuberculosis H37Rv
aggccggcggcgguggu

SEQ ID NO: 3267552 - RNA, 19 nt, Mycobacterium tuberculosis H37Rv
aggccggcggucagcagcg

SEQ ID NO: 3267553 - RNA, 17 nt, Mycobacterium tuberculosis H37Rv
aggccggcuaccgcgcu

SEQ ID NO: 3267554 - RNA, 13 nt, Mycobacterium tuberculosis H37Rv
aggccggcucgcu

SEQ ID NO: 3267555 - RNA, 17 nt, Mycobacterium tuberculosis H37Rv
aggccgggccggccacg

SEQ ID NO: 3267556 - RNA, 20 nt, Mycobacterium tuberculosis H37Rv
aggccgggcgcaagcagccc

SEQ ID NO: 3267557 - RNA, 21 nt, Mycobacterium tuberculosis H37Rv
aggccggguggccacgcccag

SEQ ID NO: 3267558 - RNA, 18 nt, Mycobacterium tuberculosis H37Rv
aggccggugaacggcagc

SEQ ID NO: 3267559 - RNA, 23 nt, Mycobacterium tuberculosis H37Rv
aggccggugcgucacagccgggu

SEQ ID NO: 3267560 - RNA, 15 nt, Mycobacterium tuberculosis H37Rv
aggccgguucccuug

SEQ ID NO: 3267561 - RNA, 23 nt, Mycobacterium tuberculosis H37Rv
aggccgguucccuuguucccgaa

SEQ ID NO: 3267562 - RNA, 18 nt, Mycobacterium tuberculosis H37Rv
aggccguccucggucagc

SEQ ID NO: 3267563 - RNA, 16 nt, Mycobacterium tuberculosis H37Rv
aggccgucguugccgg

SEQ ID NO: 3267564 - RNA, 22 nt, Mycobacterium tuberculosis H37Rv
aggccgucguugccggcgacca

SEQ ID NO: 3267565 - RNA, 14 nt, Mycobacterium tuberculosis H37Rv
aggccuagcgcggc

SEQ ID NO: 3267566 - RNA, 17 nt, Mycobacterium tuberculosis H37Rv
aggccuaguccggcacu

SEQ ID NO: 3267567 - RNA, 13 nt, Mycobacterium tuberculosis H37Rv
aggccuccaaaau

SEQ ID NO: 3267568 - RNA, 14 nt, Mycobacterium tuberculosis H37Rv
aggccuccaaaauc

SEQ ID NO: 3267569 - RNA, 13 nt, Mycobacterium tuberculosis H37Rv
aggccucggcagc

SEQ ID NO: 3267570 - RNA, 15 nt, Mycobacterium tuberculosis H37Rv
aggccucggcagcaa

SEQ ID NO: 3267571 - RNA, 15 nt, Mycobacterium tuberculosis H37Rv
aggccucggccagcg

SEQ ID NO: 3267572 - RNA, 23 nt, Mycobacterium tuberculosis H37Rv
aggccucggcgccgcccagcauc

SEQ ID NO: 3267573 - RNA, 19 nt, Mycobacterium tuberculosis H37Rv
aggccugacugaauuuggu

SEQ ID NO: 3267574 - RNA, 20 nt, Mycobacterium tuberculosis H37Rv
aggccuugacguagaagucg

SEQ ID NO: 3267575 - RNA, 13 nt, Mycobacterium tuberculosis H37Rv
aggcgaaaucgga

SEQ ID NO: 3267576 - RNA, 21 nt, Mycobacterium tuberculosis H37Rv
aggcgaagcgggacugcagcg

SEQ ID NO: 3267577 - RNA, 14 nt, Mycobacterium tuberculosis H37Rv
aggcgaccggacga

SEQ ID NO: 3267578 - RNA, 17 nt, Mycobacterium tuberculosis H37Rv
aggcgaccggacgagcg

SEQ ID NO: 3267579 - RNA, 21 nt, Mycobacterium tuberculosis H37Rv
aggcgaccggacgagcgucag

SEQ ID NO: 3267580 - RNA, 16 nt, Mycobacterium tuberculosis H37Rv
aggcgacggcucuacc

SEQ ID NO: 3267581 - RNA, 16 nt, Mycobacterium tuberculosis H37Rv
aggcgagaagcgucgc

SEQ ID NO: 3267582 - RNA, 13 nt, Mycobacterium tuberculosis H37Rv
aggcgauccagac

SEQ ID NO: 3267583 - RNA, 20 nt, Mycobacterium tuberculosis H37Rv
aggcgaugcgccaggcugaa

SEQ ID NO: 3267584 - RNA, 16 nt, Mycobacterium tuberculosis H37Rv
aggcgauggucuccuc

SEQ ID NO: 3267585 - RNA, 14 nt, Mycobacterium tuberculosis H37Rv
aggcgauugcccgc

SEQ ID NO: 3267586 - RNA, 16 nt, Mycobacterium tuberculosis H37Rv
aggcgauugcgccgca

SEQ ID NO: 3267587 - RNA, 17 nt, Mycobacterium tuberculosis H37Rv
aggcgauugcgccgcac

SEQ ID NO: 3267588 - RNA, 19 nt, Mycobacterium tuberculosis H37Rv
aggcgcauagggccaccgc

SEQ ID NO: 3267589 - RNA, 12 nt, Mycobacterium tuberculosis H37Rv
aggcgcccacaa

SEQ ID NO: 3267590 - RNA, 13 nt, Mycobacterium tuberculosis H37Rv
aggcgcccagcac

SEQ ID NO: 3267591 - RNA, 13 nt, Mycobacterium tuberculosis H37Rv
aggcgccggucgc

SEQ ID NO: 3267592 - RNA, 22 nt, Mycobacterium tuberculosis H37Rv
aggcgcgacguacgaguagugc

SEQ ID NO: 3267593 - RNA, 13 nt, Mycobacterium tuberculosis H37Rv
aggcgcgcaccac

SEQ ID NO: 3267594 - RNA, 13 nt, Mycobacterium tuberculosis H37Rv
aggcgcgccgcac

SEQ ID NO: 3267595 - RNA, 15 nt, Mycobacterium tuberculosis H37Rv
aggcgcggucaccgc

SEQ ID NO: 3267596 - RNA, 16 nt, Mycobacterium tuberculosis H37Rv
aggcgcucaucaccca

SEQ ID NO: 3267597 - RNA, 17 nt, Mycobacterium tuberculosis H37Rv
aggcgcucaucacccag

SEQ ID NO: 3267598 - RNA, 22 nt, Mycobacterium tuberculosis H37Rv
aggcgcuccuucagggcgucga

SEQ ID NO: 3267599 - RNA, 15 nt, Mycobacterium tuberculosis H37Rv
aggcgcugaacgcga

SEQ ID NO: 3267600 - RNA, 22 nt, Mycobacterium tuberculosis H37Rv
aggcgcugaacgcgagcaacac

SEQ ID NO: 3267601 - RNA, 22 nt, Mycobacterium tuberculosis H37Rv
aggcgcugaagaucaacaggcg

SEQ ID NO: 3267602 - RNA, 23 nt, Mycobacterium tuberculosis H37Rv
aggcgcugaagaucaacaggcgu

SEQ ID NO: 3267603 - RNA, 20 nt, Mycobacterium tuberculosis H37Rv
aggcgcuucgccacaccaug

SEQ ID NO: 3267604 - RNA, 18 nt, Mycobacterium tuberculosis H37Rv
aggcggccacaaacccga

SEQ ID NO: 3267605 - RNA, 21 nt, Mycobacterium tuberculosis H37Rv
agggcgccacugaccgcgauc

SEQ ID NO: 3267606 - RNA, 16 nt, Mycobacterium tuberculosis H37Rv
agggcgcccgccccgc

SEQ ID NO: 3267607 - RNA, 19 nt, Mycobacterium tuberculosis H37Rv
agggcgccgacgacuccgg

SEQ ID NO: 3267608 - RNA, 13 nt, Mycobacterium tuberculosis H37Rv
agggcgccgaucg

SEQ ID NO: 3267609 - RNA, 17 nt, Mycobacterium tuberculosis H37Rv
agggcggaaacggcacc

SEQ ID NO: 3267610 - RNA, 15 nt, Mycobacterium tuberculosis H37Rv
agggcggcagcgagg

SEQ ID NO: 3267611 - RNA, 20 nt, Mycobacterium tuberculosis H37Rv
agggcggcagcgaggcucgc

SEQ ID NO: 3267612 - RNA, 15 nt, Mycobacterium tuberculosis H37Rv
agggcggccgcggug

SEQ ID NO: 3267613 - RNA, 16 nt, Mycobacterium tuberculosis H37Rv
agggcggccgcgguga

SEQ ID NO: 3267614 - RNA, 18 nt, Mycobacterium tuberculosis H37Rv
agggcggggcagaagucg

SEQ ID NO: 3267615 - RNA, 19 nt, Mycobacterium tuberculosis H37Rv
agggcggugccaucgggcg

SEQ ID NO: 3267616 - RNA, 18 nt, Mycobacterium tuberculosis H37Rv
agggcgucgaacucaucu

SEQ ID NO: 3267617 - RNA, 13 nt, Mycobacterium tuberculosis H37Rv
agggcgucgccgc

SEQ ID NO: 3267618 - RNA, 12 nt, Mycobacterium tuberculosis H37Rv
agggcuccaccg

SEQ ID NO: 3267619 - RNA, 11 nt, Mycobacterium tuberculosis H37Rv
agggcucggcg

SEQ ID NO: 3267620 - RNA, 15 nt, Mycobacterium tuberculosis H37Rv
agggcucggcggccc

SEQ ID NO: 3267621 - RNA, 17 nt, Mycobacterium tuberculosis H37Rv
agggcucggcggcccgg

SEQ ID NO: 3267622 - RNA, 16 nt, Mycobacterium tuberculosis H37Rv
agggcugcgaugcggu

SEQ ID NO: 3267623 - RNA, 13 nt, Mycobacterium tuberculosis H37Rv
agggcugcuccug

SEQ ID NO: 3267624 - RNA, 18 nt, Mycobacterium tuberculosis H37Rv
agggcugucguuugacga

SEQ ID NO: 3267625 - RNA, 20 nt, Mycobacterium tuberculosis H37Rv
agggcuguugacgccacgac

SEQ ID NO: 3267626 - RNA, 16 nt, Mycobacterium tuberculosis H37Rv
agggcuuccagggcga

SEQ ID NO: 3267627 - RNA, 15 nt, Mycobacterium tuberculosis H37Rv
agggcuugucgccgg

SEQ ID NO: 3267628 - RNA, 19 nt, Mycobacterium tuberculosis H37Rv
agggcuuguggugagcgga

SEQ ID NO: 3267629 - RNA, 20 nt, Mycobacterium tuberculosis H37Rv
aggggacccagcggcggucu

SEQ ID NO: 3267630 - RNA, 14 nt, Mycobacterium tuberculosis H37Rv
aggggaucaccggc

SEQ ID NO: 3267631 - RNA, 18 nt, Mycobacterium tuberculosis H37Rv
aggggaucaccggcugcu

SEQ ID NO: 3267632 - RNA, 20 nt, Mycobacterium tuberculosis H37Rv
aggggaucguccggccgggg

SEQ ID NO: 3267633 - RNA, 19 nt, Mycobacterium tuberculosis H37Rv
aggggauuuugcgucugcu

SEQ ID NO: 3267634 - RNA, 14 nt, Mycobacterium tuberculosis H37Rv
aggggcaacagggg

SEQ ID NO: 3267635 - RNA, 19 nt, Mycobacterium tuberculosis H37Rv
aggggcaauugccugcgcu

SEQ ID NO: 3267636 - RNA, 17 nt, Mycobacterium tuberculosis H37Rv
aggggcagcgcggccac

SEQ ID NO: 3267637 - RNA, 19 nt, Mycobacterium tuberculosis H37Rv
aggggcgccuuugccccgu

SEQ ID NO: 3267638 - RNA, 23 nt, Mycobacterium tuberculosis H37Rv
aggggcgucgcaacgcgaucacc

SEQ ID NO: 3267639 - RNA, 20 nt, Mycobacterium tuberculosis H37Rv
aggggcgucugcagcgggcg

SEQ ID NO: 3267640 - RNA, 17 nt, Mycobacterium tuberculosis H37Rv
aggggcuuuugcgucug

SEQ ID NO: 3267641 - RNA, 19 nt, Mycobacterium tuberculosis H37Rv
aggggcuuuugcgucugcu

SEQ ID NO: 3267642 - RNA, 19 nt, Mycobacterium tuberculosis H37Rv
aggggguggugucgcggcc

SEQ ID NO: 3267643 - RNA, 18 nt, Mycobacterium tuberculosis H37Rv
aggggugcccggcggcca

SEQ ID NO: 3267644 - RNA, 16 nt, Mycobacterium tuberculosis H37Rv
agggguggcgcgggcc

SEQ ID NO: 3267645 - RNA, 11 nt, Mycobacterium tuberculosis H37Rv
agggguuggcg

SEQ ID NO: 3267646 - RNA, 19 nt, Mycobacterium tuberculosis H37Rv
aggguauccacgccgggca

SEQ ID NO: 3267647 - RNA, 16 nt, Mycobacterium tuberculosis H37Rv
agggucacaaacccag

SEQ ID NO: 3267648 - RNA, 18 nt, Mycobacterium tuberculosis H37Rv
agggucacaaacccagca

SEQ ID NO: 3267649 - RNA, 21 nt, Mycobacterium tuberculosis H37Rv
agggucagcucggugaugucg

SEQ ID NO: 3267650 - RNA, 16 nt, Mycobacterium tuberculosis H37Rv
agggucaugucgauca

SEQ ID NO: 3267651 - RNA, 19 nt, Mycobacterium tuberculosis H37Rv
agggucgaguucgcagucg

SEQ ID NO: 3267652 - RNA, 18 nt, Mycobacterium tuberculosis H37Rv
agggucgggguccgcggc

SEQ ID NO: 3267653 - RNA, 22 nt, Mycobacterium tuberculosis H37Rv
agggucugcucauccgggugcu

SEQ ID NO: 3267654 - RNA, 18 nt, Mycobacterium tuberculosis H37Rv
agggugacccccaauccu

SEQ ID NO: 3267655 - RNA, 13 nt, Mycobacterium tuberculosis H37Rv
agggugcccgcgu

SEQ ID NO: 3267656 - RNA, 17 nt, Mycobacterium tuberculosis H37Rv
agggugcccucggccgc

SEQ ID NO: 3267657 - RNA, 15 nt, Mycobacterium tuberculosis H37Rv
agggugccggucacg

SEQ ID NO: 3267658 - RNA, 19 nt, Mycobacterium tuberculosis H37Rv
agggugccggucacgucga

SEQ ID NO: 3267659 - RNA, 15 nt, Mycobacterium tuberculosis H37Rv
agggugccgucgggu

SEQ ID NO: 3267660 - RNA, 17 nt, Mycobacterium tuberculosis H37Rv
agggugcguuggaugaa

SEQ ID NO: 3267661 - RNA, 15 nt, Mycobacterium tuberculosis H37Rv
agggugcucgucacc

SEQ ID NO: 3267662 - RNA, 17 nt, Mycobacterium tuberculosis H37Rv
agggugcucgucaccaa

SEQ ID NO: 3267663 - RNA, 13 nt, Mycobacterium tuberculosis H37Rv
aggguggccagca

SEQ ID NO: 3267664 - RNA, 12 nt, Mycobacterium tuberculosis H37Rv
aggguggccgac

SEQ ID NO: 3267665 - RNA, 16 nt, Mycobacterium tuberculosis H37Rv
agggugggcucguugu

SEQ ID NO: 3267666 - RNA, 20 nt, Mycobacterium tuberculosis H37Rv
aggguggggcgguggccggc

SEQ ID NO: 3267667 - RNA, 14 nt, Mycobacterium tuberculosis H37Rv
aggguguccgucga

SEQ ID NO: 3267668 - RNA, 16 nt, Mycobacterium tuberculosis H37Rv
aggguuuccaagucgg

SEQ ID NO: 3267669 - RNA, 17 nt, Mycobacterium tuberculosis H37Rv
agguaagcagccagcaa

SEQ ID NO: 3267670 - RNA, 14 nt, Mycobacterium tuberculosis H37Rv
agguaauucgucca

SEQ ID NO: 3267671 - RNA, 20 nt, Mycobacterium tuberculosis H37Rv
agguacccggucggguccaa

SEQ ID NO: 3267672 - RNA, 14 nt, Mycobacterium tuberculosis H37Rv
agguagcgcgcaac

SEQ ID NO: 3267673 - RNA, 15 nt, Mycobacterium tuberculosis H37Rv
agguaggucaccagg

SEQ ID NO: 3267674 - RNA, 13 nt, Mycobacterium tuberculosis H37Rv
agguagucgacga

SEQ ID NO: 3267675 - RNA, 22 nt, Mycobacterium tuberculosis H37Rv
agguagucggcgcgucguugcc

SEQ ID NO: 3267676 - RNA, 13 nt, Mycobacterium tuberculosis H37Rv
agguaugcccgga

SEQ ID NO: 3267677 - RNA, 15 nt, Mycobacterium tuberculosis H37Rv
agguauucccacugc

SEQ ID NO: 3267678 - RNA, 16 nt, Mycobacterium tuberculosis H37Rv
agguauuugccgugcu

SEQ ID NO: 3267679 - RNA, 18 nt, Mycobacterium tuberculosis H37Rv
aggucaacgccacgccga

SEQ ID NO: 3267680 - RNA, 21 nt, Mycobacterium tuberculosis H37Rv
aggucaauggucuuuguccac

SEQ ID NO: 3267681 - RNA, 21 nt, Mycobacterium tuberculosis H37Rv
aggucacacguuggcagcccu

SEQ ID NO: 3267682 - RNA, 24 nt, Mycobacterium tuberculosis H37Rv
aggucacacguuggcagcccucug

SEQ ID NO: 3267683 - RNA, 17 nt, Mycobacterium tuberculosis H37Rv
aggucaccggccgccga

SEQ ID NO: 3267684 - RNA, 13 nt, Mycobacterium tuberculosis H37Rv
aggucaccgucga

SEQ ID NO: 3267685 - RNA, 19 nt, Mycobacterium tuberculosis H37Rv
aggucagccgcgcggguca

SEQ ID NO: 3267686 - RNA, 15 nt, Mycobacterium tuberculosis H37Rv
aggucagcgcugcca

SEQ ID NO: 3267687 - RNA, 21 nt, Mycobacterium tuberculosis H37Rv
aggucaggugauucgcgcagc

SEQ ID NO: 3267688 - RNA, 19 nt, Mycobacterium tuberculosis H37Rv
aggucauggcuuuggccgc

SEQ ID NO: 3267689 - RNA, 22 nt, Mycobacterium tuberculosis H37Rv
agguccaaguccuccacggcgg

SEQ ID NO: 3267690 - RNA, 16 nt, Mycobacterium tuberculosis H37Rv
agguccaccccgccga

SEQ ID NO: 3267691 - RNA, 19 nt, Mycobacterium tuberculosis H37Rv
agguccgaucgugugaggc

SEQ ID NO: 3267692 - RNA, 23 nt, Mycobacterium tuberculosis H37Rv
agguccgcacgaucugcaggccc

SEQ ID NO: 3267693 - RNA, 16 nt, Mycobacterium tuberculosis H37Rv
agguccgccaccgcga

SEQ ID NO: 3267694 - RNA, 18 nt, Mycobacterium tuberculosis H37Rv
agguccgccggugccgcc

SEQ ID NO: 3267695 - RNA, 20 nt, Mycobacterium tuberculosis H37Rv
agguccgccggugccgccgu

SEQ ID NO: 3267696 - RNA, 17 nt, Mycobacterium tuberculosis H37Rv
agguccgugccgaugcc

SEQ ID NO: 3267697 - RNA, 20 nt, Mycobacterium tuberculosis H37Rv
agguccucagcgaugcucac

SEQ ID NO: 3267698 - RNA, 17 nt, Mycobacterium tuberculosis H37Rv
agguccucgagguccuc

SEQ ID NO: 3267699 - RNA, 17 nt, Mycobacterium tuberculosis H37Rv
agguccugcgccgcacg

SEQ ID NO: 3267700 - RNA, 15 nt, Mycobacterium tuberculosis H37Rv
aggucgaaccgccgg

SEQ ID NO: 3267701 - RNA, 14 nt, Mycobacterium tuberculosis H37Rv
aguacuggaauggc

SEQ ID NO: 3267702 - RNA, 20 nt, Mycobacterium tuberculosis H37Rv
aguacugguagaggcggcga

SEQ ID NO: 3267703 - RNA, 12 nt, Mycobacterium tuberculosis H37Rv
aguagcccgcgu

SEQ ID NO: 3267704 - RNA, 14 nt, Mycobacterium tuberculosis H37Rv
aguagccgcuagga

SEQ ID NO: 3267705 - RNA, 16 nt, Mycobacterium tuberculosis H37Rv
aguaggcggcuccgau

SEQ ID NO: 3267706 - RNA, 21 nt, Mycobacterium tuberculosis H37Rv
aguaggcuucgaccguggugg

SEQ ID NO: 3267707 - RNA, 15 nt, Mycobacterium tuberculosis H37Rv
aguagucgcuggcca

SEQ ID NO: 3267708 - RNA, 16 nt, Mycobacterium tuberculosis H37Rv
aguagucgcuggccag

SEQ ID NO: 3267709 - RNA, 17 nt, Mycobacterium tuberculosis H37Rv
aguagucgcuggccaga

SEQ ID NO: 3267710 - RNA, 15 nt, Mycobacterium tuberculosis H37Rv
aguaguggccgccac

SEQ ID NO: 3267711 - RNA, 12 nt, Mycobacterium tuberculosis H37Rv
aguagugguggg

SEQ ID NO: 3267712 - RNA, 11 nt, Mycobacterium tuberculosis H37Rv
aguauggccgc

SEQ ID NO: 3267713 - RNA, 19 nt, Mycobacterium tuberculosis H37Rv
aguauggccgccaccgcga

SEQ ID NO: 3267714 - RNA, 15 nt, Mycobacterium tuberculosis H37Rv
agucaacucaccguc

SEQ ID NO: 3267715 - RNA, 13 nt, Mycobacterium tuberculosis H37Rv
agucaagcagcag

SEQ ID NO: 3267716 - RNA, 22 nt, Mycobacterium tuberculosis H37Rv
agucaaucgcgucaucaacguu

SEQ ID NO: 3267717 - RNA, 19 nt, Mycobacterium tuberculosis H37Rv
agucaccaaaggcgucuga

SEQ ID NO: 3267718 - RNA, 18 nt, Mycobacterium tuberculosis H37Rv
agucaccggguccaccgc

SEQ ID NO: 3267719 - RNA, 17 nt, Mycobacterium tuberculosis H37Rv
agucaccguccacgaca

SEQ ID NO: 3267720 - RNA, 20 nt, Mycobacterium tuberculosis H37Rv
agucacgcacucccgagcca

SEQ ID NO: 3267721 - RNA, 23 nt, Mycobacterium tuberculosis H37Rv
agucagaacggcggcagcggcgu

SEQ ID NO: 3267722 - RNA, 20 nt, Mycobacterium tuberculosis H37Rv
agucaggcgccgcuaucgag

SEQ ID NO: 3267723 - RNA, 14 nt, Mycobacterium tuberculosis H37Rv
agucauccuugagg

SEQ ID NO: 3267724 - RNA, 17 nt, Mycobacterium tuberculosis H37Rv
agucaucuggcgcgcca

SEQ ID NO: 3267725 - RNA, 16 nt, Mycobacterium tuberculosis H37Rv
agucauguccauagcc

SEQ ID NO: 3267726 - RNA, 20 nt, Mycobacterium tuberculosis H37Rv
agucauguccauagccggca

SEQ ID NO: 3267727 - RNA, 18 nt, Mycobacterium tuberculosis H37Rv
aguccaacucggccaacg

SEQ ID NO: 3267728 - RNA, 20 nt, Mycobacterium tuberculosis H37Rv
aguccaccgcgcggcgcagc

SEQ ID NO: 3267729 - RNA, 23 nt, Mycobacterium tuberculosis H37Rv
aguccagcagcgacgcugccgcc

SEQ ID NO: 3267730 - RNA, 22 nt, Mycobacterium tuberculosis H37Rv
aguccaggcugaucccgaugcu

SEQ ID NO: 3267731 - RNA, 20 nt, Mycobacterium tuberculosis H37Rv
aguccagggcgccacgggug

SEQ ID NO: 3267732 - RNA, 19 nt, Mycobacterium tuberculosis H37Rv
aguccaugugcccaggucu

SEQ ID NO: 3267733 - RNA, 15 nt, Mycobacterium tuberculosis H37Rv
agucccagcgccgca

SEQ ID NO: 3267734 - RNA, 20 nt, Mycobacterium tuberculosis H37Rv
agucccgccguugccgccgu

SEQ ID NO: 3267735 - RNA, 19 nt, Mycobacterium tuberculosis H37Rv
agucccgugacgaacuucg

SEQ ID NO: 3267736 - RNA, 16 nt, Mycobacterium tuberculosis H37Rv
aguccgaaagccgccg

SEQ ID NO: 3267737 - RNA, 15 nt, Mycobacterium tuberculosis H37Rv
aguccgaagcugcug

SEQ ID NO: 3267738 - RNA, 15 nt, Mycobacterium tuberculosis H37Rv
aguccgacaccacgg

SEQ ID NO: 3267739 - RNA, 17 nt, Mycobacterium tuberculosis H37Rv
aguccgacaccacggac

SEQ ID NO: 3267740 - RNA, 22 nt, Mycobacterium tuberculosis H37Rv
aguccgacaccacggaccagcg

SEQ ID NO: 3267741 - RNA, 14 nt, Mycobacterium tuberculosis H37Rv
aguccgacaccggc

SEQ ID NO: 3267742 - RNA, 20 nt, Mycobacterium tuberculosis H37Rv
aguccgacaccggcggcauc

SEQ ID NO: 3267743 - RNA, 20 nt, Mycobacterium tuberculosis H37Rv
aguccgagggcgucgccgcc

SEQ ID NO: 3267744 - RNA, 22 nt, Mycobacterium tuberculosis H37Rv
aguccgagggcgucgccgccgu

SEQ ID NO: 3267745 - RNA, 18 nt, Mycobacterium tuberculosis H37Rv
aguccgaugccggaaugc

SEQ ID NO: 3267746 - RNA, 17 nt, Mycobacterium tuberculosis H37Rv
aguccgcauccgcgacg

SEQ ID NO: 3267747 - RNA, 12 nt, Mycobacterium tuberculosis H37Rv
aguccgccgccu

SEQ ID NO: 3267748 - RNA, 19 nt, Mycobacterium tuberculosis H37Rv
aguccgcgccgacggccag

SEQ ID NO: 3267749 - RNA, 22 nt, Mycobacterium tuberculosis H37Rv
aguccgcgccgacggccagcag

SEQ ID NO: 3267750 - RNA, 20 nt, Mycobacterium tuberculosis H37Rv
aguccgcgccggcgggcgcg

SEQ ID NO: 3267751 - RNA, 14 nt, Mycobacterium tuberculosis H37Rv
aguccgcgcucagc

SEQ ID NO: 3267752 - RNA, 22 nt, Mycobacterium tuberculosis H37Rv
aguccgcgcucagcuccggcga

SEQ ID NO: 3267753 - RNA, 23 nt, Mycobacterium tuberculosis H37Rv
aguccgcggaucaccaucgccgc

SEQ ID NO: 3267754 - RNA, 22 nt, Mycobacterium tuberculosis H37Rv
aguccggcacugcggccaguca

SEQ ID NO: 3267755 - RNA, 21 nt, Mycobacterium tuberculosis H37Rv
aguccggccccccgacuccgg

SEQ ID NO: 3267756 - RNA, 22 nt, Mycobacterium tuberculosis H37Rv
aguccggccucagcccgucagc

SEQ ID NO: 3267757 - RNA, 24 nt, Mycobacterium tuberculosis H37Rv
aguccggcuuaccggcgggcgaac

SEQ ID NO: 3267758 - RNA, 21 nt, Mycobacterium tuberculosis H37Rv
aguccgggccccuucgcagca

SEQ ID NO: 3267759 - RNA, 19 nt, Mycobacterium tuberculosis H37Rv
aguccgguagcuguggugg

SEQ ID NO: 3267760 - RNA, 20 nt, Mycobacterium tuberculosis H37Rv
aguccgguagcugugguggu

SEQ ID NO: 3267761 - RNA, 17 nt, Mycobacterium tuberculosis H37Rv
aguccguacuugccacc

SEQ ID NO: 3267762 - RNA, 19 nt, Mycobacterium tuberculosis H37Rv
aguccguacuugccaccca

SEQ ID NO: 3267763 - RNA, 14 nt, Mycobacterium tuberculosis H37Rv
aguccgucggucgc

SEQ ID NO: 3267764 - RNA, 17 nt, Mycobacterium tuberculosis H37Rv
aguccucgagugccgcc

SEQ ID NO: 3267765 - RNA, 22 nt, Mycobacterium tuberculosis H37Rv
aguccucgggcaggcggccagc

SEQ ID NO: 3267766 - RNA, 17 nt, Mycobacterium tuberculosis H37Rv
aguccugcagugcggcg

SEQ ID NO: 3267767 - RNA, 12 nt, Mycobacterium tuberculosis H37Rv
aguccuugcgcc

SEQ ID NO: 3267768 - RNA, 19 nt, Mycobacterium tuberculosis H37Rv
agucgaaaacagcgauccg

SEQ ID NO: 3267769 - RNA, 21 nt, Mycobacterium tuberculosis H37Rv
agucgaccaugagccggcgcc

SEQ ID NO: 3267770 - RNA, 19 nt, Mycobacterium tuberculosis H37Rv
agucgacgaacgccucacc

SEQ ID NO: 3267771 - RNA, 16 nt, Mycobacterium tuberculosis H37Rv
agucgacggccagugc

SEQ ID NO: 3267772 - RNA, 14 nt, Mycobacterium tuberculosis H37Rv
agucgacggucacg

SEQ ID NO: 3267773 - RNA, 22 nt, Mycobacterium tuberculosis H37Rv
agucgagcaccugccgaucggg

SEQ ID NO: 3267774 - RNA, 13 nt, Mycobacterium tuberculosis H37Rv
agucgaucgcggc

SEQ ID NO: 3267775 - RNA, 18 nt, Mycobacterium tuberculosis H37Rv
agucgaucgcggcccgca

SEQ ID NO: 3267776 - RNA, 20 nt, Mycobacterium tuberculosis H37Rv
agucgauguacaccgugcgc

SEQ ID NO: 3267777 - RNA, 21 nt, Mycobacterium tuberculosis H37Rv
agucgauuucggcggcgaggc

SEQ ID NO: 3267778 - RNA, 15 nt, Mycobacterium tuberculosis H37Rv
agucgcacugcgccg

SEQ ID NO: 3267779 - RNA, 12 nt, Mycobacterium tuberculosis H37Rv
agucgcaggauc

SEQ ID NO: 3267780 - RNA, 15 nt, Mycobacterium tuberculosis H37Rv
agucgccagaccgca

SEQ ID NO: 3267781 - RNA, 13 nt, Mycobacterium tuberculosis H37Rv
agucgcccguggc

SEQ ID NO: 3267782 - RNA, 13 nt, Mycobacterium tuberculosis H37Rv
agucgccgaaccu

SEQ ID NO: 3267783 - RNA, 11 nt, Mycobacterium tuberculosis H37Rv
agucgccgagg

SEQ ID NO: 3267784 - RNA, 22 nt, Mycobacterium tuberculosis H37Rv
agucgccgaggacgccggcgcc

SEQ ID NO: 3267785 - RNA, 23 nt, Mycobacterium tuberculosis H37Rv
agucgccgaggacgccggcgccg

SEQ ID NO: 3267786 - RNA, 14 nt, Mycobacterium tuberculosis H37Rv
agucgccgcgggca

SEQ ID NO: 3267787 - RNA, 14 nt, Mycobacterium tuberculosis H37Rv
agucgccggccggc

SEQ ID NO: 3267788 - RNA, 20 nt, Mycobacterium tuberculosis H37Rv
agucgcgcgccaagacgaac

SEQ ID NO: 3267789 - RNA, 20 nt, Mycobacterium tuberculosis H37Rv
agucgcgguaccaucaccgc

SEQ ID NO: 3267790 - RNA, 22 nt, Mycobacterium tuberculosis H37Rv
agucgcuaaagcccccgacacg

SEQ ID NO: 3267791 - RNA, 14 nt, Mycobacterium tuberculosis H37Rv
agucgcuaagacuu

SEQ ID NO: 3267792 - RNA, 14 nt, Mycobacterium tuberculosis H37Rv
agucggagcgggga

SEQ ID NO: 3267793 - RNA, 21 nt, Mycobacterium tuberculosis H37Rv
agucggagugguauccaggcc

SEQ ID NO: 3267794 - RNA, 13 nt, Mycobacterium tuberculosis H37Rv
agucggcaaacaa

SEQ ID NO: 3267795 - RNA, 21 nt, Mycobacterium tuberculosis H37Rv
agucggcaaacaacgacuccu

SEQ ID NO: 3267796 - RNA, 21 nt, Mycobacterium tuberculosis H37Rv
agucggcauugcugguugcgc

SEQ ID NO: 3267797 - RNA, 23 nt, Mycobacterium tuberculosis H37Rv
aguggggauucguugucgagcac

SEQ ID NO: 3267798 - RNA, 17 nt, Mycobacterium tuberculosis H37Rv
agugggucaagaucggu

SEQ ID NO: 3267799 - RNA, 21 nt, Mycobacterium tuberculosis H37Rv
agugguacggcucggcgcuga

SEQ ID NO: 3267800 - RNA, 14 nt, Mycobacterium tuberculosis H37Rv
agugguccagccag

SEQ ID NO: 3267801 - RNA, 22 nt, Mycobacterium tuberculosis H37Rv
aguggucccggugaugaccgga

SEQ ID NO: 3267802 - RNA, 15 nt, Mycobacterium tuberculosis H37Rv
aguggugaccgacgc

SEQ ID NO: 3267803 - RNA, 17 nt, Mycobacterium tuberculosis H37Rv
aguggugauccagccgu

SEQ ID NO: 3267804 - RNA, 19 nt, Mycobacterium tuberculosis H37Rv
aguggugauccagccgucg

SEQ ID NO: 3267805 - RNA, 15 nt, Mycobacterium tuberculosis H37Rv
aguggugggcguggc

SEQ ID NO: 3267806 - RNA, 18 nt, Mycobacterium tuberculosis H37Rv
aguggugggcguggcugg

SEQ ID NO: 3267807 - RNA, 15 nt, Mycobacterium tuberculosis H37Rv
agugguugcccgcac

SEQ ID NO: 3267808 - RNA, 12 nt, Mycobacterium tuberculosis H37Rv
agugucagcaga

SEQ ID NO: 3267809 - RNA, 13 nt, Mycobacterium tuberculosis H37Rv
agugucagcagau

SEQ ID NO: 3267810 - RNA, 21 nt, Mycobacterium tuberculosis H37Rv
aguguccggcgacgcguagca

SEQ ID NO: 3267811 - RNA, 22 nt, Mycobacterium tuberculosis H37Rv
agugucuccggcaacagcacca

SEQ ID NO: 3267812 - RNA, 13 nt, Mycobacterium tuberculosis H37Rv
agugucugcucgc

SEQ ID NO: 3267813 - RNA, 17 nt, Mycobacterium tuberculosis H37Rv
agugucuuagccagcag

SEQ ID NO: 3267814 - RNA, 18 nt, Mycobacterium tuberculosis H37Rv
agugucuuagccagcagc

SEQ ID NO: 3267815 - RNA, 16 nt, Mycobacterium tuberculosis H37Rv
agugugagcagaccca

SEQ ID NO: 3267816 - RNA, 16 nt, Mycobacterium tuberculosis H37Rv
agugugauuccggguc

SEQ ID NO: 3267817 - RNA, 13 nt, Mycobacterium tuberculosis H37Rv
agugugcccugcu

SEQ ID NO: 3267818 - RNA, 18 nt, Mycobacterium tuberculosis H37Rv
aguguggccgaaagccag

SEQ ID NO: 3267819 - RNA, 17 nt, Mycobacterium tuberculosis H37Rv
agugugggggucagggg

SEQ ID NO: 3267820 - RNA, 19 nt, Mycobacterium tuberculosis H37Rv
aguguguuugaguugcccg

SEQ ID NO: 3267821 - RNA, 20 nt, Mycobacterium tuberculosis H37Rv
aguguugcgcugcggccagc

SEQ ID NO: 3267822 - RNA, 22 nt, Mycobacterium tuberculosis H37Rv
aguguugcgcugcggccagcgc

SEQ ID NO: 3267823 - RNA, 20 nt, Mycobacterium tuberculosis H37Rv
aguguuuggguuuuguuugg

SEQ ID NO: 3267824 - RNA, 15 nt, Mycobacterium tuberculosis H37Rv
aguuauagaagccga

SEQ ID NO: 3267825 - RNA, 14 nt, Mycobacterium tuberculosis H37Rv
aguuaucagccgcg

SEQ ID NO: 3267826 - RNA, 16 nt, Mycobacterium tuberculosis H37Rv
aguucaccaacgcggg

SEQ ID NO: 3267827 - RNA, 19 nt, Mycobacterium tuberculosis H37Rv
aguucaccaacgcgggaac

SEQ ID NO: 3267828 - RNA, 14 nt, Mycobacterium tuberculosis H37Rv
aguucacgguugau

SEQ ID NO: 3267829 - RNA, 19 nt, Mycobacterium tuberculosis H37Rv
aguucagccaggccgcaau

SEQ ID NO: 3267830 - RNA, 15 nt, Mycobacterium tuberculosis H37Rv
aguuccaauccggaa

SEQ ID NO: 3267831 - RNA, 23 nt, Mycobacterium tuberculosis H37Rv
aguucccugaugggcgaauugca

SEQ ID NO: 3267832 - RNA, 18 nt, Mycobacterium tuberculosis H37Rv
aguuccgcaccgaacgug

SEQ ID NO: 3267833 - RNA, 15 nt, Mycobacterium tuberculosis H37Rv
aguuccgggguggac

SEQ ID NO: 3267834 - RNA, 22 nt, Mycobacterium tuberculosis H37Rv
aguuccggucgacuccagcacc

SEQ ID NO: 3267835 - RNA, 17 nt, Mycobacterium tuberculosis H37Rv
aguuccucguggguccg

SEQ ID NO: 3267836 - RNA, 18 nt, Mycobacterium tuberculosis H37Rv
aguuccugacgccauuca

SEQ ID NO: 3267837 - RNA, 13 nt, Mycobacterium tuberculosis H37Rv
aguucgaccggcg

SEQ ID NO: 3267838 - RNA, 14 nt, Mycobacterium tuberculosis H37Rv
aguucgagcugcca

SEQ ID NO: 3267839 - RNA, 21 nt, Mycobacterium tuberculosis H37Rv
aguucgcaugcuugaaaccca

SEQ ID NO: 3267840 - RNA, 13 nt, Mycobacterium tuberculosis H37Rv
aguucgcggcugc

SEQ ID NO: 3267841 - RNA, 15 nt, Mycobacterium tuberculosis H37Rv
aguucggcagcgggc

SEQ ID NO: 3267842 - RNA, 13 nt, Mycobacterium tuberculosis H37Rv
aguucggccacca

SEQ ID NO: 3267843 - RNA, 16 nt, Mycobacterium tuberculosis H37Rv
aguucggccaccaacc

SEQ ID NO: 3267844 - RNA, 22 nt, Mycobacterium tuberculosis H37Rv
aguucggcgucuugcaucagcg

SEQ ID NO: 3267845 - RNA, 16 nt, Mycobacterium tuberculosis H37Rv
aguucgggcugcggca

SEQ ID NO: 3267846 - RNA, 18 nt, Mycobacterium tuberculosis H37Rv
aguucggugagccgggcg

SEQ ID NO: 3267847 - RNA, 22 nt, Mycobacterium tuberculosis H37Rv
aguucgguugcccccagggccg

SEQ ID NO: 3267848 - RNA, 16 nt, Mycobacterium tuberculosis H37Rv
aguucgucgggaucgu

SEQ ID NO: 3267849 - RNA, 19 nt, Mycobacterium tuberculosis H37Rv
aguucgucgguugccacgc

SEQ ID NO: 3267850 - RNA, 16 nt, Mycobacterium tuberculosis H37Rv
aguucuaccaccuugc

SEQ ID NO: 3267851 - RNA, 20 nt, Mycobacterium tuberculosis H37Rv
aguucugcacagugcggccc

SEQ ID NO: 3267852 - RNA, 19 nt, Mycobacterium tuberculosis H37Rv
aguucugcgcucccguacg

SEQ ID NO: 3267853 - RNA, 16 nt, Mycobacterium tuberculosis H37Rv
aguucuucgcgaagaa

SEQ ID NO: 3267854 - RNA, 20 nt, Mycobacterium tuberculosis H37Rv
aguucuugauuagccauuaa

SEQ ID NO: 3267855 - RNA, 22 nt, Mycobacterium tuberculosis H37Rv
aguucuuggucaggcuggaggu

SEQ ID NO: 3267856 - RNA, 21 nt, Mycobacterium tuberculosis H37Rv
aguugaacguucccucggcac

SEQ ID NO: 3267857 - RNA, 11 nt, Mycobacterium tuberculosis H37Rv
aguugaagaag

SEQ ID NO: 3267858 - RNA, 13 nt, Mycobacterium tuberculosis H37Rv
aguugaagaagcc

SEQ ID NO: 3267859 - RNA, 14 nt, Mycobacterium tuberculosis H37Rv
aguugaagaagcca

SEQ ID NO: 3267860 - RNA, 11 nt, Mycobacterium tuberculosis H37Rv
aguugaagaau

SEQ ID NO: 3267861 - RNA, 18 nt, Mycobacterium tuberculosis H37Rv
aguugaaggugccggcgu

SEQ ID NO: 3267862 - RNA, 14 nt, Mycobacterium tuberculosis H37Rv
aguugacaccaggg

SEQ ID NO: 3267863 - RNA, 15 nt, Mycobacterium tuberculosis H37Rv
aguugaccaggccga

SEQ ID NO: 3267864 - RNA, 19 nt, Mycobacterium tuberculosis H37Rv
aguugaccuucaccuggaa

SEQ ID NO: 3267865 - RNA, 14 nt, Mycobacterium tuberculosis H37Rv
aguugagcagcuug

SEQ ID NO: 3267866 - RNA, 15 nt, Mycobacterium tuberculosis H37Rv
aguugagcagcuugg

SEQ ID NO: 3267867 - RNA, 21 nt, Mycobacterium tuberculosis H37Rv
aguugagggugugagguaguc

SEQ ID NO: 3267868 - RNA, 22 nt, Mycobacterium tuberculosis H37Rv
aguugcaacggguacacccgcu

SEQ ID NO: 3267869 - RNA, 16 nt, Mycobacterium tuberculosis H37Rv
aguugcagcgggccac

SEQ ID NO: 3267870 - RNA, 13 nt, Mycobacterium tuberculosis H37Rv
aguugcgcggcau

SEQ ID NO: 3267871 - RNA, 13 nt, Mycobacterium tuberculosis H37Rv
aguugcggcuggc

SEQ ID NO: 3267872 - RNA, 18 nt, Mycobacterium tuberculosis H37Rv
aguugcucggccgaugcg

SEQ ID NO: 3267873 - RNA, 22 nt, Mycobacterium tuberculosis H37Rv
aguugcucguugugcagguggc

SEQ ID NO: 3267874 - RNA, 13 nt, Mycobacterium tuberculosis H37Rv
aguuggaacugcc

SEQ ID NO: 3267875 - RNA, 17 nt, Mycobacterium tuberculosis H37Rv
aguuggaacugcccgau

SEQ ID NO: 3267876 - RNA, 13 nt, Mycobacterium tuberculosis H37Rv
aguuggcaccagc

SEQ ID NO: 3267877 - RNA, 20 nt, Mycobacterium tuberculosis H37Rv
aguuggccaguaugcggugc

SEQ ID NO: 3267878 - RNA, 15 nt, Mycobacterium tuberculosis H37Rv
aguuggcgaccugcg

SEQ ID NO: 3267879 - RNA, 23 nt, Mycobacterium tuberculosis H37Rv
aguuggcugagcagcgcggccag

SEQ ID NO: 3267880 - RNA, 21 nt, Mycobacterium tuberculosis H37Rv
aguuggucacgaagaccaggc

SEQ ID NO: 3267881 - RNA, 21 nt, Mycobacterium tuberculosis H37Rv
aguugguccaggugaccgaga

SEQ ID NO: 3267882 - RNA, 23 nt, Mycobacterium tuberculosis H37Rv
aguugucuggucauggccgaaca

SEQ ID NO: 3267883 - RNA, 21 nt, Mycobacterium tuberculosis H37Rv
aguuguuggccagaccgcgcg

SEQ ID NO: 3267884 - RNA, 13 nt, Mycobacterium tuberculosis H37Rv
aguuuaccgugcc

SEQ ID NO: 3267885 - RNA, 16 nt, Mycobacterium tuberculosis H37Rv
aguuuccagaugcacg

SEQ ID NO: 3267886 - RNA, 19 nt, Mycobacterium tuberculosis H37Rv
aguuucugcucgaccguca

SEQ ID NO: 3267887 - RNA, 15 nt, Mycobacterium tuberculosis H37Rv
aguuugaccaccugg

SEQ ID NO: 3267888 - RNA, 16 nt, Mycobacterium tuberculosis H37Rv
aguuugauuccagguc

SEQ ID NO: 3267889 - RNA, 13 nt, Mycobacterium tuberculosis H37Rv
aguuuucggccgc

SEQ ID NO: 3267890 - RNA, 16 nt, Mycobacterium tuberculosis H37Rv
aguuuugcggccaggg

SEQ ID NO: 3267891 - RNA, 20 nt, Mycobacterium tuberculosis H37Rv
aguuuuucgggguggcggca

SEQ ID NO: 3267892 - RNA, 10 nt, Mycobacterium tuberculosis H37Rv
auaaaugccg

SEQ ID NO: 3267893 - RNA, 16 nt, Mycobacterium tuberculosis H37Rv
auaacagcaggcauuc

SEQ ID NO: 3267894 - RNA, 15 nt, Mycobacterium tuberculosis H37Rv
auauugcgcccggcc

SEQ ID NO: 3267895 - RNA, 16 nt, Mycobacterium tuberculosis H37Rv
auauuggacgcgcaug

SEQ ID NO: 3267896 - RNA, 21 nt, Mycobacterium tuberculosis H37Rv
auauuucuaaauaccuuuggc

SEQ ID NO: 3267897 - RNA, 20 nt, Mycobacterium tuberculosis H37Rv
aucaaaaacgaacccaggca

SEQ ID NO: 3267898 - RNA, 15 nt, Mycobacterium tuberculosis H37Rv
aucaaagccagcacc

SEQ ID NO: 3267899 - RNA, 17 nt, Mycobacterium tuberculosis H37Rv
aucaacaggcgucccgc

SEQ ID NO: 3267900 - RNA, 18 nt, Mycobacterium tuberculosis H37Rv
aucaacaugccggucauc

SEQ ID NO: 3267901 - RNA, 21 nt, Mycobacterium tuberculosis H37Rv
aucaacauugugcucgccgau

SEQ ID NO: 3267902 - RNA, 15 nt, Mycobacterium tuberculosis H37Rv
aucaaccccagcgca

SEQ ID NO: 3267903 - RNA, 22 nt, Mycobacterium tuberculosis H37Rv
aucaaccggacauccgaugcgu

SEQ ID NO: 3267904 - RNA, 23 nt, Mycobacterium tuberculosis H37Rv
aucaacgaacggauaccugggac

SEQ ID NO: 3267905 - RNA, 16 nt, Mycobacterium tuberculosis H37Rv
aucaacgacaccagau

SEQ ID NO: 3267906 - RNA, 17 nt, Mycobacterium tuberculosis H37Rv
aucaacgcguugcacag

SEQ ID NO: 3267907 - RNA, 21 nt, Mycobacterium tuberculosis H37Rv
aucaacggaaugaaggcaccg

SEQ ID NO: 3267908 - RNA, 19 nt, Mycobacterium tuberculosis H37Rv
aucaagaaguacagcuggc

SEQ ID NO: 3267909 - RNA, 22 nt, Mycobacterium tuberculosis H37Rv
aucaaggagauccagggccuuc

SEQ ID NO: 3267910 - RNA, 14 nt, Mycobacterium tuberculosis H37Rv
aucaaggccaccuc

SEQ ID NO: 3267911 - RNA, 18 nt, Mycobacterium tuberculosis H37Rv
aucaagggggucgagcgc

SEQ ID NO: 3267912 - RNA, 19 nt, Mycobacterium tuberculosis H37Rv
aucaaggugaucagcagga

SEQ ID NO: 3267913 - RNA, 16 nt, Mycobacterium tuberculosis H37Rv
acccgcccacggcacc

SEQ ID NO: 3267914 - RNA, 20 nt, Mycobacterium tuberculosis H37Rv
acccgcccaggcguccauca

SEQ ID NO: 3267915 - RNA, 18 nt, Mycobacterium tuberculosis H37Rv
acccgcccauucccauau

SEQ ID NO: 3267916 - RNA, 22 nt, Mycobacterium tuberculosis H37Rv
acccgcccgagaguggacgugu

SEQ ID NO: 3267917 - RNA, 17 nt, Mycobacterium tuberculosis H37Rv
acccgcccuugccgccg

SEQ ID NO: 3267918 - RNA, 16 nt, Mycobacterium tuberculosis H37Rv
acccgccgacgaccgc

SEQ ID NO: 3267919 - RNA, 19 nt, Mycobacterium tuberculosis H37Rv
acccgccgacgaccgccug

SEQ ID NO: 3267920 - RNA, 18 nt, Mycobacterium tuberculosis H37Rv
acccgccgacgccgccgg

SEQ ID NO: 3267921 - RNA, 14 nt, Mycobacterium tuberculosis H37Rv
acccgccgaugccg

SEQ ID NO: 3267922 - RNA, 16 nt, Mycobacterium tuberculosis H37Rv
acccgccgaugccgcc

SEQ ID NO: 3267923 - RNA, 18 nt, Mycobacterium tuberculosis H37Rv
acccgccgcgcccggcgc

SEQ ID NO: 3267924 - RNA, 21 nt, Mycobacterium tuberculosis H37Rv
acccgccgcgguuaucgccga

SEQ ID NO: 3267925 - RNA, 14 nt, Mycobacterium tuberculosis H37Rv
acccgccgcgugcu

SEQ ID NO: 3267926 - RNA, 19 nt, Mycobacterium tuberculosis H37Rv
acccgccggcgacugcagc

SEQ ID NO: 3267927 - RNA, 16 nt, Mycobacterium tuberculosis H37Rv
acccgccgucaccgcg

SEQ ID NO: 3267928 - RNA, 17 nt, Mycobacterium tuberculosis H37Rv
acccgccgucaccgcgc

SEQ ID NO: 3267929 - RNA, 18 nt, Mycobacterium tuberculosis H37Rv
acccgccgucaccgcgcg

SEQ ID NO: 3267930 - RNA, 23 nt, Mycobacterium tuberculosis H37Rv
acccgccgugaguagguccacgu

SEQ ID NO: 3267931 - RNA, 19 nt, Mycobacterium tuberculosis H37Rv
acccgccguugccaccggu

SEQ ID NO: 3267932 - RNA, 19 nt, Mycobacterium tuberculosis H37Rv
acccgccuguaccggcguu

SEQ ID NO: 3267933 - RNA, 21 nt, Mycobacterium tuberculosis H37Rv
acccgcgagaucgggccggcc

SEQ ID NO: 3267934 - RNA, 20 nt, Mycobacterium tuberculosis H37Rv
acccgcgagguugaccacca

SEQ ID NO: 3267935 - RNA, 21 nt, Mycobacterium tuberculosis H37Rv
acccgcgagguugaccaccag

SEQ ID NO: 3267936 - RNA, 15 nt, Mycobacterium tuberculosis H37Rv
acccgcgcaaccggc

SEQ ID NO: 3267937 - RNA, 21 nt, Mycobacterium tuberculosis H37Rv
acccgcgcaaucaggaaccgc

SEQ ID NO: 3267938 - RNA, 14 nt, Mycobacterium tuberculosis H37Rv
acccgcgccgccag

SEQ ID NO: 3267939 - RNA, 16 nt, Mycobacterium tuberculosis H37Rv
acccgcgccggccgcu

SEQ ID NO: 3267940 - RNA, 21 nt, Mycobacterium tuberculosis H37Rv
acccgcgcgaccugaaugcgg

SEQ ID NO: 3267941 - RNA, 21 nt, Mycobacterium tuberculosis H37Rv
acccgcgcgagcagcuacagc

SEQ ID NO: 3267942 - RNA, 14 nt, Mycobacterium tuberculosis H37Rv
acccgcgcgucgcc

SEQ ID NO: 3267943 - RNA, 16 nt, Mycobacterium tuberculosis H37Rv
acccgcgcgucgccca

SEQ ID NO: 3267944 - RNA, 22 nt, Mycobacterium tuberculosis H37Rv
acccgcgcgucgcccagugcgc

SEQ ID NO: 3267945 - RNA, 18 nt, Mycobacterium tuberculosis H37Rv
acccgcggaauccgcggc

SEQ ID NO: 3267946 - RNA, 22 nt, Mycobacterium tuberculosis H37Rv
acccgcggcgaaccgucucgcc

SEQ ID NO: 3267947 - RNA, 22 nt, Mycobacterium tuberculosis H37Rv
acccgcggcgccguugccgccg

SEQ ID NO: 3267948 - RNA, 19 nt, Mycobacterium tuberculosis H37Rv
acccgcgggugauguucgu

SEQ ID NO: 3267949 - RNA, 16 nt, Mycobacterium tuberculosis H37Rv
acccgcgguagcggac

SEQ ID NO: 3267950 - RNA, 13 nt, Mycobacterium tuberculosis H37Rv
acccgcgucaguc

SEQ ID NO: 3267951 - RNA, 14 nt, Mycobacterium tuberculosis H37Rv
acccgcgucgagug

SEQ ID NO: 3267952 - RNA, 17 nt, Mycobacterium tuberculosis H37Rv
acccgcgucgagugccg

SEQ ID NO: 3267953 - RNA, 24 nt, Mycobacterium tuberculosis H37Rv
acccgcuccauaucgucgggcguc

SEQ ID NO: 3267954 - RNA, 14 nt, Mycobacterium tuberculosis H37Rv
acccgcucggccgc

SEQ ID NO: 3267955 - RNA, 15 nt, Mycobacterium tuberculosis H37Rv
acccgcucggccguc

SEQ ID NO: 3267956 - RNA, 17 nt, Mycobacterium tuberculosis H37Rv
acccgcucggccgucag

SEQ ID NO: 3267957 - RNA, 15 nt, Mycobacterium tuberculosis H37Rv
acccgcuggcccgcc

SEQ ID NO: 3267958 - RNA, 19 nt, Mycobacterium tuberculosis H37Rv
acccgcuggucgagcagug

SEQ ID NO: 3267959 - RNA, 17 nt, Mycobacterium tuberculosis H37Rv
acccgcuggucgaugcc

SEQ ID NO: 3267960 - RNA, 19 nt, Mycobacterium tuberculosis H37Rv
acccgcuucgcccggcugc

SEQ ID NO: 3267961 - RNA, 13 nt, Mycobacterium tuberculosis H37Rv
acccggaaccagc

SEQ ID NO: 3267962 - RNA, 16 nt, Mycobacterium tuberculosis H37Rv
acccggaaccagccgc

SEQ ID NO: 3267963 - RNA, 16 nt, Mycobacterium tuberculosis H37Rv
acccggacgaacgccg

SEQ ID NO: 3267964 - RNA, 14 nt, Mycobacterium tuberculosis H37Rv
acccggagccgcca

SEQ ID NO: 3267965 - RNA, 19 nt, Mycobacterium tuberculosis H37Rv
acccggaggcaauccgauc

SEQ ID NO: 3267966 - RNA, 22 nt, Mycobacterium tuberculosis H37Rv
acccggaucuggugggugcggc

SEQ ID NO: 3267967 - RNA, 15 nt, Mycobacterium tuberculosis H37Rv
acccggcacccaguu

SEQ ID NO: 3267968 - RNA, 16 nt, Mycobacterium tuberculosis H37Rv
acccggcagagcacgc

SEQ ID NO: 3267969 - RNA, 14 nt, Mycobacterium tuberculosis H37Rv
acccggcagcccgg

SEQ ID NO: 3267970 - RNA, 22 nt, Mycobacterium tuberculosis H37Rv
acccggccagguauguccgcca

SEQ ID NO: 3267971 - RNA, 14 nt, Mycobacterium tuberculosis H37Rv
acccggccucggug

SEQ ID NO: 3267972 - RNA, 15 nt, Mycobacterium tuberculosis H37Rv
acccggcgaccacgg

SEQ ID NO: 3267973 - RNA, 16 nt, Mycobacterium tuberculosis H37Rv
acccggcgaccacggc

SEQ ID NO: 3267974 - RNA, 17 nt, Mycobacterium tuberculosis H37Rv
acccggcgaugcagccg

SEQ ID NO: 3267975 - RNA, 19 nt, Mycobacterium tuberculosis H37Rv
acccggcgcaacaaccggu

SEQ ID NO: 3267976 - RNA, 12 nt, Mycobacterium tuberculosis H37Rv
acccggcgcagc

SEQ ID NO: 3267977 - RNA, 15 nt, Mycobacterium tuberculosis H37Rv
acccggcgcgauggc

SEQ ID NO: 3267978 - RNA, 17 nt, Mycobacterium tuberculosis H37Rv
acccggcgggcgguggg

SEQ ID NO: 3267979 - RNA, 19 nt, Mycobacterium tuberculosis H37Rv
acccggcgggcggugggca

SEQ ID NO: 3267980 - RNA, 16 nt, Mycobacterium tuberculosis H37Rv
acccggcuccagcacc

SEQ ID NO: 3267981 - RNA, 18 nt, Mycobacterium tuberculosis H37Rv
acccggcuucgccgcgcu

SEQ ID NO: 3267982 - RNA, 15 nt, Mycobacterium tuberculosis H37Rv
acccgggaaggaacc

SEQ ID NO: 3267983 - RNA, 16 nt, Mycobacterium tuberculosis H37Rv
acccgggaaggaaccg

SEQ ID NO: 3267984 - RNA, 23 nt, Mycobacterium tuberculosis H37Rv
acccgggacguuguccaccgcca

SEQ ID NO: 3267985 - RNA, 18 nt, Mycobacterium tuberculosis H37Rv
acccgggaugaccaccgg

SEQ ID NO: 3267986 - RNA, 13 nt, Mycobacterium tuberculosis H37Rv
acccgggcagccu

SEQ ID NO: 3267987 - RNA, 15 nt, Mycobacterium tuberculosis H37Rv
acccgggcagccugc

SEQ ID NO: 3267988 - RNA, 13 nt, Mycobacterium tuberculosis H37Rv
acccgggccacgu

SEQ ID NO: 3267989 - RNA, 16 nt, Mycobacterium tuberculosis H37Rv
acccgggccacgucga

SEQ ID NO: 3267990 - RNA, 16 nt, Mycobacterium tuberculosis H37Rv
acccgggccgggccga

SEQ ID NO: 3267991 - RNA, 20 nt, Mycobacterium tuberculosis H37Rv
acccgggccggucggugagc

SEQ ID NO: 3267992 - RNA, 14 nt, Mycobacterium tuberculosis H37Rv
acccgggccucggc

SEQ ID NO: 3267993 - RNA, 16 nt, Mycobacterium tuberculosis H37Rv
acccgggccucggcgc

SEQ ID NO: 3267994 - RNA, 17 nt, Mycobacterium tuberculosis H37Rv
acccgggccucggcgcc

SEQ ID NO: 3267995 - RNA, 19 nt, Mycobacterium tuberculosis H37Rv
acccgggccuuguucuugg

SEQ ID NO: 3267996 - RNA, 14 nt, Mycobacterium tuberculosis H37Rv
acccgggcgaccuc

SEQ ID NO: 3267997 - RNA, 20 nt, Mycobacterium tuberculosis H37Rv
acccgggcgagcgcggccug

SEQ ID NO: 3267998 - RNA, 14 nt, Mycobacterium tuberculosis H37Rv
acccgggcguccca

SEQ ID NO: 3267999 - RNA, 17 nt, Mycobacterium tuberculosis H37Rv
acccggggggccucguu

SEQ ID NO: 3268000 - RNA, 16 nt, Mycobacterium tuberculosis H37Rv
acccggggugcccggc

SEQ ID NO: 3268001 - RNA, 14 nt, Mycobacterium tuberculosis H37Rv
acccgggucggcac

SEQ ID NO: 3268002 - RNA, 22 nt, Mycobacterium tuberculosis H37Rv
acccgguaccucaacaccaggc

SEQ ID NO: 3268003 - RNA, 14 nt, Mycobacterium tuberculosis H37Rv
acccgguaguccgc

SEQ ID NO: 3268004 - RNA, 22 nt, Mycobacterium tuberculosis H37Rv
acccggucaaagaugucgcugg

SEQ ID NO: 3268005 - RNA, 18 nt, Mycobacterium tuberculosis H37Rv
acccggucaucggccguc

SEQ ID NO: 3268006 - RNA, 18 nt, Mycobacterium tuberculosis H37Rv
acccgguccauucguccg

SEQ ID NO: 3268007 - RNA, 19 nt, Mycobacterium tuberculosis H37Rv
acccgguccauucguccgc

SEQ ID NO: 3268008 - RNA, 18 nt, Mycobacterium tuberculosis H37Rv
acccggucccccgaagug

SEQ ID NO: 3268009 - RNA, 19 nt, Mycobacterium tuberculosis H37Rv
acgacaugagcgccacgcc

SEQ ID NO: 3268010 - RNA, 16 nt, Mycobacterium tuberculosis H37Rv
acgacaugggcaggcc

SEQ ID NO: 3268011 - RNA, 18 nt, Mycobacterium tuberculosis H37Rv
acgacaugggcaggccgc

SEQ ID NO: 3268012 - RNA, 11 nt, Mycobacterium tuberculosis H37Rv
acgacauuggu

SEQ ID NO: 3268013 - RNA, 19 nt, Mycobacterium tuberculosis H37Rv
acgacauuggugcugacau

SEQ ID NO: 3268014 - RNA, 13 nt, Mycobacterium tuberculosis H37Rv
acgaccaauagca

SEQ ID NO: 3268015 - RNA, 13 nt, Mycobacterium tuberculosis H37Rv
acgaccaccacca

SEQ ID NO: 3268016 - RNA, 13 nt, Mycobacterium tuberculosis H37Rv
acgaccagcagau

SEQ ID NO: 3268017 - RNA, 14 nt, Mycobacterium tuberculosis H37Rv
acgacccagcaugg

SEQ ID NO: 3268018 - RNA, 15 nt, Mycobacterium tuberculosis H37Rv
acgacccccgaucag

SEQ ID NO: 3268019 - RNA, 13 nt, Mycobacterium tuberculosis H37Rv
acgaccccggcgg

SEQ ID NO: 3268020 - RNA, 17 nt, Mycobacterium tuberculosis H37Rv
acgacccgaagccgacc

SEQ ID NO: 3268021 - RNA, 16 nt, Mycobacterium tuberculosis H37Rv
acgacccgacguagcc

SEQ ID NO: 3268022 - RNA, 18 nt, Mycobacterium tuberculosis H37Rv
acgacccgggaaggaacc

SEQ ID NO: 3268023 - RNA, 20 nt, Mycobacterium tuberculosis H37Rv
acgacccgggucggcacgac

SEQ ID NO: 3268024 - RNA, 23 nt, Mycobacterium tuberculosis H37Rv
acgacccuggccuuugagcgcgg

SEQ ID NO: 3268025 - RNA, 13 nt, Mycobacterium tuberculosis H37Rv
acgaccgccgaua

SEQ ID NO: 3268026 - RNA, 15 nt, Mycobacterium tuberculosis H37Rv
acgaccgccugcaac

SEQ ID NO: 3268027 - RNA, 20 nt, Mycobacterium tuberculosis H37Rv
acgaccuccucgaugaccgg

SEQ ID NO: 3268028 - RNA, 19 nt, Mycobacterium tuberculosis H37Rv
acgaccugcucauccaccu

SEQ ID NO: 3268029 - RNA, 18 nt, Mycobacterium tuberculosis H37Rv
acgacgacaaccggccag

SEQ ID NO: 3268030 - RNA, 17 nt, Mycobacterium tuberculosis H37Rv
acgacgacaccgcgcag

SEQ ID NO: 3268031 - RNA, 20 nt, Mycobacterium tuberculosis H37Rv
acgacgacaccgcgcagcgg

SEQ ID NO: 3268032 - RNA, 19 nt, Mycobacterium tuberculosis H37Rv
acgacgacccgacguagcc

SEQ ID NO: 3268033 - RNA, 17 nt, Mycobacterium tuberculosis H37Rv
acgacgccaaugccgcg

SEQ ID NO: 3268034 - RNA, 16 nt, Mycobacterium tuberculosis H37Rv
acgacgcccaccguug

SEQ ID NO: 3268035 - RNA, 19 nt, Mycobacterium tuberculosis H37Rv
acgacgcccaccguugcga

SEQ ID NO: 3268036 - RNA, 19 nt, Mycobacterium tuberculosis H37Rv
acgacgccggccuggccgc

SEQ ID NO: 3268037 - RNA, 18 nt, Mycobacterium tuberculosis H37Rv
acgacgccgucggacacc

SEQ ID NO: 3268038 - RNA, 16 nt, Mycobacterium tuberculosis H37Rv
acgacggguccgggcc

SEQ ID NO: 3268039 - RNA, 21 nt, Mycobacterium tuberculosis H37Rv
acgacguagaugguggucacc

SEQ ID NO: 3268040 - RNA, 14 nt, Mycobacterium tuberculosis H37Rv
acgacgucaucguc

SEQ ID NO: 3268041 - RNA, 13 nt, Mycobacterium tuberculosis H37Rv
acgacgucggccg

SEQ ID NO: 3268042 - RNA, 20 nt, Mycobacterium tuberculosis H37Rv
acgacgucggccgcaucgcc

SEQ ID NO: 3268043 - RNA, 22 nt, Mycobacterium tuberculosis H37Rv
acgacgucggccgcaucgccca

SEQ ID NO: 3268044 - RNA, 23 nt, Mycobacterium tuberculosis H37Rv
acgacgucggccgcaucgcccaa

SEQ ID NO: 3268045 - RNA, 22 nt, Mycobacterium tuberculosis H37Rv
acgacgucggcguuaccgaccu

SEQ ID NO: 3268046 - RNA, 14 nt, Mycobacterium tuberculosis H37Rv
acgacgucgucgcc

SEQ ID NO: 3268047 - RNA, 16 nt, Mycobacterium tuberculosis H37Rv
acgacguucgacgaca

SEQ ID NO: 3268048 - RNA, 13 nt, Mycobacterium tuberculosis H37Rv
acgacucccccgg

SEQ ID NO: 3268049 - RNA, 16 nt, Mycobacterium tuberculosis H37Rv
acgacucccccggcuc

SEQ ID NO: 3268050 - RNA, 16 nt, Mycobacterium tuberculosis H37Rv
acgacuccggcaagca

SEQ ID NO: 3268051 - RNA, 21 nt, Mycobacterium tuberculosis H37Rv
acgacuccggcaagcacaccg

SEQ ID NO: 3268052 - RNA, 19 nt, Mycobacterium tuberculosis H37Rv
acgacugaucaagugccag

SEQ ID NO: 3268053 - RNA, 23 nt, Mycobacterium tuberculosis H37Rv
acgacugcggcaaacgugaucag

SEQ ID NO: 3268054 - RNA, 21 nt, Mycobacterium tuberculosis H37Rv
acgacugcguuccgaucggca

SEQ ID NO: 3268055 - RNA, 18 nt, Mycobacterium tuberculosis H37Rv
acgacugugcgccgcagc

SEQ ID NO: 3268056 - RNA, 19 nt, Mycobacterium tuberculosis H37Rv
acgacugugcgccgcagcc

SEQ ID NO: 3268057 - RNA, 15 nt, Mycobacterium tuberculosis H37Rv
acgagaagacaccgc

SEQ ID NO: 3268058 - RNA, 17 nt, Mycobacterium tuberculosis H37Rv
acgagaagacaccgcgc

SEQ ID NO: 3268059 - RNA, 13 nt, Mycobacterium tuberculosis H37Rv
acgagacgacgac

SEQ ID NO: 3268060 - RNA, 15 nt, Mycobacterium tuberculosis H37Rv
acgagacgacgaccg

SEQ ID NO: 3268061 - RNA, 16 nt, Mycobacterium tuberculosis H37Rv
acgagauacggccacc

SEQ ID NO: 3268062 - RNA, 16 nt, Mycobacterium tuberculosis H37Rv
acgagauagcauccgc

SEQ ID NO: 3268063 - RNA, 13 nt, Mycobacterium tuberculosis H37Rv
acgagaugccgcg

SEQ ID NO: 3268064 - RNA, 23 nt, Mycobacterium tuberculosis H37Rv
acgagaugugagcacaccgacag

SEQ ID NO: 3268065 - RNA, 13 nt, Mycobacterium tuberculosis H37Rv
acgagauugccgg

SEQ ID NO: 3268066 - RNA, 18 nt, Mycobacterium tuberculosis H37Rv
acgagcacacaacaccca

SEQ ID NO: 3268067 - RNA, 19 nt, Mycobacterium tuberculosis H37Rv
acgagcacaugcucgacgc

SEQ ID NO: 3268068 - RNA, 13 nt, Mycobacterium tuberculosis H37Rv
acgagcaccaucc

SEQ ID NO: 3268069 - RNA, 15 nt, Mycobacterium tuberculosis H37Rv
acgagcaugcggcua

SEQ ID NO: 3268070 - RNA, 14 nt, Mycobacterium tuberculosis H37Rv
acgagcccacgcgc

SEQ ID NO: 3268071 - RNA, 21 nt, Mycobacterium tuberculosis H37Rv
acgagcgauacgucgucagcc

SEQ ID NO: 3268072 - RNA, 23 nt, Mycobacterium tuberculosis H37Rv
acgagcgcgcugcggaucguggc

SEQ ID NO: 3268073 - RNA, 17 nt, Mycobacterium tuberculosis H37Rv
acgagcggccgcgcgca

SEQ ID NO: 3268074 - RNA, 23 nt, Mycobacterium tuberculosis H37Rv
acgagcgucagauccggccguug

SEQ ID NO: 3268075 - RNA, 18 nt, Mycobacterium tuberculosis H37Rv
acgagcuguacuugggau

SEQ ID NO: 3268076 - RNA, 15 nt, Mycobacterium tuberculosis H37Rv
acgagcuuccacgcc

SEQ ID NO: 3268077 - RNA, 17 nt, Mycobacterium tuberculosis H37Rv
acgagcuuccacgccgg

SEQ ID NO: 3268078 - RNA, 18 nt, Mycobacterium tuberculosis H37Rv
acgaggacgucaccguca

SEQ ID NO: 3268079 - RNA, 14 nt, Mycobacterium tuberculosis H37Rv
acgaggcaaugcga

SEQ ID NO: 3268080 - RNA, 17 nt, Mycobacterium tuberculosis H37Rv
acgaggcguucaccacg

SEQ ID NO: 3268081 - RNA, 23 nt, Mycobacterium tuberculosis H37Rv
acgaggcguucaccacgaucgcg

SEQ ID NO: 3268082 - RNA, 15 nt, Mycobacterium tuberculosis H37Rv
acgaggcuugcggca

SEQ ID NO: 3268083 - RNA, 18 nt, Mycobacterium tuberculosis H37Rv
acgagggccagcagccgc

SEQ ID NO: 3268084 - RNA, 14 nt, Mycobacterium tuberculosis H37Rv
acgagguagcgcgc

SEQ ID NO: 3268085 - RNA, 15 nt, Mycobacterium tuberculosis H37Rv
acgagguagcgcgca

SEQ ID NO: 3268086 - RNA, 16 nt, Mycobacterium tuberculosis H37Rv
acgagguugccgcacc

SEQ ID NO: 3268087 - RNA, 18 nt, Mycobacterium tuberculosis H37Rv
acgaguacgggcaggccg

SEQ ID NO: 3268088 - RNA, 15 nt, Mycobacterium tuberculosis H37Rv
acgaguagccggucg

SEQ ID NO: 3268089 - RNA, 12 nt, Mycobacterium tuberculosis H37Rv
acgagucgccag

SEQ ID NO: 3268090 - RNA, 19 nt, Mycobacterium tuberculosis H37Rv
acgaguuaccgguggugcg

SEQ ID NO: 3268091 - RNA, 21 nt, Mycobacterium tuberculosis H37Rv
acgaguugaugcaagcgggca

SEQ ID NO: 3268092 - RNA, 13 nt, Mycobacterium tuberculosis H37Rv
acgauagcggccc

SEQ ID NO: 3268093 - RNA, 23 nt, Mycobacterium tuberculosis H37Rv
acgauauagggcuccucgugcac

SEQ ID NO: 3268094 - RNA, 19 nt, Mycobacterium tuberculosis H37Rv
acgaucaacucgugcgggc

SEQ ID NO: 3268095 - RNA, 17 nt, Mycobacterium tuberculosis H37Rv
acgaucagcuugugggc

SEQ ID NO: 3268096 - RNA, 22 nt, Mycobacterium tuberculosis H37Rv
acgaucagggaagccugcgggc

SEQ ID NO: 3268097 - RNA, 23 nt, Mycobacterium tuberculosis H37Rv
acgaucagggugucgaagagcag

SEQ ID NO: 3268098 - RNA, 12 nt, Mycobacterium tuberculosis H37Rv
acgaucauuccu

SEQ ID NO: 3268099 - RNA, 14 nt, Mycobacterium tuberculosis H37Rv
acgauccacggcga

SEQ ID NO: 3268100 - RNA, 21 nt, Mycobacterium tuberculosis H37Rv
acgauccacggcgaugcagcc

SEQ ID NO: 3268101 - RNA, 20 nt, Mycobacterium tuberculosis H37Rv
acgauccccauugcgcccca

SEQ ID NO: 3268102 - RNA, 21 nt, Mycobacterium tuberculosis H37Rv
acgauccccauugcgccccau

SEQ ID NO: 3268103 - RNA, 14 nt, Mycobacterium tuberculosis H37Rv
acgaucgaugaccu

SEQ ID NO: 3268104 - RNA, 15 nt, Mycobacterium tuberculosis H37Rv
acgaucgcggugacc

SEQ ID NO: 3268105 - RNA, 20 nt, Mycobacterium tuberculosis H37Rv
acgccagaccgacugcgggc

SEQ ID NO: 3268106 - RNA, 15 nt, Mycobacterium tuberculosis H37Rv
acgccagcaccagcg

SEQ ID NO: 3268107 - RNA, 16 nt, Mycobacterium tuberculosis H37Rv
acgccagccaggcgaa

SEQ ID NO: 3268108 - RNA, 17 nt, Mycobacterium tuberculosis H37Rv
acgccagccuggccauc

SEQ ID NO: 3268109 - RNA, 13 nt, Mycobacterium tuberculosis H37Rv
acgccagcgcgac

SEQ ID NO: 3268110 - RNA, 14 nt, Mycobacterium tuberculosis H37Rv
acgccagcgcgacc

SEQ ID NO: 3268111 - RNA, 20 nt, Mycobacterium tuberculosis H37Rv
acgccaggggacccggggcc

SEQ ID NO: 3268112 - RNA, 15 nt, Mycobacterium tuberculosis H37Rv
acgccagucgagcac

SEQ ID NO: 3268113 - RNA, 23 nt, Mycobacterium tuberculosis H37Rv
acgccagugaacgcgcgugcagc

SEQ ID NO: 3268114 - RNA, 24 nt, Mycobacterium tuberculosis H37Rv
acgccagugaacgcgcgugcagcc

SEQ ID NO: 3268115 - RNA, 16 nt, Mycobacterium tuberculosis H37Rv
acgccaguguugcgcu

SEQ ID NO: 3268116 - RNA, 22 nt, Mycobacterium tuberculosis H37Rv
acgccaguguugcgcugcggcc

SEQ ID NO: 3268117 - RNA, 14 nt, Mycobacterium tuberculosis H37Rv
acgccaucgagcag

SEQ ID NO: 3268118 - RNA, 17 nt, Mycobacterium tuberculosis H37Rv
acgccaugucgaugucc

SEQ ID NO: 3268119 - RNA, 18 nt, Mycobacterium tuberculosis H37Rv
acgccauucaucggcauc

SEQ ID NO: 3268120 - RNA, 21 nt, Mycobacterium tuberculosis H37Rv
acgcccaauguccaggcgcgc

SEQ ID NO: 3268121 - RNA, 14 nt, Mycobacterium tuberculosis H37Rv
acgcccacagcuga

SEQ ID NO: 3268122 - RNA, 17 nt, Mycobacterium tuberculosis H37Rv
acgcccacuccagcagc

SEQ ID NO: 3268123 - RNA, 19 nt, Mycobacterium tuberculosis H37Rv
acgcccacuccagcagcuc

SEQ ID NO: 3268124 - RNA, 22 nt, Mycobacterium tuberculosis H37Rv
acgcccagcgcccgcgcggcca

SEQ ID NO: 3268125 - RNA, 21 nt, Mycobacterium tuberculosis H37Rv
acgcccaucucaugcaucugc

SEQ ID NO: 3268126 - RNA, 14 nt, Mycobacterium tuberculosis H37Rv
acgcccauggcguc

SEQ ID NO: 3268127 - RNA, 14 nt, Mycobacterium tuberculosis H37Rv
acgccccacugccg

SEQ ID NO: 3268128 - RNA, 18 nt, Mycobacterium tuberculosis H37Rv
acgcccccauccggucga

SEQ ID NO: 3268129 - RNA, 19 nt, Mycobacterium tuberculosis H37Rv
acgccccuucccuaucacg

SEQ ID NO: 3268130 - RNA, 17 nt, Mycobacterium tuberculosis H37Rv
acgcccgaaucgccggc

SEQ ID NO: 3268131 - RNA, 18 nt, Mycobacterium tuberculosis H37Rv
acgcccgcacucggcggu

SEQ ID NO: 3268132 - RNA, 21 nt, Mycobacterium tuberculosis H37Rv
acgcccgccaccggguucacc

SEQ ID NO: 3268133 - RNA, 17 nt, Mycobacterium tuberculosis H37Rv
acgcccgcccgcacgac

SEQ ID NO: 3268134 - RNA, 11 nt, Mycobacterium tuberculosis H37Rv
acgcccggcac

SEQ ID NO: 3268135 - RNA, 12 nt, Mycobacterium tuberculosis H37Rv
acgcccggcacc

SEQ ID NO: 3268136 - RNA, 14 nt, Mycobacterium tuberculosis H37Rv
acgcccguguugaa

SEQ ID NO: 3268137 - RNA, 18 nt, Mycobacterium tuberculosis H37Rv
acgcccguguugaagaag

SEQ ID NO: 3268138 - RNA, 11 nt, Mycobacterium tuberculosis H37Rv
acgcccucggg

SEQ ID NO: 3268139 - RNA, 21 nt, Mycobacterium tuberculosis H37Rv
acgcccugaagggccgccucg

SEQ ID NO: 3268140 - RNA, 22 nt, Mycobacterium tuberculosis H37Rv
acgcccuggaaugccgccacaa

SEQ ID NO: 3268141 - RNA, 12 nt, Mycobacterium tuberculosis H37Rv
acgcccuguucu

SEQ ID NO: 3268142 - RNA, 15 nt, Mycobacterium tuberculosis H37Rv
acgcccuguucuccg

SEQ ID NO: 3268143 - RNA, 16 nt, Mycobacterium tuberculosis H37Rv
acgccgaaaaugccgc

SEQ ID NO: 3268144 - RNA, 19 nt, Mycobacterium tuberculosis H37Rv
acgccgaacgcgagguucc

SEQ ID NO: 3268145 - RNA, 22 nt, Mycobacterium tuberculosis H37Rv
acgccgaauacggcugccucca

SEQ ID NO: 3268146 - RNA, 23 nt, Mycobacterium tuberculosis H37Rv
acgccgaccaauucgcaaucggc

SEQ ID NO: 3268147 - RNA, 15 nt, Mycobacterium tuberculosis H37Rv
acgccgaccagcacc

SEQ ID NO: 3268148 - RNA, 19 nt, Mycobacterium tuberculosis H37Rv
acgccgaccgcgccgcauc

SEQ ID NO: 3268149 - RNA, 17 nt, Mycobacterium tuberculosis H37Rv
acgccgaccggcccgca

SEQ ID NO: 3268150 - RNA, 23 nt, Mycobacterium tuberculosis H37Rv
acgccgacgaugacgcgcgaaac

SEQ ID NO: 3268151 - RNA, 15 nt, Mycobacterium tuberculosis H37Rv
acgccgacuccgcgu

SEQ ID NO: 3268152 - RNA, 15 nt, Mycobacterium tuberculosis H37Rv
acgccgagaccgccg

SEQ ID NO: 3268153 - RNA, 15 nt, Mycobacterium tuberculosis H37Rv
acgccgagcacacgu

SEQ ID NO: 3268154 - RNA, 23 nt, Mycobacterium tuberculosis H37Rv
acgccgagcagacgcaacggcac

SEQ ID NO: 3268155 - RNA, 19 nt, Mycobacterium tuberculosis H37Rv
acgccgagcgccaguucgc

SEQ ID NO: 3268156 - RNA, 18 nt, Mycobacterium tuberculosis H37Rv
acgccgagcugguugacg

SEQ ID NO: 3268157 - RNA, 23 nt, Mycobacterium tuberculosis H37Rv
acgccgaucugguaagucagcuc

SEQ ID NO: 3268158 - RNA, 23 nt, Mycobacterium tuberculosis H37Rv
acgccgaugccgaacuccgcgga

SEQ ID NO: 3268159 - RNA, 13 nt, Mycobacterium tuberculosis H37Rv
acgccgaugcggu

SEQ ID NO: 3268160 - RNA, 16 nt, Mycobacterium tuberculosis H37Rv
acgccgauucgccguc

SEQ ID NO: 3268161 - RNA, 13 nt, Mycobacterium tuberculosis H37Rv
acgccgcaaugga

SEQ ID NO: 3268162 - RNA, 13 nt, Mycobacterium tuberculosis H37Rv
acgccgccagcag

SEQ ID NO: 3268163 - RNA, 14 nt, Mycobacterium tuberculosis H37Rv
acgccgccagcaga

SEQ ID NO: 3268164 - RNA, 20 nt, Mycobacterium tuberculosis H37Rv
acgccgccagcauugaagaa

SEQ ID NO: 3268165 - RNA, 12 nt, Mycobacterium tuberculosis H37Rv
acgccgccggca

SEQ ID NO: 3268166 - RNA, 14 nt, Mycobacterium tuberculosis H37Rv
acgccgccggcacc

SEQ ID NO: 3268167 - RNA, 21 nt, Mycobacterium tuberculosis H37Rv
acgccgccggguccuugcggc

SEQ ID NO: 3268168 - RNA, 19 nt, Mycobacterium tuberculosis H37Rv
acgccgccguugccgauca

SEQ ID NO: 3268169 - RNA, 15 nt, Mycobacterium tuberculosis H37Rv
acgccgcgccgcaga

SEQ ID NO: 3268170 - RNA, 13 nt, Mycobacterium tuberculosis H37Rv
acgccggcaccga

SEQ ID NO: 3268171 - RNA, 11 nt, Mycobacterium tuberculosis H37Rv
acgccggcauc

SEQ ID NO: 3268172 - RNA, 16 nt, Mycobacterium tuberculosis H37Rv
acgccggccgccgacc

SEQ ID NO: 3268173 - RNA, 17 nt, Mycobacterium tuberculosis H37Rv
acgccggccgccgaccg

SEQ ID NO: 3268174 - RNA, 14 nt, Mycobacterium tuberculosis H37Rv
acgccggccuggcc

SEQ ID NO: 3268175 - RNA, 14 nt, Mycobacterium tuberculosis H37Rv
acgccggcgccgcc

SEQ ID NO: 3268176 - RNA, 15 nt, Mycobacterium tuberculosis H37Rv
acgccggcgccgcca

SEQ ID NO: 3268177 - RNA, 19 nt, Mycobacterium tuberculosis H37Rv
acgccgggaauuucgacac

SEQ ID NO: 3268178 - RNA, 15 nt, Mycobacterium tuberculosis H37Rv
acgccgggcaucggc

SEQ ID NO: 3268179 - RNA, 15 nt, Mycobacterium tuberculosis H37Rv
acgccgggcugggua

SEQ ID NO: 3268180 - RNA, 18 nt, Mycobacterium tuberculosis H37Rv
acgccggggaaccuugac

SEQ ID NO: 3268181 - RNA, 14 nt, Mycobacterium tuberculosis H37Rv
acgccggucgcggu

SEQ ID NO: 3268182 - RNA, 23 nt, Mycobacterium tuberculosis H37Rv
acgccgguggcacggccccugcc

SEQ ID NO: 3268183 - RNA, 20 nt, Mycobacterium tuberculosis H37Rv
acgccgguggcagagccgcc

SEQ ID NO: 3268184 - RNA, 13 nt, Mycobacterium tuberculosis H37Rv
acgccggugguca

SEQ ID NO: 3268185 - RNA, 19 nt, Mycobacterium tuberculosis H37Rv
acgccguagcgcagcgccu

SEQ ID NO: 3268186 - RNA, 23 nt, Mycobacterium tuberculosis H37Rv
acgccguaucggcgugucucguc

SEQ ID NO: 3268187 - RNA, 12 nt, Mycobacterium tuberculosis H37Rv
acgccgucagcg

SEQ ID NO: 3268188 - RNA, 14 nt, Mycobacterium tuberculosis H37Rv
acgccgucaugccc

SEQ ID NO: 3268189 - RNA, 14 nt, Mycobacterium tuberculosis H37Rv
acgccgucgaccgg

SEQ ID NO: 3268190 - RNA, 21 nt, Mycobacterium tuberculosis H37Rv
acgccgucgagcacggugagc

SEQ ID NO: 3268191 - RNA, 18 nt, Mycobacterium tuberculosis H37Rv
acgccgucggcgcgcacc

SEQ ID NO: 3268192 - RNA, 12 nt, Mycobacterium tuberculosis H37Rv
acgccgucgucg

SEQ ID NO: 3268193 - RNA, 22 nt, Mycobacterium tuberculosis H37Rv
acgccgugcugggugacaccgg

SEQ ID NO: 3268194 - RNA, 19 nt, Mycobacterium tuberculosis H37Rv
acgccguugaucuugacgg

SEQ ID NO: 3268195 - RNA, 16 nt, Mycobacterium tuberculosis H37Rv
acgccguugcccacgu

SEQ ID NO: 3268196 - RNA, 19 nt, Mycobacterium tuberculosis H37Rv
acgccguuggggccguuca

SEQ ID NO: 3268197 - RNA, 17 nt, Mycobacterium tuberculosis H37Rv
acgccucaccgacgucg

SEQ ID NO: 3268198 - RNA, 21 nt, Mycobacterium tuberculosis H37Rv
acgccucaccgacgucgccaa

SEQ ID NO: 3268199 - RNA, 19 nt, Mycobacterium tuberculosis H37Rv
acgccucgacagcggcaau

SEQ ID NO: 3268200 - RNA, 13 nt, Mycobacterium tuberculosis H37Rv
acgccucgccgaa

SEQ ID NO: 3268201 - RNA, 15 nt, Mycobacterium tuberculosis H37Rv
acgccucugcucagc

SEQ ID NO: 3268202 - RNA, 13 nt, Mycobacterium tuberculosis H37Rv
acgcguuccucga

SEQ ID NO: 3268203 - RNA, 15 nt, Mycobacterium tuberculosis H37Rv
acgcguuccucgacg

SEQ ID NO: 3268204 - RNA, 18 nt, Mycobacterium tuberculosis H37Rv
acgcguugcacagcagcg

SEQ ID NO: 3268205 - RNA, 13 nt, Mycobacterium tuberculosis H37Rv
acgcguuucgucg

SEQ ID NO: 3268206 - RNA, 13 nt, Mycobacterium tuberculosis H37Rv
acgcuaccgccgg

SEQ ID NO: 3268207 - RNA, 16 nt, Mycobacterium tuberculosis H37Rv
acgcucacccggcguc

SEQ ID NO: 3268208 - RNA, 13 nt, Mycobacterium tuberculosis H37Rv
acgcucacgcugc

SEQ ID NO: 3268209 - RNA, 17 nt, Mycobacterium tuberculosis H37Rv
acgcucaguuuggccug

SEQ ID NO: 3268210 - RNA, 14 nt, Mycobacterium tuberculosis H37Rv
acgcucaugaccgc

SEQ ID NO: 3268211 - RNA, 21 nt, Mycobacterium tuberculosis H37Rv
acgcucccuacgagcccacgc

SEQ ID NO: 3268212 - RNA, 18 nt, Mycobacterium tuberculosis H37Rv
acgcucgcgaagccgguu

SEQ ID NO: 3268213 - RNA, 16 nt, Mycobacterium tuberculosis H37Rv
acgcucggcacggagu

SEQ ID NO: 3268214 - RNA, 11 nt, Mycobacterium tuberculosis H37Rv
acgcucggcgg

SEQ ID NO: 3268215 - RNA, 21 nt, Mycobacterium tuberculosis H37Rv
acgcucggcggccagcucccg

SEQ ID NO: 3268216 - RNA, 14 nt, Mycobacterium tuberculosis H37Rv
acgcucggcgggga

SEQ ID NO: 3268217 - RNA, 19 nt, Mycobacterium tuberculosis H37Rv
acgcucggcguccgcccag

SEQ ID NO: 3268218 - RNA, 12 nt, Mycobacterium tuberculosis H37Rv
acgcucggcgug

SEQ ID NO: 3268219 - RNA, 18 nt, Mycobacterium tuberculosis H37Rv
acgcucgggcgcgcucgu

SEQ ID NO: 3268220 - RNA, 18 nt, Mycobacterium tuberculosis H37Rv
acgcucgggggauccggc

SEQ ID NO: 3268221 - RNA, 20 nt, Mycobacterium tuberculosis H37Rv
acgcucggucgccaccgccg

SEQ ID NO: 3268222 - RNA, 21 nt, Mycobacterium tuberculosis H37Rv
acgcucggugaaggucaccgu

SEQ ID NO: 3268223 - RNA, 23 nt, Mycobacterium tuberculosis H37Rv
acgcucggugcugcgccgauacg

SEQ ID NO: 3268224 - RNA, 20 nt, Mycobacterium tuberculosis H37Rv
acgcucguuugcgagcaggg

SEQ ID NO: 3268225 - RNA, 21 nt, Mycobacterium tuberculosis H37Rv
acgcucguuugcgagcagggg

SEQ ID NO: 3268226 - RNA, 17 nt, Mycobacterium tuberculosis H37Rv
acgcucugcgccacagc

SEQ ID NO: 3268227 - RNA, 16 nt, Mycobacterium tuberculosis H37Rv
acgcugacgugaagca

SEQ ID NO: 3268228 - RNA, 15 nt, Mycobacterium tuberculosis H37Rv
acgcugagccggucg

SEQ ID NO: 3268229 - RNA, 22 nt, Mycobacterium tuberculosis H37Rv
acgcugaguccccaggugggca

SEQ ID NO: 3268230 - RNA, 23 nt, Mycobacterium tuberculosis H37Rv
acgcugaucuuccccucggccgc

SEQ ID NO: 3268231 - RNA, 12 nt, Mycobacterium tuberculosis H37Rv
acgcugcaggcg

SEQ ID NO: 3268232 - RNA, 15 nt, Mycobacterium tuberculosis H37Rv
acgcugcaggcggcc

SEQ ID NO: 3268233 - RNA, 14 nt, Mycobacterium tuberculosis H37Rv
acgcugccaagcga

SEQ ID NO: 3268234 - RNA, 21 nt, Mycobacterium tuberculosis H37Rv
acgcugcccaaaagcgcggca

SEQ ID NO: 3268235 - RNA, 19 nt, Mycobacterium tuberculosis H37Rv
acgcugcccacgggccggc

SEQ ID NO: 3268236 - RNA, 17 nt, Mycobacterium tuberculosis H37Rv
acgcugcuggcaugcag

SEQ ID NO: 3268237 - RNA, 20 nt, Mycobacterium tuberculosis H37Rv
acgcugcuggcaugcaggug

SEQ ID NO: 3268238 - RNA, 22 nt, Mycobacterium tuberculosis H37Rv
acgcuggaacuuggcgucgaca

SEQ ID NO: 3268239 - RNA, 21 nt, Mycobacterium tuberculosis H37Rv
acgcuggccacgauccgcggu

SEQ ID NO: 3268240 - RNA, 19 nt, Mycobacterium tuberculosis H37Rv
acgcuggccuccagcuugg

SEQ ID NO: 3268241 - RNA, 14 nt, Mycobacterium tuberculosis H37Rv
acgcuggccucguc

SEQ ID NO: 3268242 - RNA, 19 nt, Mycobacterium tuberculosis H37Rv
acgcuggcgcccccgacga

SEQ ID NO: 3268243 - RNA, 13 nt, Mycobacterium tuberculosis H37Rv
acgcuggcgggca

SEQ ID NO: 3268244 - RNA, 20 nt, Mycobacterium tuberculosis H37Rv
acgcugggcggcuacccaug

SEQ ID NO: 3268245 - RNA, 15 nt, Mycobacterium tuberculosis H37Rv
acgcugggcgguagc

SEQ ID NO: 3268246 - RNA, 21 nt, Mycobacterium tuberculosis H37Rv
acgcugggcgguagcuuccgc

SEQ ID NO: 3268247 - RNA, 15 nt, Mycobacterium tuberculosis H37Rv
acgcuggucggcggc

SEQ ID NO: 3268248 - RNA, 13 nt, Mycobacterium tuberculosis H37Rv
acgcugucaauca

SEQ ID NO: 3268249 - RNA, 22 nt, Mycobacterium tuberculosis H37Rv
acgcugucccgcgggccagcac

SEQ ID NO: 3268250 - RNA, 18 nt, Mycobacterium tuberculosis H37Rv
acgcugugcgguaucggu

SEQ ID NO: 3268251 - RNA, 16 nt, Mycobacterium tuberculosis H37Rv
acgcugugcucgacga

SEQ ID NO: 3268252 - RNA, 17 nt, Mycobacterium tuberculosis H37Rv
acgcuguggcucgacga

SEQ ID NO: 3268253 - RNA, 15 nt, Mycobacterium tuberculosis H37Rv
acgcuucaccucguc

SEQ ID NO: 3268254 - RNA, 22 nt, Mycobacterium tuberculosis H37Rv
acgcuucggcagcucccgccac

SEQ ID NO: 3268255 - RNA, 22 nt, Mycobacterium tuberculosis H37Rv
acgcuucuuccgcgcgccggcg

SEQ ID NO: 3268256 - RNA, 17 nt, Mycobacterium tuberculosis H37Rv
acgcuugcggcugccca

SEQ ID NO: 3268257 - RNA, 19 nt, Mycobacterium tuberculosis H37Rv
acggaacaucgucaucgac

SEQ ID NO: 3268258 - RNA, 23 nt, Mycobacterium tuberculosis H37Rv
acggaacaucgucaucgacgagc

SEQ ID NO: 3268259 - RNA, 15 nt, Mycobacterium tuberculosis H37Rv
acggaaccgauaccu

SEQ ID NO: 3268260 - RNA, 14 nt, Mycobacterium tuberculosis H37Rv
acggaagaccgcgg

SEQ ID NO: 3268261 - RNA, 16 nt, Mycobacterium tuberculosis H37Rv
acggaagaccgcggga

SEQ ID NO: 3268262 - RNA, 20 nt, Mycobacterium tuberculosis H37Rv
acggaauguagccgacuucg

SEQ ID NO: 3268263 - RNA, 23 nt, Mycobacterium tuberculosis H37Rv
acggacacccugggcuggcugac

SEQ ID NO: 3268264 - RNA, 18 nt, Mycobacterium tuberculosis H37Rv
acggaccaggccuugacc

SEQ ID NO: 3268265 - RNA, 15 nt, Mycobacterium tuberculosis H37Rv
acggacccggcgcga

SEQ ID NO: 3268266 - RNA, 11 nt, Mycobacterium tuberculosis H37Rv
acggaccgcca

SEQ ID NO: 3268267 - RNA, 13 nt, Mycobacterium tuberculosis H37Rv
acggaccgucgcc

SEQ ID NO: 3268268 - RNA, 15 nt, Mycobacterium tuberculosis H37Rv
acggaccguuaccgg

SEQ ID NO: 3268269 - RNA, 23 nt, Mycobacterium tuberculosis H37Rv
acggaccguuaccggacccgcug

SEQ ID NO: 3268270 - RNA, 15 nt, Mycobacterium tuberculosis H37Rv
acggacgaagcaccu

SEQ ID NO: 3268271 - RNA, 19 nt, Mycobacterium tuberculosis H37Rv
acggacucccucgaucacg

SEQ ID NO: 3268272 - RNA, 18 nt, Mycobacterium tuberculosis H37Rv
acggagcucuugcgggca

SEQ ID NO: 3268273 - RNA, 19 nt, Mycobacterium tuberculosis H37Rv
acggagcucuugcgggcag

SEQ ID NO: 3268274 - RNA, 16 nt, Mycobacterium tuberculosis H37Rv
acggaggcggaccagg

SEQ ID NO: 3268275 - RNA, 13 nt, Mycobacterium tuberculosis H37Rv
acggagggcagga

SEQ ID NO: 3268276 - RNA, 23 nt, Mycobacterium tuberculosis H37Rv
acggauaauucaacagcaccgcg

SEQ ID NO: 3268277 - RNA, 17 nt, Mycobacterium tuberculosis H37Rv
acggaucaggcccgggc

SEQ ID NO: 3268278 - RNA, 21 nt, Mycobacterium tuberculosis H37Rv
acggaucgcccugacacccau

SEQ ID NO: 3268279 - RNA, 12 nt, Mycobacterium tuberculosis H37Rv
acggaucgcggc

SEQ ID NO: 3268280 - RNA, 17 nt, Mycobacterium tuberculosis H37Rv
acggaucgcggcggcgu

SEQ ID NO: 3268281 - RNA, 14 nt, Mycobacterium tuberculosis H37Rv
acggaugccggucg

SEQ ID NO: 3268282 - RNA, 18 nt, Mycobacterium tuberculosis H37Rv
acggaugcgauggccgac

SEQ ID NO: 3268283 - RNA, 20 nt, Mycobacterium tuberculosis H37Rv
acggaugcggccggugauga

SEQ ID NO: 3268284 - RNA, 20 nt, Mycobacterium tuberculosis H37Rv
acggauucccgcccagcagc

SEQ ID NO: 3268285 - RNA, 17 nt, Mycobacterium tuberculosis H37Rv
acggauucgaaggcacc

SEQ ID NO: 3268286 - RNA, 21 nt, Mycobacterium tuberculosis H37Rv
acggcaagccaaccagcccgg

SEQ ID NO: 3268287 - RNA, 16 nt, Mycobacterium tuberculosis H37Rv
acggcaagccauucac

SEQ ID NO: 3268288 - RNA, 16 nt, Mycobacterium tuberculosis H37Rv
acggcaagucuggcgg

SEQ ID NO: 3268289 - RNA, 19 nt, Mycobacterium tuberculosis H37Rv
acggcaaguuccacgggug

SEQ ID NO: 3268290 - RNA, 15 nt, Mycobacterium tuberculosis H37Rv
acggcaaucaacgca

SEQ ID NO: 3268291 - RNA, 16 nt, Mycobacterium tuberculosis H37Rv
acggcaccaccaagcu

SEQ ID NO: 3268292 - RNA, 20 nt, Mycobacterium tuberculosis H37Rv
acggcaccaccaagcucggc

SEQ ID NO: 3268293 - RNA, 23 nt, Mycobacterium tuberculosis H37Rv
acggcaccagaucuucgagcgca

SEQ ID NO: 3268294 - RNA, 13 nt, Mycobacterium tuberculosis H37Rv
acggcaccagcgg

SEQ ID NO: 3268295 - RNA, 21 nt, Mycobacterium tuberculosis H37Rv
acggcaccauguacaggcugu

SEQ ID NO: 3268296 - RNA, 18 nt, Mycobacterium tuberculosis H37Rv
acggcacccacccguucg

SEQ ID NO: 3268297 - RNA, 18 nt, Mycobacterium tuberculosis H37Rv
acggcacccccgacgaga

SEQ ID NO: 3268298 - RNA, 20 nt, Mycobacterium tuberculosis H37Rv
acggcuccuccgguaucggc

SEQ ID NO: 3268299 - RNA, 23 nt, Mycobacterium tuberculosis H37Rv
acggcuccuccgguaucggcgac

SEQ ID NO: 3268300 - RNA, 21 nt, Mycobacterium tuberculosis H37Rv
acggcucgggaacuucgccga

SEQ ID NO: 3268301 - RNA, 22 nt, Mycobacterium tuberculosis H37Rv
acggcucgggcagcgucacccu

SEQ ID NO: 3268302 - RNA, 12 nt, Mycobacterium tuberculosis H37Rv
acggcugcccau

SEQ ID NO: 3268303 - RNA, 13 nt, Mycobacterium tuberculosis H37Rv
acggcuuggcguc

SEQ ID NO: 3268304 - RNA, 17 nt, Mycobacterium tuberculosis H37Rv
acgggacgccgugugca

SEQ ID NO: 3268305 - RNA, 13 nt, Mycobacterium tuberculosis H37Rv
acgggacgucacc

SEQ ID NO: 3268306 - RNA, 21 nt, Mycobacterium tuberculosis H37Rv
acgggauagccguucggcauc

SEQ ID NO: 3268307 - RNA, 14 nt, Mycobacterium tuberculosis H37Rv
acgggaucgacccg

SEQ ID NO: 3268308 - RNA, 20 nt, Mycobacterium tuberculosis H37Rv
acgggaucgcccaggcgcga

SEQ ID NO: 3268309 - RNA, 17 nt, Mycobacterium tuberculosis H37Rv
acgggaugccggcgaag

SEQ ID NO: 3268310 - RNA, 11 nt, Mycobacterium tuberculosis H37Rv
acgggcaaacc

SEQ ID NO: 3268311 - RNA, 19 nt, Mycobacterium tuberculosis H37Rv
acgggcacccgagccgcac

SEQ ID NO: 3268312 - RNA, 12 nt, Mycobacterium tuberculosis H37Rv
acgggcaggagc

SEQ ID NO: 3268313 - RNA, 11 nt, Mycobacterium tuberculosis H37Rv
acgggcaguga

SEQ ID NO: 3268314 - RNA, 12 nt, Mycobacterium tuberculosis H37Rv
acgggcagugaa

SEQ ID NO: 3268315 - RNA, 17 nt, Mycobacterium tuberculosis H37Rv
acgggccgcaucgucgc

SEQ ID NO: 3268316 - RNA, 16 nt, Mycobacterium tuberculosis H37Rv
acgggccgucgccguc

SEQ ID NO: 3268317 - RNA, 18 nt, Mycobacterium tuberculosis H37Rv
acgggcgaaauuccgggc

SEQ ID NO: 3268318 - RNA, 15 nt, Mycobacterium tuberculosis H37Rv
acgggcgaucgcggu

SEQ ID NO: 3268319 - RNA, 13 nt, Mycobacterium tuberculosis H37Rv
acgggcgcgucgg

SEQ ID NO: 3268320 - RNA, 14 nt, Mycobacterium tuberculosis H37Rv
acgggcgugcugcc

SEQ ID NO: 3268321 - RNA, 16 nt, Mycobacterium tuberculosis H37Rv
acgggcuaccggcagc

SEQ ID NO: 3268322 - RNA, 19 nt, Mycobacterium tuberculosis H37Rv
acgggcuaccggcagcugc

SEQ ID NO: 3268323 - RNA, 20 nt, Mycobacterium tuberculosis H37Rv
acgggcucgcugcaccagcu

SEQ ID NO: 3268324 - RNA, 17 nt, Mycobacterium tuberculosis H37Rv
acgggcucggcaggccc

SEQ ID NO: 3268325 - RNA, 22 nt, Mycobacterium tuberculosis H37Rv
acgggcugccccuccgggcgca

SEQ ID NO: 3268326 - RNA, 17 nt, Mycobacterium tuberculosis H37Rv
acgggcuuccgacauga

SEQ ID NO: 3268327 - RNA, 20 nt, Mycobacterium tuberculosis H37Rv
acggggaacguccgcgccga

SEQ ID NO: 3268328 - RNA, 16 nt, Mycobacterium tuberculosis H37Rv
acggggccgccagcug

SEQ ID NO: 3268329 - RNA, 14 nt, Mycobacterium tuberculosis H37Rv
acggggcgagcaug

SEQ ID NO: 3268330 - RNA, 19 nt, Mycobacterium tuberculosis H37Rv
acggggcggucggccggcu

SEQ ID NO: 3268331 - RNA, 22 nt, Mycobacterium tuberculosis H37Rv
acggggcgugacagggcggcaa

SEQ ID NO: 3268332 - RNA, 23 nt, Mycobacterium tuberculosis H37Rv
acgggguccgaugcgugccgacc

SEQ ID NO: 3268333 - RNA, 20 nt, Mycobacterium tuberculosis H37Rv
acggggucgcccggggcgca

SEQ ID NO: 3268334 - RNA, 15 nt, Mycobacterium tuberculosis H37Rv
acgggguggcacgca

SEQ ID NO: 3268335 - RNA, 19 nt, Mycobacterium tuberculosis H37Rv
acgggguggugguggaguu

SEQ ID NO: 3268336 - RNA, 17 nt, Mycobacterium tuberculosis H37Rv
acgggguugaccgccac

SEQ ID NO: 3268337 - RNA, 23 nt, Mycobacterium tuberculosis H37Rv
acggguaauucuugacgccgaug

SEQ ID NO: 3268338 - RNA, 12 nt, Mycobacterium tuberculosis H37Rv
acgggucgaugu

SEQ ID NO: 3268339 - RNA, 12 nt, Mycobacterium tuberculosis H37Rv
acgggucgccgg

SEQ ID NO: 3268340 - RNA, 13 nt, Mycobacterium tuberculosis H37Rv
acgggucgccgga

SEQ ID NO: 3268341 - RNA, 12 nt, Mycobacterium tuberculosis H37Rv
acgggucgcggu

SEQ ID NO: 3268342 - RNA, 23 nt, Mycobacterium tuberculosis H37Rv
acgggucgggcaaccugccgggc

SEQ ID NO: 3268343 - RNA, 12 nt, Mycobacterium tuberculosis H37Rv
acgggucggguc

SEQ ID NO: 3268344 - RNA, 23 nt, Mycobacterium tuberculosis H37Rv
acgggucguaggacaccaccgug

SEQ ID NO: 3268345 - RNA, 20 nt, Mycobacterium tuberculosis H37Rv
acggguggugccaggucggc

SEQ ID NO: 3268346 - RNA, 14 nt, Mycobacterium tuberculosis H37Rv
acgggugucgggcg

SEQ ID NO: 3268347 - RNA, 23 nt, Mycobacterium tuberculosis H37Rv
acgggugucgggcgcgcugccca

SEQ ID NO: 3268348 - RNA, 16 nt, Mycobacterium tuberculosis H37Rv
acggguuggcgaucau

SEQ ID NO: 3268349 - RNA, 18 nt, Mycobacterium tuberculosis H37Rv
acggguugucguugcugg

SEQ ID NO: 3268350 - RNA, 21 nt, Mycobacterium tuberculosis H37Rv
acgguaccccaacgaccggca

SEQ ID NO: 3268351 - RNA, 16 nt, Mycobacterium tuberculosis H37Rv
acgguagcacggucug

SEQ ID NO: 3268352 - RNA, 19 nt, Mycobacterium tuberculosis H37Rv
acgguaggcccgcgcgaga

SEQ ID NO: 3268353 - RNA, 22 nt, Mycobacterium tuberculosis H37Rv
acggucaaggugcgccgccauc

SEQ ID NO: 3268354 - RNA, 18 nt, Mycobacterium tuberculosis H37Rv
acggucacacgccagccg

SEQ ID NO: 3268355 - RNA, 16 nt, Mycobacterium tuberculosis H37Rv
acggucagauggccac

SEQ ID NO: 3268356 - RNA, 21 nt, Mycobacterium tuberculosis H37Rv
acggucagcacgcugaccaca

SEQ ID NO: 3268357 - RNA, 16 nt, Mycobacterium tuberculosis H37Rv
acggucagcagacugc

SEQ ID NO: 3268358 - RNA, 19 nt, Mycobacterium tuberculosis H37Rv
acggucagcagacugccga

SEQ ID NO: 3268359 - RNA, 13 nt, Mycobacterium tuberculosis H37Rv
acggucagccagg

SEQ ID NO: 3268360 - RNA, 19 nt, Mycobacterium tuberculosis H37Rv
acggucagccguacgccgu

SEQ ID NO: 3268361 - RNA, 19 nt, Mycobacterium tuberculosis H37Rv
acggucaugccgccgccga

SEQ ID NO: 3268362 - RNA, 17 nt, Mycobacterium tuberculosis H37Rv
acgguccacgacgucga

SEQ ID NO: 3268363 - RNA, 18 nt, Mycobacterium tuberculosis H37Rv
acggucgaccaggacggu

SEQ ID NO: 3268364 - RNA, 11 nt, Mycobacterium tuberculosis H37Rv
acggucgccgu

SEQ ID NO: 3268365 - RNA, 17 nt, Mycobacterium tuberculosis H37Rv
acggucgcucggcauga

SEQ ID NO: 3268366 - RNA, 15 nt, Mycobacterium tuberculosis H37Rv
acggucgucgaucac

SEQ ID NO: 3268367 - RNA, 15 nt, Mycobacterium tuberculosis H37Rv
acggucguuggucgg

SEQ ID NO: 3268368 - RNA, 16 nt, Mycobacterium tuberculosis H37Rv
acggucugauggugga

SEQ ID NO: 3268369 - RNA, 15 nt, Mycobacterium tuberculosis H37Rv
acggugagaucgggu

SEQ ID NO: 3268370 - RNA, 19 nt, Mycobacterium tuberculosis H37Rv
acggugagggcgucgucga

SEQ ID NO: 3268371 - RNA, 16 nt, Mycobacterium tuberculosis H37Rv
acggugaucagcagca

SEQ ID NO: 3268372 - RNA, 12 nt, Mycobacterium tuberculosis H37Rv
acggugaucgcc

SEQ ID NO: 3268373 - RNA, 18 nt, Mycobacterium tuberculosis H37Rv
acggugaucuugccggcc

SEQ ID NO: 3268374 - RNA, 17 nt, Mycobacterium tuberculosis H37Rv
acggugaugacacgcgc

SEQ ID NO: 3268375 - RNA, 14 nt, Mycobacterium tuberculosis H37Rv
acggugauggggga

SEQ ID NO: 3268376 - RNA, 21 nt, Mycobacterium tuberculosis H37Rv
acggugcacagcagugaacgu

SEQ ID NO: 3268377 - RNA, 16 nt, Mycobacterium tuberculosis H37Rv
acggugccgaccgcgu

SEQ ID NO: 3268378 - RNA, 13 nt, Mycobacterium tuberculosis H37Rv
acggugccgacga

SEQ ID NO: 3268379 - RNA, 16 nt, Mycobacterium tuberculosis H37Rv
acggugccgacgauga

SEQ ID NO: 3268380 - RNA, 14 nt, Mycobacterium tuberculosis H37Rv
acggugccggcacc

SEQ ID NO: 3268381 - RNA, 20 nt, Mycobacterium tuberculosis H37Rv
acggugcgauuccgcgucug

SEQ ID NO: 3268382 - RNA, 19 nt, Mycobacterium tuberculosis H37Rv
acggugcucuucgaugacu

SEQ ID NO: 3268383 - RNA, 21 nt, Mycobacterium tuberculosis H37Rv
acggugcucuucgaugacuag

SEQ ID NO: 3268384 - RNA, 12 nt, Mycobacterium tuberculosis H37Rv
acggugcugccg

SEQ ID NO: 3268385 - RNA, 21 nt, Mycobacterium tuberculosis H37Rv
acggugcugccguugggcacc

SEQ ID NO: 3268386 - RNA, 15 nt, Mycobacterium tuberculosis H37Rv
acgguggcgcggugc

SEQ ID NO: 3268387 - RNA, 20 nt, Mycobacterium tuberculosis H37Rv
acgguggcgcggugccggcg

SEQ ID NO: 3268388 - RNA, 22 nt, Mycobacterium tuberculosis H37Rv
acggugggcgccgacaccggcu

SEQ ID NO: 3268389 - RNA, 20 nt, Mycobacterium tuberculosis H37Rv
acggugggugggcgccgcaa

SEQ ID NO: 3268390 - RNA, 20 nt, Mycobacterium tuberculosis H37Rv
acggugguaagacgccgaac

SEQ ID NO: 3268391 - RNA, 15 nt, Mycobacterium tuberculosis H37Rv
acgguguaacugcgu

SEQ ID NO: 3268392 - RNA, 18 nt, Mycobacterium tuberculosis H37Rv
acggugucgucgaccacc

SEQ ID NO: 3268393 - RNA, 14 nt, Mycobacterium tuberculosis H37Rv
acggugucucgccc

SEQ ID NO: 3268394 - RNA, 20 nt, Mycobacterium tuberculosis H37Rv
acggugucuugccaccacgc

SEQ ID NO: 3268395 - RNA, 20 nt, Mycobacterium tuberculosis H37Rv
acgugugcggaagcaucggc

SEQ ID NO: 3268396 - RNA, 15 nt, Mycobacterium tuberculosis H37Rv
acguguuaaccgggc

SEQ ID NO: 3268397 - RNA, 15 nt, Mycobacterium tuberculosis H37Rv
acguguugaccgggu

SEQ ID NO: 3268398 - RNA, 22 nt, Mycobacterium tuberculosis H37Rv
acguuacgccgagaugcugcac

SEQ ID NO: 3268399 - RNA, 14 nt, Mycobacterium tuberculosis H37Rv
acguucggcacaac

SEQ ID NO: 3268400 - RNA, 16 nt, Mycobacterium tuberculosis H37Rv
acguucgguggcgaug

SEQ ID NO: 3268401 - RNA, 18 nt, Mycobacterium tuberculosis H37Rv
acguugacguccaacagc

SEQ ID NO: 3268402 - RNA, 23 nt, Mycobacterium tuberculosis H37Rv
acguugagguucuucugcgccac

SEQ ID NO: 3268403 - RNA, 22 nt, Mycobacterium tuberculosis H37Rv
acguugauccgcgcaacuucca

SEQ ID NO: 3268404 - RNA, 15 nt, Mycobacterium tuberculosis H37Rv
acguugcagccggca

SEQ ID NO: 3268405 - RNA, 17 nt, Mycobacterium tuberculosis H37Rv
acguugcagccggcaua

SEQ ID NO: 3268406 - RNA, 22 nt, Mycobacterium tuberculosis H37Rv
acguugccaacaccggcgauca

SEQ ID NO: 3268407 - RNA, 15 nt, Mycobacterium tuberculosis H37Rv
acguugccgaucccg

SEQ ID NO: 3268408 - RNA, 19 nt, Mycobacterium tuberculosis H37Rv
acguugccggaguugucga

SEQ ID NO: 3268409 - RNA, 22 nt, Mycobacterium tuberculosis H37Rv
acguugcguagcaggucgacgg

SEQ ID NO: 3268410 - RNA, 15 nt, Mycobacterium tuberculosis H37Rv
acguuggcagcccuc

SEQ ID NO: 3268411 - RNA, 22 nt, Mycobacterium tuberculosis H37Rv
acguuggccgagcagggccggc

SEQ ID NO: 3268412 - RNA, 18 nt, Mycobacterium tuberculosis H37Rv
acguuggcggccagcgca

SEQ ID NO: 3268413 - RNA, 18 nt, Mycobacterium tuberculosis H37Rv
acguuggcgugcaccgca

SEQ ID NO: 3268414 - RNA, 23 nt, Mycobacterium tuberculosis H37Rv
acguuggcgugcaccgcaucggg

SEQ ID NO: 3268415 - RNA, 17 nt, Mycobacterium tuberculosis H37Rv
acguugugccuuagcug

SEQ ID NO: 3268416 - RNA, 20 nt, Mycobacterium tuberculosis H37Rv
acguuuagggugcccgcguu

SEQ ID NO: 3268417 - RNA, 17 nt, Mycobacterium tuberculosis H37Rv
acguuucgcuguccgac

SEQ ID NO: 3268418 - RNA, 17 nt, Mycobacterium tuberculosis H37Rv
acguuugccggcccacc

SEQ ID NO: 3268419 - RNA, 19 nt, Mycobacterium tuberculosis H37Rv
acguuuggauggcuggcca

SEQ ID NO: 3268420 - RNA, 14 nt, Mycobacterium tuberculosis H37Rv
acuaacaacaccac

SEQ ID NO: 3268421 - RNA, 16 nt, Mycobacterium tuberculosis H37Rv
acuaacggcagccacc

SEQ ID NO: 3268422 - RNA, 15 nt, Mycobacterium tuberculosis H37Rv
acuaccgaucacaua

SEQ ID NO: 3268423 - RNA, 17 nt, Mycobacterium tuberculosis H37Rv
acuaccgccgcgaccgc

SEQ ID NO: 3268424 - RNA, 20 nt, Mycobacterium tuberculosis H37Rv
acuacggccucgcugggcuc

SEQ ID NO: 3268425 - RNA, 17 nt, Mycobacterium tuberculosis H37Rv
acuacggccuggccacc

SEQ ID NO: 3268426 - RNA, 14 nt, Mycobacterium tuberculosis H37Rv
acuacuccgguccc

SEQ ID NO: 3268427 - RNA, 16 nt, Mycobacterium tuberculosis H37Rv
acuacuccugagauga

SEQ ID NO: 3268428 - RNA, 16 nt, Mycobacterium tuberculosis H37Rv
acuagccaguuacguu

SEQ ID NO: 3268429 - RNA, 17 nt, Mycobacterium tuberculosis H37Rv
acuagcgccccuggcac

SEQ ID NO: 3268430 - RNA, 14 nt, Mycobacterium tuberculosis H37Rv
acuaggcccagcac

SEQ ID NO: 3268431 - RNA, 16 nt, Mycobacterium tuberculosis H37Rv
acuaggcccagcacgg

SEQ ID NO: 3268432 - RNA, 15 nt, Mycobacterium tuberculosis H37Rv
acucacauuggccag

SEQ ID NO: 3268433 - RNA, 18 nt, Mycobacterium tuberculosis H37Rv
acucacauuggccagguc

SEQ ID NO: 3268434 - RNA, 23 nt, Mycobacterium tuberculosis H37Rv
acucacauuggccaggucggcca

SEQ ID NO: 3268435 - RNA, 14 nt, Mycobacterium tuberculosis H37Rv
acucaccaaccgca

SEQ ID NO: 3268436 - RNA, 17 nt, Mycobacterium tuberculosis H37Rv
acucaccaaccgcauau

SEQ ID NO: 3268437 - RNA, 13 nt, Mycobacterium tuberculosis H37Rv
acucaccagcacc

SEQ ID NO: 3268438 - RNA, 17 nt, Mycobacterium tuberculosis H37Rv
acucaccagcaccccga

SEQ ID NO: 3268439 - RNA, 20 nt, Mycobacterium tuberculosis H37Rv
acucacccacccgcaccgcg

SEQ ID NO: 3268440 - RNA, 20 nt, Mycobacterium tuberculosis H37Rv
acucacccgggcagccugcu

SEQ ID NO: 3268441 - RNA, 23 nt, Mycobacterium tuberculosis H37Rv
acucacccgggcagccugcugca

SEQ ID NO: 3268442 - RNA, 15 nt, Mycobacterium tuberculosis H37Rv
acucaccgugaaccg

SEQ ID NO: 3268443 - RNA, 22 nt, Mycobacterium tuberculosis H37Rv
acucacgaggcacaaucaccgc

SEQ ID NO: 3268444 - RNA, 18 nt, Mycobacterium tuberculosis H37Rv
acucacuaccgaucacau

SEQ ID NO: 3268445 - RNA, 19 nt, Mycobacterium tuberculosis H37Rv
acucagaacguggccguua

SEQ ID NO: 3268446 - RNA, 17 nt, Mycobacterium tuberculosis H37Rv
acucagcccgucgggca

SEQ ID NO: 3268447 - RNA, 14 nt, Mycobacterium tuberculosis H37Rv
acucagucugggga

SEQ ID NO: 3268448 - RNA, 17 nt, Mycobacterium tuberculosis H37Rv
acucaguguuccgccac

SEQ ID NO: 3268449 - RNA, 13 nt, Mycobacterium tuberculosis H37Rv
acucaucggcgug

SEQ ID NO: 3268450 - RNA, 21 nt, Mycobacterium tuberculosis H37Rv
acucaucuuugacaccggucg

SEQ ID NO: 3268451 - RNA, 20 nt, Mycobacterium tuberculosis H37Rv
acucauuacgguagacguug

SEQ ID NO: 3268452 - RNA, 21 nt, Mycobacterium tuberculosis H37Rv
acuccaacugaucccguagcc

SEQ ID NO: 3268453 - RNA, 20 nt, Mycobacterium tuberculosis H37Rv
acuccaagucacagcucacc

SEQ ID NO: 3268454 - RNA, 16 nt, Mycobacterium tuberculosis H37Rv
acuccaccccacccag

SEQ ID NO: 3268455 - RNA, 14 nt, Mycobacterium tuberculosis H37Rv
acuccaccgcgccg

SEQ ID NO: 3268456 - RNA, 17 nt, Mycobacterium tuberculosis H37Rv
acuccaccgcuggcccg

SEQ ID NO: 3268457 - RNA, 22 nt, Mycobacterium tuberculosis H37Rv
acuccacgaucggcccagcccu

SEQ ID NO: 3268458 - RNA, 13 nt, Mycobacterium tuberculosis H37Rv
acuccacgcagcc

SEQ ID NO: 3268459 - RNA, 11 nt, Mycobacterium tuberculosis H37Rv
acuccagcacc

SEQ ID NO: 3268460 - RNA, 16 nt, Mycobacterium tuberculosis H37Rv
acuccagcaccagcac

SEQ ID NO: 3268461 - RNA, 17 nt, Mycobacterium tuberculosis H37Rv
acuccagcaccagcacg

SEQ ID NO: 3268462 - RNA, 13 nt, Mycobacterium tuberculosis H37Rv
acuccagcgcccg

SEQ ID NO: 3268463 - RNA, 14 nt, Mycobacterium tuberculosis H37Rv
acuccagcuugccg

SEQ ID NO: 3268464 - RNA, 17 nt, Mycobacterium tuberculosis H37Rv
acuccaucagcgcgacc

SEQ ID NO: 3268465 - RNA, 12 nt, Mycobacterium tuberculosis H37Rv
acuccccagaca

SEQ ID NO: 3268466 - RNA, 19 nt, Mycobacterium tuberculosis H37Rv
acucccggauauugccauc

SEQ ID NO: 3268467 - RNA, 22 nt, Mycobacterium tuberculosis H37Rv
acucccggauauugccaucccu

SEQ ID NO: 3268468 - RNA, 20 nt, Mycobacterium tuberculosis H37Rv
acucccggcucggccagcca

SEQ ID NO: 3268469 - RNA, 24 nt, Mycobacterium tuberculosis H37Rv
acucccggcucggccagccagcgg

SEQ ID NO: 3268470 - RNA, 15 nt, Mycobacterium tuberculosis H37Rv
acucccucgaucacg

SEQ ID NO: 3268471 - RNA, 23 nt, Mycobacterium tuberculosis H37Rv
acucccucgaucacggcggcccc

SEQ ID NO: 3268472 - RNA, 18 nt, Mycobacterium tuberculosis H37Rv
acucccuggccgcuucga

SEQ ID NO: 3268473 - RNA, 15 nt, Mycobacterium tuberculosis H37Rv
acuccgaucgggccc

SEQ ID NO: 3268474 - RNA, 22 nt, Mycobacterium tuberculosis H37Rv
acuccgaucgggcccaccgcug

SEQ ID NO: 3268475 - RNA, 22 nt, Mycobacterium tuberculosis H37Rv
acuccgccaccaucgccucggc

SEQ ID NO: 3268476 - RNA, 17 nt, Mycobacterium tuberculosis H37Rv
acuccgcgagcccggcc

SEQ ID NO: 3268477 - RNA, 17 nt, Mycobacterium tuberculosis H37Rv
acuccgcgcgcugggcc

SEQ ID NO: 3268478 - RNA, 15 nt, Mycobacterium tuberculosis H37Rv
acuccgcggaaccca

SEQ ID NO: 3268479 - RNA, 19 nt, Mycobacterium tuberculosis H37Rv
acuccgcggaacccagcac

SEQ ID NO: 3268480 - RNA, 12 nt, Mycobacterium tuberculosis H37Rv
acuccgcggcgc

SEQ ID NO: 3268481 - RNA, 22 nt, Mycobacterium tuberculosis H37Rv
acuccggacccuuacccggcgc

SEQ ID NO: 3268482 - RNA, 16 nt, Mycobacterium tuberculosis H37Rv
acuccggccgcacgcc

SEQ ID NO: 3268483 - RNA, 20 nt, Mycobacterium tuberculosis H37Rv
acuccggcgcuaugaagucg

SEQ ID NO: 3268484 - RNA, 16 nt, Mycobacterium tuberculosis H37Rv
acuccggguggcggcg

SEQ ID NO: 3268485 - RNA, 18 nt, Mycobacterium tuberculosis H37Rv
acuccggucaacacccgc

SEQ ID NO: 3268486 - RNA, 16 nt, Mycobacterium tuberculosis H37Rv
acuccggucagcgcgg

SEQ ID NO: 3268487 - RNA, 17 nt, Mycobacterium tuberculosis H37Rv
acuccggucagcgcggc

SEQ ID NO: 3268488 - RNA, 17 nt, Mycobacterium tuberculosis H37Rv
acuccgugcuuccauuc

SEQ ID NO: 3268489 - RNA, 22 nt, Mycobacterium tuberculosis H37Rv
acuccgugcuuccauucgcggu

SEQ ID NO: 3268490 - RNA, 15 nt, Mycobacterium tuberculosis H37Rv
acuccucagccgccu

SEQ ID NO: 3268491 - RNA, 11 nt, Mycobacterium tuberculosis H37Rv
acugcugggcu

SEQ ID NO: 3268492 - RNA, 21 nt, Mycobacterium tuberculosis H37Rv
acugcugggggucaaucgggu

SEQ ID NO: 3268493 - RNA, 14 nt, Mycobacterium tuberculosis H37Rv
acugcuggucaggu

SEQ ID NO: 3268494 - RNA, 16 nt, Mycobacterium tuberculosis H37Rv
acugcuuccggaacaa

SEQ ID NO: 3268495 - RNA, 17 nt, Mycobacterium tuberculosis H37Rv
acuggaaagcagcagcg

SEQ ID NO: 3268496 - RNA, 13 nt, Mycobacterium tuberculosis H37Rv
acuggaagccaag

SEQ ID NO: 3268497 - RNA, 15 nt, Mycobacterium tuberculosis H37Rv
acuggaauggcucac

SEQ ID NO: 3268498 - RNA, 17 nt, Mycobacterium tuberculosis H37Rv
acuggacaagcuccucg

SEQ ID NO: 3268499 - RNA, 13 nt, Mycobacterium tuberculosis H37Rv
acuggaccaccgc

SEQ ID NO: 3268500 - RNA, 22 nt, Mycobacterium tuberculosis H37Rv
acuggaccacucggcggccacc

SEQ ID NO: 3268501 - RNA, 15 nt, Mycobacterium tuberculosis H37Rv
acuggauggcucgcc

SEQ ID NO: 3268502 - RNA, 14 nt, Mycobacterium tuberculosis H37Rv
acuggcaccgccag

SEQ ID NO: 3268503 - RNA, 16 nt, Mycobacterium tuberculosis H37Rv
acuggcaccgccagcc

SEQ ID NO: 3268504 - RNA, 20 nt, Mycobacterium tuberculosis H37Rv
acuggcccccacaccacgcu

SEQ ID NO: 3268505 - RNA, 20 nt, Mycobacterium tuberculosis H37Rv
acuggccccgccagcggcag

SEQ ID NO: 3268506 - RNA, 18 nt, Mycobacterium tuberculosis H37Rv
acuggccccgguggugcu

SEQ ID NO: 3268507 - RNA, 17 nt, Mycobacterium tuberculosis H37Rv
acuggcccggacaugcg

SEQ ID NO: 3268508 - RNA, 17 nt, Mycobacterium tuberculosis H37Rv
acuggccgcgucgcuga

SEQ ID NO: 3268509 - RNA, 20 nt, Mycobacterium tuberculosis H37Rv
acuggcgccggugccgccgg

SEQ ID NO: 3268510 - RNA, 21 nt, Mycobacterium tuberculosis H37Rv
acuggcgguguaacccggaac

SEQ ID NO: 3268511 - RNA, 20 nt, Mycobacterium tuberculosis H37Rv
acuggcgucgaugucgccgc

SEQ ID NO: 3268512 - RNA, 16 nt, Mycobacterium tuberculosis H37Rv
acuggcuuugacggga

SEQ ID NO: 3268513 - RNA, 21 nt, Mycobacterium tuberculosis H37Rv
acugggcgaucgacaccguga

SEQ ID NO: 3268514 - RNA, 18 nt, Mycobacterium tuberculosis H37Rv
acugggcgcccaagcgcg

SEQ ID NO: 3268515 - RNA, 23 nt, Mycobacterium tuberculosis H37Rv
acuggggcgccaccacccggcgc

SEQ ID NO: 3268516 - RNA, 14 nt, Mycobacterium tuberculosis H37Rv
acuggggugcugcg

SEQ ID NO: 3268517 - RNA, 16 nt, Mycobacterium tuberculosis H37Rv
acuggggugcugcgcg

SEQ ID NO: 3268518 - RNA, 13 nt, Mycobacterium tuberculosis H37Rv
acugggucgccuc

SEQ ID NO: 3268519 - RNA, 22 nt, Mycobacterium tuberculosis H37Rv
acugggugucggugucgacguu

SEQ ID NO: 3268520 - RNA, 13 nt, Mycobacterium tuberculosis H37Rv
acugguauuuccc

SEQ ID NO: 3268521 - RNA, 12 nt, Mycobacterium tuberculosis H37Rv
acuggucgccaa

SEQ ID NO: 3268522 - RNA, 13 nt, Mycobacterium tuberculosis H37Rv
acuggugcagcgc

SEQ ID NO: 3268523 - RNA, 23 nt, Mycobacterium tuberculosis H37Rv
acuggugcccgacccgccgauga

SEQ ID NO: 3268524 - RNA, 20 nt, Mycobacterium tuberculosis H37Rv
acugguggcgauccguagga

SEQ ID NO: 3268525 - RNA, 13 nt, Mycobacterium tuberculosis H37Rv
acuggugggccau

SEQ ID NO: 3268526 - RNA, 20 nt, Mycobacterium tuberculosis H37Rv
acuguccccguugagauacc

SEQ ID NO: 3268527 - RNA, 23 nt, Mycobacterium tuberculosis H37Rv
acuguccgggugggcgcugucac

SEQ ID NO: 3268528 - RNA, 18 nt, Mycobacterium tuberculosis H37Rv
acugugaaucucacgacg

SEQ ID NO: 3268529 - RNA, 19 nt, Mycobacterium tuberculosis H37Rv
acugugaaucucacgacgc

SEQ ID NO: 3268530 - RNA, 17 nt, Mycobacterium tuberculosis H37Rv
acugugaguagcccgcg

SEQ ID NO: 3268531 - RNA, 21 nt, Mycobacterium tuberculosis H37Rv
acugugccgcugcauccgcag

SEQ ID NO: 3268532 - RNA, 19 nt, Mycobacterium tuberculosis H37Rv
acugugcgagcugcggguc

SEQ ID NO: 3268533 - RNA, 20 nt, Mycobacterium tuberculosis H37Rv
acugugcucgccggaucuug

SEQ ID NO: 3268534 - RNA, 16 nt, Mycobacterium tuberculosis H37Rv
acuguggcgccgccgg

SEQ ID NO: 3268535 - RNA, 15 nt, Mycobacterium tuberculosis H37Rv
acuguuacggccaca

SEQ ID NO: 3268536 - RNA, 13 nt, Mycobacterium tuberculosis H37Rv
acuguucccacag

SEQ ID NO: 3268537 - RNA, 13 nt, Mycobacterium tuberculosis H37Rv
acuguuccgggug

SEQ ID NO: 3268538 - RNA, 14 nt, Mycobacterium tuberculosis H37Rv
acuguucugcuggc

SEQ ID NO: 3268539 - RNA, 16 nt, Mycobacterium tuberculosis H37Rv
acuuaccgagccguca

SEQ ID NO: 3268540 - RNA, 19 nt, Mycobacterium tuberculosis H37Rv
acuuaccgaggccaugcuc

SEQ ID NO: 3268541 - RNA, 17 nt, Mycobacterium tuberculosis H37Rv
acuuagcccgauggugc

SEQ ID NO: 3268542 - RNA, 13 nt, Mycobacterium tuberculosis H37Rv
acuucaccggcuc

SEQ ID NO: 3268543 - RNA, 17 nt, Mycobacterium tuberculosis H37Rv
acuucauauaccgcucg

SEQ ID NO: 3268544 - RNA, 15 nt, Mycobacterium tuberculosis H37Rv
acuucaugaugacaa

SEQ ID NO: 3268545 - RNA, 20 nt, Mycobacterium tuberculosis H37Rv
acuucccgcgcgagccgcuc

SEQ ID NO: 3268546 - RNA, 19 nt, Mycobacterium tuberculosis H37Rv
acuuccgggcagcugggca

SEQ ID NO: 3268547 - RNA, 21 nt, Mycobacterium tuberculosis H37Rv
acuuccgggcagcugggcagg

SEQ ID NO: 3268548 - RNA, 18 nt, Mycobacterium tuberculosis H37Rv
acuucgaaucaggcucca

SEQ ID NO: 3268549 - RNA, 21 nt, Mycobacterium tuberculosis H37Rv
acuucgcuggaaaccucuucg

SEQ ID NO: 3268550 - RNA, 15 nt, Mycobacterium tuberculosis H37Rv
acuucggccacaacc

SEQ ID NO: 3268551 - RNA, 16 nt, Mycobacterium tuberculosis H37Rv
acuucggggucaccgg

SEQ ID NO: 3268552 - RNA, 17 nt, Mycobacterium tuberculosis H37Rv
acuucggugagcagggc

SEQ ID NO: 3268553 - RNA, 18 nt, Mycobacterium tuberculosis H37Rv
acuucugguaggcggcca

SEQ ID NO: 3268554 - RNA, 15 nt, Mycobacterium tuberculosis H37Rv
acuucuucacuggcg

SEQ ID NO: 3268555 - RNA, 17 nt, Mycobacterium tuberculosis H37Rv
acuucuucgacgcgcau

SEQ ID NO: 3268556 - RNA, 15 nt, Mycobacterium tuberculosis H37Rv
acuugaucucggcga

SEQ ID NO: 3268557 - RNA, 13 nt, Mycobacterium tuberculosis H37Rv
acuugcacgcugu

SEQ ID NO: 3268558 - RNA, 19 nt, Mycobacterium tuberculosis H37Rv
acuugcaggcgucccagcc

SEQ ID NO: 3268559 - RNA, 19 nt, Mycobacterium tuberculosis H37Rv
acuugccacggcgauuccu

SEQ ID NO: 3268560 - RNA, 20 nt, Mycobacterium tuberculosis H37Rv
acuugcgccaccguggccgc

SEQ ID NO: 3268561 - RNA, 22 nt, Mycobacterium tuberculosis H37Rv
acuugcgccaccguggccgcag

SEQ ID NO: 3268562 - RNA, 18 nt, Mycobacterium tuberculosis H37Rv
acuuggacgacccgggcc

SEQ ID NO: 3268563 - RNA, 14 nt, Mycobacterium tuberculosis H37Rv
acuuggcaucgcga

SEQ ID NO: 3268564 - RNA, 23 nt, Mycobacterium tuberculosis H37Rv
acuuggcccccgacggugaacca

SEQ ID NO: 3268565 - RNA, 17 nt, Mycobacterium tuberculosis H37Rv
acuuggugauccgagac

SEQ ID NO: 3268566 - RNA, 20 nt, Mycobacterium tuberculosis H37Rv
acuugucgcuaugccccgga

SEQ ID NO: 3268567 - RNA, 18 nt, Mycobacterium tuberculosis H37Rv
acuugucggggugcacac

SEQ ID NO: 3268568 - RNA, 19 nt, Mycobacterium tuberculosis H37Rv
acuugugccacuucuucac

SEQ ID NO: 3268569 - RNA, 23 nt, Mycobacterium tuberculosis H37Rv
acuugugccgggcgaugcugggc

SEQ ID NO: 3268570 - RNA, 15 nt, Mycobacterium tuberculosis H37Rv
acuuguugaagccga

SEQ ID NO: 3268571 - RNA, 18 nt, Mycobacterium tuberculosis H37Rv
acuuguugacgaacccac

SEQ ID NO: 3268572 - RNA, 23 nt, Mycobacterium tuberculosis H37Rv
acuuucacgcucguuugcgagca

SEQ ID NO: 3268573 - RNA, 19 nt, Mycobacterium tuberculosis H37Rv
acuuucgaagaaccgccac

SEQ ID NO: 3268574 - RNA, 20 nt, Mycobacterium tuberculosis H37Rv
acuuugagucguuggacggc

SEQ ID NO: 3268575 - RNA, 16 nt, Mycobacterium tuberculosis H37Rv
acuuugcgcccggcac

SEQ ID NO: 3268576 - RNA, 15 nt, Mycobacterium tuberculosis H37Rv
acuuugggucggcga

SEQ ID NO: 3268577 - RNA, 15 nt, Mycobacterium tuberculosis H37Rv
acuuugguugcccgc

SEQ ID NO: 3268578 - RNA, 16 nt, Mycobacterium tuberculosis H37Rv
agaaacccggcgacca

SEQ ID NO: 3268579 - RNA, 17 nt, Mycobacterium tuberculosis H37Rv
agaaacccggcgaccac

SEQ ID NO: 3268580 - RNA, 17 nt, Mycobacterium tuberculosis H37Rv
agaaacgccgagcgcca

SEQ ID NO: 3268581 - RNA, 16 nt, Mycobacterium tuberculosis H37Rv
agaaacgucugccacg

SEQ ID NO: 3268582 - RNA, 15 nt, Mycobacterium tuberculosis H37Rv
agaaaucaaauccuu

SEQ ID NO: 3268583 - RNA, 18 nt, Mycobacterium tuberculosis H37Rv
agaaauucuugaaauagu

SEQ ID NO: 3268584 - RNA, 14 nt, Mycobacterium tuberculosis H37Rv
agaacaacaucgcc

SEQ ID NO: 3268585 - RNA, 20 nt, Mycobacterium tuberculosis H37Rv
agaacaacgggauccgcgcg

SEQ ID NO: 3268586 - RNA, 12 nt, Mycobacterium tuberculosis H37Rv
agaacaccaccg

SEQ ID NO: 3268587 - RNA, 14 nt, Mycobacterium tuberculosis H37Rv
agacgccgccgcug

SEQ ID NO: 3268588 - RNA, 12 nt, Mycobacterium tuberculosis H37Rv
agacgccgccgu

SEQ ID NO: 3268589 - RNA, 12 nt, Mycobacterium tuberculosis H37Rv
agacgccggcga

SEQ ID NO: 3268590 - RNA, 18 nt, Mycobacterium tuberculosis H37Rv
agacgccggcgaugccgg

SEQ ID NO: 3268591 - RNA, 14 nt, Mycobacterium tuberculosis H37Rv
agacgccggggaac

SEQ ID NO: 3268592 - RNA, 16 nt, Mycobacterium tuberculosis H37Rv
agacgccgucggcgcc

SEQ ID NO: 3268593 - RNA, 14 nt, Mycobacterium tuberculosis H37Rv
agacgcgaaagcac

SEQ ID NO: 3268594 - RNA, 17 nt, Mycobacterium tuberculosis H37Rv
agacggcacccccgacg

SEQ ID NO: 3268595 - RNA, 12 nt, Mycobacterium tuberculosis H37Rv
agacggccaccg

SEQ ID NO: 3268596 - RNA, 21 nt, Mycobacterium tuberculosis H37Rv
agacggcucagcgugcgcugg

SEQ ID NO: 3268597 - RNA, 15 nt, Mycobacterium tuberculosis H37Rv
agacggucgaucaca

SEQ ID NO: 3268598 - RNA, 17 nt, Mycobacterium tuberculosis H37Rv
agacgguguugccuagg

SEQ ID NO: 3268599 - RNA, 19 nt, Mycobacterium tuberculosis H37Rv
agacguccgcggucgcagc

SEQ ID NO: 3268600 - RNA, 20 nt, Mycobacterium tuberculosis H37Rv
agacguccgcggucgcagca

SEQ ID NO: 3268601 - RNA, 15 nt, Mycobacterium tuberculosis H37Rv
agacgugccaaugau

SEQ ID NO: 3268602 - RNA, 21 nt, Mycobacterium tuberculosis H37Rv
agacguuucccaggcccgaca

SEQ ID NO: 3268603 - RNA, 19 nt, Mycobacterium tuberculosis H37Rv
agacuagccgauccagcag

SEQ ID NO: 3268604 - RNA, 22 nt, Mycobacterium tuberculosis H37Rv
agacuagcugcuagcccggcgg

SEQ ID NO: 3268605 - RNA, 20 nt, Mycobacterium tuberculosis H37Rv
agacuccagcaaggccagca

SEQ ID NO: 3268606 - RNA, 20 nt, Mycobacterium tuberculosis H37Rv
agacucgauaugcagcucgc

SEQ ID NO: 3268607 - RNA, 17 nt, Mycobacterium tuberculosis H37Rv
agacucgucgaugcggu

SEQ ID NO: 3268608 - RNA, 14 nt, Mycobacterium tuberculosis H37Rv
agacugcuggucau

SEQ ID NO: 3268609 - RNA, 22 nt, Mycobacterium tuberculosis H37Rv
agacugggcgcuggaggccacc

SEQ ID NO: 3268610 - RNA, 14 nt, Mycobacterium tuberculosis H37Rv
agacuucuucgacg

SEQ ID NO: 3268611 - RNA, 16 nt, Mycobacterium tuberculosis H37Rv
agacuucuucgacgcg

SEQ ID NO: 3268612 - RNA, 15 nt, Mycobacterium tuberculosis H37Rv
agacuuucgcccagu

SEQ ID NO: 3268613 - RNA, 23 nt, Mycobacterium tuberculosis H37Rv
agagaaggcggcgucgagcaccu

SEQ ID NO: 3268614 - RNA, 18 nt, Mycobacterium tuberculosis H37Rv
agagacaugucgcugccg

SEQ ID NO: 3268615 - RNA, 21 nt, Mycobacterium tuberculosis H37Rv
agagacgucaaacgggagcga

SEQ ID NO: 3268616 - RNA, 17 nt, Mycobacterium tuberculosis H37Rv
agagauuucuugaccgc

SEQ ID NO: 3268617 - RNA, 19 nt, Mycobacterium tuberculosis H37Rv
agagcacgucaacagccag

SEQ ID NO: 3268618 - RNA, 22 nt, Mycobacterium tuberculosis H37Rv
agagcagaucuuccgagcacuc

SEQ ID NO: 3268619 - RNA, 13 nt, Mycobacterium tuberculosis H37Rv
agagcagccagcc

SEQ ID NO: 3268620 - RNA, 12 nt, Mycobacterium tuberculosis H37Rv
agagcaggccca

SEQ ID NO: 3268621 - RNA, 15 nt, Mycobacterium tuberculosis H37Rv
agagcaggcccauac

SEQ ID NO: 3268622 - RNA, 18 nt, Mycobacterium tuberculosis H37Rv
agagcaugccgcccgcgc

SEQ ID NO: 3268623 - RNA, 14 nt, Mycobacterium tuberculosis H37Rv
agagccaacgcgcg

SEQ ID NO: 3268624 - RNA, 14 nt, Mycobacterium tuberculosis H37Rv
agagccccgaccag

SEQ ID NO: 3268625 - RNA, 18 nt, Mycobacterium tuberculosis H37Rv
agagccccgaccagcaga

SEQ ID NO: 3268626 - RNA, 19 nt, Mycobacterium tuberculosis H37Rv
agagccccgaccagcagac

SEQ ID NO: 3268627 - RNA, 19 nt, Mycobacterium tuberculosis H37Rv
agagccccggcaagcgcag

SEQ ID NO: 3268628 - RNA, 21 nt, Mycobacterium tuberculosis H37Rv
agagccccggcaagcgcagac

SEQ ID NO: 3268629 - RNA, 14 nt, Mycobacterium tuberculosis H37Rv
agagccgcugcggc

SEQ ID NO: 3268630 - RNA, 19 nt, Mycobacterium tuberculosis H37Rv
agagccggcggcgaccaga

SEQ ID NO: 3268631 - RNA, 14 nt, Mycobacterium tuberculosis H37Rv
agagcgucgaacac

SEQ ID NO: 3268632 - RNA, 16 nt, Mycobacterium tuberculosis H37Rv
agagcguuccgcucga

SEQ ID NO: 3268633 - RNA, 23 nt, Mycobacterium tuberculosis H37Rv
agagcuccgucgcggccgagacg

SEQ ID NO: 3268634 - RNA, 21 nt, Mycobacterium tuberculosis H37Rv
agagcucugguuuuacacacc

SEQ ID NO: 3268635 - RNA, 20 nt, Mycobacterium tuberculosis H37Rv
agagcugguccuccaaggcg

SEQ ID NO: 3268636 - RNA, 12 nt, Mycobacterium tuberculosis H37Rv
agaggacugcgg

SEQ ID NO: 3268637 - RNA, 18 nt, Mycobacterium tuberculosis H37Rv
agaggacugcggucugga

SEQ ID NO: 3268638 - RNA, 14 nt, Mycobacterium tuberculosis H37Rv
agaggauggucagc

SEQ ID NO: 3268639 - RNA, 20 nt, Mycobacterium tuberculosis H37Rv
agagggcggggcagaagucg

SEQ ID NO: 3268640 - RNA, 15 nt, Mycobacterium tuberculosis H37Rv
agagguagagcagau

SEQ ID NO: 3268641 - RNA, 21 nt, Mycobacterium tuberculosis H37Rv
agagguccuugaugcgcccca

SEQ ID NO: 3268642 - RNA, 22 nt, Mycobacterium tuberculosis H37Rv
agagguccuugaugcgccccau

SEQ ID NO: 3268643 - RNA, 14 nt, Mycobacterium tuberculosis H37Rv
agagguuggcggcc

SEQ ID NO: 3268644 - RNA, 15 nt, Mycobacterium tuberculosis H37Rv
agagucaacaucagc

SEQ ID NO: 3268645 - RNA, 18 nt, Mycobacterium tuberculosis H37Rv
agaguccuuaaacgucgu

SEQ ID NO: 3268646 - RNA, 15 nt, Mycobacterium tuberculosis H37Rv
agagucgcacugcgc

SEQ ID NO: 3268647 - RNA, 14 nt, Mycobacterium tuberculosis H37Rv
agagucgcccgcac

SEQ ID NO: 3268648 - RNA, 11 nt, Mycobacterium tuberculosis H37Rv
agagugaaucc

SEQ ID NO: 3268649 - RNA, 17 nt, Mycobacterium tuberculosis H37Rv
agagugcucagcgcgcg

SEQ ID NO: 3268650 - RNA, 23 nt, Mycobacterium tuberculosis H37Rv
agagugcucagcgcgcgccgcug

SEQ ID NO: 3268651 - RNA, 13 nt, Mycobacterium tuberculosis H37Rv
agaguucccgaaa

SEQ ID NO: 3268652 - RNA, 21 nt, Mycobacterium tuberculosis H37Rv
agaguucgcgcgccgcgacga

SEQ ID NO: 3268653 - RNA, 14 nt, Mycobacterium tuberculosis H37Rv
agauaccaccgccg

SEQ ID NO: 3268654 - RNA, 15 nt, Mycobacterium tuberculosis H37Rv
agauaccaccgccgc

SEQ ID NO: 3268655 - RNA, 17 nt, Mycobacterium tuberculosis H37Rv
agauacccgcggcagca

SEQ ID NO: 3268656 - RNA, 21 nt, Mycobacterium tuberculosis H37Rv
agauacgcguguggcagaugu

SEQ ID NO: 3268657 - RNA, 12 nt, Mycobacterium tuberculosis H37Rv
agauacggccac

SEQ ID NO: 3268658 - RNA, 13 nt, Mycobacterium tuberculosis H37Rv
agauagcgcucga

SEQ ID NO: 3268659 - RNA, 16 nt, Mycobacterium tuberculosis H37Rv
agauaguuuaguccca

SEQ ID NO: 3268660 - RNA, 12 nt, Mycobacterium tuberculosis H37Rv
agauaugcagga

SEQ ID NO: 3268661 - RNA, 19 nt, Mycobacterium tuberculosis H37Rv
agaucaacgcgucgcccgc

SEQ ID NO: 3268662 - RNA, 15 nt, Mycobacterium tuberculosis H37Rv
agaucaccgccacca

SEQ ID NO: 3268663 - RNA, 14 nt, Mycobacterium tuberculosis H37Rv
agaucaccgccagc

SEQ ID NO: 3268664 - RNA, 22 nt, Mycobacterium tuberculosis H37Rv
agaucagcaacggcagcgaggc

SEQ ID NO: 3268665 - RNA, 13 nt, Mycobacterium tuberculosis H37Rv
agaucagcaccgu

SEQ ID NO: 3268666 - RNA, 20 nt, Mycobacterium tuberculosis H37Rv
agaucagcaugguccacagc

SEQ ID NO: 3268667 - RNA, 21 nt, Mycobacterium tuberculosis H37Rv
agaucagccucgcgggcaggg

SEQ ID NO: 3268668 - RNA, 21 nt, Mycobacterium tuberculosis H37Rv
agaucaugccggcgaacucgc

SEQ ID NO: 3268669 - RNA, 17 nt, Mycobacterium tuberculosis H37Rv
agauccagggagcggcu

SEQ ID NO: 3268670 - RNA, 18 nt, Mycobacterium tuberculosis H37Rv
agauccagggagcggcug

SEQ ID NO: 3268671 - RNA, 18 nt, Mycobacterium tuberculosis H37Rv
agauccauuggaugccau

SEQ ID NO: 3268672 - RNA, 23 nt, Mycobacterium tuberculosis H37Rv
agauccauuggaugccauaggac

SEQ ID NO: 3268673 - RNA, 19 nt, Mycobacterium tuberculosis H37Rv
agaucccaccaccggugaa

SEQ ID NO: 3268674 - RNA, 17 nt, Mycobacterium tuberculosis H37Rv
agaucccaguccgaugg

SEQ ID NO: 3268675 - RNA, 15 nt, Mycobacterium tuberculosis H37Rv
agaucccggucccaa

SEQ ID NO: 3268676 - RNA, 13 nt, Mycobacterium tuberculosis H37Rv
agauccgccgggu

SEQ ID NO: 3268677 - RNA, 22 nt, Mycobacterium tuberculosis H37Rv
agauccggccaacggcacccug

SEQ ID NO: 3268678 - RNA, 18 nt, Mycobacterium tuberculosis H37Rv
agauccguccgcuggugg

SEQ ID NO: 3268679 - RNA, 20 nt, Mycobacterium tuberculosis H37Rv
agauccucgucgagguccuc

SEQ ID NO: 3268680 - RNA, 14 nt, Mycobacterium tuberculosis H37Rv
agauccuggaggug

SEQ ID NO: 3268681 - RNA, 19 nt, Mycobacterium tuberculosis H37Rv
agauccuuaucgcucucgg

SEQ ID NO: 3268682 - RNA, 24 nt, Mycobacterium tuberculosis H37Rv
agaucgacuucauagcgccggagu

SEQ ID NO: 3268683 - RNA, 19 nt, Mycobacterium tuberculosis H37Rv
agcacacgucgggaguaag

SEQ ID NO: 3268684 - RNA, 18 nt, Mycobacterium tuberculosis H37Rv
agcacacuccuagccaac

SEQ ID NO: 3268685 - RNA, 12 nt, Mycobacterium tuberculosis H37Rv
agcacagcagca

SEQ ID NO: 3268686 - RNA, 14 nt, Mycobacterium tuberculosis H37Rv
agcacagcccggcg

SEQ ID NO: 3268687 - RNA, 17 nt, Mycobacterium tuberculosis H37Rv
agcacagcccggcgacg

SEQ ID NO: 3268688 - RNA, 14 nt, Mycobacterium tuberculosis H37Rv
agcacagcccggcu

SEQ ID NO: 3268689 - RNA, 15 nt, Mycobacterium tuberculosis H37Rv
agcacauccugcagc

SEQ ID NO: 3268690 - RNA, 20 nt, Mycobacterium tuberculosis H37Rv
agcacaugcucggccugcuu

SEQ ID NO: 3268691 - RNA, 18 nt, Mycobacterium tuberculosis H37Rv
agcacaugguccaaccag

SEQ ID NO: 3268692 - RNA, 22 nt, Mycobacterium tuberculosis H37Rv
agcacauuauucuucgcggcga

SEQ ID NO: 3268693 - RNA, 16 nt, Mycobacterium tuberculosis H37Rv
agcacauucugcagcg

SEQ ID NO: 3268694 - RNA, 18 nt, Mycobacterium tuberculosis H37Rv
agcaccaaaagcccggua

SEQ ID NO: 3268695 - RNA, 17 nt, Mycobacterium tuberculosis H37Rv
agcaccaaaugccccga

SEQ ID NO: 3268696 - RNA, 20 nt, Mycobacterium tuberculosis H37Rv
agcaccaaaugccccgaacc

SEQ ID NO: 3268697 - RNA, 17 nt, Mycobacterium tuberculosis H37Rv
agcaccacaacgucggc

SEQ ID NO: 3268698 - RNA, 19 nt, Mycobacterium tuberculosis H37Rv
agcaccacaacgucggcac

SEQ ID NO: 3268699 - RNA, 14 nt, Mycobacterium tuberculosis H37Rv
agcaccaccacccg

SEQ ID NO: 3268700 - RNA, 13 nt, Mycobacterium tuberculosis H37Rv
agcaccaccccag

SEQ ID NO: 3268701 - RNA, 22 nt, Mycobacterium tuberculosis H37Rv
agcaccaccccagcggccaccg

SEQ ID NO: 3268702 - RNA, 20 nt, Mycobacterium tuberculosis H37Rv
agcaccaccggaaccaccag

SEQ ID NO: 3268703 - RNA, 14 nt, Mycobacterium tuberculosis H37Rv
agcaccacggccag

SEQ ID NO: 3268704 - RNA, 16 nt, Mycobacterium tuberculosis H37Rv
agcaccacggccagcg

SEQ ID NO: 3268705 - RNA, 19 nt, Mycobacterium tuberculosis H37Rv
agcaccagcacggcaacca

SEQ ID NO: 3268706 - RNA, 16 nt, Mycobacterium tuberculosis H37Rv
agcaccagcagcacca

SEQ ID NO: 3268707 - RNA, 20 nt, Mycobacterium tuberculosis H37Rv
agcaccagccagccugcugg

SEQ ID NO: 3268708 - RNA, 21 nt, Mycobacterium tuberculosis H37Rv
agcaccagcgucgcggccacg

SEQ ID NO: 3268709 - RNA, 20 nt, Mycobacterium tuberculosis H37Rv
agcaccaguguggcgaugac

SEQ ID NO: 3268710 - RNA, 20 nt, Mycobacterium tuberculosis H37Rv
agcaccaguuugugccgccg

SEQ ID NO: 3268711 - RNA, 17 nt, Mycobacterium tuberculosis H37Rv
agcacccaacccggcgg

SEQ ID NO: 3268712 - RNA, 22 nt, Mycobacterium tuberculosis H37Rv
agcacccaaugccaccgcggcc

SEQ ID NO: 3268713 - RNA, 19 nt, Mycobacterium tuberculosis H37Rv
agcacccacaucagccgca

SEQ ID NO: 3268714 - RNA, 13 nt, Mycobacterium tuberculosis H37Rv
agcacccacgccg

SEQ ID NO: 3268715 - RNA, 14 nt, Mycobacterium tuberculosis H37Rv
agcacccacggcga

SEQ ID NO: 3268716 - RNA, 12 nt, Mycobacterium tuberculosis H37Rv
agcacccgagcg

SEQ ID NO: 3268717 - RNA, 16 nt, Mycobacterium tuberculosis H37Rv
agcacccgcagccgcg

SEQ ID NO: 3268718 - RNA, 23 nt, Mycobacterium tuberculosis H37Rv
agcacccgcgccaguaacgccca

SEQ ID NO: 3268719 - RNA, 12 nt, Mycobacterium tuberculosis H37Rv
agcacccgcucc

SEQ ID NO: 3268720 - RNA, 23 nt, Mycobacterium tuberculosis H37Rv
agcacccgcuggucgagcagugc

SEQ ID NO: 3268721 - RNA, 19 nt, Mycobacterium tuberculosis H37Rv
agcacccggccaccggacg

SEQ ID NO: 3268722 - RNA, 23 nt, Mycobacterium tuberculosis H37Rv
agcacccgggccacgucgagcac

SEQ ID NO: 3268723 - RNA, 19 nt, Mycobacterium tuberculosis H37Rv
agcacccugaugugagucc

SEQ ID NO: 3268724 - RNA, 14 nt, Mycobacterium tuberculosis H37Rv
agcacccugcgggc

SEQ ID NO: 3268725 - RNA, 20 nt, Mycobacterium tuberculosis H37Rv
agcacccuguuccagcgggu

SEQ ID NO: 3268726 - RNA, 19 nt, Mycobacterium tuberculosis H37Rv
agcaccgaacccgccaccg

SEQ ID NO: 3268727 - RNA, 14 nt, Mycobacterium tuberculosis H37Rv
agcaccgacaccgg

SEQ ID NO: 3268728 - RNA, 15 nt, Mycobacterium tuberculosis H37Rv
agcaccgacagcccg

SEQ ID NO: 3268729 - RNA, 14 nt, Mycobacterium tuberculosis H37Rv
agcaccgacgugau

SEQ ID NO: 3268730 - RNA, 19 nt, Mycobacterium tuberculosis H37Rv
agcaccgacgugaugguga

SEQ ID NO: 3268731 - RNA, 21 nt, Mycobacterium tuberculosis H37Rv
agcaccgccgcgccggcggcc

SEQ ID NO: 3268732 - RNA, 16 nt, Mycobacterium tuberculosis H37Rv
agcaccgccgcugcca

SEQ ID NO: 3268733 - RNA, 12 nt, Mycobacterium tuberculosis H37Rv
agcaccgccggu

SEQ ID NO: 3268734 - RNA, 18 nt, Mycobacterium tuberculosis H37Rv
agcaccgccggugcggcc

SEQ ID NO: 3268735 - RNA, 13 nt, Mycobacterium tuberculosis H37Rv
agcaccgcgccga

SEQ ID NO: 3268736 - RNA, 22 nt, Mycobacterium tuberculosis H37Rv
agcaccgcuacgaccaauagca

SEQ ID NO: 3268737 - RNA, 22 nt, Mycobacterium tuberculosis H37Rv
agcaccgcucgguccagccggu

SEQ ID NO: 3268738 - RNA, 19 nt, Mycobacterium tuberculosis H37Rv
agcaccggaucgaccaauu

SEQ ID NO: 3268739 - RNA, 15 nt, Mycobacterium tuberculosis H37Rv
agcaccgggaagucg

SEQ ID NO: 3268740 - RNA, 20 nt, Mycobacterium tuberculosis H37Rv
agcaccgucggcaccagcag

SEQ ID NO: 3268741 - RNA, 22 nt, Mycobacterium tuberculosis H37Rv
agcaccgucgggcccagccgga

SEQ ID NO: 3268742 - RNA, 14 nt, Mycobacterium tuberculosis H37Rv
agcaccgugacagc

SEQ ID NO: 3268743 - RNA, 16 nt, Mycobacterium tuberculosis H37Rv
agcaccgugacccuga

SEQ ID NO: 3268744 - RNA, 17 nt, Mycobacterium tuberculosis H37Rv
agcaccuagucgcggcc

SEQ ID NO: 3268745 - RNA, 13 nt, Mycobacterium tuberculosis H37Rv
agcaccugcaccg

SEQ ID NO: 3268746 - RNA, 21 nt, Mycobacterium tuberculosis H37Rv
agcaccugccgaucgggcuca

SEQ ID NO: 3268747 - RNA, 23 nt, Mycobacterium tuberculosis H37Rv
agcacgaaagucaaucgcgucau

SEQ ID NO: 3268748 - RNA, 17 nt, Mycobacterium tuberculosis H37Rv
agcacgacgacaaccgg

SEQ ID NO: 3268749 - RNA, 18 nt, Mycobacterium tuberculosis H37Rv
agcacgaugucgaugccg

SEQ ID NO: 3268750 - RNA, 13 nt, Mycobacterium tuberculosis H37Rv
agcacgcccucga

SEQ ID NO: 3268751 - RNA, 15 nt, Mycobacterium tuberculosis H37Rv
agcacgcccucgacg

SEQ ID NO: 3268752 - RNA, 16 nt, Mycobacterium tuberculosis H37Rv
agcacgcccucgacgc

SEQ ID NO: 3268753 - RNA, 15 nt, Mycobacterium tuberculosis H37Rv
agcacgcgcggcguc

SEQ ID NO: 3268754 - RNA, 16 nt, Mycobacterium tuberculosis H37Rv
agcacgcgggcacugg

SEQ ID NO: 3268755 - RNA, 13 nt, Mycobacterium tuberculosis H37Rv
agcacgcugacca

SEQ ID NO: 3268756 - RNA, 18 nt, Mycobacterium tuberculosis H37Rv
agcacgcugaccacaacc

SEQ ID NO: 3268757 - RNA, 18 nt, Mycobacterium tuberculosis H37Rv
agcacggcgauccccgac

SEQ ID NO: 3268758 - RNA, 19 nt, Mycobacterium tuberculosis H37Rv
agcacggcgauccccgacg

SEQ ID NO: 3268759 - RNA, 20 nt, Mycobacterium tuberculosis H37Rv
agcacggcgccgccacggau

SEQ ID NO: 3268760 - RNA, 22 nt, Mycobacterium tuberculosis H37Rv
agcacggcgcggcggagugcau

SEQ ID NO: 3268761 - RNA, 16 nt, Mycobacterium tuberculosis H37Rv
agcacggcggccacgu

SEQ ID NO: 3268762 - RNA, 15 nt, Mycobacterium tuberculosis H37Rv
agcacggcuucgacc

SEQ ID NO: 3268763 - RNA, 22 nt, Mycobacterium tuberculosis H37Rv
agcacgggacuucgugccucgg

SEQ ID NO: 3268764 - RNA, 14 nt, Mycobacterium tuberculosis H37Rv
agcacgggcacgau

SEQ ID NO: 3268765 - RNA, 17 nt, Mycobacterium tuberculosis H37Rv
agcacggguagcgucca

SEQ ID NO: 3268766 - RNA, 15 nt, Mycobacterium tuberculosis H37Rv
agcacgggugagcac

SEQ ID NO: 3268767 - RNA, 15 nt, Mycobacterium tuberculosis H37Rv
agcacggugagccgg

SEQ ID NO: 3268768 - RNA, 19 nt, Mycobacterium tuberculosis H37Rv
agcacggugaucagcagca

SEQ ID NO: 3268769 - RNA, 21 nt, Mycobacterium tuberculosis H37Rv
agcacggugggcgcugggucg

SEQ ID NO: 3268770 - RNA, 23 nt, Mycobacterium tuberculosis H37Rv
agcacgguguugcgcacccgcgg

SEQ ID NO: 3268771 - RNA, 18 nt, Mycobacterium tuberculosis H37Rv
agcacguaacgccgcuca

SEQ ID NO: 3268772 - RNA, 13 nt, Mycobacterium tuberculosis H37Rv
agcacguccucga

SEQ ID NO: 3268773 - RNA, 16 nt, Mycobacterium tuberculosis H37Rv
agcacgucgcggccgu

SEQ ID NO: 3268774 - RNA, 19 nt, Mycobacterium tuberculosis H37Rv
agcacgucuugcugcacgc

SEQ ID NO: 3268775 - RNA, 17 nt, Mycobacterium tuberculosis H37Rv
agcacguggaccggcac

SEQ ID NO: 3268776 - RNA, 14 nt, Mycobacterium tuberculosis H37Rv
agcacguugcacag

SEQ ID NO: 3268777 - RNA, 15 nt, Mycobacterium tuberculosis H37Rv
agcacguugcacagc

SEQ ID NO: 3268778 - RNA, 16 nt, Mycobacterium tuberculosis H37Rv
agcacguugcacagcu

SEQ ID NO: 3268779 - RNA, 16 nt, Mycobacterium tuberculosis H37Rv
agcaggccgggacagc

SEQ ID NO: 3268780 - RNA, 15 nt, Mycobacterium tuberculosis H37Rv
agcaggcgagugaag

SEQ ID NO: 3268781 - RNA, 21 nt, Mycobacterium tuberculosis H37Rv
agcaggcgggggaucucgagc

SEQ ID NO: 3268782 - RNA, 16 nt, Mycobacterium tuberculosis H37Rv
agcagggauucuggau

SEQ ID NO: 3268783 - RNA, 13 nt, Mycobacterium tuberculosis H37Rv
agcagggccacca

SEQ ID NO: 3268784 - RNA, 20 nt, Mycobacterium tuberculosis H37Rv
agcagggccaccaccacggc

SEQ ID NO: 3268785 - RNA, 16 nt, Mycobacterium tuberculosis H37Rv
agcagggcggcgaacu

SEQ ID NO: 3268786 - RNA, 21 nt, Mycobacterium tuberculosis H37Rv
agcagggcggcguuaccaccg

SEQ ID NO: 3268787 - RNA, 21 nt, Mycobacterium tuberculosis H37Rv
agcaggggacgaccaugccga

SEQ ID NO: 3268788 - RNA, 18 nt, Mycobacterium tuberculosis H37Rv
agcaggggacgggcggcc

SEQ ID NO: 3268789 - RNA, 17 nt, Mycobacterium tuberculosis H37Rv
agcagggugugcgucug

SEQ ID NO: 3268790 - RNA, 14 nt, Mycobacterium tuberculosis H37Rv
agcagguacucgcc

SEQ ID NO: 3268791 - RNA, 15 nt, Mycobacterium tuberculosis H37Rv
agcagguccgccacc

SEQ ID NO: 3268792 - RNA, 15 nt, Mycobacterium tuberculosis H37Rv
agcaggucgccugcc

SEQ ID NO: 3268793 - RNA, 19 nt, Mycobacterium tuberculosis H37Rv
agcaggucgccugcccccg

SEQ ID NO: 3268794 - RNA, 23 nt, Mycobacterium tuberculosis H37Rv
agcagguuccacggccaggucga

SEQ ID NO: 3268795 - RNA, 23 nt, Mycobacterium tuberculosis H37Rv
agcagguuccgcacgaucaggga

SEQ ID NO: 3268796 - RNA, 15 nt, Mycobacterium tuberculosis H37Rv
agcagguuggucacc

SEQ ID NO: 3268797 - RNA, 17 nt, Mycobacterium tuberculosis H37Rv
agcaguacaccgcccgg

SEQ ID NO: 3268798 - RNA, 14 nt, Mycobacterium tuberculosis H37Rv
agcaguccacgagc

SEQ ID NO: 3268799 - RNA, 16 nt, Mycobacterium tuberculosis H37Rv
agcagugccucggcga

SEQ ID NO: 3268800 - RNA, 23 nt, Mycobacterium tuberculosis H37Rv
agcagugcgguaaagaucuuguc

SEQ ID NO: 3268801 - RNA, 16 nt, Mycobacterium tuberculosis H37Rv
agcaguggaguauccg

SEQ ID NO: 3268802 - RNA, 23 nt, Mycobacterium tuberculosis H37Rv
agcaguucggcgaugcgcgggug

SEQ ID NO: 3268803 - RNA, 18 nt, Mycobacterium tuberculosis H37Rv
agcauaccgccgcugcca

SEQ ID NO: 3268804 - RNA, 17 nt, Mycobacterium tuberculosis H37Rv
agcauauccgccggcga

SEQ ID NO: 3268805 - RNA, 19 nt, Mycobacterium tuberculosis H37Rv
agcauauccgccggcgaca

SEQ ID NO: 3268806 - RNA, 14 nt, Mycobacterium tuberculosis H37Rv
agcaucaaagcggu

SEQ ID NO: 3268807 - RNA, 20 nt, Mycobacterium tuberculosis H37Rv
agcaucaacgaaccagcuug

SEQ ID NO: 3268808 - RNA, 18 nt, Mycobacterium tuberculosis H37Rv
agcaucaccguaaagccg

SEQ ID NO: 3268809 - RNA, 15 nt, Mycobacterium tuberculosis H37Rv
agcaucacgaucacg

SEQ ID NO: 3268810 - RNA, 14 nt, Mycobacterium tuberculosis H37Rv
agcaucacgcccac

SEQ ID NO: 3268811 - RNA, 17 nt, Mycobacterium tuberculosis H37Rv
agcaucacgcccacgau

SEQ ID NO: 3268812 - RNA, 13 nt, Mycobacterium tuberculosis H37Rv
agcaucagcgcca

SEQ ID NO: 3268813 - RNA, 20 nt, Mycobacterium tuberculosis H37Rv
agcaucagcucgaugccgug

SEQ ID NO: 3268814 - RNA, 19 nt, Mycobacterium tuberculosis H37Rv
agcauccccgcagcgucca

SEQ ID NO: 3268815 - RNA, 21 nt, Mycobacterium tuberculosis H37Rv
agcauccgcccgagccgggga

SEQ ID NO: 3268816 - RNA, 16 nt, Mycobacterium tuberculosis H37Rv
agcauccggccgucau

SEQ ID NO: 3268817 - RNA, 20 nt, Mycobacterium tuberculosis H37Rv
agcauccucgacuugcuugg

SEQ ID NO: 3268818 - RNA, 21 nt, Mycobacterium tuberculosis H37Rv
agcaucggcaccccggccacu

SEQ ID NO: 3268819 - RNA, 16 nt, Mycobacterium tuberculosis H37Rv
agcaucggcagcagcg

SEQ ID NO: 3268820 - RNA, 22 nt, Mycobacterium tuberculosis H37Rv
agcaucguggccgcaccuccgc

SEQ ID NO: 3268821 - RNA, 21 nt, Mycobacterium tuberculosis H37Rv
agcaucuccgucggccaggcc

SEQ ID NO: 3268822 - RNA, 14 nt, Mycobacterium tuberculosis H37Rv
agcaugaagucccg

SEQ ID NO: 3268823 - RNA, 19 nt, Mycobacterium tuberculosis H37Rv
agcaugacaccggccacca

SEQ ID NO: 3268824 - RNA, 16 nt, Mycobacterium tuberculosis H37Rv
agcauggcccuggcga

SEQ ID NO: 3268825 - RNA, 21 nt, Mycobacterium tuberculosis H37Rv
agcauggcuuuugcgccgaau

SEQ ID NO: 3268826 - RNA, 17 nt, Mycobacterium tuberculosis H37Rv
agcaugucgacggucag

SEQ ID NO: 3268827 - RNA, 20 nt, Mycobacterium tuberculosis H37Rv
agcauguggccgccgucgac

SEQ ID NO: 3268828 - RNA, 16 nt, Mycobacterium tuberculosis H37Rv
agcauugaccaaucca

SEQ ID NO: 3268829 - RNA, 19 nt, Mycobacterium tuberculosis H37Rv
agcauugaguucggccacc

SEQ ID NO: 3268830 - RNA, 18 nt, Mycobacterium tuberculosis H37Rv
agccaaacuacccgccca

SEQ ID NO: 3268831 - RNA, 23 nt, Mycobacterium tuberculosis H37Rv
agccaaaugcgcugucgcccucg

SEQ ID NO: 3268832 - RNA, 18 nt, Mycobacterium tuberculosis H37Rv
agccaacaagucgauggc

SEQ ID NO: 3268833 - RNA, 13 nt, Mycobacterium tuberculosis H37Rv
agccaacgagcgc

SEQ ID NO: 3268834 - RNA, 15 nt, Mycobacterium tuberculosis H37Rv
agccaacgagcgcgc

SEQ ID NO: 3268835 - RNA, 15 nt, Mycobacterium tuberculosis H37Rv
agccaacgcaucaug

SEQ ID NO: 3268836 - RNA, 14 nt, Mycobacterium tuberculosis H37Rv
agccaagaaucacg

SEQ ID NO: 3268837 - RNA, 15 nt, Mycobacterium tuberculosis H37Rv
agccaagcgacucgc

SEQ ID NO: 3268838 - RNA, 14 nt, Mycobacterium tuberculosis H37Rv
agccaagcgagcgg

SEQ ID NO: 3268839 - RNA, 20 nt, Mycobacterium tuberculosis H37Rv
agccaaugcccuuggccagc

SEQ ID NO: 3268840 - RNA, 23 nt, Mycobacterium tuberculosis H37Rv
agccaaugcccuuggccagcagg

SEQ ID NO: 3268841 - RNA, 16 nt, Mycobacterium tuberculosis H37Rv
agccacagggaagcaa

SEQ ID NO: 3268842 - RNA, 20 nt, Mycobacterium tuberculosis H37Rv
agccacauacaggcccgcca

SEQ ID NO: 3268843 - RNA, 22 nt, Mycobacterium tuberculosis H37Rv
agccaccgaucgacugcagccc

SEQ ID NO: 3268844 - RNA, 22 nt, Mycobacterium tuberculosis H37Rv
agccaccgcgcgucauaacgcu

SEQ ID NO: 3268845 - RNA, 21 nt, Mycobacterium tuberculosis H37Rv
agccaccgucaugccgacgac

SEQ ID NO: 3268846 - RNA, 18 nt, Mycobacterium tuberculosis H37Rv
agccaccugacaaacggc

SEQ ID NO: 3268847 - RNA, 22 nt, Mycobacterium tuberculosis H37Rv
agccaccugccgacucaucggc

SEQ ID NO: 3268848 - RNA, 23 nt, Mycobacterium tuberculosis H37Rv
agccaccugccgacucaucggcc

SEQ ID NO: 3268849 - RNA, 21 nt, Mycobacterium tuberculosis H37Rv
agccacgcaaaguucgucacc

SEQ ID NO: 3268850 - RNA, 23 nt, Mycobacterium tuberculosis H37Rv
agccacgcaaaguucgucaccac

SEQ ID NO: 3268851 - RNA, 21 nt, Mycobacterium tuberculosis H37Rv
agccacgcacaauacggucag

SEQ ID NO: 3268852 - RNA, 12 nt, Mycobacterium tuberculosis H37Rv
agccacgcaugg

SEQ ID NO: 3268853 - RNA, 22 nt, Mycobacterium tuberculosis H37Rv
agccacgcaugggccaggucag

SEQ ID NO: 3268854 - RNA, 18 nt, Mycobacterium tuberculosis H37Rv
agccacgccagcgucgac

SEQ ID NO: 3268855 - RNA, 16 nt, Mycobacterium tuberculosis H37Rv
agccacgcugucccgc

SEQ ID NO: 3268856 - RNA, 14 nt, Mycobacterium tuberculosis H37Rv
agccacggcacugg

SEQ ID NO: 3268857 - RNA, 23 nt, Mycobacterium tuberculosis H37Rv
agccacggcuucgccgcgggaca

SEQ ID NO: 3268858 - RNA, 22 nt, Mycobacterium tuberculosis H37Rv
agccacucaucuucucgcagcc

SEQ ID NO: 3268859 - RNA, 13 nt, Mycobacterium tuberculosis H37Rv
agccacuccucgg

SEQ ID NO: 3268860 - RNA, 14 nt, Mycobacterium tuberculosis H37Rv
agccacucggcccg

SEQ ID NO: 3268861 - RNA, 16 nt, Mycobacterium tuberculosis H37Rv
agccagauccgucagc

SEQ ID NO: 3268862 - RNA, 22 nt, Mycobacterium tuberculosis H37Rv
agccagaucuccccgaccgcgc

SEQ ID NO: 3268863 - RNA, 15 nt, Mycobacterium tuberculosis H37Rv
agccagaugccggua

SEQ ID NO: 3268864 - RNA, 20 nt, Mycobacterium tuberculosis H37Rv
agccagcacugccaucgcgg

SEQ ID NO: 3268865 - RNA, 13 nt, Mycobacterium tuberculosis H37Rv
agccagcagcaca

SEQ ID NO: 3268866 - RNA, 16 nt, Mycobacterium tuberculosis H37Rv
agccagcaucggcagc

SEQ ID NO: 3268867 - RNA, 20 nt, Mycobacterium tuberculosis H37Rv
agccagcaucggcagcagcg

SEQ ID NO: 3268868 - RNA, 18 nt, Mycobacterium tuberculosis H37Rv
agccagccaccgaucgac

SEQ ID NO: 3268869 - RNA, 13 nt, Mycobacterium tuberculosis H37Rv
agccagccugcug

SEQ ID NO: 3268870 - RNA, 15 nt, Mycobacterium tuberculosis H37Rv
agccagccugcuggc

SEQ ID NO: 3268871 - RNA, 23 nt, Mycobacterium tuberculosis H37Rv
agccagccugcuggccgcggccu

SEQ ID NO: 3268872 - RNA, 13 nt, Mycobacterium tuberculosis H37Rv
agccagcgcagcc

SEQ ID NO: 3268873 - RNA, 14 nt, Mycobacterium tuberculosis H37Rv
agccagcggcgaag

SEQ ID NO: 3268874 - RNA, 18 nt, Mycobacterium tuberculosis H37Rv
agccagcggcugcccauc

SEQ ID NO: 3268875 - RNA, 17 nt, Mycobacterium tuberculosis H37Rv
agcccgggccugaacca

SEQ ID NO: 3268876 - RNA, 12 nt, Mycobacterium tuberculosis H37Rv
agcccggggaga

SEQ ID NO: 3268877 - RNA, 22 nt, Mycobacterium tuberculosis H37Rv
agcccgggugaaacgauggcga

SEQ ID NO: 3268878 - RNA, 18 nt, Mycobacterium tuberculosis H37Rv
agcccgguacgccgcgcc

SEQ ID NO: 3268879 - RNA, 18 nt, Mycobacterium tuberculosis H37Rv
agcccggucgcucgacga

SEQ ID NO: 3268880 - RNA, 19 nt, Mycobacterium tuberculosis H37Rv
agcccggugcuaccggcuu

SEQ ID NO: 3268881 - RNA, 22 nt, Mycobacterium tuberculosis H37Rv
agcccguccaggcgcugcagca

SEQ ID NO: 3268882 - RNA, 16 nt, Mycobacterium tuberculosis H37Rv
agcccguccggccccc

SEQ ID NO: 3268883 - RNA, 13 nt, Mycobacterium tuberculosis H37Rv
agcccgucgauca

SEQ ID NO: 3268884 - RNA, 17 nt, Mycobacterium tuberculosis H37Rv
agcccgucgucgugcac

SEQ ID NO: 3268885 - RNA, 17 nt, Mycobacterium tuberculosis H37Rv
agcccguugaccugcgc

SEQ ID NO: 3268886 - RNA, 15 nt, Mycobacterium tuberculosis H37Rv
agcccguugggcucu

SEQ ID NO: 3268887 - RNA, 19 nt, Mycobacterium tuberculosis H37Rv
agcccguugguagccggug

SEQ ID NO: 3268888 - RNA, 21 nt, Mycobacterium tuberculosis H37Rv
agcccguuguccagaacggcg

SEQ ID NO: 3268889 - RNA, 14 nt, Mycobacterium tuberculosis H37Rv
agcccugcgcagcc

SEQ ID NO: 3268890 - RNA, 23 nt, Mycobacterium tuberculosis H37Rv
agcccugcgccucggcggccagc

SEQ ID NO: 3268891 - RNA, 19 nt, Mycobacterium tuberculosis H37Rv
agcccuucagcgaagccgg

SEQ ID NO: 3268892 - RNA, 13 nt, Mycobacterium tuberculosis H37Rv
agccgaacaccgu

SEQ ID NO: 3268893 - RNA, 14 nt, Mycobacterium tuberculosis H37Rv
agccgaacccaagg

SEQ ID NO: 3268894 - RNA, 17 nt, Mycobacterium tuberculosis H37Rv
agccgaacccgccguca

SEQ ID NO: 3268895 - RNA, 14 nt, Mycobacterium tuberculosis H37Rv
agccgaacgacagc

SEQ ID NO: 3268896 - RNA, 15 nt, Mycobacterium tuberculosis H37Rv
agccgaagaaccggu

SEQ ID NO: 3268897 - RNA, 18 nt, Mycobacterium tuberculosis H37Rv
agccgaagaaccggucgc

SEQ ID NO: 3268898 - RNA, 23 nt, Mycobacterium tuberculosis H37Rv
agccgaagaugcacaggccgacg

SEQ ID NO: 3268899 - RNA, 17 nt, Mycobacterium tuberculosis H37Rv
agccgaaggggaacgcg

SEQ ID NO: 3268900 - RNA, 12 nt, Mycobacterium tuberculosis H37Rv
agccgaccagcg

SEQ ID NO: 3268901 - RNA, 13 nt, Mycobacterium tuberculosis H37Rv
agccgaccaggac

SEQ ID NO: 3268902 - RNA, 18 nt, Mycobacterium tuberculosis H37Rv
agccgaccaggaccaccg

SEQ ID NO: 3268903 - RNA, 20 nt, Mycobacterium tuberculosis H37Rv
agccgaccaggaccaccgca

SEQ ID NO: 3268904 - RNA, 12 nt, Mycobacterium tuberculosis H37Rv
agccgaccgcgg

SEQ ID NO: 3268905 - RNA, 16 nt, Mycobacterium tuberculosis H37Rv
agccgaccucacggca

SEQ ID NO: 3268906 - RNA, 20 nt, Mycobacterium tuberculosis H37Rv
agccgaccucgagugcgaac

SEQ ID NO: 3268907 - RNA, 16 nt, Mycobacterium tuberculosis H37Rv
agccgacgaccagcag

SEQ ID NO: 3268908 - RNA, 17 nt, Mycobacterium tuberculosis H37Rv
agccgacgaccagcaga

SEQ ID NO: 3268909 - RNA, 18 nt, Mycobacterium tuberculosis H37Rv
agccgacgauccacggcg

SEQ ID NO: 3268910 - RNA, 16 nt, Mycobacterium tuberculosis H37Rv
agccgacgccuuccag

SEQ ID NO: 3268911 - RNA, 12 nt, Mycobacterium tuberculosis H37Rv
agccgacgucgc

SEQ ID NO: 3268912 - RNA, 17 nt, Mycobacterium tuberculosis H37Rv
agccgacuucgucaacc

SEQ ID NO: 3268913 - RNA, 15 nt, Mycobacterium tuberculosis H37Rv
agccgagccaguccu

SEQ ID NO: 3268914 - RNA, 16 nt, Mycobacterium tuberculosis H37Rv
agccgagcgcccgcaa

SEQ ID NO: 3268915 - RNA, 12 nt, Mycobacterium tuberculosis H37Rv
agccgagcggcg

SEQ ID NO: 3268916 - RNA, 17 nt, Mycobacterium tuberculosis H37Rv
agccgagcggcggcacu

SEQ ID NO: 3268917 - RNA, 13 nt, Mycobacterium tuberculosis H37Rv
agccgagcguggc

SEQ ID NO: 3268918 - RNA, 17 nt, Mycobacterium tuberculosis H37Rv
agccgagcuccuccacc

SEQ ID NO: 3268919 - RNA, 12 nt, Mycobacterium tuberculosis H37Rv
agccgagcucgu

SEQ ID NO: 3268920 - RNA, 14 nt, Mycobacterium tuberculosis H37Rv
agccgagcuugagc

SEQ ID NO: 3268921 - RNA, 19 nt, Mycobacterium tuberculosis H37Rv
agccgaggugcugcacacu

SEQ ID NO: 3268922 - RNA, 20 nt, Mycobacterium tuberculosis H37Rv
agccgagguucaaagcagcg

SEQ ID NO: 3268923 - RNA, 22 nt, Mycobacterium tuberculosis H37Rv
agccgagguucaaagcagcgca

SEQ ID NO: 3268924 - RNA, 17 nt, Mycobacterium tuberculosis H37Rv
agccgauauaccagggc

SEQ ID NO: 3268925 - RNA, 19 nt, Mycobacterium tuberculosis H37Rv
agccgauauuggcaucgug

SEQ ID NO: 3268926 - RNA, 16 nt, Mycobacterium tuberculosis H37Rv
agccgaucaucaccgg

SEQ ID NO: 3268927 - RNA, 18 nt, Mycobacterium tuberculosis H37Rv
agccgaucaucaccggca

SEQ ID NO: 3268928 - RNA, 14 nt, Mycobacterium tuberculosis H37Rv
agccgauccagcag

SEQ ID NO: 3268929 - RNA, 17 nt, Mycobacterium tuberculosis H37Rv
agccgauccagcaggcc

SEQ ID NO: 3268930 - RNA, 14 nt, Mycobacterium tuberculosis H37Rv
agccgaucgagcag

SEQ ID NO: 3268931 - RNA, 15 nt, Mycobacterium tuberculosis H37Rv
agccgaucgcccgcu

SEQ ID NO: 3268932 - RNA, 23 nt, Mycobacterium tuberculosis H37Rv
agccgaucggugccagaaugccg

SEQ ID NO: 3268933 - RNA, 20 nt, Mycobacterium tuberculosis H37Rv
agccgaucgucucggccacg

SEQ ID NO: 3268934 - RNA, 22 nt, Mycobacterium tuberculosis H37Rv
agccgaugauaauuccagcacc

SEQ ID NO: 3268935 - RNA, 16 nt, Mycobacterium tuberculosis H37Rv
agccgaugaucgaaca

SEQ ID NO: 3268936 - RNA, 18 nt, Mycobacterium tuberculosis H37Rv
agccgaugaucgaacacg

SEQ ID NO: 3268937 - RNA, 22 nt, Mycobacterium tuberculosis H37Rv
agccgaugaucgaacacggcac

SEQ ID NO: 3268938 - RNA, 21 nt, Mycobacterium tuberculosis H37Rv
agccgauguccgacgccaccg

SEQ ID NO: 3268939 - RNA, 21 nt, Mycobacterium tuberculosis H37Rv
agccgauuuuuccacaccagc

SEQ ID NO: 3268940 - RNA, 14 nt, Mycobacterium tuberculosis H37Rv
agccgcacagcaug

SEQ ID NO: 3268941 - RNA, 18 nt, Mycobacterium tuberculosis H37Rv
agccgcaccaguggcgcc

SEQ ID NO: 3268942 - RNA, 12 nt, Mycobacterium tuberculosis H37Rv
agccgcaccccg

SEQ ID NO: 3268943 - RNA, 15 nt, Mycobacterium tuberculosis H37Rv
agccgcaccccgccc

SEQ ID NO: 3268944 - RNA, 12 nt, Mycobacterium tuberculosis H37Rv
agccgcaccgcu

SEQ ID NO: 3268945 - RNA, 15 nt, Mycobacterium tuberculosis H37Rv
agccgcaccgcuguu

SEQ ID NO: 3268946 - RNA, 14 nt, Mycobacterium tuberculosis H37Rv
agccgcacgaugcc

SEQ ID NO: 3268947 - RNA, 20 nt, Mycobacterium tuberculosis H37Rv
agccgcacgaugccgggaac

SEQ ID NO: 3268948 - RNA, 19 nt, Mycobacterium tuberculosis H37Rv
agccgcacgguugccguca

SEQ ID NO: 3268949 - RNA, 17 nt, Mycobacterium tuberculosis H37Rv
agccgcagaugcaccug

SEQ ID NO: 3268950 - RNA, 18 nt, Mycobacterium tuberculosis H37Rv
agccgcagaugcaccugc

SEQ ID NO: 3268951 - RNA, 14 nt, Mycobacterium tuberculosis H37Rv
agccgcagcaccuc

SEQ ID NO: 3268952 - RNA, 22 nt, Mycobacterium tuberculosis H37Rv
agccgcagcggccugaccggcu

SEQ ID NO: 3268953 - RNA, 16 nt, Mycobacterium tuberculosis H37Rv
agccgcagcugagccg

SEQ ID NO: 3268954 - RNA, 20 nt, Mycobacterium tuberculosis H37Rv
agccgcauaggccccgccag

SEQ ID NO: 3268955 - RNA, 21 nt, Mycobacterium tuberculosis H37Rv
agccgcauaggccccgccagc

SEQ ID NO: 3268956 - RNA, 11 nt, Mycobacterium tuberculosis H37Rv
agccgccaccg

SEQ ID NO: 3268957 - RNA, 18 nt, Mycobacterium tuberculosis H37Rv
agccgccaccgaggccgc

SEQ ID NO: 3268958 - RNA, 22 nt, Mycobacterium tuberculosis H37Rv
agccgccaccguacgacagucg

SEQ ID NO: 3268959 - RNA, 21 nt, Mycobacterium tuberculosis H37Rv
agccgccauugagcucccgca

SEQ ID NO: 3268960 - RNA, 17 nt, Mycobacterium tuberculosis H37Rv
agccgcccaagccgccg

SEQ ID NO: 3268961 - RNA, 18 nt, Mycobacterium tuberculosis H37Rv
agccgcccaagccgccgg

SEQ ID NO: 3268962 - RNA, 15 nt, Mycobacterium tuberculosis H37Rv
agccgcccgcccacc

SEQ ID NO: 3268963 - RNA, 17 nt, Mycobacterium tuberculosis H37Rv
agccgcccgcccaccuc

SEQ ID NO: 3268964 - RNA, 15 nt, Mycobacterium tuberculosis H37Rv
agccgcccgcccgga

SEQ ID NO: 3268965 - RNA, 16 nt, Mycobacterium tuberculosis H37Rv
agccgcccucccuggg

SEQ ID NO: 3268966 - RNA, 17 nt, Mycobacterium tuberculosis H37Rv
agccgccgacucggcac

SEQ ID NO: 3268967 - RNA, 15 nt, Mycobacterium tuberculosis H37Rv
agccgccgccggcaa

SEQ ID NO: 3268968 - RNA, 22 nt, Mycobacterium tuberculosis H37Rv
agccgccgcgaccaaaccgcug

SEQ ID NO: 3268969 - RNA, 16 nt, Mycobacterium tuberculosis H37Rv
agccgccggccccgcc

SEQ ID NO: 3268970 - RNA, 17 nt, Mycobacterium tuberculosis H37Rv
agccgccgggugcgccg

SEQ ID NO: 3268971 - RNA, 13 nt, Mycobacterium tuberculosis H37Rv
agccgccgucgcc

SEQ ID NO: 3268972 - RNA, 16 nt, Mycobacterium tuberculosis H37Rv
agccggugggugacgu

SEQ ID NO: 3268973 - RNA, 17 nt, Mycobacterium tuberculosis H37Rv
agccgguugucgcagcg

SEQ ID NO: 3268974 - RNA, 21 nt, Mycobacterium tuberculosis H37Rv
agccguagaccaggcccaggu

SEQ ID NO: 3268975 - RNA, 19 nt, Mycobacterium tuberculosis H37Rv
agccguagccgccguggau

SEQ ID NO: 3268976 - RNA, 16 nt, Mycobacterium tuberculosis H37Rv
agccguaguaguggcc

SEQ ID NO: 3268977 - RNA, 18 nt, Mycobacterium tuberculosis H37Rv
agccguagugucggcguc

SEQ ID NO: 3268978 - RNA, 20 nt, Mycobacterium tuberculosis H37Rv
agccgucaccgcgaccccug

SEQ ID NO: 3268979 - RNA, 15 nt, Mycobacterium tuberculosis H37Rv
agccguccaauuccg

SEQ ID NO: 3268980 - RNA, 19 nt, Mycobacterium tuberculosis H37Rv
agccguccaauuccgcaga

SEQ ID NO: 3268981 - RNA, 18 nt, Mycobacterium tuberculosis H37Rv
agccguccgaccagggau

SEQ ID NO: 3268982 - RNA, 17 nt, Mycobacterium tuberculosis H37Rv
agccgucgccaccagag

SEQ ID NO: 3268983 - RNA, 20 nt, Mycobacterium tuberculosis H37Rv
agccgugauauccguacagu

SEQ ID NO: 3268984 - RNA, 14 nt, Mycobacterium tuberculosis H37Rv
agccgugcagcucg

SEQ ID NO: 3268985 - RNA, 20 nt, Mycobacterium tuberculosis H37Rv
agccgugcagcucggucagc

SEQ ID NO: 3268986 - RNA, 17 nt, Mycobacterium tuberculosis H37Rv
agccgugccgccagcaa

SEQ ID NO: 3268987 - RNA, 14 nt, Mycobacterium tuberculosis H37Rv
agccgugccguggu

SEQ ID NO: 3268988 - RNA, 16 nt, Mycobacterium tuberculosis H37Rv
agccgugccgugguga

SEQ ID NO: 3268989 - RNA, 18 nt, Mycobacterium tuberculosis H37Rv
agccgugccguggugaaa

SEQ ID NO: 3268990 - RNA, 15 nt, Mycobacterium tuberculosis H37Rv
agccgugccucgagg

SEQ ID NO: 3268991 - RNA, 12 nt, Mycobacterium tuberculosis H37Rv
agccguggcggc

SEQ ID NO: 3268992 - RNA, 18 nt, Mycobacterium tuberculosis H37Rv
agccgugggccacgauga

SEQ ID NO: 3268993 - RNA, 16 nt, Mycobacterium tuberculosis H37Rv
agccguguucgaccgc

SEQ ID NO: 3268994 - RNA, 15 nt, Mycobacterium tuberculosis H37Rv
agccguucccgguga

SEQ ID NO: 3268995 - RNA, 14 nt, Mycobacterium tuberculosis H37Rv
agccguucgcagcu

SEQ ID NO: 3268996 - RNA, 17 nt, Mycobacterium tuberculosis H37Rv
agccguucggcaucugg

SEQ ID NO: 3268997 - RNA, 12 nt, Mycobacterium tuberculosis H37Rv
agccguucgucg

SEQ ID NO: 3268998 - RNA, 23 nt, Mycobacterium tuberculosis H37Rv
agccguugccgccacgggcggcc

SEQ ID NO: 3268999 - RNA, 19 nt, Mycobacterium tuberculosis H37Rv
agccuaaaaccccgagccg

SEQ ID NO: 3269000 - RNA, 17 nt, Mycobacterium tuberculosis H37Rv
agccuaguacgccgagc

SEQ ID NO: 3269001 - RNA, 19 nt, Mycobacterium tuberculosis H37Rv
agccuaguacgccgagcag

SEQ ID NO: 3269002 - RNA, 13 nt, Mycobacterium tuberculosis H37Rv
agccucagccgcu

SEQ ID NO: 3269003 - RNA, 14 nt, Mycobacterium tuberculosis H37Rv
agccucagccgcuc

SEQ ID NO: 3269004 - RNA, 16 nt, Mycobacterium tuberculosis H37Rv
agccuccaccaggucg

SEQ ID NO: 3269005 - RNA, 20 nt, Mycobacterium tuberculosis H37Rv
agccucggcaugcagcccca

SEQ ID NO: 3269006 - RNA, 20 nt, Mycobacterium tuberculosis H37Rv
agccucggccaucugcucgu

SEQ ID NO: 3269007 - RNA, 16 nt, Mycobacterium tuberculosis H37Rv
agccucguggugagau

SEQ ID NO: 3269008 - RNA, 13 nt, Mycobacterium tuberculosis H37Rv
agccucuugguca

SEQ ID NO: 3269009 - RNA, 17 nt, Mycobacterium tuberculosis H37Rv
agccucuuggucaacgg

SEQ ID NO: 3269010 - RNA, 23 nt, Mycobacterium tuberculosis H37Rv
agccugaccgaagucugcagacg

SEQ ID NO: 3269011 - RNA, 19 nt, Mycobacterium tuberculosis H37Rv
agccugauaaagcccggcg

SEQ ID NO: 3269012 - RNA, 20 nt, Mycobacterium tuberculosis H37Rv
agccugauaaagcccggcgg

SEQ ID NO: 3269013 - RNA, 21 nt, Mycobacterium tuberculosis H37Rv
agccugccagguacucagugu

SEQ ID NO: 3269014 - RNA, 13 nt, Mycobacterium tuberculosis H37Rv
agccugccgaacc

SEQ ID NO: 3269015 - RNA, 15 nt, Mycobacterium tuberculosis H37Rv
agccugccgaugacg

SEQ ID NO: 3269016 - RNA, 17 nt, Mycobacterium tuberculosis H37Rv
agccugcgccgacccgc

SEQ ID NO: 3269017 - RNA, 18 nt, Mycobacterium tuberculosis H37Rv
agccugcgccgacccgcg

SEQ ID NO: 3269018 - RNA, 21 nt, Mycobacterium tuberculosis H37Rv
agccugcgccgcgcgagaucc

SEQ ID NO: 3269019 - RNA, 19 nt, Mycobacterium tuberculosis H37Rv
agccugcgcuguucggcac

SEQ ID NO: 3269020 - RNA, 15 nt, Mycobacterium tuberculosis H37Rv
agccugcgggccggc

SEQ ID NO: 3269021 - RNA, 16 nt, Mycobacterium tuberculosis H37Rv
agccugcgggccggca

SEQ ID NO: 3269022 - RNA, 19 nt, Mycobacterium tuberculosis H37Rv
agccugcucgcagcgggcg

SEQ ID NO: 3269023 - RNA, 15 nt, Mycobacterium tuberculosis H37Rv
agccuggagauggca

SEQ ID NO: 3269024 - RNA, 23 nt, Mycobacterium tuberculosis H37Rv
agccuggcaaccacguccgcaac

SEQ ID NO: 3269025 - RNA, 14 nt, Mycobacterium tuberculosis H37Rv
agccuggccucgcc

SEQ ID NO: 3269026 - RNA, 15 nt, Mycobacterium tuberculosis H37Rv
agccugugcugccaa

SEQ ID NO: 3269027 - RNA, 15 nt, Mycobacterium tuberculosis H37Rv
agccuugacccaugg

SEQ ID NO: 3269028 - RNA, 17 nt, Mycobacterium tuberculosis H37Rv
agccuugacccauggcu

SEQ ID NO: 3269029 - RNA, 14 nt, Mycobacterium tuberculosis H37Rv
agccuugaucucgu

SEQ ID NO: 3269030 - RNA, 12 nt, Mycobacterium tuberculosis H37Rv
agccuugcagcg

SEQ ID NO: 3269031 - RNA, 17 nt, Mycobacterium tuberculosis H37Rv
agccuugcagcgccccc

SEQ ID NO: 3269032 - RNA, 16 nt, Mycobacterium tuberculosis H37Rv
agccuuggacgugcgc

SEQ ID NO: 3269033 - RNA, 23 nt, Mycobacterium tuberculosis H37Rv
agccuuggacgugcgcgccaagu

SEQ ID NO: 3269034 - RNA, 19 nt, Mycobacterium tuberculosis H37Rv
agcgaaaugcccaucacca

SEQ ID NO: 3269035 - RNA, 16 nt, Mycobacterium tuberculosis H37Rv
agcgaaccgaagccgu

SEQ ID NO: 3269036 - RNA, 17 nt, Mycobacterium tuberculosis H37Rv
agcgaaccggcugggcg

SEQ ID NO: 3269037 - RNA, 15 nt, Mycobacterium tuberculosis H37Rv
agcgaacggccagga

SEQ ID NO: 3269038 - RNA, 15 nt, Mycobacterium tuberculosis H37Rv
agcgaagaacugggc

SEQ ID NO: 3269039 - RNA, 13 nt, Mycobacterium tuberculosis H37Rv
agcgaagcaacgg

SEQ ID NO: 3269040 - RNA, 16 nt, Mycobacterium tuberculosis H37Rv
agcgaagccgggucug

SEQ ID NO: 3269041 - RNA, 12 nt, Mycobacterium tuberculosis H37Rv
agcgaauccagc

SEQ ID NO: 3269042 - RNA, 16 nt, Mycobacterium tuberculosis H37Rv
agcgaauggggcagcu

SEQ ID NO: 3269043 - RNA, 21 nt, Mycobacterium tuberculosis H37Rv
agcgaaugucugcgcaggugg

SEQ ID NO: 3269044 - RNA, 14 nt, Mycobacterium tuberculosis H37Rv
agcgacaacaccac

SEQ ID NO: 3269045 - RNA, 16 nt, Mycobacterium tuberculosis H37Rv
agcgacaacaccacgg

SEQ ID NO: 3269046 - RNA, 20 nt, Mycobacterium tuberculosis H37Rv
agcgacaagugcacgaaguc

SEQ ID NO: 3269047 - RNA, 20 nt, Mycobacterium tuberculosis H37Rv
agcgacagacaaacuccgac

SEQ ID NO: 3269048 - RNA, 20 nt, Mycobacterium tuberculosis H37Rv
agcgacagcgcggcgcgaca

SEQ ID NO: 3269049 - RNA, 16 nt, Mycobacterium tuberculosis H37Rv
agcgacagcgugccga

SEQ ID NO: 3269050 - RNA, 18 nt, Mycobacterium tuberculosis H37Rv
agcgacaugcccgccaau

SEQ ID NO: 3269051 - RNA, 19 nt, Mycobacterium tuberculosis H37Rv
agcgaccaaugcagugcga

SEQ ID NO: 3269052 - RNA, 19 nt, Mycobacterium tuberculosis H37Rv
agcgaccagugguggccga

SEQ ID NO: 3269053 - RNA, 18 nt, Mycobacterium tuberculosis H37Rv
agcgacccccagcgcccg

SEQ ID NO: 3269054 - RNA, 14 nt, Mycobacterium tuberculosis H37Rv
agcgaccgacgcca

SEQ ID NO: 3269055 - RNA, 14 nt, Mycobacterium tuberculosis H37Rv
agcgaccgcugcag

SEQ ID NO: 3269056 - RNA, 16 nt, Mycobacterium tuberculosis H37Rv
agcgaccgcugcagau

SEQ ID NO: 3269057 - RNA, 20 nt, Mycobacterium tuberculosis H37Rv
agcgaccgucgggacggcca

SEQ ID NO: 3269058 - RNA, 18 nt, Mycobacterium tuberculosis H37Rv
agcgaccgucguccagac

SEQ ID NO: 3269059 - RNA, 21 nt, Mycobacterium tuberculosis H37Rv
agcgaccuagcagcgcugcga

SEQ ID NO: 3269060 - RNA, 17 nt, Mycobacterium tuberculosis H37Rv
agcgacgaagucgcagc

SEQ ID NO: 3269061 - RNA, 23 nt, Mycobacterium tuberculosis H37Rv
agcgacgaccacaccacgauggc

SEQ ID NO: 3269062 - RNA, 13 nt, Mycobacterium tuberculosis H37Rv
agcgacgcacgca

SEQ ID NO: 3269063 - RNA, 13 nt, Mycobacterium tuberculosis H37Rv
agcgacgcgguca

SEQ ID NO: 3269064 - RNA, 23 nt, Mycobacterium tuberculosis H37Rv
agcgacgcugacacccacggcgc

SEQ ID NO: 3269065 - RNA, 16 nt, Mycobacterium tuberculosis H37Rv
agcgacgcugccgcca

SEQ ID NO: 3269066 - RNA, 23 nt, Mycobacterium tuberculosis H37Rv
agcgacggucccggcacgucgac

SEQ ID NO: 3269067 - RNA, 17 nt, Mycobacterium tuberculosis H37Rv
agcgacuccaccccacc

SEQ ID NO: 3269068 - RNA, 13 nt, Mycobacterium tuberculosis H37Rv
agcgccgucagca

SEQ ID NO: 3269069 - RNA, 15 nt, Mycobacterium tuberculosis H37Rv
agcgccgucagcaug

SEQ ID NO: 3269070 - RNA, 20 nt, Mycobacterium tuberculosis H37Rv
agcgccucaagcucgccgga

SEQ ID NO: 3269071 - RNA, 12 nt, Mycobacterium tuberculosis H37Rv
agcgccucgaug

SEQ ID NO: 3269072 - RNA, 16 nt, Mycobacterium tuberculosis H37Rv
agcgccucgccggcca

SEQ ID NO: 3269073 - RNA, 20 nt, Mycobacterium tuberculosis H37Rv
agcgccucgccggccacccg

SEQ ID NO: 3269074 - RNA, 14 nt, Mycobacterium tuberculosis H37Rv
agcgccucggcauc

SEQ ID NO: 3269075 - RNA, 22 nt, Mycobacterium tuberculosis H37Rv
agcgccucgguaaagccgcgga

SEQ ID NO: 3269076 - RNA, 19 nt, Mycobacterium tuberculosis H37Rv
agcgccucgguggucuugg

SEQ ID NO: 3269077 - RNA, 15 nt, Mycobacterium tuberculosis H37Rv
agcgccugagcggcc

SEQ ID NO: 3269078 - RNA, 18 nt, Mycobacterium tuberculosis H37Rv
agcgccuugaccagcagc

SEQ ID NO: 3269079 - RNA, 16 nt, Mycobacterium tuberculosis H37Rv
agcgccuugucgaucu

SEQ ID NO: 3269080 - RNA, 16 nt, Mycobacterium tuberculosis H37Rv
agcgccuuguggcaca

SEQ ID NO: 3269081 - RNA, 21 nt, Mycobacterium tuberculosis H37Rv
agcgccuuguuggcgaagucg

SEQ ID NO: 3269082 - RNA, 20 nt, Mycobacterium tuberculosis H37Rv
agcgccuuucggucacgcgu

SEQ ID NO: 3269083 - RNA, 14 nt, Mycobacterium tuberculosis H37Rv
agcgccuuugcccg

SEQ ID NO: 3269084 - RNA, 18 nt, Mycobacterium tuberculosis H37Rv
agcgcgaaagcgccgaaa

SEQ ID NO: 3269085 - RNA, 15 nt, Mycobacterium tuberculosis H37Rv
agcgcgaacaccaug

SEQ ID NO: 3269086 - RNA, 17 nt, Mycobacterium tuberculosis H37Rv
agcgcgaacgccugcug

SEQ ID NO: 3269087 - RNA, 18 nt, Mycobacterium tuberculosis H37Rv
agcgcgagcagacgcaga

SEQ ID NO: 3269088 - RNA, 16 nt, Mycobacterium tuberculosis H37Rv
agcgcgagcccgaacc

SEQ ID NO: 3269089 - RNA, 16 nt, Mycobacterium tuberculosis H37Rv
agcgcgaucgauuccg

SEQ ID NO: 3269090 - RNA, 14 nt, Mycobacterium tuberculosis H37Rv
agcgcgaucgcggu

SEQ ID NO: 3269091 - RNA, 16 nt, Mycobacterium tuberculosis H37Rv
agcgcgaucgcgguca

SEQ ID NO: 3269092 - RNA, 18 nt, Mycobacterium tuberculosis H37Rv
agcgcgaucgggccggcg

SEQ ID NO: 3269093 - RNA, 15 nt, Mycobacterium tuberculosis H37Rv
agcgcgaugaccucg

SEQ ID NO: 3269094 - RNA, 17 nt, Mycobacterium tuberculosis H37Rv
agcgcgaugcagugcga

SEQ ID NO: 3269095 - RNA, 20 nt, Mycobacterium tuberculosis H37Rv
agcgcgcaacguacgcacgc

SEQ ID NO: 3269096 - RNA, 19 nt, Mycobacterium tuberculosis H37Rv
agcgcgcacacggcuaccc

SEQ ID NO: 3269097 - RNA, 20 nt, Mycobacterium tuberculosis H37Rv
agcgcgcagcaguuggucgc

SEQ ID NO: 3269098 - RNA, 15 nt, Mycobacterium tuberculosis H37Rv
agcgcgccacccagc

SEQ ID NO: 3269099 - RNA, 22 nt, Mycobacterium tuberculosis H37Rv
agcgcgccagcuugucgggcac

SEQ ID NO: 3269100 - RNA, 18 nt, Mycobacterium tuberculosis H37Rv
agcgcgcccgacacccgu

SEQ ID NO: 3269101 - RNA, 22 nt, Mycobacterium tuberculosis H37Rv
agcgcgcccgacacccguaagc

SEQ ID NO: 3269102 - RNA, 19 nt, Mycobacterium tuberculosis H37Rv
agcgcgccgaaggcggcca

SEQ ID NO: 3269103 - RNA, 19 nt, Mycobacterium tuberculosis H37Rv
agcgcgccguugccgccca

SEQ ID NO: 3269104 - RNA, 18 nt, Mycobacterium tuberculosis H37Rv
agcgcgccucgcccagca

SEQ ID NO: 3269105 - RNA, 22 nt, Mycobacterium tuberculosis H37Rv
agcgcgcgcgggugcaaccgga

SEQ ID NO: 3269106 - RNA, 21 nt, Mycobacterium tuberculosis H37Rv
agcgcgcgcggugcggccacu

SEQ ID NO: 3269107 - RNA, 17 nt, Mycobacterium tuberculosis H37Rv
agcgcgcgcgugaagaa

SEQ ID NO: 3269108 - RNA, 16 nt, Mycobacterium tuberculosis H37Rv
agcgcgcggagucaag

SEQ ID NO: 3269109 - RNA, 17 nt, Mycobacterium tuberculosis H37Rv
agcgcgcggagucaagc

SEQ ID NO: 3269110 - RNA, 17 nt, Mycobacterium tuberculosis H37Rv
agcgcgcguagcggggg

SEQ ID NO: 3269111 - RNA, 14 nt, Mycobacterium tuberculosis H37Rv
agcgcgcucagguc

SEQ ID NO: 3269112 - RNA, 19 nt, Mycobacterium tuberculosis H37Rv
agcgcgcugcggaucgugg

SEQ ID NO: 3269113 - RNA, 22 nt, Mycobacterium tuberculosis H37Rv
agcgcgcugcggaucguggcgc

SEQ ID NO: 3269114 - RNA, 18 nt, Mycobacterium tuberculosis H37Rv
agcgcgcuggccagcccg

SEQ ID NO: 3269115 - RNA, 21 nt, Mycobacterium tuberculosis H37Rv
agcgcgcuggccagcccgguc

SEQ ID NO: 3269116 - RNA, 22 nt, Mycobacterium tuberculosis H37Rv
agcgcgcuggccagcccgguca

SEQ ID NO: 3269117 - RNA, 12 nt, Mycobacterium tuberculosis H37Rv
agcgcggagacg

SEQ ID NO: 3269118 - RNA, 14 nt, Mycobacterium tuberculosis H37Rv
agcgcggcaaccgu

SEQ ID NO: 3269119 - RNA, 19 nt, Mycobacterium tuberculosis H37Rv
agcgcggcaacuccgguca

SEQ ID NO: 3269120 - RNA, 21 nt, Mycobacterium tuberculosis H37Rv
agcgcggcaacuccggucaac

SEQ ID NO: 3269121 - RNA, 17 nt, Mycobacterium tuberculosis H37Rv
agcgcggcaccagcacc

SEQ ID NO: 3269122 - RNA, 19 nt, Mycobacterium tuberculosis H37Rv
agcgcggccaauugcgccg

SEQ ID NO: 3269123 - RNA, 12 nt, Mycobacterium tuberculosis H37Rv
agcgcggccacc

SEQ ID NO: 3269124 - RNA, 13 nt, Mycobacterium tuberculosis H37Rv
agcgcggccaccc

SEQ ID NO: 3269125 - RNA, 13 nt, Mycobacterium tuberculosis H37Rv
agcgcggccagca

SEQ ID NO: 3269126 - RNA, 14 nt, Mycobacterium tuberculosis H37Rv
agcgcggccagcag

SEQ ID NO: 3269127 - RNA, 15 nt, Mycobacterium tuberculosis H37Rv
agcgcggccagcagc

SEQ ID NO: 3269128 - RNA, 16 nt, Mycobacterium tuberculosis H37Rv
agcgcggccagcagca

SEQ ID NO: 3269129 - RNA, 17 nt, Mycobacterium tuberculosis H37Rv
agcgcggccagcagcag

SEQ ID NO: 3269130 - RNA, 19 nt, Mycobacterium tuberculosis H37Rv
agcgcggccagcagcagau

SEQ ID NO: 3269131 - RNA, 22 nt, Mycobacterium tuberculosis H37Rv
agcgcggccauuagcagcaccc

SEQ ID NO: 3269132 - RNA, 13 nt, Mycobacterium tuberculosis H37Rv
agcgcggccggaa

SEQ ID NO: 3269133 - RNA, 18 nt, Mycobacterium tuberculosis H37Rv
agcgcggcgaagccgggu

SEQ ID NO: 3269134 - RNA, 13 nt, Mycobacterium tuberculosis H37Rv
agcgcggcgacga

SEQ ID NO: 3269135 - RNA, 14 nt, Mycobacterium tuberculosis H37Rv
agcgcggcgagggc

SEQ ID NO: 3269136 - RNA, 19 nt, Mycobacterium tuberculosis H37Rv
agcgcggcgagggcgguca

SEQ ID NO: 3269137 - RNA, 13 nt, Mycobacterium tuberculosis H37Rv
agcgcggcgcaca

SEQ ID NO: 3269138 - RNA, 20 nt, Mycobacterium tuberculosis H37Rv
agcgcggcgcccuggccgcc

SEQ ID NO: 3269139 - RNA, 22 nt, Mycobacterium tuberculosis H37Rv
agcgcggcgcgcggggccucgc

SEQ ID NO: 3269140 - RNA, 19 nt, Mycobacterium tuberculosis H37Rv
agcgcggcguguacgucga

SEQ ID NO: 3269141 - RNA, 17 nt, Mycobacterium tuberculosis H37Rv
agcgcgggacacgucgc

SEQ ID NO: 3269142 - RNA, 17 nt, Mycobacterium tuberculosis H37Rv
agcgcggugccgccacc

SEQ ID NO: 3269143 - RNA, 18 nt, Mycobacterium tuberculosis H37Rv
agcgcggugccgccaccg

SEQ ID NO: 3269144 - RNA, 23 nt, Mycobacterium tuberculosis H37Rv
agcgcggugccgccaccggcguc

SEQ ID NO: 3269145 - RNA, 16 nt, Mycobacterium tuberculosis H37Rv
agcgcgguuucggcga

SEQ ID NO: 3269146 - RNA, 19 nt, Mycobacterium tuberculosis H37Rv
agcgcgguuucggcgauga

SEQ ID NO: 3269147 - RNA, 14 nt, Mycobacterium tuberculosis H37Rv
agcgcguaguccgc

SEQ ID NO: 3269148 - RNA, 13 nt, Mycobacterium tuberculosis H37Rv
agcgcgucgccga

SEQ ID NO: 3269149 - RNA, 13 nt, Mycobacterium tuberculosis H37Rv
agcgcgucgccgu

SEQ ID NO: 3269150 - RNA, 19 nt, Mycobacterium tuberculosis H37Rv
agcgcgucggagccgggca

SEQ ID NO: 3269151 - RNA, 21 nt, Mycobacterium tuberculosis H37Rv
agcgcgucgggaugcgcguua

SEQ ID NO: 3269152 - RNA, 14 nt, Mycobacterium tuberculosis H37Rv
agcgcgucgucacg

SEQ ID NO: 3269153 - RNA, 22 nt, Mycobacterium tuberculosis H37Rv
agcgcgucguccagggcgacga

SEQ ID NO: 3269154 - RNA, 19 nt, Mycobacterium tuberculosis H37Rv
agcgcgugguaccgcuugu

SEQ ID NO: 3269155 - RNA, 16 nt, Mycobacterium tuberculosis H37Rv
agcgcgugugcgucgc

SEQ ID NO: 3269156 - RNA, 15 nt, Mycobacterium tuberculosis H37Rv
agcgcguucggcacc

SEQ ID NO: 3269157 - RNA, 23 nt, Mycobacterium tuberculosis H37Rv
agcgcguugagcucaauggcuuc

SEQ ID NO: 3269158 - RNA, 20 nt, Mycobacterium tuberculosis H37Rv
agcgcucgaucacggcggga

SEQ ID NO: 3269159 - RNA, 14 nt, Mycobacterium tuberculosis H37Rv
agcgcucgaucagg

SEQ ID NO: 3269160 - RNA, 12 nt, Mycobacterium tuberculosis H37Rv
agcgcucgcguc

SEQ ID NO: 3269161 - RNA, 20 nt, Mycobacterium tuberculosis H37Rv
agcgcucguagaaucggcuc

SEQ ID NO: 3269162 - RNA, 21 nt, Mycobacterium tuberculosis H37Rv
agcgcucguagaaucggcuca

SEQ ID NO: 3269163 - RNA, 16 nt, Mycobacterium tuberculosis H37Rv
agcgcucgugaccgaa

SEQ ID NO: 3269164 - RNA, 15 nt, Mycobacterium tuberculosis H37Rv
agcggcgggcgauga

SEQ ID NO: 3269165 - RNA, 23 nt, Mycobacterium tuberculosis H37Rv
agcggcgggggcgucgccgccgg

SEQ ID NO: 3269166 - RNA, 20 nt, Mycobacterium tuberculosis H37Rv
agcggcggggggugaucgcc

SEQ ID NO: 3269167 - RNA, 20 nt, Mycobacterium tuberculosis H37Rv
agcggcgucggugccgcuga

SEQ ID NO: 3269168 - RNA, 22 nt, Mycobacterium tuberculosis H37Rv
agcggcgugacgucgucggugc

SEQ ID NO: 3269169 - RNA, 12 nt, Mycobacterium tuberculosis H37Rv
agcggcguuccg

SEQ ID NO: 3269170 - RNA, 17 nt, Mycobacterium tuberculosis H37Rv
agcggcguucgaugcca

SEQ ID NO: 3269171 - RNA, 22 nt, Mycobacterium tuberculosis H37Rv
agcggcuccacuuggggcgcca

SEQ ID NO: 3269172 - RNA, 18 nt, Mycobacterium tuberculosis H37Rv
agcggcuccgaaggccgc

SEQ ID NO: 3269173 - RNA, 13 nt, Mycobacterium tuberculosis H37Rv
agcggcuccggga

SEQ ID NO: 3269174 - RNA, 21 nt, Mycobacterium tuberculosis H37Rv
agcggcucuauccggcgcagg

SEQ ID NO: 3269175 - RNA, 22 nt, Mycobacterium tuberculosis H37Rv
aaacccggugaccagcaaccac

SEQ ID NO: 3269176 - RNA, 16 nt, Mycobacterium tuberculosis H37Rv
aaaccgaggauguggu

SEQ ID NO: 3269177 - RNA, 16 nt, Mycobacterium tuberculosis H37Rv
aaaccgauaucgcugc

SEQ ID NO: 3269178 - RNA, 21 nt, Mycobacterium tuberculosis H37Rv
aaaccggaccugaccgguggc

SEQ ID NO: 3269179 - RNA, 23 nt, Mycobacterium tuberculosis H37Rv
aaaccucuucgggugcagccaga

SEQ ID NO: 3269180 - RNA, 11 nt, Mycobacterium tuberculosis H37Rv
aaaccugggau

SEQ ID NO: 3269181 - RNA, 19 nt, Mycobacterium tuberculosis H37Rv
aaacgacagcccuaucagc

SEQ ID NO: 3269182 - RNA, 22 nt, Mycobacterium tuberculosis H37Rv
aaacgcugcgcccggaccacug

SEQ ID NO: 3269183 - RNA, 13 nt, Mycobacterium tuberculosis H37Rv
aaacgcugcuggc

SEQ ID NO: 3269184 - RNA, 14 nt, Mycobacterium tuberculosis H37Rv
aaacgcugcuggca

SEQ ID NO: 3269185 - RNA, 18 nt, Mycobacterium tuberculosis H37Rv
aaacggugucucgcccac

SEQ ID NO: 3269186 - RNA, 12 nt, Mycobacterium tuberculosis H37Rv
aaacgucaccgc

SEQ ID NO: 3269187 - RNA, 15 nt, Mycobacterium tuberculosis H37Rv
aaacuaauucuccug

SEQ ID NO: 3269188 - RNA, 13 nt, Mycobacterium tuberculosis H37Rv
aaacuaccgaaca

SEQ ID NO: 3269189 - RNA, 16 nt, Mycobacterium tuberculosis H37Rv
aaacucaccagcaccc

SEQ ID NO: 3269190 - RNA, 16 nt, Mycobacterium tuberculosis H37Rv
aaacuccgugccgagc

SEQ ID NO: 3269191 - RNA, 17 nt, Mycobacterium tuberculosis H37Rv
aaacugccgcggcaccg

SEQ ID NO: 3269192 - RNA, 13 nt, Mycobacterium tuberculosis H37Rv
aaacugggcaccg

SEQ ID NO: 3269193 - RNA, 15 nt, Mycobacterium tuberculosis H37Rv
aaagacagcgcggga

SEQ ID NO: 3269194 - RNA, 12 nt, Mycobacterium tuberculosis H37Rv
aaagacucgacc

SEQ ID NO: 3269195 - RNA, 22 nt, Mycobacterium tuberculosis H37Rv
aaagaucagcaugguccacagc

SEQ ID NO: 3269196 - RNA, 23 nt, Mycobacterium tuberculosis H37Rv
aaagaucagcaugguccacagcc

SEQ ID NO: 3269197 - RNA, 22 nt, Mycobacterium tuberculosis H37Rv
aaagcaucaaagcggugccauu

SEQ ID NO: 3269198 - RNA, 22 nt, Mycobacterium tuberculosis H37Rv
aaagccaccagaauccugcuuu

SEQ ID NO: 3269199 - RNA, 13 nt, Mycobacterium tuberculosis H37Rv
aaagccagcgcag

SEQ ID NO: 3269200 - RNA, 19 nt, Mycobacterium tuberculosis H37Rv
aaagccagcgcagccaggc

SEQ ID NO: 3269201 - RNA, 16 nt, Mycobacterium tuberculosis H37Rv
aaagcccgacaugaau

SEQ ID NO: 3269202 - RNA, 14 nt, Mycobacterium tuberculosis H37Rv
aaagcccggcggca

SEQ ID NO: 3269203 - RNA, 14 nt, Mycobacterium tuberculosis H37Rv
aaagccgcaccaga

SEQ ID NO: 3269204 - RNA, 14 nt, Mycobacterium tuberculosis H37Rv
aaagccgugccagc

SEQ ID NO: 3269205 - RNA, 22 nt, Mycobacterium tuberculosis H37Rv
aaagccuaguccuggcucggca

SEQ ID NO: 3269206 - RNA, 14 nt, Mycobacterium tuberculosis H37Rv
aaagcgagcaccgc

SEQ ID NO: 3269207 - RNA, 13 nt, Mycobacterium tuberculosis H37Rv
aaagcucucggca

SEQ ID NO: 3269208 - RNA, 19 nt, Mycobacterium tuberculosis H37Rv
aaagcuugggcgaucguca

SEQ ID NO: 3269209 - RNA, 14 nt, Mycobacterium tuberculosis H37Rv
aaaggaagaccucg

SEQ ID NO: 3269210 - RNA, 15 nt, Mycobacterium tuberculosis H37Rv
aaaggacgucgaccu

SEQ ID NO: 3269211 - RNA, 16 nt, Mycobacterium tuberculosis H37Rv
aaagggccgccgcugg

SEQ ID NO: 3269212 - RNA, 14 nt, Mycobacterium tuberculosis H37Rv
aaaggucggccugc

SEQ ID NO: 3269213 - RNA, 21 nt, Mycobacterium tuberculosis H37Rv
aaaggucggggaacgcggcga

SEQ ID NO: 3269214 - RNA, 20 nt, Mycobacterium tuberculosis H37Rv
aaauaccuuuggcucccuuu

SEQ ID NO: 3269215 - RNA, 22 nt, Mycobacterium tuberculosis H37Rv
aaauacuccgcgagcccggccu

SEQ ID NO: 3269216 - RNA, 19 nt, Mycobacterium tuberculosis H37Rv
aaauagauucccggcucga

SEQ ID NO: 3269217 - RNA, 16 nt, Mycobacterium tuberculosis H37Rv
aaauaggccgggcagu

SEQ ID NO: 3269218 - RNA, 22 nt, Mycobacterium tuberculosis H37Rv
aaauauuggcccgucacgcccg

SEQ ID NO: 3269219 - RNA, 15 nt, Mycobacterium tuberculosis H37Rv
aaaucaagcacagcc

SEQ ID NO: 3269220 - RNA, 21 nt, Mycobacterium tuberculosis H37Rv
aaaucaagcacagcccggcga

SEQ ID NO: 3269221 - RNA, 13 nt, Mycobacterium tuberculosis H37Rv
aaauccagcagcc

SEQ ID NO: 3269222 - RNA, 20 nt, Mycobacterium tuberculosis H37Rv
aaauccccucgcaaccggcg

SEQ ID NO: 3269223 - RNA, 23 nt, Mycobacterium tuberculosis H37Rv
aaauccgcaccagccgccaugcg

SEQ ID NO: 3269224 - RNA, 22 nt, Mycobacterium tuberculosis H37Rv
aaauccggggggauccagcagg

SEQ ID NO: 3269225 - RNA, 14 nt, Mycobacterium tuberculosis H37Rv
aaaucgcacagcgc

SEQ ID NO: 3269226 - RNA, 21 nt, Mycobacterium tuberculosis H37Rv
aaaucggcggcguccagcagc

SEQ ID NO: 3269227 - RNA, 15 nt, Mycobacterium tuberculosis H37Rv
aaaugauagcggcgc

SEQ ID NO: 3269228 - RNA, 22 nt, Mycobacterium tuberculosis H37Rv
aaaugcgggcuuugccaacaaa

SEQ ID NO: 3269229 - RNA, 20 nt, Mycobacterium tuberculosis H37Rv
aaaugggugugcugccaccg

SEQ ID NO: 3269230 - RNA, 21 nt, Mycobacterium tuberculosis H37Rv
aaaugguucgcacaccuccuc

SEQ ID NO: 3269231 - RNA, 24 nt, Mycobacterium tuberculosis H37Rv
aaauguaccugguugcugacgacu

SEQ ID NO: 3269232 - RNA, 13 nt, Mycobacterium tuberculosis H37Rv
aacaaaggcuugc

SEQ ID NO: 3269233 - RNA, 16 nt, Mycobacterium tuberculosis H37Rv
aacaacaccaccgccg

SEQ ID NO: 3269234 - RNA, 13 nt, Mycobacterium tuberculosis H37Rv
aacaacagcggca

SEQ ID NO: 3269235 - RNA, 23 nt, Mycobacterium tuberculosis H37Rv
aacaaccccgguugacucgcucc

SEQ ID NO: 3269236 - RNA, 23 nt, Mycobacterium tuberculosis H37Rv
aacaacgcauuuggugucggcgc

SEQ ID NO: 3269237 - RNA, 14 nt, Mycobacterium tuberculosis H37Rv
aacaacuccagcag

SEQ ID NO: 3269238 - RNA, 15 nt, Mycobacterium tuberculosis H37Rv
aacaacuccagcagg

SEQ ID NO: 3269239 - RNA, 20 nt, Mycobacterium tuberculosis H37Rv
aacaacuuggccaucccggc

SEQ ID NO: 3269240 - RNA, 22 nt, Mycobacterium tuberculosis H37Rv
aacaacuuggccaucccggccu

SEQ ID NO: 3269241 - RNA, 23 nt, Mycobacterium tuberculosis H37Rv
aacaauaaggccgcacgggcgac

SEQ ID NO: 3269242 - RNA, 21 nt, Mycobacterium tuberculosis H37Rv
aacaauucacgcaccacaaac

SEQ ID NO: 3269243 - RNA, 16 nt, Mycobacterium tuberculosis H37Rv
aacacagccgucgcac

SEQ ID NO: 3269244 - RNA, 21 nt, Mycobacterium tuberculosis H37Rv
aacacauccaguaaccguccg

SEQ ID NO: 3269245 - RNA, 22 nt, Mycobacterium tuberculosis H37Rv
aacaccaaccagugcagcucga

SEQ ID NO: 3269246 - RNA, 19 nt, Mycobacterium tuberculosis H37Rv
aacaccagaugcaccucgc

SEQ ID NO: 3269247 - RNA, 19 nt, Mycobacterium tuberculosis H37Rv
aacaccagauggcucucgg

SEQ ID NO: 3269248 - RNA, 21 nt, Mycobacterium tuberculosis H37Rv
aacaccagcaggcggcucaac

SEQ ID NO: 3269249 - RNA, 16 nt, Mycobacterium tuberculosis H37Rv
aacaccaucagcgaca

SEQ ID NO: 3269250 - RNA, 20 nt, Mycobacterium tuberculosis H37Rv
aacacccacgugcugccuuu

SEQ ID NO: 3269251 - RNA, 17 nt, Mycobacterium tuberculosis H37Rv
aacaccccgggcgccga

SEQ ID NO: 3269252 - RNA, 18 nt, Mycobacterium tuberculosis H37Rv
aacaccgacgucaggcuc

SEQ ID NO: 3269253 - RNA, 22 nt, Mycobacterium tuberculosis H37Rv
aacaccgcccggcccggcucgg

SEQ ID NO: 3269254 - RNA, 16 nt, Mycobacterium tuberculosis H37Rv
aacaccguccaauugg

SEQ ID NO: 3269255 - RNA, 19 nt, Mycobacterium tuberculosis H37Rv
aacaccgucggcagcagcg

SEQ ID NO: 3269256 - RNA, 20 nt, Mycobacterium tuberculosis H37Rv
aacaccgugcaccagcucac

SEQ ID NO: 3269257 - RNA, 14 nt, Mycobacterium tuberculosis H37Rv
aacacgaccucuug

SEQ ID NO: 3269258 - RNA, 23 nt, Mycobacterium tuberculosis H37Rv
aacacguggauguguaggugggg

SEQ ID NO: 3269259 - RNA, 17 nt, Mycobacterium tuberculosis H37Rv
aacacucauuccccgga

SEQ ID NO: 3269260 - RNA, 18 nt, Mycobacterium tuberculosis H37Rv
aacacuugucgcuaugcc

SEQ ID NO: 3269261 - RNA, 11 nt, Mycobacterium tuberculosis H37Rv
aacagagcgug

SEQ ID NO: 3269262 - RNA, 15 nt, Mycobacterium tuberculosis H37Rv
aacagaguagacaac

SEQ ID NO: 3269263 - RNA, 13 nt, Mycobacterium tuberculosis H37Rv
aacagcaccagug

SEQ ID NO: 3269264 - RNA, 14 nt, Mycobacterium tuberculosis H37Rv
aacagcaccgccgg

SEQ ID NO: 3269265 - RNA, 18 nt, Mycobacterium tuberculosis H37Rv
aacagcagguuggcgagc

SEQ ID NO: 3269266 - RNA, 22 nt, Mycobacterium tuberculosis H37Rv
aacagcaugauccgcugggccg

SEQ ID NO: 3269267 - RNA, 18 nt, Mycobacterium tuberculosis H37Rv
aacagccgagccagcagc

SEQ ID NO: 3269268 - RNA, 12 nt, Mycobacterium tuberculosis H37Rv
aacagccgcagc

SEQ ID NO: 3269269 - RNA, 13 nt, Mycobacterium tuberculosis H37Rv
aacagcgaaccgc

SEQ ID NO: 3269270 - RNA, 15 nt, Mycobacterium tuberculosis H37Rv
aacagcgaaccgccg

SEQ ID NO: 3269271 - RNA, 19 nt, Mycobacterium tuberculosis H37Rv
aacagcgaaccgccggcac

SEQ ID NO: 3269272 - RNA, 20 nt, Mycobacterium tuberculosis H37Rv
aacagcgaaccggcugggcg

SEQ ID NO: 3269273 - RNA, 13 nt, Mycobacterium tuberculosis H37Rv
aacagcgauccga

SEQ ID NO: 3269274 - RNA, 16 nt, Mycobacterium tuberculosis H37Rv
aacagcgaucgccgca

SEQ ID NO: 3269275 - RNA, 16 nt, Mycobacterium tuberculosis H37Rv
aacagcgcgccggcgu

SEQ ID NO: 3269276 - RNA, 13 nt, Mycobacterium tuberculosis H37Rv
aacagcgcggugu

SEQ ID NO: 3269277 - RNA, 13 nt, Mycobacterium tuberculosis H37Rv
aacagcgcgucgg

SEQ ID NO: 3269278 - RNA, 13 nt, Mycobacterium tuberculosis H37Rv
aacagcggcacga

SEQ ID NO: 3269279 - RNA, 18 nt, Mycobacterium tuberculosis H37Rv
aacagcggguccuucugc

SEQ ID NO: 3269280 - RNA, 23 nt, Mycobacterium tuberculosis H37Rv
aacagcgguggguaggcucccac

SEQ ID NO: 3269281 - RNA, 16 nt, Mycobacterium tuberculosis H37Rv
aacagcucguuggcga

SEQ ID NO: 3269282 - RNA, 19 nt, Mycobacterium tuberculosis H37Rv
aacagcugcccgccagcgc

SEQ ID NO: 3269283 - RNA, 11 nt, Mycobacterium tuberculosis H37Rv
aacaggauggu

SEQ ID NO: 3269284 - RNA, 17 nt, Mycobacterium tuberculosis H37Rv
aacaggcccacggcgac

SEQ ID NO: 3269285 - RNA, 19 nt, Mycobacterium tuberculosis H37Rv
aacaggccgccaccgucac

SEQ ID NO: 3269286 - RNA, 16 nt, Mycobacterium tuberculosis H37Rv
aacaggccuaggucga

SEQ ID NO: 3269287 - RNA, 18 nt, Mycobacterium tuberculosis H37Rv
aacaggcgucccgcccgg

SEQ ID NO: 3269288 - RNA, 18 nt, Mycobacterium tuberculosis H37Rv
aacagguccaccggccag

SEQ ID NO: 3269289 - RNA, 16 nt, Mycobacterium tuberculosis H37Rv
aacagucgcagccagg

SEQ ID NO: 3269290 - RNA, 20 nt, Mycobacterium tuberculosis H37Rv
aacagucgcagccaggcacg

SEQ ID NO: 3269291 - RNA, 22 nt, Mycobacterium tuberculosis H37Rv
aacagugacgccacgaccgccg

SEQ ID NO: 3269292 - RNA, 15 nt, Mycobacterium tuberculosis H37Rv
aacagugccaccuga

SEQ ID NO: 3269293 - RNA, 16 nt, Mycobacterium tuberculosis H37Rv
aacaucaccucgaugc

SEQ ID NO: 3269294 - RNA, 23 nt, Mycobacterium tuberculosis H37Rv
aacauccccaugucggugaccgu

SEQ ID NO: 3269295 - RNA, 19 nt, Mycobacterium tuberculosis H37Rv
aacauccccgagcugucgg

SEQ ID NO: 3269296 - RNA, 13 nt, Mycobacterium tuberculosis H37Rv
aacauccuaagaa

SEQ ID NO: 3269297 - RNA, 15 nt, Mycobacterium tuberculosis H37Rv
aacaucgagcgccag

SEQ ID NO: 3269298 - RNA, 23 nt, Mycobacterium tuberculosis H37Rv
aacaucggaacgugaccgacgcc

SEQ ID NO: 3269299 - RNA, 14 nt, Mycobacterium tuberculosis H37Rv
aacaucuccgcguc

SEQ ID NO: 3269300 - RNA, 21 nt, Mycobacterium tuberculosis H37Rv
aaccgguccugggauccggcg

SEQ ID NO: 3269301 - RNA, 21 nt, Mycobacterium tuberculosis H37Rv
aaccgguuggcgauccgcggc

SEQ ID NO: 3269302 - RNA, 19 nt, Mycobacterium tuberculosis H37Rv
aaccgucucggcgaccgac

SEQ ID NO: 3269303 - RNA, 15 nt, Mycobacterium tuberculosis H37Rv
aaccgugagcaccag

SEQ ID NO: 3269304 - RNA, 15 nt, Mycobacterium tuberculosis H37Rv
aaccguguaggccau

SEQ ID NO: 3269305 - RNA, 22 nt, Mycobacterium tuberculosis H37Rv
aaccgugucgccgccgcgacug

SEQ ID NO: 3269306 - RNA, 21 nt, Mycobacterium tuberculosis H37Rv
aaccguugcugcgcagcggca

SEQ ID NO: 3269307 - RNA, 22 nt, Mycobacterium tuberculosis H37Rv
aaccguugcugcgcagcggcau

SEQ ID NO: 3269308 - RNA, 15 nt, Mycobacterium tuberculosis H37Rv
aaccguuguacccca

SEQ ID NO: 3269309 - RNA, 19 nt, Mycobacterium tuberculosis H37Rv
aaccguuugacgcgcucgc

SEQ ID NO: 3269310 - RNA, 20 nt, Mycobacterium tuberculosis H37Rv
aaccucaucgcggucgccac

SEQ ID NO: 3269311 - RNA, 22 nt, Mycobacterium tuberculosis H37Rv
aaccuccucggguucgucaguc

SEQ ID NO: 3269312 - RNA, 13 nt, Mycobacterium tuberculosis H37Rv
aaccucgaccguc

SEQ ID NO: 3269313 - RNA, 14 nt, Mycobacterium tuberculosis H37Rv
aaccucggacugca

SEQ ID NO: 3269314 - RNA, 19 nt, Mycobacterium tuberculosis H37Rv
aaccucggaucgccaggcc

SEQ ID NO: 3269315 - RNA, 19 nt, Mycobacterium tuberculosis H37Rv
aaccucggcuuggccggcg

SEQ ID NO: 3269316 - RNA, 21 nt, Mycobacterium tuberculosis H37Rv
aaccucgguuugggaauccgc

SEQ ID NO: 3269317 - RNA, 14 nt, Mycobacterium tuberculosis H37Rv
aaccugcgcaucac

SEQ ID NO: 3269318 - RNA, 21 nt, Mycobacterium tuberculosis H37Rv
aaccuggggugaacuccauga

SEQ ID NO: 3269319 - RNA, 20 nt, Mycobacterium tuberculosis H37Rv
aacgaaaauuugacgacggc

SEQ ID NO: 3269320 - RNA, 13 nt, Mycobacterium tuberculosis H37Rv
aacgacaccagau

SEQ ID NO: 3269321 - RNA, 16 nt, Mycobacterium tuberculosis H37Rv
aacgacacgccgcucc

SEQ ID NO: 3269322 - RNA, 16 nt, Mycobacterium tuberculosis H37Rv
aacgacccgaagccga

SEQ ID NO: 3269323 - RNA, 13 nt, Mycobacterium tuberculosis H37Rv
aacgacgacgaca

SEQ ID NO: 3269324 - RNA, 14 nt, Mycobacterium tuberculosis H37Rv
aacgacggccgaca

SEQ ID NO: 3269325 - RNA, 19 nt, Mycobacterium tuberculosis H37Rv
aacgacgggucguucuccg

SEQ ID NO: 3269326 - RNA, 22 nt, Mycobacterium tuberculosis H37Rv
aacgacgggucguucuccgcgc

SEQ ID NO: 3269327 - RNA, 19 nt, Mycobacterium tuberculosis H37Rv
aacgacgucgccgacccgg

SEQ ID NO: 3269328 - RNA, 15 nt, Mycobacterium tuberculosis H37Rv
aacgacuccuggcga

SEQ ID NO: 3269329 - RNA, 20 nt, Mycobacterium tuberculosis H37Rv
aacgacuguggcgccgccgg

SEQ ID NO: 3269330 - RNA, 23 nt, Mycobacterium tuberculosis H37Rv
aacgacuguggcgccgccggcac

SEQ ID NO: 3269331 - RNA, 18 nt, Mycobacterium tuberculosis H37Rv
aacgagaugugagcacac

SEQ ID NO: 3269332 - RNA, 22 nt, Mycobacterium tuberculosis H37Rv
aacgaucccgugauccgccgac

SEQ ID NO: 3269333 - RNA, 17 nt, Mycobacterium tuberculosis H37Rv
aacgaucgcgcgagcga

SEQ ID NO: 3269334 - RNA, 19 nt, Mycobacterium tuberculosis H37Rv
aacgaugaugaugaccaca

SEQ ID NO: 3269335 - RNA, 16 nt, Mycobacterium tuberculosis H37Rv
aacgaugccgccggcg

SEQ ID NO: 3269336 - RNA, 21 nt, Mycobacterium tuberculosis H37Rv
aacgaugguggcgaucaucgg

SEQ ID NO: 3269337 - RNA, 16 nt, Mycobacterium tuberculosis H37Rv
aacgauguccgcgcga

SEQ ID NO: 3269338 - RNA, 15 nt, Mycobacterium tuberculosis H37Rv
aacgcaaucgucgcc

SEQ ID NO: 3269339 - RNA, 14 nt, Mycobacterium tuberculosis H37Rv
aacgcagccagcgc

SEQ ID NO: 3269340 - RNA, 18 nt, Mycobacterium tuberculosis H37Rv
aacgcaggcagugagggu

SEQ ID NO: 3269341 - RNA, 18 nt, Mycobacterium tuberculosis H37Rv
aacgcauacagcgcccgg

SEQ ID NO: 3269342 - RNA, 12 nt, Mycobacterium tuberculosis H37Rv
aacgccaaaaug

SEQ ID NO: 3269343 - RNA, 19 nt, Mycobacterium tuberculosis H37Rv
aacgccaccgucgcugccc

SEQ ID NO: 3269344 - RNA, 22 nt, Mycobacterium tuberculosis H37Rv
aacgccacggcaucggccaccu

SEQ ID NO: 3269345 - RNA, 19 nt, Mycobacterium tuberculosis H37Rv
aacgccacugcgccgugac

SEQ ID NO: 3269346 - RNA, 14 nt, Mycobacterium tuberculosis H37Rv
aacgccagcaccag

SEQ ID NO: 3269347 - RNA, 12 nt, Mycobacterium tuberculosis H37Rv
aacgccagcagc

SEQ ID NO: 3269348 - RNA, 16 nt, Mycobacterium tuberculosis H37Rv
aacgccagucgagcac

SEQ ID NO: 3269349 - RNA, 13 nt, Mycobacterium tuberculosis H37Rv
aacgcccgcuuca

SEQ ID NO: 3269350 - RNA, 11 nt, Mycobacterium tuberculosis H37Rv
aacgcccggca

SEQ ID NO: 3269351 - RNA, 11 nt, Mycobacterium tuberculosis H37Rv
aacgcccggcu

SEQ ID NO: 3269352 - RNA, 17 nt, Mycobacterium tuberculosis H37Rv
aacgcccugacgguggu

SEQ ID NO: 3269353 - RNA, 18 nt, Mycobacterium tuberculosis H37Rv
aacgccgaccgcgccgca

SEQ ID NO: 3269354 - RNA, 15 nt, Mycobacterium tuberculosis H37Rv
aacgccgagcgccag

SEQ ID NO: 3269355 - RNA, 22 nt, Mycobacterium tuberculosis H37Rv
aacgccgcccgcugggcucgcu

SEQ ID NO: 3269356 - RNA, 12 nt, Mycobacterium tuberculosis H37Rv
aacgccgcucau

SEQ ID NO: 3269357 - RNA, 12 nt, Mycobacterium tuberculosis H37Rv
aacgccggcacc

SEQ ID NO: 3269358 - RNA, 16 nt, Mycobacterium tuberculosis H37Rv
aacgccggguucgccg

SEQ ID NO: 3269359 - RNA, 15 nt, Mycobacterium tuberculosis H37Rv
aacgccgucgccugc

SEQ ID NO: 3269360 - RNA, 23 nt, Mycobacterium tuberculosis H37Rv
aacgccgucgucguagaacugca

SEQ ID NO: 3269361 - RNA, 13 nt, Mycobacterium tuberculosis H37Rv
aacgccugcucgu

SEQ ID NO: 3269362 - RNA, 23 nt, Mycobacterium tuberculosis H37Rv
aacgccuugacugaacucaacac

SEQ ID NO: 3269363 - RNA, 21 nt, Mycobacterium tuberculosis H37Rv
aacgcgaccgcaucucgggcg

SEQ ID NO: 3269364 - RNA, 17 nt, Mycobacterium tuberculosis H37Rv
aacgcgcaggccgacac

SEQ ID NO: 3269365 - RNA, 21 nt, Mycobacterium tuberculosis H37Rv
aacgcgcgcagccgggcaccg

SEQ ID NO: 3269366 - RNA, 14 nt, Mycobacterium tuberculosis H37Rv
aacgcggacaccgc

SEQ ID NO: 3269367 - RNA, 14 nt, Mycobacterium tuberculosis H37Rv
aacgcggccaccac

SEQ ID NO: 3269368 - RNA, 14 nt, Mycobacterium tuberculosis H37Rv
aacgcggccucguc

SEQ ID NO: 3269369 - RNA, 13 nt, Mycobacterium tuberculosis H37Rv
aacgcggcgucga

SEQ ID NO: 3269370 - RNA, 19 nt, Mycobacterium tuberculosis H37Rv
aacgcgggaacgaugccgc

SEQ ID NO: 3269371 - RNA, 16 nt, Mycobacterium tuberculosis H37Rv
aacgcggugggcacag

SEQ ID NO: 3269372 - RNA, 20 nt, Mycobacterium tuberculosis H37Rv
aacgcguauucggcaucgcc

SEQ ID NO: 3269373 - RNA, 22 nt, Mycobacterium tuberculosis H37Rv
aacgcgucccgccgcaccgccg

SEQ ID NO: 3269374 - RNA, 15 nt, Mycobacterium tuberculosis H37Rv
aacgcgucgcccgca

SEQ ID NO: 3269375 - RNA, 13 nt, Mycobacterium tuberculosis H37Rv
aacgcgucgcgcg

SEQ ID NO: 3269376 - RNA, 21 nt, Mycobacterium tuberculosis H37Rv
aacgcgugcugagucgguuca

SEQ ID NO: 3269377 - RNA, 14 nt, Mycobacterium tuberculosis H37Rv
aacgcucgucgaca

SEQ ID NO: 3269378 - RNA, 14 nt, Mycobacterium tuberculosis H37Rv
aacgcugcgcccgg

SEQ ID NO: 3269379 - RNA, 20 nt, Mycobacterium tuberculosis H37Rv
aacgcugcgcccggaccacu

SEQ ID NO: 3269380 - RNA, 20 nt, Mycobacterium tuberculosis H37Rv
aacgcuggccacucacauug

SEQ ID NO: 3269381 - RNA, 18 nt, Mycobacterium tuberculosis H37Rv
aacgcugggcggcuaccc

SEQ ID NO: 3269382 - RNA, 18 nt, Mycobacterium tuberculosis H37Rv
aacgcugucccagcccgg

SEQ ID NO: 3269383 - RNA, 16 nt, Mycobacterium tuberculosis H37Rv
aacgcuucaccucguc

SEQ ID NO: 3269384 - RNA, 13 nt, Mycobacterium tuberculosis H37Rv
aacgcuuccagcg

SEQ ID NO: 3269385 - RNA, 21 nt, Mycobacterium tuberculosis H37Rv
aacggauucccgcccagcagc

SEQ ID NO: 3269386 - RNA, 23 nt, Mycobacterium tuberculosis H37Rv
aacggauuggugggccagcagca

SEQ ID NO: 3269387 - RNA, 13 nt, Mycobacterium tuberculosis H37Rv
aacggcagcacgg

SEQ ID NO: 3269388 - RNA, 17 nt, Mycobacterium tuberculosis H37Rv
aacggcgaggugcccaa

SEQ ID NO: 3269389 - RNA, 13 nt, Mycobacterium tuberculosis H37Rv
aacggcgaucacc

SEQ ID NO: 3269390 - RNA, 22 nt, Mycobacterium tuberculosis H37Rv
aacggcgggcgauuucggcgcc

SEQ ID NO: 3269391 - RNA, 20 nt, Mycobacterium tuberculosis H37Rv
aacggcguuggcgccguuac

SEQ ID NO: 3269392 - RNA, 21 nt, Mycobacterium tuberculosis H37Rv
aacggcucgggaacuucgccg

SEQ ID NO: 3269393 - RNA, 22 nt, Mycobacterium tuberculosis H37Rv
aacggcuuggcugccuccauca

SEQ ID NO: 3269394 - RNA, 23 nt, Mycobacterium tuberculosis H37Rv
aacggcuuggcugccuccaucaa

SEQ ID NO: 3269395 - RNA, 14 nt, Mycobacterium tuberculosis H37Rv
aacgggauccgcgc

SEQ ID NO: 3269396 - RNA, 19 nt, Mycobacterium tuberculosis H37Rv
aagagcggagccggcgcau

SEQ ID NO: 3269397 - RNA, 16 nt, Mycobacterium tuberculosis H37Rv
aagaggcgcaccuccu

SEQ ID NO: 3269398 - RNA, 16 nt, Mycobacterium tuberculosis H37Rv
aagagguggggcagga

SEQ ID NO: 3269399 - RNA, 21 nt, Mycobacterium tuberculosis H37Rv
aagaucagcaugguccacagc

SEQ ID NO: 3269400 - RNA, 18 nt, Mycobacterium tuberculosis H37Rv
aagaucagcggauccaga

SEQ ID NO: 3269401 - RNA, 13 nt, Mycobacterium tuberculosis H37Rv
aagauccagcgca

SEQ ID NO: 3269402 - RNA, 18 nt, Mycobacterium tuberculosis H37Rv
aagaucgcgugccacagc

SEQ ID NO: 3269403 - RNA, 15 nt, Mycobacterium tuberculosis H37Rv
aagaucggugccagc

SEQ ID NO: 3269404 - RNA, 13 nt, Mycobacterium tuberculosis H37Rv
aagaucuccuccu

SEQ ID NO: 3269405 - RNA, 14 nt, Mycobacterium tuberculosis H37Rv
aagaucuucgccga

SEQ ID NO: 3269406 - RNA, 15 nt, Mycobacterium tuberculosis H37Rv
aagaugccugcuagc

SEQ ID NO: 3269407 - RNA, 20 nt, Mycobacterium tuberculosis H37Rv
aagaugccugcuagcagcag

SEQ ID NO: 3269408 - RNA, 18 nt, Mycobacterium tuberculosis H37Rv
aagauggccucaacgcca

SEQ ID NO: 3269409 - RNA, 19 nt, Mycobacterium tuberculosis H37Rv
aagauuauggcgagcgcgc

SEQ ID NO: 3269410 - RNA, 17 nt, Mycobacterium tuberculosis H37Rv
aagcaagcguguuguuu

SEQ ID NO: 3269411 - RNA, 21 nt, Mycobacterium tuberculosis H37Rv
aagcaauuccaccgccgagau

SEQ ID NO: 3269412 - RNA, 14 nt, Mycobacterium tuberculosis H37Rv
aagcacaccgccag

SEQ ID NO: 3269413 - RNA, 13 nt, Mycobacterium tuberculosis H37Rv
aagcacagcccgg

SEQ ID NO: 3269414 - RNA, 10 nt, Mycobacterium tuberculosis H37Rv
aagcaccagc

SEQ ID NO: 3269415 - RNA, 14 nt, Mycobacterium tuberculosis H37Rv
aagcaccagccagc

SEQ ID NO: 3269416 - RNA, 15 nt, Mycobacterium tuberculosis H37Rv
aagcaccagccagcc

SEQ ID NO: 3269417 - RNA, 12 nt, Mycobacterium tuberculosis H37Rv
aagcagccagca

SEQ ID NO: 3269418 - RNA, 14 nt, Mycobacterium tuberculosis H37Rv
aagcagccagcaac

SEQ ID NO: 3269419 - RNA, 21 nt, Mycobacterium tuberculosis H37Rv
aagcagccagcaacaccagau

SEQ ID NO: 3269420 - RNA, 15 nt, Mycobacterium tuberculosis H37Rv
aagcagcugggcauc

SEQ ID NO: 3269421 - RNA, 15 nt, Mycobacterium tuberculosis H37Rv
aagcauucaggccga

SEQ ID NO: 3269422 - RNA, 15 nt, Mycobacterium tuberculosis H37Rv
aagccacucaucuuc

SEQ ID NO: 3269423 - RNA, 20 nt, Mycobacterium tuberculosis H37Rv
aagccagaucgcuaggaccg

SEQ ID NO: 3269424 - RNA, 15 nt, Mycobacterium tuberculosis H37Rv
aagccagcacugcca

SEQ ID NO: 3269425 - RNA, 17 nt, Mycobacterium tuberculosis H37Rv
aagccagcaucggcagc

SEQ ID NO: 3269426 - RNA, 16 nt, Mycobacterium tuberculosis H37Rv
aagccagcgcagccag

SEQ ID NO: 3269427 - RNA, 12 nt, Mycobacterium tuberculosis H37Rv
aagcccaacagc

SEQ ID NO: 3269428 - RNA, 20 nt, Mycobacterium tuberculosis H37Rv
aagcccagcgauucagccug

SEQ ID NO: 3269429 - RNA, 18 nt, Mycobacterium tuberculosis H37Rv
aagcccauccccgcucga

SEQ ID NO: 3269430 - RNA, 15 nt, Mycobacterium tuberculosis H37Rv
aagcccccgcacgca

SEQ ID NO: 3269431 - RNA, 20 nt, Mycobacterium tuberculosis H37Rv
aagcccccgcacgcucggcg

SEQ ID NO: 3269432 - RNA, 12 nt, Mycobacterium tuberculosis H37Rv
aagcccgagacg

SEQ ID NO: 3269433 - RNA, 16 nt, Mycobacterium tuberculosis H37Rv
aagcccgagacggugu

SEQ ID NO: 3269434 - RNA, 14 nt, Mycobacterium tuberculosis H37Rv
aagcccuccucgau

SEQ ID NO: 3269435 - RNA, 20 nt, Mycobacterium tuberculosis H37Rv
aagccgaacaccgucagcgu

SEQ ID NO: 3269436 - RNA, 14 nt, Mycobacterium tuberculosis H37Rv
aagccgacgaccag

SEQ ID NO: 3269437 - RNA, 16 nt, Mycobacterium tuberculosis H37Rv
aagccgacgaccagca

SEQ ID NO: 3269438 - RNA, 19 nt, Mycobacterium tuberculosis H37Rv
aagccgacgaccagcagau

SEQ ID NO: 3269439 - RNA, 18 nt, Mycobacterium tuberculosis H37Rv
aagccgacguugaagccg

SEQ ID NO: 3269440 - RNA, 14 nt, Mycobacterium tuberculosis H37Rv
aagccgagcaucag

SEQ ID NO: 3269441 - RNA, 16 nt, Mycobacterium tuberculosis H37Rv
aagccgagcaucagau

SEQ ID NO: 3269442 - RNA, 14 nt, Mycobacterium tuberculosis H37Rv
aagccgcaccagau

SEQ ID NO: 3269443 - RNA, 16 nt, Mycobacterium tuberculosis H37Rv
aagccgcaccagaucg

SEQ ID NO: 3269444 - RNA, 15 nt, Mycobacterium tuberculosis H37Rv
aagccgcaccgcugu

SEQ ID NO: 3269445 - RNA, 18 nt, Mycobacterium tuberculosis H37Rv
aagccgcccgaguugugg

SEQ ID NO: 3269446 - RNA, 14 nt, Mycobacterium tuberculosis H37Rv
aagccgcgcugcga

SEQ ID NO: 3269447 - RNA, 22 nt, Mycobacterium tuberculosis H37Rv
aagccgcggcuaggccagcacg

SEQ ID NO: 3269448 - RNA, 14 nt, Mycobacterium tuberculosis H37Rv
aagccggccacgca

SEQ ID NO: 3269449 - RNA, 21 nt, Mycobacterium tuberculosis H37Rv
aagccggcugcauccuccucg

SEQ ID NO: 3269450 - RNA, 16 nt, Mycobacterium tuberculosis H37Rv
aagccgggucuguugg

SEQ ID NO: 3269451 - RNA, 21 nt, Mycobacterium tuberculosis H37Rv
aagccguaguaguggccgcca

SEQ ID NO: 3269452 - RNA, 14 nt, Mycobacterium tuberculosis H37Rv
aagccgucagcuca

SEQ ID NO: 3269453 - RNA, 17 nt, Mycobacterium tuberculosis H37Rv
aagccgugccgcacagc

SEQ ID NO: 3269454 - RNA, 17 nt, Mycobacterium tuberculosis H37Rv
aagccguuggcgacguu

SEQ ID NO: 3269455 - RNA, 14 nt, Mycobacterium tuberculosis H37Rv
aagccuggaaaacc

SEQ ID NO: 3269456 - RNA, 23 nt, Mycobacterium tuberculosis H37Rv
aagccugguuccugguagucgcc

SEQ ID NO: 3269457 - RNA, 20 nt, Mycobacterium tuberculosis H37Rv
aagccuuaccccgcagcuca

SEQ ID NO: 3269458 - RNA, 16 nt, Mycobacterium tuberculosis H37Rv
aagccuugccgucgag

SEQ ID NO: 3269459 - RNA, 13 nt, Mycobacterium tuberculosis H37Rv
aagcgaagccaga

SEQ ID NO: 3269460 - RNA, 15 nt, Mycobacterium tuberculosis H37Rv
aagcgacgagcagca

SEQ ID NO: 3269461 - RNA, 22 nt, Mycobacterium tuberculosis H37Rv
aagcgacgagcagcaauccaag

SEQ ID NO: 3269462 - RNA, 14 nt, Mycobacterium tuberculosis H37Rv
aagcgagcggucga

SEQ ID NO: 3269463 - RNA, 18 nt, Mycobacterium tuberculosis H37Rv
aagcgccgaaacagcacc

SEQ ID NO: 3269464 - RNA, 23 nt, Mycobacterium tuberculosis H37Rv
aagcgcgcgcgugaagaacacgu

SEQ ID NO: 3269465 - RNA, 17 nt, Mycobacterium tuberculosis H37Rv
aagcgcguuguugucga

SEQ ID NO: 3269466 - RNA, 23 nt, Mycobacterium tuberculosis H37Rv
aagcgcguuguugucgaucagaa

SEQ ID NO: 3269467 - RNA, 17 nt, Mycobacterium tuberculosis H37Rv
aagcggacccgaccguc

SEQ ID NO: 3269468 - RNA, 18 nt, Mycobacterium tuberculosis H37Rv
aagcggaucuggccuugg

SEQ ID NO: 3269469 - RNA, 13 nt, Mycobacterium tuberculosis H37Rv
aagcggccucgac

SEQ ID NO: 3269470 - RNA, 19 nt, Mycobacterium tuberculosis H37Rv
aagcggcugcccgagaucg

SEQ ID NO: 3269471 - RNA, 22 nt, Mycobacterium tuberculosis H37Rv
aagcggcugcccgagaucgcgu

SEQ ID NO: 3269472 - RNA, 17 nt, Mycobacterium tuberculosis H37Rv
aagcgggauugccgaga

SEQ ID NO: 3269473 - RNA, 13 nt, Mycobacterium tuberculosis H37Rv
aagcgggcgucgc

SEQ ID NO: 3269474 - RNA, 17 nt, Mycobacterium tuberculosis H37Rv
aagcguacucgugauga

SEQ ID NO: 3269475 - RNA, 23 nt, Mycobacterium tuberculosis H37Rv
aagcgucguugcucggucucguc

SEQ ID NO: 3269476 - RNA, 21 nt, Mycobacterium tuberculosis H37Rv
aagcguugcacugcugguuga

SEQ ID NO: 3269477 - RNA, 21 nt, Mycobacterium tuberculosis H37Rv
aagcuaccggcccgaugccga

SEQ ID NO: 3269478 - RNA, 17 nt, Mycobacterium tuberculosis H37Rv
aagcucacacuggcuuu

SEQ ID NO: 3269479 - RNA, 13 nt, Mycobacterium tuberculosis H37Rv
aagcucaucaccg

SEQ ID NO: 3269480 - RNA, 18 nt, Mycobacterium tuberculosis H37Rv
aagcucgcaaccgagaug

SEQ ID NO: 3269481 - RNA, 16 nt, Mycobacterium tuberculosis H37Rv
aagcucggccagcacg

SEQ ID NO: 3269482 - RNA, 14 nt, Mycobacterium tuberculosis H37Rv
aagcugaccgccag

SEQ ID NO: 3269483 - RNA, 14 nt, Mycobacterium tuberculosis H37Rv
aagcugcugcugcu

SEQ ID NO: 3269484 - RNA, 21 nt, Mycobacterium tuberculosis H37Rv
aagcugugccuucgccucguu

SEQ ID NO: 3269485 - RNA, 17 nt, Mycobacterium tuberculosis H37Rv
aagcuucggccuucuug

SEQ ID NO: 3269486 - RNA, 16 nt, Mycobacterium tuberculosis H37Rv
aagcuugggcgaucgu

SEQ ID NO: 3269487 - RNA, 14 nt, Mycobacterium tuberculosis H37Rv
aaggaaccgggcaa

SEQ ID NO: 3269488 - RNA, 20 nt, Mycobacterium tuberculosis H37Rv
aaggaaccgggcaaaucaag

SEQ ID NO: 3269489 - RNA, 13 nt, Mycobacterium tuberculosis H37Rv
aaggacgacaccg

SEQ ID NO: 3269490 - RNA, 17 nt, Mycobacterium tuberculosis H37Rv
aaggacggcagccacca

SEQ ID NO: 3269491 - RNA, 22 nt, Mycobacterium tuberculosis H37Rv
aaggacggcagccaccagcgac

SEQ ID NO: 3269492 - RNA, 15 nt, Mycobacterium tuberculosis H37Rv
aaggaucaacgugcg

SEQ ID NO: 3269493 - RNA, 16 nt, Mycobacterium tuberculosis H37Rv
aaucgcggagccagga

SEQ ID NO: 3269494 - RNA, 18 nt, Mycobacterium tuberculosis H37Rv
aaucgcggagccaggacg

SEQ ID NO: 3269495 - RNA, 23 nt, Mycobacterium tuberculosis H37Rv
aaucgcucugugucgccgaucac

SEQ ID NO: 3269496 - RNA, 20 nt, Mycobacterium tuberculosis H37Rv
aaucgcugaccgcguagacc

SEQ ID NO: 3269497 - RNA, 22 nt, Mycobacterium tuberculosis H37Rv
aaucgcugaccgcguagaccag

SEQ ID NO: 3269498 - RNA, 16 nt, Mycobacterium tuberculosis H37Rv
aaucggcaagacgcgg

SEQ ID NO: 3269499 - RNA, 12 nt, Mycobacterium tuberculosis H37Rv
aaucggcaccgu

SEQ ID NO: 3269500 - RNA, 18 nt, Mycobacterium tuberculosis H37Rv
aaucggcaggauucccuc

SEQ ID NO: 3269501 - RNA, 20 nt, Mycobacterium tuberculosis H37Rv
aaucggcaggauucccucga

SEQ ID NO: 3269502 - RNA, 16 nt, Mycobacterium tuberculosis H37Rv
aaucgggauagcccag

SEQ ID NO: 3269503 - RNA, 22 nt, Mycobacterium tuberculosis H37Rv
aaucgucggguaccagcaccga

SEQ ID NO: 3269504 - RNA, 13 nt, Mycobacterium tuberculosis H37Rv
aaucgugcgggua

SEQ ID NO: 3269505 - RNA, 16 nt, Mycobacterium tuberculosis H37Rv
aaucguuggccaugcc

SEQ ID NO: 3269506 - RNA, 19 nt, Mycobacterium tuberculosis H37Rv
aaucucccgaaucgugcgg

SEQ ID NO: 3269507 - RNA, 20 nt, Mycobacterium tuberculosis H37Rv
aaucucgguggugcgcucgc

SEQ ID NO: 3269508 - RNA, 15 nt, Mycobacterium tuberculosis H37Rv
aaugaaggcaccgaa

SEQ ID NO: 3269509 - RNA, 16 nt, Mycobacterium tuberculosis H37Rv
aaugaagugcaccgaa

SEQ ID NO: 3269510 - RNA, 14 nt, Mycobacterium tuberculosis H37Rv
aaugaccugcagcg

SEQ ID NO: 3269511 - RNA, 17 nt, Mycobacterium tuberculosis H37Rv
aaugacgauccagccca

SEQ ID NO: 3269512 - RNA, 16 nt, Mycobacterium tuberculosis H37Rv
aaugacucggccgcac

SEQ ID NO: 3269513 - RNA, 21 nt, Mycobacterium tuberculosis H37Rv
aaugacuugcgacccgucgaa

SEQ ID NO: 3269514 - RNA, 14 nt, Mycobacterium tuberculosis H37Rv
aaugccagcggcac

SEQ ID NO: 3269515 - RNA, 19 nt, Mycobacterium tuberculosis H37Rv
aaugcccuuggccagcagg

SEQ ID NO: 3269516 - RNA, 18 nt, Mycobacterium tuberculosis H37Rv
aaugccgggcccgacguu

SEQ ID NO: 3269517 - RNA, 12 nt, Mycobacterium tuberculosis H37Rv
aaugccuggccc

SEQ ID NO: 3269518 - RNA, 19 nt, Mycobacterium tuberculosis H37Rv
aaugcgaugcggucgucac

SEQ ID NO: 3269519 - RNA, 13 nt, Mycobacterium tuberculosis H37Rv
aaugcgcgcuggg

SEQ ID NO: 3269520 - RNA, 19 nt, Mycobacterium tuberculosis H37Rv
aaugcgcuggcgccgccgg

SEQ ID NO: 3269521 - RNA, 16 nt, Mycobacterium tuberculosis H37Rv
aaugcgcugucgcccu

SEQ ID NO: 3269522 - RNA, 22 nt, Mycobacterium tuberculosis H37Rv
aaugcgcugucgcccucgaucg

SEQ ID NO: 3269523 - RNA, 12 nt, Mycobacterium tuberculosis H37Rv
aaugcugcugca

SEQ ID NO: 3269524 - RNA, 15 nt, Mycobacterium tuberculosis H37Rv
aaugcugcugcagca

SEQ ID NO: 3269525 - RNA, 23 nt, Mycobacterium tuberculosis H37Rv
aaugcuguggcccgucauacucg

SEQ ID NO: 3269526 - RNA, 13 nt, Mycobacterium tuberculosis H37Rv
aauggaaugaucg

SEQ ID NO: 3269527 - RNA, 15 nt, Mycobacterium tuberculosis H37Rv
aauggacugaacacc

SEQ ID NO: 3269528 - RNA, 16 nt, Mycobacterium tuberculosis H37Rv
aauggacugaacacca

SEQ ID NO: 3269529 - RNA, 15 nt, Mycobacterium tuberculosis H37Rv
aauggcaacacaccg

SEQ ID NO: 3269530 - RNA, 12 nt, Mycobacterium tuberculosis H37Rv
aauggcaccgag

SEQ ID NO: 3269531 - RNA, 15 nt, Mycobacterium tuberculosis H37Rv
aauggccgaaccguu

SEQ ID NO: 3269532 - RNA, 22 nt, Mycobacterium tuberculosis H37Rv
aauggcgccuuggguuccgugg

SEQ ID NO: 3269533 - RNA, 19 nt, Mycobacterium tuberculosis H37Rv
aauggcggccuugcucagc

SEQ ID NO: 3269534 - RNA, 21 nt, Mycobacterium tuberculosis H37Rv
aauggcugagcccgccgcgac

SEQ ID NO: 3269535 - RNA, 22 nt, Mycobacterium tuberculosis H37Rv
aaugggaccgggcguuucccug

SEQ ID NO: 3269536 - RNA, 15 nt, Mycobacterium tuberculosis H37Rv
aaugggcgccacagc

SEQ ID NO: 3269537 - RNA, 16 nt, Mycobacterium tuberculosis H37Rv
aaugggcgccacagcc

SEQ ID NO: 3269538 - RNA, 22 nt, Mycobacterium tuberculosis H37Rv
aauggucgucgcgaucagaaac

SEQ ID NO: 3269539 - RNA, 16 nt, Mycobacterium tuberculosis H37Rv
aauguauugcggugag

SEQ ID NO: 3269540 - RNA, 20 nt, Mycobacterium tuberculosis H37Rv
aaugucagugccccgcccgg

SEQ ID NO: 3269541 - RNA, 18 nt, Mycobacterium tuberculosis H37Rv
aaugucgauuucgaugac

SEQ ID NO: 3269542 - RNA, 23 nt, Mycobacterium tuberculosis H37Rv
aaugucggcgaugcguccgccca

SEQ ID NO: 3269543 - RNA, 16 nt, Mycobacterium tuberculosis H37Rv
aauucaacagcaccgc

SEQ ID NO: 3269544 - RNA, 21 nt, Mycobacterium tuberculosis H37Rv
aauucacgacgccgagcagau

SEQ ID NO: 3269545 - RNA, 15 nt, Mycobacterium tuberculosis H37Rv
aauucacgcaccaca

SEQ ID NO: 3269546 - RNA, 13 nt, Mycobacterium tuberculosis H37Rv
aauuccagccagc

SEQ ID NO: 3269547 - RNA, 14 nt, Mycobacterium tuberculosis H37Rv
aauuccagccagcc

SEQ ID NO: 3269548 - RNA, 18 nt, Mycobacterium tuberculosis H37Rv
aauuccgcagagaccaag

SEQ ID NO: 3269549 - RNA, 11 nt, Mycobacterium tuberculosis H37Rv
aauuccgcgag

SEQ ID NO: 3269550 - RNA, 18 nt, Mycobacterium tuberculosis H37Rv
aauuccggcucaccgauc

SEQ ID NO: 3269551 - RNA, 16 nt, Mycobacterium tuberculosis H37Rv
aauuccguuaggcucc

SEQ ID NO: 3269552 - RNA, 18 nt, Mycobacterium tuberculosis H37Rv
aauuccuacgccgccagc

SEQ ID NO: 3269553 - RNA, 22 nt, Mycobacterium tuberculosis H37Rv
aauuccucggauaacgucacac

SEQ ID NO: 3269554 - RNA, 21 nt, Mycobacterium tuberculosis H37Rv
aauucgaccgcgcggaucuca

SEQ ID NO: 3269555 - RNA, 23 nt, Mycobacterium tuberculosis H37Rv
aauucgccaaggccgucgaccca

SEQ ID NO: 3269556 - RNA, 21 nt, Mycobacterium tuberculosis H37Rv
aauucgggcauggucgccgga

SEQ ID NO: 3269557 - RNA, 21 nt, Mycobacterium tuberculosis H37Rv
aauucguacagugucugccau

SEQ ID NO: 3269558 - RNA, 19 nt, Mycobacterium tuberculosis H37Rv
aauucguagggaugcggcc

SEQ ID NO: 3269559 - RNA, 17 nt, Mycobacterium tuberculosis H37Rv
aauucucgcccugacgu

SEQ ID NO: 3269560 - RNA, 21 nt, Mycobacterium tuberculosis H37Rv
aauugagccggcccugcucgc

SEQ ID NO: 3269561 - RNA, 16 nt, Mycobacterium tuberculosis H37Rv
aauugaugaucugcag

SEQ ID NO: 3269562 - RNA, 16 nt, Mycobacterium tuberculosis H37Rv
aauugcaacagagcgc

SEQ ID NO: 3269563 - RNA, 22 nt, Mycobacterium tuberculosis H37Rv
aauugcguucgccgcccggcgu

SEQ ID NO: 3269564 - RNA, 19 nt, Mycobacterium tuberculosis H37Rv
aauuggucgaacagcgaac

SEQ ID NO: 3269565 - RNA, 18 nt, Mycobacterium tuberculosis H37Rv
aauugugugcagcagcau

SEQ ID NO: 3269566 - RNA, 17 nt, Mycobacterium tuberculosis H37Rv
aauuucacugcgagcgc

SEQ ID NO: 3269567 - RNA, 17 nt, Mycobacterium tuberculosis H37Rv
aauuucgauuucccaug

SEQ ID NO: 3269568 - RNA, 11 nt, Mycobacterium tuberculosis H37Rv
aauuugacgac

SEQ ID NO: 3269569 - RNA, 14 nt, Mycobacterium tuberculosis H37Rv
aauuuggugaagug

SEQ ID NO: 3269570 - RNA, 20 nt, Mycobacterium tuberculosis H37Rv
aauuuugcgccgacaccggg

SEQ ID NO: 3269571 - RNA, 12 nt, Mycobacterium tuberculosis H37Rv
acaaaaucagca

SEQ ID NO: 3269572 - RNA, 14 nt, Mycobacterium tuberculosis H37Rv
acaaaaucagcagc

SEQ ID NO: 3269573 - RNA, 16 nt, Mycobacterium tuberculosis H37Rv
acaaacaccccacaca

SEQ ID NO: 3269574 - RNA, 13 nt, Mycobacterium tuberculosis H37Rv
acaaacagcgcca

SEQ ID NO: 3269575 - RNA, 13 nt, Mycobacterium tuberculosis H37Rv
acaaacaucgcac

SEQ ID NO: 3269576 - RNA, 15 nt, Mycobacterium tuberculosis H37Rv
acaaacccgaugacu

SEQ ID NO: 3269577 - RNA, 21 nt, Mycobacterium tuberculosis H37Rv
acaaaccgucggggaugccga

SEQ ID NO: 3269578 - RNA, 17 nt, Mycobacterium tuberculosis H37Rv
acaaaccugcaugccca

SEQ ID NO: 3269579 - RNA, 16 nt, Mycobacterium tuberculosis H37Rv
acaaacguguugaccg

SEQ ID NO: 3269580 - RNA, 15 nt, Mycobacterium tuberculosis H37Rv
acaaacuccgacacc

SEQ ID NO: 3269581 - RNA, 14 nt, Mycobacterium tuberculosis H37Rv
acaaagcugcucgu

SEQ ID NO: 3269582 - RNA, 21 nt, Mycobacterium tuberculosis H37Rv
acaaagcugcucgucggcgcc

SEQ ID NO: 3269583 - RNA, 14 nt, Mycobacterium tuberculosis H37Rv
acaaaggugccgac

SEQ ID NO: 3269584 - RNA, 20 nt, Mycobacterium tuberculosis H37Rv
acaaaucggccaucaugagc

SEQ ID NO: 3269585 - RNA, 21 nt, Mycobacterium tuberculosis H37Rv
acaacagccgcucgcacagcc

SEQ ID NO: 3269586 - RNA, 14 nt, Mycobacterium tuberculosis H37Rv
acaacagcgcucca

SEQ ID NO: 3269587 - RNA, 10 nt, Mycobacterium tuberculosis H37Rv
acaacaugcu

SEQ ID NO: 3269588 - RNA, 14 nt, Mycobacterium tuberculosis H37Rv
acaaccacccaccc

SEQ ID NO: 3269589 - RNA, 13 nt, Mycobacterium tuberculosis H37Rv
acaccgcccggcc

SEQ ID NO: 3269590 - RNA, 19 nt, Mycobacterium tuberculosis H37Rv
acaccgccgaccuagucac

SEQ ID NO: 3269591 - RNA, 22 nt, Mycobacterium tuberculosis H37Rv
acaccgccgccaagcucggcca

SEQ ID NO: 3269592 - RNA, 15 nt, Mycobacterium tuberculosis H37Rv
acaccgccgcgucga

SEQ ID NO: 3269593 - RNA, 17 nt, Mycobacterium tuberculosis H37Rv
acaccgcgcccgccgau

SEQ ID NO: 3269594 - RNA, 20 nt, Mycobacterium tuberculosis H37Rv
acaccgcgcccgccgauccu

SEQ ID NO: 3269595 - RNA, 21 nt, Mycobacterium tuberculosis H37Rv
acaccgcgccgacgaaaucgu

SEQ ID NO: 3269596 - RNA, 22 nt, Mycobacterium tuberculosis H37Rv
acaccgcggacccgcagcugcg

SEQ ID NO: 3269597 - RNA, 21 nt, Mycobacterium tuberculosis H37Rv
acaccggccagcggcccguca

SEQ ID NO: 3269598 - RNA, 17 nt, Mycobacterium tuberculosis H37Rv
acaccggcuuugcuugc

SEQ ID NO: 3269599 - RNA, 22 nt, Mycobacterium tuberculosis H37Rv
acaccggggacgucgacuucgc

SEQ ID NO: 3269600 - RNA, 17 nt, Mycobacterium tuberculosis H37Rv
acaccggucggcagcuu

SEQ ID NO: 3269601 - RNA, 12 nt, Mycobacterium tuberculosis H37Rv
acaccgucagcg

SEQ ID NO: 3269602 - RNA, 16 nt, Mycobacterium tuberculosis H37Rv
acaccguccagcagcu

SEQ ID NO: 3269603 - RNA, 19 nt, Mycobacterium tuberculosis H37Rv
acaccguccagcagcucgg

SEQ ID NO: 3269604 - RNA, 18 nt, Mycobacterium tuberculosis H37Rv
acaccgucggcagcagcg

SEQ ID NO: 3269605 - RNA, 18 nt, Mycobacterium tuberculosis H37Rv
acaccgugaccagccggu

SEQ ID NO: 3269606 - RNA, 13 nt, Mycobacterium tuberculosis H37Rv
acaccgugaccgc

SEQ ID NO: 3269607 - RNA, 19 nt, Mycobacterium tuberculosis H37Rv
acaccgugaccgccgcgcc

SEQ ID NO: 3269608 - RNA, 18 nt, Mycobacterium tuberculosis H37Rv
acaccgugcaccagcuca

SEQ ID NO: 3269609 - RNA, 19 nt, Mycobacterium tuberculosis H37Rv
acaccgugcaccagcucac

SEQ ID NO: 3269610 - RNA, 16 nt, Mycobacterium tuberculosis H37Rv
acaccgugucgccggc

SEQ ID NO: 3269611 - RNA, 18 nt, Mycobacterium tuberculosis H37Rv
acaccgugucgccggcga

SEQ ID NO: 3269612 - RNA, 17 nt, Mycobacterium tuberculosis H37Rv
acaccucauacgccaau

SEQ ID NO: 3269613 - RNA, 19 nt, Mycobacterium tuberculosis H37Rv
acaccuccgucagcgccgc

SEQ ID NO: 3269614 - RNA, 13 nt, Mycobacterium tuberculosis H37Rv
acaccuccucgac

SEQ ID NO: 3269615 - RNA, 21 nt, Mycobacterium tuberculosis H37Rv
acaccuccucgaccguggcgg

SEQ ID NO: 3269616 - RNA, 14 nt, Mycobacterium tuberculosis H37Rv
acaccuccucgagc

SEQ ID NO: 3269617 - RNA, 19 nt, Mycobacterium tuberculosis H37Rv
acaccucgaaggcacugcg

SEQ ID NO: 3269618 - RNA, 18 nt, Mycobacterium tuberculosis H37Rv
acaccucgggguuacguu

SEQ ID NO: 3269619 - RNA, 22 nt, Mycobacterium tuberculosis H37Rv
acaccugcgcggcgugcgcggu

SEQ ID NO: 3269620 - RNA, 12 nt, Mycobacterium tuberculosis H37Rv
acaccugcggcu

SEQ ID NO: 3269621 - RNA, 23 nt, Mycobacterium tuberculosis H37Rv
acaccuguaguucgaugacugaa

SEQ ID NO: 3269622 - RNA, 24 nt, Mycobacterium tuberculosis H37Rv
acaccuucggcugguagggcggaa

SEQ ID NO: 3269623 - RNA, 14 nt, Mycobacterium tuberculosis H37Rv
acaccuuucuccac

SEQ ID NO: 3269624 - RNA, 13 nt, Mycobacterium tuberculosis H37Rv
acacgaacgcugc

SEQ ID NO: 3269625 - RNA, 13 nt, Mycobacterium tuberculosis H37Rv
acacgaccucuug

SEQ ID NO: 3269626 - RNA, 15 nt, Mycobacterium tuberculosis H37Rv
acacgacgucaucgu

SEQ ID NO: 3269627 - RNA, 14 nt, Mycobacterium tuberculosis H37Rv
acacgaugcccggc

SEQ ID NO: 3269628 - RNA, 15 nt, Mycobacterium tuberculosis H37Rv
acacgcccgcgagcu

SEQ ID NO: 3269629 - RNA, 20 nt, Mycobacterium tuberculosis H37Rv
acacgcccuaacccugcccu

SEQ ID NO: 3269630 - RNA, 15 nt, Mycobacterium tuberculosis H37Rv
acacgcccucgacgc

SEQ ID NO: 3269631 - RNA, 18 nt, Mycobacterium tuberculosis H37Rv
acacgccgaacgugcaac

SEQ ID NO: 3269632 - RNA, 21 nt, Mycobacterium tuberculosis H37Rv
acacgccggcccggugaugaa

SEQ ID NO: 3269633 - RNA, 12 nt, Mycobacterium tuberculosis H37Rv
acacgccgucga

SEQ ID NO: 3269634 - RNA, 21 nt, Mycobacterium tuberculosis H37Rv
acacgcuguacaagcauuggc

SEQ ID NO: 3269635 - RNA, 18 nt, Mycobacterium tuberculosis H37Rv
acacggauacccuuugca

SEQ ID NO: 3269636 - RNA, 12 nt, Mycobacterium tuberculosis H37Rv
acacggcagcug

SEQ ID NO: 3269637 - RNA, 19 nt, Mycobacterium tuberculosis H37Rv
acacggcgacauacccgau

SEQ ID NO: 3269638 - RNA, 17 nt, Mycobacterium tuberculosis H37Rv
acacggcggcccgcucg

SEQ ID NO: 3269639 - RNA, 23 nt, Mycobacterium tuberculosis H37Rv
acacggcgucuuccucggccacc

SEQ ID NO: 3269640 - RNA, 18 nt, Mycobacterium tuberculosis H37Rv
acacggcucgccggcucg

SEQ ID NO: 3269641 - RNA, 17 nt, Mycobacterium tuberculosis H37Rv
acacggucgucgcgagc

SEQ ID NO: 3269642 - RNA, 17 nt, Mycobacterium tuberculosis H37Rv
acacggugcugccguug

SEQ ID NO: 3269643 - RNA, 14 nt, Mycobacterium tuberculosis H37Rv
acacguaccgacag

SEQ ID NO: 3269644 - RNA, 13 nt, Mycobacterium tuberculosis H37Rv
acacguccagugg

SEQ ID NO: 3269645 - RNA, 13 nt, Mycobacterium tuberculosis H37Rv
acacgucgagcag

SEQ ID NO: 3269646 - RNA, 20 nt, Mycobacterium tuberculosis H37Rv
acacgucgcgguaggcggga

SEQ ID NO: 3269647 - RNA, 14 nt, Mycobacterium tuberculosis H37Rv
acacguucggcguc

SEQ ID NO: 3269648 - RNA, 20 nt, Mycobacterium tuberculosis H37Rv
acacguucucaccaccagag

SEQ ID NO: 3269649 - RNA, 21 nt, Mycobacterium tuberculosis H37Rv
acacguugccgaucccggcga

SEQ ID NO: 3269650 - RNA, 19 nt, Mycobacterium tuberculosis H37Rv
acacuccugagaugcggcc

SEQ ID NO: 3269651 - RNA, 17 nt, Mycobacterium tuberculosis H37Rv
acacuccugcacacagg

SEQ ID NO: 3269652 - RNA, 12 nt, Mycobacterium tuberculosis H37Rv
acacucgcagca

SEQ ID NO: 3269653 - RNA, 19 nt, Mycobacterium tuberculosis H37Rv
acacugaguucggugcugu

SEQ ID NO: 3269654 - RNA, 18 nt, Mycobacterium tuberculosis H37Rv
acacugguggugcccgga

SEQ ID NO: 3269655 - RNA, 16 nt, Mycobacterium tuberculosis H37Rv
acacuguucccacagg

SEQ ID NO: 3269656 - RNA, 23 nt, Mycobacterium tuberculosis H37Rv
acagacaucgcgacgaucgucca

SEQ ID NO: 3269657 - RNA, 19 nt, Mycobacterium tuberculosis H37Rv
acagacccccagacaaaga

SEQ ID NO: 3269658 - RNA, 18 nt, Mycobacterium tuberculosis H37Rv
acagaccgggcaccagaa

SEQ ID NO: 3269659 - RNA, 15 nt, Mycobacterium tuberculosis H37Rv
acagaccuagcaccg

SEQ ID NO: 3269660 - RNA, 16 nt, Mycobacterium tuberculosis H37Rv
acagacgcaauagcca

SEQ ID NO: 3269661 - RNA, 18 nt, Mycobacterium tuberculosis H37Rv
acagacggcucagcgugc

SEQ ID NO: 3269662 - RNA, 15 nt, Mycobacterium tuberculosis H37Rv
acagagucaccgcgc

SEQ ID NO: 3269663 - RNA, 21 nt, Mycobacterium tuberculosis H37Rv
acagaucgagggggacgcuga

SEQ ID NO: 3269664 - RNA, 18 nt, Mycobacterium tuberculosis H37Rv
acagaucuggguucccga

SEQ ID NO: 3269665 - RNA, 18 nt, Mycobacterium tuberculosis H37Rv
acagaucuugugccaggc

SEQ ID NO: 3269666 - RNA, 19 nt, Mycobacterium tuberculosis H37Rv
acagaugcauccagcugcu

SEQ ID NO: 3269667 - RNA, 20 nt, Mycobacterium tuberculosis H37Rv
acagaugcauccagcugcug

SEQ ID NO: 3269668 - RNA, 13 nt, Mycobacterium tuberculosis H37Rv
acagauggcggcc

SEQ ID NO: 3269669 - RNA, 19 nt, Mycobacterium tuberculosis H37Rv
acagaugugguaccagccc

SEQ ID NO: 3269670 - RNA, 22 nt, Mycobacterium tuberculosis H37Rv
acagauucggugccagcaggcc

SEQ ID NO: 3269671 - RNA, 13 nt, Mycobacterium tuberculosis H37Rv
acagcaacgccca

SEQ ID NO: 3269672 - RNA, 14 nt, Mycobacterium tuberculosis H37Rv
acagcaauccgcaa

SEQ ID NO: 3269673 - RNA, 20 nt, Mycobacterium tuberculosis H37Rv
acagcaauuugccguagaaa

SEQ ID NO: 3269674 - RNA, 22 nt, Mycobacterium tuberculosis H37Rv
acagcacagcgcagccugcagc

SEQ ID NO: 3269675 - RNA, 18 nt, Mycobacterium tuberculosis H37Rv
acagcacauccagcccug

SEQ ID NO: 3269676 - RNA, 21 nt, Mycobacterium tuberculosis H37Rv
acagcaccacgugcgagggca

SEQ ID NO: 3269677 - RNA, 15 nt, Mycobacterium tuberculosis H37Rv
acagcaccguccucg

SEQ ID NO: 3269678 - RNA, 17 nt, Mycobacterium tuberculosis H37Rv
acagcaccguccucggu

SEQ ID NO: 3269679 - RNA, 21 nt, Mycobacterium tuberculosis H37Rv
acagcacgacugcggcaaacg

SEQ ID NO: 3269680 - RNA, 15 nt, Mycobacterium tuberculosis H37Rv
acagcagcccgcccu

SEQ ID NO: 3269681 - RNA, 14 nt, Mycobacterium tuberculosis H37Rv
acagcagcgcgaca

SEQ ID NO: 3269682 - RNA, 15 nt, Mycobacterium tuberculosis H37Rv
acagcagcgucauca

SEQ ID NO: 3269683 - RNA, 15 nt, Mycobacterium tuberculosis H37Rv
acagcaggcauuccc

SEQ ID NO: 3269684 - RNA, 16 nt, Mycobacterium tuberculosis H37Rv
acagcagguugccgaa

SEQ ID NO: 3269685 - RNA, 16 nt, Mycobacterium tuberculosis H37Rv
acaguggucccgguga

SEQ ID NO: 3269686 - RNA, 19 nt, Mycobacterium tuberculosis H37Rv
acagugugaagaccaccgc

SEQ ID NO: 3269687 - RNA, 14 nt, Mycobacterium tuberculosis H37Rv
acaguguuguucgg

SEQ ID NO: 3269688 - RNA, 14 nt, Mycobacterium tuberculosis H37Rv
acaguucugccuua

SEQ ID NO: 3269689 - RNA, 23 nt, Mycobacterium tuberculosis H37Rv
acauacaccggccgguccacggu

SEQ ID NO: 3269690 - RNA, 21 nt, Mycobacterium tuberculosis H37Rv
acauaccccgaacauugcgcc

SEQ ID NO: 3269691 - RNA, 16 nt, Mycobacterium tuberculosis H37Rv
acauacgaaacaugcg

SEQ ID NO: 3269692 - RNA, 17 nt, Mycobacterium tuberculosis H37Rv
acauagccggucauuuc

SEQ ID NO: 3269693 - RNA, 19 nt, Mycobacterium tuberculosis H37Rv
acauagcgauucgcgcugc

SEQ ID NO: 3269694 - RNA, 20 nt, Mycobacterium tuberculosis H37Rv
acauagcgauucgcgcugcu

SEQ ID NO: 3269695 - RNA, 14 nt, Mycobacterium tuberculosis H37Rv
acauaggccaccuc

SEQ ID NO: 3269696 - RNA, 13 nt, Mycobacterium tuberculosis H37Rv
acauaggcgaucg

SEQ ID NO: 3269697 - RNA, 20 nt, Mycobacterium tuberculosis H37Rv
acaucaaagucggcgucacg

SEQ ID NO: 3269698 - RNA, 21 nt, Mycobacterium tuberculosis H37Rv
acaucaccccgauggucgaga

SEQ ID NO: 3269699 - RNA, 14 nt, Mycobacterium tuberculosis H37Rv
acaucacucgcgcc

SEQ ID NO: 3269700 - RNA, 15 nt, Mycobacterium tuberculosis H37Rv
acaucagcaggacca

SEQ ID NO: 3269701 - RNA, 22 nt, Mycobacterium tuberculosis H37Rv
acaucauggugaaggcaaacac

SEQ ID NO: 3269702 - RNA, 13 nt, Mycobacterium tuberculosis H37Rv
acauccacaccgc

SEQ ID NO: 3269703 - RNA, 23 nt, Mycobacterium tuberculosis H37Rv
acauccagggccgagcagcuccu

SEQ ID NO: 3269704 - RNA, 18 nt, Mycobacterium tuberculosis H37Rv
acaucccagcgaaugcug

SEQ ID NO: 3269705 - RNA, 19 nt, Mycobacterium tuberculosis H37Rv
acaucccccggcuggucac

SEQ ID NO: 3269706 - RNA, 13 nt, Mycobacterium tuberculosis H37Rv
acauccgcacugg

SEQ ID NO: 3269707 - RNA, 13 nt, Mycobacterium tuberculosis H37Rv
acauccugcagcu

SEQ ID NO: 3269708 - RNA, 16 nt, Mycobacterium tuberculosis H37Rv
acauccugcagcucgg

SEQ ID NO: 3269709 - RNA, 15 nt, Mycobacterium tuberculosis H37Rv
acauccuggcggcug

SEQ ID NO: 3269710 - RNA, 22 nt, Mycobacterium tuberculosis H37Rv
acauccuucaucccccaaauca

SEQ ID NO: 3269711 - RNA, 16 nt, Mycobacterium tuberculosis H37Rv
acauccuugacgcggc

SEQ ID NO: 3269712 - RNA, 17 nt, Mycobacterium tuberculosis H37Rv
acaucgaaaaccgaggc

SEQ ID NO: 3269713 - RNA, 20 nt, Mycobacterium tuberculosis H37Rv
acaucgaauaugacugcgcu

SEQ ID NO: 3269714 - RNA, 14 nt, Mycobacterium tuberculosis H37Rv
acaucgaccaccuc

SEQ ID NO: 3269715 - RNA, 18 nt, Mycobacterium tuberculosis H37Rv
acaucgaccaccucgaug

SEQ ID NO: 3269716 - RNA, 23 nt, Mycobacterium tuberculosis H37Rv
acaucgagccaacgcgcagagcg

SEQ ID NO: 3269717 - RNA, 19 nt, Mycobacterium tuberculosis H37Rv
acaucgaggccacgccagc

SEQ ID NO: 3269718 - RNA, 23 nt, Mycobacterium tuberculosis H37Rv
acaucgaugucagugaucaccaa

SEQ ID NO: 3269719 - RNA, 16 nt, Mycobacterium tuberculosis H37Rv
acaucgaugucggcuc

SEQ ID NO: 3269720 - RNA, 19 nt, Mycobacterium tuberculosis H37Rv
acaucgcacaacugcgcca

SEQ ID NO: 3269721 - RNA, 22 nt, Mycobacterium tuberculosis H37Rv
acaucgcaggcaccccgaucac

SEQ ID NO: 3269722 - RNA, 11 nt, Mycobacterium tuberculosis H37Rv
acaucgccagc

SEQ ID NO: 3269723 - RNA, 21 nt, Mycobacterium tuberculosis H37Rv
acaucgcgaaaccggaccuga

SEQ ID NO: 3269724 - RNA, 18 nt, Mycobacterium tuberculosis H37Rv
acaucgcgaggcgucacc

SEQ ID NO: 3269725 - RNA, 15 nt, Mycobacterium tuberculosis H37Rv
acaucggaacgugac

SEQ ID NO: 3269726 - RNA, 14 nt, Mycobacterium tuberculosis H37Rv
acaucggcggcguc

SEQ ID NO: 3269727 - RNA, 18 nt, Mycobacterium tuberculosis H37Rv
acaucgggaucugggcuc

SEQ ID NO: 3269728 - RNA, 16 nt, Mycobacterium tuberculosis H37Rv
acaucgggcgugguga

SEQ ID NO: 3269729 - RNA, 19 nt, Mycobacterium tuberculosis H37Rv
acaucggugguuagguggc

SEQ ID NO: 3269730 - RNA, 16 nt, Mycobacterium tuberculosis H37Rv
acaucgucaucgacga

SEQ ID NO: 3269731 - RNA, 20 nt, Mycobacterium tuberculosis H37Rv
acaucguucaugaucggcag

SEQ ID NO: 3269732 - RNA, 14 nt, Mycobacterium tuberculosis H37Rv
acaucguucugacg

SEQ ID NO: 3269733 - RNA, 17 nt, Mycobacterium tuberculosis H37Rv
acaucguucugacggcu

SEQ ID NO: 3269734 - RNA, 23 nt, Mycobacterium tuberculosis H37Rv
acaucuccgcgucggucagcugu

SEQ ID NO: 3269735 - RNA, 17 nt, Mycobacterium tuberculosis H37Rv
acaucugacagcugggu

SEQ ID NO: 3269736 - RNA, 17 nt, Mycobacterium tuberculosis H37Rv
acaucugcccaccgcag

SEQ ID NO: 3269737 - RNA, 15 nt, Mycobacterium tuberculosis H37Rv
acaucugccggucga

SEQ ID NO: 3269738 - RNA, 15 nt, Mycobacterium tuberculosis H37Rv
acaugaaccggucga

SEQ ID NO: 3269739 - RNA, 13 nt, Mycobacterium tuberculosis H37Rv
acaugaccgacag

SEQ ID NO: 3269740 - RNA, 18 nt, Mycobacterium tuberculosis H37Rv
acaugaccgacaggugcu

SEQ ID NO: 3269741 - RNA, 22 nt, Mycobacterium tuberculosis H37Rv
acaugaccugauccggccgguu

SEQ ID NO: 3269742 - RNA, 17 nt, Mycobacterium tuberculosis H37Rv
acaugauccgccggcaa

SEQ ID NO: 3269743 - RNA, 14 nt, Mycobacterium tuberculosis H37Rv
acaugaucgagcag

SEQ ID NO: 3269744 - RNA, 16 nt, Mycobacterium tuberculosis H37Rv
acaugcgcaccauggg

SEQ ID NO: 3269745 - RNA, 19 nt, Mycobacterium tuberculosis H37Rv
acaugcucagucgcucucg

SEQ ID NO: 3269746 - RNA, 12 nt, Mycobacterium tuberculosis H37Rv
acaugcuggaga

SEQ ID NO: 3269747 - RNA, 16 nt, Mycobacterium tuberculosis H37Rv
acaugcuggagaaacc

SEQ ID NO: 3269748 - RNA, 16 nt, Mycobacterium tuberculosis H37Rv
acauggccagcaucag

SEQ ID NO: 3269749 - RNA, 15 nt, Mycobacterium tuberculosis H37Rv
acauggcccggaggc

SEQ ID NO: 3269750 - RNA, 20 nt, Mycobacterium tuberculosis H37Rv
acaugguccgaccagcggcc

SEQ ID NO: 3269751 - RNA, 14 nt, Mycobacterium tuberculosis H37Rv
acaugucacaccca

SEQ ID NO: 3269752 - RNA, 20 nt, Mycobacterium tuberculosis H37Rv
acaugucuaucgugggggac

SEQ ID NO: 3269753 - RNA, 16 nt, Mycobacterium tuberculosis H37Rv
acaugugggugaacac

SEQ ID NO: 3269754 - RNA, 14 nt, Mycobacterium tuberculosis H37Rv
acaugugucacugu

SEQ ID NO: 3269755 - RNA, 15 nt, Mycobacterium tuberculosis H37Rv
acauguguggcagcc

SEQ ID NO: 3269756 - RNA, 21 nt, Mycobacterium tuberculosis H37Rv
acauucauccaccccugagcu

SEQ ID NO: 3269757 - RNA, 22 nt, Mycobacterium tuberculosis H37Rv
acauucauccaccccugagcuc

SEQ ID NO: 3269758 - RNA, 23 nt, Mycobacterium tuberculosis H37Rv
acauucccgaguugcccucuggc

SEQ ID NO: 3269759 - RNA, 23 nt, Mycobacterium tuberculosis H37Rv
acauucgggcgugcucgccgggu

SEQ ID NO: 3269760 - RNA, 19 nt, Mycobacterium tuberculosis H37Rv
acauucugcagcgucuccu

SEQ ID NO: 3269761 - RNA, 18 nt, Mycobacterium tuberculosis H37Rv
acauugaccaggugcccg

SEQ ID NO: 3269762 - RNA, 19 nt, Mycobacterium tuberculosis H37Rv
acauuggccaggucggcca

SEQ ID NO: 3269763 - RNA, 14 nt, Mycobacterium tuberculosis H37Rv
acauuggccgucau

SEQ ID NO: 3269764 - RNA, 21 nt, Mycobacterium tuberculosis H37Rv
acauuggccgucaucgccggg

SEQ ID NO: 3269765 - RNA, 21 nt, Mycobacterium tuberculosis H37Rv
acauuggugcugacauuucca

SEQ ID NO: 3269766 - RNA, 22 nt, Mycobacterium tuberculosis H37Rv
acauugguguggaauacgcugc

SEQ ID NO: 3269767 - RNA, 13 nt, Mycobacterium tuberculosis H37Rv
acauugugcucgc

SEQ ID NO: 3269768 - RNA, 23 nt, Mycobacterium tuberculosis H37Rv
acauuucuuugggcggcccaccg

SEQ ID NO: 3269769 - RNA, 22 nt, Mycobacterium tuberculosis H37Rv
accaaacccgaugguacucagg

SEQ ID NO: 3269770 - RNA, 13 nt, Mycobacterium tuberculosis H37Rv
accaaacgcugcu

SEQ ID NO: 3269771 - RNA, 18 nt, Mycobacterium tuberculosis H37Rv
accaaagcugucgaccgc

SEQ ID NO: 3269772 - RNA, 20 nt, Mycobacterium tuberculosis H37Rv
accaaagcugucgaccgcga

SEQ ID NO: 3269773 - RNA, 14 nt, Mycobacterium tuberculosis H37Rv
accaacaccgcccg

SEQ ID NO: 3269774 - RNA, 17 nt, Mycobacterium tuberculosis H37Rv
accaacaccgcccgcaa

SEQ ID NO: 3269775 - RNA, 20 nt, Mycobacterium tuberculosis H37Rv
accaacauguugucgucgcc

SEQ ID NO: 3269776 - RNA, 22 nt, Mycobacterium tuberculosis H37Rv
accaacauguugucgucgccgc

SEQ ID NO: 3269777 - RNA, 24 nt, Mycobacterium tuberculosis H37Rv
accaacccucgccggucagcgugc

SEQ ID NO: 3269778 - RNA, 21 nt, Mycobacterium tuberculosis H37Rv
accaaccgggacaaccccuug

SEQ ID NO: 3269779 - RNA, 15 nt, Mycobacterium tuberculosis H37Rv
accaaccgucgguga

SEQ ID NO: 3269780 - RNA, 16 nt, Mycobacterium tuberculosis H37Rv
accaaccgucggugaa

SEQ ID NO: 3269781 - RNA, 22 nt, Mycobacterium tuberculosis H37Rv
accaccucgaugccgccccgca

SEQ ID NO: 3269782 - RNA, 20 nt, Mycobacterium tuberculosis H37Rv
accaccucggugaccaggcc

SEQ ID NO: 3269783 - RNA, 14 nt, Mycobacterium tuberculosis H37Rv
accaccucgguuga

SEQ ID NO: 3269784 - RNA, 15 nt, Mycobacterium tuberculosis H37Rv
accaccucgugggcc

SEQ ID NO: 3269785 - RNA, 17 nt, Mycobacterium tuberculosis H37Rv
accaccucgugggccac

SEQ ID NO: 3269786 - RNA, 18 nt, Mycobacterium tuberculosis H37Rv
accaccuggugcaaccgu

SEQ ID NO: 3269787 - RNA, 22 nt, Mycobacterium tuberculosis H37Rv
accaccuguccgguggaaucca

SEQ ID NO: 3269788 - RNA, 16 nt, Mycobacterium tuberculosis H37Rv
accaccuuggaugccc

SEQ ID NO: 3269789 - RNA, 22 nt, Mycobacterium tuberculosis H37Rv
accacgacgucggugaacgcgu

SEQ ID NO: 3269790 - RNA, 13 nt, Mycobacterium tuberculosis H37Rv
accacgacgugga

SEQ ID NO: 3269791 - RNA, 21 nt, Mycobacterium tuberculosis H37Rv
accacgacguucgacgacagc

SEQ ID NO: 3269792 - RNA, 13 nt, Mycobacterium tuberculosis H37Rv
accacgagcagcc

SEQ ID NO: 3269793 - RNA, 14 nt, Mycobacterium tuberculosis H37Rv
accacgagcagccg

SEQ ID NO: 3269794 - RNA, 23 nt, Mycobacterium tuberculosis H37Rv
accacgagcguagcgaccucgcc

SEQ ID NO: 3269795 - RNA, 18 nt, Mycobacterium tuberculosis H37Rv
accacgaucgcagugggc

SEQ ID NO: 3269796 - RNA, 23 nt, Mycobacterium tuberculosis H37Rv
accacgaucgcgagcccauggac

SEQ ID NO: 3269797 - RNA, 21 nt, Mycobacterium tuberculosis H37Rv
accacgaugaccggggacagc

SEQ ID NO: 3269798 - RNA, 14 nt, Mycobacterium tuberculosis H37Rv
accacgcaccgccc

SEQ ID NO: 3269799 - RNA, 18 nt, Mycobacterium tuberculosis H37Rv
accacgcaccgccccgcc

SEQ ID NO: 3269800 - RNA, 20 nt, Mycobacterium tuberculosis H37Rv
accacgccaucgagcagcag

SEQ ID NO: 3269801 - RNA, 14 nt, Mycobacterium tuberculosis H37Rv
accacgccgucgac

SEQ ID NO: 3269802 - RNA, 22 nt, Mycobacterium tuberculosis H37Rv
accacgccguggcccgcucccu

SEQ ID NO: 3269803 - RNA, 15 nt, Mycobacterium tuberculosis H37Rv
accacgcgcccgcac

SEQ ID NO: 3269804 - RNA, 17 nt, Mycobacterium tuberculosis H37Rv
accacgcgcccgcacca

SEQ ID NO: 3269805 - RNA, 20 nt, Mycobacterium tuberculosis H37Rv
accacgcgcccgcaccaccg

SEQ ID NO: 3269806 - RNA, 21 nt, Mycobacterium tuberculosis H37Rv
accacgcgucgcuguuggcga

SEQ ID NO: 3269807 - RNA, 19 nt, Mycobacterium tuberculosis H37Rv
accacgcguuucgaaccgc

SEQ ID NO: 3269808 - RNA, 17 nt, Mycobacterium tuberculosis H37Rv
accacgcuggccucguc

SEQ ID NO: 3269809 - RNA, 13 nt, Mycobacterium tuberculosis H37Rv
accacgcugugcu

SEQ ID NO: 3269810 - RNA, 14 nt, Mycobacterium tuberculosis H37Rv
accacggcaccgau

SEQ ID NO: 3269811 - RNA, 18 nt, Mycobacterium tuberculosis H37Rv
accacggcagauugacgg

SEQ ID NO: 3269812 - RNA, 16 nt, Mycobacterium tuberculosis H37Rv
accacggccagcgggu

SEQ ID NO: 3269813 - RNA, 23 nt, Mycobacterium tuberculosis H37Rv
accacggcggcggcguagcagaa

SEQ ID NO: 3269814 - RNA, 23 nt, Mycobacterium tuberculosis H37Rv
accacgguagacaagucggcgcu

SEQ ID NO: 3269815 - RNA, 18 nt, Mycobacterium tuberculosis H37Rv
accacggucaagccggcg

SEQ ID NO: 3269816 - RNA, 22 nt, Mycobacterium tuberculosis H37Rv
accacggucagcacgcugacca

SEQ ID NO: 3269817 - RNA, 18 nt, Mycobacterium tuberculosis H37Rv
accacgucccggaaugag

SEQ ID NO: 3269818 - RNA, 16 nt, Mycobacterium tuberculosis H37Rv
accacgucgaccgaac

SEQ ID NO: 3269819 - RNA, 13 nt, Mycobacterium tuberculosis H37Rv
accacgucggcga

SEQ ID NO: 3269820 - RNA, 17 nt, Mycobacterium tuberculosis H37Rv
accacgugaucgacgac

SEQ ID NO: 3269821 - RNA, 22 nt, Mycobacterium tuberculosis H37Rv
accacguggcccuccucgguga

SEQ ID NO: 3269822 - RNA, 20 nt, Mycobacterium tuberculosis H37Rv
accacuagcggcucaccgcg

SEQ ID NO: 3269823 - RNA, 21 nt, Mycobacterium tuberculosis H37Rv
accacuagcggcucaccgcgc

SEQ ID NO: 3269824 - RNA, 20 nt, Mycobacterium tuberculosis H37Rv
accacuaguucgagcugcca

SEQ ID NO: 3269825 - RNA, 17 nt, Mycobacterium tuberculosis H37Rv
accacucggcggccacc

SEQ ID NO: 3269826 - RNA, 20 nt, Mycobacterium tuberculosis H37Rv
accacugaaccguucgaccc

SEQ ID NO: 3269827 - RNA, 14 nt, Mycobacterium tuberculosis H37Rv
accacugaucggca

SEQ ID NO: 3269828 - RNA, 22 nt, Mycobacterium tuberculosis H37Rv
accacugcaugaacugcucgcc

SEQ ID NO: 3269829 - RNA, 15 nt, Mycobacterium tuberculosis H37Rv
accacugcgcccgcc

SEQ ID NO: 3269830 - RNA, 12 nt, Mycobacterium tuberculosis H37Rv
accacugcggcc

SEQ ID NO: 3269831 - RNA, 16 nt, Mycobacterium tuberculosis H37Rv
accacuggauggcucg

SEQ ID NO: 3269832 - RNA, 18 nt, Mycobacterium tuberculosis H37Rv
accacuguuacggccaca

SEQ ID NO: 3269833 - RNA, 19 nt, Mycobacterium tuberculosis H37Rv
accacuguuggugccgcca

SEQ ID NO: 3269834 - RNA, 23 nt, Mycobacterium tuberculosis H37Rv
accacuguuggugccgccaccac

SEQ ID NO: 3269835 - RNA, 19 nt, Mycobacterium tuberculosis H37Rv
accacuucccgcuugagca

SEQ ID NO: 3269836 - RNA, 14 nt, Mycobacterium tuberculosis H37Rv
accacuucggcguc

SEQ ID NO: 3269837 - RNA, 17 nt, Mycobacterium tuberculosis H37Rv
accacuugcagcacaac

SEQ ID NO: 3269838 - RNA, 18 nt, Mycobacterium tuberculosis H37Rv
accacuugcagcacaacg

SEQ ID NO: 3269839 - RNA, 18 nt, Mycobacterium tuberculosis H37Rv
accacuuuccggccgaug

SEQ ID NO: 3269840 - RNA, 23 nt, Mycobacterium tuberculosis H37Rv
accagaacgacgccgcggucgug

SEQ ID NO: 3269841 - RNA, 13 nt, Mycobacterium tuberculosis H37Rv
accagaagcagug

SEQ ID NO: 3269842 - RNA, 22 nt, Mycobacterium tuberculosis H37Rv
accagacccacgauggcaaacg

SEQ ID NO: 3269843 - RNA, 19 nt, Mycobacterium tuberculosis H37Rv
accagacgaacgaccaggc

SEQ ID NO: 3269844 - RNA, 22 nt, Mycobacterium tuberculosis H37Rv
accagagcacgggcucgcugca

SEQ ID NO: 3269845 - RNA, 20 nt, Mycobacterium tuberculosis H37Rv
accagaggcgugucgacucc

SEQ ID NO: 3269846 - RNA, 14 nt, Mycobacterium tuberculosis H37Rv
accagaggucacgc

SEQ ID NO: 3269847 - RNA, 17 nt, Mycobacterium tuberculosis H37Rv
accagaggucacgcagc

SEQ ID NO: 3269848 - RNA, 21 nt, Mycobacterium tuberculosis H37Rv
accagaggucacgcagcaccc

SEQ ID NO: 3269849 - RNA, 22 nt, Mycobacterium tuberculosis H37Rv
accagauagaucgugaucgacc

SEQ ID NO: 3269850 - RNA, 20 nt, Mycobacterium tuberculosis H37Rv
accagaucaacaucaucacu

SEQ ID NO: 3269851 - RNA, 22 nt, Mycobacterium tuberculosis H37Rv
accagaucaacaucaucacugu

SEQ ID NO: 3269852 - RNA, 13 nt, Mycobacterium tuberculosis H37Rv
accagaucgacgc

SEQ ID NO: 3269853 - RNA, 18 nt, Mycobacterium tuberculosis H37Rv
accagaucuucgagcgca

SEQ ID NO: 3269854 - RNA, 20 nt, Mycobacterium tuberculosis H37Rv
accagauugccgagcccagg

SEQ ID NO: 3269855 - RNA, 21 nt, Mycobacterium tuberculosis H37Rv
accagcaaccaccccagggca

SEQ ID NO: 3269856 - RNA, 13 nt, Mycobacterium tuberculosis H37Rv
accagcacaccgg

SEQ ID NO: 3269857 - RNA, 14 nt, Mycobacterium tuberculosis H37Rv
accagcaccgccgc

SEQ ID NO: 3269858 - RNA, 17 nt, Mycobacterium tuberculosis H37Rv
accagcaccgccgcgcc

SEQ ID NO: 3269859 - RNA, 23 nt, Mycobacterium tuberculosis H37Rv
accagcacgacggcaucgucgac

SEQ ID NO: 3269860 - RNA, 14 nt, Mycobacterium tuberculosis H37Rv
accagcacggcaac

SEQ ID NO: 3269861 - RNA, 18 nt, Mycobacterium tuberculosis H37Rv
accagcacggcaaccagc

SEQ ID NO: 3269862 - RNA, 19 nt, Mycobacterium tuberculosis H37Rv
accagcagaccaagcccua

SEQ ID NO: 3269863 - RNA, 22 nt, Mycobacterium tuberculosis H37Rv
accagcagauccaggcgucggu

SEQ ID NO: 3269864 - RNA, 16 nt, Mycobacterium tuberculosis H37Rv
accagcagcaccaacu

SEQ ID NO: 3269865 - RNA, 15 nt, Mycobacterium tuberculosis H37Rv
accagcagccagccc

SEQ ID NO: 3269866 - RNA, 22 nt, Mycobacterium tuberculosis H37Rv
accagcagcucguugaugcggc

SEQ ID NO: 3269867 - RNA, 14 nt, Mycobacterium tuberculosis H37Rv
accagcaggcggcu

SEQ ID NO: 3269868 - RNA, 14 nt, Mycobacterium tuberculosis H37Rv
accagcaucguggc

SEQ ID NO: 3269869 - RNA, 14 nt, Mycobacterium tuberculosis H37Rv
accagcaucucggc

SEQ ID NO: 3269870 - RNA, 14 nt, Mycobacterium tuberculosis H37Rv
accagccaccacca

SEQ ID NO: 3269871 - RNA, 18 nt, Mycobacterium tuberculosis H37Rv
accagccaccaccagguc

SEQ ID NO: 3269872 - RNA, 11 nt, Mycobacterium tuberculosis H37Rv
accagccaccg

SEQ ID NO: 3269873 - RNA, 14 nt, Mycobacterium tuberculosis H37Rv
accagccagccugc

SEQ ID NO: 3269874 - RNA, 18 nt, Mycobacterium tuberculosis H37Rv
accagccaggugauuacc

SEQ ID NO: 3269875 - RNA, 14 nt, Mycobacterium tuberculosis H37Rv
accagcccagcggc

SEQ ID NO: 3269876 - RNA, 15 nt, Mycobacterium tuberculosis H37Rv
accagccccaacccu

SEQ ID NO: 3269877 - RNA, 21 nt, Mycobacterium tuberculosis H37Rv
accaguguggcgaugaccacg

SEQ ID NO: 3269878 - RNA, 16 nt, Mycobacterium tuberculosis H37Rv
accaguuauucggugc

SEQ ID NO: 3269879 - RNA, 21 nt, Mycobacterium tuberculosis H37Rv
accaguuauucggugcgcggu

SEQ ID NO: 3269880 - RNA, 23 nt, Mycobacterium tuberculosis H37Rv
accauaagcucguagagcaccgc

SEQ ID NO: 3269881 - RNA, 23 nt, Mycobacterium tuberculosis H37Rv
accaucaacauugugcucgccga

SEQ ID NO: 3269882 - RNA, 20 nt, Mycobacterium tuberculosis H37Rv
accaucaccacggccgccga

SEQ ID NO: 3269883 - RNA, 14 nt, Mycobacterium tuberculosis H37Rv
accaucaccgcgcc

SEQ ID NO: 3269884 - RNA, 20 nt, Mycobacterium tuberculosis H37Rv
accaucaccgcgccagccuc

SEQ ID NO: 3269885 - RNA, 22 nt, Mycobacterium tuberculosis H37Rv
accaucaccgcgccagccucca

SEQ ID NO: 3269886 - RNA, 22 nt, Mycobacterium tuberculosis H37Rv
accaucaucaccucucgcuugc

SEQ ID NO: 3269887 - RNA, 13 nt, Mycobacterium tuberculosis H37Rv
accaucaucucgg

SEQ ID NO: 3269888 - RNA, 22 nt, Mycobacterium tuberculosis H37Rv
accaucccugaaauaccagucc

SEQ ID NO: 3269889 - RNA, 23 nt, Mycobacterium tuberculosis H37Rv
accauccgggcaaccgaugacgc

SEQ ID NO: 3269890 - RNA, 20 nt, Mycobacterium tuberculosis H37Rv
accaucgaggcgaucaccgc

SEQ ID NO: 3269891 - RNA, 15 nt, Mycobacterium tuberculosis H37Rv
accaucgccaggccc

SEQ ID NO: 3269892 - RNA, 14 nt, Mycobacterium tuberculosis H37Rv
accaucgcgaucug

SEQ ID NO: 3269893 - RNA, 20 nt, Mycobacterium tuberculosis H37Rv
accaucgcuugcgcacggau

SEQ ID NO: 3269894 - RNA, 20 nt, Mycobacterium tuberculosis H37Rv
accaucugaucgggcccguc

SEQ ID NO: 3269895 - RNA, 12 nt, Mycobacterium tuberculosis H37Rv
accaugaagaac

SEQ ID NO: 3269896 - RNA, 23 nt, Mycobacterium tuberculosis H37Rv
accaugauugccaggaccgcgcc

SEQ ID NO: 3269897 - RNA, 17 nt, Mycobacterium tuberculosis H37Rv
accaugguugaugacgg

SEQ ID NO: 3269898 - RNA, 13 nt, Mycobacterium tuberculosis H37Rv
accaugucggcca

SEQ ID NO: 3269899 - RNA, 23 nt, Mycobacterium tuberculosis H37Rv
acccaaaaugccuuggcagccca

SEQ ID NO: 3269900 - RNA, 14 nt, Mycobacterium tuberculosis H37Rv
acccaacacccaga

SEQ ID NO: 3269901 - RNA, 14 nt, Mycobacterium tuberculosis H37Rv
acccaauggagccg

SEQ ID NO: 3269902 - RNA, 16 nt, Mycobacterium tuberculosis H37Rv
acccacacccagcgug

SEQ ID NO: 3269903 - RNA, 23 nt, Mycobacterium tuberculosis H37Rv
acccacacccagcgugcccgcca

SEQ ID NO: 3269904 - RNA, 22 nt, Mycobacterium tuberculosis H37Rv
acccacacgcccucgacgccgc

SEQ ID NO: 3269905 - RNA, 20 nt, Mycobacterium tuberculosis H37Rv
acccacaucagccgcaccag

SEQ ID NO: 3269906 - RNA, 20 nt, Mycobacterium tuberculosis H37Rv
acccacaugacgaucgcggc

SEQ ID NO: 3269907 - RNA, 14 nt, Mycobacterium tuberculosis H37Rv
acccaccacaggac

SEQ ID NO: 3269908 - RNA, 15 nt, Mycobacterium tuberculosis H37Rv
acccaccaccgcaac

SEQ ID NO: 3269909 - RNA, 20 nt, Mycobacterium tuberculosis H37Rv
acccaccagugcaucgauca

SEQ ID NO: 3269910 - RNA, 13 nt, Mycobacterium tuberculosis H37Rv
acccaccccccag

SEQ ID NO: 3269911 - RNA, 13 nt, Mycobacterium tuberculosis H37Rv
acccacccgcacc

SEQ ID NO: 3269912 - RNA, 16 nt, Mycobacterium tuberculosis H37Rv
acccacccgcaccgcc

SEQ ID NO: 3269913 - RNA, 14 nt, Mycobacterium tuberculosis H37Rv
acccaccggccacc

SEQ ID NO: 3269914 - RNA, 20 nt, Mycobacterium tuberculosis H37Rv
acccaccggccaccagggcc

SEQ ID NO: 3269915 - RNA, 13 nt, Mycobacterium tuberculosis H37Rv
acccaccgucacc

SEQ ID NO: 3269916 - RNA, 16 nt, Mycobacterium tuberculosis H37Rv
acccaccucccgcagc

SEQ ID NO: 3269917 - RNA, 16 nt, Mycobacterium tuberculosis H37Rv
acccacgagagcgcug

SEQ ID NO: 3269918 - RNA, 14 nt, Mycobacterium tuberculosis H37Rv
acccacgccgacua

SEQ ID NO: 3269919 - RNA, 15 nt, Mycobacterium tuberculosis H37Rv
acccacgucgagcag

SEQ ID NO: 3269920 - RNA, 22 nt, Mycobacterium tuberculosis H37Rv
acccacucgacgucgucgucga

SEQ ID NO: 3269921 - RNA, 13 nt, Mycobacterium tuberculosis H37Rv
acccacugcaggc

SEQ ID NO: 3269922 - RNA, 17 nt, Mycobacterium tuberculosis H37Rv
acccacuggaccaccgc

SEQ ID NO: 3269923 - RNA, 23 nt, Mycobacterium tuberculosis H37Rv
acccacuuuucgguggcggcagc

SEQ ID NO: 3269924 - RNA, 20 nt, Mycobacterium tuberculosis H37Rv
acccagaaugacaucgucgc

SEQ ID NO: 3269925 - RNA, 21 nt, Mycobacterium tuberculosis H37Rv
acccagaaugacaucgucgcc

SEQ ID NO: 3269926 - RNA, 15 nt, Mycobacterium tuberculosis H37Rv
acccagaauuccggc

SEQ ID NO: 3269927 - RNA, 17 nt, Mycobacterium tuberculosis H37Rv
acccagacaccggcuau

SEQ ID NO: 3269928 - RNA, 13 nt, Mycobacterium tuberculosis H37Rv
acccagaccgccg

SEQ ID NO: 3269929 - RNA, 14 nt, Mycobacterium tuberculosis H37Rv
acccagaccggcuc

SEQ ID NO: 3269930 - RNA, 21 nt, Mycobacterium tuberculosis H37Rv
acccagcaccacaacgucggc

SEQ ID NO: 3269931 - RNA, 17 nt, Mycobacterium tuberculosis H37Rv
acccagcaccagggcgc

SEQ ID NO: 3269932 - RNA, 15 nt, Mycobacterium tuberculosis H37Rv
acccagcacgcgcgc

SEQ ID NO: 3269933 - RNA, 14 nt, Mycobacterium tuberculosis H37Rv
acccagcagcggca

SEQ ID NO: 3269934 - RNA, 16 nt, Mycobacterium tuberculosis H37Rv
acccagccagcagcgg

SEQ ID NO: 3269935 - RNA, 14 nt, Mycobacterium tuberculosis H37Rv
acccagcccagccg

SEQ ID NO: 3269936 - RNA, 14 nt, Mycobacterium tuberculosis H37Rv
acccagccgcagcc

SEQ ID NO: 3269937 - RNA, 14 nt, Mycobacterium tuberculosis H37Rv
acccagccggccug

SEQ ID NO: 3269938 - RNA, 14 nt, Mycobacterium tuberculosis H37Rv
acccagcgcagcag

SEQ ID NO: 3269939 - RNA, 15 nt, Mycobacterium tuberculosis H37Rv
acccagcgcagcagc

SEQ ID NO: 3269940 - RNA, 15 nt, Mycobacterium tuberculosis H37Rv
acccagcgcccggcc

SEQ ID NO: 3269941 - RNA, 12 nt, Mycobacterium tuberculosis H37Rv
acccagcgccga

SEQ ID NO: 3269942 - RNA, 22 nt, Mycobacterium tuberculosis H37Rv
acccagcgccgacccaacccga

SEQ ID NO: 3269943 - RNA, 19 nt, Mycobacterium tuberculosis H37Rv
acccagcgcgcugggaagc

SEQ ID NO: 3269944 - RNA, 12 nt, Mycobacterium tuberculosis H37Rv
acccagcgcggc

SEQ ID NO: 3269945 - RNA, 14 nt, Mycobacterium tuberculosis H37Rv
acccagcgcggcca

SEQ ID NO: 3269946 - RNA, 14 nt, Mycobacterium tuberculosis H37Rv
acccagcggcgcca

SEQ ID NO: 3269947 - RNA, 17 nt, Mycobacterium tuberculosis H37Rv
acccagcggcgccacgu

SEQ ID NO: 3269948 - RNA, 19 nt, Mycobacterium tuberculosis H37Rv
acccagcgguaucccccag

SEQ ID NO: 3269949 - RNA, 22 nt, Mycobacterium tuberculosis H37Rv
acccagcgguaucccccagccg

SEQ ID NO: 3269950 - RNA, 23 nt, Mycobacterium tuberculosis H37Rv
acccagcgguaucccccagccgc

SEQ ID NO: 3269951 - RNA, 16 nt, Mycobacterium tuberculosis H37Rv
acccagcgugcccgcc

SEQ ID NO: 3269952 - RNA, 18 nt, Mycobacterium tuberculosis H37Rv
acccagcgugcccgccac

SEQ ID NO: 3269953 - RNA, 19 nt, Mycobacterium tuberculosis H37Rv
acccagcgugcccgccacc

SEQ ID NO: 3269954 - RNA, 21 nt, Mycobacterium tuberculosis H37Rv
acccagcgugcccgccaccgg

SEQ ID NO: 3269955 - RNA, 15 nt, Mycobacterium tuberculosis H37Rv
acccagcucgucgac

SEQ ID NO: 3269956 - RNA, 18 nt, Mycobacterium tuberculosis H37Rv
acccagcucgucgacguc

SEQ ID NO: 3269957 - RNA, 17 nt, Mycobacterium tuberculosis H37Rv
acccagcugggucccgc

SEQ ID NO: 3269958 - RNA, 19 nt, Mycobacterium tuberculosis H37Rv
cauccccagcacaaccagc

SEQ ID NO: 3269959 - RNA, 19 nt, Mycobacterium tuberculosis H37Rv
cauccccuggccagcagag

SEQ ID NO: 3269960 - RNA, 19 nt, Mycobacterium tuberculosis H37Rv
caucccgaaguagaagccc

SEQ ID NO: 3269961 - RNA, 23 nt, Mycobacterium tuberculosis H37Rv
caucccgaaguagaagcccagga

SEQ ID NO: 3269962 - RNA, 13 nt, Mycobacterium tuberculosis H37Rv
caucccgaccagc

SEQ ID NO: 3269963 - RNA, 20 nt, Mycobacterium tuberculosis H37Rv
caucccgaucccggccagcu

SEQ ID NO: 3269964 - RNA, 14 nt, Mycobacterium tuberculosis H37Rv
caucccgccacacc

SEQ ID NO: 3269965 - RNA, 15 nt, Mycobacterium tuberculosis H37Rv
caucccggagccgcu

SEQ ID NO: 3269966 - RNA, 13 nt, Mycobacterium tuberculosis H37Rv
caucccggccgcu

SEQ ID NO: 3269967 - RNA, 13 nt, Mycobacterium tuberculosis H37Rv
caucccggcgccg

SEQ ID NO: 3269968 - RNA, 18 nt, Mycobacterium tuberculosis H37Rv
caucccguucagcgacca

SEQ ID NO: 3269969 - RNA, 17 nt, Mycobacterium tuberculosis H37Rv
caucccguucagcuucc

SEQ ID NO: 3269970 - RNA, 13 nt, Mycobacterium tuberculosis H37Rv
caucccucggugu

SEQ ID NO: 3269971 - RNA, 18 nt, Mycobacterium tuberculosis H37Rv
caucccucgguguacacc

SEQ ID NO: 3269972 - RNA, 13 nt, Mycobacterium tuberculosis H37Rv
caucccugacgaa

SEQ ID NO: 3269973 - RNA, 14 nt, Mycobacterium tuberculosis H37Rv
cauccgacaagcug

SEQ ID NO: 3269974 - RNA, 14 nt, Mycobacterium tuberculosis H37Rv
cauccgacagcagc

SEQ ID NO: 3269975 - RNA, 15 nt, Mycobacterium tuberculosis H37Rv
cauccgacagcagcc

SEQ ID NO: 3269976 - RNA, 20 nt, Mycobacterium tuberculosis H37Rv
cauccgagcgggaacgagcc

SEQ ID NO: 3269977 - RNA, 14 nt, Mycobacterium tuberculosis H37Rv
cauccgaucgccgc

SEQ ID NO: 3269978 - RNA, 17 nt, Mycobacterium tuberculosis H37Rv
cauccgaucgccgcgaa

SEQ ID NO: 3269979 - RNA, 14 nt, Mycobacterium tuberculosis H37Rv
cauccgccccgccc

SEQ ID NO: 3269980 - RNA, 15 nt, Mycobacterium tuberculosis H37Rv
cauccgccccgcccg

SEQ ID NO: 3269981 - RNA, 17 nt, Mycobacterium tuberculosis H37Rv
cauccgccgggccaggc

SEQ ID NO: 3269982 - RNA, 18 nt, Mycobacterium tuberculosis H37Rv
cauccgcgacggcgcccu

SEQ ID NO: 3269983 - RNA, 22 nt, Mycobacterium tuberculosis H37Rv
cauccgcggcagggccuggaac

SEQ ID NO: 3269984 - RNA, 18 nt, Mycobacterium tuberculosis H37Rv
cauccggauauggaaagc

SEQ ID NO: 3269985 - RNA, 21 nt, Mycobacterium tuberculosis H37Rv
cauccggccgucggcgggcau

SEQ ID NO: 3269986 - RNA, 12 nt, Mycobacterium tuberculosis H37Rv
cauccggcgccg

SEQ ID NO: 3269987 - RNA, 19 nt, Mycobacterium tuberculosis H37Rv
cauccggcggcggccagga

SEQ ID NO: 3269988 - RNA, 19 nt, Mycobacterium tuberculosis H37Rv
cauccgggccgcggccaca

SEQ ID NO: 3269989 - RNA, 17 nt, Mycobacterium tuberculosis H37Rv
cauccgggcgaccacca

SEQ ID NO: 3269990 - RNA, 23 nt, Mycobacterium tuberculosis H37Rv
cauccgggcgaccaccaccgccg

SEQ ID NO: 3269991 - RNA, 14 nt, Mycobacterium tuberculosis H37Rv
cauccgggcucgca

SEQ ID NO: 3269992 - RNA, 17 nt, Mycobacterium tuberculosis H37Rv
cauccgggcucgcaugu

SEQ ID NO: 3269993 - RNA, 18 nt, Mycobacterium tuberculosis H37Rv
cauccgggcugccacggc

SEQ ID NO: 3269994 - RNA, 23 nt, Mycobacterium tuberculosis H37Rv
cauccggucagauagugcaugua

SEQ ID NO: 3269995 - RNA, 20 nt, Mycobacterium tuberculosis H37Rv
cauccggucggucucggcga

SEQ ID NO: 3269996 - RNA, 17 nt, Mycobacterium tuberculosis H37Rv
cauccggucucggccga

SEQ ID NO: 3269997 - RNA, 12 nt, Mycobacterium tuberculosis H37Rv
cauccgucaagu

SEQ ID NO: 3269998 - RNA, 19 nt, Mycobacterium tuberculosis H37Rv
cauccgucguacacgccau

SEQ ID NO: 3269999 - RNA, 20 nt, Mycobacterium tuberculosis H37Rv
cauccgugaaucgagcaccg

SEQ ID NO: 3270000 - RNA, 22 nt, Mycobacterium tuberculosis H37Rv
cauccgugucgagaucucacgu

SEQ ID NO: 3270001 - RNA, 15 nt, Mycobacterium tuberculosis H37Rv
cauccuccucgucga

SEQ ID NO: 3270002 - RNA, 19 nt, Mycobacterium tuberculosis H37Rv
cauccucgacuugcuuggc

SEQ ID NO: 3270003 - RNA, 13 nt, Mycobacterium tuberculosis H37Rv
cauccucgagcug

SEQ ID NO: 3270004 - RNA, 18 nt, Mycobacterium tuberculosis H37Rv
cauccucgagcugcuggc

SEQ ID NO: 3270005 - RNA, 15 nt, Mycobacterium tuberculosis H37Rv
cauccucgauggacc

SEQ ID NO: 3270006 - RNA, 15 nt, Mycobacterium tuberculosis H37Rv
cauccugcacgaccc

SEQ ID NO: 3270007 - RNA, 12 nt, Mycobacterium tuberculosis H37Rv
cauccugcagcu

SEQ ID NO: 3270008 - RNA, 17 nt, Mycobacterium tuberculosis H37Rv
cauccugcagcucgggc

SEQ ID NO: 3270009 - RNA, 16 nt, Mycobacterium tuberculosis H37Rv
cauccuucaccagcug

SEQ ID NO: 3270010 - RNA, 16 nt, Mycobacterium tuberculosis H37Rv
cauccuugacgcggcc

SEQ ID NO: 3270011 - RNA, 21 nt, Mycobacterium tuberculosis H37Rv
caucgaaaaaccucgacgccc

SEQ ID NO: 3270012 - RNA, 16 nt, Mycobacterium tuberculosis H37Rv
caucgaaaaccgaggc

SEQ ID NO: 3270013 - RNA, 12 nt, Mycobacterium tuberculosis H37Rv
caucgaacgacg

SEQ ID NO: 3270014 - RNA, 14 nt, Mycobacterium tuberculosis H37Rv
caucgaacucugga

SEQ ID NO: 3270015 - RNA, 12 nt, Mycobacterium tuberculosis H37Rv
caucgaccaccu

SEQ ID NO: 3270016 - RNA, 21 nt, Mycobacterium tuberculosis H37Rv
caucgaccaccucgaugccgc

SEQ ID NO: 3270017 - RNA, 17 nt, Mycobacterium tuberculosis H37Rv
caucgaccgcggccggg

SEQ ID NO: 3270018 - RNA, 13 nt, Mycobacterium tuberculosis H37Rv
caucgaccguccg

SEQ ID NO: 3270019 - RNA, 15 nt, Mycobacterium tuberculosis H37Rv
caucgaccuggccac

SEQ ID NO: 3270020 - RNA, 13 nt, Mycobacterium tuberculosis H37Rv
caucgacgagcga

SEQ ID NO: 3270021 - RNA, 19 nt, Mycobacterium tuberculosis H37Rv
caucgacgccugcggcggu

SEQ ID NO: 3270022 - RNA, 15 nt, Mycobacterium tuberculosis H37Rv
caucgacgcggccaa

SEQ ID NO: 3270023 - RNA, 22 nt, Mycobacterium tuberculosis H37Rv
caucgacgcucaucucgggcac

SEQ ID NO: 3270024 - RNA, 23 nt, Mycobacterium tuberculosis H37Rv
caucgacguagcgaagugcgcgc

SEQ ID NO: 3270025 - RNA, 18 nt, Mycobacterium tuberculosis H37Rv
caucgacguuccagcagu

SEQ ID NO: 3270026 - RNA, 17 nt, Mycobacterium tuberculosis H37Rv
caucgacuugccgccgc

SEQ ID NO: 3270027 - RNA, 18 nt, Mycobacterium tuberculosis H37Rv
caucgagacgagccacgg

SEQ ID NO: 3270028 - RNA, 20 nt, Mycobacterium tuberculosis H37Rv
caucgagaguugaauccggg

SEQ ID NO: 3270029 - RNA, 23 nt, Mycobacterium tuberculosis H37Rv
caucgagcaccuccacugggucg

SEQ ID NO: 3270030 - RNA, 20 nt, Mycobacterium tuberculosis H37Rv
caucgagcccggacgagugc

SEQ ID NO: 3270031 - RNA, 15 nt, Mycobacterium tuberculosis H37Rv
caucgagcgccagcc

SEQ ID NO: 3270032 - RNA, 17 nt, Mycobacterium tuberculosis H37Rv
caucgagcgccagccgg

SEQ ID NO: 3270033 - RNA, 19 nt, Mycobacterium tuberculosis H37Rv
caucgagcugaccugguuc

SEQ ID NO: 3270034 - RNA, 14 nt, Mycobacterium tuberculosis H37Rv
caucgaggccagca

SEQ ID NO: 3270035 - RNA, 20 nt, Mycobacterium tuberculosis H37Rv
caucgaggccagcagcugcu

SEQ ID NO: 3270036 - RNA, 23 nt, Mycobacterium tuberculosis H37Rv
caucgagucgaagaaccugagca

SEQ ID NO: 3270037 - RNA, 17 nt, Mycobacterium tuberculosis H37Rv
caucgaguugucucgca

SEQ ID NO: 3270038 - RNA, 14 nt, Mycobacterium tuberculosis H37Rv
caucgaucagaugc

SEQ ID NO: 3270039 - RNA, 17 nt, Mycobacterium tuberculosis H37Rv
caucgaucccguucggg

SEQ ID NO: 3270040 - RNA, 22 nt, Mycobacterium tuberculosis H37Rv
caucgaugucagugaucaccaa

SEQ ID NO: 3270041 - RNA, 17 nt, Mycobacterium tuberculosis H37Rv
caucgauuggcucgagc

SEQ ID NO: 3270042 - RNA, 18 nt, Mycobacterium tuberculosis H37Rv
caucgcacaacugcgcca

SEQ ID NO: 3270043 - RNA, 21 nt, Mycobacterium tuberculosis H37Rv
caucgcacaacugcgccagca

SEQ ID NO: 3270044 - RNA, 16 nt, Mycobacterium tuberculosis H37Rv
caucgcacagcgccgc

SEQ ID NO: 3270045 - RNA, 17 nt, Mycobacterium tuberculosis H37Rv
caucgcacagcgccgcg

SEQ ID NO: 3270046 - RNA, 20 nt, Mycobacterium tuberculosis H37Rv
caucgcacagcgccgcguug

SEQ ID NO: 3270047 - RNA, 13 nt, Mycobacterium tuberculosis H37Rv
caucgcacccacc

SEQ ID NO: 3270048 - RNA, 13 nt, Mycobacterium tuberculosis H37Rv
caucgcagacggc

SEQ ID NO: 3270049 - RNA, 14 nt, Mycobacterium tuberculosis H37Rv
caucgcagccgguc

SEQ ID NO: 3270050 - RNA, 22 nt, Mycobacterium tuberculosis H37Rv
caucgcaggcaccccgaucacc

SEQ ID NO: 3270051 - RNA, 13 nt, Mycobacterium tuberculosis H37Rv
caucgccaccgcg

SEQ ID NO: 3270052 - RNA, 21 nt, Mycobacterium tuberculosis H37Rv
caucgccacuguugaagaagc

SEQ ID NO: 3270053 - RNA, 14 nt, Mycobacterium tuberculosis H37Rv
caucgccagcagca

SEQ ID NO: 3270054 - RNA, 21 nt, Mycobacterium tuberculosis H37Rv
caucgccagccugugcugcca

SEQ ID NO: 3270055 - RNA, 16 nt, Mycobacterium tuberculosis H37Rv
caucgucgaaagccug

SEQ ID NO: 3270056 - RNA, 16 nt, Mycobacterium tuberculosis H37Rv
caucgucgaagaccuc

SEQ ID NO: 3270057 - RNA, 21 nt, Mycobacterium tuberculosis H37Rv
caucgucgccacgaugccggc

SEQ ID NO: 3270058 - RNA, 19 nt, Mycobacterium tuberculosis H37Rv
caucgucgccgaccgucac

SEQ ID NO: 3270059 - RNA, 15 nt, Mycobacterium tuberculosis H37Rv
caucgucgccgcgca

SEQ ID NO: 3270060 - RNA, 20 nt, Mycobacterium tuberculosis H37Rv
caucgucguggugaugucca

SEQ ID NO: 3270061 - RNA, 15 nt, Mycobacterium tuberculosis H37Rv
caucgucugguggca

SEQ ID NO: 3270062 - RNA, 16 nt, Mycobacterium tuberculosis H37Rv
caucgucugguggcag

SEQ ID NO: 3270063 - RNA, 23 nt, Mycobacterium tuberculosis H37Rv
caucgucugguggcagcgcaccc

SEQ ID NO: 3270064 - RNA, 17 nt, Mycobacterium tuberculosis H37Rv
caucgugcccgcgucua

SEQ ID NO: 3270065 - RNA, 16 nt, Mycobacterium tuberculosis H37Rv
caucgugcugaagcug

SEQ ID NO: 3270066 - RNA, 20 nt, Mycobacterium tuberculosis H37Rv
caucguugacccggcgaugc

SEQ ID NO: 3270067 - RNA, 14 nt, Mycobacterium tuberculosis H37Rv
caucguugccgacc

SEQ ID NO: 3270068 - RNA, 16 nt, Mycobacterium tuberculosis H37Rv
caucguugccgaccgu

SEQ ID NO: 3270069 - RNA, 21 nt, Mycobacterium tuberculosis H37Rv
caucguugccgaccgucacug

SEQ ID NO: 3270070 - RNA, 17 nt, Mycobacterium tuberculosis H37Rv
caucguugccggugccg

SEQ ID NO: 3270071 - RNA, 21 nt, Mycobacterium tuberculosis H37Rv
caucguuggccgggcacgcga

SEQ ID NO: 3270072 - RNA, 21 nt, Mycobacterium tuberculosis H37Rv
caucuacaucgucgagcgcgg

SEQ ID NO: 3270073 - RNA, 23 nt, Mycobacterium tuberculosis H37Rv
caucuaggccucagaaccggguc

SEQ ID NO: 3270074 - RNA, 16 nt, Mycobacterium tuberculosis H37Rv
caucucccgaccgccg

SEQ ID NO: 3270075 - RNA, 14 nt, Mycobacterium tuberculosis H37Rv
caucuccgacucga

SEQ ID NO: 3270076 - RNA, 16 nt, Mycobacterium tuberculosis H37Rv
caucuccgacucgaua

SEQ ID NO: 3270077 - RNA, 19 nt, Mycobacterium tuberculosis H37Rv
caucuccgccgucgccacc

SEQ ID NO: 3270078 - RNA, 15 nt, Mycobacterium tuberculosis H37Rv
caucuccucgccugc

SEQ ID NO: 3270079 - RNA, 14 nt, Mycobacterium tuberculosis H37Rv
caucucgacgguga

SEQ ID NO: 3270080 - RNA, 17 nt, Mycobacterium tuberculosis H37Rv
caucucgacgucgguga

SEQ ID NO: 3270081 - RNA, 20 nt, Mycobacterium tuberculosis H37Rv
caucucggcgcagccgguga

SEQ ID NO: 3270082 - RNA, 23 nt, Mycobacterium tuberculosis H37Rv
caucucggcggccaacagcaccc

SEQ ID NO: 3270083 - RNA, 18 nt, Mycobacterium tuberculosis H37Rv
caucugaucaggccacac

SEQ ID NO: 3270084 - RNA, 19 nt, Mycobacterium tuberculosis H37Rv
caucugaucaggccacacu

SEQ ID NO: 3270085 - RNA, 18 nt, Mycobacterium tuberculosis H37Rv
caucugcgaaaagccuug

SEQ ID NO: 3270086 - RNA, 13 nt, Mycobacterium tuberculosis H37Rv
caucugcgggacg

SEQ ID NO: 3270087 - RNA, 22 nt, Mycobacterium tuberculosis H37Rv
caucugcgggacgucgucguug

SEQ ID NO: 3270088 - RNA, 11 nt, Mycobacterium tuberculosis H37Rv
caucugcucgc

SEQ ID NO: 3270089 - RNA, 14 nt, Mycobacterium tuberculosis H37Rv
caucuggcgcugcu

SEQ ID NO: 3270090 - RNA, 15 nt, Mycobacterium tuberculosis H37Rv
caucuggcgcugcug

SEQ ID NO: 3270091 - RNA, 20 nt, Mycobacterium tuberculosis H37Rv
caucugggguccggugacga

SEQ ID NO: 3270092 - RNA, 19 nt, Mycobacterium tuberculosis H37Rv
caucuggucgaccaucggu

SEQ ID NO: 3270093 - RNA, 19 nt, Mycobacterium tuberculosis H37Rv
caucugguggaccuccgga

SEQ ID NO: 3270094 - RNA, 18 nt, Mycobacterium tuberculosis H37Rv
caucuguaaccuccucga

SEQ ID NO: 3270095 - RNA, 20 nt, Mycobacterium tuberculosis H37Rv
caucugugagauaccgacgc

SEQ ID NO: 3270096 - RNA, 21 nt, Mycobacterium tuberculosis H37Rv
caucuguuccgugccagcugc

SEQ ID NO: 3270097 - RNA, 13 nt, Mycobacterium tuberculosis H37Rv
caucuucaucgcc

SEQ ID NO: 3270098 - RNA, 15 nt, Mycobacterium tuberculosis H37Rv
caucuucggacgcca

SEQ ID NO: 3270099 - RNA, 16 nt, Mycobacterium tuberculosis H37Rv
caucuucggacgccag

SEQ ID NO: 3270100 - RNA, 14 nt, Mycobacterium tuberculosis H37Rv
caucuugccaccgc

SEQ ID NO: 3270101 - RNA, 21 nt, Mycobacterium tuberculosis H37Rv
caucuuguugucgacaucggc

SEQ ID NO: 3270102 - RNA, 18 nt, Mycobacterium tuberculosis H37Rv
caugaacaucggccgggu

SEQ ID NO: 3270103 - RNA, 18 nt, Mycobacterium tuberculosis H37Rv
caugaacgaucggaccac

SEQ ID NO: 3270104 - RNA, 13 nt, Mycobacterium tuberculosis H37Rv
caugaacgccagc

SEQ ID NO: 3270105 - RNA, 17 nt, Mycobacterium tuberculosis H37Rv
caugaacgccagcagcg

SEQ ID NO: 3270106 - RNA, 19 nt, Mycobacterium tuberculosis H37Rv
caugaacucgaacuggguc

SEQ ID NO: 3270107 - RNA, 23 nt, Mycobacterium tuberculosis H37Rv
caugaaggagaucccccaggcga

SEQ ID NO: 3270108 - RNA, 15 nt, Mycobacterium tuberculosis H37Rv
caugaauuuccccgg

SEQ ID NO: 3270109 - RNA, 17 nt, Mycobacterium tuberculosis H37Rv
caugacaccggccacca

SEQ ID NO: 3270110 - RNA, 19 nt, Mycobacterium tuberculosis H37Rv
caugacaccggccaccagc

SEQ ID NO: 3270111 - RNA, 20 nt, Mycobacterium tuberculosis H37Rv
caugacaccggccaccagcc

SEQ ID NO: 3270112 - RNA, 17 nt, Mycobacterium tuberculosis H37Rv
caugaccgggcuggcca

SEQ ID NO: 3270113 - RNA, 14 nt, Mycobacterium tuberculosis H37Rv
caugacgaucgcgg

SEQ ID NO: 3270114 - RNA, 12 nt, Mycobacterium tuberculosis H37Rv
caugacggcucc

SEQ ID NO: 3270115 - RNA, 16 nt, Mycobacterium tuberculosis H37Rv
caugagcguucagcac

SEQ ID NO: 3270116 - RNA, 14 nt, Mycobacterium tuberculosis H37Rv
caugaggugagcug

SEQ ID NO: 3270117 - RNA, 19 nt, Mycobacterium tuberculosis H37Rv
caugaguggcaaucccgcc

SEQ ID NO: 3270118 - RNA, 18 nt, Mycobacterium tuberculosis H37Rv
caugaucacaccgcugcu

SEQ ID NO: 3270119 - RNA, 18 nt, Mycobacterium tuberculosis H37Rv
caugaucccgcugaccug

SEQ ID NO: 3270120 - RNA, 15 nt, Mycobacterium tuberculosis H37Rv
caugaugaugacauc

SEQ ID NO: 3270121 - RNA, 21 nt, Mycobacterium tuberculosis H37Rv
caugauggccgucagccaggu

SEQ ID NO: 3270122 - RNA, 13 nt, Mycobacterium tuberculosis H37Rv
caugauggucacg

SEQ ID NO: 3270123 - RNA, 19 nt, Mycobacterium tuberculosis H37Rv
caugauguagcggcguucc

SEQ ID NO: 3270124 - RNA, 16 nt, Mycobacterium tuberculosis H37Rv
caugaugucgacaucg

SEQ ID NO: 3270125 - RNA, 21 nt, Mycobacterium tuberculosis H37Rv
caugauucaucaacacgacgu

SEQ ID NO: 3270126 - RNA, 21 nt, Mycobacterium tuberculosis H37Rv
caugcaaaagccgcgaucggu

SEQ ID NO: 3270127 - RNA, 14 nt, Mycobacterium tuberculosis H37Rv
caugcaccgaugcc

SEQ ID NO: 3270128 - RNA, 23 nt, Mycobacterium tuberculosis H37Rv
caugcaccgaugccgaagccccc

SEQ ID NO: 3270129 - RNA, 20 nt, Mycobacterium tuberculosis H37Rv
caugcacgucaucggcuggc

SEQ ID NO: 3270130 - RNA, 19 nt, Mycobacterium tuberculosis H37Rv
caugcaucugaucaggcca

SEQ ID NO: 3270131 - RNA, 22 nt, Mycobacterium tuberculosis H37Rv
caugcaucugcuucugcguaua

SEQ ID NO: 3270132 - RNA, 15 nt, Mycobacterium tuberculosis H37Rv
caugccaagcuccaa

SEQ ID NO: 3270133 - RNA, 22 nt, Mycobacterium tuberculosis H37Rv
caugccaagcuccaaccaugcg

SEQ ID NO: 3270134 - RNA, 24 nt, Mycobacterium tuberculosis H37Rv
caugccacaacgccucgauggcgg

SEQ ID NO: 3270135 - RNA, 13 nt, Mycobacterium tuberculosis H37Rv
caugccacacacu

SEQ ID NO: 3270136 - RNA, 14 nt, Mycobacterium tuberculosis H37Rv
caugccacacacug

SEQ ID NO: 3270137 - RNA, 13 nt, Mycobacterium tuberculosis H37Rv
caugccagccguc

SEQ ID NO: 3270138 - RNA, 18 nt, Mycobacterium tuberculosis H37Rv
caugcccagcgcacggac

SEQ ID NO: 3270139 - RNA, 22 nt, Mycobacterium tuberculosis H37Rv
caugcccaggugcguccaggcc

SEQ ID NO: 3270140 - RNA, 17 nt, Mycobacterium tuberculosis H37Rv
caugcccaucuccaaca

SEQ ID NO: 3270141 - RNA, 17 nt, Mycobacterium tuberculosis H37Rv
caugcccaugauggccg

SEQ ID NO: 3270142 - RNA, 22 nt, Mycobacterium tuberculosis H37Rv
caugcccaugauggccgcggcu

SEQ ID NO: 3270143 - RNA, 16 nt, Mycobacterium tuberculosis H37Rv
caugcccgcaccgucg

SEQ ID NO: 3270144 - RNA, 23 nt, Mycobacterium tuberculosis H37Rv
caugcccgggaugacugggcaaa

SEQ ID NO: 3270145 - RNA, 22 nt, Mycobacterium tuberculosis H37Rv
caugcccucgcuguuggccggu

SEQ ID NO: 3270146 - RNA, 14 nt, Mycobacterium tuberculosis H37Rv
caugcccucggcgc

SEQ ID NO: 3270147 - RNA, 14 nt, Mycobacterium tuberculosis H37Rv
caugccgagcgacc

SEQ ID NO: 3270148 - RNA, 16 nt, Mycobacterium tuberculosis H37Rv
caugccgagguaacgc

SEQ ID NO: 3270149 - RNA, 15 nt, Mycobacterium tuberculosis H37Rv
caugccgaucggccu

SEQ ID NO: 3270150 - RNA, 21 nt, Mycobacterium tuberculosis H37Rv
caugccgaucggccugcagcg

SEQ ID NO: 3270151 - RNA, 18 nt, Mycobacterium tuberculosis H37Rv
cauguccuuggagauguc

SEQ ID NO: 3270152 - RNA, 20 nt, Mycobacterium tuberculosis H37Rv
caugucgaagaaccggccga

SEQ ID NO: 3270153 - RNA, 20 nt, Mycobacterium tuberculosis H37Rv
caugucgacggucagauggc

SEQ ID NO: 3270154 - RNA, 14 nt, Mycobacterium tuberculosis H37Rv
caugucgagcacgc

SEQ ID NO: 3270155 - RNA, 15 nt, Mycobacterium tuberculosis H37Rv
caugucgagcacgcc

SEQ ID NO: 3270156 - RNA, 11 nt, Mycobacterium tuberculosis H37Rv
caugucgagga

SEQ ID NO: 3270157 - RNA, 17 nt, Mycobacterium tuberculosis H37Rv
caugucgauccggcgcc

SEQ ID NO: 3270158 - RNA, 20 nt, Mycobacterium tuberculosis H37Rv
caugucgccgaacgccacca

SEQ ID NO: 3270159 - RNA, 15 nt, Mycobacterium tuberculosis H37Rv
caugucgcugccgcc

SEQ ID NO: 3270160 - RNA, 19 nt, Mycobacterium tuberculosis H37Rv
caugucgcugccgccgccg

SEQ ID NO: 3270161 - RNA, 21 nt, Mycobacterium tuberculosis H37Rv
caugucgcugccgccgccggc

SEQ ID NO: 3270162 - RNA, 17 nt, Mycobacterium tuberculosis H37Rv
caugucggccacccgga

SEQ ID NO: 3270163 - RNA, 14 nt, Mycobacterium tuberculosis H37Rv
caugucggccaccg

SEQ ID NO: 3270164 - RNA, 14 nt, Mycobacterium tuberculosis H37Rv
caugucggccaggu

SEQ ID NO: 3270165 - RNA, 17 nt, Mycobacterium tuberculosis H37Rv
caugucggccggggcca

SEQ ID NO: 3270166 - RNA, 13 nt, Mycobacterium tuberculosis H37Rv
caugucggcgcgc

SEQ ID NO: 3270167 - RNA, 14 nt, Mycobacterium tuberculosis H37Rv
caugucggcgcgcc

SEQ ID NO: 3270168 - RNA, 17 nt, Mycobacterium tuberculosis H37Rv
caugucggcgcgccgca

SEQ ID NO: 3270169 - RNA, 17 nt, Mycobacterium tuberculosis H37Rv
caugucgggccaggcga

SEQ ID NO: 3270170 - RNA, 16 nt, Mycobacterium tuberculosis H37Rv
caugucgguuuccucg

SEQ ID NO: 3270171 - RNA, 18 nt, Mycobacterium tuberculosis H37Rv
caugucgguuuccucgag

SEQ ID NO: 3270172 - RNA, 23 nt, Mycobacterium tuberculosis H37Rv
caugucgguuuccucgagccagc

SEQ ID NO: 3270173 - RNA, 18 nt, Mycobacterium tuberculosis H37Rv
caugucuccgacauuggc

SEQ ID NO: 3270174 - RNA, 16 nt, Mycobacterium tuberculosis H37Rv
caugugcccaggucuc

SEQ ID NO: 3270175 - RNA, 17 nt, Mycobacterium tuberculosis H37Rv
caugugcgacauugguc

SEQ ID NO: 3270176 - RNA, 16 nt, Mycobacterium tuberculosis H37Rv
caugugggugaacacc

SEQ ID NO: 3270177 - RNA, 13 nt, Mycobacterium tuberculosis H37Rv
cauguguggcagc

SEQ ID NO: 3270178 - RNA, 16 nt, Mycobacterium tuberculosis H37Rv
cauguguggcagcccc

SEQ ID NO: 3270179 - RNA, 13 nt, Mycobacterium tuberculosis H37Rv
cauguucaucgca

SEQ ID NO: 3270180 - RNA, 13 nt, Mycobacterium tuberculosis H37Rv
cauguucggccac

SEQ ID NO: 3270181 - RNA, 20 nt, Mycobacterium tuberculosis H37Rv
cauguucggggcgcaccacg

SEQ ID NO: 3270182 - RNA, 20 nt, Mycobacterium tuberculosis H37Rv
cauguucuccacgccgaucu

SEQ ID NO: 3270183 - RNA, 22 nt, Mycobacterium tuberculosis H37Rv
cauguucuuuugcgucugcugg

SEQ ID NO: 3270184 - RNA, 22 nt, Mycobacterium tuberculosis H37Rv
cauguugaagcgaagccagauc

SEQ ID NO: 3270185 - RNA, 14 nt, Mycobacterium tuberculosis H37Rv
cauguugcggacca

SEQ ID NO: 3270186 - RNA, 22 nt, Mycobacterium tuberculosis H37Rv
cauguuuugcugcaugccgacc

SEQ ID NO: 3270187 - RNA, 19 nt, Mycobacterium tuberculosis H37Rv
cauuaaugcggccccgcgc

SEQ ID NO: 3270188 - RNA, 13 nt, Mycobacterium tuberculosis H37Rv
cauuagcagcacc

SEQ ID NO: 3270189 - RNA, 12 nt, Mycobacterium tuberculosis H37Rv
cauuagccggac

SEQ ID NO: 3270190 - RNA, 18 nt, Mycobacterium tuberculosis H37Rv
cauucaacagauccgacg

SEQ ID NO: 3270191 - RNA, 23 nt, Mycobacterium tuberculosis H37Rv
cauucaacagauccgacgaccgc

SEQ ID NO: 3270192 - RNA, 15 nt, Mycobacterium tuberculosis H37Rv
cauucaucuugcggc

SEQ ID NO: 3270193 - RNA, 21 nt, Mycobacterium tuberculosis H37Rv
cauuccagcaggccacugcgu

SEQ ID NO: 3270194 - RNA, 16 nt, Mycobacterium tuberculosis H37Rv
cauucccaacacagcc

SEQ ID NO: 3270195 - RNA, 16 nt, Mycobacterium tuberculosis H37Rv
cauucccgaguugccc

SEQ ID NO: 3270196 - RNA, 21 nt, Mycobacterium tuberculosis H37Rv
cauucccgaguugcccucugg

SEQ ID NO: 3270197 - RNA, 18 nt, Mycobacterium tuberculosis H37Rv
cauuccggcaccuccgcc

SEQ ID NO: 3270198 - RNA, 13 nt, Mycobacterium tuberculosis H37Rv
cauuccggcgcca

SEQ ID NO: 3270199 - RNA, 16 nt, Mycobacterium tuberculosis H37Rv
cauuccguaggccaca

SEQ ID NO: 3270200 - RNA, 19 nt, Mycobacterium tuberculosis H37Rv
cauuccguaggccacagcc

SEQ ID NO: 3270201 - RNA, 21 nt, Mycobacterium tuberculosis H37Rv
cauuccucgacgguguaacug

SEQ ID NO: 3270202 - RNA, 21 nt, Mycobacterium tuberculosis H37Rv
cauuccuugauaacgacccuc

SEQ ID NO: 3270203 - RNA, 16 nt, Mycobacterium tuberculosis H37Rv
cauucgccccacccga

SEQ ID NO: 3270204 - RNA, 15 nt, Mycobacterium tuberculosis H37Rv
cauucgcccggccgc

SEQ ID NO: 3270205 - RNA, 11 nt, Mycobacterium tuberculosis H37Rv
cauucgccggg

SEQ ID NO: 3270206 - RNA, 16 nt, Mycobacterium tuberculosis H37Rv
cauucggcgagccgcg

SEQ ID NO: 3270207 - RNA, 18 nt, Mycobacterium tuberculosis H37Rv
cauucgggcgugcucgcc

SEQ ID NO: 3270208 - RNA, 19 nt, Mycobacterium tuberculosis H37Rv
cauucggucagccagccca

SEQ ID NO: 3270209 - RNA, 14 nt, Mycobacterium tuberculosis H37Rv
cauucgguguggcc

SEQ ID NO: 3270210 - RNA, 22 nt, Mycobacterium tuberculosis H37Rv
cauucgugggaaccaccagcac

SEQ ID NO: 3270211 - RNA, 16 nt, Mycobacterium tuberculosis H37Rv
cauucucgccgacggc

SEQ ID NO: 3270212 - RNA, 19 nt, Mycobacterium tuberculosis H37Rv
cauucugcagcgucuccuu

SEQ ID NO: 3270213 - RNA, 12 nt, Mycobacterium tuberculosis H37Rv
cauucugcugcc

SEQ ID NO: 3270214 - RNA, 16 nt, Mycobacterium tuberculosis H37Rv
cauugaguucggccac

SEQ ID NO: 3270215 - RNA, 19 nt, Mycobacterium tuberculosis H37Rv
cauugaucgacggccagcc

SEQ ID NO: 3270216 - RNA, 21 nt, Mycobacterium tuberculosis H37Rv
cauugaucgacggccagccca

SEQ ID NO: 3270217 - RNA, 15 nt, Mycobacterium tuberculosis H37Rv
cauugcagaaccgcc

SEQ ID NO: 3270218 - RNA, 22 nt, Mycobacterium tuberculosis H37Rv
cauugcaugguuucguuccucg

SEQ ID NO: 3270219 - RNA, 11 nt, Mycobacterium tuberculosis H37Rv
cauugcccaca

SEQ ID NO: 3270220 - RNA, 14 nt, Mycobacterium tuberculosis H37Rv
cauugcccauagcc

SEQ ID NO: 3270221 - RNA, 18 nt, Mycobacterium tuberculosis H37Rv
cauugcccauagccaggu

SEQ ID NO: 3270222 - RNA, 21 nt, Mycobacterium tuberculosis H37Rv
cauugcccguguuaaagaagc

SEQ ID NO: 3270223 - RNA, 18 nt, Mycobacterium tuberculosis H37Rv
cauugccgacgcgcggcc

SEQ ID NO: 3270224 - RNA, 20 nt, Mycobacterium tuberculosis H37Rv
cauugccgauuacgacuugg

SEQ ID NO: 3270225 - RNA, 13 nt, Mycobacterium tuberculosis H37Rv
cauugccgccggc

SEQ ID NO: 3270226 - RNA, 21 nt, Mycobacterium tuberculosis H37Rv
cauugccguucucgucgagga

SEQ ID NO: 3270227 - RNA, 19 nt, Mycobacterium tuberculosis H37Rv
cauugcgcccagcgacccg

SEQ ID NO: 3270228 - RNA, 15 nt, Mycobacterium tuberculosis H37Rv
cauugcgccugaaua

SEQ ID NO: 3270229 - RNA, 21 nt, Mycobacterium tuberculosis H37Rv
cauugcgggagccucgccugu

SEQ ID NO: 3270230 - RNA, 22 nt, Mycobacterium tuberculosis H37Rv
cauugcugcccaauggcguucg

SEQ ID NO: 3270231 - RNA, 19 nt, Mycobacterium tuberculosis H37Rv
cauugcugcucgugagccc

SEQ ID NO: 3270232 - RNA, 22 nt, Mycobacterium tuberculosis H37Rv
cauugcugcucgugagccccag

SEQ ID NO: 3270233 - RNA, 18 nt, Mycobacterium tuberculosis H37Rv
cauuggaugccauaggac

SEQ ID NO: 3270234 - RNA, 23 nt, Mycobacterium tuberculosis H37Rv
cauuggccuaggacaccggcacc

SEQ ID NO: 3270235 - RNA, 20 nt, Mycobacterium tuberculosis H37Rv
cauuggcggugcgcaccacc

SEQ ID NO: 3270236 - RNA, 13 nt, Mycobacterium tuberculosis H37Rv
cauuggcuccgaa

SEQ ID NO: 3270237 - RNA, 16 nt, Mycobacterium tuberculosis H37Rv
cauuggcuuguccggu

SEQ ID NO: 3270238 - RNA, 22 nt, Mycobacterium tuberculosis H37Rv
cauugggguggcaucgaacgcc

SEQ ID NO: 3270239 - RNA, 17 nt, Mycobacterium tuberculosis H37Rv
cauugguaccggcuucg

SEQ ID NO: 3270240 - RNA, 17 nt, Mycobacterium tuberculosis H37Rv
cauugguguccaccacc

SEQ ID NO: 3270241 - RNA, 21 nt, Mycobacterium tuberculosis H37Rv
cauugucgccaaauaccguga

SEQ ID NO: 3270242 - RNA, 14 nt, Mycobacterium tuberculosis H37Rv
cauugugcucgccg

SEQ ID NO: 3270243 - RNA, 22 nt, Mycobacterium tuberculosis H37Rv
cauuucaacguauccccgacca

SEQ ID NO: 3270244 - RNA, 14 nt, Mycobacterium tuberculosis H37Rv
cauuuccacaucca

SEQ ID NO: 3270245 - RNA, 21 nt, Mycobacterium tuberculosis H37Rv
cauuuccacauccaacgaccu

SEQ ID NO: 3270246 - RNA, 14 nt, Mycobacterium tuberculosis H37Rv
cauuucggaacgcc

SEQ ID NO: 3270247 - RNA, 13 nt, Mycobacterium tuberculosis H37Rv
ccaagaugccgcc

SEQ ID NO: 3270248 - RNA, 22 nt, Mycobacterium tuberculosis H37Rv
ccaagcaauuccaccgccgaga

SEQ ID NO: 3270249 - RNA, 19 nt, Mycobacterium tuberculosis H37Rv
ccaagcagacgcagaaucg

SEQ ID NO: 3270250 - RNA, 15 nt, Mycobacterium tuberculosis H37Rv
ccaagcccaggcgau

SEQ ID NO: 3270251 - RNA, 19 nt, Mycobacterium tuberculosis H37Rv
ccaagcccgccggacccgc

SEQ ID NO: 3270252 - RNA, 12 nt, Mycobacterium tuberculosis H37Rv
ccaagccgcggc

SEQ ID NO: 3270253 - RNA, 16 nt, Mycobacterium tuberculosis H37Rv
ccaagccgcggcuagg

SEQ ID NO: 3270254 - RNA, 22 nt, Mycobacterium tuberculosis H37Rv
ccaagccgcggcuaggccagca

SEQ ID NO: 3270255 - RNA, 15 nt, Mycobacterium tuberculosis H37Rv
ccaagccggagcccg

SEQ ID NO: 3270256 - RNA, 16 nt, Mycobacterium tuberculosis H37Rv
ccaagccggccacgca

SEQ ID NO: 3270257 - RNA, 12 nt, Mycobacterium tuberculosis H37Rv
ccaagccgugcc

SEQ ID NO: 3270258 - RNA, 19 nt, Mycobacterium tuberculosis H37Rv
ccaagcgagcggucgacgu

SEQ ID NO: 3270259 - RNA, 13 nt, Mycobacterium tuberculosis H37Rv
ccaagcgcggugg

SEQ ID NO: 3270260 - RNA, 15 nt, Mycobacterium tuberculosis H37Rv
ccaagcgugccugca

SEQ ID NO: 3270261 - RNA, 19 nt, Mycobacterium tuberculosis H37Rv
ccaagcucggccaccagcg

SEQ ID NO: 3270262 - RNA, 16 nt, Mycobacterium tuberculosis H37Rv
ccaagcucggccagca

SEQ ID NO: 3270263 - RNA, 18 nt, Mycobacterium tuberculosis H37Rv
ccaaggccgucgacccag

SEQ ID NO: 3270264 - RNA, 13 nt, Mycobacterium tuberculosis H37Rv
ccaaggcucagca

SEQ ID NO: 3270265 - RNA, 16 nt, Mycobacterium tuberculosis H37Rv
ccaaggcucagcagcg

SEQ ID NO: 3270266 - RNA, 14 nt, Mycobacterium tuberculosis H37Rv
ccaaggcuuccucc

SEQ ID NO: 3270267 - RNA, 13 nt, Mycobacterium tuberculosis H37Rv
ccaaggucgaccc

SEQ ID NO: 3270268 - RNA, 19 nt, Mycobacterium tuberculosis H37Rv
ccaaggucuucaggccgcg

SEQ ID NO: 3270269 - RNA, 20 nt, Mycobacterium tuberculosis H37Rv
ccaaggucuucaggccgcgc

SEQ ID NO: 3270270 - RNA, 15 nt, Mycobacterium tuberculosis H37Rv
ccaagguggccacca

SEQ ID NO: 3270271 - RNA, 14 nt, Mycobacterium tuberculosis H37Rv
ccaagguguccagc

SEQ ID NO: 3270272 - RNA, 15 nt, Mycobacterium tuberculosis H37Rv
ccaagguguccagca

SEQ ID NO: 3270273 - RNA, 17 nt, Mycobacterium tuberculosis H37Rv
ccaagguuggucggugc

SEQ ID NO: 3270274 - RNA, 17 nt, Mycobacterium tuberculosis H37Rv
ccaaguacgcgaccgcg

SEQ ID NO: 3270275 - RNA, 14 nt, Mycobacterium tuberculosis H37Rv
ccaaguccagcagc

SEQ ID NO: 3270276 - RNA, 18 nt, Mycobacterium tuberculosis H37Rv
ccaaguccuccacggcgg

SEQ ID NO: 3270277 - RNA, 19 nt, Mycobacterium tuberculosis H37Rv
ccaagugaccggccugcga

SEQ ID NO: 3270278 - RNA, 16 nt, Mycobacterium tuberculosis H37Rv
ccaaguugaccuucac

SEQ ID NO: 3270279 - RNA, 15 nt, Mycobacterium tuberculosis H37Rv
ccaauaguccuugcg

SEQ ID NO: 3270280 - RNA, 16 nt, Mycobacterium tuberculosis H37Rv
ccaauauugcguucgg

SEQ ID NO: 3270281 - RNA, 18 nt, Mycobacterium tuberculosis H37Rv
ccaauauugcguucgggc

SEQ ID NO: 3270282 - RNA, 15 nt, Mycobacterium tuberculosis H37Rv
ccaaucagcccgccg

SEQ ID NO: 3270283 - RNA, 19 nt, Mycobacterium tuberculosis H37Rv
ccaauccggcgccagcagu

SEQ ID NO: 3270284 - RNA, 16 nt, Mycobacterium tuberculosis H37Rv
ccaauccggggcccgg

SEQ ID NO: 3270285 - RNA, 15 nt, Mycobacterium tuberculosis H37Rv
ccaaucgaguagcug

SEQ ID NO: 3270286 - RNA, 18 nt, Mycobacterium tuberculosis H37Rv
ccaaucgucggccagcag

SEQ ID NO: 3270287 - RNA, 19 nt, Mycobacterium tuberculosis H37Rv
ccaaucuucucgagccgcc

SEQ ID NO: 3270288 - RNA, 13 nt, Mycobacterium tuberculosis H37Rv
ccaaugacgucgg

SEQ ID NO: 3270289 - RNA, 23 nt, Mycobacterium tuberculosis H37Rv
ccaaugcaccguuguaugcugcg

SEQ ID NO: 3270290 - RNA, 17 nt, Mycobacterium tuberculosis H37Rv
ccaaugccaccgcggcc

SEQ ID NO: 3270291 - RNA, 15 nt, Mycobacterium tuberculosis H37Rv
ccaaugcccaggugu

SEQ ID NO: 3270292 - RNA, 19 nt, Mycobacterium tuberculosis H37Rv
ccaaugcccuuggccagca

SEQ ID NO: 3270293 - RNA, 12 nt, Mycobacterium tuberculosis H37Rv
ccaaugccgcgg

SEQ ID NO: 3270294 - RNA, 18 nt, Mycobacterium tuberculosis H37Rv
ccaaugccguugaucgca

SEQ ID NO: 3270295 - RNA, 19 nt, Mycobacterium tuberculosis H37Rv
ccaaugccuugagcaaaau

SEQ ID NO: 3270296 - RNA, 21 nt, Mycobacterium tuberculosis H37Rv
ccaaugcguugacgucgagca

SEQ ID NO: 3270297 - RNA, 17 nt, Mycobacterium tuberculosis H37Rv
ccaauggccgcggcacc

SEQ ID NO: 3270298 - RNA, 16 nt, Mycobacterium tuberculosis H37Rv
ccaauggccugcagcg

SEQ ID NO: 3270299 - RNA, 14 nt, Mycobacterium tuberculosis H37Rv
ccaauggcguucgu

SEQ ID NO: 3270300 - RNA, 15 nt, Mycobacterium tuberculosis H37Rv
ccaauggcguucguc

SEQ ID NO: 3270301 - RNA, 20 nt, Mycobacterium tuberculosis H37Rv
ccaauggcguucgucggcug

SEQ ID NO: 3270302 - RNA, 20 nt, Mycobacterium tuberculosis H37Rv
ccaauggugggcgagcugcu

SEQ ID NO: 3270303 - RNA, 19 nt, Mycobacterium tuberculosis H37Rv
ccaauuacagcuugcgcag

SEQ ID NO: 3270304 - RNA, 18 nt, Mycobacterium tuberculosis H37Rv
ccaauucacgacgccgag

SEQ ID NO: 3270305 - RNA, 17 nt, Mycobacterium tuberculosis H37Rv
ccaauucgacugcaacu

SEQ ID NO: 3270306 - RNA, 23 nt, Mycobacterium tuberculosis H37Rv
ccaauucgacugcaacucuuccc

SEQ ID NO: 3270307 - RNA, 16 nt, Mycobacterium tuberculosis H37Rv
ccaauugauaggcccc

SEQ ID NO: 3270308 - RNA, 13 nt, Mycobacterium tuberculosis H37Rv
ccaauuggcgucg

SEQ ID NO: 3270309 - RNA, 17 nt, Mycobacterium tuberculosis H37Rv
ccacaaccgaauccauc

SEQ ID NO: 3270310 - RNA, 20 nt, Mycobacterium tuberculosis H37Rv
ccacaaccgugagcaccagc

SEQ ID NO: 3270311 - RNA, 13 nt, Mycobacterium tuberculosis H37Rv
ccacaacgccucg

SEQ ID NO: 3270312 - RNA, 23 nt, Mycobacterium tuberculosis H37Rv
ccacaacgccucgauggcggugg

SEQ ID NO: 3270313 - RNA, 17 nt, Mycobacterium tuberculosis H37Rv
ccacaaggguuggccga

SEQ ID NO: 3270314 - RNA, 19 nt, Mycobacterium tuberculosis H37Rv
ccacaaucagcccgacacc

SEQ ID NO: 3270315 - RNA, 13 nt, Mycobacterium tuberculosis H37Rv
ccacaaucgcaga

SEQ ID NO: 3270316 - RNA, 21 nt, Mycobacterium tuberculosis H37Rv
ccacaaugcaaauagccuugu

SEQ ID NO: 3270317 - RNA, 19 nt, Mycobacterium tuberculosis H37Rv
ccacacagucggugcagcg

SEQ ID NO: 3270318 - RNA, 14 nt, Mycobacterium tuberculosis H37Rv
ccacaccaaggccg

SEQ ID NO: 3270319 - RNA, 16 nt, Mycobacterium tuberculosis H37Rv
ccacaccagcgcagca

SEQ ID NO: 3270320 - RNA, 13 nt, Mycobacterium tuberculosis H37Rv
ccacaccaggccg

SEQ ID NO: 3270321 - RNA, 14 nt, Mycobacterium tuberculosis H37Rv
ccacacccaaaccg

SEQ ID NO: 3270322 - RNA, 21 nt, Mycobacterium tuberculosis H37Rv
ccacacccagcgugcccgcca

SEQ ID NO: 3270323 - RNA, 14 nt, Mycobacterium tuberculosis H37Rv
ccacacccaguuga

SEQ ID NO: 3270324 - RNA, 16 nt, Mycobacterium tuberculosis H37Rv
ccacaccgaccgcggg

SEQ ID NO: 3270325 - RNA, 15 nt, Mycobacterium tuberculosis H37Rv
ccacaccgaguugau

SEQ ID NO: 3270326 - RNA, 13 nt, Mycobacterium tuberculosis H37Rv
ccacaccggcagc

SEQ ID NO: 3270327 - RNA, 14 nt, Mycobacterium tuberculosis H37Rv
ccacaccgugacca

SEQ ID NO: 3270328 - RNA, 21 nt, Mycobacterium tuberculosis H37Rv
ccacaccgugggcgacggcgg

SEQ ID NO: 3270329 - RNA, 19 nt, Mycobacterium tuberculosis H37Rv
ccacaccuccucgagcagg

SEQ ID NO: 3270330 - RNA, 17 nt, Mycobacterium tuberculosis H37Rv
ccacaccuucggcuggu

SEQ ID NO: 3270331 - RNA, 18 nt, Mycobacterium tuberculosis H37Rv
ccacaccuuggcggucgg

SEQ ID NO: 3270332 - RNA, 13 nt, Mycobacterium tuberculosis H37Rv
ccacacgaagugg

SEQ ID NO: 3270333 - RNA, 22 nt, Mycobacterium tuberculosis H37Rv
ccacacgaagugggucaagauc

SEQ ID NO: 3270334 - RNA, 23 nt, Mycobacterium tuberculosis H37Rv
ccacacgcccucgacgccgcgca

SEQ ID NO: 3270335 - RNA, 11 nt, Mycobacterium tuberculosis H37Rv
ccacacgcugc

SEQ ID NO: 3270336 - RNA, 12 nt, Mycobacterium tuberculosis H37Rv
ccacacgcugcc

SEQ ID NO: 3270337 - RNA, 17 nt, Mycobacterium tuberculosis H37Rv
ccacacggggccgccag

SEQ ID NO: 3270338 - RNA, 20 nt, Mycobacterium tuberculosis H37Rv
ccacacggggccgccagcug

SEQ ID NO: 3270339 - RNA, 23 nt, Mycobacterium tuberculosis H37Rv
ccacacucgccagggccaucugg

SEQ ID NO: 3270340 - RNA, 17 nt, Mycobacterium tuberculosis H37Rv
ccacagaccgaacagca

SEQ ID NO: 3270341 - RNA, 12 nt, Mycobacterium tuberculosis H37Rv
ccacagacgacg

SEQ ID NO: 3270342 - RNA, 11 nt, Mycobacterium tuberculosis H37Rv
ccacagcaacg

SEQ ID NO: 3270343 - RNA, 20 nt, Mycobacterium tuberculosis H37Rv
ccacagcauaaagaucagca

SEQ ID NO: 3270344 - RNA, 19 nt, Mycobacterium tuberculosis H37Rv
ccaccccccagcgccgccg

SEQ ID NO: 3270345 - RNA, 19 nt, Mycobacterium tuberculosis H37Rv
ccaccccgcguaugccagg

SEQ ID NO: 3270346 - RNA, 13 nt, Mycobacterium tuberculosis H37Rv
ccaccccggccaa

SEQ ID NO: 3270347 - RNA, 23 nt, Mycobacterium tuberculosis H37Rv
ccaccccggucggagcggugccg

SEQ ID NO: 3270348 - RNA, 14 nt, Mycobacterium tuberculosis H37Rv
ccaccccguagcgg

SEQ ID NO: 3270349 - RNA, 15 nt, Mycobacterium tuberculosis H37Rv
ccaccccgucugcag

SEQ ID NO: 3270350 - RNA, 22 nt, Mycobacterium tuberculosis H37Rv
ccaccccgucugcagggucgag

SEQ ID NO: 3270351 - RNA, 18 nt, Mycobacterium tuberculosis H37Rv
ccaccccguuggcggugg

SEQ ID NO: 3270352 - RNA, 22 nt, Mycobacterium tuberculosis H37Rv
ccacccgacaacgcugggcggc

SEQ ID NO: 3270353 - RNA, 17 nt, Mycobacterium tuberculosis H37Rv
ccacccgacaugcgccg

SEQ ID NO: 3270354 - RNA, 19 nt, Mycobacterium tuberculosis H37Rv
ccacccgacaugcgccgag

SEQ ID NO: 3270355 - RNA, 19 nt, Mycobacterium tuberculosis H37Rv
ccacccgauauucggccau

SEQ ID NO: 3270356 - RNA, 16 nt, Mycobacterium tuberculosis H37Rv
ccacccgcaccgccgg

SEQ ID NO: 3270357 - RNA, 16 nt, Mycobacterium tuberculosis H37Rv
ccacccgcaccgcggu

SEQ ID NO: 3270358 - RNA, 14 nt, Mycobacterium tuberculosis H37Rv
ccacccgccgcagc

SEQ ID NO: 3270359 - RNA, 19 nt, Mycobacterium tuberculosis H37Rv
ccacccgcgcgaugcuggc

SEQ ID NO: 3270360 - RNA, 23 nt, Mycobacterium tuberculosis H37Rv
ccacccgcggcgccguugccgcc

SEQ ID NO: 3270361 - RNA, 13 nt, Mycobacterium tuberculosis H37Rv
ccacccggccgcg

SEQ ID NO: 3270362 - RNA, 14 nt, Mycobacterium tuberculosis H37Rv
ccacccgggccucg

SEQ ID NO: 3270363 - RNA, 14 nt, Mycobacterium tuberculosis H37Rv
ccacccgguccugc

SEQ ID NO: 3270364 - RNA, 12 nt, Mycobacterium tuberculosis H37Rv
ccacccuugccg

SEQ ID NO: 3270365 - RNA, 15 nt, Mycobacterium tuberculosis H37Rv
ccacccuugccgccg

SEQ ID NO: 3270366 - RNA, 19 nt, Mycobacterium tuberculosis H37Rv
ccaccgaaaaguccgccgc

SEQ ID NO: 3270367 - RNA, 23 nt, Mycobacterium tuberculosis H37Rv
ccaccgaaauacccagcgcagca

SEQ ID NO: 3270368 - RNA, 18 nt, Mycobacterium tuberculosis H37Rv
ccaccgaacgcggccacc

SEQ ID NO: 3270369 - RNA, 24 nt, Mycobacterium tuberculosis H37Rv
ccaccgaacgcggccaccgaccgc

SEQ ID NO: 3270370 - RNA, 16 nt, Mycobacterium tuberculosis H37Rv
ccaccgaagcggugac

SEQ ID NO: 3270371 - RNA, 20 nt, Mycobacterium tuberculosis H37Rv
ccaccgaagcggugacccac

SEQ ID NO: 3270372 - RNA, 21 nt, Mycobacterium tuberculosis H37Rv
ccaccgacaagaauggccgcc

SEQ ID NO: 3270373 - RNA, 15 nt, Mycobacterium tuberculosis H37Rv
ccaccgacagcaccc

SEQ ID NO: 3270374 - RNA, 20 nt, Mycobacterium tuberculosis H37Rv
ccaccgaccgcacgaucgca

SEQ ID NO: 3270375 - RNA, 22 nt, Mycobacterium tuberculosis H37Rv
ccaccgacgacaucgguggccc

SEQ ID NO: 3270376 - RNA, 17 nt, Mycobacterium tuberculosis H37Rv
ccaccgagaucaugccg

SEQ ID NO: 3270377 - RNA, 18 nt, Mycobacterium tuberculosis H37Rv
ccaccgagcccuccaggg

SEQ ID NO: 3270378 - RNA, 22 nt, Mycobacterium tuberculosis H37Rv
ccaccgauaccgucagcgccgc

SEQ ID NO: 3270379 - RNA, 13 nt, Mycobacterium tuberculosis H37Rv
ccaccgaucgacu

SEQ ID NO: 3270380 - RNA, 18 nt, Mycobacterium tuberculosis H37Rv
ccaccgaucgacugcagc

SEQ ID NO: 3270381 - RNA, 21 nt, Mycobacterium tuberculosis H37Rv
ccaccgauucggcgacgaacu

SEQ ID NO: 3270382 - RNA, 14 nt, Mycobacterium tuberculosis H37Rv
ccaccgcaaaggag

SEQ ID NO: 3270383 - RNA, 17 nt, Mycobacterium tuberculosis H37Rv
ccaccgcacgcuggcgg

SEQ ID NO: 3270384 - RNA, 18 nt, Mycobacterium tuberculosis H37Rv
ccaccgcauaacgccagu

SEQ ID NO: 3270385 - RNA, 21 nt, Mycobacterium tuberculosis H37Rv
ccaccgccgaacagugucgau

SEQ ID NO: 3270386 - RNA, 21 nt, Mycobacterium tuberculosis H37Rv
ccaccgccgacaggccggcca

SEQ ID NO: 3270387 - RNA, 12 nt, Mycobacterium tuberculosis H37Rv
ccaccgccgcca

SEQ ID NO: 3270388 - RNA, 13 nt, Mycobacterium tuberculosis H37Rv
ccaccgccgccgg

SEQ ID NO: 3270389 - RNA, 19 nt, Mycobacterium tuberculosis H37Rv
ccaccgccgccggcaccgc

SEQ ID NO: 3270390 - RNA, 12 nt, Mycobacterium tuberculosis H37Rv
ccaccgccgccu

SEQ ID NO: 3270391 - RNA, 22 nt, Mycobacterium tuberculosis H37Rv
ccaccgccgccugcccggcccg

SEQ ID NO: 3270392 - RNA, 12 nt, Mycobacterium tuberculosis H37Rv
ccaccgccgcug

SEQ ID NO: 3270393 - RNA, 14 nt, Mycobacterium tuberculosis H37Rv
ccaccgccggcccg

SEQ ID NO: 3270394 - RNA, 18 nt, Mycobacterium tuberculosis H37Rv
ccaccgccuggaucagcg

SEQ ID NO: 3270395 - RNA, 14 nt, Mycobacterium tuberculosis H37Rv
ccaccgcgagcaga

SEQ ID NO: 3270396 - RNA, 18 nt, Mycobacterium tuberculosis H37Rv
ccaccgcgagcagaggau

SEQ ID NO: 3270397 - RNA, 24 nt, Mycobacterium tuberculosis H37Rv
ccaccgcgaugccccacggugcgg

SEQ ID NO: 3270398 - RNA, 14 nt, Mycobacterium tuberculosis H37Rv
ccaccgcgcaaccc

SEQ ID NO: 3270399 - RNA, 17 nt, Mycobacterium tuberculosis H37Rv
ccaccgcgccgagcaga

SEQ ID NO: 3270400 - RNA, 16 nt, Mycobacterium tuberculosis H37Rv
ccaccgcgccgucguc

SEQ ID NO: 3270401 - RNA, 15 nt, Mycobacterium tuberculosis H37Rv
ccaccgcgcggcgca

SEQ ID NO: 3270402 - RNA, 22 nt, Mycobacterium tuberculosis H37Rv
ccaccgcggcaugugacaucgg

SEQ ID NO: 3270403 - RNA, 14 nt, Mycobacterium tuberculosis H37Rv
ccaccgcggccgcg

SEQ ID NO: 3270404 - RNA, 20 nt, Mycobacterium tuberculosis H37Rv
ccaccgcggccgcggucgau

SEQ ID NO: 3270405 - RNA, 20 nt, Mycobacterium tuberculosis H37Rv
ccaccgcggcgucgccgugc

SEQ ID NO: 3270406 - RNA, 15 nt, Mycobacterium tuberculosis H37Rv
ccaccgcggucaccg

SEQ ID NO: 3270407 - RNA, 20 nt, Mycobacterium tuberculosis H37Rv
ccaccgcggucaccgacgca

SEQ ID NO: 3270408 - RNA, 13 nt, Mycobacterium tuberculosis H37Rv
ccaccgcgguggc

SEQ ID NO: 3270409 - RNA, 18 nt, Mycobacterium tuberculosis H37Rv
ccaccgcgguggcggcga

SEQ ID NO: 3270410 - RNA, 14 nt, Mycobacterium tuberculosis H37Rv
ccaccgcguccagg

SEQ ID NO: 3270411 - RNA, 23 nt, Mycobacterium tuberculosis H37Rv
ccaccgcucgucguccggccacg

SEQ ID NO: 3270412 - RNA, 15 nt, Mycobacterium tuberculosis H37Rv
ccaccgcugccggca

SEQ ID NO: 3270413 - RNA, 12 nt, Mycobacterium tuberculosis H37Rv
ccaccgcugcga

SEQ ID NO: 3270414 - RNA, 22 nt, Mycobacterium tuberculosis H37Rv
ccaccggaauccgggccgccgc

SEQ ID NO: 3270415 - RNA, 21 nt, Mycobacterium tuberculosis H37Rv
ccaccggaccgaccaccgcga

SEQ ID NO: 3270416 - RNA, 21 nt, Mycobacterium tuberculosis H37Rv
ccaccggacgaaacgaucgcg

SEQ ID NO: 3270417 - RNA, 21 nt, Mycobacterium tuberculosis H37Rv
ccaccggaucgucgaacagca

SEQ ID NO: 3270418 - RNA, 13 nt, Mycobacterium tuberculosis H37Rv
ccaccggcaccgc

SEQ ID NO: 3270419 - RNA, 17 nt, Mycobacterium tuberculosis H37Rv
ccaccggcaccgccugc

SEQ ID NO: 3270420 - RNA, 17 nt, Mycobacterium tuberculosis H37Rv
ccaccggcaccggccgu

SEQ ID NO: 3270421 - RNA, 14 nt, Mycobacterium tuberculosis H37Rv
ccaccggcacggug

SEQ ID NO: 3270422 - RNA, 19 nt, Mycobacterium tuberculosis H37Rv
ccaccggcagaugagucaa

SEQ ID NO: 3270423 - RNA, 21 nt, Mycobacterium tuberculosis H37Rv
ccaccggccccaccggcaccc

SEQ ID NO: 3270424 - RNA, 13 nt, Mycobacterium tuberculosis H37Rv
ccaccggcccucg

SEQ ID NO: 3270425 - RNA, 14 nt, Mycobacterium tuberculosis H37Rv
ccaccggccgcgca

SEQ ID NO: 3270426 - RNA, 14 nt, Mycobacterium tuberculosis H37Rv
ccaccggccggcgc

SEQ ID NO: 3270427 - RNA, 16 nt, Mycobacterium tuberculosis H37Rv
ccaccggccgucccgc

SEQ ID NO: 3270428 - RNA, 21 nt, Mycobacterium tuberculosis H37Rv
ccaccggccgucccgcgagca

SEQ ID NO: 3270429 - RNA, 19 nt, Mycobacterium tuberculosis H37Rv
ccaccggcgccaccggcgc

SEQ ID NO: 3270430 - RNA, 15 nt, Mycobacterium tuberculosis H37Rv
ccaccggcgccgccc

SEQ ID NO: 3270431 - RNA, 19 nt, Mycobacterium tuberculosis H37Rv
ccaccggcgccgccggcac

SEQ ID NO: 3270432 - RNA, 16 nt, Mycobacterium tuberculosis H37Rv
ccaccggcgccgccgu

SEQ ID NO: 3270433 - RNA, 19 nt, Mycobacterium tuberculosis H37Rv
ccaccggcgccgccgucgc

SEQ ID NO: 3270434 - RNA, 15 nt, Mycobacterium tuberculosis H37Rv
ccaccggcgccuccg

SEQ ID NO: 3270435 - RNA, 20 nt, Mycobacterium tuberculosis H37Rv
ccaccggcgucugcccgccc

SEQ ID NO: 3270436 - RNA, 23 nt, Mycobacterium tuberculosis H37Rv
ccaccggcugauucgagccacau

SEQ ID NO: 3270437 - RNA, 15 nt, Mycobacterium tuberculosis H37Rv
ccaccggcugcaacc

SEQ ID NO: 3270438 - RNA, 15 nt, Mycobacterium tuberculosis H37Rv
ccaccggcuggugcc

SEQ ID NO: 3270439 - RNA, 14 nt, Mycobacterium tuberculosis H37Rv
ccaccgggccgaca

SEQ ID NO: 3270440 - RNA, 22 nt, Mycobacterium tuberculosis H37Rv
ccacgccgaucaacaugccggu

SEQ ID NO: 3270441 - RNA, 12 nt, Mycobacterium tuberculosis H37Rv
ccacgccgaucu

SEQ ID NO: 3270442 - RNA, 21 nt, Mycobacterium tuberculosis H37Rv
ccacgccggcaucgucgacgc

SEQ ID NO: 3270443 - RNA, 20 nt, Mycobacterium tuberculosis H37Rv
ccacgccgggcaaggccacc

SEQ ID NO: 3270444 - RNA, 21 nt, Mycobacterium tuberculosis H37Rv
ccacgccguagcgcagcgccu

SEQ ID NO: 3270445 - RNA, 14 nt, Mycobacterium tuberculosis H37Rv
ccacgccgucgaca

SEQ ID NO: 3270446 - RNA, 16 nt, Mycobacterium tuberculosis H37Rv
ccacgccgucgacaac

SEQ ID NO: 3270447 - RNA, 12 nt, Mycobacterium tuberculosis H37Rv
ccacgccgugcu

SEQ ID NO: 3270448 - RNA, 15 nt, Mycobacterium tuberculosis H37Rv
ccacgcgccgcacau

SEQ ID NO: 3270449 - RNA, 15 nt, Mycobacterium tuberculosis H37Rv
ccacgcgcucggugc

SEQ ID NO: 3270450 - RNA, 23 nt, Mycobacterium tuberculosis H37Rv
ccacgcggauaucuugcgcaugu

SEQ ID NO: 3270451 - RNA, 15 nt, Mycobacterium tuberculosis H37Rv
ccacgcgucgguuga

SEQ ID NO: 3270452 - RNA, 17 nt, Mycobacterium tuberculosis H37Rv
ccacgcguugacgaucu

SEQ ID NO: 3270453 - RNA, 17 nt, Mycobacterium tuberculosis H37Rv
ccacgcguuucgaaccg

SEQ ID NO: 3270454 - RNA, 19 nt, Mycobacterium tuberculosis H37Rv
ccacgcuccccagcgaauc

SEQ ID NO: 3270455 - RNA, 22 nt, Mycobacterium tuberculosis H37Rv
ccacgcucggcggccagcuccc

SEQ ID NO: 3270456 - RNA, 15 nt, Mycobacterium tuberculosis H37Rv
ccacgcugaccaacg

SEQ ID NO: 3270457 - RNA, 14 nt, Mycobacterium tuberculosis H37Rv
ccacgcugccgcag

SEQ ID NO: 3270458 - RNA, 18 nt, Mycobacterium tuberculosis H37Rv
ccacgcuuaacgacggga

SEQ ID NO: 3270459 - RNA, 13 nt, Mycobacterium tuberculosis H37Rv
ccacggagaccgg

SEQ ID NO: 3270460 - RNA, 17 nt, Mycobacterium tuberculosis H37Rv
ccacggcaaaggcgcuc

SEQ ID NO: 3270461 - RNA, 22 nt, Mycobacterium tuberculosis H37Rv
ccacggcaaaggcgcucugcug

SEQ ID NO: 3270462 - RNA, 21 nt, Mycobacterium tuberculosis H37Rv
ccacggcagccaaccggcgca

SEQ ID NO: 3270463 - RNA, 23 nt, Mycobacterium tuberculosis H37Rv
ccacggcagccaaccggcgcagu

SEQ ID NO: 3270464 - RNA, 14 nt, Mycobacterium tuberculosis H37Rv
ccacggcagcgccg

SEQ ID NO: 3270465 - RNA, 18 nt, Mycobacterium tuberculosis H37Rv
ccacggcaucggccaccu

SEQ ID NO: 3270466 - RNA, 13 nt, Mycobacterium tuberculosis H37Rv
ccacggccgccga

SEQ ID NO: 3270467 - RNA, 13 nt, Mycobacterium tuberculosis H37Rv
ccacggccgccgc

SEQ ID NO: 3270468 - RNA, 18 nt, Mycobacterium tuberculosis H37Rv
ccacggccggccgcugcc

SEQ ID NO: 3270469 - RNA, 16 nt, Mycobacterium tuberculosis H37Rv
ccacggccuucagcgg

SEQ ID NO: 3270470 - RNA, 16 nt, Mycobacterium tuberculosis H37Rv
ccacggcgaccacgcc

SEQ ID NO: 3270471 - RNA, 18 nt, Mycobacterium tuberculosis H37Rv
ccacggcgaccacgccgc

SEQ ID NO: 3270472 - RNA, 20 nt, Mycobacterium tuberculosis H37Rv
ccacggcgaccacgccgccg

SEQ ID NO: 3270473 - RNA, 23 nt, Mycobacterium tuberculosis H37Rv
ccacggcgaccaggagccuccag

SEQ ID NO: 3270474 - RNA, 22 nt, Mycobacterium tuberculosis H37Rv
ccacggcgauccggucggccag

SEQ ID NO: 3270475 - RNA, 20 nt, Mycobacterium tuberculosis H37Rv
ccacggcgaugcagccacau

SEQ ID NO: 3270476 - RNA, 12 nt, Mycobacterium tuberculosis H37Rv
ccacggcgcagu

SEQ ID NO: 3270477 - RNA, 16 nt, Mycobacterium tuberculosis H37Rv
ccacggcgccaccacc

SEQ ID NO: 3270478 - RNA, 23 nt, Mycobacterium tuberculosis H37Rv
ccacggcgcgcgcgccggcugcc

SEQ ID NO: 3270479 - RNA, 21 nt, Mycobacterium tuberculosis H37Rv
ccacggcggccaccugcuggc

SEQ ID NO: 3270480 - RNA, 17 nt, Mycobacterium tuberculosis H37Rv
ccacggcgggcgacccg

SEQ ID NO: 3270481 - RNA, 15 nt, Mycobacterium tuberculosis H37Rv
ccacggcgggcgagc

SEQ ID NO: 3270482 - RNA, 15 nt, Mycobacterium tuberculosis H37Rv
ccacggcgucggcca

SEQ ID NO: 3270483 - RNA, 18 nt, Mycobacterium tuberculosis H37Rv
ccacggcgucggccaccc

SEQ ID NO: 3270484 - RNA, 15 nt, Mycobacterium tuberculosis H37Rv
ccacggcguggcgcc

SEQ ID NO: 3270485 - RNA, 19 nt, Mycobacterium tuberculosis H37Rv
ccacggcugcccauggugg

SEQ ID NO: 3270486 - RNA, 22 nt, Mycobacterium tuberculosis H37Rv
ccacggcugcccaugguggcga

SEQ ID NO: 3270487 - RNA, 18 nt, Mycobacterium tuberculosis H37Rv
ccacggcugcggaauggg

SEQ ID NO: 3270488 - RNA, 16 nt, Mycobacterium tuberculosis H37Rv
ccacggggcuuggcga

SEQ ID NO: 3270489 - RNA, 15 nt, Mycobacterium tuberculosis H37Rv
ccacggucagcacgc

SEQ ID NO: 3270490 - RNA, 13 nt, Mycobacterium tuberculosis H37Rv
ccacggucagcca

SEQ ID NO: 3270491 - RNA, 21 nt, Mycobacterium tuberculosis H37Rv
ccacggucauugggugucaau

SEQ ID NO: 3270492 - RNA, 18 nt, Mycobacterium tuberculosis H37Rv
ccacggucgccgaccacu

SEQ ID NO: 3270493 - RNA, 18 nt, Mycobacterium tuberculosis H37Rv
ccacggugccgacgauga

SEQ ID NO: 3270494 - RNA, 18 nt, Mycobacterium tuberculosis H37Rv
ccacggugcgauccccaa

SEQ ID NO: 3270495 - RNA, 14 nt, Mycobacterium tuberculosis H37Rv
ccacggugcgguga

SEQ ID NO: 3270496 - RNA, 19 nt, Mycobacterium tuberculosis H37Rv
ccacgguggccgcugccag

SEQ ID NO: 3270497 - RNA, 23 nt, Mycobacterium tuberculosis H37Rv
ccacgguggcgcaagugauuucg

SEQ ID NO: 3270498 - RNA, 14 nt, Mycobacterium tuberculosis H37Rv
ccacggugucccgc

SEQ ID NO: 3270499 - RNA, 17 nt, Mycobacterium tuberculosis H37Rv
ccacggugucgcgaugc

SEQ ID NO: 3270500 - RNA, 14 nt, Mycobacterium tuberculosis H37Rv
ccacggugucgucg

SEQ ID NO: 3270501 - RNA, 21 nt, Mycobacterium tuberculosis H37Rv
ccacgguucuuccuggucgac

SEQ ID NO: 3270502 - RNA, 15 nt, Mycobacterium tuberculosis H37Rv
ccacgguugccggcg

SEQ ID NO: 3270503 - RNA, 16 nt, Mycobacterium tuberculosis H37Rv
ccacgguuggccacca

SEQ ID NO: 3270504 - RNA, 23 nt, Mycobacterium tuberculosis H37Rv
ccacgguuggccaccagcuggcg

SEQ ID NO: 3270505 - RNA, 18 nt, Mycobacterium tuberculosis H37Rv
ccacguaagcgguugucc

SEQ ID NO: 3270506 - RNA, 20 nt, Mycobacterium tuberculosis H37Rv
ccacguaagcgguuguccgg

SEQ ID NO: 3270507 - RNA, 15 nt, Mycobacterium tuberculosis H37Rv
ccacguaauucccca

SEQ ID NO: 3270508 - RNA, 16 nt, Mycobacterium tuberculosis H37Rv
ccacguaauuccccag

SEQ ID NO: 3270509 - RNA, 17 nt, Mycobacterium tuberculosis H37Rv
ccacguaauuccccagg

SEQ ID NO: 3270510 - RNA, 16 nt, Mycobacterium tuberculosis H37Rv
ccacguacgcggcugc

SEQ ID NO: 3270511 - RNA, 16 nt, Mycobacterium tuberculosis H37Rv
ccacguacuccaccgc

SEQ ID NO: 3270512 - RNA, 18 nt, Mycobacterium tuberculosis H37Rv
ccacguacuccaccgcgc

SEQ ID NO: 3270513 - RNA, 20 nt, Mycobacterium tuberculosis H37Rv
ccacguacuccaccgcgccg

SEQ ID NO: 3270514 - RNA, 23 nt, Mycobacterium tuberculosis H37Rv
ccacguagcagcgccggcaccga

SEQ ID NO: 3270515 - RNA, 22 nt, Mycobacterium tuberculosis H37Rv
ccacgucaucuggcgcugcugg

SEQ ID NO: 3270516 - RNA, 23 nt, Mycobacterium tuberculosis H37Rv
ccacgucaucuggcgcugcuggc

SEQ ID NO: 3270517 - RNA, 19 nt, Mycobacterium tuberculosis H37Rv
ccacguccaacucggcccg

SEQ ID NO: 3270518 - RNA, 18 nt, Mycobacterium tuberculosis H37Rv
ccacgucccagagaauca

SEQ ID NO: 3270519 - RNA, 23 nt, Mycobacterium tuberculosis H37Rv
ccacguccgcaaccucgccgucg

SEQ ID NO: 3270520 - RNA, 15 nt, Mycobacterium tuberculosis H37Rv
ccacgucgacgaugu

SEQ ID NO: 3270521 - RNA, 14 nt, Mycobacterium tuberculosis H37Rv
ccacgucgagcagg

SEQ ID NO: 3270522 - RNA, 13 nt, Mycobacterium tuberculosis H37Rv
ccacgucgcccag

SEQ ID NO: 3270523 - RNA, 21 nt, Mycobacterium tuberculosis H37Rv
ccacgucggcgaacgcgucca

SEQ ID NO: 3270524 - RNA, 16 nt, Mycobacterium tuberculosis H37Rv
ccacgucgucgcccag

SEQ ID NO: 3270525 - RNA, 14 nt, Mycobacterium tuberculosis H37Rv
ccacgucgucgggg

SEQ ID NO: 3270526 - RNA, 20 nt, Mycobacterium tuberculosis H37Rv
ccacgugagugccggcgugc

SEQ ID NO: 3270527 - RNA, 13 nt, Mycobacterium tuberculosis H37Rv
ccacgugcgccac

SEQ ID NO: 3270528 - RNA, 21 nt, Mycobacterium tuberculosis H37Rv
ccacguugaugaugccggcgu

SEQ ID NO: 3270529 - RNA, 16 nt, Mycobacterium tuberculosis H37Rv
ccacguugcugaugcc

SEQ ID NO: 3270530 - RNA, 15 nt, Mycobacterium tuberculosis H37Rv
ccacuacaucgauca

SEQ ID NO: 3270531 - RNA, 21 nt, Mycobacterium tuberculosis H37Rv
ccacucaggaucccgguggca

SEQ ID NO: 3270532 - RNA, 16 nt, Mycobacterium tuberculosis H37Rv
ccacuccaggagccga

SEQ ID NO: 3270533 - RNA, 20 nt, Mycobacterium tuberculosis H37Rv
ccacucccagccaacccguc

SEQ ID NO: 3270534 - RNA, 13 nt, Mycobacterium tuberculosis H37Rv
ccacucccgcccc

SEQ ID NO: 3270535 - RNA, 17 nt, Mycobacterium tuberculosis H37Rv
ccacucccgccccgcuc

SEQ ID NO: 3270536 - RNA, 21 nt, Mycobacterium tuberculosis H37Rv
ccagaucgguugaucggccac

SEQ ID NO: 3270537 - RNA, 18 nt, Mycobacterium tuberculosis H37Rv
ccagaucguuccaggccg

SEQ ID NO: 3270538 - RNA, 17 nt, Mycobacterium tuberculosis H37Rv
ccagaucuugcagugcg

SEQ ID NO: 3270539 - RNA, 12 nt, Mycobacterium tuberculosis H37Rv
ccagaugcacgu

SEQ ID NO: 3270540 - RNA, 14 nt, Mycobacterium tuberculosis H37Rv
ccagaugcagcggu

SEQ ID NO: 3270541 - RNA, 13 nt, Mycobacterium tuberculosis H37Rv
ccagaugcaggcu

SEQ ID NO: 3270542 - RNA, 14 nt, Mycobacterium tuberculosis H37Rv
ccagaugcccagca

SEQ ID NO: 3270543 - RNA, 23 nt, Mycobacterium tuberculosis H37Rv
ccagaugccgguaacgaacagcg

SEQ ID NO: 3270544 - RNA, 12 nt, Mycobacterium tuberculosis H37Rv
ccagauggccac

SEQ ID NO: 3270545 - RNA, 15 nt, Mycobacterium tuberculosis H37Rv
ccagauggcucucgg

SEQ ID NO: 3270546 - RNA, 17 nt, Mycobacterium tuberculosis H37Rv
ccagauggcucucggug

SEQ ID NO: 3270547 - RNA, 21 nt, Mycobacterium tuberculosis H37Rv
ccagauguaccucaucgcaga

SEQ ID NO: 3270548 - RNA, 15 nt, Mycobacterium tuberculosis H37Rv
ccagauucgccgccc

SEQ ID NO: 3270549 - RNA, 17 nt, Mycobacterium tuberculosis H37Rv
ccagauuggcgcugccc

SEQ ID NO: 3270550 - RNA, 15 nt, Mycobacterium tuberculosis H37Rv
ccagauuugacgaca

SEQ ID NO: 3270551 - RNA, 17 nt, Mycobacterium tuberculosis H37Rv
ccagcaaaggggugugu

SEQ ID NO: 3270552 - RNA, 21 nt, Mycobacterium tuberculosis H37Rv
ccagcaaaggggugugugcug

SEQ ID NO: 3270553 - RNA, 14 nt, Mycobacterium tuberculosis H37Rv
ccagcaacaccaga

SEQ ID NO: 3270554 - RNA, 15 nt, Mycobacterium tuberculosis H37Rv
ccagcaacaccagau

SEQ ID NO: 3270555 - RNA, 15 nt, Mycobacterium tuberculosis H37Rv
ccagcaacagcgagc

SEQ ID NO: 3270556 - RNA, 23 nt, Mycobacterium tuberculosis H37Rv
ccagcaacagcgagcgguugauc

SEQ ID NO: 3270557 - RNA, 15 nt, Mycobacterium tuberculosis H37Rv
ccagcaacagcgcgg

SEQ ID NO: 3270558 - RNA, 19 nt, Mycobacterium tuberculosis H37Rv
ccagcaaccaccccagggc

SEQ ID NO: 3270559 - RNA, 22 nt, Mycobacterium tuberculosis H37Rv
ccagcaaccucgguugguccuc

SEQ ID NO: 3270560 - RNA, 14 nt, Mycobacterium tuberculosis H37Rv
ccagcaacgguugg

SEQ ID NO: 3270561 - RNA, 14 nt, Mycobacterium tuberculosis H37Rv
ccagcaacuaccug

SEQ ID NO: 3270562 - RNA, 14 nt, Mycobacterium tuberculosis H37Rv
ccagcaacugccgc

SEQ ID NO: 3270563 - RNA, 16 nt, Mycobacterium tuberculosis H37Rv
ccagcaagacgaugac

SEQ ID NO: 3270564 - RNA, 18 nt, Mycobacterium tuberculosis H37Rv
ccagcaagugugagcaga

SEQ ID NO: 3270565 - RNA, 22 nt, Mycobacterium tuberculosis H37Rv
ccagcaagugugagcagaccca

SEQ ID NO: 3270566 - RNA, 19 nt, Mycobacterium tuberculosis H37Rv
ccagcaauaccugagcgcg

SEQ ID NO: 3270567 - RNA, 22 nt, Mycobacterium tuberculosis H37Rv
ccagcaaugcccgcaccgcguu

SEQ ID NO: 3270568 - RNA, 22 nt, Mycobacterium tuberculosis H37Rv
ccagcaccaccgcggugugcgu

SEQ ID NO: 3270569 - RNA, 16 nt, Mycobacterium tuberculosis H37Rv
ccagcaccacggccag

SEQ ID NO: 3270570 - RNA, 18 nt, Mycobacterium tuberculosis H37Rv
ccagcaccacggccagcg

SEQ ID NO: 3270571 - RNA, 19 nt, Mycobacterium tuberculosis H37Rv
ccagcaccacggcgcgcgc

SEQ ID NO: 3270572 - RNA, 15 nt, Mycobacterium tuberculosis H37Rv
ccagcacccccugca

SEQ ID NO: 3270573 - RNA, 18 nt, Mycobacterium tuberculosis H37Rv
ccagcacccgagcgaugc

SEQ ID NO: 3270574 - RNA, 19 nt, Mycobacterium tuberculosis H37Rv
ccagcacccgcagccgcga

SEQ ID NO: 3270575 - RNA, 13 nt, Mycobacterium tuberculosis H37Rv
ccagcacccgcgc

SEQ ID NO: 3270576 - RNA, 20 nt, Mycobacterium tuberculosis H37Rv
ccagcacccgcuccagcucg

SEQ ID NO: 3270577 - RNA, 12 nt, Mycobacterium tuberculosis H37Rv
ccagcacccggc

SEQ ID NO: 3270578 - RNA, 16 nt, Mycobacterium tuberculosis H37Rv
ccagcacccggcuucg

SEQ ID NO: 3270579 - RNA, 21 nt, Mycobacterium tuberculosis H37Rv
ccagcaccgccgcgccggcgg

SEQ ID NO: 3270580 - RNA, 13 nt, Mycobacterium tuberculosis H37Rv
ccagcaccggugg

SEQ ID NO: 3270581 - RNA, 17 nt, Mycobacterium tuberculosis H37Rv
ccagcaccucgaccgcc

SEQ ID NO: 3270582 - RNA, 23 nt, Mycobacterium tuberculosis H37Rv
ccagcaccucggccagcuccgcc

SEQ ID NO: 3270583 - RNA, 21 nt, Mycobacterium tuberculosis H37Rv
ccagcacgcgcgcgaccucgc

SEQ ID NO: 3270584 - RNA, 12 nt, Mycobacterium tuberculosis H37Rv
ccagcacgcugg

SEQ ID NO: 3270585 - RNA, 15 nt, Mycobacterium tuberculosis H37Rv
ccagcacggcaacca

SEQ ID NO: 3270586 - RNA, 14 nt, Mycobacterium tuberculosis H37Rv
ccagcacggccacg

SEQ ID NO: 3270587 - RNA, 15 nt, Mycobacterium tuberculosis H37Rv
ccagcacggucaacg

SEQ ID NO: 3270588 - RNA, 12 nt, Mycobacterium tuberculosis H37Rv
ccagcacggugg

SEQ ID NO: 3270589 - RNA, 13 nt, Mycobacterium tuberculosis H37Rv
ccagcacgugcca

SEQ ID NO: 3270590 - RNA, 20 nt, Mycobacterium tuberculosis H37Rv
ccagcacuccaccgcuggcc

SEQ ID NO: 3270591 - RNA, 21 nt, Mycobacterium tuberculosis H37Rv
ccagcacuccgcgggguugau

SEQ ID NO: 3270592 - RNA, 22 nt, Mycobacterium tuberculosis H37Rv
ccagcagacgccguagccggcc

SEQ ID NO: 3270593 - RNA, 14 nt, Mycobacterium tuberculosis H37Rv
ccagcagagcggca

SEQ ID NO: 3270594 - RNA, 16 nt, Mycobacterium tuberculosis H37Rv
ccagcagauccaggcg

SEQ ID NO: 3270595 - RNA, 17 nt, Mycobacterium tuberculosis H37Rv
ccagcagauccaggcgu

SEQ ID NO: 3270596 - RNA, 20 nt, Mycobacterium tuberculosis H37Rv
ccagcagauccaggcgucgg

SEQ ID NO: 3270597 - RNA, 22 nt, Mycobacterium tuberculosis H37Rv
ccagcagauucucccuugccga

SEQ ID NO: 3270598 - RNA, 12 nt, Mycobacterium tuberculosis H37Rv
ccagcagcaacc

SEQ ID NO: 3270599 - RNA, 16 nt, Mycobacterium tuberculosis H37Rv
ccagcagcaaccgcca

SEQ ID NO: 3270600 - RNA, 17 nt, Mycobacterium tuberculosis H37Rv
ccagcagcaaucagccg

SEQ ID NO: 3270601 - RNA, 14 nt, Mycobacterium tuberculosis H37Rv
ccagcagcagcgcc

SEQ ID NO: 3270602 - RNA, 14 nt, Mycobacterium tuberculosis H37Rv
ccagcagcaggcca

SEQ ID NO: 3270603 - RNA, 21 nt, Mycobacterium tuberculosis H37Rv
ccagcagcagugccaccgguu

SEQ ID NO: 3270604 - RNA, 16 nt, Mycobacterium tuberculosis H37Rv
ccagcagccagcccag

SEQ ID NO: 3270605 - RNA, 14 nt, Mycobacterium tuberculosis H37Rv
ccagcagccaggag

SEQ ID NO: 3270606 - RNA, 23 nt, Mycobacterium tuberculosis H37Rv
ccagcagcgaaaaccgucgcaga

SEQ ID NO: 3270607 - RNA, 10 nt, Mycobacterium tuberculosis H37Rv
ccagcagcgc

SEQ ID NO: 3270608 - RNA, 13 nt, Mycobacterium tuberculosis H37Rv
ccagcagcgcaac

SEQ ID NO: 3270609 - RNA, 18 nt, Mycobacterium tuberculosis H37Rv
ccagcagcgcgggaucug

SEQ ID NO: 3270610 - RNA, 18 nt, Mycobacterium tuberculosis H37Rv
ccagcagcggcacgucgg

SEQ ID NO: 3270611 - RNA, 13 nt, Mycobacterium tuberculosis H37Rv
ccagcagcggcuc

SEQ ID NO: 3270612 - RNA, 17 nt, Mycobacterium tuberculosis H37Rv
ccagcagcucgccggca

SEQ ID NO: 3270613 - RNA, 12 nt, Mycobacterium tuberculosis H37Rv
ccagcagcugaa

SEQ ID NO: 3270614 - RNA, 18 nt, Mycobacterium tuberculosis H37Rv
ccagcagcugaaaauagg

SEQ ID NO: 3270615 - RNA, 14 nt, Mycobacterium tuberculosis H37Rv
ccagcagcugcucc

SEQ ID NO: 3270616 - RNA, 15 nt, Mycobacterium tuberculosis H37Rv
ccagcaggacgguga

SEQ ID NO: 3270617 - RNA, 23 nt, Mycobacterium tuberculosis H37Rv
ccagcaggaugaugaccgccauc

SEQ ID NO: 3270618 - RNA, 21 nt, Mycobacterium tuberculosis H37Rv
ccagcaggcccuggccaccca

SEQ ID NO: 3270619 - RNA, 13 nt, Mycobacterium tuberculosis H37Rv
ccagcaggccgaa

SEQ ID NO: 3270620 - RNA, 16 nt, Mycobacterium tuberculosis H37Rv
ccagcaggccgaagaa

SEQ ID NO: 3270621 - RNA, 12 nt, Mycobacterium tuberculosis H37Rv
ccagcaggccgg

SEQ ID NO: 3270622 - RNA, 15 nt, Mycobacterium tuberculosis H37Rv
ccagcaggcggcuga

SEQ ID NO: 3270623 - RNA, 14 nt, Mycobacterium tuberculosis H37Rv
ccagcagggccaga

SEQ ID NO: 3270624 - RNA, 12 nt, Mycobacterium tuberculosis H37Rv
ccagcagggugu

SEQ ID NO: 3270625 - RNA, 18 nt, Mycobacterium tuberculosis H37Rv
ccagcaggguuccccaua

SEQ ID NO: 3270626 - RNA, 21 nt, Mycobacterium tuberculosis H37Rv
ccagcagguauuugccgugcu

SEQ ID NO: 3270627 - RNA, 16 nt, Mycobacterium tuberculosis H37Rv
ccagcaggucgccugc

SEQ ID NO: 3270628 - RNA, 18 nt, Mycobacterium tuberculosis H37Rv
ccagcaggucgucggcgu

SEQ ID NO: 3270629 - RNA, 20 nt, Mycobacterium tuberculosis H37Rv
ccagcaggucgucggcgucg

SEQ ID NO: 3270630 - RNA, 20 nt, Mycobacterium tuberculosis H37Rv
ccagcagguuccacggccag

SEQ ID NO: 3270631 - RNA, 21 nt, Mycobacterium tuberculosis H37Rv
ccagcagguuggucaccaccu

SEQ ID NO: 3270632 - RNA, 16 nt, Mycobacterium tuberculosis H37Rv
ccagcaguacaccgcc

SEQ ID NO: 3270633 - RNA, 17 nt, Mycobacterium tuberculosis H37Rv
ccagccuggcaaccacg

SEQ ID NO: 3270634 - RNA, 21 nt, Mycobacterium tuberculosis H37Rv
ccagccuggccaucgagggca

SEQ ID NO: 3270635 - RNA, 23 nt, Mycobacterium tuberculosis H37Rv
ccagccuggccaucgagggcauc

SEQ ID NO: 3270636 - RNA, 14 nt, Mycobacterium tuberculosis H37Rv
ccagcgaacgcugc

SEQ ID NO: 3270637 - RNA, 22 nt, Mycobacterium tuberculosis H37Rv
ccagcgaacgcugccgagccca

SEQ ID NO: 3270638 - RNA, 15 nt, Mycobacterium tuberculosis H37Rv
ccagcgaaucacccg

SEQ ID NO: 3270639 - RNA, 17 nt, Mycobacterium tuberculosis H37Rv
ccagcgaauccaggccg

SEQ ID NO: 3270640 - RNA, 18 nt, Mycobacterium tuberculosis H37Rv
ccagcgaauccaggccgu

SEQ ID NO: 3270641 - RNA, 17 nt, Mycobacterium tuberculosis H37Rv
ccagcgacaugcccgcc

SEQ ID NO: 3270642 - RNA, 18 nt, Mycobacterium tuberculosis H37Rv
ccagcgacaugcccgcca

SEQ ID NO: 3270643 - RNA, 20 nt, Mycobacterium tuberculosis H37Rv
ccagcgacaugucgaacgcc

SEQ ID NO: 3270644 - RNA, 17 nt, Mycobacterium tuberculosis H37Rv
ccagcgacccggccagc

SEQ ID NO: 3270645 - RNA, 18 nt, Mycobacterium tuberculosis H37Rv
ccagcgacgaccacacca

SEQ ID NO: 3270646 - RNA, 15 nt, Mycobacterium tuberculosis H37Rv
ccagcgacgccaugu

SEQ ID NO: 3270647 - RNA, 15 nt, Mycobacterium tuberculosis H37Rv
ccagcgacgcggcca

SEQ ID NO: 3270648 - RNA, 14 nt, Mycobacterium tuberculosis H37Rv
ccagcgacucggcc

SEQ ID NO: 3270649 - RNA, 14 nt, Mycobacterium tuberculosis H37Rv
ccagcgagcccagc

SEQ ID NO: 3270650 - RNA, 22 nt, Mycobacterium tuberculosis H37Rv
ccagcgagcccagcugcgccga

SEQ ID NO: 3270651 - RNA, 13 nt, Mycobacterium tuberculosis H37Rv
ccagcgaggagca

SEQ ID NO: 3270652 - RNA, 15 nt, Mycobacterium tuberculosis H37Rv
ccagcgaggagcagg

SEQ ID NO: 3270653 - RNA, 14 nt, Mycobacterium tuberculosis H37Rv
ccagcgaggccagc

SEQ ID NO: 3270654 - RNA, 15 nt, Mycobacterium tuberculosis H37Rv
ccagcgaggccagcg

SEQ ID NO: 3270655 - RNA, 16 nt, Mycobacterium tuberculosis H37Rv
ccagcgaggccagcgg

SEQ ID NO: 3270656 - RNA, 21 nt, Mycobacterium tuberculosis H37Rv
ccagcgauaucggcggcuugg

SEQ ID NO: 3270657 - RNA, 22 nt, Mycobacterium tuberculosis H37Rv
ccagcgauggguguugcuggcc

SEQ ID NO: 3270658 - RNA, 22 nt, Mycobacterium tuberculosis H37Rv
ccagcgcacggaccaucgccag

SEQ ID NO: 3270659 - RNA, 16 nt, Mycobacterium tuberculosis H37Rv
ccagcgcaucggccag

SEQ ID NO: 3270660 - RNA, 20 nt, Mycobacterium tuberculosis H37Rv
ccagcgcauggacgaacgcg

SEQ ID NO: 3270661 - RNA, 19 nt, Mycobacterium tuberculosis H37Rv
ccagcgcauuuuccacauc

SEQ ID NO: 3270662 - RNA, 13 nt, Mycobacterium tuberculosis H37Rv
ccagcgccaccgu

SEQ ID NO: 3270663 - RNA, 21 nt, Mycobacterium tuberculosis H37Rv
ccagcgccaccguuugcgcac

SEQ ID NO: 3270664 - RNA, 18 nt, Mycobacterium tuberculosis H37Rv
ccagcgccacuggaagcc

SEQ ID NO: 3270665 - RNA, 18 nt, Mycobacterium tuberculosis H37Rv
ccagcgcccccagcagcu

SEQ ID NO: 3270666 - RNA, 16 nt, Mycobacterium tuberculosis H37Rv
ccagcgcccgccggca

SEQ ID NO: 3270667 - RNA, 12 nt, Mycobacterium tuberculosis H37Rv
ccagcgcccggc

SEQ ID NO: 3270668 - RNA, 14 nt, Mycobacterium tuberculosis H37Rv
ccagcgcccggcca

SEQ ID NO: 3270669 - RNA, 19 nt, Mycobacterium tuberculosis H37Rv
ccagcgcccgucgcuggga

SEQ ID NO: 3270670 - RNA, 19 nt, Mycobacterium tuberculosis H37Rv
ccagcgccgacccaacccg

SEQ ID NO: 3270671 - RNA, 17 nt, Mycobacterium tuberculosis H37Rv
ccagcgccgacccguac

SEQ ID NO: 3270672 - RNA, 16 nt, Mycobacterium tuberculosis H37Rv
ccagcgccgaccuccu

SEQ ID NO: 3270673 - RNA, 18 nt, Mycobacterium tuberculosis H37Rv
ccagcgccgcacccgcuc

SEQ ID NO: 3270674 - RNA, 13 nt, Mycobacterium tuberculosis H37Rv
ccagcgccgccac

SEQ ID NO: 3270675 - RNA, 12 nt, Mycobacterium tuberculosis H37Rv
ccagcgccgccg

SEQ ID NO: 3270676 - RNA, 19 nt, Mycobacterium tuberculosis H37Rv
ccagcgccgccgcguucac

SEQ ID NO: 3270677 - RNA, 15 nt, Mycobacterium tuberculosis H37Rv
ccagcgccgccggca

SEQ ID NO: 3270678 - RNA, 18 nt, Mycobacterium tuberculosis H37Rv
ccagcgccgccggcaccu

SEQ ID NO: 3270679 - RNA, 22 nt, Mycobacterium tuberculosis H37Rv
ccagcgccgccggcaccucccu

SEQ ID NO: 3270680 - RNA, 14 nt, Mycobacterium tuberculosis H37Rv
ccagcgccgcggcc

SEQ ID NO: 3270681 - RNA, 22 nt, Mycobacterium tuberculosis H37Rv
ccagcgccggccaagaccgcgg

SEQ ID NO: 3270682 - RNA, 17 nt, Mycobacterium tuberculosis H37Rv
ccagcgccuccagcacc

SEQ ID NO: 3270683 - RNA, 17 nt, Mycobacterium tuberculosis H37Rv
ccagcgccucggcaucg

SEQ ID NO: 3270684 - RNA, 15 nt, Mycobacterium tuberculosis H37Rv
ccagcgccugcgccc

SEQ ID NO: 3270685 - RNA, 14 nt, Mycobacterium tuberculosis H37Rv
ccagcgccugcgcg

SEQ ID NO: 3270686 - RNA, 18 nt, Mycobacterium tuberculosis H37Rv
ccagcgcgacguccacca

SEQ ID NO: 3270687 - RNA, 20 nt, Mycobacterium tuberculosis H37Rv
ccagcgcgacguccaccagc

SEQ ID NO: 3270688 - RNA, 13 nt, Mycobacterium tuberculosis H37Rv
ccagcgcgagccc

SEQ ID NO: 3270689 - RNA, 18 nt, Mycobacterium tuberculosis H37Rv
ccagcgcgccacgagcaa

SEQ ID NO: 3270690 - RNA, 21 nt, Mycobacterium tuberculosis H37Rv
ccagcgcgccgaucacggugg

SEQ ID NO: 3270691 - RNA, 13 nt, Mycobacterium tuberculosis H37Rv
ccagcgcgcgccg

SEQ ID NO: 3270692 - RNA, 15 nt, Mycobacterium tuberculosis H37Rv
ccagcgcgcgccgca

SEQ ID NO: 3270693 - RNA, 18 nt, Mycobacterium tuberculosis H37Rv
ccagcgcgcgcugagccg

SEQ ID NO: 3270694 - RNA, 24 nt, Mycobacterium tuberculosis H37Rv
ccagcgcgcggagucaagcagcag

SEQ ID NO: 3270695 - RNA, 14 nt, Mycobacterium tuberculosis H37Rv
ccagcgcggcacac

SEQ ID NO: 3270696 - RNA, 14 nt, Mycobacterium tuberculosis H37Rv
ccagcgcggccuug

SEQ ID NO: 3270697 - RNA, 12 nt, Mycobacterium tuberculosis H37Rv
ccagcgcggcga

SEQ ID NO: 3270698 - RNA, 23 nt, Mycobacterium tuberculosis H37Rv
ccagcgcggcgcgcggggccucg

SEQ ID NO: 3270699 - RNA, 14 nt, Mycobacterium tuberculosis H37Rv
ccagcgcggcgucg

SEQ ID NO: 3270700 - RNA, 12 nt, Mycobacterium tuberculosis H37Rv
ccagcgcggugu

SEQ ID NO: 3270701 - RNA, 20 nt, Mycobacterium tuberculosis H37Rv
ccagcgcgguguagagcgca

SEQ ID NO: 3270702 - RNA, 22 nt, Mycobacterium tuberculosis H37Rv
ccagcgcguaguccgcauccgc

SEQ ID NO: 3270703 - RNA, 16 nt, Mycobacterium tuberculosis H37Rv
ccagcgcgucgggaug

SEQ ID NO: 3270704 - RNA, 19 nt, Mycobacterium tuberculosis H37Rv
ccagcgcguuguccucgaa

SEQ ID NO: 3270705 - RNA, 14 nt, Mycobacterium tuberculosis H37Rv
ccagcgcuccagca

SEQ ID NO: 3270706 - RNA, 16 nt, Mycobacterium tuberculosis H37Rv
ccagcgcugcugccga

SEQ ID NO: 3270707 - RNA, 16 nt, Mycobacterium tuberculosis H37Rv
ccagcgcuucggccug

SEQ ID NO: 3270708 - RNA, 21 nt, Mycobacterium tuberculosis H37Rv
ccagcgcuucgucggccggca

SEQ ID NO: 3270709 - RNA, 17 nt, Mycobacterium tuberculosis H37Rv
ccagcggcaauggccag

SEQ ID NO: 3270710 - RNA, 21 nt, Mycobacterium tuberculosis H37Rv
ccagcggcaauggccagcacc

SEQ ID NO: 3270711 - RNA, 21 nt, Mycobacterium tuberculosis H37Rv
ccagcggcacacccaucaccg

SEQ ID NO: 3270712 - RNA, 13 nt, Mycobacterium tuberculosis H37Rv
ccagcggcaccgc

SEQ ID NO: 3270713 - RNA, 14 nt, Mycobacterium tuberculosis H37Rv
ccagcggcaccgcg

SEQ ID NO: 3270714 - RNA, 21 nt, Mycobacterium tuberculosis H37Rv
ccagcggcauggugacgugcu

SEQ ID NO: 3270715 - RNA, 12 nt, Mycobacterium tuberculosis H37Rv
ccagcggccacc

SEQ ID NO: 3270716 - RNA, 13 nt, Mycobacterium tuberculosis H37Rv
ccagcggccaccg

SEQ ID NO: 3270717 - RNA, 14 nt, Mycobacterium tuberculosis H37Rv
ccagcggccauccg

SEQ ID NO: 3270718 - RNA, 18 nt, Mycobacterium tuberculosis H37Rv
ccagcggcccgucaccgc

SEQ ID NO: 3270719 - RNA, 14 nt, Mycobacterium tuberculosis H37Rv
ccagcggccgccgc

SEQ ID NO: 3270720 - RNA, 17 nt, Mycobacterium tuberculosis H37Rv
ccagcggccgccgcggc

SEQ ID NO: 3270721 - RNA, 17 nt, Mycobacterium tuberculosis H37Rv
ccagcggcgaaggucug

SEQ ID NO: 3270722 - RNA, 15 nt, Mycobacterium tuberculosis H37Rv
ccagcggcgccacgu

SEQ ID NO: 3270723 - RNA, 17 nt, Mycobacterium tuberculosis H37Rv
ccagcggcgccacgugg

SEQ ID NO: 3270724 - RNA, 16 nt, Mycobacterium tuberculosis H37Rv
ccagcgggacaaaauc

SEQ ID NO: 3270725 - RNA, 18 nt, Mycobacterium tuberculosis H37Rv
ccagcgggaugagcucgu

SEQ ID NO: 3270726 - RNA, 23 nt, Mycobacterium tuberculosis H37Rv
ccagcgggcauaacccgcaccgg

SEQ ID NO: 3270727 - RNA, 21 nt, Mycobacterium tuberculosis H37Rv
ccagcggggucuugacggcgc

SEQ ID NO: 3270728 - RNA, 22 nt, Mycobacterium tuberculosis H37Rv
ccagcgggugaaucgacaccgc

SEQ ID NO: 3270729 - RNA, 16 nt, Mycobacterium tuberculosis H37Rv
ccaggagccgaggaau

SEQ ID NO: 3270730 - RNA, 15 nt, Mycobacterium tuberculosis H37Rv
ccaggagccgaucac

SEQ ID NO: 3270731 - RNA, 18 nt, Mycobacterium tuberculosis H37Rv
ccaggagugauucggcga

SEQ ID NO: 3270732 - RNA, 19 nt, Mycobacterium tuberculosis H37Rv
ccaggagugcgggcaugcc

SEQ ID NO: 3270733 - RNA, 15 nt, Mycobacterium tuberculosis H37Rv
ccaggauaaguccgg

SEQ ID NO: 3270734 - RNA, 12 nt, Mycobacterium tuberculosis H37Rv
ccaggaucgcgu

SEQ ID NO: 3270735 - RNA, 19 nt, Mycobacterium tuberculosis H37Rv
ccaggaucgcuacgucgac

SEQ ID NO: 3270736 - RNA, 22 nt, Mycobacterium tuberculosis H37Rv
ccaggaugaauuuggugaagug

SEQ ID NO: 3270737 - RNA, 21 nt, Mycobacterium tuberculosis H37Rv
ccaggauguguugccagauca

SEQ ID NO: 3270738 - RNA, 14 nt, Mycobacterium tuberculosis H37Rv
ccaggauugccgcc

SEQ ID NO: 3270739 - RNA, 15 nt, Mycobacterium tuberculosis H37Rv
ccaggauugccgccg

SEQ ID NO: 3270740 - RNA, 20 nt, Mycobacterium tuberculosis H37Rv
ccaggcacaacaucgccgca

SEQ ID NO: 3270741 - RNA, 21 nt, Mycobacterium tuberculosis H37Rv
ccaggcacaacaucgccgcag

SEQ ID NO: 3270742 - RNA, 15 nt, Mycobacterium tuberculosis H37Rv
ccaggcaccacgacc

SEQ ID NO: 3270743 - RNA, 22 nt, Mycobacterium tuberculosis H37Rv
ccaggcaccacgaccgacaccc

SEQ ID NO: 3270744 - RNA, 18 nt, Mycobacterium tuberculosis H37Rv
ccaggcacguccgaucgg

SEQ ID NO: 3270745 - RNA, 13 nt, Mycobacterium tuberculosis H37Rv
ccaggcagcuugc

SEQ ID NO: 3270746 - RNA, 22 nt, Mycobacterium tuberculosis H37Rv
ccaggcaugccgcccagugcgg

SEQ ID NO: 3270747 - RNA, 20 nt, Mycobacterium tuberculosis H37Rv
ccaggcauuggugaguagau

SEQ ID NO: 3270748 - RNA, 13 nt, Mycobacterium tuberculosis H37Rv
ccaggccaacggc

SEQ ID NO: 3270749 - RNA, 23 nt, Mycobacterium tuberculosis H37Rv
ccaggccaacggcgcugccggga

SEQ ID NO: 3270750 - RNA, 19 nt, Mycobacterium tuberculosis H37Rv
ccaggccaagguggccacc

SEQ ID NO: 3270751 - RNA, 20 nt, Mycobacterium tuberculosis H37Rv
ccaggccaagguggccacca

SEQ ID NO: 3270752 - RNA, 15 nt, Mycobacterium tuberculosis H37Rv
ccaggccaccggcug

SEQ ID NO: 3270753 - RNA, 14 nt, Mycobacterium tuberculosis H37Rv
ccaggccagagccg

SEQ ID NO: 3270754 - RNA, 18 nt, Mycobacterium tuberculosis H37Rv
ccaggccagagccgcccu

SEQ ID NO: 3270755 - RNA, 22 nt, Mycobacterium tuberculosis H37Rv
ccaggccagagccgcccuugcc

SEQ ID NO: 3270756 - RNA, 17 nt, Mycobacterium tuberculosis H37Rv
ccaggccagugccaccu

SEQ ID NO: 3270757 - RNA, 18 nt, Mycobacterium tuberculosis H37Rv
ccaggcccauacgugccg

SEQ ID NO: 3270758 - RNA, 20 nt, Mycobacterium tuberculosis H37Rv
ccaggcccgacacggcggcu

SEQ ID NO: 3270759 - RNA, 16 nt, Mycobacterium tuberculosis H37Rv
ccaggcccuggccagc

SEQ ID NO: 3270760 - RNA, 23 nt, Mycobacterium tuberculosis H37Rv
ccaggcccuggccagcccgagcu

SEQ ID NO: 3270761 - RNA, 15 nt, Mycobacterium tuberculosis H37Rv
ccaggccgaccgcgc

SEQ ID NO: 3270762 - RNA, 14 nt, Mycobacterium tuberculosis H37Rv
ccaggccgagcccg

SEQ ID NO: 3270763 - RNA, 13 nt, Mycobacterium tuberculosis H37Rv
ccaggccgagccg

SEQ ID NO: 3270764 - RNA, 21 nt, Mycobacterium tuberculosis H37Rv
ccaggccgagcucguugcugg

SEQ ID NO: 3270765 - RNA, 22 nt, Mycobacterium tuberculosis H37Rv
ccaggccgaucagcguggcgcc

SEQ ID NO: 3270766 - RNA, 15 nt, Mycobacterium tuberculosis H37Rv
ccaggccgcacagca

SEQ ID NO: 3270767 - RNA, 19 nt, Mycobacterium tuberculosis H37Rv
ccaggccgcacagcaccac

SEQ ID NO: 3270768 - RNA, 20 nt, Mycobacterium tuberculosis H37Rv
ccaggccgcgacaauggugc

SEQ ID NO: 3270769 - RNA, 21 nt, Mycobacterium tuberculosis H37Rv
ccaggccgcgacaauggugcc

SEQ ID NO: 3270770 - RNA, 12 nt, Mycobacterium tuberculosis H37Rv
ccaggccgcgcg

SEQ ID NO: 3270771 - RNA, 19 nt, Mycobacterium tuberculosis H37Rv
ccaggccgcuugccccgcc

SEQ ID NO: 3270772 - RNA, 18 nt, Mycobacterium tuberculosis H37Rv
ccaggccggcacccacca

SEQ ID NO: 3270773 - RNA, 14 nt, Mycobacterium tuberculosis H37Rv
ccaggccggcggcg

SEQ ID NO: 3270774 - RNA, 19 nt, Mycobacterium tuberculosis H37Rv
ccaggccggcggcggcgcu

SEQ ID NO: 3270775 - RNA, 21 nt, Mycobacterium tuberculosis H37Rv
ccaggccggcggcggcgcucg

SEQ ID NO: 3270776 - RNA, 13 nt, Mycobacterium tuberculosis H37Rv
ccaggccguugcc

SEQ ID NO: 3270777 - RNA, 23 nt, Mycobacterium tuberculosis H37Rv
ccaggccguugcuauucgccagc

SEQ ID NO: 3270778 - RNA, 15 nt, Mycobacterium tuberculosis H37Rv
ccaggccuaguccgg

SEQ ID NO: 3270779 - RNA, 23 nt, Mycobacterium tuberculosis H37Rv
ccaggccuaguccggcacugcgg

SEQ ID NO: 3270780 - RNA, 14 nt, Mycobacterium tuberculosis H37Rv
ccaggcgaacaggg

SEQ ID NO: 3270781 - RNA, 17 nt, Mycobacterium tuberculosis H37Rv
ccaggcgaacagggcug

SEQ ID NO: 3270782 - RNA, 14 nt, Mycobacterium tuberculosis H37Rv
ccaggcgagccgcc

SEQ ID NO: 3270783 - RNA, 21 nt, Mycobacterium tuberculosis H37Rv
ccaggcgagugaacucguccu

SEQ ID NO: 3270784 - RNA, 18 nt, Mycobacterium tuberculosis H37Rv
ccaggcgauaaagccgcu

SEQ ID NO: 3270785 - RNA, 19 nt, Mycobacterium tuberculosis H37Rv
ccaggcgcauagggccacc

SEQ ID NO: 3270786 - RNA, 23 nt, Mycobacterium tuberculosis H37Rv
ccaggcgcauagggccaccgccg

SEQ ID NO: 3270787 - RNA, 17 nt, Mycobacterium tuberculosis H37Rv
ccaggcgcgaucgcgcc

SEQ ID NO: 3270788 - RNA, 18 nt, Mycobacterium tuberculosis H37Rv
ccaggcgcgcaccaccgc

SEQ ID NO: 3270789 - RNA, 17 nt, Mycobacterium tuberculosis H37Rv
ccaggcgcucagcgcgg

SEQ ID NO: 3270790 - RNA, 21 nt, Mycobacterium tuberculosis H37Rv
ccaggcgcucagcgcggccac

SEQ ID NO: 3270791 - RNA, 14 nt, Mycobacterium tuberculosis H37Rv
ccaggcgcugcagc

SEQ ID NO: 3270792 - RNA, 20 nt, Mycobacterium tuberculosis H37Rv
ccaggcgcugcagcauggcu

SEQ ID NO: 3270793 - RNA, 22 nt, Mycobacterium tuberculosis H37Rv
ccaggcgcugcagcauggcucc

SEQ ID NO: 3270794 - RNA, 17 nt, Mycobacterium tuberculosis H37Rv
ccaggcgcuuggccgga

SEQ ID NO: 3270795 - RNA, 15 nt, Mycobacterium tuberculosis H37Rv
ccaggcggacgccgc

SEQ ID NO: 3270796 - RNA, 22 nt, Mycobacterium tuberculosis H37Rv
ccaggcggcaaggacggagccc

SEQ ID NO: 3270797 - RNA, 15 nt, Mycobacterium tuberculosis H37Rv
ccaggcgggcggcac

SEQ ID NO: 3270798 - RNA, 22 nt, Mycobacterium tuberculosis H37Rv
ccaggcggugacguggugggcu

SEQ ID NO: 3270799 - RNA, 21 nt, Mycobacterium tuberculosis H37Rv
ccaggcguuggaucccagccc

SEQ ID NO: 3270800 - RNA, 20 nt, Mycobacterium tuberculosis H37Rv
ccaggcuaauagcucgccgg

SEQ ID NO: 3270801 - RNA, 21 nt, Mycobacterium tuberculosis H37Rv
ccaggcuaauagcucgccggc

SEQ ID NO: 3270802 - RNA, 22 nt, Mycobacterium tuberculosis H37Rv
ccaggcuaauagcucgccggcg

SEQ ID NO: 3270803 - RNA, 23 nt, Mycobacterium tuberculosis H37Rv
ccaggcugaaaccuugcggcaga

SEQ ID NO: 3270804 - RNA, 20 nt, Mycobacterium tuberculosis H37Rv
ccaggcugaucccgaugcug

SEQ ID NO: 3270805 - RNA, 18 nt, Mycobacterium tuberculosis H37Rv
ccaggcuggcgucaccgc

SEQ ID NO: 3270806 - RNA, 15 nt, Mycobacterium tuberculosis H37Rv
ccaggcugguccggg

SEQ ID NO: 3270807 - RNA, 21 nt, Mycobacterium tuberculosis H37Rv
ccaggcugucgcgggccacca

SEQ ID NO: 3270808 - RNA, 23 nt, Mycobacterium tuberculosis H37Rv
ccaggcuguggccagcaucauca

SEQ ID NO: 3270809 - RNA, 20 nt, Mycobacterium tuberculosis H37Rv
ccaggcuugcggcacccagu

SEQ ID NO: 3270810 - RNA, 21 nt, Mycobacterium tuberculosis H37Rv
ccaggcuugcggcacccaguc

SEQ ID NO: 3270811 - RNA, 18 nt, Mycobacterium tuberculosis H37Rv
ccagggagcgcagcgccg

SEQ ID NO: 3270812 - RNA, 17 nt, Mycobacterium tuberculosis H37Rv
ccagggagcgcccggcu

SEQ ID NO: 3270813 - RNA, 13 nt, Mycobacterium tuberculosis H37Rv
ccagggagcggcu

SEQ ID NO: 3270814 - RNA, 17 nt, Mycobacterium tuberculosis H37Rv
ccagggagcggcugcac

SEQ ID NO: 3270815 - RNA, 14 nt, Mycobacterium tuberculosis H37Rv
ccagggcagugcga

SEQ ID NO: 3270816 - RNA, 13 nt, Mycobacterium tuberculosis H37Rv
ccagggccaccgc

SEQ ID NO: 3270817 - RNA, 15 nt, Mycobacterium tuberculosis H37Rv
ccagggccaccgcgc

SEQ ID NO: 3270818 - RNA, 14 nt, Mycobacterium tuberculosis H37Rv
ccagggccaucugg

SEQ ID NO: 3270819 - RNA, 15 nt, Mycobacterium tuberculosis H37Rv
ccagggcccugcugg

SEQ ID NO: 3270820 - RNA, 17 nt, Mycobacterium tuberculosis H37Rv
ccagggcccugcuggcc

SEQ ID NO: 3270821 - RNA, 11 nt, Mycobacterium tuberculosis H37Rv
ccagggccgac

SEQ ID NO: 3270822 - RNA, 16 nt, Mycobacterium tuberculosis H37Rv
ccagggccgagcagcu

SEQ ID NO: 3270823 - RNA, 17 nt, Mycobacterium tuberculosis H37Rv
ccagggccgcaguggca

SEQ ID NO: 3270824 - RNA, 15 nt, Mycobacterium tuberculosis H37Rv
ccagggccgccgcug

SEQ ID NO: 3270825 - RNA, 23 nt, Mycobacterium tuberculosis H37Rv
ccagucgacgucucuggugcagg

SEQ ID NO: 3270826 - RNA, 14 nt, Mycobacterium tuberculosis H37Rv
ccagucgaucgcgg

SEQ ID NO: 3270827 - RNA, 15 nt, Mycobacterium tuberculosis H37Rv
ccagucgaucgcggc

SEQ ID NO: 3270828 - RNA, 17 nt, Mycobacterium tuberculosis H37Rv
ccagucgauucggccca

SEQ ID NO: 3270829 - RNA, 17 nt, Mycobacterium tuberculosis H37Rv
ccagucgcggcguucgg

SEQ ID NO: 3270830 - RNA, 20 nt, Mycobacterium tuberculosis H37Rv
ccagucggcgccgccgucca

SEQ ID NO: 3270831 - RNA, 16 nt, Mycobacterium tuberculosis H37Rv
ccagucguuccgccgc

SEQ ID NO: 3270832 - RNA, 20 nt, Mycobacterium tuberculosis H37Rv
ccagucguuccgccgccucg

SEQ ID NO: 3270833 - RNA, 21 nt, Mycobacterium tuberculosis H37Rv
ccagugaccgcagucccagca

SEQ ID NO: 3270834 - RNA, 15 nt, Mycobacterium tuberculosis H37Rv
ccagugacucaccgu

SEQ ID NO: 3270835 - RNA, 16 nt, Mycobacterium tuberculosis H37Rv
ccagugacucaccgug

SEQ ID NO: 3270836 - RNA, 15 nt, Mycobacterium tuberculosis H37Rv
ccagugagcaugcga

SEQ ID NO: 3270837 - RNA, 12 nt, Mycobacterium tuberculosis H37Rv
ccagugagcccg

SEQ ID NO: 3270838 - RNA, 20 nt, Mycobacterium tuberculosis H37Rv
ccagugagguaucccggucu

SEQ ID NO: 3270839 - RNA, 17 nt, Mycobacterium tuberculosis H37Rv
ccagugccaccugggcg

SEQ ID NO: 3270840 - RNA, 13 nt, Mycobacterium tuberculosis H37Rv
ccagugccacgcc

SEQ ID NO: 3270841 - RNA, 17 nt, Mycobacterium tuberculosis H37Rv
ccagugccagaacccgg

SEQ ID NO: 3270842 - RNA, 15 nt, Mycobacterium tuberculosis H37Rv
ccagugccccgccga

SEQ ID NO: 3270843 - RNA, 20 nt, Mycobacterium tuberculosis H37Rv
ccagugcccgcacugccgcc

SEQ ID NO: 3270844 - RNA, 17 nt, Mycobacterium tuberculosis H37Rv
ccagugccgcccaccac

SEQ ID NO: 3270845 - RNA, 23 nt, Mycobacterium tuberculosis H37Rv
ccagugccgcccaccacacagcc

SEQ ID NO: 3270846 - RNA, 20 nt, Mycobacterium tuberculosis H37Rv
ccagugcgcaacccagccgc

SEQ ID NO: 3270847 - RNA, 22 nt, Mycobacterium tuberculosis H37Rv
ccagugcgcagaacaccaccgc

SEQ ID NO: 3270848 - RNA, 14 nt, Mycobacterium tuberculosis H37Rv
ccagugcggccacc

SEQ ID NO: 3270849 - RNA, 19 nt, Mycobacterium tuberculosis H37Rv
ccagugcggccaccuccaa

SEQ ID NO: 3270850 - RNA, 19 nt, Mycobacterium tuberculosis H37Rv
ccagugcggucucgaccgu

SEQ ID NO: 3270851 - RNA, 16 nt, Mycobacterium tuberculosis H37Rv
ccagugcgguggcagg

SEQ ID NO: 3270852 - RNA, 15 nt, Mycobacterium tuberculosis H37Rv
ccagugcugcaccga

SEQ ID NO: 3270853 - RNA, 19 nt, Mycobacterium tuberculosis H37Rv
ccaguggauuggcgaugac

SEQ ID NO: 3270854 - RNA, 24 nt, Mycobacterium tuberculosis H37Rv
ccaguggauuggcgaugacaauca

SEQ ID NO: 3270855 - RNA, 21 nt, Mycobacterium tuberculosis H37Rv
ccaguggcgcccauggccacc

SEQ ID NO: 3270856 - RNA, 19 nt, Mycobacterium tuberculosis H37Rv
ccaguggcgcgugcagcgg

SEQ ID NO: 3270857 - RNA, 13 nt, Mycobacterium tuberculosis H37Rv
ccagugggaugac

SEQ ID NO: 3270858 - RNA, 23 nt, Mycobacterium tuberculosis H37Rv
ccagugucagcacgacgacaacc

SEQ ID NO: 3270859 - RNA, 22 nt, Mycobacterium tuberculosis H37Rv
ccaguguguccugucgcaccag

SEQ ID NO: 3270860 - RNA, 16 nt, Mycobacterium tuberculosis H37Rv
ccaguguugcgcugcg

SEQ ID NO: 3270861 - RNA, 19 nt, Mycobacterium tuberculosis H37Rv
ccaguucaccgcgcugaac

SEQ ID NO: 3270862 - RNA, 17 nt, Mycobacterium tuberculosis H37Rv
ccaguuccacccggugc

SEQ ID NO: 3270863 - RNA, 19 nt, Mycobacterium tuberculosis H37Rv
ccaguucccuacacccauu

SEQ ID NO: 3270864 - RNA, 22 nt, Mycobacterium tuberculosis H37Rv
ccaguucggauccggacggugu

SEQ ID NO: 3270865 - RNA, 16 nt, Mycobacterium tuberculosis H37Rv
ccaguucggugagccg

SEQ ID NO: 3270866 - RNA, 16 nt, Mycobacterium tuberculosis H37Rv
ccaguucgugggucaa

SEQ ID NO: 3270867 - RNA, 20 nt, Mycobacterium tuberculosis H37Rv
ccaguucuucgggcgggaug

SEQ ID NO: 3270868 - RNA, 22 nt, Mycobacterium tuberculosis H37Rv
ccaguucuucgggcgggaugac

SEQ ID NO: 3270869 - RNA, 23 nt, Mycobacterium tuberculosis H37Rv
ccaguuggccggccagccauggc

SEQ ID NO: 3270870 - RNA, 19 nt, Mycobacterium tuberculosis H37Rv
ccaguugugcggccaggcg

SEQ ID NO: 3270871 - RNA, 22 nt, Mycobacterium tuberculosis H37Rv
ccauaaucacaucgcccggaac

SEQ ID NO: 3270872 - RNA, 17 nt, Mycobacterium tuberculosis H37Rv
ccauaauucgcccgcuc

SEQ ID NO: 3270873 - RNA, 17 nt, Mycobacterium tuberculosis H37Rv
ccauacccgcgcgcacc

SEQ ID NO: 3270874 - RNA, 16 nt, Mycobacterium tuberculosis H37Rv
ccauaccggccgccau

SEQ ID NO: 3270875 - RNA, 14 nt, Mycobacterium tuberculosis H37Rv
ccauaccugaaugu

SEQ ID NO: 3270876 - RNA, 19 nt, Mycobacterium tuberculosis H37Rv
ccauaccugccggaccacc

SEQ ID NO: 3270877 - RNA, 20 nt, Mycobacterium tuberculosis H37Rv
ccauacgcgcugacccgcca

SEQ ID NO: 3270878 - RNA, 21 nt, Mycobacterium tuberculosis H37Rv
ccauacgcgcugacccgccac

SEQ ID NO: 3270879 - RNA, 14 nt, Mycobacterium tuberculosis H37Rv
ccauacgucgccuc

SEQ ID NO: 3270880 - RNA, 16 nt, Mycobacterium tuberculosis H37Rv
ccauacgugccgccga

SEQ ID NO: 3270881 - RNA, 15 nt, Mycobacterium tuberculosis H37Rv
ccauacucggcggcu

SEQ ID NO: 3270882 - RNA, 14 nt, Mycobacterium tuberculosis H37Rv
ccauagaugcccgc

SEQ ID NO: 3270883 - RNA, 12 nt, Mycobacterium tuberculosis H37Rv
ccauagccaggu

SEQ ID NO: 3270884 - RNA, 16 nt, Mycobacterium tuberculosis H37Rv
ccauagcgccgcgccc

SEQ ID NO: 3270885 - RNA, 17 nt, Mycobacterium tuberculosis H37Rv
ccauagcgccgcgccca

SEQ ID NO: 3270886 - RNA, 16 nt, Mycobacterium tuberculosis H37Rv
ccauagcugccggccc

SEQ ID NO: 3270887 - RNA, 20 nt, Mycobacterium tuberculosis H37Rv
ccauagugaggccgaccagc

SEQ ID NO: 3270888 - RNA, 18 nt, Mycobacterium tuberculosis H37Rv
ccauagugcggcagcggu

SEQ ID NO: 3270889 - RNA, 20 nt, Mycobacterium tuberculosis H37Rv
ccauaucgaucggaucggca

SEQ ID NO: 3270890 - RNA, 21 nt, Mycobacterium tuberculosis H37Rv
ccauaucgaucggaucggcac

SEQ ID NO: 3270891 - RNA, 15 nt, Mycobacterium tuberculosis H37Rv
ccauaucgcccacca

SEQ ID NO: 3270892 - RNA, 17 nt, Mycobacterium tuberculosis H37Rv
ccauaugggggaaagcu

SEQ ID NO: 3270893 - RNA, 11 nt, Mycobacterium tuberculosis H37Rv
ccaucaacaag

SEQ ID NO: 3270894 - RNA, 21 nt, Mycobacterium tuberculosis H37Rv
ccaucaacauugugcucgccg

SEQ ID NO: 3270895 - RNA, 15 nt, Mycobacterium tuberculosis H37Rv
ccaucaacugcauca

SEQ ID NO: 3270896 - RNA, 19 nt, Mycobacterium tuberculosis H37Rv
ccaucaacugcaucaccac

SEQ ID NO: 3270897 - RNA, 23 nt, Mycobacterium tuberculosis H37Rv
ccaucaacugcaucaccacugga

SEQ ID NO: 3270898 - RNA, 15 nt, Mycobacterium tuberculosis H37Rv
ccaucaaggccaccu

SEQ ID NO: 3270899 - RNA, 16 nt, Mycobacterium tuberculosis H37Rv
ccaucaaggccaccuc

SEQ ID NO: 3270900 - RNA, 15 nt, Mycobacterium tuberculosis H37Rv
ccaucacacccggua

SEQ ID NO: 3270901 - RNA, 16 nt, Mycobacterium tuberculosis H37Rv
ccaucacauccacgca

SEQ ID NO: 3270902 - RNA, 17 nt, Mycobacterium tuberculosis H37Rv
ccaucacaucggccucu

SEQ ID NO: 3270903 - RNA, 20 nt, Mycobacterium tuberculosis H37Rv
ccaucaccacaccggcagcu

SEQ ID NO: 3270904 - RNA, 23 nt, Mycobacterium tuberculosis H37Rv
ccaucaccacggccgccgacucc

SEQ ID NO: 3270905 - RNA, 15 nt, Mycobacterium tuberculosis H37Rv
ccaucaccccggccu

SEQ ID NO: 3270906 - RNA, 17 nt, Mycobacterium tuberculosis H37Rv
ccaucaccccggccuug

SEQ ID NO: 3270907 - RNA, 13 nt, Mycobacterium tuberculosis H37Rv
ccaucaccggcgg

SEQ ID NO: 3270908 - RNA, 18 nt, Mycobacterium tuberculosis H37Rv
ccaucaccggcggcccca

SEQ ID NO: 3270909 - RNA, 20 nt, Mycobacterium tuberculosis H37Rv
ccaucacgacucccccggcu

SEQ ID NO: 3270910 - RNA, 12 nt, Mycobacterium tuberculosis H37Rv
ccaucacggacc

SEQ ID NO: 3270911 - RNA, 15 nt, Mycobacterium tuberculosis H37Rv
ccaucacggaccagg

SEQ ID NO: 3270912 - RNA, 15 nt, Mycobacterium tuberculosis H37Rv
ccaucacggucagcu

SEQ ID NO: 3270913 - RNA, 16 nt, Mycobacterium tuberculosis H37Rv
ccaucacggucagcuc

SEQ ID NO: 3270914 - RNA, 12 nt, Mycobacterium tuberculosis H37Rv
ccaucacggugg

SEQ ID NO: 3270915 - RNA, 16 nt, Mycobacterium tuberculosis H37Rv
ccaucagaaccuccuc

SEQ ID NO: 3270916 - RNA, 22 nt, Mycobacterium tuberculosis H37Rv
ccaucagaaugccuggcccguc

SEQ ID NO: 3270917 - RNA, 19 nt, Mycobacterium tuberculosis H37Rv
ccaucagagacagcagcgu

SEQ ID NO: 3270918 - RNA, 16 nt, Mycobacterium tuberculosis H37Rv
ccaucaucgacgguga

SEQ ID NO: 3270919 - RNA, 19 nt, Mycobacterium tuberculosis H37Rv
ccaucaucuuggcgcgguc

SEQ ID NO: 3270920 - RNA, 17 nt, Mycobacterium tuberculosis H37Rv
ccaucauggcggcccgg

SEQ ID NO: 3270921 - RNA, 20 nt, Mycobacterium tuberculosis H37Rv
ccauggucgcgccacccgcg

SEQ ID NO: 3270922 - RNA, 16 nt, Mycobacterium tuberculosis H37Rv
ccaugguggcgccgac

SEQ ID NO: 3270923 - RNA, 22 nt, Mycobacterium tuberculosis H37Rv
ccaugguggcgccgacguacag

SEQ ID NO: 3270924 - RNA, 18 nt, Mycobacterium tuberculosis H37Rv
ccauggugguauccaugu

SEQ ID NO: 3270925 - RNA, 20 nt, Mycobacterium tuberculosis H37Rv
ccaugguguucggcagcgcg

SEQ ID NO: 3270926 - RNA, 16 nt, Mycobacterium tuberculosis H37Rv
ccauguacaggcccca

SEQ ID NO: 3270927 - RNA, 12 nt, Mycobacterium tuberculosis H37Rv
ccaugucggcca

SEQ ID NO: 3270928 - RNA, 13 nt, Mycobacterium tuberculosis H37Rv
ccaugucggccag

SEQ ID NO: 3270929 - RNA, 15 nt, Mycobacterium tuberculosis H37Rv
ccaugucggccaggu

SEQ ID NO: 3270930 - RNA, 20 nt, Mycobacterium tuberculosis H37Rv
ccaugucggcgcgccgcaca

SEQ ID NO: 3270931 - RNA, 21 nt, Mycobacterium tuberculosis H37Rv
ccaugucggcgcgccgcacac

SEQ ID NO: 3270932 - RNA, 22 nt, Mycobacterium tuberculosis H37Rv
ccaugucggcgcgccgcacacg

SEQ ID NO: 3270933 - RNA, 23 nt, Mycobacterium tuberculosis H37Rv
ccaugucggugaggaagcggccg

SEQ ID NO: 3270934 - RNA, 14 nt, Mycobacterium tuberculosis H37Rv
ccaugucuccgaca

SEQ ID NO: 3270935 - RNA, 14 nt, Mycobacterium tuberculosis H37Rv
ccaugugcccaggu

SEQ ID NO: 3270936 - RNA, 18 nt, Mycobacterium tuberculosis H37Rv
ccauguggcgucgcucgu

SEQ ID NO: 3270937 - RNA, 12 nt, Mycobacterium tuberculosis H37Rv
ccauguguuuga

SEQ ID NO: 3270938 - RNA, 21 nt, Mycobacterium tuberculosis H37Rv
ccauuagcacaucgccggcgu

SEQ ID NO: 3270939 - RNA, 15 nt, Mycobacterium tuberculosis H37Rv
ccauuagcagcaccc

SEQ ID NO: 3270940 - RNA, 12 nt, Mycobacterium tuberculosis H37Rv
ccauucaccgcg

SEQ ID NO: 3270941 - RNA, 14 nt, Mycobacterium tuberculosis H37Rv
ccauucgcccggcc

SEQ ID NO: 3270942 - RNA, 20 nt, Mycobacterium tuberculosis H37Rv
ccauucgcgguccaucagca

SEQ ID NO: 3270943 - RNA, 13 nt, Mycobacterium tuberculosis H37Rv
ccauucucggccg

SEQ ID NO: 3270944 - RNA, 16 nt, Mycobacterium tuberculosis H37Rv
ccauucuuggugaucg

SEQ ID NO: 3270945 - RNA, 18 nt, Mycobacterium tuberculosis H37Rv
ccauucuuggugaucgcg

SEQ ID NO: 3270946 - RNA, 17 nt, Mycobacterium tuberculosis H37Rv
ccauugacauugagguc

SEQ ID NO: 3270947 - RNA, 11 nt, Mycobacterium tuberculosis H37Rv
ccauugccaua

SEQ ID NO: 3270948 - RNA, 20 nt, Mycobacterium tuberculosis H37Rv
ccauugccgccggcgccgcc

SEQ ID NO: 3270949 - RNA, 22 nt, Mycobacterium tuberculosis H37Rv
ccauugccgccggugccgccga

SEQ ID NO: 3270950 - RNA, 19 nt, Mycobacterium tuberculosis H37Rv
ccauugccggauuuguauu

SEQ ID NO: 3270951 - RNA, 13 nt, Mycobacterium tuberculosis H37Rv
ccauugccucccg

SEQ ID NO: 3270952 - RNA, 19 nt, Mycobacterium tuberculosis H37Rv
ccauuggccaagucagccc

SEQ ID NO: 3270953 - RNA, 15 nt, Mycobacterium tuberculosis H37Rv
ccauuggcgccgccg

SEQ ID NO: 3270954 - RNA, 14 nt, Mycobacterium tuberculosis H37Rv
ccauuggcgccguc

SEQ ID NO: 3270955 - RNA, 22 nt, Mycobacterium tuberculosis H37Rv
ccauugucgaucaccugcagca

SEQ ID NO: 3270956 - RNA, 15 nt, Mycobacterium tuberculosis H37Rv
ccauugugggacgcg

SEQ ID NO: 3270957 - RNA, 13 nt, Mycobacterium tuberculosis H37Rv
ccauuucggcccg

SEQ ID NO: 3270958 - RNA, 15 nt, Mycobacterium tuberculosis H37Rv
cccaaaaagaccgcc

SEQ ID NO: 3270959 - RNA, 21 nt, Mycobacterium tuberculosis H37Rv
cccaaaaugccuuggcagccc

SEQ ID NO: 3270960 - RNA, 22 nt, Mycobacterium tuberculosis H37Rv
cccaaaggcuguaacacccggc

SEQ ID NO: 3270961 - RNA, 23 nt, Mycobacterium tuberculosis H37Rv
cccaacagcccaccggugccgcc

SEQ ID NO: 3270962 - RNA, 16 nt, Mycobacterium tuberculosis H37Rv
cccaaccccgccggcc

SEQ ID NO: 3270963 - RNA, 19 nt, Mycobacterium tuberculosis H37Rv
cccaacccuaaaccagcca

SEQ ID NO: 3270964 - RNA, 13 nt, Mycobacterium tuberculosis H37Rv
cccaaccgaaccg

SEQ ID NO: 3270965 - RNA, 13 nt, Mycobacterium tuberculosis H37Rv
cccaacgaccacc

SEQ ID NO: 3270966 - RNA, 15 nt, Mycobacterium tuberculosis H37Rv
cccaacgaccaccac

SEQ ID NO: 3270967 - RNA, 14 nt, Mycobacterium tuberculosis H37Rv
cccaacgaccggca

SEQ ID NO: 3270968 - RNA, 19 nt, Mycobacterium tuberculosis H37Rv
cccaacgcccgggcgaauc

SEQ ID NO: 3270969 - RNA, 16 nt, Mycobacterium tuberculosis H37Rv
cccaacgcggugggca

SEQ ID NO: 3270970 - RNA, 23 nt, Mycobacterium tuberculosis H37Rv
cccaacggugggugggcgccgca

SEQ ID NO: 3270971 - RNA, 19 nt, Mycobacterium tuberculosis H37Rv
cccaacuccaucagcgcga

SEQ ID NO: 3270972 - RNA, 14 nt, Mycobacterium tuberculosis H37Rv
cccaacucggccag

SEQ ID NO: 3270973 - RNA, 21 nt, Mycobacterium tuberculosis H37Rv
cccaagaccaagugucgccgc

SEQ ID NO: 3270974 - RNA, 21 nt, Mycobacterium tuberculosis H37Rv
cccaagccauguggcgucgcu

SEQ ID NO: 3270975 - RNA, 17 nt, Mycobacterium tuberculosis H37Rv
cccaagcccgauucagc

SEQ ID NO: 3270976 - RNA, 21 nt, Mycobacterium tuberculosis H37Rv
cccaagcccgauucagcgccc

SEQ ID NO: 3270977 - RNA, 15 nt, Mycobacterium tuberculosis H37Rv
cccaagccgccggcg

SEQ ID NO: 3270978 - RNA, 20 nt, Mycobacterium tuberculosis H37Rv
cccaagcgccugagcggccu

SEQ ID NO: 3270979 - RNA, 16 nt, Mycobacterium tuberculosis H37Rv
cccaagcucagggugg

SEQ ID NO: 3270980 - RNA, 15 nt, Mycobacterium tuberculosis H37Rv
cccaaggccaggauc

SEQ ID NO: 3270981 - RNA, 14 nt, Mycobacterium tuberculosis H37Rv
cccaagucgccgag

SEQ ID NO: 3270982 - RNA, 15 nt, Mycobacterium tuberculosis H37Rv
cccaauagccggauc

SEQ ID NO: 3270983 - RNA, 17 nt, Mycobacterium tuberculosis H37Rv
cccaaucagugcagcgu

SEQ ID NO: 3270984 - RNA, 19 nt, Mycobacterium tuberculosis H37Rv
cccaaucagugcagcgugg

SEQ ID NO: 3270985 - RNA, 15 nt, Mycobacterium tuberculosis H37Rv
cccaaucgaccgccc

SEQ ID NO: 3270986 - RNA, 22 nt, Mycobacterium tuberculosis H37Rv
cccaaucgaccgcccgccaacu

SEQ ID NO: 3270987 - RNA, 19 nt, Mycobacterium tuberculosis H37Rv
cccaaugccaccgcggccg

SEQ ID NO: 3270988 - RNA, 20 nt, Mycobacterium tuberculosis H37Rv
cccaauucagauagucgccg

SEQ ID NO: 3270989 - RNA, 23 nt, Mycobacterium tuberculosis H37Rv
cccaauucagauagucgccgccg

SEQ ID NO: 3270990 - RNA, 22 nt, Mycobacterium tuberculosis H37Rv
cccaauuucgugccgaaauggg

SEQ ID NO: 3270991 - RNA, 15 nt, Mycobacterium tuberculosis H37Rv
cccacaacaugcugg

SEQ ID NO: 3270992 - RNA, 15 nt, Mycobacterium tuberculosis H37Rv
cccacaaccgcacca

SEQ ID NO: 3270993 - RNA, 21 nt, Mycobacterium tuberculosis H37Rv
cccacaagcgauggcaccacu

SEQ ID NO: 3270994 - RNA, 15 nt, Mycobacterium tuberculosis H37Rv
cccacaaucagcccg

SEQ ID NO: 3270995 - RNA, 21 nt, Mycobacterium tuberculosis H37Rv
cccacaaucagcccgacaccg

SEQ ID NO: 3270996 - RNA, 14 nt, Mycobacterium tuberculosis H37Rv
cccacacacccgac

SEQ ID NO: 3270997 - RNA, 17 nt, Mycobacterium tuberculosis H37Rv
cccacacacccgacacg

SEQ ID NO: 3270998 - RNA, 13 nt, Mycobacterium tuberculosis H37Rv
cccacacagucgg

SEQ ID NO: 3270999 - RNA, 13 nt, Mycobacterium tuberculosis H37Rv
cccacacccagcg

SEQ ID NO: 3271000 - RNA, 21 nt, Mycobacterium tuberculosis H37Rv
cccacaccgucuuacucguca

SEQ ID NO: 3271001 - RNA, 12 nt, Mycobacterium tuberculosis H37Rv
cccacaccuugg

SEQ ID NO: 3271002 - RNA, 23 nt, Mycobacterium tuberculosis H37Rv
cccacacgcccucgacgccgcgc

SEQ ID NO: 3271003 - RNA, 22 nt, Mycobacterium tuberculosis H37Rv
cccacacggucgucgcgagcgg

SEQ ID NO: 3271004 - RNA, 12 nt, Mycobacterium tuberculosis H37Rv
cccacagcagga

SEQ ID NO: 3271005 - RNA, 12 nt, Mycobacterium tuberculosis H37Rv
cccacagcgugc

SEQ ID NO: 3271006 - RNA, 15 nt, Mycobacterium tuberculosis H37Rv
cccacaggcuuuucc

SEQ ID NO: 3271007 - RNA, 22 nt, Mycobacterium tuberculosis H37Rv
cccacaggggcagcgcggccac

SEQ ID NO: 3271008 - RNA, 20 nt, Mycobacterium tuberculosis H37Rv
cccacagguuugcgccgcgc

SEQ ID NO: 3271009 - RNA, 18 nt, Mycobacterium tuberculosis H37Rv
cccacagucgccggccgg

SEQ ID NO: 3271010 - RNA, 20 nt, Mycobacterium tuberculosis H37Rv
cccacagucgccggccggcc

SEQ ID NO: 3271011 - RNA, 19 nt, Mycobacterium tuberculosis H37Rv
cccacaucagccgcaccag

SEQ ID NO: 3271012 - RNA, 22 nt, Mycobacterium tuberculosis H37Rv
cccacaucagccgcaccagugg

SEQ ID NO: 3271013 - RNA, 16 nt, Mycobacterium tuberculosis H37Rv
cccacaucgucggcgg

SEQ ID NO: 3271014 - RNA, 14 nt, Mycobacterium tuberculosis H37Rv
cccaccacaccaag

SEQ ID NO: 3271015 - RNA, 22 nt, Mycobacterium tuberculosis H37Rv
cccaccacaccaaggccgagcg

SEQ ID NO: 3271016 - RNA, 11 nt, Mycobacterium tuberculosis H37Rv
cccaccaccac

SEQ ID NO: 3271017 - RNA, 16 nt, Mycobacterium tuberculosis H37Rv
cccagcaugaaguccc

SEQ ID NO: 3271018 - RNA, 18 nt, Mycobacterium tuberculosis H37Rv
cccagcaugaagucccgg

SEQ ID NO: 3271019 - RNA, 15 nt, Mycobacterium tuberculosis H37Rv
cccagccaacccguc

SEQ ID NO: 3271020 - RNA, 21 nt, Mycobacterium tuberculosis H37Rv
cccagccagcagcggcgagcc

SEQ ID NO: 3271021 - RNA, 14 nt, Mycobacterium tuberculosis H37Rv
cccagccagcugga

SEQ ID NO: 3271022 - RNA, 12 nt, Mycobacterium tuberculosis H37Rv
cccagcccaugu

SEQ ID NO: 3271023 - RNA, 13 nt, Mycobacterium tuberculosis H37Rv
cccagcccauguc

SEQ ID NO: 3271024 - RNA, 13 nt, Mycobacterium tuberculosis H37Rv
cccagccccgacu

SEQ ID NO: 3271025 - RNA, 23 nt, Mycobacterium tuberculosis H37Rv
cccagcccuuggcgcgcagguag

SEQ ID NO: 3271026 - RNA, 15 nt, Mycobacterium tuberculosis H37Rv
cccagccgagcggcg

SEQ ID NO: 3271027 - RNA, 18 nt, Mycobacterium tuberculosis H37Rv
cccagccgccagcccguc

SEQ ID NO: 3271028 - RNA, 13 nt, Mycobacterium tuberculosis H37Rv
cccagccgcgcca

SEQ ID NO: 3271029 - RNA, 14 nt, Mycobacterium tuberculosis H37Rv
cccagccgcgccag

SEQ ID NO: 3271030 - RNA, 21 nt, Mycobacterium tuberculosis H37Rv
cccagccggaaccggacagcg

SEQ ID NO: 3271031 - RNA, 14 nt, Mycobacterium tuberculosis H37Rv
cccagccggaaggu

SEQ ID NO: 3271032 - RNA, 13 nt, Mycobacterium tuberculosis H37Rv
cccagccggcagc

SEQ ID NO: 3271033 - RNA, 17 nt, Mycobacterium tuberculosis H37Rv
cccagccggcagcagcg

SEQ ID NO: 3271034 - RNA, 19 nt, Mycobacterium tuberculosis H37Rv
cccagccggguggacaccu

SEQ ID NO: 3271035 - RNA, 17 nt, Mycobacterium tuberculosis H37Rv
cccagcgaaucacccgc

SEQ ID NO: 3271036 - RNA, 19 nt, Mycobacterium tuberculosis H37Rv
cccagcgaaucacccgcga

SEQ ID NO: 3271037 - RNA, 24 nt, Mycobacterium tuberculosis H37Rv
cccagcgaauccaggccguacucg

SEQ ID NO: 3271038 - RNA, 14 nt, Mycobacterium tuberculosis H37Rv
cccagcgacccggc

SEQ ID NO: 3271039 - RNA, 20 nt, Mycobacterium tuberculosis H37Rv
cccagcgacccggccagcgg

SEQ ID NO: 3271040 - RNA, 21 nt, Mycobacterium tuberculosis H37Rv
cccagcgacccggccagcggc

SEQ ID NO: 3271041 - RNA, 13 nt, Mycobacterium tuberculosis H37Rv
cccagcgaccgcu

SEQ ID NO: 3271042 - RNA, 16 nt, Mycobacterium tuberculosis H37Rv
cccagcgaccgcugca

SEQ ID NO: 3271043 - RNA, 15 nt, Mycobacterium tuberculosis H37Rv
cccagcgacucggcc

SEQ ID NO: 3271044 - RNA, 19 nt, Mycobacterium tuberculosis H37Rv
cccagcgacucggccagga

SEQ ID NO: 3271045 - RNA, 22 nt, Mycobacterium tuberculosis H37Rv
cccagcgacucggccaggauga

SEQ ID NO: 3271046 - RNA, 21 nt, Mycobacterium tuberculosis H37Rv
cccagcgaugcgcucacugca

SEQ ID NO: 3271047 - RNA, 14 nt, Mycobacterium tuberculosis H37Rv
cccagcgauucagc

SEQ ID NO: 3271048 - RNA, 17 nt, Mycobacterium tuberculosis H37Rv
cccagcgcacggaccau

SEQ ID NO: 3271049 - RNA, 21 nt, Mycobacterium tuberculosis H37Rv
cccagcgcacggaccaucgcc

SEQ ID NO: 3271050 - RNA, 15 nt, Mycobacterium tuberculosis H37Rv
cccagcgcagcagcg

SEQ ID NO: 3271051 - RNA, 14 nt, Mycobacterium tuberculosis H37Rv
cccagcgcccccag

SEQ ID NO: 3271052 - RNA, 22 nt, Mycobacterium tuberculosis H37Rv
cccagcgcccccagcagcugcg

SEQ ID NO: 3271053 - RNA, 18 nt, Mycobacterium tuberculosis H37Rv
cccagcgcccgccggcau

SEQ ID NO: 3271054 - RNA, 15 nt, Mycobacterium tuberculosis H37Rv
cccagcgcccggcca

SEQ ID NO: 3271055 - RNA, 23 nt, Mycobacterium tuberculosis H37Rv
cccagcgcccggccacuccagua

SEQ ID NO: 3271056 - RNA, 15 nt, Mycobacterium tuberculosis H37Rv
cccagcgccgcacag

SEQ ID NO: 3271057 - RNA, 13 nt, Mycobacterium tuberculosis H37Rv
cccagcgccgccg

SEQ ID NO: 3271058 - RNA, 13 nt, Mycobacterium tuberculosis H37Rv
cccagcgccucca

SEQ ID NO: 3271059 - RNA, 16 nt, Mycobacterium tuberculosis H37Rv
cccagcgccuccagca

SEQ ID NO: 3271060 - RNA, 15 nt, Mycobacterium tuberculosis H37Rv
cccagcgcgccagcu

SEQ ID NO: 3271061 - RNA, 21 nt, Mycobacterium tuberculosis H37Rv
cccagcgcgcugggaagcucg

SEQ ID NO: 3271062 - RNA, 23 nt, Mycobacterium tuberculosis H37Rv
cccagcgcuagccgggcgcgccg

SEQ ID NO: 3271063 - RNA, 15 nt, Mycobacterium tuberculosis H37Rv
cccagcggaaucacc

SEQ ID NO: 3271064 - RNA, 19 nt, Mycobacterium tuberculosis H37Rv
cccagcggagccacucggc

SEQ ID NO: 3271065 - RNA, 15 nt, Mycobacterium tuberculosis H37Rv
cccagcggccgcgau

SEQ ID NO: 3271066 - RNA, 20 nt, Mycobacterium tuberculosis H37Rv
cccagcgggucgcgggugcc

SEQ ID NO: 3271067 - RNA, 20 nt, Mycobacterium tuberculosis H37Rv
cccagcgguagccgagcucg

SEQ ID NO: 3271068 - RNA, 19 nt, Mycobacterium tuberculosis H37Rv
cccagcgguugacccucgg

SEQ ID NO: 3271069 - RNA, 23 nt, Mycobacterium tuberculosis H37Rv
cccagcgucugugucccgucgau

SEQ ID NO: 3271070 - RNA, 16 nt, Mycobacterium tuberculosis H37Rv
cccagcgugcccgcca

SEQ ID NO: 3271071 - RNA, 19 nt, Mycobacterium tuberculosis H37Rv
cccagcgugcccgccaccg

SEQ ID NO: 3271072 - RNA, 21 nt, Mycobacterium tuberculosis H37Rv
cccagcgugcccgccaccggc

SEQ ID NO: 3271073 - RNA, 22 nt, Mycobacterium tuberculosis H37Rv
cccagcgugucuugucgcgcag

SEQ ID NO: 3271074 - RNA, 16 nt, Mycobacterium tuberculosis H37Rv
cccagcguucccgccg

SEQ ID NO: 3271075 - RNA, 21 nt, Mycobacterium tuberculosis H37Rv
cccagcuagguccgaacuuga

SEQ ID NO: 3271076 - RNA, 17 nt, Mycobacterium tuberculosis H37Rv
cccagcucccgcggcgc

SEQ ID NO: 3271077 - RNA, 14 nt, Mycobacterium tuberculosis H37Rv
cccagcucgcgcac

SEQ ID NO: 3271078 - RNA, 15 nt, Mycobacterium tuberculosis H37Rv
cccagcucgcgcacc

SEQ ID NO: 3271079 - RNA, 21 nt, Mycobacterium tuberculosis H37Rv
cccagcucgcgcacccagccc

SEQ ID NO: 3271080 - RNA, 16 nt, Mycobacterium tuberculosis H37Rv
cccagcucgucgagcu

SEQ ID NO: 3271081 - RNA, 12 nt, Mycobacterium tuberculosis H37Rv
cccagcugacca

SEQ ID NO: 3271082 - RNA, 15 nt, Mycobacterium tuberculosis H37Rv
cccagcugaccagcg

SEQ ID NO: 3271083 - RNA, 16 nt, Mycobacterium tuberculosis H37Rv
cccagcugaccagcgu

SEQ ID NO: 3271084 - RNA, 15 nt, Mycobacterium tuberculosis H37Rv
cccagcugaccugaa

SEQ ID NO: 3271085 - RNA, 13 nt, Mycobacterium tuberculosis H37Rv
cccagcugcaggg

SEQ ID NO: 3271086 - RNA, 17 nt, Mycobacterium tuberculosis H37Rv
cccagcugcggucgcgg

SEQ ID NO: 3271087 - RNA, 15 nt, Mycobacterium tuberculosis H37Rv
cccagcugggucccg

SEQ ID NO: 3271088 - RNA, 15 nt, Mycobacterium tuberculosis H37Rv
cccagcuuggcgucg

SEQ ID NO: 3271089 - RNA, 15 nt, Mycobacterium tuberculosis H37Rv
cccaggaacgggacg

SEQ ID NO: 3271090 - RNA, 18 nt, Mycobacterium tuberculosis H37Rv
cccaggaaggcgacgccg

SEQ ID NO: 3271091 - RNA, 22 nt, Mycobacterium tuberculosis H37Rv
cccaggacuccggccgcacgcc

SEQ ID NO: 3271092 - RNA, 12 nt, Mycobacterium tuberculosis H37Rv
cccaggaucgga

SEQ ID NO: 3271093 - RNA, 22 nt, Mycobacterium tuberculosis H37Rv
cccaggcacaacaucgccgcag

SEQ ID NO: 3271094 - RNA, 19 nt, Mycobacterium tuberculosis H37Rv
cccaggccaagguggccac

SEQ ID NO: 3271095 - RNA, 14 nt, Mycobacterium tuberculosis H37Rv
cccaggccaccggc

SEQ ID NO: 3271096 - RNA, 15 nt, Mycobacterium tuberculosis H37Rv
cccaggccgucgcgc

SEQ ID NO: 3271097 - RNA, 12 nt, Mycobacterium tuberculosis H37Rv
cccaggcgaaca

SEQ ID NO: 3271098 - RNA, 17 nt, Mycobacterium tuberculosis H37Rv
cccaggcgaacagggcu

SEQ ID NO: 3271099 - RNA, 21 nt, Mycobacterium tuberculosis H37Rv
cccaggcgcucagcgcggcca

SEQ ID NO: 3271100 - RNA, 20 nt, Mycobacterium tuberculosis H37Rv
cccaggcgcucaucacccag

SEQ ID NO: 3271101 - RNA, 13 nt, Mycobacterium tuberculosis H37Rv
cccaggcucgcac

SEQ ID NO: 3271102 - RNA, 15 nt, Mycobacterium tuberculosis H37Rv
cccaggcuguccgac

SEQ ID NO: 3271103 - RNA, 12 nt, Mycobacterium tuberculosis H37Rv
cccagggcugcc

SEQ ID NO: 3271104 - RNA, 13 nt, Mycobacterium tuberculosis H37Rv
cccaggggcaccg

SEQ ID NO: 3271105 - RNA, 14 nt, Mycobacterium tuberculosis H37Rv
cccaggguggcgac

SEQ ID NO: 3271106 - RNA, 19 nt, Mycobacterium tuberculosis H37Rv
cccaggugcguccaggcca

SEQ ID NO: 3271107 - RNA, 13 nt, Mycobacterium tuberculosis H37Rv
cccaggugggcag

SEQ ID NO: 3271108 - RNA, 18 nt, Mycobacterium tuberculosis H37Rv
cccaggugguucaaccgg

SEQ ID NO: 3271109 - RNA, 19 nt, Mycobacterium tuberculosis H37Rv
cccaggugugugccucagu

SEQ ID NO: 3271110 - RNA, 19 nt, Mycobacterium tuberculosis H37Rv
cccagguguguggcggcgu

SEQ ID NO: 3271111 - RNA, 17 nt, Mycobacterium tuberculosis H37Rv
cccagguuccgcugucg

SEQ ID NO: 3271112 - RNA, 21 nt, Mycobacterium tuberculosis H37Rv
cccagguuucauuccugguua

SEQ ID NO: 3271113 - RNA, 17 nt, Mycobacterium tuberculosis H37Rv
cccaguaaguccucgau

SEQ ID NO: 3271114 - RNA, 20 nt, Mycobacterium tuberculosis H37Rv
ccccauacucggcggcuucg

SEQ ID NO: 3271115 - RNA, 17 nt, Mycobacterium tuberculosis H37Rv
ccccaucaccaccggca

SEQ ID NO: 3271116 - RNA, 18 nt, Mycobacterium tuberculosis H37Rv
ccccaugaucuggugcgc

SEQ ID NO: 3271117 - RNA, 12 nt, Mycobacterium tuberculosis H37Rv
ccccaugcaaca

SEQ ID NO: 3271118 - RNA, 18 nt, Mycobacterium tuberculosis H37Rv
ccccaugccgaccggcac

SEQ ID NO: 3271119 - RNA, 14 nt, Mycobacterium tuberculosis H37Rv
ccccauugcgcccc

SEQ ID NO: 3271120 - RNA, 16 nt, Mycobacterium tuberculosis H37Rv
ccccauugcgccccau

SEQ ID NO: 3271121 - RNA, 15 nt, Mycobacterium tuberculosis H37Rv
cccccaaccgccggc

SEQ ID NO: 3271122 - RNA, 17 nt, Mycobacterium tuberculosis H37Rv
cccccaaucagugcagc

SEQ ID NO: 3271123 - RNA, 18 nt, Mycobacterium tuberculosis H37Rv
cccccaccagggacgaug

SEQ ID NO: 3271124 - RNA, 14 nt, Mycobacterium tuberculosis H37Rv
cccccagauccgca

SEQ ID NO: 3271125 - RNA, 12 nt, Mycobacterium tuberculosis H37Rv
cccccagcgccc

SEQ ID NO: 3271126 - RNA, 14 nt, Mycobacterium tuberculosis H37Rv
cccccagcgcccgc

SEQ ID NO: 3271127 - RNA, 12 nt, Mycobacterium tuberculosis H37Rv
cccccaggcgaa

SEQ ID NO: 3271128 - RNA, 23 nt, Mycobacterium tuberculosis H37Rv
cccccagugcacgcucggcgccg

SEQ ID NO: 3271129 - RNA, 15 nt, Mycobacterium tuberculosis H37Rv
cccccaguucggcgu

SEQ ID NO: 3271130 - RNA, 13 nt, Mycobacterium tuberculosis H37Rv
cccccauugccgc

SEQ ID NO: 3271131 - RNA, 13 nt, Mycobacterium tuberculosis H37Rv
cccccccacccac

SEQ ID NO: 3271132 - RNA, 13 nt, Mycobacterium tuberculosis H37Rv
ccccccccaccca

SEQ ID NO: 3271133 - RNA, 16 nt, Mycobacterium tuberculosis H37Rv
ccccccgagcccgcca

SEQ ID NO: 3271134 - RNA, 14 nt, Mycobacterium tuberculosis H37Rv
ccccccgggcccgc

SEQ ID NO: 3271135 - RNA, 16 nt, Mycobacterium tuberculosis H37Rv
ccccccguugccgccg

SEQ ID NO: 3271136 - RNA, 19 nt, Mycobacterium tuberculosis H37Rv
cccccgaaccugcggcagc

SEQ ID NO: 3271137 - RNA, 20 nt, Mycobacterium tuberculosis H37Rv
cccccgacuccggcaggccc

SEQ ID NO: 3271138 - RNA, 21 nt, Mycobacterium tuberculosis H37Rv
cccccgagcccgccagcgccg

SEQ ID NO: 3271139 - RNA, 22 nt, Mycobacterium tuberculosis H37Rv
cccccgagcccgccagcgccgc

SEQ ID NO: 3271140 - RNA, 22 nt, Mycobacterium tuberculosis H37Rv
cccccgauggcgucgccggccc

SEQ ID NO: 3271141 - RNA, 18 nt, Mycobacterium tuberculosis H37Rv
cccccgcacgcucggcgu

SEQ ID NO: 3271142 - RNA, 19 nt, Mycobacterium tuberculosis H37Rv
cccccggcaccgccggcuc

SEQ ID NO: 3271143 - RNA, 23 nt, Mycobacterium tuberculosis H37Rv
cccccggcagcgugcggggcgcc

SEQ ID NO: 3271144 - RNA, 13 nt, Mycobacterium tuberculosis H37Rv
cccccgggcccgc

SEQ ID NO: 3271145 - RNA, 16 nt, Mycobacterium tuberculosis H37Rv
cccccggguccgccgu

SEQ ID NO: 3271146 - RNA, 17 nt, Mycobacterium tuberculosis H37Rv
cccccgguaccgcccgc

SEQ ID NO: 3271147 - RNA, 18 nt, Mycobacterium tuberculosis H37Rv
cccccgguaccgcccgca

SEQ ID NO: 3271148 - RNA, 13 nt, Mycobacterium tuberculosis H37Rv
cccccggugccgc

SEQ ID NO: 3271149 - RNA, 15 nt, Mycobacterium tuberculosis H37Rv
cccccggugccgccc

SEQ ID NO: 3271150 - RNA, 17 nt, Mycobacterium tuberculosis H37Rv
cccccggugccgcccgc

SEQ ID NO: 3271151 - RNA, 14 nt, Mycobacterium tuberculosis H37Rv
cccccgucggccuu

SEQ ID NO: 3271152 - RNA, 16 nt, Mycobacterium tuberculosis H37Rv
cccccguugccgcccg

SEQ ID NO: 3271153 - RNA, 16 nt, Mycobacterium tuberculosis H37Rv
cccccguugccgccgu

SEQ ID NO: 3271154 - RNA, 18 nt, Mycobacterium tuberculosis H37Rv
cccccguuuacggcccgg

SEQ ID NO: 3271155 - RNA, 17 nt, Mycobacterium tuberculosis H37Rv
cccccuuuacaccccca

SEQ ID NO: 3271156 - RNA, 19 nt, Mycobacterium tuberculosis H37Rv
ccccgaacauccgccgccc

SEQ ID NO: 3271157 - RNA, 19 nt, Mycobacterium tuberculosis H37Rv
ccccgaacauugcgcccag

SEQ ID NO: 3271158 - RNA, 13 nt, Mycobacterium tuberculosis H37Rv
ccccgaaccgcgc

SEQ ID NO: 3271159 - RNA, 14 nt, Mycobacterium tuberculosis H37Rv
ccccgacaccacgu

SEQ ID NO: 3271160 - RNA, 23 nt, Mycobacterium tuberculosis H37Rv
ccccgacacuuaaccugaaccgg

SEQ ID NO: 3271161 - RNA, 12 nt, Mycobacterium tuberculosis H37Rv
ccccgaccgcgc

SEQ ID NO: 3271162 - RNA, 21 nt, Mycobacterium tuberculosis H37Rv
ccccgacgagauacggccacc

SEQ ID NO: 3271163 - RNA, 23 nt, Mycobacterium tuberculosis H37Rv
ccccgacgaugcgcacucccggc

SEQ ID NO: 3271164 - RNA, 22 nt, Mycobacterium tuberculosis H37Rv
ccccgacggacuccggccggcc

SEQ ID NO: 3271165 - RNA, 20 nt, Mycobacterium tuberculosis H37Rv
ccccgacgucaggcagcucc

SEQ ID NO: 3271166 - RNA, 13 nt, Mycobacterium tuberculosis H37Rv
ccccgacuccggc

SEQ ID NO: 3271167 - RNA, 17 nt, Mycobacterium tuberculosis H37Rv
ccccgacugcgcccaua

SEQ ID NO: 3271168 - RNA, 16 nt, Mycobacterium tuberculosis H37Rv
ccccgagauccguccg

SEQ ID NO: 3271169 - RNA, 17 nt, Mycobacterium tuberculosis H37Rv
ccccgagauccguccgc

SEQ ID NO: 3271170 - RNA, 18 nt, Mycobacterium tuberculosis H37Rv
ccccgagauccguccgcu

SEQ ID NO: 3271171 - RNA, 13 nt, Mycobacterium tuberculosis H37Rv
ccccgagcccgcc

SEQ ID NO: 3271172 - RNA, 16 nt, Mycobacterium tuberculosis H37Rv
ccccgagcccgccagc

SEQ ID NO: 3271173 - RNA, 17 nt, Mycobacterium tuberculosis H37Rv
ccccgagcggagccgcc

SEQ ID NO: 3271174 - RNA, 22 nt, Mycobacterium tuberculosis H37Rv
ccccgagcugucggcuuccucc

SEQ ID NO: 3271175 - RNA, 23 nt, Mycobacterium tuberculosis H37Rv
ccccgauaaaaaccacccccacc

SEQ ID NO: 3271176 - RNA, 12 nt, Mycobacterium tuberculosis H37Rv
ccccgaucaccc

SEQ ID NO: 3271177 - RNA, 12 nt, Mycobacterium tuberculosis H37Rv
ccccgaucaggc

SEQ ID NO: 3271178 - RNA, 14 nt, Mycobacterium tuberculosis H37Rv
ccccgaucaggccg

SEQ ID NO: 3271179 - RNA, 15 nt, Mycobacterium tuberculosis H37Rv
ccccgaucaggccga

SEQ ID NO: 3271180 - RNA, 13 nt, Mycobacterium tuberculosis H37Rv
ccccgaucugcuc

SEQ ID NO: 3271181 - RNA, 14 nt, Mycobacterium tuberculosis H37Rv
ccccgcacgcucgg

SEQ ID NO: 3271182 - RNA, 20 nt, Mycobacterium tuberculosis H37Rv
ccccgcacggaaggucgaca

SEQ ID NO: 3271183 - RNA, 22 nt, Mycobacterium tuberculosis H37Rv
ccccgcagcaucgccagcagga

SEQ ID NO: 3271184 - RNA, 21 nt, Mycobacterium tuberculosis H37Rv
ccccgcagccagaucuccccg

SEQ ID NO: 3271185 - RNA, 11 nt, Mycobacterium tuberculosis H37Rv
ccccgcagcuc

SEQ ID NO: 3271186 - RNA, 13 nt, Mycobacterium tuberculosis H37Rv
ccccgcagcucga

SEQ ID NO: 3271187 - RNA, 12 nt, Mycobacterium tuberculosis H37Rv
ccccgcagcugc

SEQ ID NO: 3271188 - RNA, 23 nt, Mycobacterium tuberculosis H37Rv
ccccgcaggggguggugucgcgg

SEQ ID NO: 3271189 - RNA, 17 nt, Mycobacterium tuberculosis H37Rv
ccccgcauugccgucgg

SEQ ID NO: 3271190 - RNA, 15 nt, Mycobacterium tuberculosis H37Rv
ccccgccaccucgcc

SEQ ID NO: 3271191 - RNA, 14 nt, Mycobacterium tuberculosis H37Rv
ccccgccagcgccg

SEQ ID NO: 3271192 - RNA, 13 nt, Mycobacterium tuberculosis H37Rv
ccccgccaggauc

SEQ ID NO: 3271193 - RNA, 15 nt, Mycobacterium tuberculosis H37Rv
ccccgcccggccagc

SEQ ID NO: 3271194 - RNA, 14 nt, Mycobacterium tuberculosis H37Rv
ccccgcccuugccg

SEQ ID NO: 3271195 - RNA, 18 nt, Mycobacterium tuberculosis H37Rv
ccccgcccuugccgccag

SEQ ID NO: 3271196 - RNA, 19 nt, Mycobacterium tuberculosis H37Rv
ccccgcccuugccgccagc

SEQ ID NO: 3271197 - RNA, 15 nt, Mycobacterium tuberculosis H37Rv
ccccgccgagcaccg

SEQ ID NO: 3271198 - RNA, 13 nt, Mycobacterium tuberculosis H37Rv
ccccgccgagcgg

SEQ ID NO: 3271199 - RNA, 11 nt, Mycobacterium tuberculosis H37Rv
ccccgccgcua

SEQ ID NO: 3271200 - RNA, 16 nt, Mycobacterium tuberculosis H37Rv
ccccgccggggccgcc

SEQ ID NO: 3271201 - RNA, 16 nt, Mycobacterium tuberculosis H37Rv
ccccgccgucgccacc

SEQ ID NO: 3271202 - RNA, 15 nt, Mycobacterium tuberculosis H37Rv
ccccgcgccggccgc

SEQ ID NO: 3271203 - RNA, 16 nt, Mycobacterium tuberculosis H37Rv
ccccgcgccggccgca

SEQ ID NO: 3271204 - RNA, 13 nt, Mycobacterium tuberculosis H37Rv
ccccgcgccugcc

SEQ ID NO: 3271205 - RNA, 13 nt, Mycobacterium tuberculosis H37Rv
ccccgcgcgaacc

SEQ ID NO: 3271206 - RNA, 20 nt, Mycobacterium tuberculosis H37Rv
ccccgcgcggugcccugccg

SEQ ID NO: 3271207 - RNA, 19 nt, Mycobacterium tuberculosis H37Rv
ccccgcuacgcgcgcucgc

SEQ ID NO: 3271208 - RNA, 21 nt, Mycobacterium tuberculosis H37Rv
ccccgcuacgcgcgcucgcuc

SEQ ID NO: 3271209 - RNA, 18 nt, Mycobacterium tuberculosis H37Rv
ccccgcuggucgaccggc

SEQ ID NO: 3271210 - RNA, 21 nt, Mycobacterium tuberculosis H37Rv
ccccggaaugcccgagcagga

SEQ ID NO: 3271211 - RNA, 20 nt, Mycobacterium tuberculosis H37Rv
cccgacccgccgacgccgcc

SEQ ID NO: 3271212 - RNA, 14 nt, Mycobacterium tuberculosis H37Rv
cccgaccgccaccg

SEQ ID NO: 3271213 - RNA, 16 nt, Mycobacterium tuberculosis H37Rv
cccgaccgccaccgcc

SEQ ID NO: 3271214 - RNA, 11 nt, Mycobacterium tuberculosis H37Rv
cccgaccgccg

SEQ ID NO: 3271215 - RNA, 17 nt, Mycobacterium tuberculosis H37Rv
cccgaccgccgagcggg

SEQ ID NO: 3271216 - RNA, 21 nt, Mycobacterium tuberculosis H37Rv
cccgacgacggcaccgaugca

SEQ ID NO: 3271217 - RNA, 15 nt, Mycobacterium tuberculosis H37Rv
cccgacgagucgccg

SEQ ID NO: 3271218 - RNA, 13 nt, Mycobacterium tuberculosis H37Rv
cccgacgaugccg

SEQ ID NO: 3271219 - RNA, 15 nt, Mycobacterium tuberculosis H37Rv
cccgacgccacgcgu

SEQ ID NO: 3271220 - RNA, 17 nt, Mycobacterium tuberculosis H37Rv
cccgacgccagcugccc

SEQ ID NO: 3271221 - RNA, 21 nt, Mycobacterium tuberculosis H37Rv
cccgacggacuccggccggcc

SEQ ID NO: 3271222 - RNA, 13 nt, Mycobacterium tuberculosis H37Rv
cccgacggcgccc

SEQ ID NO: 3271223 - RNA, 22 nt, Mycobacterium tuberculosis H37Rv
cccgacgucaggcagcuccgcc

SEQ ID NO: 3271224 - RNA, 15 nt, Mycobacterium tuberculosis H37Rv
cccgacgucgcggag

SEQ ID NO: 3271225 - RNA, 23 nt, Mycobacterium tuberculosis H37Rv
cccgacgucgcggaguagccgca

SEQ ID NO: 3271226 - RNA, 18 nt, Mycobacterium tuberculosis H37Rv
cccgacgugaagccaagc

SEQ ID NO: 3271227 - RNA, 19 nt, Mycobacterium tuberculosis H37Rv
cccgacguugccgaagccg

SEQ ID NO: 3271228 - RNA, 19 nt, Mycobacterium tuberculosis H37Rv
cccgacuucaagacagccg

SEQ ID NO: 3271229 - RNA, 13 nt, Mycobacterium tuberculosis H37Rv
cccgagaccaacg

SEQ ID NO: 3271230 - RNA, 22 nt, Mycobacterium tuberculosis H37Rv
cccgagaccaacgcgcaggccg

SEQ ID NO: 3271231 - RNA, 18 nt, Mycobacterium tuberculosis H37Rv
cccgagaccggcaccggc

SEQ ID NO: 3271232 - RNA, 22 nt, Mycobacterium tuberculosis H37Rv
cccgagcccagccgggcacccu

SEQ ID NO: 3271233 - RNA, 20 nt, Mycobacterium tuberculosis H37Rv
cccgagcccagcgccuccag

SEQ ID NO: 3271234 - RNA, 12 nt, Mycobacterium tuberculosis H37Rv
cccgagcccgcc

SEQ ID NO: 3271235 - RNA, 14 nt, Mycobacterium tuberculosis H37Rv
cccgagcccgccag

SEQ ID NO: 3271236 - RNA, 16 nt, Mycobacterium tuberculosis H37Rv
cccgagccgcugcgac

SEQ ID NO: 3271237 - RNA, 11 nt, Mycobacterium tuberculosis H37Rv
cccgagccugg

SEQ ID NO: 3271238 - RNA, 16 nt, Mycobacterium tuberculosis H37Rv
cccgagcggagccgcc

SEQ ID NO: 3271239 - RNA, 20 nt, Mycobacterium tuberculosis H37Rv
cccgagcuccgcggcgagcu

SEQ ID NO: 3271240 - RNA, 15 nt, Mycobacterium tuberculosis H37Rv
cccgagcucgggugc

SEQ ID NO: 3271241 - RNA, 12 nt, Mycobacterium tuberculosis H37Rv
cccgaggcaacg

SEQ ID NO: 3271242 - RNA, 22 nt, Mycobacterium tuberculosis H37Rv
cccgagggcagagcggcaguca

SEQ ID NO: 3271243 - RNA, 15 nt, Mycobacterium tuberculosis H37Rv
cccgagggcggcagc

SEQ ID NO: 3271244 - RNA, 20 nt, Mycobacterium tuberculosis H37Rv
cccgaggugccggggcccca

SEQ ID NO: 3271245 - RNA, 22 nt, Mycobacterium tuberculosis H37Rv
cccgagugaccaggguggcauc

SEQ ID NO: 3271246 - RNA, 23 nt, Mycobacterium tuberculosis H37Rv
cccgaguggccggugggccgccc

SEQ ID NO: 3271247 - RNA, 18 nt, Mycobacterium tuberculosis H37Rv
cccgaguuaaacgcagcg

SEQ ID NO: 3271248 - RNA, 15 nt, Mycobacterium tuberculosis H37Rv
cccgaguugaagaag

SEQ ID NO: 3271249 - RNA, 18 nt, Mycobacterium tuberculosis H37Rv
cccgaguugaagaagccg

SEQ ID NO: 3271250 - RNA, 22 nt, Mycobacterium tuberculosis H37Rv
cccgaguuguggacgcccgagu

SEQ ID NO: 3271251 - RNA, 17 nt, Mycobacterium tuberculosis H37Rv
cccgauacgccaccggc

SEQ ID NO: 3271252 - RNA, 16 nt, Mycobacterium tuberculosis H37Rv
cccgauacggccggcc

SEQ ID NO: 3271253 - RNA, 16 nt, Mycobacterium tuberculosis H37Rv
cccgauauucggccau

SEQ ID NO: 3271254 - RNA, 22 nt, Mycobacterium tuberculosis H37Rv
cccgaucaccuucggccgaccg

SEQ ID NO: 3271255 - RNA, 13 nt, Mycobacterium tuberculosis H37Rv
cccgaucagcgac

SEQ ID NO: 3271256 - RNA, 16 nt, Mycobacterium tuberculosis H37Rv
cccgaucaggccgacg

SEQ ID NO: 3271257 - RNA, 21 nt, Mycobacterium tuberculosis H37Rv
cccgaucagguacgccaggug

SEQ ID NO: 3271258 - RNA, 14 nt, Mycobacterium tuberculosis H37Rv
cccgauccuggcca

SEQ ID NO: 3271259 - RNA, 14 nt, Mycobacterium tuberculosis H37Rv
cccgaucgcgccag

SEQ ID NO: 3271260 - RNA, 13 nt, Mycobacterium tuberculosis H37Rv
cccgaucggcaac

SEQ ID NO: 3271261 - RNA, 13 nt, Mycobacterium tuberculosis H37Rv
cccgaucggccac

SEQ ID NO: 3271262 - RNA, 20 nt, Mycobacterium tuberculosis H37Rv
cccgaucggccaccaucgcc

SEQ ID NO: 3271263 - RNA, 18 nt, Mycobacterium tuberculosis H37Rv
cccgaucgucgagccgau

SEQ ID NO: 3271264 - RNA, 23 nt, Mycobacterium tuberculosis H37Rv
cccgaucgucgagccgaucgccc

SEQ ID NO: 3271265 - RNA, 21 nt, Mycobacterium tuberculosis H37Rv
cccgaucugcuccucggucag

SEQ ID NO: 3271266 - RNA, 19 nt, Mycobacterium tuberculosis H37Rv
cccgaugacccacugcagg

SEQ ID NO: 3271267 - RNA, 13 nt, Mycobacterium tuberculosis H37Rv
cccgaugaccgcc

SEQ ID NO: 3271268 - RNA, 19 nt, Mycobacterium tuberculosis H37Rv
cccgauggcgucgccggcc

SEQ ID NO: 3271269 - RNA, 22 nt, Mycobacterium tuberculosis H37Rv
cccgaugguacccgcgccgcgc

SEQ ID NO: 3271270 - RNA, 14 nt, Mycobacterium tuberculosis H37Rv
cccgauggugccga

SEQ ID NO: 3271271 - RNA, 16 nt, Mycobacterium tuberculosis H37Rv
cccgauggugccgacc

SEQ ID NO: 3271272 - RNA, 20 nt, Mycobacterium tuberculosis H37Rv
cccgauggugccgacccgcc

SEQ ID NO: 3271273 - RNA, 17 nt, Mycobacterium tuberculosis H37Rv
cccgaugguggugccga

SEQ ID NO: 3271274 - RNA, 21 nt, Mycobacterium tuberculosis H37Rv
cccgaugguggugccgaccug

SEQ ID NO: 3271275 - RNA, 11 nt, Mycobacterium tuberculosis H37Rv
cccgauucugg

SEQ ID NO: 3271276 - RNA, 19 nt, Mycobacterium tuberculosis H37Rv
cccgauugaccuucgacaa

SEQ ID NO: 3271277 - RNA, 21 nt, Mycobacterium tuberculosis H37Rv
cccgauuuauccggaucggcc

SEQ ID NO: 3271278 - RNA, 18 nt, Mycobacterium tuberculosis H37Rv
cccgcaaaaucgucagcg

SEQ ID NO: 3271279 - RNA, 21 nt, Mycobacterium tuberculosis H37Rv
cccgcaaaaucgucagcgccg

SEQ ID NO: 3271280 - RNA, 23 nt, Mycobacterium tuberculosis H37Rv
cccgcaaaaucgucagcgccgcc

SEQ ID NO: 3271281 - RNA, 23 nt, Mycobacterium tuberculosis H37Rv
cccgcaacgacugaucaagugcc

SEQ ID NO: 3271282 - RNA, 20 nt, Mycobacterium tuberculosis H37Rv
cccgcaacgccaacacgcgu

SEQ ID NO: 3271283 - RNA, 14 nt, Mycobacterium tuberculosis H37Rv
cccgcaacuacggc

SEQ ID NO: 3271284 - RNA, 15 nt, Mycobacterium tuberculosis H37Rv
cccgcaaugcgagcg

SEQ ID NO: 3271285 - RNA, 13 nt, Mycobacterium tuberculosis H37Rv
cccgcaccacacc

SEQ ID NO: 3271286 - RNA, 16 nt, Mycobacterium tuberculosis H37Rv
cccgcaccaccggccc

SEQ ID NO: 3271287 - RNA, 13 nt, Mycobacterium tuberculosis H37Rv
cccgcacccccga

SEQ ID NO: 3271288 - RNA, 13 nt, Mycobacterium tuberculosis H37Rv
cccgcaccccggc

SEQ ID NO: 3271289 - RNA, 15 nt, Mycobacterium tuberculosis H37Rv
cccgcaccccggccg

SEQ ID NO: 3271290 - RNA, 21 nt, Mycobacterium tuberculosis H37Rv
cccgcaccccggccgcgcgca

SEQ ID NO: 3271291 - RNA, 15 nt, Mycobacterium tuberculosis H37Rv
cccgcacccggccca

SEQ ID NO: 3271292 - RNA, 13 nt, Mycobacterium tuberculosis H37Rv
cccgcaccgccgg

SEQ ID NO: 3271293 - RNA, 12 nt, Mycobacterium tuberculosis H37Rv
cccgcaccgcgu

SEQ ID NO: 3271294 - RNA, 13 nt, Mycobacterium tuberculosis H37Rv
cccgcaccgcguu

SEQ ID NO: 3271295 - RNA, 18 nt, Mycobacterium tuberculosis H37Rv
cccgcacgaagccggcuu

SEQ ID NO: 3271296 - RNA, 12 nt, Mycobacterium tuberculosis H37Rv
cccgcacgcggg

SEQ ID NO: 3271297 - RNA, 21 nt, Mycobacterium tuberculosis H37Rv
cccgcacgcucggcgugucgg

SEQ ID NO: 3271298 - RNA, 17 nt, Mycobacterium tuberculosis H37Rv
cccgcacggccuccgga

SEQ ID NO: 3271299 - RNA, 13 nt, Mycobacterium tuberculosis H37Rv
cccgcacggugua

SEQ ID NO: 3271300 - RNA, 18 nt, Mycobacterium tuberculosis H37Rv
cccgcacuccacgaucgg

SEQ ID NO: 3271301 - RNA, 15 nt, Mycobacterium tuberculosis H37Rv
cccgcacugccgccg

SEQ ID NO: 3271302 - RNA, 13 nt, Mycobacterium tuberculosis H37Rv
cccgcagaccgcc

SEQ ID NO: 3271303 - RNA, 13 nt, Mycobacterium tuberculosis H37Rv
cccgcagcagcau

SEQ ID NO: 3271304 - RNA, 21 nt, Mycobacterium tuberculosis H37Rv
cccgcagccaaguccgcccgc

SEQ ID NO: 3271305 - RNA, 22 nt, Mycobacterium tuberculosis H37Rv
cccgcagccaaguccgcccgcc

SEQ ID NO: 3271306 - RNA, 19 nt, Mycobacterium tuberculosis H37Rv
cccgcagcgcuuccagguc

SEQ ID NO: 3271307 - RNA, 13 nt, Mycobacterium tuberculosis H37Rv
cccgcaggacgcu

SEQ ID NO: 3271308 - RNA, 16 nt, Mycobacterium tuberculosis H37Rv
cccgccucgaccgcca

SEQ ID NO: 3271309 - RNA, 18 nt, Mycobacterium tuberculosis H37Rv
cccgccucgggccggcgu

SEQ ID NO: 3271310 - RNA, 19 nt, Mycobacterium tuberculosis H37Rv
cccgccucugucuucagcu

SEQ ID NO: 3271311 - RNA, 18 nt, Mycobacterium tuberculosis H37Rv
cccgccugaccgccaccg

SEQ ID NO: 3271312 - RNA, 21 nt, Mycobacterium tuberculosis H37Rv
cccgccuucucccgcacggcc

SEQ ID NO: 3271313 - RNA, 13 nt, Mycobacterium tuberculosis H37Rv
cccgccuuggcca

SEQ ID NO: 3271314 - RNA, 18 nt, Mycobacterium tuberculosis H37Rv
cccgcgaacgaucccgcc

SEQ ID NO: 3271315 - RNA, 21 nt, Mycobacterium tuberculosis H37Rv
cccgcgaagcgggaaggcuca

SEQ ID NO: 3271316 - RNA, 15 nt, Mycobacterium tuberculosis H37Rv
cccgcgacaucggga

SEQ ID NO: 3271317 - RNA, 20 nt, Mycobacterium tuberculosis H37Rv
cccgcgagaucgggccggcc

SEQ ID NO: 3271318 - RNA, 13 nt, Mycobacterium tuberculosis H37Rv
cccgcgagcaucg

SEQ ID NO: 3271319 - RNA, 23 nt, Mycobacterium tuberculosis H37Rv
cccgcgaggacagcugguugugc

SEQ ID NO: 3271320 - RNA, 23 nt, Mycobacterium tuberculosis H37Rv
cccgcgagguugaccaccagcgu

SEQ ID NO: 3271321 - RNA, 16 nt, Mycobacterium tuberculosis H37Rv
cccgcgaugcgcacca

SEQ ID NO: 3271322 - RNA, 20 nt, Mycobacterium tuberculosis H37Rv
cccgcgaugcgcaccagcgg

SEQ ID NO: 3271323 - RNA, 17 nt, Mycobacterium tuberculosis H37Rv
cccgcgauucgcggcag

SEQ ID NO: 3271324 - RNA, 21 nt, Mycobacterium tuberculosis H37Rv
cccgcgauuggaaugguggug

SEQ ID NO: 3271325 - RNA, 14 nt, Mycobacterium tuberculosis H37Rv
cccgcgcaaccggc

SEQ ID NO: 3271326 - RNA, 15 nt, Mycobacterium tuberculosis H37Rv
cccgcgcagcacugc

SEQ ID NO: 3271327 - RNA, 13 nt, Mycobacterium tuberculosis H37Rv
cccgcgccaccag

SEQ ID NO: 3271328 - RNA, 18 nt, Mycobacterium tuberculosis H37Rv
cccgcgccaccgauaccg

SEQ ID NO: 3271329 - RNA, 20 nt, Mycobacterium tuberculosis H37Rv
cccgcgccaccggcaccgcc

SEQ ID NO: 3271330 - RNA, 22 nt, Mycobacterium tuberculosis H37Rv
cccgcgccaccucccacgccgc

SEQ ID NO: 3271331 - RNA, 12 nt, Mycobacterium tuberculosis H37Rv
cccgcgcccaac

SEQ ID NO: 3271332 - RNA, 13 nt, Mycobacterium tuberculosis H37Rv
cccgcgcccaacg

SEQ ID NO: 3271333 - RNA, 12 nt, Mycobacterium tuberculosis H37Rv
cccgcgccgccc

SEQ ID NO: 3271334 - RNA, 13 nt, Mycobacterium tuberculosis H37Rv
cccgcgccgcccg

SEQ ID NO: 3271335 - RNA, 20 nt, Mycobacterium tuberculosis H37Rv
cccgcgccgcccgcgccccc

SEQ ID NO: 3271336 - RNA, 13 nt, Mycobacterium tuberculosis H37Rv
cccgcgccggccg

SEQ ID NO: 3271337 - RNA, 14 nt, Mycobacterium tuberculosis H37Rv
cccgcgccggccgc

SEQ ID NO: 3271338 - RNA, 15 nt, Mycobacterium tuberculosis H37Rv
cccgcgccggcgaca

SEQ ID NO: 3271339 - RNA, 18 nt, Mycobacterium tuberculosis H37Rv
cccgcgccggcgacaccg

SEQ ID NO: 3271340 - RNA, 18 nt, Mycobacterium tuberculosis H37Rv
cccgcgccuccguugccc

SEQ ID NO: 3271341 - RNA, 20 nt, Mycobacterium tuberculosis H37Rv
cccgcgccuccguugccccc

SEQ ID NO: 3271342 - RNA, 21 nt, Mycobacterium tuberculosis H37Rv
cccgcgccuccguugccccca

SEQ ID NO: 3271343 - RNA, 17 nt, Mycobacterium tuberculosis H37Rv
cccgcgccuuggcaccc

SEQ ID NO: 3271344 - RNA, 13 nt, Mycobacterium tuberculosis H37Rv
cccgcgcgcacca

SEQ ID NO: 3271345 - RNA, 12 nt, Mycobacterium tuberculosis H37Rv
cccgcgcgcuga

SEQ ID NO: 3271346 - RNA, 16 nt, Mycobacterium tuberculosis H37Rv
cccgcgcgggcggauc

SEQ ID NO: 3271347 - RNA, 11 nt, Mycobacterium tuberculosis H37Rv
cccgcgcgucg

SEQ ID NO: 3271348 - RNA, 13 nt, Mycobacterium tuberculosis H37Rv
cccgcgcgucgcc

SEQ ID NO: 3271349 - RNA, 16 nt, Mycobacterium tuberculosis H37Rv
cccgcgcgucgcccag

SEQ ID NO: 3271350 - RNA, 17 nt, Mycobacterium tuberculosis H37Rv
cccgcgcucgcacccgc

SEQ ID NO: 3271351 - RNA, 19 nt, Mycobacterium tuberculosis H37Rv
cccgcgcugagcacgcgga

SEQ ID NO: 3271352 - RNA, 13 nt, Mycobacterium tuberculosis H37Rv
cccgcgcuggaca

SEQ ID NO: 3271353 - RNA, 15 nt, Mycobacterium tuberculosis H37Rv
cccgcggacagcccg

SEQ ID NO: 3271354 - RNA, 19 nt, Mycobacterium tuberculosis H37Rv
cccgcggacgugccggucc

SEQ ID NO: 3271355 - RNA, 23 nt, Mycobacterium tuberculosis H37Rv
cccgcggcaacgcggucugcucc

SEQ ID NO: 3271356 - RNA, 13 nt, Mycobacterium tuberculosis H37Rv
cccgcggccagca

SEQ ID NO: 3271357 - RNA, 14 nt, Mycobacterium tuberculosis H37Rv
cccgcggccgggcc

SEQ ID NO: 3271358 - RNA, 23 nt, Mycobacterium tuberculosis H37Rv
cccgcggcgccacccgcgccgcc

SEQ ID NO: 3271359 - RNA, 14 nt, Mycobacterium tuberculosis H37Rv
cccgcggcgccgcc

SEQ ID NO: 3271360 - RNA, 22 nt, Mycobacterium tuberculosis H37Rv
cccgcggcgcggagagccugcu

SEQ ID NO: 3271361 - RNA, 17 nt, Mycobacterium tuberculosis H37Rv
cccgcgggcaagccgga

SEQ ID NO: 3271362 - RNA, 19 nt, Mycobacterium tuberculosis H37Rv
cccgcgguccugguguagc

SEQ ID NO: 3271363 - RNA, 13 nt, Mycobacterium tuberculosis H37Rv
cccgcggugacga

SEQ ID NO: 3271364 - RNA, 21 nt, Mycobacterium tuberculosis H37Rv
cccgcggugacgagcacaugc

SEQ ID NO: 3271365 - RNA, 13 nt, Mycobacterium tuberculosis H37Rv
cccgcggugacgc

SEQ ID NO: 3271366 - RNA, 17 nt, Mycobacterium tuberculosis H37Rv
cccgcguaugccaggac

SEQ ID NO: 3271367 - RNA, 21 nt, Mycobacterium tuberculosis H37Rv
cccgcgucgacgagcggcuuc

SEQ ID NO: 3271368 - RNA, 16 nt, Mycobacterium tuberculosis H37Rv
cccgcguggccgguca

SEQ ID NO: 3271369 - RNA, 21 nt, Mycobacterium tuberculosis H37Rv
cccgcguucgagagccccgac

SEQ ID NO: 3271370 - RNA, 22 nt, Mycobacterium tuberculosis H37Rv
cccgcguuugcgaagcccacgu

SEQ ID NO: 3271371 - RNA, 18 nt, Mycobacterium tuberculosis H37Rv
cccgcuaacuggcccgga

SEQ ID NO: 3271372 - RNA, 15 nt, Mycobacterium tuberculosis H37Rv
cccgcuacgcgcgcu

SEQ ID NO: 3271373 - RNA, 17 nt, Mycobacterium tuberculosis H37Rv
cccgcuacggcagcccg

SEQ ID NO: 3271374 - RNA, 20 nt, Mycobacterium tuberculosis H37Rv
cccgcuaggcgaagcgucug

SEQ ID NO: 3271375 - RNA, 19 nt, Mycobacterium tuberculosis H37Rv
cccgcuauucggcggcaug

SEQ ID NO: 3271376 - RNA, 16 nt, Mycobacterium tuberculosis H37Rv
cccgcucagccguccg

SEQ ID NO: 3271377 - RNA, 19 nt, Mycobacterium tuberculosis H37Rv
cccgcucauaccgggagga

SEQ ID NO: 3271378 - RNA, 15 nt, Mycobacterium tuberculosis H37Rv
cccgcuccacgguca

SEQ ID NO: 3271379 - RNA, 16 nt, Mycobacterium tuberculosis H37Rv
cccgcucccugcaccc

SEQ ID NO: 3271380 - RNA, 20 nt, Mycobacterium tuberculosis H37Rv
cccgcuccgccgucgccgcc

SEQ ID NO: 3271381 - RNA, 12 nt, Mycobacterium tuberculosis H37Rv
cccgcuccgcgg

SEQ ID NO: 3271382 - RNA, 16 nt, Mycobacterium tuberculosis H37Rv
cccgcuccuccggcac

SEQ ID NO: 3271383 - RNA, 14 nt, Mycobacterium tuberculosis H37Rv
cccgcucgaugucg

SEQ ID NO: 3271384 - RNA, 18 nt, Mycobacterium tuberculosis H37Rv
cccgcucgcgagcggcug

SEQ ID NO: 3271385 - RNA, 16 nt, Mycobacterium tuberculosis H37Rv
cccgcucggccgccgg

SEQ ID NO: 3271386 - RNA, 18 nt, Mycobacterium tuberculosis H37Rv
cccgcucgggguugcucg

SEQ ID NO: 3271387 - RNA, 21 nt, Mycobacterium tuberculosis H37Rv
cccgcucgggguugcucgcga

SEQ ID NO: 3271388 - RNA, 19 nt, Mycobacterium tuberculosis H37Rv
cccgcucguaggaccucag

SEQ ID NO: 3271389 - RNA, 23 nt, Mycobacterium tuberculosis H37Rv
cccgcugccauugccugggcgac

SEQ ID NO: 3271390 - RNA, 15 nt, Mycobacterium tuberculosis H37Rv
cccgcugcgcggccc

SEQ ID NO: 3271391 - RNA, 15 nt, Mycobacterium tuberculosis H37Rv
cccgcugcggcggcu

SEQ ID NO: 3271392 - RNA, 14 nt, Mycobacterium tuberculosis H37Rv
cccgcuggcccgcc

SEQ ID NO: 3271393 - RNA, 15 nt, Mycobacterium tuberculosis H37Rv
cccgcuggcccgcca

SEQ ID NO: 3271394 - RNA, 15 nt, Mycobacterium tuberculosis H37Rv
cccgcuggcgguaag

SEQ ID NO: 3271395 - RNA, 14 nt, Mycobacterium tuberculosis H37Rv
cccgcugggucgac

SEQ ID NO: 3271396 - RNA, 13 nt, Mycobacterium tuberculosis H37Rv
cccgcuucgcccg

SEQ ID NO: 3271397 - RNA, 16 nt, Mycobacterium tuberculosis H37Rv
cccgcuucgcccggcu

SEQ ID NO: 3271398 - RNA, 20 nt, Mycobacterium tuberculosis H37Rv
cccgcuucgcccggcugcgc

SEQ ID NO: 3271399 - RNA, 16 nt, Mycobacterium tuberculosis H37Rv
cccgcuuugcacugug

SEQ ID NO: 3271400 - RNA, 19 nt, Mycobacterium tuberculosis H37Rv
cccgcuuuuucccggcggc

SEQ ID NO: 3271401 - RNA, 14 nt, Mycobacterium tuberculosis H37Rv
cccggaaccagccg

SEQ ID NO: 3271402 - RNA, 15 nt, Mycobacterium tuberculosis H37Rv
cccggaaccggcgug

SEQ ID NO: 3271403 - RNA, 23 nt, Mycobacterium tuberculosis H37Rv
cccggaaucgcgaaacagcuugc

SEQ ID NO: 3271404 - RNA, 21 nt, Mycobacterium tuberculosis H37Rv
cccggaaugcccgagcaggac

SEQ ID NO: 3271405 - RNA, 16 nt, Mycobacterium tuberculosis H37Rv
cccggcguccgaccgg

SEQ ID NO: 3271406 - RNA, 14 nt, Mycobacterium tuberculosis H37Rv
cccggcgucgacga

SEQ ID NO: 3271407 - RNA, 15 nt, Mycobacterium tuberculosis H37Rv
cccggcgucucgcag

SEQ ID NO: 3271408 - RNA, 22 nt, Mycobacterium tuberculosis H37Rv
cccggcguggcuucacccaacc

SEQ ID NO: 3271409 - RNA, 19 nt, Mycobacterium tuberculosis H37Rv
cccggcguggugagccucg

SEQ ID NO: 3271410 - RNA, 13 nt, Mycobacterium tuberculosis H37Rv
cccggcucgaugg

SEQ ID NO: 3271411 - RNA, 18 nt, Mycobacterium tuberculosis H37Rv
cccggcucggugcgccag

SEQ ID NO: 3271412 - RNA, 17 nt, Mycobacterium tuberculosis H37Rv
cccggcucucuucgcgc

SEQ ID NO: 3271413 - RNA, 18 nt, Mycobacterium tuberculosis H37Rv
cccggcucucuucgcgcg

SEQ ID NO: 3271414 - RNA, 20 nt, Mycobacterium tuberculosis H37Rv
cccggcucucuucgcgcgcu

SEQ ID NO: 3271415 - RNA, 22 nt, Mycobacterium tuberculosis H37Rv
cccggcucucuucgcgcgcugg

SEQ ID NO: 3271416 - RNA, 17 nt, Mycobacterium tuberculosis H37Rv
cccggcugccagcgccg

SEQ ID NO: 3271417 - RNA, 20 nt, Mycobacterium tuberculosis H37Rv
cccggcugccagcgccgccg

SEQ ID NO: 3271418 - RNA, 21 nt, Mycobacterium tuberculosis H37Rv
cccggcugccagcgccgccgc

SEQ ID NO: 3271419 - RNA, 22 nt, Mycobacterium tuberculosis H37Rv
cccggcugcgcuucgaccgagu

SEQ ID NO: 3271420 - RNA, 16 nt, Mycobacterium tuberculosis H37Rv
cccggcuggggccgcu

SEQ ID NO: 3271421 - RNA, 15 nt, Mycobacterium tuberculosis H37Rv
cccggcuucgccgcg

SEQ ID NO: 3271422 - RNA, 21 nt, Mycobacterium tuberculosis H37Rv
cccggcuucuugaccacgaac

SEQ ID NO: 3271423 - RNA, 17 nt, Mycobacterium tuberculosis H37Rv
cccggcuuucccaccgc

SEQ ID NO: 3271424 - RNA, 17 nt, Mycobacterium tuberculosis H37Rv
cccgggaaggaaccggg

SEQ ID NO: 3271425 - RNA, 12 nt, Mycobacterium tuberculosis H37Rv
cccgggauaccg

SEQ ID NO: 3271426 - RNA, 18 nt, Mycobacterium tuberculosis H37Rv
cccgggaucuagaugcgg

SEQ ID NO: 3271427 - RNA, 22 nt, Mycobacterium tuberculosis H37Rv
cccgggaucuagaugcggaacg

SEQ ID NO: 3271428 - RNA, 13 nt, Mycobacterium tuberculosis H37Rv
cccgggaugcucc

SEQ ID NO: 3271429 - RNA, 14 nt, Mycobacterium tuberculosis H37Rv
cccgggaugcuccc

SEQ ID NO: 3271430 - RNA, 11 nt, Mycobacterium tuberculosis H37Rv
cccgggcaccg

SEQ ID NO: 3271431 - RNA, 15 nt, Mycobacterium tuberculosis H37Rv
cccgggcagcaccag

SEQ ID NO: 3271432 - RNA, 13 nt, Mycobacterium tuberculosis H37Rv
cccgggcagcccc

SEQ ID NO: 3271433 - RNA, 14 nt, Mycobacterium tuberculosis H37Rv
cccgggcagccgca

SEQ ID NO: 3271434 - RNA, 17 nt, Mycobacterium tuberculosis H37Rv
cccgggcagccugcugc

SEQ ID NO: 3271435 - RNA, 18 nt, Mycobacterium tuberculosis H37Rv
cccgggcagccugcugca

SEQ ID NO: 3271436 - RNA, 14 nt, Mycobacterium tuberculosis H37Rv
cccgggccaggcug

SEQ ID NO: 3271437 - RNA, 21 nt, Mycobacterium tuberculosis H37Rv
cccgggccaucgcauccccag

SEQ ID NO: 3271438 - RNA, 13 nt, Mycobacterium tuberculosis H37Rv
cccgggccgccag

SEQ ID NO: 3271439 - RNA, 22 nt, Mycobacterium tuberculosis H37Rv
cccgggccgccagggcccuagc

SEQ ID NO: 3271440 - RNA, 14 nt, Mycobacterium tuberculosis H37Rv
cccgggccgccgcg

SEQ ID NO: 3271441 - RNA, 21 nt, Mycobacterium tuberculosis H37Rv
cccgggccgccgcgauggccc

SEQ ID NO: 3271442 - RNA, 15 nt, Mycobacterium tuberculosis H37Rv
cccgggccugaacca

SEQ ID NO: 3271443 - RNA, 20 nt, Mycobacterium tuberculosis H37Rv
cccgggcggaacgccggcac

SEQ ID NO: 3271444 - RNA, 19 nt, Mycobacterium tuberculosis H37Rv
cccgggcggcgccggcgca

SEQ ID NO: 3271445 - RNA, 20 nt, Mycobacterium tuberculosis H37Rv
cccgggcggcggccugggcc

SEQ ID NO: 3271446 - RNA, 18 nt, Mycobacterium tuberculosis H37Rv
cccgggcgggagucgucg

SEQ ID NO: 3271447 - RNA, 20 nt, Mycobacterium tuberculosis H37Rv
cccgggcgggauccacccag

SEQ ID NO: 3271448 - RNA, 12 nt, Mycobacterium tuberculosis H37Rv
cccgggcggucg

SEQ ID NO: 3271449 - RNA, 20 nt, Mycobacterium tuberculosis H37Rv
cccgggcggucgagaugucg

SEQ ID NO: 3271450 - RNA, 23 nt, Mycobacterium tuberculosis H37Rv
cccgggcggugaggcagcgaccg

SEQ ID NO: 3271451 - RNA, 14 nt, Mycobacterium tuberculosis H37Rv
cccgggcugccgcc

SEQ ID NO: 3271452 - RNA, 13 nt, Mycobacterium tuberculosis H37Rv
cccggggacgggu

SEQ ID NO: 3271453 - RNA, 19 nt, Mycobacterium tuberculosis H37Rv
cccggggacgggucggcag

SEQ ID NO: 3271454 - RNA, 13 nt, Mycobacterium tuberculosis H37Rv
cccggggagacga

SEQ ID NO: 3271455 - RNA, 18 nt, Mycobacterium tuberculosis H37Rv
cccggggagacgagcaca

SEQ ID NO: 3271456 - RNA, 15 nt, Mycobacterium tuberculosis H37Rv
cccggggccgcaacc

SEQ ID NO: 3271457 - RNA, 14 nt, Mycobacterium tuberculosis H37Rv
cccggggcgcucgc

SEQ ID NO: 3271458 - RNA, 16 nt, Mycobacterium tuberculosis H37Rv
cccggggcgcucgcgc

SEQ ID NO: 3271459 - RNA, 20 nt, Mycobacterium tuberculosis H37Rv
cccggggcgcucgcgcgcug

SEQ ID NO: 3271460 - RNA, 20 nt, Mycobacterium tuberculosis H37Rv
cccggggcugggggccggca

SEQ ID NO: 3271461 - RNA, 16 nt, Mycobacterium tuberculosis H37Rv
cccgggguguucgucg

SEQ ID NO: 3271462 - RNA, 19 nt, Mycobacterium tuberculosis H37Rv
cccggguagaccaccugca

SEQ ID NO: 3271463 - RNA, 13 nt, Mycobacterium tuberculosis H37Rv
cccggguccugga

SEQ ID NO: 3271464 - RNA, 16 nt, Mycobacterium tuberculosis H37Rv
cccgggucggcacgac

SEQ ID NO: 3271465 - RNA, 17 nt, Mycobacterium tuberculosis H37Rv
cccgggugcgcucuucu

SEQ ID NO: 3271466 - RNA, 12 nt, Mycobacterium tuberculosis H37Rv
cccggguggccc

SEQ ID NO: 3271467 - RNA, 17 nt, Mycobacterium tuberculosis H37Rv
cccgggugggccaguga

SEQ ID NO: 3271468 - RNA, 19 nt, Mycobacterium tuberculosis H37Rv
cccgguaccgcccgcaccg

SEQ ID NO: 3271469 - RNA, 15 nt, Mycobacterium tuberculosis H37Rv
cccgguagccccguc

SEQ ID NO: 3271470 - RNA, 16 nt, Mycobacterium tuberculosis H37Rv
cccgguagcggcggca

SEQ ID NO: 3271471 - RNA, 18 nt, Mycobacterium tuberculosis H37Rv
cccgguagcggcggcaug

SEQ ID NO: 3271472 - RNA, 20 nt, Mycobacterium tuberculosis H37Rv
cccgguaugcgcguccccag

SEQ ID NO: 3271473 - RNA, 14 nt, Mycobacterium tuberculosis H37Rv
cccggucaacguga

SEQ ID NO: 3271474 - RNA, 15 nt, Mycobacterium tuberculosis H37Rv
cccgguccagcccca

SEQ ID NO: 3271475 - RNA, 15 nt, Mycobacterium tuberculosis H37Rv
cccgguccauucguc

SEQ ID NO: 3271476 - RNA, 13 nt, Mycobacterium tuberculosis H37Rv
cccggucccgccg

SEQ ID NO: 3271477 - RNA, 19 nt, Mycobacterium tuberculosis H37Rv
cccgguccgccauuggcgc

SEQ ID NO: 3271478 - RNA, 19 nt, Mycobacterium tuberculosis H37Rv
cccgguccugcucgcacag

SEQ ID NO: 3271479 - RNA, 17 nt, Mycobacterium tuberculosis H37Rv
cccggucgacgggucgg

SEQ ID NO: 3271480 - RNA, 19 nt, Mycobacterium tuberculosis H37Rv
cccggucgacgggucggcg

SEQ ID NO: 3271481 - RNA, 22 nt, Mycobacterium tuberculosis H37Rv
cccggucgacgggucggcgccg

SEQ ID NO: 3271482 - RNA, 23 nt, Mycobacterium tuberculosis H37Rv
cccggucgagccagcggagcagc

SEQ ID NO: 3271483 - RNA, 15 nt, Mycobacterium tuberculosis H37Rv
cccggucgauucggc

SEQ ID NO: 3271484 - RNA, 13 nt, Mycobacterium tuberculosis H37Rv
cccggucgccgcg

SEQ ID NO: 3271485 - RNA, 17 nt, Mycobacterium tuberculosis H37Rv
cccggucggcagcuggg

SEQ ID NO: 3271486 - RNA, 12 nt, Mycobacterium tuberculosis H37Rv
cccggucggcga

SEQ ID NO: 3271487 - RNA, 14 nt, Mycobacterium tuberculosis H37Rv
cccggucggcggca

SEQ ID NO: 3271488 - RNA, 22 nt, Mycobacterium tuberculosis H37Rv
cccggucgggcgcggggcggcc

SEQ ID NO: 3271489 - RNA, 15 nt, Mycobacterium tuberculosis H37Rv
cccggucuagcuggg

SEQ ID NO: 3271490 - RNA, 19 nt, Mycobacterium tuberculosis H37Rv
cccggucucgacggcggcc

SEQ ID NO: 3271491 - RNA, 12 nt, Mycobacterium tuberculosis H37Rv
cccggugacaag

SEQ ID NO: 3271492 - RNA, 20 nt, Mycobacterium tuberculosis H37Rv
cccggugagcucuucggaca

SEQ ID NO: 3271493 - RNA, 19 nt, Mycobacterium tuberculosis H37Rv
cccggugauccacgcucgg

SEQ ID NO: 3271494 - RNA, 24 nt, Mycobacterium tuberculosis H37Rv
cccggugcaaccccaaguccagca

SEQ ID NO: 3271495 - RNA, 16 nt, Mycobacterium tuberculosis H37Rv
cccggugcccaucggc

SEQ ID NO: 3271496 - RNA, 20 nt, Mycobacterium tuberculosis H37Rv
cccggugcccgcggugacga

SEQ ID NO: 3271497 - RNA, 16 nt, Mycobacterium tuberculosis H37Rv
cccggugccgcagcag

SEQ ID NO: 3271498 - RNA, 17 nt, Mycobacterium tuberculosis H37Rv
cccggugccgcccgcgc

SEQ ID NO: 3271499 - RNA, 21 nt, Mycobacterium tuberculosis H37Rv
cccggugccguuggagccgcc

SEQ ID NO: 3271500 - RNA, 16 nt, Mycobacterium tuberculosis H37Rv
cccggugcuaaccgac

SEQ ID NO: 3271501 - RNA, 14 nt, Mycobacterium tuberculosis H37Rv
cccggugcucaagc

SEQ ID NO: 3271502 - RNA, 23 nt, Mycobacterium tuberculosis H37Rv
cccucgguguacaccgcgcccgc

SEQ ID NO: 3271503 - RNA, 16 nt, Mycobacterium tuberculosis H37Rv
cccucguccugcgaga

SEQ ID NO: 3271504 - RNA, 18 nt, Mycobacterium tuberculosis H37Rv
cccucgucgaucgccgcg

SEQ ID NO: 3271505 - RNA, 18 nt, Mycobacterium tuberculosis H37Rv
cccucguuaucgaccgcc

SEQ ID NO: 3271506 - RNA, 19 nt, Mycobacterium tuberculosis H37Rv
cccucguuaucgaccgccg

SEQ ID NO: 3271507 - RNA, 20 nt, Mycobacterium tuberculosis H37Rv
cccucguuaucgaccgccgc

SEQ ID NO: 3271508 - RNA, 16 nt, Mycobacterium tuberculosis H37Rv
cccucuacacccggac

SEQ ID NO: 3271509 - RNA, 14 nt, Mycobacterium tuberculosis H37Rv
cccucuagcgccuc

SEQ ID NO: 3271510 - RNA, 22 nt, Mycobacterium tuberculosis H37Rv
cccucugguggcgcugaagccg

SEQ ID NO: 3271511 - RNA, 20 nt, Mycobacterium tuberculosis H37Rv
cccugaaaagggcuggucua

SEQ ID NO: 3271512 - RNA, 22 nt, Mycobacterium tuberculosis H37Rv
cccugaaauaccaguccggcgg

SEQ ID NO: 3271513 - RNA, 16 nt, Mycobacterium tuberculosis H37Rv
cccugaagggccgccu

SEQ ID NO: 3271514 - RNA, 20 nt, Mycobacterium tuberculosis H37Rv
cccugaagggccgccucgcg

SEQ ID NO: 3271515 - RNA, 14 nt, Mycobacterium tuberculosis H37Rv
cccugagcucccgc

SEQ ID NO: 3271516 - RNA, 21 nt, Mycobacterium tuberculosis H37Rv
cccugaucgugaacacgucgc

SEQ ID NO: 3271517 - RNA, 23 nt, Mycobacterium tuberculosis H37Rv
cccugaucgugaacacgucgcgg

SEQ ID NO: 3271518 - RNA, 14 nt, Mycobacterium tuberculosis H37Rv
cccugaucgugcgg

SEQ ID NO: 3271519 - RNA, 21 nt, Mycobacterium tuberculosis H37Rv
cccugaugaucguccagccca

SEQ ID NO: 3271520 - RNA, 15 nt, Mycobacterium tuberculosis H37Rv
cccugauggacccga

SEQ ID NO: 3271521 - RNA, 20 nt, Mycobacterium tuberculosis H37Rv
cccugaugugaguccagccg

SEQ ID NO: 3271522 - RNA, 21 nt, Mycobacterium tuberculosis H37Rv
cccugaugugaguccagccgg

SEQ ID NO: 3271523 - RNA, 15 nt, Mycobacterium tuberculosis H37Rv
cccugcaacccgguc

SEQ ID NO: 3271524 - RNA, 18 nt, Mycobacterium tuberculosis H37Rv
cccugcacccagccgugc

SEQ ID NO: 3271525 - RNA, 20 nt, Mycobacterium tuberculosis H37Rv
cccugcacccagccgugccc

SEQ ID NO: 3271526 - RNA, 17 nt, Mycobacterium tuberculosis H37Rv
cccugcacggugcccag

SEQ ID NO: 3271527 - RNA, 20 nt, Mycobacterium tuberculosis H37Rv
cccugcccagcacccccugc

SEQ ID NO: 3271528 - RNA, 15 nt, Mycobacterium tuberculosis H37Rv
cccugcccggcccgc

SEQ ID NO: 3271529 - RNA, 16 nt, Mycobacterium tuberculosis H37Rv
cccugccgccggcccc

SEQ ID NO: 3271530 - RNA, 18 nt, Mycobacterium tuberculosis H37Rv
cccugccgccggccccgc

SEQ ID NO: 3271531 - RNA, 19 nt, Mycobacterium tuberculosis H37Rv
cccugccgccggccccgcc

SEQ ID NO: 3271532 - RNA, 19 nt, Mycobacterium tuberculosis H37Rv
cccugcgccacacccggca

SEQ ID NO: 3271533 - RNA, 19 nt, Mycobacterium tuberculosis H37Rv
cccugcgccgccacagcac

SEQ ID NO: 3271534 - RNA, 13 nt, Mycobacterium tuberculosis H37Rv
cccugcgccucgg

SEQ ID NO: 3271535 - RNA, 20 nt, Mycobacterium tuberculosis H37Rv
cccugcgccucggcggccag

SEQ ID NO: 3271536 - RNA, 16 nt, Mycobacterium tuberculosis H37Rv
cccugcggccacggug

SEQ ID NO: 3271537 - RNA, 17 nt, Mycobacterium tuberculosis H37Rv
cccugcuccucgcgggc

SEQ ID NO: 3271538 - RNA, 17 nt, Mycobacterium tuberculosis H37Rv
cccugcucgaacgcuga

SEQ ID NO: 3271539 - RNA, 18 nt, Mycobacterium tuberculosis H37Rv
cccugcucgaacgcugag

SEQ ID NO: 3271540 - RNA, 14 nt, Mycobacterium tuberculosis H37Rv
cccugcuggcccaa

SEQ ID NO: 3271541 - RNA, 17 nt, Mycobacterium tuberculosis H37Rv
cccugcuggugucggcu

SEQ ID NO: 3271542 - RNA, 18 nt, Mycobacterium tuberculosis H37Rv
cccuggaaagggccgccg

SEQ ID NO: 3271543 - RNA, 20 nt, Mycobacterium tuberculosis H37Rv
cccuggaccagcgggcggcc

SEQ ID NO: 3271544 - RNA, 13 nt, Mycobacterium tuberculosis H37Rv
cccuggacuucgg

SEQ ID NO: 3271545 - RNA, 20 nt, Mycobacterium tuberculosis H37Rv
cccuggauggcgcccugcgc

SEQ ID NO: 3271546 - RNA, 22 nt, Mycobacterium tuberculosis H37Rv
cccuggauggcgcccugcgcca

SEQ ID NO: 3271547 - RNA, 16 nt, Mycobacterium tuberculosis H37Rv
cccuggcccccgguac

SEQ ID NO: 3271548 - RNA, 20 nt, Mycobacterium tuberculosis H37Rv
cccuggcccccgguaccgcc

SEQ ID NO: 3271549 - RNA, 20 nt, Mycobacterium tuberculosis H37Rv
cccuggccgcccagaccgcc

SEQ ID NO: 3271550 - RNA, 12 nt, Mycobacterium tuberculosis H37Rv
cccuggccgccg

SEQ ID NO: 3271551 - RNA, 14 nt, Mycobacterium tuberculosis H37Rv
cccuggccgccggc

SEQ ID NO: 3271552 - RNA, 20 nt, Mycobacterium tuberculosis H37Rv
cccuggccgccggcgccgcc

SEQ ID NO: 3271553 - RNA, 17 nt, Mycobacterium tuberculosis H37Rv
cccuggcgaccagccga

SEQ ID NO: 3271554 - RNA, 22 nt, Mycobacterium tuberculosis H37Rv
cccuggcgugugugcgccuccg

SEQ ID NO: 3271555 - RNA, 21 nt, Mycobacterium tuberculosis H37Rv
cccugggcaaacugggcaccg

SEQ ID NO: 3271556 - RNA, 15 nt, Mycobacterium tuberculosis H37Rv
cccugggcgccggcg

SEQ ID NO: 3271557 - RNA, 23 nt, Mycobacterium tuberculosis H37Rv
cccugggcgucgaccacgcaagg

SEQ ID NO: 3271558 - RNA, 13 nt, Mycobacterium tuberculosis H37Rv
cccugggcuggcu

SEQ ID NO: 3271559 - RNA, 16 nt, Mycobacterium tuberculosis H37Rv
cccuggggguggcagc

SEQ ID NO: 3271560 - RNA, 21 nt, Mycobacterium tuberculosis H37Rv
cccugggguugcaucaugccg

SEQ ID NO: 3271561 - RNA, 18 nt, Mycobacterium tuberculosis H37Rv
cccugguacaccaggccg

SEQ ID NO: 3271562 - RNA, 15 nt, Mycobacterium tuberculosis H37Rv
cccugguccaggccc

SEQ ID NO: 3271563 - RNA, 17 nt, Mycobacterium tuberculosis H37Rv
cccuggugugccgcguu

SEQ ID NO: 3271564 - RNA, 16 nt, Mycobacterium tuberculosis H37Rv
cccugucaacgccgcg

SEQ ID NO: 3271565 - RNA, 15 nt, Mycobacterium tuberculosis H37Rv
cccugucgcgcaccg

SEQ ID NO: 3271566 - RNA, 16 nt, Mycobacterium tuberculosis H37Rv
cccugugucgccgucg

SEQ ID NO: 3271567 - RNA, 22 nt, Mycobacterium tuberculosis H37Rv
cccugugucgccgucgcggcac

SEQ ID NO: 3271568 - RNA, 20 nt, Mycobacterium tuberculosis H37Rv
cccuguugccccuccagggg

SEQ ID NO: 3271569 - RNA, 16 nt, Mycobacterium tuberculosis H37Rv
cccuucaaagcggccu

SEQ ID NO: 3271570 - RNA, 23 nt, Mycobacterium tuberculosis H37Rv
cccuucaaagcggccucgaccuc

SEQ ID NO: 3271571 - RNA, 18 nt, Mycobacterium tuberculosis H37Rv
cccuucagcgaagccggg

SEQ ID NO: 3271572 - RNA, 14 nt, Mycobacterium tuberculosis H37Rv
cccuucgccagcgc

SEQ ID NO: 3271573 - RNA, 20 nt, Mycobacterium tuberculosis H37Rv
cccuucgcgagcagacgcgg

SEQ ID NO: 3271574 - RNA, 14 nt, Mycobacterium tuberculosis H37Rv
cccuucgcggugug

SEQ ID NO: 3271575 - RNA, 16 nt, Mycobacterium tuberculosis H37Rv
cccuucgucggcauga

SEQ ID NO: 3271576 - RNA, 11 nt, Mycobacterium tuberculosis H37Rv
cccuugccgcc

SEQ ID NO: 3271577 - RNA, 14 nt, Mycobacterium tuberculosis H37Rv
cccuugccgccauu

SEQ ID NO: 3271578 - RNA, 16 nt, Mycobacterium tuberculosis H37Rv
cccuugccgcccgcuc

SEQ ID NO: 3271579 - RNA, 16 nt, Mycobacterium tuberculosis H37Rv
cccuugccgccggccc

SEQ ID NO: 3271580 - RNA, 18 nt, Mycobacterium tuberculosis H37Rv
cccuugccgccuuggccc

SEQ ID NO: 3271581 - RNA, 17 nt, Mycobacterium tuberculosis H37Rv
cccuuggacgcgaugau

SEQ ID NO: 3271582 - RNA, 18 nt, Mycobacterium tuberculosis H37Rv
cccuuggacugucccacc

SEQ ID NO: 3271583 - RNA, 18 nt, Mycobacterium tuberculosis H37Rv
cccuugggacugcggaca

SEQ ID NO: 3271584 - RNA, 22 nt, Mycobacterium tuberculosis H37Rv
cccuuguggaguacggcgaugc

SEQ ID NO: 3271585 - RNA, 22 nt, Mycobacterium tuberculosis H37Rv
cccuuguggucugccagcaccc

SEQ ID NO: 3271586 - RNA, 19 nt, Mycobacterium tuberculosis H37Rv
cccuuguucccgaaacccg

SEQ ID NO: 3271587 - RNA, 23 nt, Mycobacterium tuberculosis H37Rv
cccuuucgcgccgcgaggcaccg

SEQ ID NO: 3271588 - RNA, 17 nt, Mycobacterium tuberculosis H37Rv
cccuuugcacgguggca

SEQ ID NO: 3271589 - RNA, 16 nt, Mycobacterium tuberculosis H37Rv
cccuuuguggggccgg

SEQ ID NO: 3271590 - RNA, 13 nt, Mycobacterium tuberculosis H37Rv
ccgaaaacaaccc

SEQ ID NO: 3271591 - RNA, 20 nt, Mycobacterium tuberculosis H37Rv
ccgaaaacgacaucaccacc

SEQ ID NO: 3271592 - RNA, 16 nt, Mycobacterium tuberculosis H37Rv
ccgaaaacugaccccc

SEQ ID NO: 3271593 - RNA, 14 nt, Mycobacterium tuberculosis H37Rv
ccgaaaaguccgcc

SEQ ID NO: 3271594 - RNA, 18 nt, Mycobacterium tuberculosis H37Rv
ccgaaaaguccgccgccu

SEQ ID NO: 3271595 - RNA, 17 nt, Mycobacterium tuberculosis H37Rv
ccgaaaauucaggcgcc

SEQ ID NO: 3271596 - RNA, 16 nt, Mycobacterium tuberculosis H37Rv
ccgaaaccaugccgcc

SEQ ID NO: 3271597 - RNA, 14 nt, Mycobacterium tuberculosis H37Rv
ccgaaacccgaugu

SEQ ID NO: 3271598 - RNA, 14 nt, Mycobacterium tuberculosis H37Rv
ccgaauggccgccg

SEQ ID NO: 3271599 - RNA, 14 nt, Mycobacterium tuberculosis H37Rv
ccgaaugucgauga

SEQ ID NO: 3271600 - RNA, 18 nt, Mycobacterium tuberculosis H37Rv
ccgaauuccucaaggucg

SEQ ID NO: 3271601 - RNA, 19 nt, Mycobacterium tuberculosis H37Rv
ccgaauuguuguaacccgu

SEQ ID NO: 3271602 - RNA, 16 nt, Mycobacterium tuberculosis H37Rv
ccgaauuugucggcga

SEQ ID NO: 3271603 - RNA, 18 nt, Mycobacterium tuberculosis H37Rv
ccgaauuugucggcgaag

SEQ ID NO: 3271604 - RNA, 19 nt, Mycobacterium tuberculosis H37Rv
ccgacaacuguccugccag

SEQ ID NO: 3271605 - RNA, 21 nt, Mycobacterium tuberculosis H37Rv
ccgacaauggcagcgagacgu

SEQ ID NO: 3271606 - RNA, 19 nt, Mycobacterium tuberculosis H37Rv
ccgacaaugucggcgaugc

SEQ ID NO: 3271607 - RNA, 17 nt, Mycobacterium tuberculosis H37Rv
ccgacaccacggaccag

SEQ ID NO: 3271608 - RNA, 12 nt, Mycobacterium tuberculosis H37Rv
ccgacacccgua

SEQ ID NO: 3271609 - RNA, 23 nt, Mycobacterium tuberculosis H37Rv
ccgacaccgccccgccgcgacgg

SEQ ID NO: 3271610 - RNA, 14 nt, Mycobacterium tuberculosis H37Rv
ccgacaccggcggc

SEQ ID NO: 3271611 - RNA, 17 nt, Mycobacterium tuberculosis H37Rv
ccgacaccggcggcauc

SEQ ID NO: 3271612 - RNA, 14 nt, Mycobacterium tuberculosis H37Rv
ccgacaccggcuga

SEQ ID NO: 3271613 - RNA, 14 nt, Mycobacterium tuberculosis H37Rv
ccgacaccgugccg

SEQ ID NO: 3271614 - RNA, 15 nt, Mycobacterium tuberculosis H37Rv
ccgacaccgugccgc

SEQ ID NO: 3271615 - RNA, 15 nt, Mycobacterium tuberculosis H37Rv
ccgacaccgugucgc

SEQ ID NO: 3271616 - RNA, 21 nt, Mycobacterium tuberculosis H37Rv
ccgacacgaacgcugcuccgc

SEQ ID NO: 3271617 - RNA, 13 nt, Mycobacterium tuberculosis H37Rv
ccgacacgccgug

SEQ ID NO: 3271618 - RNA, 21 nt, Mycobacterium tuberculosis H37Rv
ccgacacggugcugccguugg

SEQ ID NO: 3271619 - RNA, 15 nt, Mycobacterium tuberculosis H37Rv
ccgacacguugcagc

SEQ ID NO: 3271620 - RNA, 19 nt, Mycobacterium tuberculosis H37Rv
ccgacacguuucacguggu

SEQ ID NO: 3271621 - RNA, 21 nt, Mycobacterium tuberculosis H37Rv
ccgacacucgauccggauuca

SEQ ID NO: 3271622 - RNA, 21 nt, Mycobacterium tuberculosis H37Rv
ccgacacuuaaccugaaccgg

SEQ ID NO: 3271623 - RNA, 23 nt, Mycobacterium tuberculosis H37Rv
ccgacagauggucacccacguug

SEQ ID NO: 3271624 - RNA, 23 nt, Mycobacterium tuberculosis H37Rv
ccgacagcacccaaugccaccgc

SEQ ID NO: 3271625 - RNA, 14 nt, Mycobacterium tuberculosis H37Rv
ccgacagcagccgg

SEQ ID NO: 3271626 - RNA, 12 nt, Mycobacterium tuberculosis H37Rv
ccgacagcccca

SEQ ID NO: 3271627 - RNA, 12 nt, Mycobacterium tuberculosis H37Rv
ccgacagccccg

SEQ ID NO: 3271628 - RNA, 13 nt, Mycobacterium tuberculosis H37Rv
ccgacagccccgg

SEQ ID NO: 3271629 - RNA, 14 nt, Mycobacterium tuberculosis H37Rv
ccgacagccccggc

SEQ ID NO: 3271630 - RNA, 15 nt, Mycobacterium tuberculosis H37Rv
ccgacagcgccuugu

SEQ ID NO: 3271631 - RNA, 14 nt, Mycobacterium tuberculosis H37Rv
ccgacaggccggcc

SEQ ID NO: 3271632 - RNA, 16 nt, Mycobacterium tuberculosis H37Rv
ccgacaggccggccac

SEQ ID NO: 3271633 - RNA, 18 nt, Mycobacterium tuberculosis H37Rv
ccgacaggccggccacca

SEQ ID NO: 3271634 - RNA, 21 nt, Mycobacterium tuberculosis H37Rv
ccgacaggugcucgucaucca

SEQ ID NO: 3271635 - RNA, 21 nt, Mycobacterium tuberculosis H37Rv
ccgacaguccgcgccggcggg

SEQ ID NO: 3271636 - RNA, 17 nt, Mycobacterium tuberculosis H37Rv
ccgacaguggucccggu

SEQ ID NO: 3271637 - RNA, 18 nt, Mycobacterium tuberculosis H37Rv
ccgacaguuuaccgugcc

SEQ ID NO: 3271638 - RNA, 22 nt, Mycobacterium tuberculosis H37Rv
ccgacaguuuaccgugccgccc

SEQ ID NO: 3271639 - RNA, 23 nt, Mycobacterium tuberculosis H37Rv
ccgacaucgcugcgacuggccgu

SEQ ID NO: 3271640 - RNA, 16 nt, Mycobacterium tuberculosis H37Rv
ccgacaucggccagcg

SEQ ID NO: 3271641 - RNA, 12 nt, Mycobacterium tuberculosis H37Rv
ccgacaucguca

SEQ ID NO: 3271642 - RNA, 23 nt, Mycobacterium tuberculosis H37Rv
ccgacauggcggugcgcagcuug

SEQ ID NO: 3271643 - RNA, 13 nt, Mycobacterium tuberculosis H37Rv
ccgacaugguccg

SEQ ID NO: 3271644 - RNA, 19 nt, Mycobacterium tuberculosis H37Rv
ccgacaugguccgaccagc

SEQ ID NO: 3271645 - RNA, 21 nt, Mycobacterium tuberculosis H37Rv
ccgacaugguccgaccagcgg

SEQ ID NO: 3271646 - RNA, 12 nt, Mycobacterium tuberculosis H37Rv
ccgaccaccaga

SEQ ID NO: 3271647 - RNA, 20 nt, Mycobacterium tuberculosis H37Rv
ccgaccaccccgagcggcug

SEQ ID NO: 3271648 - RNA, 12 nt, Mycobacterium tuberculosis H37Rv
ccgaccagcaga

SEQ ID NO: 3271649 - RNA, 13 nt, Mycobacterium tuberculosis H37Rv
ccgaccagcagau

SEQ ID NO: 3271650 - RNA, 12 nt, Mycobacterium tuberculosis H37Rv
ccgaccagccgu

SEQ ID NO: 3271651 - RNA, 22 nt, Mycobacterium tuberculosis H37Rv
ccgaccagcgcgcugcgcgacu

SEQ ID NO: 3271652 - RNA, 19 nt, Mycobacterium tuberculosis H37Rv
ccgaccagcggccgaccgc

SEQ ID NO: 3271653 - RNA, 13 nt, Mycobacterium tuberculosis H37Rv
ccgaccagcuuga

SEQ ID NO: 3271654 - RNA, 19 nt, Mycobacterium tuberculosis H37Rv
ccgaccagucgacgucucu

SEQ ID NO: 3271655 - RNA, 22 nt, Mycobacterium tuberculosis H37Rv
ccgaccaucgggacgccuugau

SEQ ID NO: 3271656 - RNA, 14 nt, Mycobacterium tuberculosis H37Rv
ccgacccaacccga

SEQ ID NO: 3271657 - RNA, 15 nt, Mycobacterium tuberculosis H37Rv
ccgacccaacgacca

SEQ ID NO: 3271658 - RNA, 20 nt, Mycobacterium tuberculosis H37Rv
ccgacccaacgaccaccacc

SEQ ID NO: 3271659 - RNA, 17 nt, Mycobacterium tuberculosis H37Rv
ccgacccaucaccagcg

SEQ ID NO: 3271660 - RNA, 14 nt, Mycobacterium tuberculosis H37Rv
ccgaccccgacggc

SEQ ID NO: 3271661 - RNA, 16 nt, Mycobacterium tuberculosis H37Rv
ccgaccccgccgagcg

SEQ ID NO: 3271662 - RNA, 12 nt, Mycobacterium tuberculosis H37Rv
ccgaccccgcgc

SEQ ID NO: 3271663 - RNA, 16 nt, Mycobacterium tuberculosis H37Rv
ccgacccgacgcuggu

SEQ ID NO: 3271664 - RNA, 14 nt, Mycobacterium tuberculosis H37Rv
ccgacccgcccgaa

SEQ ID NO: 3271665 - RNA, 13 nt, Mycobacterium tuberculosis H37Rv
ccgacccgccgau

SEQ ID NO: 3271666 - RNA, 14 nt, Mycobacterium tuberculosis H37Rv
ccgacccgccgcgc

SEQ ID NO: 3271667 - RNA, 16 nt, Mycobacterium tuberculosis H37Rv
ccgacccgccgcgccc

SEQ ID NO: 3271668 - RNA, 23 nt, Mycobacterium tuberculosis H37Rv
ccgacccgccgcgcccggcgcaa

SEQ ID NO: 3271669 - RNA, 15 nt, Mycobacterium tuberculosis H37Rv
ccgacccgcgcgccg

SEQ ID NO: 3271670 - RNA, 16 nt, Mycobacterium tuberculosis H37Rv
ccgacccgcuucgccc

SEQ ID NO: 3271671 - RNA, 14 nt, Mycobacterium tuberculosis H37Rv
ccgacccgggcgag

SEQ ID NO: 3271672 - RNA, 22 nt, Mycobacterium tuberculosis H37Rv
ccgacccgggcgagcgcggccu

SEQ ID NO: 3271673 - RNA, 16 nt, Mycobacterium tuberculosis H37Rv
ccgaccgaaagccgca

SEQ ID NO: 3271674 - RNA, 19 nt, Mycobacterium tuberculosis H37Rv
ccgaccgaaagccgcacca

SEQ ID NO: 3271675 - RNA, 20 nt, Mycobacterium tuberculosis H37Rv
ccgaccgaaagccgcaccag

SEQ ID NO: 3271676 - RNA, 15 nt, Mycobacterium tuberculosis H37Rv
ccgaccgaaccguca

SEQ ID NO: 3271677 - RNA, 22 nt, Mycobacterium tuberculosis H37Rv
ccgaccgauaacacccgggcca

SEQ ID NO: 3271678 - RNA, 13 nt, Mycobacterium tuberculosis H37Rv
ccgaccgcaccgu

SEQ ID NO: 3271679 - RNA, 17 nt, Mycobacterium tuberculosis H37Rv
ccgaccgcacgaucgca

SEQ ID NO: 3271680 - RNA, 13 nt, Mycobacterium tuberculosis H37Rv
ccgaccgccaccg

SEQ ID NO: 3271681 - RNA, 17 nt, Mycobacterium tuberculosis H37Rv
ccgaccgccaccgccag

SEQ ID NO: 3271682 - RNA, 14 nt, Mycobacterium tuberculosis H37Rv
ccgaccgcgcccgc

SEQ ID NO: 3271683 - RNA, 19 nt, Mycobacterium tuberculosis H37Rv
ccgaccgcgggucgugcca

SEQ ID NO: 3271684 - RNA, 20 nt, Mycobacterium tuberculosis H37Rv
ccgaccgcguuguccgcggc

SEQ ID NO: 3271685 - RNA, 14 nt, Mycobacterium tuberculosis H37Rv
ccgaccggaccggg

SEQ ID NO: 3271686 - RNA, 16 nt, Mycobacterium tuberculosis H37Rv
ccgaccggagccgccg

SEQ ID NO: 3271687 - RNA, 13 nt, Mycobacterium tuberculosis H37Rv
ccgaccggcaccc

SEQ ID NO: 3271688 - RNA, 14 nt, Mycobacterium tuberculosis H37Rv
ccgaccggcccgca

SEQ ID NO: 3271689 - RNA, 20 nt, Mycobacterium tuberculosis H37Rv
ccgaccgguacccguagcac

SEQ ID NO: 3271690 - RNA, 17 nt, Mycobacterium tuberculosis H37Rv
ccgaccggucuggcgau

SEQ ID NO: 3271691 - RNA, 15 nt, Mycobacterium tuberculosis H37Rv
ccgaccgucacugau

SEQ ID NO: 3271692 - RNA, 17 nt, Mycobacterium tuberculosis H37Rv
ccgaccgucgucgugca

SEQ ID NO: 3271693 - RNA, 18 nt, Mycobacterium tuberculosis H37Rv
ccgaccguggugagcugg

SEQ ID NO: 3271694 - RNA, 23 nt, Mycobacterium tuberculosis H37Rv
ccgaccguuucuccgccgcccag

SEQ ID NO: 3271695 - RNA, 16 nt, Mycobacterium tuberculosis H37Rv
ccgagcuccuccacca

SEQ ID NO: 3271696 - RNA, 18 nt, Mycobacterium tuberculosis H37Rv
ccgagcuccuccaccaac

SEQ ID NO: 3271697 - RNA, 23 nt, Mycobacterium tuberculosis H37Rv
ccgagcucuuggagcuuggccca

SEQ ID NO: 3271698 - RNA, 14 nt, Mycobacterium tuberculosis H37Rv
ccgagcugauccgg

SEQ ID NO: 3271699 - RNA, 18 nt, Mycobacterium tuberculosis H37Rv
ccgagcugauccgggugg

SEQ ID NO: 3271700 - RNA, 14 nt, Mycobacterium tuberculosis H37Rv
ccgagcugccgucg

SEQ ID NO: 3271701 - RNA, 18 nt, Mycobacterium tuberculosis H37Rv
ccgagcugccgucgcugc

SEQ ID NO: 3271702 - RNA, 20 nt, Mycobacterium tuberculosis H37Rv
ccgagcuggcaacgccgcgc

SEQ ID NO: 3271703 - RNA, 16 nt, Mycobacterium tuberculosis H37Rv
ccgagcugguuggcgc

SEQ ID NO: 3271704 - RNA, 23 nt, Mycobacterium tuberculosis H37Rv
ccgagcugguuggcgccgaaaag

SEQ ID NO: 3271705 - RNA, 21 nt, Mycobacterium tuberculosis H37Rv
ccgagcuucagcgcgcugcag

SEQ ID NO: 3271706 - RNA, 22 nt, Mycobacterium tuberculosis H37Rv
ccgagcuugagcgugagcgccg

SEQ ID NO: 3271707 - RNA, 23 nt, Mycobacterium tuberculosis H37Rv
ccgagcuugagcgugagcgccgc

SEQ ID NO: 3271708 - RNA, 18 nt, Mycobacterium tuberculosis H37Rv
ccgagcuuggccgccgcc

SEQ ID NO: 3271709 - RNA, 19 nt, Mycobacterium tuberculosis H37Rv
ccgagcuuggccgccgcca

SEQ ID NO: 3271710 - RNA, 19 nt, Mycobacterium tuberculosis H37Rv
ccgagcuugggccggugca

SEQ ID NO: 3271711 - RNA, 19 nt, Mycobacterium tuberculosis H37Rv
ccgagcuugucgagcaggc

SEQ ID NO: 3271712 - RNA, 14 nt, Mycobacterium tuberculosis H37Rv
ccgaggaccagagg

SEQ ID NO: 3271713 - RNA, 18 nt, Mycobacterium tuberculosis H37Rv
ccgaggaccucgucaccg

SEQ ID NO: 3271714 - RNA, 16 nt, Mycobacterium tuberculosis H37Rv
ccgaggacgccggcgc

SEQ ID NO: 3271715 - RNA, 20 nt, Mycobacterium tuberculosis H37Rv
ccgaggacgccggcgccgcc

SEQ ID NO: 3271716 - RNA, 21 nt, Mycobacterium tuberculosis H37Rv
ccgaggacgccggcgccgcca

SEQ ID NO: 3271717 - RNA, 14 nt, Mycobacterium tuberculosis H37Rv
ccgaggagggccgc

SEQ ID NO: 3271718 - RNA, 12 nt, Mycobacterium tuberculosis H37Rv
ccgaggaucgcg

SEQ ID NO: 3271719 - RNA, 23 nt, Mycobacterium tuberculosis H37Rv
ccgaggaugugguuggugcuggc

SEQ ID NO: 3271720 - RNA, 16 nt, Mycobacterium tuberculosis H37Rv
ccgaggccgaccucgu

SEQ ID NO: 3271721 - RNA, 17 nt, Mycobacterium tuberculosis H37Rv
ccgaggccgccaucgcc

SEQ ID NO: 3271722 - RNA, 20 nt, Mycobacterium tuberculosis H37Rv
ccgaggccgccaucgccgcc

SEQ ID NO: 3271723 - RNA, 16 nt, Mycobacterium tuberculosis H37Rv
ccgaggccgcugccag

SEQ ID NO: 3271724 - RNA, 17 nt, Mycobacterium tuberculosis H37Rv
ccgaggccuaccaggcg

SEQ ID NO: 3271725 - RNA, 16 nt, Mycobacterium tuberculosis H37Rv
ccgaggccugacugaa

SEQ ID NO: 3271726 - RNA, 17 nt, Mycobacterium tuberculosis H37Rv
ccgaggcgaguucgcgc

SEQ ID NO: 3271727 - RNA, 15 nt, Mycobacterium tuberculosis H37Rv
ccgaggcggaugcgg

SEQ ID NO: 3271728 - RNA, 21 nt, Mycobacterium tuberculosis H37Rv
ccgaggcggucuuguccagga

SEQ ID NO: 3271729 - RNA, 13 nt, Mycobacterium tuberculosis H37Rv
ccgaggcucgggc

SEQ ID NO: 3271730 - RNA, 20 nt, Mycobacterium tuberculosis H37Rv
ccgagggcgccgggggcgcc

SEQ ID NO: 3271731 - RNA, 15 nt, Mycobacterium tuberculosis H37Rv
ccgagggcgucgccg

SEQ ID NO: 3271732 - RNA, 16 nt, Mycobacterium tuberculosis H37Rv
ccgagggcgucgccgc

SEQ ID NO: 3271733 - RNA, 18 nt, Mycobacterium tuberculosis H37Rv
ccgagggcgucgccgccg

SEQ ID NO: 3271734 - RNA, 17 nt, Mycobacterium tuberculosis H37Rv
ccgaggucacccgguag

SEQ ID NO: 3271735 - RNA, 12 nt, Mycobacterium tuberculosis H37Rv
ccgaggucggcc

SEQ ID NO: 3271736 - RNA, 17 nt, Mycobacterium tuberculosis H37Rv
ccgaggucgguucggcc

SEQ ID NO: 3271737 - RNA, 14 nt, Mycobacterium tuberculosis H37Rv
ccgaggugccgcgc

SEQ ID NO: 3271738 - RNA, 15 nt, Mycobacterium tuberculosis H37Rv
ccgaggugccgcgca

SEQ ID NO: 3271739 - RNA, 19 nt, Mycobacterium tuberculosis H37Rv
ccgaggugccgcgcagcug

SEQ ID NO: 3271740 - RNA, 18 nt, Mycobacterium tuberculosis H37Rv
ccgaggugccggggcccc

SEQ ID NO: 3271741 - RNA, 21 nt, Mycobacterium tuberculosis H37Rv
ccgaggugcuuggggucaccc

SEQ ID NO: 3271742 - RNA, 23 nt, Mycobacterium tuberculosis H37Rv
ccgagguucaaagcagcgcacca

SEQ ID NO: 3271743 - RNA, 20 nt, Mycobacterium tuberculosis H37Rv
ccgaguaccgauagccugcg

SEQ ID NO: 3271744 - RNA, 17 nt, Mycobacterium tuberculosis H37Rv
ccgaguaccggccagcc

SEQ ID NO: 3271745 - RNA, 22 nt, Mycobacterium tuberculosis H37Rv
ccgaguagaagauggcaccgcc

SEQ ID NO: 3271746 - RNA, 16 nt, Mycobacterium tuberculosis H37Rv
ccgaguccggcgagcu

SEQ ID NO: 3271747 - RNA, 16 nt, Mycobacterium tuberculosis H37Rv
ccgagucucgucgggu

SEQ ID NO: 3271748 - RNA, 17 nt, Mycobacterium tuberculosis H37Rv
ccgagucucgucgggua

SEQ ID NO: 3271749 - RNA, 14 nt, Mycobacterium tuberculosis H37Rv
ccgagugaccaggg

SEQ ID NO: 3271750 - RNA, 17 nt, Mycobacterium tuberculosis H37Rv
ccgagugaccagggugg

SEQ ID NO: 3271751 - RNA, 22 nt, Mycobacterium tuberculosis H37Rv
ccgagugcccagcgaugcgcuc

SEQ ID NO: 3271752 - RNA, 16 nt, Mycobacterium tuberculosis H37Rv
ccgagugcggugugug

SEQ ID NO: 3271753 - RNA, 22 nt, Mycobacterium tuberculosis H37Rv
ccgagugcggugugugcaagcc

SEQ ID NO: 3271754 - RNA, 18 nt, Mycobacterium tuberculosis H37Rv
ccgaguggccggugggcc

SEQ ID NO: 3271755 - RNA, 21 nt, Mycobacterium tuberculosis H37Rv
ccgaguggccggugggccgcc

SEQ ID NO: 3271756 - RNA, 16 nt, Mycobacterium tuberculosis H37Rv
ccgaguuaccggugac

SEQ ID NO: 3271757 - RNA, 18 nt, Mycobacterium tuberculosis H37Rv
ccgaguuauagaagccga

SEQ ID NO: 3271758 - RNA, 18 nt, Mycobacterium tuberculosis H37Rv
ccgaguucgucagcggcc

SEQ ID NO: 3271759 - RNA, 20 nt, Mycobacterium tuberculosis H37Rv
ccgaguugaaggugccggcg

SEQ ID NO: 3271760 - RNA, 21 nt, Mycobacterium tuberculosis H37Rv
ccgaguugaugaagauggcgc

SEQ ID NO: 3271761 - RNA, 22 nt, Mycobacterium tuberculosis H37Rv
ccgaguugaugaagauggcgcg

SEQ ID NO: 3271762 - RNA, 17 nt, Mycobacterium tuberculosis H37Rv
ccgaguugcccucuggc

SEQ ID NO: 3271763 - RNA, 18 nt, Mycobacterium tuberculosis H37Rv
ccgaguuucugaagcccg

SEQ ID NO: 3271764 - RNA, 15 nt, Mycobacterium tuberculosis H37Rv
ccgaguuugcgauac

SEQ ID NO: 3271765 - RNA, 17 nt, Mycobacterium tuberculosis H37Rv
ccgauaacacccgggcc

SEQ ID NO: 3271766 - RNA, 14 nt, Mycobacterium tuberculosis H37Rv
ccgauacccgguga

SEQ ID NO: 3271767 - RNA, 19 nt, Mycobacterium tuberculosis H37Rv
ccgauaccggcggcgagcg

SEQ ID NO: 3271768 - RNA, 16 nt, Mycobacterium tuberculosis H37Rv
ccgauaccgugcaccu

SEQ ID NO: 3271769 - RNA, 15 nt, Mycobacterium tuberculosis H37Rv
ccgauacgcacccgc

SEQ ID NO: 3271770 - RNA, 17 nt, Mycobacterium tuberculosis H37Rv
ccgauacggccggccgu

SEQ ID NO: 3271771 - RNA, 18 nt, Mycobacterium tuberculosis H37Rv
ccgauacuucaucggcac

SEQ ID NO: 3271772 - RNA, 20 nt, Mycobacterium tuberculosis H37Rv
ccgauacuucaucggcacag

SEQ ID NO: 3271773 - RNA, 13 nt, Mycobacterium tuberculosis H37Rv
ccgauagcaccgg

SEQ ID NO: 3271774 - RNA, 17 nt, Mycobacterium tuberculosis H37Rv
ccgauagcgaccgcggc

SEQ ID NO: 3271775 - RNA, 21 nt, Mycobacterium tuberculosis H37Rv
ccgauagcgaccgcggccccg

SEQ ID NO: 3271776 - RNA, 21 nt, Mycobacterium tuberculosis H37Rv
ccgauauccaaugccagaucg

SEQ ID NO: 3271777 - RNA, 13 nt, Mycobacterium tuberculosis H37Rv
ccgauaucgcaga

SEQ ID NO: 3271778 - RNA, 16 nt, Mycobacterium tuberculosis H37Rv
ccgauaucgcugcgga

SEQ ID NO: 3271779 - RNA, 17 nt, Mycobacterium tuberculosis H37Rv
ccgauaucgcugcggaa

SEQ ID NO: 3271780 - RNA, 14 nt, Mycobacterium tuberculosis H37Rv
ccgauaucggugac

SEQ ID NO: 3271781 - RNA, 22 nt, Mycobacterium tuberculosis H37Rv
ccgauaucggugaccguggcgg

SEQ ID NO: 3271782 - RNA, 15 nt, Mycobacterium tuberculosis H37Rv
ccgaucaacggaaug

SEQ ID NO: 3271783 - RNA, 22 nt, Mycobacterium tuberculosis H37Rv
ccgaucaccuucggccgaccgg

SEQ ID NO: 3271784 - RNA, 15 nt, Mycobacterium tuberculosis H37Rv
ccgaucacucggaua

SEQ ID NO: 3271785 - RNA, 14 nt, Mycobacterium tuberculosis H37Rv
ccgaucagcaccga

SEQ ID NO: 3271786 - RNA, 20 nt, Mycobacterium tuberculosis H37Rv
ccgaucagcaccgacggcgc

SEQ ID NO: 3271787 - RNA, 13 nt, Mycobacterium tuberculosis H37Rv
ccgaucagcaggg

SEQ ID NO: 3271788 - RNA, 15 nt, Mycobacterium tuberculosis H37Rv
ccgaucagcccggcc

SEQ ID NO: 3271789 - RNA, 16 nt, Mycobacterium tuberculosis H37Rv
ccgaucagccguggca

SEQ ID NO: 3271790 - RNA, 13 nt, Mycobacterium tuberculosis H37Rv
ccgaucagcgacg

SEQ ID NO: 3271791 - RNA, 16 nt, Mycobacterium tuberculosis H37Rv
ccgcaaugcguugacc

SEQ ID NO: 3271792 - RNA, 14 nt, Mycobacterium tuberculosis H37Rv
ccgcaauggaccga

SEQ ID NO: 3271793 - RNA, 15 nt, Mycobacterium tuberculosis H37Rv
ccgcaauggcggccu

SEQ ID NO: 3271794 - RNA, 17 nt, Mycobacterium tuberculosis H37Rv
ccgcaauggcggccuug

SEQ ID NO: 3271795 - RNA, 17 nt, Mycobacterium tuberculosis H37Rv
ccgcacaagcccagccc

SEQ ID NO: 3271796 - RNA, 19 nt, Mycobacterium tuberculosis H37Rv
ccgcacaagcccagcccga

SEQ ID NO: 3271797 - RNA, 22 nt, Mycobacterium tuberculosis H37Rv
ccgcacaccugcgcggcgugcg

SEQ ID NO: 3271798 - RNA, 19 nt, Mycobacterium tuberculosis H37Rv
ccgcacagaaaacgauggu

SEQ ID NO: 3271799 - RNA, 12 nt, Mycobacterium tuberculosis H37Rv
ccgcacagcgac

SEQ ID NO: 3271800 - RNA, 17 nt, Mycobacterium tuberculosis H37Rv
ccgcacagcgacgagau

SEQ ID NO: 3271801 - RNA, 22 nt, Mycobacterium tuberculosis H37Rv
ccgcacagcggauucggcgucg

SEQ ID NO: 3271802 - RNA, 21 nt, Mycobacterium tuberculosis H37Rv
ccgcacaugagcuggaaucga

SEQ ID NO: 3271803 - RNA, 15 nt, Mycobacterium tuberculosis H37Rv
ccgcaccaagcagcg

SEQ ID NO: 3271804 - RNA, 20 nt, Mycobacterium tuberculosis H37Rv
ccgcaccaagcagcgaccag

SEQ ID NO: 3271805 - RNA, 22 nt, Mycobacterium tuberculosis H37Rv
ccgcaccacaccgugggcgacg

SEQ ID NO: 3271806 - RNA, 14 nt, Mycobacterium tuberculosis H37Rv
ccgcaccaccggcc

SEQ ID NO: 3271807 - RNA, 17 nt, Mycobacterium tuberculosis H37Rv
ccgcaccaccggcccca

SEQ ID NO: 3271808 - RNA, 21 nt, Mycobacterium tuberculosis H37Rv
ccgcaccagaaauugacgugc

SEQ ID NO: 3271809 - RNA, 19 nt, Mycobacterium tuberculosis H37Rv
ccgcaccagaucgucgggc

SEQ ID NO: 3271810 - RNA, 16 nt, Mycobacterium tuberculosis H37Rv
ccgcaccagcugucgg

SEQ ID NO: 3271811 - RNA, 18 nt, Mycobacterium tuberculosis H37Rv
ccgcaccagcugucgggc

SEQ ID NO: 3271812 - RNA, 13 nt, Mycobacterium tuberculosis H37Rv
ccgcaccaggugu

SEQ ID NO: 3271813 - RNA, 20 nt, Mycobacterium tuberculosis H37Rv
ccgcaccagguguccccgcc

SEQ ID NO: 3271814 - RNA, 19 nt, Mycobacterium tuberculosis H37Rv
ccgcaccagucgcgcagcg

SEQ ID NO: 3271815 - RNA, 12 nt, Mycobacterium tuberculosis H37Rv
ccgcaccagugg

SEQ ID NO: 3271816 - RNA, 17 nt, Mycobacterium tuberculosis H37Rv
ccgcaccaguggcgccc

SEQ ID NO: 3271817 - RNA, 20 nt, Mycobacterium tuberculosis H37Rv
ccgcacccaugaucccgcug

SEQ ID NO: 3271818 - RNA, 18 nt, Mycobacterium tuberculosis H37Rv
ccgcacccccgacaccgc

SEQ ID NO: 3271819 - RNA, 15 nt, Mycobacterium tuberculosis H37Rv
ccgcacccccgucga

SEQ ID NO: 3271820 - RNA, 18 nt, Mycobacterium tuberculosis H37Rv
ccgcacccccgucgauca

SEQ ID NO: 3271821 - RNA, 21 nt, Mycobacterium tuberculosis H37Rv
ccgcacccccgucgaucagcg

SEQ ID NO: 3271822 - RNA, 15 nt, Mycobacterium tuberculosis H37Rv
ccgcaccccggccgc

SEQ ID NO: 3271823 - RNA, 17 nt, Mycobacterium tuberculosis H37Rv
ccgcaccccggccgcgc

SEQ ID NO: 3271824 - RNA, 18 nt, Mycobacterium tuberculosis H37Rv
ccgcacccgcgcggacac

SEQ ID NO: 3271825 - RNA, 14 nt, Mycobacterium tuberculosis H37Rv
ccgcacccggccgc

SEQ ID NO: 3271826 - RNA, 16 nt, Mycobacterium tuberculosis H37Rv
ccgcacccggccgcgc

SEQ ID NO: 3271827 - RNA, 12 nt, Mycobacterium tuberculosis H37Rv
ccgcacccgucc

SEQ ID NO: 3271828 - RNA, 17 nt, Mycobacterium tuberculosis H37Rv
ccgcacccguugcuccc

SEQ ID NO: 3271829 - RNA, 19 nt, Mycobacterium tuberculosis H37Rv
ccgcaccgaaaccaugccg

SEQ ID NO: 3271830 - RNA, 17 nt, Mycobacterium tuberculosis H37Rv
ccgcaccgauuuccucu

SEQ ID NO: 3271831 - RNA, 17 nt, Mycobacterium tuberculosis H37Rv
ccgcaccgcgguacgcc

SEQ ID NO: 3271832 - RNA, 15 nt, Mycobacterium tuberculosis H37Rv
ccgcaccgcugaccc

SEQ ID NO: 3271833 - RNA, 21 nt, Mycobacterium tuberculosis H37Rv
ccgcaccggaucaccgcgccc

SEQ ID NO: 3271834 - RNA, 17 nt, Mycobacterium tuberculosis H37Rv
ccgcaccggaucggcua

SEQ ID NO: 3271835 - RNA, 15 nt, Mycobacterium tuberculosis H37Rv
ccgcaccggcggcgc

SEQ ID NO: 3271836 - RNA, 20 nt, Mycobacterium tuberculosis H37Rv
ccgcaccguagccgcugcac

SEQ ID NO: 3271837 - RNA, 12 nt, Mycobacterium tuberculosis H37Rv
ccgcaccgucgc

SEQ ID NO: 3271838 - RNA, 20 nt, Mycobacterium tuberculosis H37Rv
ccgcaccuacccugcgcguu

SEQ ID NO: 3271839 - RNA, 16 nt, Mycobacterium tuberculosis H37Rv
ccgcaccugggcggcg

SEQ ID NO: 3271840 - RNA, 15 nt, Mycobacterium tuberculosis H37Rv
ccgcacgaagccggc

SEQ ID NO: 3271841 - RNA, 11 nt, Mycobacterium tuberculosis H37Rv
ccgcacgacga

SEQ ID NO: 3271842 - RNA, 16 nt, Mycobacterium tuberculosis H37Rv
ccgcacgcaaugcggg

SEQ ID NO: 3271843 - RNA, 17 nt, Mycobacterium tuberculosis H37Rv
ccgcacgcacggcgugu

SEQ ID NO: 3271844 - RNA, 13 nt, Mycobacterium tuberculosis H37Rv
ccgcacgcucggc

SEQ ID NO: 3271845 - RNA, 17 nt, Mycobacterium tuberculosis H37Rv
ccgcacgcucggcgugu

SEQ ID NO: 3271846 - RNA, 17 nt, Mycobacterium tuberculosis H37Rv
ccgcacgcucgggggau

SEQ ID NO: 3271847 - RNA, 18 nt, Mycobacterium tuberculosis H37Rv
ccgcacgcucgggggauc

SEQ ID NO: 3271848 - RNA, 19 nt, Mycobacterium tuberculosis H37Rv
ccgcacgcuggcgggcacu

SEQ ID NO: 3271849 - RNA, 21 nt, Mycobacterium tuberculosis H37Rv
ccgcacggaggcggaccaggc

SEQ ID NO: 3271850 - RNA, 22 nt, Mycobacterium tuberculosis H37Rv
ccgcacggaggcggaccaggcc

SEQ ID NO: 3271851 - RNA, 13 nt, Mycobacterium tuberculosis H37Rv
ccgcacggccucc

SEQ ID NO: 3271852 - RNA, 13 nt, Mycobacterium tuberculosis H37Rv
ccgcacgggaucg

SEQ ID NO: 3271853 - RNA, 15 nt, Mycobacterium tuberculosis H37Rv
ccgcacgggcgaccu

SEQ ID NO: 3271854 - RNA, 15 nt, Mycobacterium tuberculosis H37Rv
ccgcacggucagcgc

SEQ ID NO: 3271855 - RNA, 14 nt, Mycobacterium tuberculosis H37Rv
ccgcacguucacgc

SEQ ID NO: 3271856 - RNA, 19 nt, Mycobacterium tuberculosis H37Rv
ccgcacguuggcggccagc

SEQ ID NO: 3271857 - RNA, 12 nt, Mycobacterium tuberculosis H37Rv
ccgcacuccacg

SEQ ID NO: 3271858 - RNA, 20 nt, Mycobacterium tuberculosis H37Rv
ccgcacugcuagucgugccg

SEQ ID NO: 3271859 - RNA, 17 nt, Mycobacterium tuberculosis H37Rv
ccgcacugugcccucaa

SEQ ID NO: 3271860 - RNA, 19 nt, Mycobacterium tuberculosis H37Rv
ccgcacuugaucgacggcc

SEQ ID NO: 3271861 - RNA, 22 nt, Mycobacterium tuberculosis H37Rv
ccgcacuuucuuccucggggcu

SEQ ID NO: 3271862 - RNA, 13 nt, Mycobacterium tuberculosis H37Rv
ccgcagaccgguu

SEQ ID NO: 3271863 - RNA, 16 nt, Mycobacterium tuberculosis H37Rv
ccgcagacgccgucug

SEQ ID NO: 3271864 - RNA, 18 nt, Mycobacterium tuberculosis H37Rv
ccgcagacguccugggcc

SEQ ID NO: 3271865 - RNA, 19 nt, Mycobacterium tuberculosis H37Rv
ccgcagacgugguagccgg

SEQ ID NO: 3271866 - RNA, 14 nt, Mycobacterium tuberculosis H37Rv
ccgcagagaccaag

SEQ ID NO: 3271867 - RNA, 23 nt, Mycobacterium tuberculosis H37Rv
ccgcagagcaccgcgaacagcac

SEQ ID NO: 3271868 - RNA, 15 nt, Mycobacterium tuberculosis H37Rv
ccgcagaucaccgcc

SEQ ID NO: 3271869 - RNA, 19 nt, Mycobacterium tuberculosis H37Rv
ccgcagccagaucuccccg

SEQ ID NO: 3271870 - RNA, 13 nt, Mycobacterium tuberculosis H37Rv
ccgcagccagcgg

SEQ ID NO: 3271871 - RNA, 20 nt, Mycobacterium tuberculosis H37Rv
ccgcagccccgacaguugug

SEQ ID NO: 3271872 - RNA, 21 nt, Mycobacterium tuberculosis H37Rv
ccgcagcccgccgggcuccac

SEQ ID NO: 3271873 - RNA, 16 nt, Mycobacterium tuberculosis H37Rv
ccgcagcccgugacug

SEQ ID NO: 3271874 - RNA, 22 nt, Mycobacterium tuberculosis H37Rv
ccgcagcgccuaccagcaccgg

SEQ ID NO: 3271875 - RNA, 22 nt, Mycobacterium tuberculosis H37Rv
ccgcagcggccagcccagccgg

SEQ ID NO: 3271876 - RNA, 23 nt, Mycobacterium tuberculosis H37Rv
ccgcagcggccagcccagccggg

SEQ ID NO: 3271877 - RNA, 13 nt, Mycobacterium tuberculosis H37Rv
ccgcagcggccug

SEQ ID NO: 3271878 - RNA, 14 nt, Mycobacterium tuberculosis H37Rv
ccgcagcggcggca

SEQ ID NO: 3271879 - RNA, 22 nt, Mycobacterium tuberculosis H37Rv
ccgcagcgucagcgcggcgucu

SEQ ID NO: 3271880 - RNA, 15 nt, Mycobacterium tuberculosis H37Rv
ccgcagcucgaccag

SEQ ID NO: 3271881 - RNA, 14 nt, Mycobacterium tuberculosis H37Rv
ccgcagcugcggau

SEQ ID NO: 3271882 - RNA, 20 nt, Mycobacterium tuberculosis H37Rv
ccgcagcuuggccucagcca

SEQ ID NO: 3271883 - RNA, 15 nt, Mycobacterium tuberculosis H37Rv
ccgcaggacgcugcc

SEQ ID NO: 3271884 - RNA, 13 nt, Mycobacterium tuberculosis H37Rv
ccgcaggcccgcc

SEQ ID NO: 3271885 - RNA, 17 nt, Mycobacterium tuberculosis H37Rv
ccgcaggcucaccgagc

SEQ ID NO: 3271886 - RNA, 16 nt, Mycobacterium tuberculosis H37Rv
ccgcagggaccgguua

SEQ ID NO: 3271887 - RNA, 13 nt, Mycobacterium tuberculosis H37Rv
ccgcagggccgcc

SEQ ID NO: 3271888 - RNA, 18 nt, Mycobacterium tuberculosis H37Rv
ccgccacguacuuggacg

SEQ ID NO: 3271889 - RNA, 15 nt, Mycobacterium tuberculosis H37Rv
ccgccacgucgccgg

SEQ ID NO: 3271890 - RNA, 14 nt, Mycobacterium tuberculosis H37Rv
ccgccacugcuggg

SEQ ID NO: 3271891 - RNA, 15 nt, Mycobacterium tuberculosis H37Rv
ccgccacuggcgccg

SEQ ID NO: 3271892 - RNA, 18 nt, Mycobacterium tuberculosis H37Rv
ccgccagaauugccggcg

SEQ ID NO: 3271893 - RNA, 17 nt, Mycobacterium tuberculosis H37Rv
ccgccagauaggcacca

SEQ ID NO: 3271894 - RNA, 15 nt, Mycobacterium tuberculosis H37Rv
ccgccagcaccaccg

SEQ ID NO: 3271895 - RNA, 17 nt, Mycobacterium tuberculosis H37Rv
ccgccagcaccaccggc

SEQ ID NO: 3271896 - RNA, 22 nt, Mycobacterium tuberculosis H37Rv
ccgccagcaccaccggcucccg

SEQ ID NO: 3271897 - RNA, 17 nt, Mycobacterium tuberculosis H37Rv
ccgccagcaccucggcc

SEQ ID NO: 3271898 - RNA, 16 nt, Mycobacterium tuberculosis H37Rv
ccgccagcagggccag

SEQ ID NO: 3271899 - RNA, 17 nt, Mycobacterium tuberculosis H37Rv
ccgccagcaugacaccg

SEQ ID NO: 3271900 - RNA, 18 nt, Mycobacterium tuberculosis H37Rv
ccgccagcaugacaccgg

SEQ ID NO: 3271901 - RNA, 18 nt, Mycobacterium tuberculosis H37Rv
ccgccagcauugaagaag

SEQ ID NO: 3271902 - RNA, 11 nt, Mycobacterium tuberculosis H37Rv
ccgccagcccc

SEQ ID NO: 3271903 - RNA, 13 nt, Mycobacterium tuberculosis H37Rv
ccgccagccccac

SEQ ID NO: 3271904 - RNA, 14 nt, Mycobacterium tuberculosis H37Rv
ccgccagccccacc

SEQ ID NO: 3271905 - RNA, 19 nt, Mycobacterium tuberculosis H37Rv
ccgccagccgcgagccggu

SEQ ID NO: 3271906 - RNA, 14 nt, Mycobacterium tuberculosis H37Rv
ccgccagccggcgc

SEQ ID NO: 3271907 - RNA, 21 nt, Mycobacterium tuberculosis H37Rv
ccgccagccgguccagcagcu

SEQ ID NO: 3271908 - RNA, 15 nt, Mycobacterium tuberculosis H37Rv
ccgccagccuggucu

SEQ ID NO: 3271909 - RNA, 23 nt, Mycobacterium tuberculosis H37Rv
ccgccagcgcacgauagccaccg

SEQ ID NO: 3271910 - RNA, 13 nt, Mycobacterium tuberculosis H37Rv
ccgccagcgccac

SEQ ID NO: 3271911 - RNA, 15 nt, Mycobacterium tuberculosis H37Rv
ccgccagcgccaccg

SEQ ID NO: 3271912 - RNA, 13 nt, Mycobacterium tuberculosis H37Rv
ccgccagcgccgc

SEQ ID NO: 3271913 - RNA, 16 nt, Mycobacterium tuberculosis H37Rv
ccgccagcgccgccgc

SEQ ID NO: 3271914 - RNA, 17 nt, Mycobacterium tuberculosis H37Rv
ccgccagcgccgccgcg

SEQ ID NO: 3271915 - RNA, 15 nt, Mycobacterium tuberculosis H37Rv
ccgccagcgccgguc

SEQ ID NO: 3271916 - RNA, 14 nt, Mycobacterium tuberculosis H37Rv
ccgccagcggcagc

SEQ ID NO: 3271917 - RNA, 16 nt, Mycobacterium tuberculosis H37Rv
ccgccagcugggcagc

SEQ ID NO: 3271918 - RNA, 22 nt, Mycobacterium tuberculosis H37Rv
ccgccagcugggcagccagauc

SEQ ID NO: 3271919 - RNA, 20 nt, Mycobacterium tuberculosis H37Rv
ccgccaggaacucggcccac

SEQ ID NO: 3271920 - RNA, 12 nt, Mycobacterium tuberculosis H37Rv
ccgccaggccga

SEQ ID NO: 3271921 - RNA, 12 nt, Mycobacterium tuberculosis H37Rv
ccgccaggccgc

SEQ ID NO: 3271922 - RNA, 21 nt, Mycobacterium tuberculosis H37Rv
ccgccaggccguugccccguc

SEQ ID NO: 3271923 - RNA, 22 nt, Mycobacterium tuberculosis H37Rv
ccgccagggcccuagccggcgc

SEQ ID NO: 3271924 - RNA, 17 nt, Mycobacterium tuberculosis H37Rv
ccgccagggcggcaucc

SEQ ID NO: 3271925 - RNA, 18 nt, Mycobacterium tuberculosis H37Rv
ccgccagguguucgccgg

SEQ ID NO: 3271926 - RNA, 19 nt, Mycobacterium tuberculosis H37Rv
ccgccaguccgaucgccga

SEQ ID NO: 3271927 - RNA, 18 nt, Mycobacterium tuberculosis H37Rv
ccgccaguucuucgggcg

SEQ ID NO: 3271928 - RNA, 22 nt, Mycobacterium tuberculosis H37Rv
ccgccaucaacaaggggcagca

SEQ ID NO: 3271929 - RNA, 16 nt, Mycobacterium tuberculosis H37Rv
ccgccaucaccgccgu

SEQ ID NO: 3271930 - RNA, 15 nt, Mycobacterium tuberculosis H37Rv
ccgccaucagccgcu

SEQ ID NO: 3271931 - RNA, 20 nt, Mycobacterium tuberculosis H37Rv
ccgccaucaucgcuuggccu

SEQ ID NO: 3271932 - RNA, 19 nt, Mycobacterium tuberculosis H37Rv
ccgccaucauggcggcccg

SEQ ID NO: 3271933 - RNA, 18 nt, Mycobacterium tuberculosis H37Rv
ccgccauccccuggccag

SEQ ID NO: 3271934 - RNA, 20 nt, Mycobacterium tuberculosis H37Rv
ccgccauccgauggcccggc

SEQ ID NO: 3271935 - RNA, 20 nt, Mycobacterium tuberculosis H37Rv
ccgccaucgcccgauccccg

SEQ ID NO: 3271936 - RNA, 13 nt, Mycobacterium tuberculosis H37Rv
ccgccaucgccga

SEQ ID NO: 3271937 - RNA, 20 nt, Mycobacterium tuberculosis H37Rv
ccgccaucgucgaagaccuc

SEQ ID NO: 3271938 - RNA, 22 nt, Mycobacterium tuberculosis H37Rv
ccgccaucgucgaagaccucaa

SEQ ID NO: 3271939 - RNA, 13 nt, Mycobacterium tuberculosis H37Rv
ccgccaucugccu

SEQ ID NO: 3271940 - RNA, 17 nt, Mycobacterium tuberculosis H37Rv
ccgccaucugccugccu

SEQ ID NO: 3271941 - RNA, 14 nt, Mycobacterium tuberculosis H37Rv
ccgccauggccgcc

SEQ ID NO: 3271942 - RNA, 19 nt, Mycobacterium tuberculosis H37Rv
ccgccauggccgccguugg

SEQ ID NO: 3271943 - RNA, 22 nt, Mycobacterium tuberculosis H37Rv
ccgccauuccagccggugccgc

SEQ ID NO: 3271944 - RNA, 16 nt, Mycobacterium tuberculosis H37Rv
ccgccauugacgccgu

SEQ ID NO: 3271945 - RNA, 20 nt, Mycobacterium tuberculosis H37Rv
ccgccauugacgccguugcc

SEQ ID NO: 3271946 - RNA, 21 nt, Mycobacterium tuberculosis H37Rv
ccgccauugccgccggugccg

SEQ ID NO: 3271947 - RNA, 18 nt, Mycobacterium tuberculosis H37Rv
ccgccauugccgccgucg

SEQ ID NO: 3271948 - RNA, 21 nt, Mycobacterium tuberculosis H37Rv
ccgccauugccguccggugga

SEQ ID NO: 3271949 - RNA, 18 nt, Mycobacterium tuberculosis H37Rv
ccgccauuggcaggcaug

SEQ ID NO: 3271950 - RNA, 15 nt, Mycobacterium tuberculosis H37Rv
ccgccauuggcgccg

SEQ ID NO: 3271951 - RNA, 16 nt, Mycobacterium tuberculosis H37Rv
ccgcccaacgcgagcu

SEQ ID NO: 3271952 - RNA, 17 nt, Mycobacterium tuberculosis H37Rv
ccgcccaagccgccggc

SEQ ID NO: 3271953 - RNA, 23 nt, Mycobacterium tuberculosis H37Rv
ccgcccacaugaacgaccaccgc

SEQ ID NO: 3271954 - RNA, 17 nt, Mycobacterium tuberculosis H37Rv
ccgcccaccacacagcc

SEQ ID NO: 3271955 - RNA, 22 nt, Mycobacterium tuberculosis H37Rv
ccgcccaccacacagccgcgcu

SEQ ID NO: 3271956 - RNA, 17 nt, Mycobacterium tuberculosis H37Rv
ccgcccaccggucgccg

SEQ ID NO: 3271957 - RNA, 13 nt, Mycobacterium tuberculosis H37Rv
ccgcccacggcac

SEQ ID NO: 3271958 - RNA, 13 nt, Mycobacterium tuberculosis H37Rv
ccgcccagaccgc

SEQ ID NO: 3271959 - RNA, 18 nt, Mycobacterium tuberculosis H37Rv
ccgcccagaccgccgacg

SEQ ID NO: 3271960 - RNA, 20 nt, Mycobacterium tuberculosis H37Rv
ccgcccagagugaauccggc

SEQ ID NO: 3271961 - RNA, 19 nt, Mycobacterium tuberculosis H37Rv
ccgcccagcagcaccugca

SEQ ID NO: 3271962 - RNA, 14 nt, Mycobacterium tuberculosis H37Rv
ccgcccagcaucuc

SEQ ID NO: 3271963 - RNA, 15 nt, Mycobacterium tuberculosis H37Rv
ccgcccagcccggcg

SEQ ID NO: 3271964 - RNA, 13 nt, Mycobacterium tuberculosis H37Rv
ccgcccagccgca

SEQ ID NO: 3271965 - RNA, 16 nt, Mycobacterium tuberculosis H37Rv
ccgcccagcgaggugg

SEQ ID NO: 3271966 - RNA, 21 nt, Mycobacterium tuberculosis H37Rv
ccgcccagcggaaucaccgaa

SEQ ID NO: 3271967 - RNA, 16 nt, Mycobacterium tuberculosis H37Rv
ccgcccaggagcaccu

SEQ ID NO: 3271968 - RNA, 17 nt, Mycobacterium tuberculosis H37Rv
ccgcccaggagcaccuc

SEQ ID NO: 3271969 - RNA, 12 nt, Mycobacterium tuberculosis H37Rv
ccgcccaugccg

SEQ ID NO: 3271970 - RNA, 17 nt, Mycobacterium tuberculosis H37Rv
ccgcccaugccuccaga

SEQ ID NO: 3271971 - RNA, 18 nt, Mycobacterium tuberculosis H37Rv
ccgcccaugccuccagaa

SEQ ID NO: 3271972 - RNA, 22 nt, Mycobacterium tuberculosis H37Rv
ccgcccaugccuccagaaccga

SEQ ID NO: 3271973 - RNA, 22 nt, Mycobacterium tuberculosis H37Rv
ccgcccauucccagaggcccgc

SEQ ID NO: 3271974 - RNA, 21 nt, Mycobacterium tuberculosis H37Rv
ccgccccacaacaugcuggag

SEQ ID NO: 3271975 - RNA, 20 nt, Mycobacterium tuberculosis H37Rv
ccgccccauacuugcgccga

SEQ ID NO: 3271976 - RNA, 14 nt, Mycobacterium tuberculosis H37Rv
ccgcccccagcggu

SEQ ID NO: 3271977 - RNA, 18 nt, Mycobacterium tuberculosis H37Rv
ccgcccccgucggccuug

SEQ ID NO: 3271978 - RNA, 13 nt, Mycobacterium tuberculosis H37Rv
ccgccccgcccgc

SEQ ID NO: 3271979 - RNA, 15 nt, Mycobacterium tuberculosis H37Rv
ccgccccgccguuga

SEQ ID NO: 3271980 - RNA, 14 nt, Mycobacterium tuberculosis H37Rv
ccgccccgggccac

SEQ ID NO: 3271981 - RNA, 15 nt, Mycobacterium tuberculosis H37Rv
ccgccccgggccacc

SEQ ID NO: 3271982 - RNA, 16 nt, Mycobacterium tuberculosis H37Rv
ccgccccgggccacca

SEQ ID NO: 3271983 - RNA, 14 nt, Mycobacterium tuberculosis H37Rv
ccgcccgacgugaa

SEQ ID NO: 3271984 - RNA, 18 nt, Mycobacterium tuberculosis H37Rv
ccgcccgaggcacccgug

SEQ ID NO: 3271985 - RNA, 21 nt, Mycobacterium tuberculosis H37Rv
ccgccgccgaagcgaugccgu

SEQ ID NO: 3271986 - RNA, 13 nt, Mycobacterium tuberculosis H37Rv
ccgccgccgccgc

SEQ ID NO: 3271987 - RNA, 21 nt, Mycobacterium tuberculosis H37Rv
ccgccgccggaucgccgguga

SEQ ID NO: 3271988 - RNA, 14 nt, Mycobacterium tuberculosis H37Rv
ccgccgccggcggu

SEQ ID NO: 3271989 - RNA, 23 nt, Mycobacterium tuberculosis H37Rv
ccgccgccgucggcgagcagacg

SEQ ID NO: 3271990 - RNA, 13 nt, Mycobacterium tuberculosis H37Rv
cacgcucggcgug

SEQ ID NO: 3271991 - RNA, 14 nt, Mycobacterium tuberculosis H37Rv
cacgcucggcgugu

SEQ ID NO: 3271992 - RNA, 22 nt, Mycobacterium tuberculosis H37Rv
cacgcucggugaaggucaccgu

SEQ ID NO: 3271993 - RNA, 22 nt, Mycobacterium tuberculosis H37Rv
cacgcucggugcugcgccgaua

SEQ ID NO: 3271994 - RNA, 19 nt, Mycobacterium tuberculosis H37Rv
cacgcucugcgccacagca

SEQ ID NO: 3271995 - RNA, 22 nt, Mycobacterium tuberculosis H37Rv
cacgcugaccggaucugacggc

SEQ ID NO: 3271996 - RNA, 20 nt, Mycobacterium tuberculosis H37Rv
cacgcugagccggucgcgca

SEQ ID NO: 3271997 - RNA, 22 nt, Mycobacterium tuberculosis H37Rv
cacgcugcccaaaaggaagacc

SEQ ID NO: 3271998 - RNA, 21 nt, Mycobacterium tuberculosis H37Rv
cacgcugcccacgggccggcc

SEQ ID NO: 3271999 - RNA, 22 nt, Mycobacterium tuberculosis H37Rv
cacgcugcccacgggccggccg

SEQ ID NO: 3272000 - RNA, 18 nt, Mycobacterium tuberculosis H37Rv
cacgcugccccgccgcca

SEQ ID NO: 3272001 - RNA, 18 nt, Mycobacterium tuberculosis H37Rv
cacgcugcccgccagccc

SEQ ID NO: 3272002 - RNA, 22 nt, Mycobacterium tuberculosis H37Rv
cacgcugcuggugacgaaagcg

SEQ ID NO: 3272003 - RNA, 19 nt, Mycobacterium tuberculosis H37Rv
cacgcuggaacuuggcguc

SEQ ID NO: 3272004 - RNA, 21 nt, Mycobacterium tuberculosis H37Rv
cacgcuggaacuuggcgucga

SEQ ID NO: 3272005 - RNA, 20 nt, Mycobacterium tuberculosis H37Rv
cacgcuggccuccagcuugg

SEQ ID NO: 3272006 - RNA, 14 nt, Mycobacterium tuberculosis H37Rv
cacgcuggccucgu

SEQ ID NO: 3272007 - RNA, 18 nt, Mycobacterium tuberculosis H37Rv
cacgcuggcgcccccgac

SEQ ID NO: 3272008 - RNA, 13 nt, Mycobacterium tuberculosis H37Rv
cacgcuggcguug

SEQ ID NO: 3272009 - RNA, 13 nt, Mycobacterium tuberculosis H37Rv
cacgcugucgauc

SEQ ID NO: 3272010 - RNA, 15 nt, Mycobacterium tuberculosis H37Rv
cacgcugucgaucug

SEQ ID NO: 3272011 - RNA, 16 nt, Mycobacterium tuberculosis H37Rv
cacgcugucgaucuga

SEQ ID NO: 3272012 - RNA, 15 nt, Mycobacterium tuberculosis H37Rv
cacgcugugcucgac

SEQ ID NO: 3272013 - RNA, 16 nt, Mycobacterium tuberculosis H37Rv
cacgcugugcucgacg

SEQ ID NO: 3272014 - RNA, 18 nt, Mycobacterium tuberculosis H37Rv
cacgcuucggccugugcg

SEQ ID NO: 3272015 - RNA, 12 nt, Mycobacterium tuberculosis H37Rv
cacgcuugcggc

SEQ ID NO: 3272016 - RNA, 22 nt, Mycobacterium tuberculosis H37Rv
cacggacccgaagucacaggau

SEQ ID NO: 3272017 - RNA, 15 nt, Mycobacterium tuberculosis H37Rv
cacggaccgccaccu

SEQ ID NO: 3272018 - RNA, 13 nt, Mycobacterium tuberculosis H37Rv
cacggaccuggaa

SEQ ID NO: 3272019 - RNA, 20 nt, Mycobacterium tuberculosis H37Rv
cacggacggucgggcggauc

SEQ ID NO: 3272020 - RNA, 20 nt, Mycobacterium tuberculosis H37Rv
cacggauacccuucgucaca

SEQ ID NO: 3272021 - RNA, 19 nt, Mycobacterium tuberculosis H37Rv
cacggauccgccggugcca

SEQ ID NO: 3272022 - RNA, 21 nt, Mycobacterium tuberculosis H37Rv
cacggaugcgauggccgacgc

SEQ ID NO: 3272023 - RNA, 19 nt, Mycobacterium tuberculosis H37Rv
cacggcaaaggcgcucugc

SEQ ID NO: 3272024 - RNA, 20 nt, Mycobacterium tuberculosis H37Rv
cacggcaaaggcgcucugcu

SEQ ID NO: 3272025 - RNA, 12 nt, Mycobacterium tuberculosis H37Rv
cacggcaccacc

SEQ ID NO: 3272026 - RNA, 18 nt, Mycobacterium tuberculosis H37Rv
cacggcaccaccaagcuc

SEQ ID NO: 3272027 - RNA, 22 nt, Mycobacterium tuberculosis H37Rv
cacggcacccaauccggcgcca

SEQ ID NO: 3272028 - RNA, 21 nt, Mycobacterium tuberculosis H37Rv
cacggcacccacccguucggc

SEQ ID NO: 3272029 - RNA, 14 nt, Mycobacterium tuberculosis H37Rv
cacggcaccgauca

SEQ ID NO: 3272030 - RNA, 18 nt, Mycobacterium tuberculosis H37Rv
cacggcagacacgcugca

SEQ ID NO: 3272031 - RNA, 13 nt, Mycobacterium tuberculosis H37Rv
cacgguuggcgcu

SEQ ID NO: 3272032 - RNA, 19 nt, Mycobacterium tuberculosis H37Rv
cacgguuuucgagggaugg

SEQ ID NO: 3272033 - RNA, 17 nt, Mycobacterium tuberculosis H37Rv
cacguaacgccgcggug

SEQ ID NO: 3272034 - RNA, 15 nt, Mycobacterium tuberculosis H37Rv
cacguaauuccccag

SEQ ID NO: 3272035 - RNA, 17 nt, Mycobacterium tuberculosis H37Rv
cacguaauuccccaggg

SEQ ID NO: 3272036 - RNA, 17 nt, Mycobacterium tuberculosis H37Rv
cacguaauuccccaggu

SEQ ID NO: 3272037 - RNA, 19 nt, Mycobacterium tuberculosis H37Rv
cacguaauuccccaggugu

SEQ ID NO: 3272038 - RNA, 14 nt, Mycobacterium tuberculosis H37Rv
cacguacuccaccg

SEQ ID NO: 3272039 - RNA, 17 nt, Mycobacterium tuberculosis H37Rv
cacguacucggccagcu

SEQ ID NO: 3272040 - RNA, 21 nt, Mycobacterium tuberculosis H37Rv
cacguacuuggacgacccggg

SEQ ID NO: 3272041 - RNA, 20 nt, Mycobacterium tuberculosis H37Rv
cacguagaaguaggcggcga

SEQ ID NO: 3272042 - RNA, 15 nt, Mycobacterium tuberculosis H37Rv
cacguagcagcagac

SEQ ID NO: 3272043 - RNA, 21 nt, Mycobacterium tuberculosis H37Rv
cacguagcagcgccggcaccg

SEQ ID NO: 3272044 - RNA, 17 nt, Mycobacterium tuberculosis H37Rv
cacguaguagccgagca

SEQ ID NO: 3272045 - RNA, 12 nt, Mycobacterium tuberculosis H37Rv
cacgucaacagc

SEQ ID NO: 3272046 - RNA, 18 nt, Mycobacterium tuberculosis H37Rv
cacgucaucggcuggccg

SEQ ID NO: 3272047 - RNA, 23 nt, Mycobacterium tuberculosis H37Rv
cacgucaucuggcgcugcuggca

SEQ ID NO: 3272048 - RNA, 22 nt, Mycobacterium tuberculosis H37Rv
cacguccaucaccggcggcccc

SEQ ID NO: 3272049 - RNA, 19 nt, Mycobacterium tuberculosis H37Rv
cacguccgcgggggaccgc

SEQ ID NO: 3272050 - RNA, 22 nt, Mycobacterium tuberculosis H37Rv
cacguccgcgggggaccgcccg

SEQ ID NO: 3272051 - RNA, 14 nt, Mycobacterium tuberculosis H37Rv
cacguccggcgaug

SEQ ID NO: 3272052 - RNA, 20 nt, Mycobacterium tuberculosis H37Rv
cacguccucgacccggcgca

SEQ ID NO: 3272053 - RNA, 18 nt, Mycobacterium tuberculosis H37Rv
cacguccugaaucgguuc

SEQ ID NO: 3272054 - RNA, 22 nt, Mycobacterium tuberculosis H37Rv
cacgucgaaaucggugcacaac

SEQ ID NO: 3272055 - RNA, 22 nt, Mycobacterium tuberculosis H37Rv
cacgucgaccaauaccaguccg

SEQ ID NO: 3272056 - RNA, 22 nt, Mycobacterium tuberculosis H37Rv
cacgucgaccgaacccgacguc

SEQ ID NO: 3272057 - RNA, 16 nt, Mycobacterium tuberculosis H37Rv
cacgucgagcacccgc

SEQ ID NO: 3272058 - RNA, 20 nt, Mycobacterium tuberculosis H37Rv
cacgucgagcaggcuggcug

SEQ ID NO: 3272059 - RNA, 17 nt, Mycobacterium tuberculosis H37Rv
cacgucgaggcggcagu

SEQ ID NO: 3272060 - RNA, 19 nt, Mycobacterium tuberculosis H37Rv
cacgucgaucucccaguga

SEQ ID NO: 3272061 - RNA, 12 nt, Mycobacterium tuberculosis H37Rv
cacgucgcccag

SEQ ID NO: 3272062 - RNA, 19 nt, Mycobacterium tuberculosis H37Rv
cacgucgcgccaggcgcga

SEQ ID NO: 3272063 - RNA, 23 nt, Mycobacterium tuberculosis H37Rv
cacgucggcccauaacagcuggc

SEQ ID NO: 3272064 - RNA, 18 nt, Mycobacterium tuberculosis H37Rv
cacgucgggaugcccgcu

SEQ ID NO: 3272065 - RNA, 23 nt, Mycobacterium tuberculosis H37Rv
cacgucggguugcacggcgauug

SEQ ID NO: 3272066 - RNA, 21 nt, Mycobacterium tuberculosis H37Rv
cacgucgucgcccaggcgugu

SEQ ID NO: 3272067 - RNA, 21 nt, Mycobacterium tuberculosis H37Rv
cacgucgucgucccagggcug

SEQ ID NO: 3272068 - RNA, 15 nt, Mycobacterium tuberculosis H37Rv
cacgucgucucggcg

SEQ ID NO: 3272069 - RNA, 19 nt, Mycobacterium tuberculosis H37Rv
cacgucgucucggcggugg

SEQ ID NO: 3272070 - RNA, 23 nt, Mycobacterium tuberculosis H37Rv
cacgucguugggcaugucgccga

SEQ ID NO: 3272071 - RNA, 19 nt, Mycobacterium tuberculosis H37Rv
cacgucguuuggccucagc

SEQ ID NO: 3272072 - RNA, 22 nt, Mycobacterium tuberculosis H37Rv
cacgucuccuucggcgacugcg

SEQ ID NO: 3272073 - RNA, 19 nt, Mycobacterium tuberculosis H37Rv
cacgugaaagccgaccagc

SEQ ID NO: 3272074 - RNA, 16 nt, Mycobacterium tuberculosis H37Rv
cacgugaaggcgaugg

SEQ ID NO: 3272075 - RNA, 22 nt, Mycobacterium tuberculosis H37Rv
cacgugaaggcgauggcaccgu

SEQ ID NO: 3272076 - RNA, 16 nt, Mycobacterium tuberculosis H37Rv
cacgugagugccggcg

SEQ ID NO: 3272077 - RNA, 14 nt, Mycobacterium tuberculosis H37Rv
cacgugcacggcga

SEQ ID NO: 3272078 - RNA, 20 nt, Mycobacterium tuberculosis H37Rv
cacgugccaaaugaugacga

SEQ ID NO: 3272079 - RNA, 19 nt, Mycobacterium tuberculosis H37Rv
cacgugcccgcgcggcgca

SEQ ID NO: 3272080 - RNA, 23 nt, Mycobacterium tuberculosis H37Rv
cacguggagucgaaagaacaacc

SEQ ID NO: 3272081 - RNA, 16 nt, Mycobacterium tuberculosis H37Rv
cacgugggcacucauc

SEQ ID NO: 3272082 - RNA, 15 nt, Mycobacterium tuberculosis H37Rv
cacgugggccaugcu

SEQ ID NO: 3272083 - RNA, 14 nt, Mycobacterium tuberculosis H37Rv
cacguggucgagca

SEQ ID NO: 3272084 - RNA, 19 nt, Mycobacterium tuberculosis H37Rv
cacguggucgagcaggcga

SEQ ID NO: 3272085 - RNA, 14 nt, Mycobacterium tuberculosis H37Rv
cacguggucggcca

SEQ ID NO: 3272086 - RNA, 22 nt, Mycobacterium tuberculosis H37Rv
cacgugugcggaagcaucggcu

SEQ ID NO: 3272087 - RNA, 14 nt, Mycobacterium tuberculosis H37Rv
cacgugugcgggca

SEQ ID NO: 3272088 - RNA, 22 nt, Mycobacterium tuberculosis H37Rv
cacguguggugugucaccggau

SEQ ID NO: 3272089 - RNA, 14 nt, Mycobacterium tuberculosis H37Rv
cacguuauucaugc

SEQ ID NO: 3272090 - RNA, 13 nt, Mycobacterium tuberculosis H37Rv
cacguucggcguc

SEQ ID NO: 3272091 - RNA, 15 nt, Mycobacterium tuberculosis H37Rv
cacguucggcgucgu

SEQ ID NO: 3272092 - RNA, 16 nt, Mycobacterium tuberculosis H37Rv
cacguucggcugcgaa

SEQ ID NO: 3272093 - RNA, 14 nt, Mycobacterium tuberculosis H37Rv
cacguugacgucca

SEQ ID NO: 3272094 - RNA, 16 nt, Mycobacterium tuberculosis H37Rv
cacguugauccgcgca

SEQ ID NO: 3272095 - RNA, 17 nt, Mycobacterium tuberculosis H37Rv
cacguugcacagcuugg

SEQ ID NO: 3272096 - RNA, 19 nt, Mycobacterium tuberculosis H37Rv
cacguugcagcucgauccg

SEQ ID NO: 3272097 - RNA, 23 nt, Mycobacterium tuberculosis H37Rv
cacguugccgaucccggcgagca

SEQ ID NO: 3272098 - RNA, 17 nt, Mycobacterium tuberculosis H37Rv
cacguuggcggccagcg

SEQ ID NO: 3272099 - RNA, 19 nt, Mycobacterium tuberculosis H37Rv
cacguugugcagcgcguca

SEQ ID NO: 3272100 - RNA, 14 nt, Mycobacterium tuberculosis H37Rv
cacguuugccggcc

SEQ ID NO: 3272101 - RNA, 19 nt, Mycobacterium tuberculosis H37Rv
cacuaaccgaauuguugua

SEQ ID NO: 3272102 - RNA, 20 nt, Mycobacterium tuberculosis H37Rv
cacuaaccuggcguagauca

SEQ ID NO: 3272103 - RNA, 22 nt, Mycobacterium tuberculosis H37Rv
cacuaaccuggcguagaucauc

SEQ ID NO: 3272104 - RNA, 21 nt, Mycobacterium tuberculosis H37Rv
cacuaccccacaagcgauggc

SEQ ID NO: 3272105 - RNA, 20 nt, Mycobacterium tuberculosis H37Rv
cacuacccgcaacgaggcaa

SEQ ID NO: 3272106 - RNA, 13 nt, Mycobacterium tuberculosis H37Rv
cacuacgcagccg

SEQ ID NO: 3272107 - RNA, 22 nt, Mycobacterium tuberculosis H37Rv
cacuacggccuggccaccuggu

SEQ ID NO: 3272108 - RNA, 18 nt, Mycobacterium tuberculosis H37Rv
cacuacucgaacaacccc

SEQ ID NO: 3272109 - RNA, 22 nt, Mycobacterium tuberculosis H37Rv
cacuagacugcuggucaucggu

SEQ ID NO: 3272110 - RNA, 22 nt, Mycobacterium tuberculosis H37Rv
cacuagcauugucgccggaugc

SEQ ID NO: 3272111 - RNA, 23 nt, Mycobacterium tuberculosis H37Rv
cacuagcgccccuggcaccucgc

SEQ ID NO: 3272112 - RNA, 23 nt, Mycobacterium tuberculosis H37Rv
cacuaguucgagcugccaggccc

SEQ ID NO: 3272113 - RNA, 15 nt, Mycobacterium tuberculosis H37Rv
cacucacauuggcca

SEQ ID NO: 3272114 - RNA, 13 nt, Mycobacterium tuberculosis H37Rv
cacucacccagcu

SEQ ID NO: 3272115 - RNA, 14 nt, Mycobacterium tuberculosis H37Rv
cacucacccgggca

SEQ ID NO: 3272116 - RNA, 12 nt, Mycobacterium tuberculosis H37Rv
cacucaccuugu

SEQ ID NO: 3272117 - RNA, 20 nt, Mycobacterium tuberculosis H37Rv
cacucauagaacucgccgcu

SEQ ID NO: 3272118 - RNA, 14 nt, Mycobacterium tuberculosis H37Rv
cacucaucggugug

SEQ ID NO: 3272119 - RNA, 19 nt, Mycobacterium tuberculosis H37Rv
cacucaucggugugcaucg

SEQ ID NO: 3272120 - RNA, 23 nt, Mycobacterium tuberculosis H37Rv
cacucaucuucucgcagccacgc

SEQ ID NO: 3272121 - RNA, 20 nt, Mycobacterium tuberculosis H37Rv
cacucaugaugccggacgcc

SEQ ID NO: 3272122 - RNA, 20 nt, Mycobacterium tuberculosis H37Rv
cacuccaagucacagcucac

SEQ ID NO: 3272123 - RNA, 23 nt, Mycobacterium tuberculosis H37Rv
cacuccaagucacagcucaccau

SEQ ID NO: 3272124 - RNA, 17 nt, Mycobacterium tuberculosis H37Rv
cacuccagcagcucgcc

SEQ ID NO: 3272125 - RNA, 20 nt, Mycobacterium tuberculosis H37Rv
cacuccagcagcucgccggc

SEQ ID NO: 3272126 - RNA, 18 nt, Mycobacterium tuberculosis H37Rv
cacuucggcguccaaggc

SEQ ID NO: 3272127 - RNA, 21 nt, Mycobacterium tuberculosis H37Rv
cacuucggugccgugaucggc

SEQ ID NO: 3272128 - RNA, 23 nt, Mycobacterium tuberculosis H37Rv
cacuucgguguuggacacucccg

SEQ ID NO: 3272129 - RNA, 21 nt, Mycobacterium tuberculosis H37Rv
cacuugaaguucuucuccguc

SEQ ID NO: 3272130 - RNA, 16 nt, Mycobacterium tuberculosis H37Rv
cacuugcagcacaacg

SEQ ID NO: 3272131 - RNA, 20 nt, Mycobacterium tuberculosis H37Rv
cacuugcagcacaacgucuu

SEQ ID NO: 3272132 - RNA, 18 nt, Mycobacterium tuberculosis H37Rv
cacuugcgccaccguggc

SEQ ID NO: 3272133 - RNA, 20 nt, Mycobacterium tuberculosis H37Rv
cacuugcgccaccguggccg

SEQ ID NO: 3272134 - RNA, 20 nt, Mycobacterium tuberculosis H37Rv
cacuugcucggcgagccucu

SEQ ID NO: 3272135 - RNA, 21 nt, Mycobacterium tuberculosis H37Rv
cacuugcucggcgagccucuu

SEQ ID NO: 3272136 - RNA, 15 nt, Mycobacterium tuberculosis H37Rv
cacuuggacccggcc

SEQ ID NO: 3272137 - RNA, 16 nt, Mycobacterium tuberculosis H37Rv
cacuugugacccggcg

SEQ ID NO: 3272138 - RNA, 22 nt, Mycobacterium tuberculosis H37Rv
cacuuucagaucgaucugcggg

SEQ ID NO: 3272139 - RNA, 21 nt, Mycobacterium tuberculosis H37Rv
cacuuuguagcccgcgaucuc

SEQ ID NO: 3272140 - RNA, 19 nt, Mycobacterium tuberculosis H37Rv
cagaaacaccgacgacggc

SEQ ID NO: 3272141 - RNA, 19 nt, Mycobacterium tuberculosis H37Rv
cagaaaccccaaacaaccc

SEQ ID NO: 3272142 - RNA, 17 nt, Mycobacterium tuberculosis H37Rv
cagaaacgcgauggugg

SEQ ID NO: 3272143 - RNA, 20 nt, Mycobacterium tuberculosis H37Rv
cagaaaugguucgcacaccu

SEQ ID NO: 3272144 - RNA, 12 nt, Mycobacterium tuberculosis H37Rv
cagaacaccacc

SEQ ID NO: 3272145 - RNA, 13 nt, Mycobacterium tuberculosis H37Rv
cagaacaccaccg

SEQ ID NO: 3272146 - RNA, 14 nt, Mycobacterium tuberculosis H37Rv
cagaacaugccgga

SEQ ID NO: 3272147 - RNA, 21 nt, Mycobacterium tuberculosis H37Rv
cagaaccacuuuccgaggagg

SEQ ID NO: 3272148 - RNA, 15 nt, Mycobacterium tuberculosis H37Rv
cagaaccgacggcca

SEQ ID NO: 3272149 - RNA, 16 nt, Mycobacterium tuberculosis H37Rv
cagaaccgacggccag

SEQ ID NO: 3272150 - RNA, 19 nt, Mycobacterium tuberculosis H37Rv
cagaaccgccaacauuggu

SEQ ID NO: 3272151 - RNA, 17 nt, Mycobacterium tuberculosis H37Rv
cagaaccggcucaagga

SEQ ID NO: 3272152 - RNA, 16 nt, Mycobacterium tuberculosis H37Rv
cagaaccuggagccgu

SEQ ID NO: 3272153 - RNA, 18 nt, Mycobacterium tuberculosis H37Rv
cagaaccuggagccgugc

SEQ ID NO: 3272154 - RNA, 19 nt, Mycobacterium tuberculosis H37Rv
cagaaccuggagccgugcg

SEQ ID NO: 3272155 - RNA, 22 nt, Mycobacterium tuberculosis H37Rv
cagaacgcaucggucccacugc

SEQ ID NO: 3272156 - RNA, 15 nt, Mycobacterium tuberculosis H37Rv
cagaacgcggccucg

SEQ ID NO: 3272157 - RNA, 22 nt, Mycobacterium tuberculosis H37Rv
cagaacggaauucagcgacgcu

SEQ ID NO: 3272158 - RNA, 14 nt, Mycobacterium tuberculosis H37Rv
cagaacggcggcag

SEQ ID NO: 3272159 - RNA, 17 nt, Mycobacterium tuberculosis H37Rv
cagaacgugacggucca

SEQ ID NO: 3272160 - RNA, 12 nt, Mycobacterium tuberculosis H37Rv
cagaacguggcc

SEQ ID NO: 3272161 - RNA, 14 nt, Mycobacterium tuberculosis H37Rv
cagaacucaccgac

SEQ ID NO: 3272162 - RNA, 20 nt, Mycobacterium tuberculosis H37Rv
cagaacucaccgacggauga

SEQ ID NO: 3272163 - RNA, 22 nt, Mycobacterium tuberculosis H37Rv
cagaacuggacaagcuccucgc

SEQ ID NO: 3272164 - RNA, 18 nt, Mycobacterium tuberculosis H37Rv
cagaagaagaugaucgcg

SEQ ID NO: 3272165 - RNA, 16 nt, Mycobacterium tuberculosis H37Rv
cagaaggccgcaccgc

SEQ ID NO: 3272166 - RNA, 22 nt, Mycobacterium tuberculosis H37Rv
cagaaucgcacaaaaucagcga

SEQ ID NO: 3272167 - RNA, 18 nt, Mycobacterium tuberculosis H37Rv
cagaaucgcacgcgaaau

SEQ ID NO: 3272168 - RNA, 21 nt, Mycobacterium tuberculosis H37Rv
cagaaucucgccgggcugcaa

SEQ ID NO: 3272169 - RNA, 13 nt, Mycobacterium tuberculosis H37Rv
cagaaucugccuc

SEQ ID NO: 3272170 - RNA, 14 nt, Mycobacterium tuberculosis H37Rv
cagaaucugccucu

SEQ ID NO: 3272171 - RNA, 15 nt, Mycobacterium tuberculosis H37Rv
cagaaucugccucuc

SEQ ID NO: 3272172 - RNA, 12 nt, Mycobacterium tuberculosis H37Rv
cagaaugagcac

SEQ ID NO: 3272173 - RNA, 14 nt, Mycobacterium tuberculosis H37Rv
cagaaugccuggcc

SEQ ID NO: 3272174 - RNA, 17 nt, Mycobacterium tuberculosis H37Rv
cagaaugccuggcccgu

SEQ ID NO: 3272175 - RNA, 18 nt, Mycobacterium tuberculosis H37Rv
cagaaugccuggcccguc

SEQ ID NO: 3272176 - RNA, 21 nt, Mycobacterium tuberculosis H37Rv
cagaauucggcgcgacagccg

SEQ ID NO: 3272177 - RNA, 17 nt, Mycobacterium tuberculosis H37Rv
cagaauugugugcagca

SEQ ID NO: 3272178 - RNA, 14 nt, Mycobacterium tuberculosis H37Rv
cagacaaacuccga

SEQ ID NO: 3272179 - RNA, 16 nt, Mycobacterium tuberculosis H37Rv
cagacaacgccgucga

SEQ ID NO: 3272180 - RNA, 14 nt, Mycobacterium tuberculosis H37Rv
cagacacaaccgcu

SEQ ID NO: 3272181 - RNA, 13 nt, Mycobacterium tuberculosis H37Rv
cagacacagaauc

SEQ ID NO: 3272182 - RNA, 20 nt, Mycobacterium tuberculosis H37Rv
cagacacagaaucgcacgaa

SEQ ID NO: 3272183 - RNA, 20 nt, Mycobacterium tuberculosis H37Rv
cagacacagaaucgcccauu

SEQ ID NO: 3272184 - RNA, 13 nt, Mycobacterium tuberculosis H37Rv
cagacacgcugca

SEQ ID NO: 3272185 - RNA, 15 nt, Mycobacterium tuberculosis H37Rv
cagacagacccccag

SEQ ID NO: 3272186 - RNA, 15 nt, Mycobacterium tuberculosis H37Rv
cagacaucgcgacga

SEQ ID NO: 3272187 - RNA, 11 nt, Mycobacterium tuberculosis H37Rv
cagacauggca

SEQ ID NO: 3272188 - RNA, 21 nt, Mycobacterium tuberculosis H37Rv
cagacauggcaagucaacacc

SEQ ID NO: 3272189 - RNA, 13 nt, Mycobacterium tuberculosis H37Rv
cagaccaacauga

SEQ ID NO: 3272190 - RNA, 19 nt, Mycobacterium tuberculosis H37Rv
cagaccaacaugaacguca

SEQ ID NO: 3272191 - RNA, 12 nt, Mycobacterium tuberculosis H37Rv
cagaccaagccc

SEQ ID NO: 3272192 - RNA, 23 nt, Mycobacterium tuberculosis H37Rv
cagaccaaugaccgccagcagca

SEQ ID NO: 3272193 - RNA, 13 nt, Mycobacterium tuberculosis H37Rv
cagaccacaacgc

SEQ ID NO: 3272194 - RNA, 13 nt, Mycobacterium tuberculosis H37Rv
cagaccaccgccu

SEQ ID NO: 3272195 - RNA, 12 nt, Mycobacterium tuberculosis H37Rv
cagaccaccgug

SEQ ID NO: 3272196 - RNA, 12 nt, Mycobacterium tuberculosis H37Rv
cagaccagacug

SEQ ID NO: 3272197 - RNA, 13 nt, Mycobacterium tuberculosis H37Rv
cagacccaccacc

SEQ ID NO: 3272198 - RNA, 14 nt, Mycobacterium tuberculosis H37Rv
cagacccagcucgu

SEQ ID NO: 3272199 - RNA, 22 nt, Mycobacterium tuberculosis H37Rv
cagacccgugccgucaacgaug

SEQ ID NO: 3272200 - RNA, 17 nt, Mycobacterium tuberculosis H37Rv
cagaccgaacagcaccg

SEQ ID NO: 3272201 - RNA, 18 nt, Mycobacterium tuberculosis H37Rv
cagaccgaacagcaccga

SEQ ID NO: 3272202 - RNA, 18 nt, Mycobacterium tuberculosis H37Rv
cagaccgaucggcaggcc

SEQ ID NO: 3272203 - RNA, 12 nt, Mycobacterium tuberculosis H37Rv
cagaccgccgaa

SEQ ID NO: 3272204 - RNA, 17 nt, Mycobacterium tuberculosis H37Rv
cagaccgccgacgccgu

SEQ ID NO: 3272205 - RNA, 14 nt, Mycobacterium tuberculosis H37Rv
cagaccguccagca

SEQ ID NO: 3272206 - RNA, 20 nt, Mycobacterium tuberculosis H37Rv
cagaccguccagcaacagcg

SEQ ID NO: 3272207 - RNA, 13 nt, Mycobacterium tuberculosis H37Rv
cagaccgugacgu

SEQ ID NO: 3272208 - RNA, 23 nt, Mycobacterium tuberculosis H37Rv
cagaccgugacguagggcagcgc

SEQ ID NO: 3272209 - RNA, 20 nt, Mycobacterium tuberculosis H37Rv
cagaccuagcaccgcgccga

SEQ ID NO: 3272210 - RNA, 22 nt, Mycobacterium tuberculosis H37Rv
cagaccuagcaccgcgccgaac

SEQ ID NO: 3272211 - RNA, 14 nt, Mycobacterium tuberculosis H37Rv
cagacgacgaucag

SEQ ID NO: 3272212 - RNA, 14 nt, Mycobacterium tuberculosis H37Rv
cagacgauggccag

SEQ ID NO: 3272213 - RNA, 13 nt, Mycobacterium tuberculosis H37Rv
cagacgauucggc

SEQ ID NO: 3272214 - RNA, 21 nt, Mycobacterium tuberculosis H37Rv
cagacgcaaaauccccucgca

SEQ ID NO: 3272215 - RNA, 19 nt, Mycobacterium tuberculosis H37Rv
cagacgcaaaaucgcccga

SEQ ID NO: 3272216 - RNA, 15 nt, Mycobacterium tuberculosis H37Rv
cagacgcagaaucgc

SEQ ID NO: 3272217 - RNA, 16 nt, Mycobacterium tuberculosis H37Rv
cagacgcagaaucgca

SEQ ID NO: 3272218 - RNA, 19 nt, Mycobacterium tuberculosis H37Rv
cagacgcagaaucgcacgc

SEQ ID NO: 3272219 - RNA, 18 nt, Mycobacterium tuberculosis H37Rv
cagacgcagaaucgccca

SEQ ID NO: 3272220 - RNA, 15 nt, Mycobacterium tuberculosis H37Rv
cagacgcagagucgc

SEQ ID NO: 3272221 - RNA, 17 nt, Mycobacterium tuberculosis H37Rv
cagacgcauaagccccc

SEQ ID NO: 3272222 - RNA, 20 nt, Mycobacterium tuberculosis H37Rv
cagacgccacugccagccgu

SEQ ID NO: 3272223 - RNA, 16 nt, Mycobacterium tuberculosis H37Rv
cagauucgcgcuggcc

SEQ ID NO: 3272224 - RNA, 20 nt, Mycobacterium tuberculosis H37Rv
cagauucggugccagcaggc

SEQ ID NO: 3272225 - RNA, 22 nt, Mycobacterium tuberculosis H37Rv
cagauugccgagcccagguggu

SEQ ID NO: 3272226 - RNA, 23 nt, Mycobacterium tuberculosis H37Rv
cagauugccugacaacucccgaa

SEQ ID NO: 3272227 - RNA, 16 nt, Mycobacterium tuberculosis H37Rv
cagauugucgcugaau

SEQ ID NO: 3272228 - RNA, 18 nt, Mycobacterium tuberculosis H37Rv
cagauuucugggagccgg

SEQ ID NO: 3272229 - RNA, 16 nt, Mycobacterium tuberculosis H37Rv
cagauuugcuccagcg

SEQ ID NO: 3272230 - RNA, 20 nt, Mycobacterium tuberculosis H37Rv
cagcaaaacccgagccugga

SEQ ID NO: 3272231 - RNA, 21 nt, Mycobacterium tuberculosis H37Rv
cagcaaaacccgagccuggau

SEQ ID NO: 3272232 - RNA, 17 nt, Mycobacterium tuberculosis H37Rv
cagcaacagcgcggugu

SEQ ID NO: 3272233 - RNA, 17 nt, Mycobacterium tuberculosis H37Rv
cagcaaccaccccaggg

SEQ ID NO: 3272234 - RNA, 16 nt, Mycobacterium tuberculosis H37Rv
cagcaacgacauccag

SEQ ID NO: 3272235 - RNA, 14 nt, Mycobacterium tuberculosis H37Rv
cagcaacgcggugc

SEQ ID NO: 3272236 - RNA, 18 nt, Mycobacterium tuberculosis H37Rv
cagcaacggcagcgaggc

SEQ ID NO: 3272237 - RNA, 16 nt, Mycobacterium tuberculosis H37Rv
cagcaacggcagcgug

SEQ ID NO: 3272238 - RNA, 14 nt, Mycobacterium tuberculosis H37Rv
cagcaacgucggua

SEQ ID NO: 3272239 - RNA, 19 nt, Mycobacterium tuberculosis H37Rv
cagcaacgugugcaccauc

SEQ ID NO: 3272240 - RNA, 12 nt, Mycobacterium tuberculosis H37Rv
cagcaacucgac

SEQ ID NO: 3272241 - RNA, 14 nt, Mycobacterium tuberculosis H37Rv
cagcaacucggcca

SEQ ID NO: 3272242 - RNA, 14 nt, Mycobacterium tuberculosis H37Rv
cagcaacugccgca

SEQ ID NO: 3272243 - RNA, 14 nt, Mycobacterium tuberculosis H37Rv
cagcaagagccgca

SEQ ID NO: 3272244 - RNA, 14 nt, Mycobacterium tuberculosis H37Rv
cagcaaggccagca

SEQ ID NO: 3272245 - RNA, 15 nt, Mycobacterium tuberculosis H37Rv
cagcaagugcgggcu

SEQ ID NO: 3272246 - RNA, 20 nt, Mycobacterium tuberculosis H37Rv
cagcaagugugagcagaccc

SEQ ID NO: 3272247 - RNA, 16 nt, Mycobacterium tuberculosis H37Rv
cagcaaucagccgccu

SEQ ID NO: 3272248 - RNA, 17 nt, Mycobacterium tuberculosis H37Rv
cagcaaucagccgccuu

SEQ ID NO: 3272249 - RNA, 19 nt, Mycobacterium tuberculosis H37Rv
cagcaaucagccgccuucu

SEQ ID NO: 3272250 - RNA, 18 nt, Mycobacterium tuberculosis H37Rv
cagcaauccaaggcucag

SEQ ID NO: 3272251 - RNA, 14 nt, Mycobacterium tuberculosis H37Rv
cagcacaaacccag

SEQ ID NO: 3272252 - RNA, 16 nt, Mycobacterium tuberculosis H37Rv
cagcacacccagaugc

SEQ ID NO: 3272253 - RNA, 20 nt, Mycobacterium tuberculosis H37Rv
cagcacacugucgauuugau

SEQ ID NO: 3272254 - RNA, 21 nt, Mycobacterium tuberculosis H37Rv
cagcacagcauuguccggcgu

SEQ ID NO: 3272255 - RNA, 16 nt, Mycobacterium tuberculosis H37Rv
cagcacagcgcagccu

SEQ ID NO: 3272256 - RNA, 17 nt, Mycobacterium tuberculosis H37Rv
cagcacagcgcagccug

SEQ ID NO: 3272257 - RNA, 19 nt, Mycobacterium tuberculosis H37Rv
cagcacagcgcagccugca

SEQ ID NO: 3272258 - RNA, 13 nt, Mycobacterium tuberculosis H37Rv
cagcacaggcugg

SEQ ID NO: 3272259 - RNA, 20 nt, Mycobacterium tuberculosis H37Rv
cagcacaggcuggcgauggc

SEQ ID NO: 3272260 - RNA, 13 nt, Mycobacterium tuberculosis H37Rv
cagcacauccagc

SEQ ID NO: 3272261 - RNA, 15 nt, Mycobacterium tuberculosis H37Rv
cagcacauccagccc

SEQ ID NO: 3272262 - RNA, 16 nt, Mycobacterium tuberculosis H37Rv
cagcacauccugcagc

SEQ ID NO: 3272263 - RNA, 13 nt, Mycobacterium tuberculosis H37Rv
cagcaccacaacg

SEQ ID NO: 3272264 - RNA, 13 nt, Mycobacterium tuberculosis H37Rv
cagcaccacaucg

SEQ ID NO: 3272265 - RNA, 12 nt, Mycobacterium tuberculosis H37Rv
cagcaccaccgg

SEQ ID NO: 3272266 - RNA, 14 nt, Mycobacterium tuberculosis H37Rv
cagcaccaccggcu

SEQ ID NO: 3272267 - RNA, 13 nt, Mycobacterium tuberculosis H37Rv
cagcaccacggcc

SEQ ID NO: 3272268 - RNA, 14 nt, Mycobacterium tuberculosis H37Rv
cagcaccacggcca

SEQ ID NO: 3272269 - RNA, 18 nt, Mycobacterium tuberculosis H37Rv
cagcaccacggcgcgcgc

SEQ ID NO: 3272270 - RNA, 12 nt, Mycobacterium tuberculosis H37Rv
cagcaccagcac

SEQ ID NO: 3272271 - RNA, 13 nt, Mycobacterium tuberculosis H37Rv
cagcaccagcacg

SEQ ID NO: 3272272 - RNA, 13 nt, Mycobacterium tuberculosis H37Rv
cagcaccagcgcc

SEQ ID NO: 3272273 - RNA, 15 nt, Mycobacterium tuberculosis H37Rv
cagcaccagcucacg

SEQ ID NO: 3272274 - RNA, 17 nt, Mycobacterium tuberculosis H37Rv
cagcacccaacccggcg

SEQ ID NO: 3272275 - RNA, 13 nt, Mycobacterium tuberculosis H37Rv
cagcacccacauc

SEQ ID NO: 3272276 - RNA, 14 nt, Mycobacterium tuberculosis H37Rv
cagcacccacauca

SEQ ID NO: 3272277 - RNA, 23 nt, Mycobacterium tuberculosis H37Rv
cagcacccaccgaagcgaacggc

SEQ ID NO: 3272278 - RNA, 17 nt, Mycobacterium tuberculosis H37Rv
cagcacccacgccggug

SEQ ID NO: 3272279 - RNA, 22 nt, Mycobacterium tuberculosis H37Rv
cagcacccacgccgguggcacg

SEQ ID NO: 3272280 - RNA, 16 nt, Mycobacterium tuberculosis H37Rv
cagcaccccauggcca

SEQ ID NO: 3272281 - RNA, 14 nt, Mycobacterium tuberculosis H37Rv
cagcacccccucgg

SEQ ID NO: 3272282 - RNA, 19 nt, Mycobacterium tuberculosis H37Rv
cagcacccccucggcuucg

SEQ ID NO: 3272283 - RNA, 14 nt, Mycobacterium tuberculosis H37Rv
cagcaccccgaucu

SEQ ID NO: 3272284 - RNA, 18 nt, Mycobacterium tuberculosis H37Rv
cagcaccccgccgccugc

SEQ ID NO: 3272285 - RNA, 13 nt, Mycobacterium tuberculosis H37Rv
cagcacccgagcg

SEQ ID NO: 3272286 - RNA, 13 nt, Mycobacterium tuberculosis H37Rv
cagcacccgcagc

SEQ ID NO: 3272287 - RNA, 14 nt, Mycobacterium tuberculosis H37Rv
cagcacccgcagcc

SEQ ID NO: 3272288 - RNA, 13 nt, Mycobacterium tuberculosis H37Rv
cagcacccgcgcc

SEQ ID NO: 3272289 - RNA, 14 nt, Mycobacterium tuberculosis H37Rv
cagcacccgcucca

SEQ ID NO: 3272290 - RNA, 16 nt, Mycobacterium tuberculosis H37Rv
cagcacccgggccacg

SEQ ID NO: 3272291 - RNA, 18 nt, Mycobacterium tuberculosis H37Rv
cagcacccgggccuggga

SEQ ID NO: 3272292 - RNA, 23 nt, Mycobacterium tuberculosis H37Rv
cagcacccucaggcaaucgcggg

SEQ ID NO: 3272293 - RNA, 13 nt, Mycobacterium tuberculosis H37Rv
cagcaccgacagc

SEQ ID NO: 3272294 - RNA, 18 nt, Mycobacterium tuberculosis H37Rv
cagcaccgccgcgccggc

SEQ ID NO: 3272295 - RNA, 12 nt, Mycobacterium tuberculosis H37Rv
cagcaccgccgg

SEQ ID NO: 3272296 - RNA, 14 nt, Mycobacterium tuberculosis H37Rv
cagcaccgccggug

SEQ ID NO: 3272297 - RNA, 16 nt, Mycobacterium tuberculosis H37Rv
cagcaccgccggugcg

SEQ ID NO: 3272298 - RNA, 15 nt, Mycobacterium tuberculosis H37Rv
cagcaccgcgacgac

SEQ ID NO: 3272299 - RNA, 14 nt, Mycobacterium tuberculosis H37Rv
cagcaccggcccga

SEQ ID NO: 3272300 - RNA, 22 nt, Mycobacterium tuberculosis H37Rv
cagcaccggcgcgggcacgccc

SEQ ID NO: 3272301 - RNA, 18 nt, Mycobacterium tuberculosis H37Rv
cagcaccggcucgacugc

SEQ ID NO: 3272302 - RNA, 21 nt, Mycobacterium tuberculosis H37Rv
cagcaccguaguccacauggu

SEQ ID NO: 3272303 - RNA, 15 nt, Mycobacterium tuberculosis H37Rv
cagcaccguccucgg

SEQ ID NO: 3272304 - RNA, 16 nt, Mycobacterium tuberculosis H37Rv
cagcaccuagucgcgg

SEQ ID NO: 3272305 - RNA, 23 nt, Mycobacterium tuberculosis H37Rv
cagcaccuccguaacgccaagcu

SEQ ID NO: 3272306 - RNA, 22 nt, Mycobacterium tuberculosis H37Rv
cagcaccucggucccguugccg

SEQ ID NO: 3272307 - RNA, 13 nt, Mycobacterium tuberculosis H37Rv
cagcacgacgugc

SEQ ID NO: 3272308 - RNA, 14 nt, Mycobacterium tuberculosis H37Rv
cagcacgauccagc

SEQ ID NO: 3272309 - RNA, 16 nt, Mycobacterium tuberculosis H37Rv
cagcacgauccagcug

SEQ ID NO: 3272310 - RNA, 20 nt, Mycobacterium tuberculosis H37Rv
cagcacgauccagcuguaca

SEQ ID NO: 3272311 - RNA, 15 nt, Mycobacterium tuberculosis H37Rv
cagcacgccguccag

SEQ ID NO: 3272312 - RNA, 19 nt, Mycobacterium tuberculosis H37Rv
cagcacgccguccagguuc

SEQ ID NO: 3272313 - RNA, 14 nt, Mycobacterium tuberculosis H37Rv
cagcacgcgcgcga

SEQ ID NO: 3272314 - RNA, 16 nt, Mycobacterium tuberculosis H37Rv
cagcacgcgcgcgacc

SEQ ID NO: 3272315 - RNA, 21 nt, Mycobacterium tuberculosis H37Rv
cagcacgcucgugacgaucag

SEQ ID NO: 3272316 - RNA, 14 nt, Mycobacterium tuberculosis H37Rv
cagcacgcugacca

SEQ ID NO: 3272317 - RNA, 19 nt, Mycobacterium tuberculosis H37Rv
cagcacgcugaccacaacc

SEQ ID NO: 3272318 - RNA, 21 nt, Mycobacterium tuberculosis H37Rv
cagcacgcugaccacaaccgu

SEQ ID NO: 3272319 - RNA, 13 nt, Mycobacterium tuberculosis H37Rv
cagcacggcgauc

SEQ ID NO: 3272320 - RNA, 19 nt, Mycobacterium tuberculosis H37Rv
cagccaguaaaaaggcagg

SEQ ID NO: 3272321 - RNA, 23 nt, Mycobacterium tuberculosis H37Rv
cagccaguaaaaaggcaggacug

SEQ ID NO: 3272322 - RNA, 19 nt, Mycobacterium tuberculosis H37Rv
cagccaguccagcgcgcca

SEQ ID NO: 3272323 - RNA, 14 nt, Mycobacterium tuberculosis H37Rv
cagccauacuccga

SEQ ID NO: 3272324 - RNA, 22 nt, Mycobacterium tuberculosis H37Rv
cagccauacuccgagggaacgg

SEQ ID NO: 3272325 - RNA, 14 nt, Mycobacterium tuberculosis H37Rv
cagccaugcggcug

SEQ ID NO: 3272326 - RNA, 23 nt, Mycobacterium tuberculosis H37Rv
cagccaugcgguuugccggugcg

SEQ ID NO: 3272327 - RNA, 17 nt, Mycobacterium tuberculosis H37Rv
cagccaugcucgucuug

SEQ ID NO: 3272328 - RNA, 14 nt, Mycobacterium tuberculosis H37Rv
cagccauucuucga

SEQ ID NO: 3272329 - RNA, 16 nt, Mycobacterium tuberculosis H37Rv
cagcccaaagcgccag

SEQ ID NO: 3272330 - RNA, 23 nt, Mycobacterium tuberculosis H37Rv
cagcccaaagcgccagcagccac

SEQ ID NO: 3272331 - RNA, 16 nt, Mycobacterium tuberculosis H37Rv
cagcccacaggcggcg

SEQ ID NO: 3272332 - RNA, 21 nt, Mycobacterium tuberculosis H37Rv
cagcccacaggcggcgcugca

SEQ ID NO: 3272333 - RNA, 23 nt, Mycobacterium tuberculosis H37Rv
cagcccacaggcggcgcugcagc

SEQ ID NO: 3272334 - RNA, 16 nt, Mycobacterium tuberculosis H37Rv
cagcccaccggugccg

SEQ ID NO: 3272335 - RNA, 17 nt, Mycobacterium tuberculosis H37Rv
cagcccaccggugccgc

SEQ ID NO: 3272336 - RNA, 19 nt, Mycobacterium tuberculosis H37Rv
cagcccaccggugccgccc

SEQ ID NO: 3272337 - RNA, 20 nt, Mycobacterium tuberculosis H37Rv
cagcccacgagugcaagacc

SEQ ID NO: 3272338 - RNA, 10 nt, Mycobacterium tuberculosis H37Rv
cagcccacuc

SEQ ID NO: 3272339 - RNA, 14 nt, Mycobacterium tuberculosis H37Rv
cagcccacucgucg

SEQ ID NO: 3272340 - RNA, 15 nt, Mycobacterium tuberculosis H37Rv
cagcccagauccagc

SEQ ID NO: 3272341 - RNA, 19 nt, Mycobacterium tuberculosis H37Rv
cagcccagcacgcuggcgu

SEQ ID NO: 3272342 - RNA, 13 nt, Mycobacterium tuberculosis H37Rv
cagcccagcaggu

SEQ ID NO: 3272343 - RNA, 13 nt, Mycobacterium tuberculosis H37Rv
cagcccagccggg

SEQ ID NO: 3272344 - RNA, 15 nt, Mycobacterium tuberculosis H37Rv
cagcccagcggcugg

SEQ ID NO: 3272345 - RNA, 13 nt, Mycobacterium tuberculosis H37Rv
cagcccaggccuu

SEQ ID NO: 3272346 - RNA, 17 nt, Mycobacterium tuberculosis H37Rv
cagcccaugcgccacgc

SEQ ID NO: 3272347 - RNA, 16 nt, Mycobacterium tuberculosis H37Rv
cagcccaugucgagca

SEQ ID NO: 3272348 - RNA, 15 nt, Mycobacterium tuberculosis H37Rv
cagccccccggcgac

SEQ ID NO: 3272349 - RNA, 18 nt, Mycobacterium tuberculosis H37Rv
cagccccccggcgacggc

SEQ ID NO: 3272350 - RNA, 14 nt, Mycobacterium tuberculosis H37Rv
cagccccgacugcg

SEQ ID NO: 3272351 - RNA, 17 nt, Mycobacterium tuberculosis H37Rv
cagccccgacugcgccc

SEQ ID NO: 3272352 - RNA, 22 nt, Mycobacterium tuberculosis H37Rv
cagccccgccggggccgccguc

SEQ ID NO: 3272353 - RNA, 15 nt, Mycobacterium tuberculosis H37Rv
cagccccgcgcccac

SEQ ID NO: 3272354 - RNA, 21 nt, Mycobacterium tuberculosis H37Rv
cagccccgcgcccaccccggc

SEQ ID NO: 3272355 - RNA, 22 nt, Mycobacterium tuberculosis H37Rv
cagccccgcgcccaccccggcc

SEQ ID NO: 3272356 - RNA, 17 nt, Mycobacterium tuberculosis H37Rv
cagccccgcggccagca

SEQ ID NO: 3272357 - RNA, 22 nt, Mycobacterium tuberculosis H37Rv
cagccccguuucgccagauggc

SEQ ID NO: 3272358 - RNA, 16 nt, Mycobacterium tuberculosis H37Rv
cagccccuccgcgccg

SEQ ID NO: 3272359 - RNA, 22 nt, Mycobacterium tuberculosis H37Rv
cagccccuccgcgccgaucagc

SEQ ID NO: 3272360 - RNA, 16 nt, Mycobacterium tuberculosis H37Rv
cagccccugccgaucc

SEQ ID NO: 3272361 - RNA, 20 nt, Mycobacterium tuberculosis H37Rv
cagccccuuguaucccucgg

SEQ ID NO: 3272362 - RNA, 14 nt, Mycobacterium tuberculosis H37Rv
cagcccgacaccgu

SEQ ID NO: 3272363 - RNA, 23 nt, Mycobacterium tuberculosis H37Rv
cagcccgacaccguccagcagcu

SEQ ID NO: 3272364 - RNA, 15 nt, Mycobacterium tuberculosis H37Rv
cagcccgacgcccga

SEQ ID NO: 3272365 - RNA, 14 nt, Mycobacterium tuberculosis H37Rv
cagcccgacguugc

SEQ ID NO: 3272366 - RNA, 17 nt, Mycobacterium tuberculosis H37Rv
cagcccgaugaucccgc

SEQ ID NO: 3272367 - RNA, 21 nt, Mycobacterium tuberculosis H37Rv
cagcccgaugaucccgccacc

SEQ ID NO: 3272368 - RNA, 22 nt, Mycobacterium tuberculosis H37Rv
cagcccgaugaucccgccaccg

SEQ ID NO: 3272369 - RNA, 23 nt, Mycobacterium tuberculosis H37Rv
cagcccgaugaucccgccaccga

SEQ ID NO: 3272370 - RNA, 12 nt, Mycobacterium tuberculosis H37Rv
cagcccgcccaa

SEQ ID NO: 3272371 - RNA, 16 nt, Mycobacterium tuberculosis H37Rv
cagcccgcccaaugcg

SEQ ID NO: 3272372 - RNA, 22 nt, Mycobacterium tuberculosis H37Rv
cagcccgcccugaccgcccgca

SEQ ID NO: 3272373 - RNA, 16 nt, Mycobacterium tuberculosis H37Rv
cagcccgccgaucggg

SEQ ID NO: 3272374 - RNA, 13 nt, Mycobacterium tuberculosis H37Rv
cagcccgccgcug

SEQ ID NO: 3272375 - RNA, 16 nt, Mycobacterium tuberculosis H37Rv
cagcccgccgcugaac

SEQ ID NO: 3272376 - RNA, 12 nt, Mycobacterium tuberculosis H37Rv
cagcccgccgga

SEQ ID NO: 3272377 - RNA, 15 nt, Mycobacterium tuberculosis H37Rv
cagcccgccggaccc

SEQ ID NO: 3272378 - RNA, 22 nt, Mycobacterium tuberculosis H37Rv
cagcccgccggacccgcccuug

SEQ ID NO: 3272379 - RNA, 14 nt, Mycobacterium tuberculosis H37Rv
cagcccgccggcgu

SEQ ID NO: 3272380 - RNA, 23 nt, Mycobacterium tuberculosis H37Rv
cagcccgccgggcuccacgucau

SEQ ID NO: 3272381 - RNA, 14 nt, Mycobacterium tuberculosis H37Rv
cagcccgccgucgg

SEQ ID NO: 3272382 - RNA, 15 nt, Mycobacterium tuberculosis H37Rv
cagcccgccgucggc

SEQ ID NO: 3272383 - RNA, 13 nt, Mycobacterium tuberculosis H37Rv
cagcccgcgcagc

SEQ ID NO: 3272384 - RNA, 15 nt, Mycobacterium tuberculosis H37Rv
cagcccgcuggccgu

SEQ ID NO: 3272385 - RNA, 19 nt, Mycobacterium tuberculosis H37Rv
cagcccgcuggccuccugg

SEQ ID NO: 3272386 - RNA, 19 nt, Mycobacterium tuberculosis H37Rv
cagcccggcacugaccgcg

SEQ ID NO: 3272387 - RNA, 14 nt, Mycobacterium tuberculosis H37Rv
cagcccggccgccg

SEQ ID NO: 3272388 - RNA, 16 nt, Mycobacterium tuberculosis H37Rv
cagcccggcgacgacc

SEQ ID NO: 3272389 - RNA, 21 nt, Mycobacterium tuberculosis H37Rv
cagcccggcgaugagcaugcc

SEQ ID NO: 3272390 - RNA, 15 nt, Mycobacterium tuberculosis H37Rv
cagcccggcgcgccg

SEQ ID NO: 3272391 - RNA, 21 nt, Mycobacterium tuberculosis H37Rv
cagcccggcgcgccgaguugc

SEQ ID NO: 3272392 - RNA, 16 nt, Mycobacterium tuberculosis H37Rv
cagcccggcggccgcu

SEQ ID NO: 3272393 - RNA, 13 nt, Mycobacterium tuberculosis H37Rv
cagcccggcguug

SEQ ID NO: 3272394 - RNA, 13 nt, Mycobacterium tuberculosis H37Rv
cagcccgggcagc

SEQ ID NO: 3272395 - RNA, 17 nt, Mycobacterium tuberculosis H37Rv
cagcccgggcagccccu

SEQ ID NO: 3272396 - RNA, 18 nt, Mycobacterium tuberculosis H37Rv
cagcccgggcagccccuc

SEQ ID NO: 3272397 - RNA, 19 nt, Mycobacterium tuberculosis H37Rv
cagcccggucauggucagc

SEQ ID NO: 3272398 - RNA, 18 nt, Mycobacterium tuberculosis H37Rv
cagcccggugugcugcac

SEQ ID NO: 3272399 - RNA, 17 nt, Mycobacterium tuberculosis H37Rv
cagcccguagcacaccg

SEQ ID NO: 3272400 - RNA, 13 nt, Mycobacterium tuberculosis H37Rv
cagcccgucagcc

SEQ ID NO: 3272401 - RNA, 20 nt, Mycobacterium tuberculosis H37Rv
cagcccguccaggcgcugca

SEQ ID NO: 3272402 - RNA, 22 nt, Mycobacterium tuberculosis H37Rv
cagcccguccaggcgcugcagc

SEQ ID NO: 3272403 - RNA, 15 nt, Mycobacterium tuberculosis H37Rv
cagcccgucggaccc

SEQ ID NO: 3272404 - RNA, 15 nt, Mycobacterium tuberculosis H37Rv
cagcccgugacuggu

SEQ ID NO: 3272405 - RNA, 16 nt, Mycobacterium tuberculosis H37Rv
cagcccuaucagccga

SEQ ID NO: 3272406 - RNA, 12 nt, Mycobacterium tuberculosis H37Rv
cagcccucuggu

SEQ ID NO: 3272407 - RNA, 23 nt, Mycobacterium tuberculosis H37Rv
cagcccucugguggcgcugaagc

SEQ ID NO: 3272408 - RNA, 23 nt, Mycobacterium tuberculosis H37Rv
cagcccuguuugacugcgaccgg

SEQ ID NO: 3272409 - RNA, 14 nt, Mycobacterium tuberculosis H37Rv
cagcccuucagcgu

SEQ ID NO: 3272410 - RNA, 16 nt, Mycobacterium tuberculosis H37Rv
cagcccuucagcgucc

SEQ ID NO: 3272411 - RNA, 18 nt, Mycobacterium tuberculosis H37Rv
cagcccuuggcgcgcagg

SEQ ID NO: 3272412 - RNA, 18 nt, Mycobacterium tuberculosis H37Rv
cagccgaaccggcaccag

SEQ ID NO: 3272413 - RNA, 20 nt, Mycobacterium tuberculosis H37Rv
cagccgaaccggcaccagcg

SEQ ID NO: 3272414 - RNA, 14 nt, Mycobacterium tuberculosis H37Rv
cagccgaagccgaa

SEQ ID NO: 3272415 - RNA, 18 nt, Mycobacterium tuberculosis H37Rv
cagccgacaacuguccug

SEQ ID NO: 3272416 - RNA, 13 nt, Mycobacterium tuberculosis H37Rv
cagcgacaagugc

SEQ ID NO: 3272417 - RNA, 16 nt, Mycobacterium tuberculosis H37Rv
cagcgacagcgugccg

SEQ ID NO: 3272418 - RNA, 21 nt, Mycobacterium tuberculosis H37Rv
cagcgacagcugccugaccgg

SEQ ID NO: 3272419 - RNA, 16 nt, Mycobacterium tuberculosis H37Rv
cagcgacaugcccgcc

SEQ ID NO: 3272420 - RNA, 16 nt, Mycobacterium tuberculosis H37Rv
cagcgaccaguggugg

SEQ ID NO: 3272421 - RNA, 15 nt, Mycobacterium tuberculosis H37Rv
cagcgaccgguaauc

SEQ ID NO: 3272422 - RNA, 20 nt, Mycobacterium tuberculosis H37Rv
cagcgaccucacgaaucgcu

SEQ ID NO: 3272423 - RNA, 15 nt, Mycobacterium tuberculosis H37Rv
cagcgaccucacugc

SEQ ID NO: 3272424 - RNA, 15 nt, Mycobacterium tuberculosis H37Rv
cagcgacgacgccca

SEQ ID NO: 3272425 - RNA, 21 nt, Mycobacterium tuberculosis H37Rv
cagcgacgacgcccaccaggc

SEQ ID NO: 3272426 - RNA, 18 nt, Mycobacterium tuberculosis H37Rv
cagcgacgagaucagccu

SEQ ID NO: 3272427 - RNA, 14 nt, Mycobacterium tuberculosis H37Rv
cagcgacgccaugg

SEQ ID NO: 3272428 - RNA, 16 nt, Mycobacterium tuberculosis H37Rv
cagcgacgccaugguc

SEQ ID NO: 3272429 - RNA, 15 nt, Mycobacterium tuberculosis H37Rv
cagcgacgccauguc

SEQ ID NO: 3272430 - RNA, 17 nt, Mycobacterium tuberculosis H37Rv
cagcgacgccaugucga

SEQ ID NO: 3272431 - RNA, 15 nt, Mycobacterium tuberculosis H37Rv
cagcgacgccggccc

SEQ ID NO: 3272432 - RNA, 17 nt, Mycobacterium tuberculosis H37Rv
cagcgacgcggccagcg

SEQ ID NO: 3272433 - RNA, 21 nt, Mycobacterium tuberculosis H37Rv
cagcgacgcggccagcggcaa

SEQ ID NO: 3272434 - RNA, 18 nt, Mycobacterium tuberculosis H37Rv
cagcgacgcggucaucga

SEQ ID NO: 3272435 - RNA, 20 nt, Mycobacterium tuberculosis H37Rv
cagcgacgcugccgccaggc

SEQ ID NO: 3272436 - RNA, 19 nt, Mycobacterium tuberculosis H37Rv
cagcgacgggaaagccacc

SEQ ID NO: 3272437 - RNA, 13 nt, Mycobacterium tuberculosis H37Rv
cagcgacggucag

SEQ ID NO: 3272438 - RNA, 12 nt, Mycobacterium tuberculosis H37Rv
cagcgacgucgc

SEQ ID NO: 3272439 - RNA, 22 nt, Mycobacterium tuberculosis H37Rv
cagcgacgucgcaauaugccac

SEQ ID NO: 3272440 - RNA, 13 nt, Mycobacterium tuberculosis H37Rv
cagcgacuccacc

SEQ ID NO: 3272441 - RNA, 18 nt, Mycobacterium tuberculosis H37Rv
cagcgacuccaccccacc

SEQ ID NO: 3272442 - RNA, 15 nt, Mycobacterium tuberculosis H37Rv
cagcgacuugcggug

SEQ ID NO: 3272443 - RNA, 14 nt, Mycobacterium tuberculosis H37Rv
cagcgacuuggcau

SEQ ID NO: 3272444 - RNA, 19 nt, Mycobacterium tuberculosis H37Rv
cagcgacuuggcaucgcga

SEQ ID NO: 3272445 - RNA, 21 nt, Mycobacterium tuberculosis H37Rv
cagcgacuuggcaucgcgagc

SEQ ID NO: 3272446 - RNA, 23 nt, Mycobacterium tuberculosis H37Rv
cagcgacuuggcaucgcgagcca

SEQ ID NO: 3272447 - RNA, 14 nt, Mycobacterium tuberculosis H37Rv
cagcgagacgucga

SEQ ID NO: 3272448 - RNA, 19 nt, Mycobacterium tuberculosis H37Rv
cagcgagaucagcaugccc

SEQ ID NO: 3272449 - RNA, 15 nt, Mycobacterium tuberculosis H37Rv
cagcgagcacacucc

SEQ ID NO: 3272450 - RNA, 19 nt, Mycobacterium tuberculosis H37Rv
cagcgagcauaccgccgcu

SEQ ID NO: 3272451 - RNA, 19 nt, Mycobacterium tuberculosis H37Rv
cagcgagcgguugaucgcg

SEQ ID NO: 3272452 - RNA, 14 nt, Mycobacterium tuberculosis H37Rv
cagcgaggccagcg

SEQ ID NO: 3272453 - RNA, 14 nt, Mycobacterium tuberculosis H37Rv
cagcgagucgacgu

SEQ ID NO: 3272454 - RNA, 17 nt, Mycobacterium tuberculosis H37Rv
cagcgagucgacgucga

SEQ ID NO: 3272455 - RNA, 15 nt, Mycobacterium tuberculosis H37Rv
cagcgauauccacaa

SEQ ID NO: 3272456 - RNA, 17 nt, Mycobacterium tuberculosis H37Rv
cagcgauauccacaauc

SEQ ID NO: 3272457 - RNA, 17 nt, Mycobacterium tuberculosis H37Rv
cagcgauaucggcggcu

SEQ ID NO: 3272458 - RNA, 23 nt, Mycobacterium tuberculosis H37Rv
cagcgauauugagggugagccga

SEQ ID NO: 3272459 - RNA, 20 nt, Mycobacterium tuberculosis H37Rv
cagcgaucccggcaacaacg

SEQ ID NO: 3272460 - RNA, 15 nt, Mycobacterium tuberculosis H37Rv
cagcgaucccgguga

SEQ ID NO: 3272461 - RNA, 15 nt, Mycobacterium tuberculosis H37Rv
cagcgauccggggcu

SEQ ID NO: 3272462 - RNA, 19 nt, Mycobacterium tuberculosis H37Rv
cagcgauccucgccgggua

SEQ ID NO: 3272463 - RNA, 13 nt, Mycobacterium tuberculosis H37Rv
cagcgaucgccgc

SEQ ID NO: 3272464 - RNA, 14 nt, Mycobacterium tuberculosis H37Rv
cagcgaucgccgca

SEQ ID NO: 3272465 - RNA, 20 nt, Mycobacterium tuberculosis H37Rv
cagcgaucuugguggccuca

SEQ ID NO: 3272466 - RNA, 14 nt, Mycobacterium tuberculosis H37Rv
cagcgaugacgacc

SEQ ID NO: 3272467 - RNA, 20 nt, Mycobacterium tuberculosis H37Rv
cagcgaugcgcucacugcag

SEQ ID NO: 3272468 - RNA, 17 nt, Mycobacterium tuberculosis H37Rv
cagcgaugcggcguugg

SEQ ID NO: 3272469 - RNA, 16 nt, Mycobacterium tuberculosis H37Rv
cagcgaugcucacuac

SEQ ID NO: 3272470 - RNA, 13 nt, Mycobacterium tuberculosis H37Rv
cagcgauucagcc

SEQ ID NO: 3272471 - RNA, 19 nt, Mycobacterium tuberculosis H37Rv
cagcgauuccacggcagca

SEQ ID NO: 3272472 - RNA, 19 nt, Mycobacterium tuberculosis H37Rv
cagcgcaaagcccuccucg

SEQ ID NO: 3272473 - RNA, 20 nt, Mycobacterium tuberculosis H37Rv
cagcgcaaagcccuccucga

SEQ ID NO: 3272474 - RNA, 21 nt, Mycobacterium tuberculosis H37Rv
cagcgcaacaucgaaaaccga

SEQ ID NO: 3272475 - RNA, 15 nt, Mycobacterium tuberculosis H37Rv
cagcgcaaccgaccg

SEQ ID NO: 3272476 - RNA, 17 nt, Mycobacterium tuberculosis H37Rv
cagcgcaaccgaccggg

SEQ ID NO: 3272477 - RNA, 20 nt, Mycobacterium tuberculosis H37Rv
cagcgcaagguugccaacgc

SEQ ID NO: 3272478 - RNA, 22 nt, Mycobacterium tuberculosis H37Rv
cagcgcaaugcaucgcggcggc

SEQ ID NO: 3272479 - RNA, 18 nt, Mycobacterium tuberculosis H37Rv
cagcgcacacuaccgccg

SEQ ID NO: 3272480 - RNA, 13 nt, Mycobacterium tuberculosis H37Rv
cagcgcacccggu

SEQ ID NO: 3272481 - RNA, 12 nt, Mycobacterium tuberculosis H37Rv
cagcgcaccggu

SEQ ID NO: 3272482 - RNA, 17 nt, Mycobacterium tuberculosis H37Rv
cagcgcaccggugaugg

SEQ ID NO: 3272483 - RNA, 21 nt, Mycobacterium tuberculosis H37Rv
cagcgcacgauuucgagcgcu

SEQ ID NO: 3272484 - RNA, 14 nt, Mycobacterium tuberculosis H37Rv
cagcgcacgcagcc

SEQ ID NO: 3272485 - RNA, 21 nt, Mycobacterium tuberculosis H37Rv
cagcgcacggaccaucgccag

SEQ ID NO: 3272486 - RNA, 20 nt, Mycobacterium tuberculosis H37Rv
cagcgcacuacucgaacaac

SEQ ID NO: 3272487 - RNA, 22 nt, Mycobacterium tuberculosis H37Rv
cagcgcacuacucgaacaaccc

SEQ ID NO: 3272488 - RNA, 14 nt, Mycobacterium tuberculosis H37Rv
cagcgcacugcccg

SEQ ID NO: 3272489 - RNA, 16 nt, Mycobacterium tuberculosis H37Rv
cagcgcacugcccggg

SEQ ID NO: 3272490 - RNA, 16 nt, Mycobacterium tuberculosis H37Rv
cagcgcacuggccgcu

SEQ ID NO: 3272491 - RNA, 11 nt, Mycobacterium tuberculosis H37Rv
cagcgcagcag

SEQ ID NO: 3272492 - RNA, 13 nt, Mycobacterium tuberculosis H37Rv
cagcgcagcagcg

SEQ ID NO: 3272493 - RNA, 18 nt, Mycobacterium tuberculosis H37Rv
cagcgcagcagcggcauc

SEQ ID NO: 3272494 - RNA, 21 nt, Mycobacterium tuberculosis H37Rv
cagcgcagccgaucgucucgg

SEQ ID NO: 3272495 - RNA, 16 nt, Mycobacterium tuberculosis H37Rv
cagcgcagccugcagc

SEQ ID NO: 3272496 - RNA, 22 nt, Mycobacterium tuberculosis H37Rv
cagcgcaggauucugcugacca

SEQ ID NO: 3272497 - RNA, 16 nt, Mycobacterium tuberculosis H37Rv
cagcgcauccacaauc

SEQ ID NO: 3272498 - RNA, 13 nt, Mycobacterium tuberculosis H37Rv
cagcgcaucgccg

SEQ ID NO: 3272499 - RNA, 15 nt, Mycobacterium tuberculosis H37Rv
cagcgcaucgccgcu

SEQ ID NO: 3272500 - RNA, 16 nt, Mycobacterium tuberculosis H37Rv
cagcgcaucgccgcug

SEQ ID NO: 3272501 - RNA, 14 nt, Mycobacterium tuberculosis H37Rv
cagcgcaucggcca

SEQ ID NO: 3272502 - RNA, 17 nt, Mycobacterium tuberculosis H37Rv
cagcgcaucggccagca

SEQ ID NO: 3272503 - RNA, 22 nt, Mycobacterium tuberculosis H37Rv
cagcgcaucggucaccaacucc

SEQ ID NO: 3272504 - RNA, 20 nt, Mycobacterium tuberculosis H37Rv
cagcgcauggacgaacgcgg

SEQ ID NO: 3272505 - RNA, 18 nt, Mycobacterium tuberculosis H37Rv
cagcgcauuuuccacauc

SEQ ID NO: 3272506 - RNA, 19 nt, Mycobacterium tuberculosis H37Rv
cagcgcauuuuccacaucc

SEQ ID NO: 3272507 - RNA, 22 nt, Mycobacterium tuberculosis H37Rv
cagcgccaacucgagaguggcc

SEQ ID NO: 3272508 - RNA, 21 nt, Mycobacterium tuberculosis H37Rv
cagcgccaagacgucggcgug

SEQ ID NO: 3272509 - RNA, 13 nt, Mycobacterium tuberculosis H37Rv
cagcgccaauguc

SEQ ID NO: 3272510 - RNA, 20 nt, Mycobacterium tuberculosis H37Rv
cagcgccacauacaccggcc

SEQ ID NO: 3272511 - RNA, 12 nt, Mycobacterium tuberculosis H37Rv
cagcgccacccg

SEQ ID NO: 3272512 - RNA, 16 nt, Mycobacterium tuberculosis H37Rv
cagcgccacccgaucg

SEQ ID NO: 3272513 - RNA, 23 nt, Mycobacterium tuberculosis H37Rv
cagcgcggcguguacgucgauca

SEQ ID NO: 3272514 - RNA, 15 nt, Mycobacterium tuberculosis H37Rv
cagcgcggcuggggc

SEQ ID NO: 3272515 - RNA, 20 nt, Mycobacterium tuberculosis H37Rv
cagcgcggcuggggccccgc

SEQ ID NO: 3272516 - RNA, 14 nt, Mycobacterium tuberculosis H37Rv
cagcgcgggaucug

SEQ ID NO: 3272517 - RNA, 19 nt, Mycobacterium tuberculosis H37Rv
cagcgcgguguagagcgca

SEQ ID NO: 3272518 - RNA, 21 nt, Mycobacterium tuberculosis H37Rv
cagcgcgguguucgcggcauc

SEQ ID NO: 3272519 - RNA, 20 nt, Mycobacterium tuberculosis H37Rv
cagcgcguacuugguggugg

SEQ ID NO: 3272520 - RNA, 19 nt, Mycobacterium tuberculosis H37Rv
cagcgcguagccaaugccc

SEQ ID NO: 3272521 - RNA, 23 nt, Mycobacterium tuberculosis H37Rv
cagcgcguauggcucaccccguu

SEQ ID NO: 3272522 - RNA, 15 nt, Mycobacterium tuberculosis H37Rv
cagcgcgucgccgaa

SEQ ID NO: 3272523 - RNA, 16 nt, Mycobacterium tuberculosis H37Rv
cagcgcgucgccgaaa

SEQ ID NO: 3272524 - RNA, 17 nt, Mycobacterium tuberculosis H37Rv
cagcgcgucggagccgg

SEQ ID NO: 3272525 - RNA, 13 nt, Mycobacterium tuberculosis H37Rv
cagcgcgucggga

SEQ ID NO: 3272526 - RNA, 14 nt, Mycobacterium tuberculosis H37Rv
cagcgcgucgucca

SEQ ID NO: 3272527 - RNA, 15 nt, Mycobacterium tuberculosis H37Rv
cagcgcgucguccag

SEQ ID NO: 3272528 - RNA, 22 nt, Mycobacterium tuberculosis H37Rv
cagcgcuccagcacccgcgcga

SEQ ID NO: 3272529 - RNA, 22 nt, Mycobacterium tuberculosis H37Rv
cagcgcucucauagcgacggcg

SEQ ID NO: 3272530 - RNA, 15 nt, Mycobacterium tuberculosis H37Rv
cagcgcugagccgcu

SEQ ID NO: 3272531 - RNA, 18 nt, Mycobacterium tuberculosis H37Rv
cagcgcugagccgcucau

SEQ ID NO: 3272532 - RNA, 12 nt, Mycobacterium tuberculosis H37Rv
cagcgcugccac

SEQ ID NO: 3272533 - RNA, 21 nt, Mycobacterium tuberculosis H37Rv
cagcgcugccaccgcgguggc

SEQ ID NO: 3272534 - RNA, 20 nt, Mycobacterium tuberculosis H37Rv
cagcgcuggcuacgccuccu

SEQ ID NO: 3272535 - RNA, 14 nt, Mycobacterium tuberculosis H37Rv
cagcgcugggccca

SEQ ID NO: 3272536 - RNA, 17 nt, Mycobacterium tuberculosis H37Rv
cagcgcugucguaccgc

SEQ ID NO: 3272537 - RNA, 18 nt, Mycobacterium tuberculosis H37Rv
cagcgcuucacgggccgu

SEQ ID NO: 3272538 - RNA, 15 nt, Mycobacterium tuberculosis H37Rv
cagcgcuucgucggc

SEQ ID NO: 3272539 - RNA, 16 nt, Mycobacterium tuberculosis H37Rv
cagcgcuucgucggcc

SEQ ID NO: 3272540 - RNA, 21 nt, Mycobacterium tuberculosis H37Rv
cagcgcuucgucggccggcac

SEQ ID NO: 3272541 - RNA, 14 nt, Mycobacterium tuberculosis H37Rv
cagcggaagcgaau

SEQ ID NO: 3272542 - RNA, 16 nt, Mycobacterium tuberculosis H37Rv
cagcggaaucaccgaa

SEQ ID NO: 3272543 - RNA, 22 nt, Mycobacterium tuberculosis H37Rv
cagcggaauuagucgccgcagu

SEQ ID NO: 3272544 - RNA, 20 nt, Mycobacterium tuberculosis H37Rv
cagcggaccccacgaguagc

SEQ ID NO: 3272545 - RNA, 13 nt, Mycobacterium tuberculosis H37Rv
cagcggaccgcug

SEQ ID NO: 3272546 - RNA, 14 nt, Mycobacterium tuberculosis H37Rv
cagcggaccgcugc

SEQ ID NO: 3272547 - RNA, 19 nt, Mycobacterium tuberculosis H37Rv
cagcggaucgucguuguca

SEQ ID NO: 3272548 - RNA, 16 nt, Mycobacterium tuberculosis H37Rv
cagcggcaacgaucga

SEQ ID NO: 3272549 - RNA, 11 nt, Mycobacterium tuberculosis H37Rv
cagcggcaaga

SEQ ID NO: 3272550 - RNA, 15 nt, Mycobacterium tuberculosis H37Rv
cagcggcaauggcca

SEQ ID NO: 3272551 - RNA, 20 nt, Mycobacterium tuberculosis H37Rv
cagcggcacacccaucaccg

SEQ ID NO: 3272552 - RNA, 15 nt, Mycobacterium tuberculosis H37Rv
cagcggcaccgcgcc

SEQ ID NO: 3272553 - RNA, 14 nt, Mycobacterium tuberculosis H37Rv
cagcggcacgaucg

SEQ ID NO: 3272554 - RNA, 18 nt, Mycobacterium tuberculosis H37Rv
cagcggcacugaucugcg

SEQ ID NO: 3272555 - RNA, 21 nt, Mycobacterium tuberculosis H37Rv
cagcggcacugaucugcguug

SEQ ID NO: 3272556 - RNA, 13 nt, Mycobacterium tuberculosis H37Rv
cagcggcaggaag

SEQ ID NO: 3272557 - RNA, 22 nt, Mycobacterium tuberculosis H37Rv
cagcggcaguuccugacgccau

SEQ ID NO: 3272558 - RNA, 22 nt, Mycobacterium tuberculosis H37Rv
cagcggcauccacaccgaccgc

SEQ ID NO: 3272559 - RNA, 14 nt, Mycobacterium tuberculosis H37Rv
cagcggcaucgcgg

SEQ ID NO: 3272560 - RNA, 16 nt, Mycobacterium tuberculosis H37Rv
cagcggcaucggccag

SEQ ID NO: 3272561 - RNA, 13 nt, Mycobacterium tuberculosis H37Rv
cagcggcauugcc

SEQ ID NO: 3272562 - RNA, 15 nt, Mycobacterium tuberculosis H37Rv
cagcggcauugccag

SEQ ID NO: 3272563 - RNA, 12 nt, Mycobacterium tuberculosis H37Rv
cagcggccaccg

SEQ ID NO: 3272564 - RNA, 13 nt, Mycobacterium tuberculosis H37Rv
cagcggccaccga

SEQ ID NO: 3272565 - RNA, 19 nt, Mycobacterium tuberculosis H37Rv
cagcggccaccgaggcguu

SEQ ID NO: 3272566 - RNA, 14 nt, Mycobacterium tuberculosis H37Rv
cagcggccagcagu

SEQ ID NO: 3272567 - RNA, 16 nt, Mycobacterium tuberculosis H37Rv
cagcggccauaucgcc

SEQ ID NO: 3272568 - RNA, 20 nt, Mycobacterium tuberculosis H37Rv
cagcggcccuaucuggcggc

SEQ ID NO: 3272569 - RNA, 12 nt, Mycobacterium tuberculosis H37Rv
cagcggccgacc

SEQ ID NO: 3272570 - RNA, 22 nt, Mycobacterium tuberculosis H37Rv
cagcggccgaccgcgacccggc

SEQ ID NO: 3272571 - RNA, 17 nt, Mycobacterium tuberculosis H37Rv
cagcggccgcuccaccu

SEQ ID NO: 3272572 - RNA, 16 nt, Mycobacterium tuberculosis H37Rv
cagcggccgggcggcc

SEQ ID NO: 3272573 - RNA, 22 nt, Mycobacterium tuberculosis H37Rv
cagcggccgguacacguccagu

SEQ ID NO: 3272574 - RNA, 17 nt, Mycobacterium tuberculosis H37Rv
cagcggccuccgggcca

SEQ ID NO: 3272575 - RNA, 17 nt, Mycobacterium tuberculosis H37Rv
cagcggccugaccggcu

SEQ ID NO: 3272576 - RNA, 12 nt, Mycobacterium tuberculosis H37Rv
aucauguggugg

SEQ ID NO: 3272577 - RNA, 12 nt, Mycobacterium tuberculosis H37Rv
aucauguucggc

SEQ ID NO: 3272578 - RNA, 20 nt, Mycobacterium tuberculosis H37Rv
aucauguucuuuugcgucug

SEQ ID NO: 3272579 - RNA, 15 nt, Mycobacterium tuberculosis H37Rv
auccaacgaccucca

SEQ ID NO: 3272580 - RNA, 16 nt, Mycobacterium tuberculosis H37Rv
auccaacuggccgcgu

SEQ ID NO: 3272581 - RNA, 15 nt, Mycobacterium tuberculosis H37Rv
auccaaggcucagca

SEQ ID NO: 3272582 - RNA, 19 nt, Mycobacterium tuberculosis H37Rv
auccaaugccagaucggcc

SEQ ID NO: 3272583 - RNA, 18 nt, Mycobacterium tuberculosis H37Rv
auccacacacagccggug

SEQ ID NO: 3272584 - RNA, 17 nt, Mycobacterium tuberculosis H37Rv
auccacaccgaccgcgg

SEQ ID NO: 3272585 - RNA, 18 nt, Mycobacterium tuberculosis H37Rv
auccaccgauucggcgac

SEQ ID NO: 3272586 - RNA, 18 nt, Mycobacterium tuberculosis H37Rv
auccaccgguccagggcc

SEQ ID NO: 3272587 - RNA, 23 nt, Mycobacterium tuberculosis H37Rv
auccacgacaucguaggccggca

SEQ ID NO: 3272588 - RNA, 13 nt, Mycobacterium tuberculosis H37Rv
auccacggagacc

SEQ ID NO: 3272589 - RNA, 17 nt, Mycobacterium tuberculosis H37Rv
auccacggcgaugcagc

SEQ ID NO: 3272590 - RNA, 21 nt, Mycobacterium tuberculosis H37Rv
auccacggcgaugcagccaca

SEQ ID NO: 3272591 - RNA, 23 nt, Mycobacterium tuberculosis H37Rv
auccacgguugccggcggcgacg

SEQ ID NO: 3272592 - RNA, 15 nt, Mycobacterium tuberculosis H37Rv
auccacgucgcccag

SEQ ID NO: 3272593 - RNA, 13 nt, Mycobacterium tuberculosis H37Rv
auccacugcggcg

SEQ ID NO: 3272594 - RNA, 17 nt, Mycobacterium tuberculosis H37Rv
auccagaaacugcucgg

SEQ ID NO: 3272595 - RNA, 14 nt, Mycobacterium tuberculosis H37Rv
auccagauaauccu

SEQ ID NO: 3272596 - RNA, 16 nt, Mycobacterium tuberculosis H37Rv
auccagaugcccagca

SEQ ID NO: 3272597 - RNA, 17 nt, Mycobacterium tuberculosis H37Rv
auccagaugcccagcag

SEQ ID NO: 3272598 - RNA, 15 nt, Mycobacterium tuberculosis H37Rv
auccagcaacgcggu

SEQ ID NO: 3272599 - RNA, 19 nt, Mycobacterium tuberculosis H37Rv
auccagcagccaggagccg

SEQ ID NO: 3272600 - RNA, 22 nt, Mycobacterium tuberculosis H37Rv
auccagcagccaggagccgauc

SEQ ID NO: 3272601 - RNA, 18 nt, Mycobacterium tuberculosis H37Rv
auccagccagcaagcggu

SEQ ID NO: 3272602 - RNA, 15 nt, Mycobacterium tuberculosis H37Rv
auccagccaugcggu

SEQ ID NO: 3272603 - RNA, 16 nt, Mycobacterium tuberculosis H37Rv
auccagcccgacgccc

SEQ ID NO: 3272604 - RNA, 18 nt, Mycobacterium tuberculosis H37Rv
auccaggagugauucggc

SEQ ID NO: 3272605 - RNA, 14 nt, Mycobacterium tuberculosis H37Rv
auccaggcccagcc

SEQ ID NO: 3272606 - RNA, 22 nt, Mycobacterium tuberculosis H37Rv
auccaggcccagccgagcggcg

SEQ ID NO: 3272607 - RNA, 21 nt, Mycobacterium tuberculosis H37Rv
auccaggccucgcaccggauc

SEQ ID NO: 3272608 - RNA, 22 nt, Mycobacterium tuberculosis H37Rv
auccagggccgacgcgaaccca

SEQ ID NO: 3272609 - RNA, 21 nt, Mycobacterium tuberculosis H37Rv
auccaggggcgcaacucaucg

SEQ ID NO: 3272610 - RNA, 16 nt, Mycobacterium tuberculosis H37Rv
auccagguagaccgga

SEQ ID NO: 3272611 - RNA, 14 nt, Mycobacterium tuberculosis H37Rv
auccaguucaccgc

SEQ ID NO: 3272612 - RNA, 12 nt, Mycobacterium tuberculosis H37Rv
auccauccugcc

SEQ ID NO: 3272613 - RNA, 21 nt, Mycobacterium tuberculosis H37Rv
auccaugauggccgucagcca

SEQ ID NO: 3272614 - RNA, 21 nt, Mycobacterium tuberculosis H37Rv
aucccaagcguccgcugcagg

SEQ ID NO: 3272615 - RNA, 16 nt, Mycobacterium tuberculosis H37Rv
aucccacggugguggg

SEQ ID NO: 3272616 - RNA, 19 nt, Mycobacterium tuberculosis H37Rv
aucccagauaugcaggacu

SEQ ID NO: 3272617 - RNA, 15 nt, Mycobacterium tuberculosis H37Rv
aucccaggggcaccg

SEQ ID NO: 3272618 - RNA, 11 nt, Mycobacterium tuberculosis H37Rv
aucccaucggg

SEQ ID NO: 3272619 - RNA, 12 nt, Mycobacterium tuberculosis H37Rv
auccccagcaca

SEQ ID NO: 3272620 - RNA, 13 nt, Mycobacterium tuberculosis H37Rv
auccccagcacca

SEQ ID NO: 3272621 - RNA, 19 nt, Mycobacterium tuberculosis H37Rv
auccccaguugugcggcca

SEQ ID NO: 3272622 - RNA, 19 nt, Mycobacterium tuberculosis H37Rv
aucccccggcuggucaccc

SEQ ID NO: 3272623 - RNA, 24 nt, Mycobacterium tuberculosis H37Rv
aucccccggcuggucacccguauc

SEQ ID NO: 3272624 - RNA, 12 nt, Mycobacterium tuberculosis H37Rv
auccccgacguc

SEQ ID NO: 3272625 - RNA, 20 nt, Mycobacterium tuberculosis H37Rv
auccccgcggcgguaaaccu

SEQ ID NO: 3272626 - RNA, 18 nt, Mycobacterium tuberculosis H37Rv
auccccuggccaaccggg

SEQ ID NO: 3272627 - RNA, 15 nt, Mycobacterium tuberculosis H37Rv
auccccuggccagca

SEQ ID NO: 3272628 - RNA, 21 nt, Mycobacterium tuberculosis H37Rv
aucccgaaguagaagcccagg

SEQ ID NO: 3272629 - RNA, 23 nt, Mycobacterium tuberculosis H37Rv
aucccgaggggagugucagcgcc

SEQ ID NO: 3272630 - RNA, 13 nt, Mycobacterium tuberculosis H37Rv
aucccgauacgca

SEQ ID NO: 3272631 - RNA, 20 nt, Mycobacterium tuberculosis H37Rv
aucccgccaccgaacagucg

SEQ ID NO: 3272632 - RNA, 19 nt, Mycobacterium tuberculosis H37Rv
aucccgccaucugccugcc

SEQ ID NO: 3272633 - RNA, 22 nt, Mycobacterium tuberculosis H37Rv
aucccgcccaagguggcggcca

SEQ ID NO: 3272634 - RNA, 19 nt, Mycobacterium tuberculosis H37Rv
aucccgccgaucgaaccgc

SEQ ID NO: 3272635 - RNA, 22 nt, Mycobacterium tuberculosis H37Rv
aucccgccgcccgcaucgcggc

SEQ ID NO: 3272636 - RNA, 19 nt, Mycobacterium tuberculosis H37Rv
aucccgccgcugccgccgg

SEQ ID NO: 3272637 - RNA, 19 nt, Mycobacterium tuberculosis H37Rv
aucccgcucccaugaucgc

SEQ ID NO: 3272638 - RNA, 14 nt, Mycobacterium tuberculosis H37Rv
aucccggccaggcc

SEQ ID NO: 3272639 - RNA, 22 nt, Mycobacterium tuberculosis H37Rv
aucccggucuuuaauccagcgc

SEQ ID NO: 3272640 - RNA, 13 nt, Mycobacterium tuberculosis H37Rv
aucccgguggcag

SEQ ID NO: 3272641 - RNA, 21 nt, Mycobacterium tuberculosis H37Rv
aucccguauugauacugcccg

SEQ ID NO: 3272642 - RNA, 13 nt, Mycobacterium tuberculosis H37Rv
aucccgucgggca

SEQ ID NO: 3272643 - RNA, 21 nt, Mycobacterium tuberculosis H37Rv
aucccuccgccaaggaggcca

SEQ ID NO: 3272644 - RNA, 22 nt, Mycobacterium tuberculosis H37Rv
auccgaacuucgugggggaccu

SEQ ID NO: 3272645 - RNA, 19 nt, Mycobacterium tuberculosis H37Rv
auccgacacugcggccgau

SEQ ID NO: 3272646 - RNA, 13 nt, Mycobacterium tuberculosis H37Rv
auccgaccugcuc

SEQ ID NO: 3272647 - RNA, 17 nt, Mycobacterium tuberculosis H37Rv
auccgacgaaccgggac

SEQ ID NO: 3272648 - RNA, 23 nt, Mycobacterium tuberculosis H37Rv
caaccucgguugguccucggcgg

SEQ ID NO: 3272649 - RNA, 13 nt, Mycobacterium tuberculosis H37Rv
caaccugcgacca

SEQ ID NO: 3272650 - RNA, 21 nt, Mycobacterium tuberculosis H37Rv
caaccuuugcguugcugagca

SEQ ID NO: 3272651 - RNA, 14 nt, Mycobacterium tuberculosis H37Rv
caacgaaaccgacc

SEQ ID NO: 3272652 - RNA, 15 nt, Mycobacterium tuberculosis H37Rv
caacgaaaccgaccu

SEQ ID NO: 3272653 - RNA, 16 nt, Mycobacterium tuberculosis H37Rv
caacgaaccagcuugc

SEQ ID NO: 3272654 - RNA, 14 nt, Mycobacterium tuberculosis H37Rv
caacgaaccgcuca

SEQ ID NO: 3272655 - RNA, 19 nt, Mycobacterium tuberculosis H37Rv
caacgaaccgcucagcgca

SEQ ID NO: 3272656 - RNA, 20 nt, Mycobacterium tuberculosis H37Rv
caacgaaccgcucagcgcag

SEQ ID NO: 3272657 - RNA, 18 nt, Mycobacterium tuberculosis H37Rv
caacgaagccggcgccgg

SEQ ID NO: 3272658 - RNA, 21 nt, Mycobacterium tuberculosis H37Rv
caacgaaugguaucgaguggc

SEQ ID NO: 3272659 - RNA, 15 nt, Mycobacterium tuberculosis H37Rv
caacgacaccagauc

SEQ ID NO: 3272660 - RNA, 15 nt, Mycobacterium tuberculosis H37Rv
caacgacacgccgca

SEQ ID NO: 3272661 - RNA, 21 nt, Mycobacterium tuberculosis H37Rv
caacgacaggcgcccacaaau

SEQ ID NO: 3272662 - RNA, 22 nt, Mycobacterium tuberculosis H37Rv
caacgacaggcgcccacaaaua

SEQ ID NO: 3272663 - RNA, 23 nt, Mycobacterium tuberculosis H37Rv
caacgacauccagaugcccagca

SEQ ID NO: 3272664 - RNA, 17 nt, Mycobacterium tuberculosis H37Rv
caacgacaugagcgcca

SEQ ID NO: 3272665 - RNA, 13 nt, Mycobacterium tuberculosis H37Rv
caacgaccaccac

SEQ ID NO: 3272666 - RNA, 15 nt, Mycobacterium tuberculosis H37Rv
caacgaccaccacca

SEQ ID NO: 3272667 - RNA, 18 nt, Mycobacterium tuberculosis H37Rv
caacgacgcuaaauuuug

SEQ ID NO: 3272668 - RNA, 14 nt, Mycobacterium tuberculosis H37Rv
caacgacggcaagc

SEQ ID NO: 3272669 - RNA, 15 nt, Mycobacterium tuberculosis H37Rv
caacgacuccuggcg

SEQ ID NO: 3272670 - RNA, 23 nt, Mycobacterium tuberculosis H37Rv
caacgacucucaucgacucgacc

SEQ ID NO: 3272671 - RNA, 18 nt, Mycobacterium tuberculosis H37Rv
caacgacugaucaagugc

SEQ ID NO: 3272672 - RNA, 18 nt, Mycobacterium tuberculosis H37Rv
caacgacuucgggaacgc

SEQ ID NO: 3272673 - RNA, 21 nt, Mycobacterium tuberculosis H37Rv
caacgacuucgggaacgcucg

SEQ ID NO: 3272674 - RNA, 20 nt, Mycobacterium tuberculosis H37Rv
caacgagagcggcuccggga

SEQ ID NO: 3272675 - RNA, 14 nt, Mycobacterium tuberculosis H37Rv
caacgagauccagc

SEQ ID NO: 3272676 - RNA, 15 nt, Mycobacterium tuberculosis H37Rv
caacgagcgcgcugc

SEQ ID NO: 3272677 - RNA, 12 nt, Mycobacterium tuberculosis H37Rv
caacgaucaggu

SEQ ID NO: 3272678 - RNA, 20 nt, Mycobacterium tuberculosis H37Rv
caacgaucccggggugccga

SEQ ID NO: 3272679 - RNA, 14 nt, Mycobacterium tuberculosis H37Rv
caacgaucgcgcga

SEQ ID NO: 3272680 - RNA, 13 nt, Mycobacterium tuberculosis H37Rv
caacgaucugcug

SEQ ID NO: 3272681 - RNA, 19 nt, Mycobacterium tuberculosis H37Rv
caacgaugguggcgaucau

SEQ ID NO: 3272682 - RNA, 23 nt, Mycobacterium tuberculosis H37Rv
caacgcaacacgggcgccggaac

SEQ ID NO: 3272683 - RNA, 16 nt, Mycobacterium tuberculosis H37Rv
caacgcaaucgacuga

SEQ ID NO: 3272684 - RNA, 13 nt, Mycobacterium tuberculosis H37Rv
caacgcacacacc

SEQ ID NO: 3272685 - RNA, 19 nt, Mycobacterium tuberculosis H37Rv
caacgcagcacguucaggu

SEQ ID NO: 3272686 - RNA, 18 nt, Mycobacterium tuberculosis H37Rv
caacgcaucgaugcgugc

SEQ ID NO: 3272687 - RNA, 15 nt, Mycobacterium tuberculosis H37Rv
caacgcaucgguggc

SEQ ID NO: 3272688 - RNA, 15 nt, Mycobacterium tuberculosis H37Rv
caacgccaaaauggu

SEQ ID NO: 3272689 - RNA, 23 nt, Mycobacterium tuberculosis H37Rv
caacgccacgccgaugauggaca

SEQ ID NO: 3272690 - RNA, 23 nt, Mycobacterium tuberculosis H37Rv
caacgccacugcgccgugaccca

SEQ ID NO: 3272691 - RNA, 13 nt, Mycobacterium tuberculosis H37Rv
caacgccagcugc

SEQ ID NO: 3272692 - RNA, 21 nt, Mycobacterium tuberculosis H37Rv
caacgccaucaccccggccuu

SEQ ID NO: 3272693 - RNA, 20 nt, Mycobacterium tuberculosis H37Rv
caacgccauuuccuggcgca

SEQ ID NO: 3272694 - RNA, 18 nt, Mycobacterium tuberculosis H37Rv
caacgcccaacgucgcca

SEQ ID NO: 3272695 - RNA, 20 nt, Mycobacterium tuberculosis H37Rv
caacgcccccauccggucga

SEQ ID NO: 3272696 - RNA, 14 nt, Mycobacterium tuberculosis H37Rv
caacgcccgggcga

SEQ ID NO: 3272697 - RNA, 21 nt, Mycobacterium tuberculosis H37Rv
caacgccgccuugacccuccg

SEQ ID NO: 3272698 - RNA, 17 nt, Mycobacterium tuberculosis H37Rv
caacgccggcgacggcg

SEQ ID NO: 3272699 - RNA, 18 nt, Mycobacterium tuberculosis H37Rv
caacgccucugcucagcc

SEQ ID NO: 3272700 - RNA, 20 nt, Mycobacterium tuberculosis H37Rv
caacgccucugcucagccgu

SEQ ID NO: 3272701 - RNA, 17 nt, Mycobacterium tuberculosis H37Rv
caacgcgaaccgucucg

SEQ ID NO: 3272702 - RNA, 23 nt, Mycobacterium tuberculosis H37Rv
caacgcgaucaccucgccacacu

SEQ ID NO: 3272703 - RNA, 17 nt, Mycobacterium tuberculosis H37Rv
caacgcgaugccgucca

SEQ ID NO: 3272704 - RNA, 22 nt, Mycobacterium tuberculosis H37Rv
caacgcgauguccagguggcgc

SEQ ID NO: 3272705 - RNA, 15 nt, Mycobacterium tuberculosis H37Rv
caacgcgcaaccagc

SEQ ID NO: 3272706 - RNA, 16 nt, Mycobacterium tuberculosis H37Rv
caacgcgcacgcgugc

SEQ ID NO: 3272707 - RNA, 15 nt, Mycobacterium tuberculosis H37Rv
caacgcgcagagcgu

SEQ ID NO: 3272708 - RNA, 20 nt, Mycobacterium tuberculosis H37Rv
caacgcgcagagcguuccgc

SEQ ID NO: 3272709 - RNA, 15 nt, Mycobacterium tuberculosis H37Rv
caacgcgcgaccgcg

SEQ ID NO: 3272710 - RNA, 19 nt, Mycobacterium tuberculosis H37Rv
caacgcgcgcacgccaccg

SEQ ID NO: 3272711 - RNA, 22 nt, Mycobacterium tuberculosis H37Rv
caacgcgggaacgaugccgccg

SEQ ID NO: 3272712 - RNA, 18 nt, Mycobacterium tuberculosis H37Rv
caacgcgggugccgggca

SEQ ID NO: 3272713 - RNA, 14 nt, Mycobacterium tuberculosis H37Rv
caacgcggucugcu

SEQ ID NO: 3272714 - RNA, 15 nt, Mycobacterium tuberculosis H37Rv
caacgcggucugcuc

SEQ ID NO: 3272715 - RNA, 14 nt, Mycobacterium tuberculosis H37Rv
caacgcggugacga

SEQ ID NO: 3272716 - RNA, 15 nt, Mycobacterium tuberculosis H37Rv
caacgcggugggcac

SEQ ID NO: 3272717 - RNA, 18 nt, Mycobacterium tuberculosis H37Rv
caacgcggugggcacagc

SEQ ID NO: 3272718 - RNA, 19 nt, Mycobacterium tuberculosis H37Rv
caacgcggugggcacagcc

SEQ ID NO: 3272719 - RNA, 17 nt, Mycobacterium tuberculosis H37Rv
caacgcguugcacagca

SEQ ID NO: 3272720 - RNA, 12 nt, Mycobacterium tuberculosis H37Rv
caacgcugcagc

SEQ ID NO: 3272721 - RNA, 16 nt, Mycobacterium tuberculosis H37Rv
caacgcugcagcaggu

SEQ ID NO: 3272722 - RNA, 18 nt, Mycobacterium tuberculosis H37Rv
caacgcuucggcagcucc

SEQ ID NO: 3272723 - RNA, 15 nt, Mycobacterium tuberculosis H37Rv
caacgcuucggcgug

SEQ ID NO: 3272724 - RNA, 14 nt, Mycobacterium tuberculosis H37Rv
caacgcuucugccu

SEQ ID NO: 3272725 - RNA, 21 nt, Mycobacterium tuberculosis H37Rv
caacggaagaagcaguagcug

SEQ ID NO: 3272726 - RNA, 16 nt, Mycobacterium tuberculosis H37Rv
caacggaagaccgcgg

SEQ ID NO: 3272727 - RNA, 23 nt, Mycobacterium tuberculosis H37Rv
caacggaaucgguuucgaccugc

SEQ ID NO: 3272728 - RNA, 22 nt, Mycobacterium tuberculosis H37Rv
caacggacgaagcaccucccga

SEQ ID NO: 3272729 - RNA, 17 nt, Mycobacterium tuberculosis H37Rv
caacggacgggaucgcc

SEQ ID NO: 3272730 - RNA, 14 nt, Mycobacterium tuberculosis H37Rv
caacggcacccgaa

SEQ ID NO: 3272731 - RNA, 19 nt, Mycobacterium tuberculosis H37Rv
caacggcacccugcggcac

SEQ ID NO: 3272732 - RNA, 17 nt, Mycobacterium tuberculosis H37Rv
caacggcaccucgacgu

SEQ ID NO: 3272733 - RNA, 20 nt, Mycobacterium tuberculosis H37Rv
caacggcaccucgacgucga

SEQ ID NO: 3272734 - RNA, 19 nt, Mycobacterium tuberculosis H37Rv
caacggcacuagcccgacc

SEQ ID NO: 3272735 - RNA, 21 nt, Mycobacterium tuberculosis H37Rv
caacggcagaucccacgccag

SEQ ID NO: 3272736 - RNA, 23 nt, Mycobacterium tuberculosis H37Rv
caacggcagaucccacgccagga

SEQ ID NO: 3272737 - RNA, 17 nt, Mycobacterium tuberculosis H37Rv
caacggcagcgccaccg

SEQ ID NO: 3272738 - RNA, 17 nt, Mycobacterium tuberculosis H37Rv
caacggccacaugccac

SEQ ID NO: 3272739 - RNA, 13 nt, Mycobacterium tuberculosis H37Rv
caacggcgcggca

SEQ ID NO: 3272740 - RNA, 15 nt, Mycobacterium tuberculosis H37Rv
caacggcggcgucgc

SEQ ID NO: 3272741 - RNA, 15 nt, Mycobacterium tuberculosis H37Rv
caacgggaccgaucu

SEQ ID NO: 3272742 - RNA, 22 nt, Mycobacterium tuberculosis H37Rv
caacgggccuucagcucaccac

SEQ ID NO: 3272743 - RNA, 18 nt, Mycobacterium tuberculosis H37Rv
caacgggccuucgccacu

SEQ ID NO: 3272744 - RNA, 14 nt, Mycobacterium tuberculosis H37Rv
caacgguacgcgcu

SEQ ID NO: 3272745 - RNA, 19 nt, Mycobacterium tuberculosis H37Rv
caacgguuggucgaacaga

SEQ ID NO: 3272746 - RNA, 17 nt, Mycobacterium tuberculosis H37Rv
caacguacgcacgcagc

SEQ ID NO: 3272747 - RNA, 14 nt, Mycobacterium tuberculosis H37Rv
caacgucacgucga

SEQ ID NO: 3272748 - RNA, 17 nt, Mycobacterium tuberculosis H37Rv
caacgucacgucgacgg

SEQ ID NO: 3272749 - RNA, 22 nt, Mycobacterium tuberculosis H37Rv
caacgucgcuccgaugugccga

SEQ ID NO: 3272750 - RNA, 22 nt, Mycobacterium tuberculosis H37Rv
caacgucuugcuggucgauggc

SEQ ID NO: 3272751 - RNA, 13 nt, Mycobacterium tuberculosis H37Rv
caacgugaacugu

SEQ ID NO: 3272752 - RNA, 23 nt, Mycobacterium tuberculosis H37Rv
caacgugacccggauaucgacca

SEQ ID NO: 3272753 - RNA, 18 nt, Mycobacterium tuberculosis H37Rv
caacgugccgaacgccag

SEQ ID NO: 3272754 - RNA, 20 nt, Mycobacterium tuberculosis H37Rv
caacgugcgcaacgcgucgu

SEQ ID NO: 3272755 - RNA, 20 nt, Mycobacterium tuberculosis H37Rv
caacgugguauugacguggc

SEQ ID NO: 3272756 - RNA, 18 nt, Mycobacterium tuberculosis H37Rv
caacguucggcacaacca

SEQ ID NO: 3272757 - RNA, 20 nt, Mycobacterium tuberculosis H37Rv
caacguuuugggcgccggag

SEQ ID NO: 3272758 - RNA, 22 nt, Mycobacterium tuberculosis H37Rv
caacuaccuguugacacaacga

SEQ ID NO: 3272759 - RNA, 18 nt, Mycobacterium tuberculosis H37Rv
caacuagccgcugccugg

SEQ ID NO: 3272760 - RNA, 19 nt, Mycobacterium tuberculosis H37Rv
caacuaucgucgugucgcc

SEQ ID NO: 3272761 - RNA, 23 nt, Mycobacterium tuberculosis H37Rv
caacuaucgucgugucgccgccg

SEQ ID NO: 3272762 - RNA, 20 nt, Mycobacterium tuberculosis H37Rv
caacuccaagaugccgcccc

SEQ ID NO: 3272763 - RNA, 15 nt, Mycobacterium tuberculosis H37Rv
caacucccagcacgg

SEQ ID NO: 3272764 - RNA, 18 nt, Mycobacterium tuberculosis H37Rv
caacucccgaacuggcug

SEQ ID NO: 3272765 - RNA, 13 nt, Mycobacterium tuberculosis H37Rv
caacuccucagcc

SEQ ID NO: 3272766 - RNA, 17 nt, Mycobacterium tuberculosis H37Rv
caacucgaacgucacca

SEQ ID NO: 3272767 - RNA, 19 nt, Mycobacterium tuberculosis H37Rv
caacucgagaguggccucg

SEQ ID NO: 3272768 - RNA, 20 nt, Mycobacterium tuberculosis H37Rv
caacucgagaguggccucgu

SEQ ID NO: 3272769 - RNA, 15 nt, Mycobacterium tuberculosis H37Rv
caacucgaucgccug

SEQ ID NO: 3272770 - RNA, 15 nt, Mycobacterium tuberculosis H37Rv
caacucggccacggc

SEQ ID NO: 3272771 - RNA, 21 nt, Mycobacterium tuberculosis H37Rv
caacucggccacggcgucggc

SEQ ID NO: 3272772 - RNA, 13 nt, Mycobacterium tuberculosis H37Rv
caacucgggcagc

SEQ ID NO: 3272773 - RNA, 19 nt, Mycobacterium tuberculosis H37Rv
caacucgggcagcgcggcc

SEQ ID NO: 3272774 - RNA, 17 nt, Mycobacterium tuberculosis H37Rv
caacucgguucgccccu

SEQ ID NO: 3272775 - RNA, 17 nt, Mycobacterium tuberculosis H37Rv
caacucguccagcagug

SEQ ID NO: 3272776 - RNA, 20 nt, Mycobacterium tuberculosis H37Rv
caacucguccagcagugcga

SEQ ID NO: 3272777 - RNA, 16 nt, Mycobacterium tuberculosis H37Rv
caacucuucagcaagc

SEQ ID NO: 3272778 - RNA, 20 nt, Mycobacterium tuberculosis H37Rv
caacucuucccauuucggca

SEQ ID NO: 3272779 - RNA, 18 nt, Mycobacterium tuberculosis H37Rv
caacugauggcgcgcaac

SEQ ID NO: 3272780 - RNA, 18 nt, Mycobacterium tuberculosis H37Rv
caacugccgcacccgguc

SEQ ID NO: 3272781 - RNA, 17 nt, Mycobacterium tuberculosis H37Rv
caacugcggcaggucuu

SEQ ID NO: 3272782 - RNA, 23 nt, Mycobacterium tuberculosis H37Rv
caacugggcggccuggucggcca

SEQ ID NO: 3272783 - RNA, 20 nt, Mycobacterium tuberculosis H37Rv
caacuggucgccaacgccag

SEQ ID NO: 3272784 - RNA, 21 nt, Mycobacterium tuberculosis H37Rv
caacuggugggccaucgucag

SEQ ID NO: 3272785 - RNA, 16 nt, Mycobacterium tuberculosis H37Rv
caacuguccugccaga

SEQ ID NO: 3272786 - RNA, 16 nt, Mycobacterium tuberculosis H37Rv
caacuucaccacccug

SEQ ID NO: 3272787 - RNA, 16 nt, Mycobacterium tuberculosis H37Rv
caacuucuucagcagc

SEQ ID NO: 3272788 - RNA, 21 nt, Mycobacterium tuberculosis H37Rv
caacuuggcggccagccgcuc

SEQ ID NO: 3272789 - RNA, 21 nt, Mycobacterium tuberculosis H37Rv
caacuuggggucguucgccga

SEQ ID NO: 3272790 - RNA, 17 nt, Mycobacterium tuberculosis H37Rv
caagaaacagguaagca

SEQ ID NO: 3272791 - RNA, 15 nt, Mycobacterium tuberculosis H37Rv
caagaaccacgacgu

SEQ ID NO: 3272792 - RNA, 17 nt, Mycobacterium tuberculosis H37Rv
caagaaguacagcuggc

SEQ ID NO: 3272793 - RNA, 16 nt, Mycobacterium tuberculosis H37Rv
caagaaucagcagcag

SEQ ID NO: 3272794 - RNA, 20 nt, Mycobacterium tuberculosis H37Rv
caagaaugccgccgacggga

SEQ ID NO: 3272795 - RNA, 18 nt, Mycobacterium tuberculosis H37Rv
caagaauggccgccuuga

SEQ ID NO: 3272796 - RNA, 17 nt, Mycobacterium tuberculosis H37Rv
caagaccaagugucgcc

SEQ ID NO: 3272797 - RNA, 21 nt, Mycobacterium tuberculosis H37Rv
caagaccaagugucgccgcuc

SEQ ID NO: 3272798 - RNA, 17 nt, Mycobacterium tuberculosis H37Rv
caagacgaacagcacga

SEQ ID NO: 3272799 - RNA, 16 nt, Mycobacterium tuberculosis H37Rv
caagacgauucaccaa

SEQ ID NO: 3272800 - RNA, 21 nt, Mycobacterium tuberculosis H37Rv
caagagccguccgaccaggga

SEQ ID NO: 3272801 - RNA, 21 nt, Mycobacterium tuberculosis H37Rv
caagaucagcgguuugccagu

SEQ ID NO: 3272802 - RNA, 16 nt, Mycobacterium tuberculosis H37Rv
caagaucggcgccccu

SEQ ID NO: 3272803 - RNA, 17 nt, Mycobacterium tuberculosis H37Rv
caagaugccugacacga

SEQ ID NO: 3272804 - RNA, 14 nt, Mycobacterium tuberculosis H37Rv
caagauggcgcgcu

SEQ ID NO: 3272805 - RNA, 18 nt, Mycobacterium tuberculosis H37Rv
caagauuaccgaagcccg

SEQ ID NO: 3272806 - RNA, 14 nt, Mycobacterium tuberculosis H37Rv
caagcaaccggugc

SEQ ID NO: 3272807 - RNA, 16 nt, Mycobacterium tuberculosis H37Rv
caagcaaugggcggac

SEQ ID NO: 3272808 - RNA, 15 nt, Mycobacterium tuberculosis H37Rv
caagcacaccgccag

SEQ ID NO: 3272809 - RNA, 17 nt, Mycobacterium tuberculosis H37Rv
caagcacaccgccagcg

SEQ ID NO: 3272810 - RNA, 22 nt, Mycobacterium tuberculosis H37Rv
caagcacagcccggcgacgacc

SEQ ID NO: 3272811 - RNA, 14 nt, Mycobacterium tuberculosis H37Rv
caagcacagcgaac

SEQ ID NO: 3272812 - RNA, 18 nt, Mycobacterium tuberculosis H37Rv
caagcacagcgaacagac

SEQ ID NO: 3272813 - RNA, 22 nt, Mycobacterium tuberculosis H37Rv
caagcacauuauucuucgcggc

SEQ ID NO: 3272814 - RNA, 12 nt, Mycobacterium tuberculosis H37Rv
caagcagcagca

SEQ ID NO: 3272815 - RNA, 14 nt, Mycobacterium tuberculosis H37Rv
caagcagcccgggu

SEQ ID NO: 3272816 - RNA, 16 nt, Mycobacterium tuberculosis H37Rv
caagcagcccggguga

SEQ ID NO: 3272817 - RNA, 16 nt, Mycobacterium tuberculosis H37Rv
caagcagcgaccagca

SEQ ID NO: 3272818 - RNA, 16 nt, Mycobacterium tuberculosis H37Rv
caagcaguccacgagc

SEQ ID NO: 3272819 - RNA, 19 nt, Mycobacterium tuberculosis H37Rv
caagcaguccacgagcacg

SEQ ID NO: 3272820 - RNA, 17 nt, Mycobacterium tuberculosis H37Rv
caagcagucgguauagc

SEQ ID NO: 3272821 - RNA, 16 nt, Mycobacterium tuberculosis H37Rv
caagcauuggcgucga

SEQ ID NO: 3272822 - RNA, 12 nt, Mycobacterium tuberculosis H37Rv
caagccaagcgu

SEQ ID NO: 3272823 - RNA, 13 nt, Mycobacterium tuberculosis H37Rv
caagccagcacug

SEQ ID NO: 3272824 - RNA, 14 nt, Mycobacterium tuberculosis H37Rv
caagccagcacugc

SEQ ID NO: 3272825 - RNA, 16 nt, Mycobacterium tuberculosis H37Rv
caagccagcacugcca

SEQ ID NO: 3272826 - RNA, 17 nt, Mycobacterium tuberculosis H37Rv
caagccagcacugccau

SEQ ID NO: 3272827 - RNA, 14 nt, Mycobacterium tuberculosis H37Rv
caagccagcguugg

SEQ ID NO: 3272828 - RNA, 18 nt, Mycobacterium tuberculosis H37Rv
caagccauguggcgucgc

SEQ ID NO: 3272829 - RNA, 21 nt, Mycobacterium tuberculosis H37Rv
caagcccgauucagcgcccca

SEQ ID NO: 3272830 - RNA, 20 nt, Mycobacterium tuberculosis H37Rv
caagccgagcccgucgauca

SEQ ID NO: 3272831 - RNA, 16 nt, Mycobacterium tuberculosis H37Rv
caagccgcgagucgcc

SEQ ID NO: 3272832 - RNA, 22 nt, Mycobacterium tuberculosis H37Rv
caagccgcugauguacccggcg

SEQ ID NO: 3272833 - RNA, 19 nt, Mycobacterium tuberculosis H37Rv
caagccguagaccaggccc

SEQ ID NO: 3272834 - RNA, 21 nt, Mycobacterium tuberculosis H37Rv
caagccguaguaguggccgcc

SEQ ID NO: 3272835 - RNA, 14 nt, Mycobacterium tuberculosis H37Rv
caagccgugcagcu

SEQ ID NO: 3272836 - RNA, 15 nt, Mycobacterium tuberculosis H37Rv
caagccgugccgcac

SEQ ID NO: 3272837 - RNA, 20 nt, Mycobacterium tuberculosis H37Rv
caagccucguggugagauca

SEQ ID NO: 3272838 - RNA, 21 nt, Mycobacterium tuberculosis H37Rv
caagccucuauacgccugcuc

SEQ ID NO: 3272839 - RNA, 12 nt, Mycobacterium tuberculosis H37Rv
caagccugccga

SEQ ID NO: 3272840 - RNA, 15 nt, Mycobacterium tuberculosis H37Rv
caagccuuaccccgc

SEQ ID NO: 3272841 - RNA, 24 nt, Mycobacterium tuberculosis H37Rv
caagccuuaccccgcagcucaccu

SEQ ID NO: 3272842 - RNA, 17 nt, Mycobacterium tuberculosis H37Rv
caagccuucgucgaugc

SEQ ID NO: 3272843 - RNA, 12 nt, Mycobacterium tuberculosis H37Rv
caagcgauggca

SEQ ID NO: 3272844 - RNA, 13 nt, Mycobacterium tuberculosis H37Rv
caagcgcagccug

SEQ ID NO: 3272845 - RNA, 22 nt, Mycobacterium tuberculosis H37Rv
caagcgcaucgcacagcgccgc

SEQ ID NO: 3272846 - RNA, 23 nt, Mycobacterium tuberculosis H37Rv
caagcggacccgaccgucgucgu

SEQ ID NO: 3272847 - RNA, 23 nt, Mycobacterium tuberculosis H37Rv
caagcggguuguggcacccggcu

SEQ ID NO: 3272848 - RNA, 15 nt, Mycobacterium tuberculosis H37Rv
caagcgucgcaaaca

SEQ ID NO: 3272849 - RNA, 13 nt, Mycobacterium tuberculosis H37Rv
caagcgugacccg

SEQ ID NO: 3272850 - RNA, 14 nt, Mycobacterium tuberculosis H37Rv
caagcgugcugccg

SEQ ID NO: 3272851 - RNA, 14 nt, Mycobacterium tuberculosis H37Rv
caagcuaacucgac

SEQ ID NO: 3272852 - RNA, 21 nt, Mycobacterium tuberculosis H37Rv
caagcucagggugggcgacgu

SEQ ID NO: 3272853 - RNA, 16 nt, Mycobacterium tuberculosis H37Rv
caagcucgacaacugc

SEQ ID NO: 3272854 - RNA, 14 nt, Mycobacterium tuberculosis H37Rv
caagcucggccacc

SEQ ID NO: 3272855 - RNA, 18 nt, Mycobacterium tuberculosis H37Rv
caagcucggccaccagcg

SEQ ID NO: 3272856 - RNA, 15 nt, Mycobacterium tuberculosis H37Rv
caagcucggccagca

SEQ ID NO: 3272857 - RNA, 16 nt, Mycobacterium tuberculosis H37Rv
caagcucggcccagcg

SEQ ID NO: 3272858 - RNA, 21 nt, Mycobacterium tuberculosis H37Rv
caagcucggcccagcgcgcca

SEQ ID NO: 3272859 - RNA, 12 nt, Mycobacterium tuberculosis H37Rv
caagcucguccg

SEQ ID NO: 3272860 - RNA, 21 nt, Mycobacterium tuberculosis H37Rv
caagcucguccggugcgaucc

SEQ ID NO: 3272861 - RNA, 19 nt, Mycobacterium tuberculosis H37Rv
caagcucuuccauuaggcu

SEQ ID NO: 3272862 - RNA, 22 nt, Mycobacterium tuberculosis H37Rv
caagcugacacgacgaacuagg

SEQ ID NO: 3272863 - RNA, 18 nt, Mycobacterium tuberculosis H37Rv
caagcugccccgccaccu

SEQ ID NO: 3272864 - RNA, 23 nt, Mycobacterium tuberculosis H37Rv
caagcuguuuggggucgcgcugc

SEQ ID NO: 3272865 - RNA, 14 nt, Mycobacterium tuberculosis H37Rv
caaggaagccgcgg

SEQ ID NO: 3272866 - RNA, 14 nt, Mycobacterium tuberculosis H37Rv
caaggccaccgucg

SEQ ID NO: 3272867 - RNA, 15 nt, Mycobacterium tuberculosis H37Rv
caaggcccgcaccgc

SEQ ID NO: 3272868 - RNA, 14 nt, Mycobacterium tuberculosis H37Rv
caaggccgaccugu

SEQ ID NO: 3272869 - RNA, 13 nt, Mycobacterium tuberculosis H37Rv
caaggccgccugc

SEQ ID NO: 3272870 - RNA, 14 nt, Mycobacterium tuberculosis H37Rv
caaggccgucgacc

SEQ ID NO: 3272871 - RNA, 19 nt, Mycobacterium tuberculosis H37Rv
caaggcgcuaaaacgccag

SEQ ID NO: 3272872 - RNA, 23 nt, Mycobacterium tuberculosis H37Rv
caaggcgcuaaaacgccagucga

SEQ ID NO: 3272873 - RNA, 14 nt, Mycobacterium tuberculosis H37Rv
caaggcggucacca

SEQ ID NO: 3272874 - RNA, 22 nt, Mycobacterium tuberculosis H37Rv
caaggcgugagcuaugcuggca

SEQ ID NO: 3272875 - RNA, 16 nt, Mycobacterium tuberculosis H37Rv
caaggcgugcaccccc

SEQ ID NO: 3272876 - RNA, 20 nt, Mycobacterium tuberculosis H37Rv
caaggcguugguagccaggg

SEQ ID NO: 3272877 - RNA, 15 nt, Mycobacterium tuberculosis H37Rv
caaggcucagcagcg

SEQ ID NO: 3272878 - RNA, 17 nt, Mycobacterium tuberculosis H37Rv
caaggcucagcagcgcc

SEQ ID NO: 3272879 - RNA, 19 nt, Mycobacterium tuberculosis H37Rv
caagggaauccgaacucgc

SEQ ID NO: 3272880 - RNA, 23 nt, Mycobacterium tuberculosis H37Rv
caagggcgcgagcagacgcagaa

SEQ ID NO: 3272881 - RNA, 21 nt, Mycobacterium tuberculosis H37Rv
caagggcugugucugacgcua

SEQ ID NO: 3272882 - RNA, 16 nt, Mycobacterium tuberculosis H37Rv
caaggggcagcacguc

SEQ ID NO: 3272883 - RNA, 14 nt, Mycobacterium tuberculosis H37Rv
caagggugcccgga

SEQ ID NO: 3272884 - RNA, 21 nt, Mycobacterium tuberculosis H37Rv
caagggugcuugucgccgcgu

SEQ ID NO: 3272885 - RNA, 19 nt, Mycobacterium tuberculosis H37Rv
caagguauagccggagcgc

SEQ ID NO: 3272886 - RNA, 20 nt, Mycobacterium tuberculosis H37Rv
caagguauagccggagcgca

SEQ ID NO: 3272887 - RNA, 22 nt, Mycobacterium tuberculosis H37Rv
caaggucaucacuaaccuggcg

SEQ ID NO: 3272888 - RNA, 13 nt, Mycobacterium tuberculosis H37Rv
caagguccagcga

SEQ ID NO: 3272889 - RNA, 15 nt, Mycobacterium tuberculosis H37Rv
caaggugcgccgcca

SEQ ID NO: 3272890 - RNA, 24 nt, Mycobacterium tuberculosis H37Rv
caagguggcaugcgacagaugccg

SEQ ID NO: 3272891 - RNA, 13 nt, Mycobacterium tuberculosis H37Rv
caagguggccacc

SEQ ID NO: 3272892 - RNA, 14 nt, Mycobacterium tuberculosis H37Rv
caagguggccacca

SEQ ID NO: 3272893 - RNA, 19 nt, Mycobacterium tuberculosis H37Rv
caagguggccaccaaacgc

SEQ ID NO: 3272894 - RNA, 15 nt, Mycobacterium tuberculosis H37Rv
caagguggcggccag

SEQ ID NO: 3272895 - RNA, 23 nt, Mycobacterium tuberculosis H37Rv
caagguggcggccaguucggcgg

SEQ ID NO: 3272896 - RNA, 17 nt, Mycobacterium tuberculosis H37Rv
caagguguccagcaccu

SEQ ID NO: 3272897 - RNA, 21 nt, Mycobacterium tuberculosis H37Rv
caagguguugcggugggugaa

SEQ ID NO: 3272898 - RNA, 18 nt, Mycobacterium tuberculosis H37Rv
caagguuucgacaucacu

SEQ ID NO: 3272899 - RNA, 19 nt, Mycobacterium tuberculosis H37Rv
caaguacgcgaccgcgauc

SEQ ID NO: 3272900 - RNA, 17 nt, Mycobacterium tuberculosis H37Rv
caagucaacccugccac

SEQ ID NO: 3272901 - RNA, 17 nt, Mycobacterium tuberculosis H37Rv
caagucacagcucacca

SEQ ID NO: 3272902 - RNA, 13 nt, Mycobacterium tuberculosis H37Rv
caagucagcccga

SEQ ID NO: 3272903 - RNA, 22 nt, Mycobacterium tuberculosis H37Rv
caagucauccaggucgccuucc

SEQ ID NO: 3272904 - RNA, 18 nt, Mycobacterium tuberculosis H37Rv
caagucgacacgccgaac

SEQ ID NO: 3272905 - RNA, 19 nt, Mycobacterium tuberculosis H37Rv
caagucgaccaugagccgg

SEQ ID NO: 3272906 - RNA, 20 nt, Mycobacterium tuberculosis H37Rv
caagucgacgguggcgccgu

SEQ ID NO: 3272907 - RNA, 14 nt, Mycobacterium tuberculosis H37Rv
caagucgauguaca

SEQ ID NO: 3272908 - RNA, 17 nt, Mycobacterium tuberculosis H37Rv
caagucggcaccggugc

SEQ ID NO: 3272909 - RNA, 16 nt, Mycobacterium tuberculosis H37Rv
caagucggcgcuggcc

SEQ ID NO: 3272910 - RNA, 15 nt, Mycobacterium tuberculosis H37Rv
caagucugcccgacu

SEQ ID NO: 3272911 - RNA, 19 nt, Mycobacterium tuberculosis H37Rv
caagugcuuccggccauug

SEQ ID NO: 3272912 - RNA, 20 nt, Mycobacterium tuberculosis H37Rv
caaguggcgcucgcaaacaa

SEQ ID NO: 3272913 - RNA, 20 nt, Mycobacterium tuberculosis H37Rv
caaguggucgaugaaccaau

SEQ ID NO: 3272914 - RNA, 13 nt, Mycobacterium tuberculosis H37Rv
caagugucgccgc

SEQ ID NO: 3272915 - RNA, 19 nt, Mycobacterium tuberculosis H37Rv
caagugucuccggcaacag

SEQ ID NO: 3272916 - RNA, 16 nt, Mycobacterium tuberculosis H37Rv
caagugugagcagacc

SEQ ID NO: 3272917 - RNA, 20 nt, Mycobacterium tuberculosis H37Rv
caaguucgccgauaucgcag

SEQ ID NO: 3272918 - RNA, 21 nt, Mycobacterium tuberculosis H37Rv
caaguucggccgagugcacgc

SEQ ID NO: 3272919 - RNA, 20 nt, Mycobacterium tuberculosis H37Rv
caaguugaccuucaccugga

SEQ ID NO: 3272920 - RNA, 17 nt, Mycobacterium tuberculosis H37Rv
caaguugagcagcuugg

SEQ ID NO: 3272921 - RNA, 19 nt, Mycobacterium tuberculosis H37Rv
caauaagggagaccgcggc

SEQ ID NO: 3272922 - RNA, 23 nt, Mycobacterium tuberculosis H37Rv
caauacccgagcguccggugguc

SEQ ID NO: 3272923 - RNA, 15 nt, Mycobacterium tuberculosis H37Rv
caauaccgcacccgc

SEQ ID NO: 3272924 - RNA, 17 nt, Mycobacterium tuberculosis H37Rv
caauaccgccagcgcca

SEQ ID NO: 3272925 - RNA, 21 nt, Mycobacterium tuberculosis H37Rv
caauaccgccagcgccaccgu

SEQ ID NO: 3272926 - RNA, 15 nt, Mycobacterium tuberculosis H37Rv
caauacguagucgcc

SEQ ID NO: 3272927 - RNA, 19 nt, Mycobacterium tuberculosis H37Rv
caauacgugcgaaucgaga

SEQ ID NO: 3272928 - RNA, 15 nt, Mycobacterium tuberculosis H37Rv
caauagaagcacguc

SEQ ID NO: 3272929 - RNA, 14 nt, Mycobacterium tuberculosis H37Rv
caauagccggaucc

SEQ ID NO: 3272930 - RNA, 20 nt, Mycobacterium tuberculosis H37Rv
caauagcgacagcagcgcca

SEQ ID NO: 3272931 - RNA, 23 nt, Mycobacterium tuberculosis H37Rv
caauagcugcgcgaagccaccag

SEQ ID NO: 3272932 - RNA, 13 nt, Mycobacterium tuberculosis H37Rv
caauaguguguuu

SEQ ID NO: 3272933 - RNA, 17 nt, Mycobacterium tuberculosis H37Rv
caaucaccgccgcgacc

SEQ ID NO: 3272934 - RNA, 22 nt, Mycobacterium tuberculosis H37Rv
caaucaccugguaguccccgaa

SEQ ID NO: 3272935 - RNA, 14 nt, Mycobacterium tuberculosis H37Rv
caaucaugucagcg

SEQ ID NO: 3272936 - RNA, 19 nt, Mycobacterium tuberculosis H37Rv
caauccaaggcucagcagc

SEQ ID NO: 3272937 - RNA, 15 nt, Mycobacterium tuberculosis H37Rv
caauccaccgauucg

SEQ ID NO: 3272938 - RNA, 18 nt, Mycobacterium tuberculosis H37Rv
caaucccgccaucugccu

SEQ ID NO: 3272939 - RNA, 19 nt, Mycobacterium tuberculosis H37Rv
caaucccgccaucugccug

SEQ ID NO: 3272940 - RNA, 14 nt, Mycobacterium tuberculosis H37Rv
caauccgcacagcg

SEQ ID NO: 3272941 - RNA, 22 nt, Mycobacterium tuberculosis H37Rv
caauccgcacagcgacgagauc

SEQ ID NO: 3272942 - RNA, 18 nt, Mycobacterium tuberculosis H37Rv
caauccgcccuaaugaag

SEQ ID NO: 3272943 - RNA, 14 nt, Mycobacterium tuberculosis H37Rv
caauccgcucgguc

SEQ ID NO: 3272944 - RNA, 17 nt, Mycobacterium tuberculosis H37Rv
caauccgcucggucgcc

SEQ ID NO: 3272945 - RNA, 21 nt, Mycobacterium tuberculosis H37Rv
caauccgcucggucgccuccu

SEQ ID NO: 3272946 - RNA, 18 nt, Mycobacterium tuberculosis H37Rv
caauccggcgccagcagu

SEQ ID NO: 3272947 - RNA, 14 nt, Mycobacterium tuberculosis H37Rv
caauccggcugcgg

SEQ ID NO: 3272948 - RNA, 18 nt, Mycobacterium tuberculosis H37Rv
caauccggucagcgcggc

SEQ ID NO: 3272949 - RNA, 14 nt, Mycobacterium tuberculosis H37Rv
caaucgaccacgac

SEQ ID NO: 3272950 - RNA, 18 nt, Mycobacterium tuberculosis H37Rv
caaucgagaacgcccgcu

SEQ ID NO: 3272951 - RNA, 13 nt, Mycobacterium tuberculosis H37Rv
caaucgaggaagg

SEQ ID NO: 3272952 - RNA, 18 nt, Mycobacterium tuberculosis H37Rv
caaucgaggaaggugugc

SEQ ID NO: 3272953 - RNA, 14 nt, Mycobacterium tuberculosis H37Rv
caaucgcgacgggg

SEQ ID NO: 3272954 - RNA, 16 nt, Mycobacterium tuberculosis H37Rv
caaucgcgugcuggaa

SEQ ID NO: 3272955 - RNA, 22 nt, Mycobacterium tuberculosis H37Rv
caaucggauagguggcgccacu

SEQ ID NO: 3272956 - RNA, 20 nt, Mycobacterium tuberculosis H37Rv
caaucguccacccgagcucu

SEQ ID NO: 3272957 - RNA, 14 nt, Mycobacterium tuberculosis H37Rv
caaucgucggccag

SEQ ID NO: 3272958 - RNA, 16 nt, Mycobacterium tuberculosis H37Rv
caaucguuuucguguc

SEQ ID NO: 3272959 - RNA, 18 nt, Mycobacterium tuberculosis H37Rv
caaucuucucgagccgcc

SEQ ID NO: 3272960 - RNA, 19 nt, Mycobacterium tuberculosis H37Rv
caaugacgucgucggccaa

SEQ ID NO: 3272961 - RNA, 16 nt, Mycobacterium tuberculosis H37Rv
caaugacucggccgca

SEQ ID NO: 3272962 - RNA, 22 nt, Mycobacterium tuberculosis H37Rv
caaugacuggaccgcggugacc

SEQ ID NO: 3272963 - RNA, 22 nt, Mycobacterium tuberculosis H37Rv
caaugagaucgggaccgacuuc

SEQ ID NO: 3272964 - RNA, 21 nt, Mycobacterium tuberculosis H37Rv
caaugaucaucccggcgcguu

SEQ ID NO: 3272965 - RNA, 12 nt, Mycobacterium tuberculosis H37Rv
caaugauucggc

SEQ ID NO: 3272966 - RNA, 16 nt, Mycobacterium tuberculosis H37Rv
caaugcaaauagccuu

SEQ ID NO: 3272967 - RNA, 20 nt, Mycobacterium tuberculosis H37Rv
caaugcaaauagccuuguuc

SEQ ID NO: 3272968 - RNA, 19 nt, Mycobacterium tuberculosis H37Rv
caaugcacaccgggcacca

SEQ ID NO: 3272969 - RNA, 18 nt, Mycobacterium tuberculosis H37Rv
caaugccaaucgcacugg

SEQ ID NO: 3272970 - RNA, 18 nt, Mycobacterium tuberculosis H37Rv
caaugcccuuggccagca

SEQ ID NO: 3272971 - RNA, 19 nt, Mycobacterium tuberculosis H37Rv
caaugccguugaucgcaaa

SEQ ID NO: 3272972 - RNA, 13 nt, Mycobacterium tuberculosis H37Rv
caaugcgagcacc

SEQ ID NO: 3272973 - RNA, 14 nt, Mycobacterium tuberculosis H37Rv
caaugcgagcaccc

SEQ ID NO: 3272974 - RNA, 17 nt, Mycobacterium tuberculosis H37Rv
caaugcgcgacggucaa

SEQ ID NO: 3272975 - RNA, 20 nt, Mycobacterium tuberculosis H37Rv
caaugcgcgcgauggcgcgu

SEQ ID NO: 3272976 - RNA, 13 nt, Mycobacterium tuberculosis H37Rv
caaugcggcccgg

SEQ ID NO: 3272977 - RNA, 22 nt, Mycobacterium tuberculosis H37Rv
caaugcguugaccgauacgcgg

SEQ ID NO: 3272978 - RNA, 17 nt, Mycobacterium tuberculosis H37Rv
caaugcguugacgucga

SEQ ID NO: 3272979 - RNA, 20 nt, Mycobacterium tuberculosis H37Rv
caaugcuggcagcggccucc

SEQ ID NO: 3272980 - RNA, 20 nt, Mycobacterium tuberculosis H37Rv
caauggacaccaacccaccc

SEQ ID NO: 3272981 - RNA, 15 nt, Mycobacterium tuberculosis H37Rv
caauggccugcagcg

SEQ ID NO: 3272982 - RNA, 17 nt, Mycobacterium tuberculosis H37Rv
caauggcgcgaccgaug

SEQ ID NO: 3272983 - RNA, 15 nt, Mycobacterium tuberculosis H37Rv
caauggcggcgccgu

SEQ ID NO: 3272984 - RNA, 18 nt, Mycobacterium tuberculosis H37Rv
caauggcggcgccgucga

SEQ ID NO: 3272985 - RNA, 15 nt, Mycobacterium tuberculosis H37Rv
caauggcguucgucg

SEQ ID NO: 3272986 - RNA, 19 nt, Mycobacterium tuberculosis H37Rv
caauggcucugaggucacc

SEQ ID NO: 3272987 - RNA, 21 nt, Mycobacterium tuberculosis H37Rv
caauggcuucgaagcgaucgc

SEQ ID NO: 3272988 - RNA, 20 nt, Mycobacterium tuberculosis H37Rv
caauggugggcgagcugcug

SEQ ID NO: 3272989 - RNA, 12 nt, Mycobacterium tuberculosis H37Rv
caauguccaggc

SEQ ID NO: 3272990 - RNA, 20 nt, Mycobacterium tuberculosis H37Rv
caauguccaggcgcgcacca

SEQ ID NO: 3272991 - RNA, 21 nt, Mycobacterium tuberculosis H37Rv
caauguccaggcgcgcaccac

SEQ ID NO: 3272992 - RNA, 20 nt, Mycobacterium tuberculosis H37Rv
caaugucggcagggccccca

SEQ ID NO: 3272993 - RNA, 19 nt, Mycobacterium tuberculosis H37Rv
caaugugguucgucgucgu

SEQ ID NO: 3272994 - RNA, 16 nt, Mycobacterium tuberculosis H37Rv
caauucacgcaccaca

SEQ ID NO: 3272995 - RNA, 19 nt, Mycobacterium tuberculosis H37Rv
caauucacgcaccacaaac

SEQ ID NO: 3272996 - RNA, 12 nt, Mycobacterium tuberculosis H37Rv
caauucagcggc

SEQ ID NO: 3272997 - RNA, 22 nt, Mycobacterium tuberculosis H37Rv
caauuccacgaucggcucacga

SEQ ID NO: 3272998 - RNA, 18 nt, Mycobacterium tuberculosis H37Rv
caauuccaugcaguuguc

SEQ ID NO: 3272999 - RNA, 15 nt, Mycobacterium tuberculosis H37Rv
caauuccgccgagcg

SEQ ID NO: 3273000 - RNA, 13 nt, Mycobacterium tuberculosis H37Rv
caauuccucagcc

SEQ ID NO: 3273001 - RNA, 12 nt, Mycobacterium tuberculosis H37Rv
caauucgacugc

SEQ ID NO: 3273002 - RNA, 19 nt, Mycobacterium tuberculosis H37Rv
caauucgcaaucggcguua

SEQ ID NO: 3273003 - RNA, 18 nt, Mycobacterium tuberculosis H37Rv
caauucggugcgcuggcg

SEQ ID NO: 3273004 - RNA, 18 nt, Mycobacterium tuberculosis H37Rv
caauugaacgcaccaacg

SEQ ID NO: 3273005 - RNA, 17 nt, Mycobacterium tuberculosis H37Rv
caauugcaccuucucca

SEQ ID NO: 3273006 - RNA, 19 nt, Mycobacterium tuberculosis H37Rv
caauugcgcugaagcccau

SEQ ID NO: 3273007 - RNA, 21 nt, Mycobacterium tuberculosis H37Rv
caauugcgguucgaacgcgau

SEQ ID NO: 3273008 - RNA, 14 nt, Mycobacterium tuberculosis H37Rv
caauugggcgaugc

SEQ ID NO: 3273009 - RNA, 15 nt, Mycobacterium tuberculosis H37Rv
caauugucaagccgu

SEQ ID NO: 3273010 - RNA, 15 nt, Mycobacterium tuberculosis H37Rv
caauugugcggcccc

SEQ ID NO: 3273011 - RNA, 18 nt, Mycobacterium tuberculosis H37Rv
caauugugcggccccguc

SEQ ID NO: 3273012 - RNA, 14 nt, Mycobacterium tuberculosis H37Rv
caauuucacugcga

SEQ ID NO: 3273013 - RNA, 24 nt, Mycobacterium tuberculosis H37Rv
cacaaacaccccacacagucggug

SEQ ID NO: 3273014 - RNA, 14 nt, Mycobacterium tuberculosis H37Rv
cacaaacccagcau

SEQ ID NO: 3273015 - RNA, 21 nt, Mycobacterium tuberculosis H37Rv
cacaaacgggcgugggccgcu

SEQ ID NO: 3273016 - RNA, 21 nt, Mycobacterium tuberculosis H37Rv
cacaacccgucgagccgugcc

SEQ ID NO: 3273017 - RNA, 19 nt, Mycobacterium tuberculosis H37Rv
cacaaccggauugagcacg

SEQ ID NO: 3273018 - RNA, 16 nt, Mycobacterium tuberculosis H37Rv
cacaaccgugagcacc

SEQ ID NO: 3273019 - RNA, 17 nt, Mycobacterium tuberculosis H37Rv
cacaaccgugagcacca

SEQ ID NO: 3273020 - RNA, 20 nt, Mycobacterium tuberculosis H37Rv
cacaaccgugagcaccagca

SEQ ID NO: 3273021 - RNA, 22 nt, Mycobacterium tuberculosis H37Rv
cacaaccgugagcaccagcagc

SEQ ID NO: 3273022 - RNA, 23 nt, Mycobacterium tuberculosis H37Rv
cacaaccguugcugcgcagcggc

SEQ ID NO: 3273023 - RNA, 20 nt, Mycobacterium tuberculosis H37Rv
cacaacgaucugcuggccga

SEQ ID NO: 3273024 - RNA, 22 nt, Mycobacterium tuberculosis H37Rv
cacaacgaucugcuggccgaac

SEQ ID NO: 3273025 - RNA, 23 nt, Mycobacterium tuberculosis H37Rv
cacaacgccucgauggcgguggc

SEQ ID NO: 3273026 - RNA, 23 nt, Mycobacterium tuberculosis H37Rv
cacaacgcgugaccagggccuga

SEQ ID NO: 3273027 - RNA, 15 nt, Mycobacterium tuberculosis H37Rv
cacaacggcggcgcc

SEQ ID NO: 3273028 - RNA, 13 nt, Mycobacterium tuberculosis H37Rv
cacaacgucggca

SEQ ID NO: 3273029 - RNA, 15 nt, Mycobacterium tuberculosis H37Rv
cacaacgucggcacc

SEQ ID NO: 3273030 - RNA, 15 nt, Mycobacterium tuberculosis H37Rv
cacaacgucgugauc

SEQ ID NO: 3273031 - RNA, 23 nt, Mycobacterium tuberculosis H37Rv
cacaacguggugucucggcugau

SEQ ID NO: 3273032 - RNA, 21 nt, Mycobacterium tuberculosis H37Rv
cacaacugcccgacgaccauu

SEQ ID NO: 3273033 - RNA, 13 nt, Mycobacterium tuberculosis H37Rv
cacaagcgauggc

SEQ ID NO: 3273034 - RNA, 17 nt, Mycobacterium tuberculosis H37Rv
cacaagcgauggcacca

SEQ ID NO: 3273035 - RNA, 14 nt, Mycobacterium tuberculosis H37Rv
cacaagcugaacua

SEQ ID NO: 3273036 - RNA, 22 nt, Mycobacterium tuberculosis H37Rv
cacaaggcgugagcuaugcugg

SEQ ID NO: 3273037 - RNA, 13 nt, Mycobacterium tuberculosis H37Rv
cacaagucgacac

SEQ ID NO: 3273038 - RNA, 20 nt, Mycobacterium tuberculosis H37Rv
cacaagucgcgcgccaagac

SEQ ID NO: 3273039 - RNA, 17 nt, Mycobacterium tuberculosis H37Rv
cacaauacggucagcag

SEQ ID NO: 3273040 - RNA, 18 nt, Mycobacterium tuberculosis H37Rv
cacaauaggcuccagcgc

SEQ ID NO: 3273041 - RNA, 20 nt, Mycobacterium tuberculosis H37Rv
cacaauccacgucgcggcgu

SEQ ID NO: 3273042 - RNA, 21 nt, Mycobacterium tuberculosis H37Rv
cacaauccgcucggucgccuc

SEQ ID NO: 3273043 - RNA, 19 nt, Mycobacterium tuberculosis H37Rv
cacaauggcggcgccgucg

SEQ ID NO: 3273044 - RNA, 23 nt, Mycobacterium tuberculosis H37Rv
cacaauggcucugaggucaccgg

SEQ ID NO: 3273045 - RNA, 16 nt, Mycobacterium tuberculosis H37Rv
cacacaauucgggcgu

SEQ ID NO: 3273046 - RNA, 20 nt, Mycobacterium tuberculosis H37Rv
cacacacagccgguggcauu

SEQ ID NO: 3273047 - RNA, 19 nt, Mycobacterium tuberculosis H37Rv
cacacacccgacacggcuc

SEQ ID NO: 3273048 - RNA, 23 nt, Mycobacterium tuberculosis H37Rv
cacacacugccggacagccacgc

SEQ ID NO: 3273049 - RNA, 17 nt, Mycobacterium tuberculosis H37Rv
cacacaggcggcgaacu

SEQ ID NO: 3273050 - RNA, 21 nt, Mycobacterium tuberculosis H37Rv
cacacaggcggcgaacugccu

SEQ ID NO: 3273051 - RNA, 14 nt, Mycobacterium tuberculosis H37Rv
cacacagucacgga

SEQ ID NO: 3273052 - RNA, 15 nt, Mycobacterium tuberculosis H37Rv
cacaccaacaccgcg

SEQ ID NO: 3273053 - RNA, 22 nt, Mycobacterium tuberculosis H37Rv
cacaccaacaccgcggcgcuga

SEQ ID NO: 3273054 - RNA, 18 nt, Mycobacterium tuberculosis H37Rv
cacaccaaccgagcgccc

SEQ ID NO: 3273055 - RNA, 23 nt, Mycobacterium tuberculosis H37Rv
cacaccaaccgagcgcccuccuc

SEQ ID NO: 3273056 - RNA, 13 nt, Mycobacterium tuberculosis H37Rv
cacaccaccgccg

SEQ ID NO: 3273057 - RNA, 14 nt, Mycobacterium tuberculosis H37Rv
cacaccacgauggc

SEQ ID NO: 3273058 - RNA, 15 nt, Mycobacterium tuberculosis H37Rv
cacaccacgauggcg

SEQ ID NO: 3273059 - RNA, 21 nt, Mycobacterium tuberculosis H37Rv
cacaccagcuuguagcgcucg

SEQ ID NO: 3273060 - RNA, 20 nt, Mycobacterium tuberculosis H37Rv
cacaccaggccgagccgccc

SEQ ID NO: 3273061 - RNA, 14 nt, Mycobacterium tuberculosis H37Rv
cacacccacaccca

SEQ ID NO: 3273062 - RNA, 13 nt, Mycobacterium tuberculosis H37Rv
cacacccagcgug

SEQ ID NO: 3273063 - RNA, 16 nt, Mycobacterium tuberculosis H37Rv
cacacccaucagcccu

SEQ ID NO: 3273064 - RNA, 13 nt, Mycobacterium tuberculosis H37Rv
cacaccccaggca

SEQ ID NO: 3273065 - RNA, 15 nt, Mycobacterium tuberculosis H37Rv
cacacccccgucugc

SEQ ID NO: 3273066 - RNA, 18 nt, Mycobacterium tuberculosis H37Rv
cacacccggcacacccuc

SEQ ID NO: 3273067 - RNA, 13 nt, Mycobacterium tuberculosis H37Rv
cacacccugcagc

SEQ ID NO: 3273068 - RNA, 16 nt, Mycobacterium tuberculosis H37Rv
cacaccgacagcaccc

SEQ ID NO: 3273069 - RNA, 14 nt, Mycobacterium tuberculosis H37Rv
cacaccgaccgcgg

SEQ ID NO: 3273070 - RNA, 15 nt, Mycobacterium tuberculosis H37Rv
cacaccgacgccgcc

SEQ ID NO: 3273071 - RNA, 16 nt, Mycobacterium tuberculosis H37Rv
cacaccgagcgcaauc

SEQ ID NO: 3273072 - RNA, 21 nt, Mycobacterium tuberculosis H37Rv
cacaccgagcgcaaucgacca

SEQ ID NO: 3273073 - RNA, 15 nt, Mycobacterium tuberculosis H37Rv
cacaccgaucggcaa

SEQ ID NO: 3273074 - RNA, 12 nt, Mycobacterium tuberculosis H37Rv
cacaccgccgcc

SEQ ID NO: 3273075 - RNA, 14 nt, Mycobacterium tuberculosis H37Rv
cacaccggagccga

SEQ ID NO: 3273076 - RNA, 14 nt, Mycobacterium tuberculosis H37Rv
cacaccggcacugc

SEQ ID NO: 3273077 - RNA, 23 nt, Mycobacterium tuberculosis H37Rv
cacaccggcacugcccagcagac

SEQ ID NO: 3273078 - RNA, 19 nt, Mycobacterium tuberculosis H37Rv
cacaccgggcaccagucgc

SEQ ID NO: 3273079 - RNA, 12 nt, Mycobacterium tuberculosis H37Rv
cacaccgucgca

SEQ ID NO: 3273080 - RNA, 16 nt, Mycobacterium tuberculosis H37Rv
cacaccgucgcaccca

SEQ ID NO: 3273081 - RNA, 21 nt, Mycobacterium tuberculosis H37Rv
cacaccgucgcgcucgcacca

SEQ ID NO: 3273082 - RNA, 23 nt, Mycobacterium tuberculosis H37Rv
cacaccgucgucguacggcucau

SEQ ID NO: 3273083 - RNA, 16 nt, Mycobacterium tuberculosis H37Rv
cacaccgugaccagcc

SEQ ID NO: 3273084 - RNA, 15 nt, Mycobacterium tuberculosis H37Rv
cacaccuccucgacc

SEQ ID NO: 3273085 - RNA, 17 nt, Mycobacterium tuberculosis H37Rv
cacaccuccucgagcag

SEQ ID NO: 3273086 - RNA, 19 nt, Mycobacterium tuberculosis H37Rv
cacaccucgugcggcgcuc

SEQ ID NO: 3273087 - RNA, 15 nt, Mycobacterium tuberculosis H37Rv
cacaccuucggcugg

SEQ ID NO: 3273088 - RNA, 16 nt, Mycobacterium tuberculosis H37Rv
cacacgaucgcgguga

SEQ ID NO: 3273089 - RNA, 18 nt, Mycobacterium tuberculosis H37Rv
cacacgaucgcggugaug

SEQ ID NO: 3273090 - RNA, 12 nt, Mycobacterium tuberculosis H37Rv
cacacgaugacg

SEQ ID NO: 3273091 - RNA, 16 nt, Mycobacterium tuberculosis H37Rv
cacacgcccucgacgc

SEQ ID NO: 3273092 - RNA, 18 nt, Mycobacterium tuberculosis H37Rv
cacacgcccucgacgccg

SEQ ID NO: 3273093 - RNA, 21 nt, Mycobacterium tuberculosis H37Rv
cacacgcccucgacgccgcgc

SEQ ID NO: 3273094 - RNA, 22 nt, Mycobacterium tuberculosis H37Rv
cacacgcccucgacgccgcgca

SEQ ID NO: 3273095 - RNA, 19 nt, Mycobacterium tuberculosis H37Rv
cacacgcucacgggcucca

SEQ ID NO: 3273096 - RNA, 20 nt, Mycobacterium tuberculosis H37Rv
cacacggggccgccagcugc

SEQ ID NO: 3273097 - RNA, 22 nt, Mycobacterium tuberculosis H37Rv
cacacgucaggcaacgaagagg

SEQ ID NO: 3273098 - RNA, 15 nt, Mycobacterium tuberculosis H37Rv
cacacucccgcgccc

SEQ ID NO: 3273099 - RNA, 14 nt, Mycobacterium tuberculosis H37Rv
cacacucgccaggg

SEQ ID NO: 3273100 - RNA, 23 nt, Mycobacterium tuberculosis H37Rv
cacacucggccgggcucuaucag

SEQ ID NO: 3273101 - RNA, 22 nt, Mycobacterium tuberculosis H37Rv
cacacucucggugaacgccgcc

SEQ ID NO: 3273102 - RNA, 16 nt, Mycobacterium tuberculosis H37Rv
cacacugaccccgccg

SEQ ID NO: 3273103 - RNA, 17 nt, Mycobacterium tuberculosis H37Rv
cacacugccgcgcucgc

SEQ ID NO: 3273104 - RNA, 18 nt, Mycobacterium tuberculosis H37Rv
cacacugccgcgcucgcg

SEQ ID NO: 3273105 - RNA, 22 nt, Mycobacterium tuberculosis H37Rv
cacacuguuacuccgacggccc

SEQ ID NO: 3273106 - RNA, 15 nt, Mycobacterium tuberculosis H37Rv
cacacuguucccaca

SEQ ID NO: 3273107 - RNA, 14 nt, Mycobacterium tuberculosis H37Rv
cacacuugcaacuc

SEQ ID NO: 3273108 - RNA, 14 nt, Mycobacterium tuberculosis H37Rv
cacagaaccgggua

SEQ ID NO: 3273109 - RNA, 23 nt, Mycobacterium tuberculosis H37Rv
cacagaaucgcccauuucggcac

SEQ ID NO: 3273110 - RNA, 18 nt, Mycobacterium tuberculosis H37Rv
cacagaccgaacagcacc

SEQ ID NO: 3273111 - RNA, 19 nt, Mycobacterium tuberculosis H37Rv
cacagaccgaacagcaccg

SEQ ID NO: 3273112 - RNA, 13 nt, Mycobacterium tuberculosis H37Rv
cacagaccgugac

SEQ ID NO: 3273113 - RNA, 12 nt, Mycobacterium tuberculosis H37Rv
cacagacgacgu

SEQ ID NO: 3273114 - RNA, 17 nt, Mycobacterium tuberculosis H37Rv
cacagacugcgcggcac

SEQ ID NO: 3273115 - RNA, 15 nt, Mycobacterium tuberculosis H37Rv
cacagcacagcgcag

SEQ ID NO: 3273116 - RNA, 16 nt, Mycobacterium tuberculosis H37Rv
cacagcacagcgcagc

SEQ ID NO: 3273117 - RNA, 20 nt, Mycobacterium tuberculosis H37Rv
cacagcaccacaucgaaggu

SEQ ID NO: 3273118 - RNA, 13 nt, Mycobacterium tuberculosis H37Rv
cacagcacccacg

SEQ ID NO: 3273119 - RNA, 13 nt, Mycobacterium tuberculosis H37Rv
cacagcaccgucc

SEQ ID NO: 3273120 - RNA, 13 nt, Mycobacterium tuberculosis H37Rv
cacagcagcgguu

SEQ ID NO: 3273121 - RNA, 20 nt, Mycobacterium tuberculosis H37Rv
cacagcagcgucaucagguc

SEQ ID NO: 3273122 - RNA, 14 nt, Mycobacterium tuberculosis H37Rv
cacagccaccagcc

SEQ ID NO: 3273123 - RNA, 15 nt, Mycobacterium tuberculosis H37Rv
cacagccaccagccg

SEQ ID NO: 3273124 - RNA, 22 nt, Mycobacterium tuberculosis H37Rv
cacagccaguaaaaaggcagga

SEQ ID NO: 3273125 - RNA, 13 nt, Mycobacterium tuberculosis H37Rv
cacagccccaggg

SEQ ID NO: 3273126 - RNA, 15 nt, Mycobacterium tuberculosis H37Rv
cacagcccggcgacg

SEQ ID NO: 3273127 - RNA, 14 nt, Mycobacterium tuberculosis H37Rv
cacagccgcgccga

SEQ ID NO: 3273128 - RNA, 18 nt, Mycobacterium tuberculosis H37Rv
cacagccgucgcaccaga

SEQ ID NO: 3273129 - RNA, 18 nt, Mycobacterium tuberculosis H37Rv
cacagccucguagaacgc

SEQ ID NO: 3273130 - RNA, 12 nt, Mycobacterium tuberculosis H37Rv
cacagcgcagcc

SEQ ID NO: 3273131 - RNA, 14 nt, Mycobacterium tuberculosis H37Rv
cacagcggagacga

SEQ ID NO: 3273132 - RNA, 21 nt, Mycobacterium tuberculosis H37Rv
cacagcggccauaucgcccac

SEQ ID NO: 3273133 - RNA, 22 nt, Mycobacterium tuberculosis H37Rv
cacagcggccauaucgcccacc

SEQ ID NO: 3273134 - RNA, 12 nt, Mycobacterium tuberculosis H37Rv
cacagcggcgau

SEQ ID NO: 3273135 - RNA, 18 nt, Mycobacterium tuberculosis H37Rv
cacagcucgccgugacca

SEQ ID NO: 3273136 - RNA, 22 nt, Mycobacterium tuberculosis H37Rv
cacagcugauucugguucagcc

SEQ ID NO: 3273137 - RNA, 13 nt, Mycobacterium tuberculosis H37Rv
cacagcuugcccg

SEQ ID NO: 3273138 - RNA, 17 nt, Mycobacterium tuberculosis H37Rv
cacagcuugcccgagcc

SEQ ID NO: 3273139 - RNA, 18 nt, Mycobacterium tuberculosis H37Rv
cacagcuugcccgagccc

SEQ ID NO: 3273140 - RNA, 20 nt, Mycobacterium tuberculosis H37Rv
cacaggacaauggacaccaa

SEQ ID NO: 3273141 - RNA, 14 nt, Mycobacterium tuberculosis H37Rv
cacaggaucaccca

SEQ ID NO: 3273142 - RNA, 16 nt, Mycobacterium tuberculosis H37Rv
cacaggccgacgaugu

SEQ ID NO: 3273143 - RNA, 15 nt, Mycobacterium tuberculosis H37Rv
cacaggccgccuggg

SEQ ID NO: 3273144 - RNA, 12 nt, Mycobacterium tuberculosis H37Rv
cacaggcggcca

SEQ ID NO: 3273145 - RNA, 16 nt, Mycobacterium tuberculosis H37Rv
cacaggcggcgcugca

SEQ ID NO: 3273146 - RNA, 16 nt, Mycobacterium tuberculosis H37Rv
cacaggcguccaucgc

SEQ ID NO: 3273147 - RNA, 19 nt, Mycobacterium tuberculosis H37Rv
cacaggcguccaucgccac

SEQ ID NO: 3273148 - RNA, 13 nt, Mycobacterium tuberculosis H37Rv
cacaggcugaaga

SEQ ID NO: 3273149 - RNA, 14 nt, Mycobacterium tuberculosis H37Rv
cacaggggcagcgc

SEQ ID NO: 3273150 - RNA, 19 nt, Mycobacterium tuberculosis H37Rv
cacaggggcagcgcggcca

SEQ ID NO: 3273151 - RNA, 23 nt, Mycobacterium tuberculosis H37Rv
cacagguacuuugcgcccggcac

SEQ ID NO: 3273152 - RNA, 17 nt, Mycobacterium tuberculosis H37Rv
cacagguuugcgccgcg

SEQ ID NO: 3273153 - RNA, 22 nt, Mycobacterium tuberculosis H37Rv
cacagguuugcgccgcgcagcg

SEQ ID NO: 3273154 - RNA, 18 nt, Mycobacterium tuberculosis H37Rv
cacagucacggaccgcuu

SEQ ID NO: 3273155 - RNA, 17 nt, Mycobacterium tuberculosis H37Rv
cacagugccaauuccag

SEQ ID NO: 3273156 - RNA, 16 nt, Mycobacterium tuberculosis H37Rv
cacagugcggccccga

SEQ ID NO: 3273157 - RNA, 23 nt, Mycobacterium tuberculosis H37Rv
cacaguggcucgcggaugcucgu

SEQ ID NO: 3273158 - RNA, 22 nt, Mycobacterium tuberculosis H37Rv
cacaguuaucagccgcgcgcca

SEQ ID NO: 3273159 - RNA, 13 nt, Mycobacterium tuberculosis H37Rv
cacauaagccccc

SEQ ID NO: 3273160 - RNA, 17 nt, Mycobacterium tuberculosis H37Rv
cacauacagcaggccgc

SEQ ID NO: 3273161 - RNA, 18 nt, Mycobacterium tuberculosis H37Rv
cacauacgauuucgacga

SEQ ID NO: 3273162 - RNA, 15 nt, Mycobacterium tuberculosis H37Rv
cacauagccggucag

SEQ ID NO: 3273163 - RNA, 17 nt, Mycobacterium tuberculosis H37Rv
cacauaugugcccggcg

SEQ ID NO: 3273164 - RNA, 19 nt, Mycobacterium tuberculosis H37Rv
cacaucaaaacggcggugg

SEQ ID NO: 3273165 - RNA, 18 nt, Mycobacterium tuberculosis H37Rv
cacaucagccgcaccagu

SEQ ID NO: 3273166 - RNA, 17 nt, Mycobacterium tuberculosis H37Rv
cacaucaugccagccgu

SEQ ID NO: 3273167 - RNA, 19 nt, Mycobacterium tuberculosis H37Rv
cacaucaugccagccguca

SEQ ID NO: 3273168 - RNA, 13 nt, Mycobacterium tuberculosis H37Rv
cacaucaugggcg

SEQ ID NO: 3273169 - RNA, 19 nt, Mycobacterium tuberculosis H37Rv
cacaucaugggcgcugcca

SEQ ID NO: 3273170 - RNA, 20 nt, Mycobacterium tuberculosis H37Rv
cacauccagggugccgguca

SEQ ID NO: 3273171 - RNA, 13 nt, Mycobacterium tuberculosis H37Rv
cacauccaguaac

SEQ ID NO: 3273172 - RNA, 18 nt, Mycobacterium tuberculosis H37Rv
cacauccuggcggcugca

SEQ ID NO: 3273173 - RNA, 23 nt, Mycobacterium tuberculosis H37Rv
cacauccuggcggcugcagccga

SEQ ID NO: 3273174 - RNA, 20 nt, Mycobacterium tuberculosis H37Rv
cacaucgcacaacugcgcca

SEQ ID NO: 3273175 - RNA, 12 nt, Mycobacterium tuberculosis H37Rv
cacaucgcacgg

SEQ ID NO: 3273176 - RNA, 17 nt, Mycobacterium tuberculosis H37Rv
cacaucgcauccacuuc

SEQ ID NO: 3273177 - RNA, 20 nt, Mycobacterium tuberculosis H37Rv
cacaucgcucaucgucaccu

SEQ ID NO: 3273178 - RNA, 22 nt, Mycobacterium tuberculosis H37Rv
cacaucggccucugaccagccg

SEQ ID NO: 3273179 - RNA, 19 nt, Mycobacterium tuberculosis H37Rv
cacaucggcucugauggug

SEQ ID NO: 3273180 - RNA, 22 nt, Mycobacterium tuberculosis H37Rv
cacaucggugguuagguggcug

SEQ ID NO: 3273181 - RNA, 12 nt, Mycobacterium tuberculosis H37Rv
cacaucgucggc

SEQ ID NO: 3273182 - RNA, 19 nt, Mycobacterium tuberculosis H37Rv
cacaucguugucauagaaa

SEQ ID NO: 3273183 - RNA, 15 nt, Mycobacterium tuberculosis H37Rv
cacaugacgaucgcg

SEQ ID NO: 3273184 - RNA, 17 nt, Mycobacterium tuberculosis H37Rv
cacaugcaucugaucag

SEQ ID NO: 3273185 - RNA, 15 nt, Mycobacterium tuberculosis H37Rv
cacaugcucagucgc

SEQ ID NO: 3273186 - RNA, 19 nt, Mycobacterium tuberculosis H37Rv
cacaugcucgacgcccgcc

SEQ ID NO: 3273187 - RNA, 20 nt, Mycobacterium tuberculosis H37Rv
cacaugcucgacgcccgcca

SEQ ID NO: 3273188 - RNA, 19 nt, Mycobacterium tuberculosis H37Rv
cacauggaacucacccuau

SEQ ID NO: 3273189 - RNA, 19 nt, Mycobacterium tuberculosis H37Rv
cacauguucuccucgucgc

SEQ ID NO: 3273190 - RNA, 16 nt, Mycobacterium tuberculosis H37Rv
cacauuccgcaguccc

SEQ ID NO: 3273191 - RNA, 12 nt, Mycobacterium tuberculosis H37Rv
cacauugaccag

SEQ ID NO: 3273192 - RNA, 19 nt, Mycobacterium tuberculosis H37Rv
cacauugaucgacggccag

SEQ ID NO: 3273193 - RNA, 21 nt, Mycobacterium tuberculosis H37Rv
cacauugaucgacggccagcc

SEQ ID NO: 3273194 - RNA, 14 nt, Mycobacterium tuberculosis H37Rv
cacauugccaccgu

SEQ ID NO: 3273195 - RNA, 15 nt, Mycobacterium tuberculosis H37Rv
cacauuggcgaucag

SEQ ID NO: 3273196 - RNA, 15 nt, Mycobacterium tuberculosis H37Rv
cacauugguguccac

SEQ ID NO: 3273197 - RNA, 23 nt, Mycobacterium tuberculosis H37Rv
caccaaaaacccggugaccagca

SEQ ID NO: 3273198 - RNA, 20 nt, Mycobacterium tuberculosis H37Rv
caccaaaagcccgguacgcc

SEQ ID NO: 3273199 - RNA, 18 nt, Mycobacterium tuberculosis H37Rv
caccaaaaggaucaacgu

SEQ ID NO: 3273200 - RNA, 16 nt, Mycobacterium tuberculosis H37Rv
caccaaaucgaugucc

SEQ ID NO: 3273201 - RNA, 14 nt, Mycobacterium tuberculosis H37Rv
caccaaaugccccg

SEQ ID NO: 3273202 - RNA, 23 nt, Mycobacterium tuberculosis H37Rv
caccaaaugccccgaaccgcgcu

SEQ ID NO: 3273203 - RNA, 17 nt, Mycobacterium tuberculosis H37Rv
caccaacaccgcggcgc

SEQ ID NO: 3273204 - RNA, 18 nt, Mycobacterium tuberculosis H37Rv
caccaacaccgcggcgcu

SEQ ID NO: 3273205 - RNA, 22 nt, Mycobacterium tuberculosis H37Rv
caccaaccagugcagcucgaua

SEQ ID NO: 3273206 - RNA, 15 nt, Mycobacterium tuberculosis H37Rv
caccaaccucaucgc

SEQ ID NO: 3273207 - RNA, 14 nt, Mycobacterium tuberculosis H37Rv
caccaacgacagcg

SEQ ID NO: 3273208 - RNA, 15 nt, Mycobacterium tuberculosis H37Rv
caccaacgacagcga

SEQ ID NO: 3273209 - RNA, 14 nt, Mycobacterium tuberculosis H37Rv
caccaacgccaccg

SEQ ID NO: 3273210 - RNA, 13 nt, Mycobacterium tuberculosis H37Rv
caccaacgcggga

SEQ ID NO: 3273211 - RNA, 17 nt, Mycobacterium tuberculosis H37Rv
caccaacgucgaugucc

SEQ ID NO: 3273212 - RNA, 22 nt, Mycobacterium tuberculosis H37Rv
caccaagaaguugacaccaggg

SEQ ID NO: 3273213 - RNA, 15 nt, Mycobacterium tuberculosis H37Rv
caccaagacgccacc

SEQ ID NO: 3273214 - RNA, 16 nt, Mycobacterium tuberculosis H37Rv
caccaagacgccaccc

SEQ ID NO: 3273215 - RNA, 16 nt, Mycobacterium tuberculosis H37Rv
caccaagcagcgacca

SEQ ID NO: 3273216 - RNA, 16 nt, Mycobacterium tuberculosis H37Rv
caccaagcucggccag

SEQ ID NO: 3273217 - RNA, 18 nt, Mycobacterium tuberculosis H37Rv
caccaagcucggccagca

SEQ ID NO: 3273218 - RNA, 20 nt, Mycobacterium tuberculosis H37Rv
caccaagcucggccagcacg

SEQ ID NO: 3273219 - RNA, 15 nt, Mycobacterium tuberculosis H37Rv
caccaaggucggcga

SEQ ID NO: 3273220 - RNA, 17 nt, Mycobacterium tuberculosis H37Rv
caccaagguuggucggu

SEQ ID NO: 3273221 - RNA, 20 nt, Mycobacterium tuberculosis H37Rv
caccaagguuggucggugcu

SEQ ID NO: 3273222 - RNA, 14 nt, Mycobacterium tuberculosis H37Rv
caccaaugcuccug

SEQ ID NO: 3273223 - RNA, 21 nt, Mycobacterium tuberculosis H37Rv
caccacaaacaccccacacag

SEQ ID NO: 3273224 - RNA, 15 nt, Mycobacterium tuberculosis H37Rv
caccacaauccacgc

SEQ ID NO: 3273225 - RNA, 21 nt, Mycobacterium tuberculosis H37Rv
caccacaccacgguggccgcu

SEQ ID NO: 3273226 - RNA, 14 nt, Mycobacterium tuberculosis H37Rv
caccacaccgagca

SEQ ID NO: 3273227 - RNA, 17 nt, Mycobacterium tuberculosis H37Rv
caccacaccgagcaccu

SEQ ID NO: 3273228 - RNA, 19 nt, Mycobacterium tuberculosis H37Rv
caccacaccggagccgaac

SEQ ID NO: 3273229 - RNA, 14 nt, Mycobacterium tuberculosis H37Rv
caccacaccggcag

SEQ ID NO: 3273230 - RNA, 19 nt, Mycobacterium tuberculosis H37Rv
caccacaccugcggcugcu

SEQ ID NO: 3273231 - RNA, 13 nt, Mycobacterium tuberculosis H37Rv
caccacagugcca

SEQ ID NO: 3273232 - RNA, 13 nt, Mycobacterium tuberculosis H37Rv
caccacaugggag

SEQ ID NO: 3273233 - RNA, 19 nt, Mycobacterium tuberculosis H37Rv
caccacauuggcgaucagc

SEQ ID NO: 3273234 - RNA, 21 nt, Mycobacterium tuberculosis H37Rv
caccacauuggcgaucagcag

SEQ ID NO: 3273235 - RNA, 18 nt, Mycobacterium tuberculosis H37Rv
caccaccaagcucggcca

SEQ ID NO: 3273236 - RNA, 20 nt, Mycobacterium tuberculosis H37Rv
caccaccaagcucggccagc

SEQ ID NO: 3273237 - RNA, 17 nt, Mycobacterium tuberculosis H37Rv
caccaccaccgccggug

SEQ ID NO: 3273238 - RNA, 12 nt, Mycobacterium tuberculosis H37Rv
caccaccacggc

SEQ ID NO: 3273239 - RNA, 14 nt, Mycobacterium tuberculosis H37Rv
caccaccacggcca

SEQ ID NO: 3273240 - RNA, 15 nt, Mycobacterium tuberculosis H37Rv
caccaccacggccag

SEQ ID NO: 3273241 - RNA, 14 nt, Mycobacterium tuberculosis H37Rv
caccaccacugcgg

SEQ ID NO: 3273242 - RNA, 22 nt, Mycobacterium tuberculosis H37Rv
caccaccagagacgaucaucuc

SEQ ID NO: 3273243 - RNA, 17 nt, Mycobacterium tuberculosis H37Rv
caccaccagcacgcucg

SEQ ID NO: 3273244 - RNA, 19 nt, Mycobacterium tuberculosis H37Rv
caccaccaggcugucgugg

SEQ ID NO: 3273245 - RNA, 21 nt, Mycobacterium tuberculosis H37Rv
caccaccagguccaccccgcc

SEQ ID NO: 3273246 - RNA, 18 nt, Mycobacterium tuberculosis H37Rv
caccaccaucacgguggc

SEQ ID NO: 3273247 - RNA, 14 nt, Mycobacterium tuberculosis H37Rv
caccacccaacagc

SEQ ID NO: 3273248 - RNA, 16 nt, Mycobacterium tuberculosis H37Rv
caccaccccagcggcc

SEQ ID NO: 3273249 - RNA, 17 nt, Mycobacterium tuberculosis H37Rv
caccaccccagcggcca

SEQ ID NO: 3273250 - RNA, 20 nt, Mycobacterium tuberculosis H37Rv
caccaccccagcggccaccg

SEQ ID NO: 3273251 - RNA, 18 nt, Mycobacterium tuberculosis H37Rv
caccaccccgaggccgac

SEQ ID NO: 3273252 - RNA, 21 nt, Mycobacterium tuberculosis H37Rv
caccacccgauuggccaaccc

SEQ ID NO: 3273253 - RNA, 20 nt, Mycobacterium tuberculosis H37Rv
caccacccgggccucggcgc

SEQ ID NO: 3273254 - RNA, 13 nt, Mycobacterium tuberculosis H37Rv
caccaccgccaga

SEQ ID NO: 3273255 - RNA, 14 nt, Mycobacterium tuberculosis H37Rv
caccaccgcccgca

SEQ ID NO: 3273256 - RNA, 18 nt, Mycobacterium tuberculosis H37Rv
caccaccgcccgcacguu

SEQ ID NO: 3273257 - RNA, 12 nt, Mycobacterium tuberculosis H37Rv
caccaccgccga

SEQ ID NO: 3273258 - RNA, 15 nt, Mycobacterium tuberculosis H37Rv
caccaccgccgccac

SEQ ID NO: 3273259 - RNA, 16 nt, Mycobacterium tuberculosis H37Rv
caccaccgccgccgga

SEQ ID NO: 3273260 - RNA, 20 nt, Mycobacterium tuberculosis H37Rv
caccaccgccgccggcaccg

SEQ ID NO: 3273261 - RNA, 18 nt, Mycobacterium tuberculosis H37Rv
caccaccgccggugccgc

SEQ ID NO: 3273262 - RNA, 23 nt, Mycobacterium tuberculosis H37Rv
caccaccgcgaccucgcggcgcu

SEQ ID NO: 3273263 - RNA, 14 nt, Mycobacterium tuberculosis H37Rv
caccaccgcgccgu

SEQ ID NO: 3273264 - RNA, 19 nt, Mycobacterium tuberculosis H37Rv
caccaccgcggcggcggcc

SEQ ID NO: 3273265 - RNA, 20 nt, Mycobacterium tuberculosis H37Rv
caccaccgcggcggcggcca

SEQ ID NO: 3273266 - RNA, 20 nt, Mycobacterium tuberculosis H37Rv
caccaccgcucgucguccgg

SEQ ID NO: 3273267 - RNA, 15 nt, Mycobacterium tuberculosis H37Rv
caccaccggaaccac

SEQ ID NO: 3273268 - RNA, 19 nt, Mycobacterium tuberculosis H37Rv
caccaccggaucgcucccg

SEQ ID NO: 3273269 - RNA, 11 nt, Mycobacterium tuberculosis H37Rv
caccaccggca

SEQ ID NO: 3273270 - RNA, 14 nt, Mycobacterium tuberculosis H37Rv
caccaccggcaccc

SEQ ID NO: 3273271 - RNA, 18 nt, Mycobacterium tuberculosis H37Rv
caccaccggcacccgcug

SEQ ID NO: 3273272 - RNA, 15 nt, Mycobacterium tuberculosis H37Rv
caccaccggccccac

SEQ ID NO: 3273273 - RNA, 18 nt, Mycobacterium tuberculosis H37Rv
caccaccggccccaccga

SEQ ID NO: 3273274 - RNA, 23 nt, Mycobacterium tuberculosis H37Rv
caccaccggccccaccgacagcc

SEQ ID NO: 3273275 - RNA, 14 nt, Mycobacterium tuberculosis H37Rv
caccaccggcgccg

SEQ ID NO: 3273276 - RNA, 14 nt, Mycobacterium tuberculosis H37Rv
caccaccggcuccc

SEQ ID NO: 3273277 - RNA, 20 nt, Mycobacterium tuberculosis H37Rv
caccaccgucgagccggaca

SEQ ID NO: 3273278 - RNA, 20 nt, Mycobacterium tuberculosis H37Rv
caccaccgucucgccgcgca

SEQ ID NO: 3273279 - RNA, 15 nt, Mycobacterium tuberculosis H37Rv
caccaccguugccgc

SEQ ID NO: 3273280 - RNA, 16 nt, Mycobacterium tuberculosis H37Rv
caccaccguugccgcc

SEQ ID NO: 3273281 - RNA, 13 nt, Mycobacterium tuberculosis H37Rv
caccaccuccgcg

SEQ ID NO: 3273282 - RNA, 22 nt, Mycobacterium tuberculosis H37Rv
caccaccucggugaccaggccg

SEQ ID NO: 3273283 - RNA, 13 nt, Mycobacterium tuberculosis H37Rv
caccaccucguca

SEQ ID NO: 3273284 - RNA, 22 nt, Mycobacterium tuberculosis H37Rv
caccaccuggccggccaucuug

SEQ ID NO: 3273285 - RNA, 18 nt, Mycobacterium tuberculosis H37Rv
caccaccuggugcaaccg

SEQ ID NO: 3273286 - RNA, 18 nt, Mycobacterium tuberculosis H37Rv
caccaccuuggaugcccu

SEQ ID NO: 3273287 - RNA, 18 nt, Mycobacterium tuberculosis H37Rv
caccacgaacacguucgg

SEQ ID NO: 3273288 - RNA, 23 nt, Mycobacterium tuberculosis H37Rv
caccacgaacacguucggguacc

SEQ ID NO: 3273289 - RNA, 19 nt, Mycobacterium tuberculosis H37Rv
caccacgaccgacaccccg

SEQ ID NO: 3273290 - RNA, 15 nt, Mycobacterium tuberculosis H37Rv
caccacgagcagccg

SEQ ID NO: 3273291 - RNA, 16 nt, Mycobacterium tuberculosis H37Rv
caccacgagcagccga

SEQ ID NO: 3273292 - RNA, 20 nt, Mycobacterium tuberculosis H37Rv
caccacgaggcuugcggcac

SEQ ID NO: 3273293 - RNA, 22 nt, Mycobacterium tuberculosis H37Rv
caccacgagggccacguagcag

SEQ ID NO: 3273294 - RNA, 19 nt, Mycobacterium tuberculosis H37Rv
caccacgaucaacucgugc

SEQ ID NO: 3273295 - RNA, 16 nt, Mycobacterium tuberculosis H37Rv
caccacgauggcggcc

SEQ ID NO: 3273296 - RNA, 17 nt, Mycobacterium tuberculosis H37Rv
caccacgauggcggcca

SEQ ID NO: 3273297 - RNA, 14 nt, Mycobacterium tuberculosis H37Rv
caccacgcgccgca

SEQ ID NO: 3273298 - RNA, 17 nt, Mycobacterium tuberculosis H37Rv
caccacgcgccgcacau

SEQ ID NO: 3273299 - RNA, 13 nt, Mycobacterium tuberculosis H37Rv
caccacgcuggcc

SEQ ID NO: 3273300 - RNA, 18 nt, Mycobacterium tuberculosis H37Rv
caccacgcuggccucguc

SEQ ID NO: 3273301 - RNA, 20 nt, Mycobacterium tuberculosis H37Rv
caccacgcuggccucgucgc

SEQ ID NO: 3273302 - RNA, 18 nt, Mycobacterium tuberculosis H37Rv
caccacggaccagcgccg

SEQ ID NO: 3273303 - RNA, 16 nt, Mycobacterium tuberculosis H37Rv
caccacggcgcgcagc

SEQ ID NO: 3273304 - RNA, 20 nt, Mycobacterium tuberculosis H37Rv
caccacggcgcgcagcgacg

SEQ ID NO: 3273305 - RNA, 14 nt, Mycobacterium tuberculosis H37Rv
caccacggcgcgcg

SEQ ID NO: 3273306 - RNA, 20 nt, Mycobacterium tuberculosis H37Rv
caccacggucaagccggcgc

SEQ ID NO: 3273307 - RNA, 21 nt, Mycobacterium tuberculosis H37Rv
caccacggugacuaccgugca

SEQ ID NO: 3273308 - RNA, 16 nt, Mycobacterium tuberculosis H37Rv
caccacgucccggaau

SEQ ID NO: 3273309 - RNA, 14 nt, Mycobacterium tuberculosis H37Rv
caccacgucgacga

SEQ ID NO: 3273310 - RNA, 14 nt, Mycobacterium tuberculosis H37Rv
caccacgugcgcca

SEQ ID NO: 3273311 - RNA, 15 nt, Mycobacterium tuberculosis H37Rv
caccacgugcgccac

SEQ ID NO: 3273312 - RNA, 16 nt, Mycobacterium tuberculosis H37Rv
caccacgugcgccacu

SEQ ID NO: 3273313 - RNA, 14 nt, Mycobacterium tuberculosis H37Rv
caccacguggcccu

SEQ ID NO: 3273314 - RNA, 22 nt, Mycobacterium tuberculosis H37Rv
caccacguugugcagcgcguca

SEQ ID NO: 3273315 - RNA, 21 nt, Mycobacterium tuberculosis H37Rv
caccacuagcggcucaccgcg

SEQ ID NO: 3273316 - RNA, 17 nt, Mycobacterium tuberculosis H37Rv
caccacugcggccgcgc

SEQ ID NO: 3273317 - RNA, 19 nt, Mycobacterium tuberculosis H37Rv
caccacugcggccgcgccg

SEQ ID NO: 3273318 - RNA, 20 nt, Mycobacterium tuberculosis H37Rv
caccacugcggccgcgccgu

SEQ ID NO: 3273319 - RNA, 17 nt, Mycobacterium tuberculosis H37Rv
caccacuggacccgccc

SEQ ID NO: 3273320 - RNA, 22 nt, Mycobacterium tuberculosis H37Rv
caccagaaaacauugcggcccu

SEQ ID NO: 3273321 - RNA, 22 nt, Mycobacterium tuberculosis H37Rv
caccagaaaugguucgcacacc

SEQ ID NO: 3273322 - RNA, 13 nt, Mycobacterium tuberculosis H37Rv
caccagaaccggu

SEQ ID NO: 3273323 - RNA, 20 nt, Mycobacterium tuberculosis H37Rv
caccagaauccugcuuucca

SEQ ID NO: 3273324 - RNA, 21 nt, Mycobacterium tuberculosis H37Rv
caccagaccaggaagcaggug

SEQ ID NO: 3273325 - RNA, 22 nt, Mycobacterium tuberculosis H37Rv
caccagagucaacaucagcacc

SEQ ID NO: 3273326 - RNA, 13 nt, Mycobacterium tuberculosis H37Rv
caccagaucaaca

SEQ ID NO: 3273327 - RNA, 22 nt, Mycobacterium tuberculosis H37Rv
caccagaucgcacaccaacacc

SEQ ID NO: 3273328 - RNA, 23 nt, Mycobacterium tuberculosis H37Rv
caccagaucguuccaggccgcgu

SEQ ID NO: 3273329 - RNA, 17 nt, Mycobacterium tuberculosis H37Rv
caccagaugcaccucgc

SEQ ID NO: 3273330 - RNA, 22 nt, Mycobacterium tuberculosis H37Rv
caccagaugcaccucgcccugc

SEQ ID NO: 3273331 - RNA, 14 nt, Mycobacterium tuberculosis H37Rv
caccagcaagugug

SEQ ID NO: 3273332 - RNA, 16 nt, Mycobacterium tuberculosis H37Rv
caccagcacggcaacc

SEQ ID NO: 3273333 - RNA, 24 nt, Mycobacterium tuberculosis H37Rv
caccagcacggcaaccagcgagcc

SEQ ID NO: 3273334 - RNA, 11 nt, Mycobacterium tuberculosis H37Rv
caccagcagga

SEQ ID NO: 3273335 - RNA, 19 nt, Mycobacterium tuberculosis H37Rv
caccagcaucguggccgca

SEQ ID NO: 3273336 - RNA, 20 nt, Mycobacterium tuberculosis H37Rv
caccagcaucguggccgcac

SEQ ID NO: 3273337 - RNA, 13 nt, Mycobacterium tuberculosis H37Rv
caccagcaugccu

SEQ ID NO: 3273338 - RNA, 17 nt, Mycobacterium tuberculosis H37Rv
caccagcauucucgccg

SEQ ID NO: 3273339 - RNA, 15 nt, Mycobacterium tuberculosis H37Rv
caccagccacgccag

SEQ ID NO: 3273340 - RNA, 13 nt, Mycobacterium tuberculosis H37Rv
caccagccagccu

SEQ ID NO: 3273341 - RNA, 12 nt, Mycobacterium tuberculosis H37Rv
caccagcccggc

SEQ ID NO: 3273342 - RNA, 18 nt, Mycobacterium tuberculosis H37Rv
caccagccgguagccggg

SEQ ID NO: 3273343 - RNA, 21 nt, Mycobacterium tuberculosis H37Rv
caccagccgguuggcugccgg

SEQ ID NO: 3273344 - RNA, 18 nt, Mycobacterium tuberculosis H37Rv
caccagcgaggccagcgg

SEQ ID NO: 3273345 - RNA, 15 nt, Mycobacterium tuberculosis H37Rv
caccagcgcagccga

SEQ ID NO: 3273346 - RNA, 17 nt, Mycobacterium tuberculosis H37Rv
caccagcgcaucggcca

SEQ ID NO: 3273347 - RNA, 23 nt, Mycobacterium tuberculosis H37Rv
caccagcgcaucggccagcagcg

SEQ ID NO: 3273348 - RNA, 15 nt, Mycobacterium tuberculosis H37Rv
caccagcgcccggcc

SEQ ID NO: 3273349 - RNA, 16 nt, Mycobacterium tuberculosis H37Rv
caccagcgcccggccc

SEQ ID NO: 3273350 - RNA, 20 nt, Mycobacterium tuberculosis H37Rv
caccagcgccgacccguacc

SEQ ID NO: 3273351 - RNA, 23 nt, Mycobacterium tuberculosis H37Rv
caccagcgcgccguagaccagca

SEQ ID NO: 3273352 - RNA, 15 nt, Mycobacterium tuberculosis H37Rv
caccagcgcuccagc

SEQ ID NO: 3273353 - RNA, 18 nt, Mycobacterium tuberculosis H37Rv
caccagcgcuccagcacc

SEQ ID NO: 3273354 - RNA, 21 nt, Mycobacterium tuberculosis H37Rv
caccagcgcuccagcacccgc

SEQ ID NO: 3273355 - RNA, 19 nt, Mycobacterium tuberculosis H37Rv
caccagcggcaccgcggcc

SEQ ID NO: 3273356 - RNA, 13 nt, Mycobacterium tuberculosis H37Rv
caccagcggcggc

SEQ ID NO: 3273357 - RNA, 15 nt, Mycobacterium tuberculosis H37Rv
caccagcgucgcggc

SEQ ID NO: 3273358 - RNA, 18 nt, Mycobacterium tuberculosis H37Rv
caccagcgucgcggccac

SEQ ID NO: 3273359 - RNA, 23 nt, Mycobacterium tuberculosis H37Rv
caccagcgucgcggccacgguca

SEQ ID NO: 3273360 - RNA, 15 nt, Mycobacterium tuberculosis H37Rv
caccagcucggugau

SEQ ID NO: 3273361 - RNA, 17 nt, Mycobacterium tuberculosis H37Rv
caccagcugcgcgaugu

SEQ ID NO: 3273362 - RNA, 18 nt, Mycobacterium tuberculosis H37Rv
caccagcugucgggcagc

SEQ ID NO: 3273363 - RNA, 13 nt, Mycobacterium tuberculosis H37Rv
caccaggagcgga

SEQ ID NO: 3273364 - RNA, 15 nt, Mycobacterium tuberculosis H37Rv
caccaggcccgguuc

SEQ ID NO: 3273365 - RNA, 22 nt, Mycobacterium tuberculosis H37Rv
caccaggccgagccgcccgccc

SEQ ID NO: 3273366 - RNA, 21 nt, Mycobacterium tuberculosis H37Rv
caccaggcgagccggcgcgca

SEQ ID NO: 3273367 - RNA, 23 nt, Mycobacterium tuberculosis H37Rv
caccaggcggccguaacggcgaa

SEQ ID NO: 3273368 - RNA, 20 nt, Mycobacterium tuberculosis H37Rv
caccagggcacguucggcgc

SEQ ID NO: 3273369 - RNA, 14 nt, Mycobacterium tuberculosis H37Rv
caccagggcgcgga

SEQ ID NO: 3273370 - RNA, 22 nt, Mycobacterium tuberculosis H37Rv
caccagggcgcggaucugcagc

SEQ ID NO: 3273371 - RNA, 18 nt, Mycobacterium tuberculosis H37Rv
caccagggcgugcgcgaa

SEQ ID NO: 3273372 - RNA, 19 nt, Mycobacterium tuberculosis H37Rv
caccaggggaccgcggcgc

SEQ ID NO: 3273373 - RNA, 19 nt, Mycobacterium tuberculosis H37Rv
caccagguacgcgaucagc

SEQ ID NO: 3273374 - RNA, 19 nt, Mycobacterium tuberculosis H37Rv
caccaggucauugccggcg

SEQ ID NO: 3273375 - RNA, 18 nt, Mycobacterium tuberculosis H37Rv
caccagguccaccccgcc

SEQ ID NO: 3273376 - RNA, 14 nt, Mycobacterium tuberculosis H37Rv
caccaggugucccc

SEQ ID NO: 3273377 - RNA, 18 nt, Mycobacterium tuberculosis H37Rv
caccagguguccccgccc

SEQ ID NO: 3273378 - RNA, 23 nt, Mycobacterium tuberculosis H37Rv
caccagguugccgagguugcgga

SEQ ID NO: 3273379 - RNA, 14 nt, Mycobacterium tuberculosis H37Rv
caccaguaccaccg

SEQ ID NO: 3273380 - RNA, 13 nt, Mycobacterium tuberculosis H37Rv
caccaguccagcg

SEQ ID NO: 3273381 - RNA, 19 nt, Mycobacterium tuberculosis H37Rv
caccaguggcgcgugcagc

SEQ ID NO: 3273382 - RNA, 14 nt, Mycobacterium tuberculosis H37Rv
caccaucaaggacu

SEQ ID NO: 3273383 - RNA, 14 nt, Mycobacterium tuberculosis H37Rv
caccaucaccucgc

SEQ ID NO: 3273384 - RNA, 20 nt, Mycobacterium tuberculosis H37Rv
caccaucacgguggccgcac

SEQ ID NO: 3273385 - RNA, 17 nt, Mycobacterium tuberculosis H37Rv
caccaucagcgacaagu

SEQ ID NO: 3273386 - RNA, 11 nt, Mycobacterium tuberculosis H37Rv
caccaucauca

SEQ ID NO: 3273387 - RNA, 13 nt, Mycobacterium tuberculosis H37Rv
caccaucgccgcc

SEQ ID NO: 3273388 - RNA, 17 nt, Mycobacterium tuberculosis H37Rv
caccaucgccucggcgc

SEQ ID NO: 3273389 - RNA, 18 nt, Mycobacterium tuberculosis H37Rv
caccaucgccucggcgcu

SEQ ID NO: 3273390 - RNA, 21 nt, Mycobacterium tuberculosis H37Rv
caccaucgguaucgagggcag

SEQ ID NO: 3273391 - RNA, 22 nt, Mycobacterium tuberculosis H37Rv
caccaucgguaucgagggcagc

SEQ ID NO: 3273392 - RNA, 16 nt, Mycobacterium tuberculosis H37Rv
caccaucguugccggu

SEQ ID NO: 3273393 - RNA, 16 nt, Mycobacterium tuberculosis H37Rv
caccaugaucacaccg

SEQ ID NO: 3273394 - RNA, 20 nt, Mycobacterium tuberculosis H37Rv
caccaugaucacaccgagcg

SEQ ID NO: 3273395 - RNA, 17 nt, Mycobacterium tuberculosis H37Rv
caccaugauugccagga

SEQ ID NO: 3273396 - RNA, 22 nt, Mycobacterium tuberculosis H37Rv
caccaugauugccaggaccgcg

SEQ ID NO: 3273397 - RNA, 18 nt, Mycobacterium tuberculosis H37Rv
caccaugggucuggcagg

SEQ ID NO: 3273398 - RNA, 21 nt, Mycobacterium tuberculosis H37Rv
caccaugggucuggcaggcca

SEQ ID NO: 3273399 - RNA, 21 nt, Mycobacterium tuberculosis H37Rv
caccauguauuucucccagcc

SEQ ID NO: 3273400 - RNA, 19 nt, Mycobacterium tuberculosis H37Rv
caccaugucggccacccgg

SEQ ID NO: 3273401 - RNA, 20 nt, Mycobacterium tuberculosis H37Rv
caccaugucggccacccgga

SEQ ID NO: 3273402 - RNA, 16 nt, Mycobacterium tuberculosis H37Rv
caccauucgcaccggc

SEQ ID NO: 3273403 - RNA, 13 nt, Mycobacterium tuberculosis H37Rv
caccauuggccaa

SEQ ID NO: 3273404 - RNA, 19 nt, Mycobacterium tuberculosis H37Rv
caccauuggccaagucagc

SEQ ID NO: 3273405 - RNA, 22 nt, Mycobacterium tuberculosis H37Rv
caccauuguuccguccccgacg

SEQ ID NO: 3273406 - RNA, 17 nt, Mycobacterium tuberculosis H37Rv
cacccaaaccggcccgc

SEQ ID NO: 3273407 - RNA, 23 nt, Mycobacterium tuberculosis H37Rv
cacccaaaccggcccgcagcagc

SEQ ID NO: 3273408 - RNA, 14 nt, Mycobacterium tuberculosis H37Rv
cacccaaccccgcc

SEQ ID NO: 3273409 - RNA, 21 nt, Mycobacterium tuberculosis H37Rv
cacccaacgcaauaagggaga

SEQ ID NO: 3273410 - RNA, 22 nt, Mycobacterium tuberculosis H37Rv
cacccaacgcggugggcacagc

SEQ ID NO: 3273411 - RNA, 15 nt, Mycobacterium tuberculosis H37Rv
cacccaacuccauca

SEQ ID NO: 3273412 - RNA, 17 nt, Mycobacterium tuberculosis H37Rv
cacccaauggagccgcg

SEQ ID NO: 3273413 - RNA, 19 nt, Mycobacterium tuberculosis H37Rv
cacccaauggagccgcgac

SEQ ID NO: 3273414 - RNA, 16 nt, Mycobacterium tuberculosis H37Rv
cacccacauggugauc

SEQ ID NO: 3273415 - RNA, 16 nt, Mycobacterium tuberculosis H37Rv
cacccaccacaccaag

SEQ ID NO: 3273416 - RNA, 17 nt, Mycobacterium tuberculosis H37Rv
cacccacccgcaccgcg

SEQ ID NO: 3273417 - RNA, 21 nt, Mycobacterium tuberculosis H37Rv
cacccacccguucggcugcgc

SEQ ID NO: 3273418 - RNA, 19 nt, Mycobacterium tuberculosis H37Rv
cacccaccggccaccaggg

SEQ ID NO: 3273419 - RNA, 13 nt, Mycobacterium tuberculosis H37Rv
cacccaccuggau

SEQ ID NO: 3273420 - RNA, 14 nt, Mycobacterium tuberculosis H37Rv
cacccacgccggug

SEQ ID NO: 3273421 - RNA, 14 nt, Mycobacterium tuberculosis H37Rv
cacccacgucgagc

SEQ ID NO: 3273422 - RNA, 15 nt, Mycobacterium tuberculosis H37Rv
cacccacuccgccga

SEQ ID NO: 3273423 - RNA, 14 nt, Mycobacterium tuberculosis H37Rv
cacccacuggacca

SEQ ID NO: 3273424 - RNA, 19 nt, Mycobacterium tuberculosis H37Rv
cacccacuggaccaccgcc

SEQ ID NO: 3273425 - RNA, 22 nt, Mycobacterium tuberculosis H37Rv
cacccagaaugacaucgucgcc

SEQ ID NO: 3273426 - RNA, 14 nt, Mycobacterium tuberculosis H37Rv
cacccagaccgccg

SEQ ID NO: 3273427 - RNA, 14 nt, Mycobacterium tuberculosis H37Rv
cacccagaugcagg

SEQ ID NO: 3273428 - RNA, 13 nt, Mycobacterium tuberculosis H37Rv
cacccagccgcag

SEQ ID NO: 3273429 - RNA, 15 nt, Mycobacterium tuberculosis H37Rv
cacccagccgcagcc

SEQ ID NO: 3273430 - RNA, 21 nt, Mycobacterium tuberculosis H37Rv
cacccagccggaaccggacag

SEQ ID NO: 3273431 - RNA, 17 nt, Mycobacterium tuberculosis H37Rv
cacccagcgacucggcc

SEQ ID NO: 3273432 - RNA, 16 nt, Mycobacterium tuberculosis H37Rv
cacccagcgccgaccc

SEQ ID NO: 3273433 - RNA, 13 nt, Mycobacterium tuberculosis H37Rv
cacccagcgcgcu

SEQ ID NO: 3273434 - RNA, 16 nt, Mycobacterium tuberculosis H37Rv
cacccagcggaaccga

SEQ ID NO: 3273435 - RNA, 20 nt, Mycobacterium tuberculosis H37Rv
cacccagcggcgugacgucg

SEQ ID NO: 3273436 - RNA, 17 nt, Mycobacterium tuberculosis H37Rv
cacccagcgugcccgcc

SEQ ID NO: 3273437 - RNA, 21 nt, Mycobacterium tuberculosis H37Rv
cacccagcgugcccgccaccg

SEQ ID NO: 3273438 - RNA, 23 nt, Mycobacterium tuberculosis H37Rv
cacccagcucgcgcacccagccc

SEQ ID NO: 3273439 - RNA, 20 nt, Mycobacterium tuberculosis H37Rv
cacccaggccauaccgcaau

SEQ ID NO: 3273440 - RNA, 16 nt, Mycobacterium tuberculosis H37Rv
cacccaggccgaugug

SEQ ID NO: 3273441 - RNA, 18 nt, Mycobacterium tuberculosis H37Rv
cacccagggcguuggcgg

SEQ ID NO: 3273442 - RNA, 23 nt, Mycobacterium tuberculosis H37Rv
cacccagucggcgccgccgucca

SEQ ID NO: 3273443 - RNA, 15 nt, Mycobacterium tuberculosis H37Rv
cacccagugccacgc

SEQ ID NO: 3273444 - RNA, 19 nt, Mycobacterium tuberculosis H37Rv
cacccagugccacgccuga

SEQ ID NO: 3273445 - RNA, 18 nt, Mycobacterium tuberculosis H37Rv
cacccaguuccacccggu

SEQ ID NO: 3273446 - RNA, 16 nt, Mycobacterium tuberculosis H37Rv
cacccauaccuucggc

SEQ ID NO: 3273447 - RNA, 21 nt, Mycobacterium tuberculosis H37Rv
cacccauaccuucggcgaucu

SEQ ID NO: 3273448 - RNA, 14 nt, Mycobacterium tuberculosis H37Rv
cacccaucccguuc

SEQ ID NO: 3273449 - RNA, 21 nt, Mycobacterium tuberculosis H37Rv
cacccauccucgcggugcgcc

SEQ ID NO: 3273450 - RNA, 17 nt, Mycobacterium tuberculosis H37Rv
cacccaucgaccgcccg

SEQ ID NO: 3273451 - RNA, 18 nt, Mycobacterium tuberculosis H37Rv
cacccaucgcacggauga

SEQ ID NO: 3273452 - RNA, 18 nt, Mycobacterium tuberculosis H37Rv
cacccaucgugcugaagc

SEQ ID NO: 3273453 - RNA, 22 nt, Mycobacterium tuberculosis H37Rv
cacccaucguuucgaagugccg

SEQ ID NO: 3273454 - RNA, 15 nt, Mycobacterium tuberculosis H37Rv
cacccauggccuccc

SEQ ID NO: 3273455 - RNA, 22 nt, Mycobacterium tuberculosis H37Rv
cacccauggccucccacucacc

SEQ ID NO: 3273456 - RNA, 17 nt, Mycobacterium tuberculosis H37Rv
caccccaaaaccgccgg

SEQ ID NO: 3273457 - RNA, 19 nt, Mycobacterium tuberculosis H37Rv
caccccaaaaccgccgguu

SEQ ID NO: 3273458 - RNA, 14 nt, Mycobacterium tuberculosis H37Rv
caccccacacaguc

SEQ ID NO: 3273459 - RNA, 12 nt, Mycobacterium tuberculosis H37Rv
caccccacaccg

SEQ ID NO: 3273460 - RNA, 13 nt, Mycobacterium tuberculosis H37Rv
caccccaggcacc

SEQ ID NO: 3273461 - RNA, 12 nt, Mycobacterium tuberculosis H37Rv
caccccagggca

SEQ ID NO: 3273462 - RNA, 19 nt, Mycobacterium tuberculosis H37Rv
caccccaucgauaaccgaa

SEQ ID NO: 3273463 - RNA, 22 nt, Mycobacterium tuberculosis H37Rv
cacccccaccgaagcggugacc

SEQ ID NO: 3273464 - RNA, 17 nt, Mycobacterium tuberculosis H37Rv
cacccccgacaccgccg

SEQ ID NO: 3273465 - RNA, 23 nt, Mycobacterium tuberculosis H37Rv
cacccccgacgagauacggccac

SEQ ID NO: 3273466 - RNA, 13 nt, Mycobacterium tuberculosis H37Rv
cacccccuggacu

SEQ ID NO: 3273467 - RNA, 14 nt, Mycobacterium tuberculosis H37Rv
caccccgaccacca

SEQ ID NO: 3273468 - RNA, 14 nt, Mycobacterium tuberculosis H37Rv
caccccgacguucg

SEQ ID NO: 3273469 - RNA, 14 nt, Mycobacterium tuberculosis H37Rv
caccccgagcggcu

SEQ ID NO: 3273470 - RNA, 21 nt, Mycobacterium tuberculosis H37Rv
caccccgaucacccgcaggua

SEQ ID NO: 3273471 - RNA, 22 nt, Mycobacterium tuberculosis H37Rv
caccccgaucuggcguagugcu

SEQ ID NO: 3273472 - RNA, 16 nt, Mycobacterium tuberculosis H37Rv
caccccgccaugcggc

SEQ ID NO: 3273473 - RNA, 18 nt, Mycobacterium tuberculosis H37Rv
caccccgcuugcgcggcu

SEQ ID NO: 3273474 - RNA, 20 nt, Mycobacterium tuberculosis H37Rv
caccccggaauccccaagcc

SEQ ID NO: 3273475 - RNA, 13 nt, Mycobacterium tuberculosis H37Rv
caccccggccacu

SEQ ID NO: 3273476 - RNA, 22 nt, Mycobacterium tuberculosis H37Rv
caccccggcggccaucccgcgu

SEQ ID NO: 3273477 - RNA, 15 nt, Mycobacterium tuberculosis H37Rv
caccccggcggcguc

SEQ ID NO: 3273478 - RNA, 19 nt, Mycobacterium tuberculosis H37Rv
caccccggucccgccgacc

SEQ ID NO: 3273479 - RNA, 16 nt, Mycobacterium tuberculosis H37Rv
caccccggucggagcg

SEQ ID NO: 3273480 - RNA, 23 nt, Mycobacterium tuberculosis H37Rv
caccccggugcccgcggugacga

SEQ ID NO: 3273481 - RNA, 20 nt, Mycobacterium tuberculosis H37Rv
caccccgguucgacgucugc

SEQ ID NO: 3273482 - RNA, 17 nt, Mycobacterium tuberculosis H37Rv
caccccguagcggucuc

SEQ ID NO: 3273483 - RNA, 15 nt, Mycobacterium tuberculosis H37Rv
caccccuucgccagc

SEQ ID NO: 3273484 - RNA, 14 nt, Mycobacterium tuberculosis H37Rv
caccccuuugacgc

SEQ ID NO: 3273485 - RNA, 14 nt, Mycobacterium tuberculosis H37Rv
cacccgagccgcac

SEQ ID NO: 3273486 - RNA, 19 nt, Mycobacterium tuberculosis H37Rv
cacccgagggccugacgcg

SEQ ID NO: 3273487 - RNA, 16 nt, Mycobacterium tuberculosis H37Rv
cacccgauuggccaac

SEQ ID NO: 3273488 - RNA, 19 nt, Mycobacterium tuberculosis H37Rv
cacccgauuggccaacccc

SEQ ID NO: 3273489 - RNA, 18 nt, Mycobacterium tuberculosis H37Rv
cacccgcaaugaccgcgg

SEQ ID NO: 3273490 - RNA, 16 nt, Mycobacterium tuberculosis H37Rv
cacccgcaccaccggc

SEQ ID NO: 3273491 - RNA, 17 nt, Mycobacterium tuberculosis H37Rv
cacccgcaccaccggcc

SEQ ID NO: 3273492 - RNA, 17 nt, Mycobacterium tuberculosis H37Rv
cacccgcaccgccggca

SEQ ID NO: 3273493 - RNA, 15 nt, Mycobacterium tuberculosis H37Rv
cacccgcaccgcggu

SEQ ID NO: 3273494 - RNA, 14 nt, Mycobacterium tuberculosis H37Rv
cacccgcaccggau

SEQ ID NO: 3273495 - RNA, 15 nt, Mycobacterium tuberculosis H37Rv
cacccgcacgaagcc

SEQ ID NO: 3273496 - RNA, 23 nt, Mycobacterium tuberculosis H37Rv
cacccgcacggccuccggaccga

SEQ ID NO: 3273497 - RNA, 16 nt, Mycobacterium tuberculosis H37Rv
cacccgcagaccgguu

SEQ ID NO: 3273498 - RNA, 13 nt, Mycobacterium tuberculosis H37Rv
cacccgcagccgc

SEQ ID NO: 3273499 - RNA, 21 nt, Mycobacterium tuberculosis H37Rv
cacccgcaggucgaucugcgc

SEQ ID NO: 3273500 - RNA, 21 nt, Mycobacterium tuberculosis H37Rv
cacccgccaggccgcgcgaca

SEQ ID NO: 3273501 - RNA, 20 nt, Mycobacterium tuberculosis H37Rv
cacccgccagggcggcaucc

SEQ ID NO: 3273502 - RNA, 16 nt, Mycobacterium tuberculosis H37Rv
cacccgcgaagccgcc

SEQ ID NO: 3273503 - RNA, 12 nt, Mycobacterium tuberculosis H37Rv
cacccgcgacga

SEQ ID NO: 3273504 - RNA, 23 nt, Mycobacterium tuberculosis H37Rv
cacccgcgcgaugcuggcgaacu

SEQ ID NO: 3273505 - RNA, 13 nt, Mycobacterium tuberculosis H37Rv
cacccgcgcucca

SEQ ID NO: 3273506 - RNA, 12 nt, Mycobacterium tuberculosis H37Rv
cacccgcggcga

SEQ ID NO: 3273507 - RNA, 15 nt, Mycobacterium tuberculosis H37Rv
cacccgcggcgaacc

SEQ ID NO: 3273508 - RNA, 14 nt, Mycobacterium tuberculosis H37Rv
cacccgcggcgccg

SEQ ID NO: 3273509 - RNA, 15 nt, Mycobacterium tuberculosis H37Rv
cacccgcggcgccgu

SEQ ID NO: 3273510 - RNA, 17 nt, Mycobacterium tuberculosis H37Rv
cacccgcggcgccguug

SEQ ID NO: 3273511 - RNA, 16 nt, Mycobacterium tuberculosis H37Rv
cacccgcgucgagugc

SEQ ID NO: 3273512 - RNA, 17 nt, Mycobacterium tuberculosis H37Rv
cacccgcuccagcucgg

SEQ ID NO: 3273513 - RNA, 21 nt, Mycobacterium tuberculosis H37Rv
cacccgcucgcccgccgccac

SEQ ID NO: 3273514 - RNA, 23 nt, Mycobacterium tuberculosis H37Rv
cacccgcucgcccgccgccacca

SEQ ID NO: 3273515 - RNA, 16 nt, Mycobacterium tuberculosis H37Rv
cacccgcucggccgcc

SEQ ID NO: 3273516 - RNA, 20 nt, Mycobacterium tuberculosis H37Rv
cacccgcucggccgccgggu

SEQ ID NO: 3273517 - RNA, 14 nt, Mycobacterium tuberculosis H37Rv
cacccgcucggcgc

SEQ ID NO: 3273518 - RNA, 16 nt, Mycobacterium tuberculosis H37Rv
cacccgcucgucggua

SEQ ID NO: 3273519 - RNA, 17 nt, Mycobacterium tuberculosis H37Rv
cacccgcuggucgagca

SEQ ID NO: 3273520 - RNA, 23 nt, Mycobacterium tuberculosis H37Rv
cacccgcuuaucgaacgucucgg

SEQ ID NO: 3273521 - RNA, 17 nt, Mycobacterium tuberculosis H37Rv
cacccgcuuugcacugu

SEQ ID NO: 3273522 - RNA, 18 nt, Mycobacterium tuberculosis H37Rv
cacccggaaagaucucgg

SEQ ID NO: 3273523 - RNA, 22 nt, Mycobacterium tuberculosis H37Rv
cacccggaaagaucucggucac

SEQ ID NO: 3273524 - RNA, 22 nt, Mycobacterium tuberculosis H37Rv
cacccggacugcgaagaguccu

SEQ ID NO: 3273525 - RNA, 18 nt, Mycobacterium tuberculosis H37Rv
cacccggcaaucucccga

SEQ ID NO: 3273526 - RNA, 23 nt, Mycobacterium tuberculosis H37Rv
cacccggccguugggccaccggc

SEQ ID NO: 3273527 - RNA, 21 nt, Mycobacterium tuberculosis H37Rv
cacccggcgggcggugggcag

SEQ ID NO: 3273528 - RNA, 19 nt, Mycobacterium tuberculosis H37Rv
cacccggcugaaacguccu

SEQ ID NO: 3273529 - RNA, 16 nt, Mycobacterium tuberculosis H37Rv
cacccgggaugaccac

SEQ ID NO: 3273530 - RNA, 17 nt, Mycobacterium tuberculosis H37Rv
cacccgggccgccucga

SEQ ID NO: 3273531 - RNA, 22 nt, Mycobacterium tuberculosis H37Rv
cacccgggccucggcgccgucg

SEQ ID NO: 3273532 - RNA, 23 nt, Mycobacterium tuberculosis H37Rv
cacccgguagacgucguagacac

SEQ ID NO: 3273533 - RNA, 17 nt, Mycobacterium tuberculosis H37Rv
cacccggucaacgugaa

SEQ ID NO: 3273534 - RNA, 19 nt, Mycobacterium tuberculosis H37Rv
cacccggucaucggccguc

SEQ ID NO: 3273535 - RNA, 17 nt, Mycobacterium tuberculosis H37Rv
cacccgguccugcucgc

SEQ ID NO: 3273536 - RNA, 23 nt, Mycobacterium tuberculosis H37Rv
cacccgguggcugaucaccguug

SEQ ID NO: 3273537 - RNA, 21 nt, Mycobacterium tuberculosis H37Rv
cacccgguugugcgcgcgccc

SEQ ID NO: 3273538 - RNA, 15 nt, Mycobacterium tuberculosis H37Rv
cacccguaagcggau

SEQ ID NO: 3273539 - RNA, 16 nt, Mycobacterium tuberculosis H37Rv
cacccguaagcggaug

SEQ ID NO: 3273540 - RNA, 20 nt, Mycobacterium tuberculosis H37Rv
cacccgucacaagcugacac

SEQ ID NO: 3273541 - RNA, 20 nt, Mycobacterium tuberculosis H37Rv
cacccguccgccgcagacgc

SEQ ID NO: 3273542 - RNA, 14 nt, Mycobacterium tuberculosis H37Rv
cacccgugccgccg

SEQ ID NO: 3273543 - RNA, 19 nt, Mycobacterium tuberculosis H37Rv
cacccguugcucccacggc

SEQ ID NO: 3273544 - RNA, 13 nt, Mycobacterium tuberculosis H37Rv
cacccucgggccc

SEQ ID NO: 3273545 - RNA, 19 nt, Mycobacterium tuberculosis H37Rv
cacccucggguccaaccac

SEQ ID NO: 3273546 - RNA, 15 nt, Mycobacterium tuberculosis H37Rv
cacccugaccaacau

SEQ ID NO: 3273547 - RNA, 21 nt, Mycobacterium tuberculosis H37Rv
cacccugaugugaguccagcc

SEQ ID NO: 3273548 - RNA, 22 nt, Mycobacterium tuberculosis H37Rv
cacccugaugugaguccagccg

SEQ ID NO: 3273549 - RNA, 22 nt, Mycobacterium tuberculosis H37Rv
cacccugcgaauagccaccaag

SEQ ID NO: 3273550 - RNA, 15 nt, Mycobacterium tuberculosis H37Rv
cacccugcggcaccu

SEQ ID NO: 3273551 - RNA, 21 nt, Mycobacterium tuberculosis H37Rv
cacccugcggcaccucauugc

SEQ ID NO: 3273552 - RNA, 21 nt, Mycobacterium tuberculosis H37Rv
cacccugcucgaacgcugagg

SEQ ID NO: 3273553 - RNA, 13 nt, Mycobacterium tuberculosis H37Rv
cacccuggucgaa

SEQ ID NO: 3273554 - RNA, 13 nt, Mycobacterium tuberculosis H37Rv
cacccuugcccac

SEQ ID NO: 3273555 - RNA, 20 nt, Mycobacterium tuberculosis H37Rv
cacccuugcccacggcgacc

SEQ ID NO: 3273556 - RNA, 13 nt, Mycobacterium tuberculosis H37Rv
cacccuugccgcc

SEQ ID NO: 3273557 - RNA, 17 nt, Mycobacterium tuberculosis H37Rv
cacccuugccgccggug

SEQ ID NO: 3273558 - RNA, 13 nt, Mycobacterium tuberculosis H37Rv
cacccuuggcccg

SEQ ID NO: 3273559 - RNA, 20 nt, Mycobacterium tuberculosis H37Rv
cacccuuggcccggugcagc

SEQ ID NO: 3273560 - RNA, 17 nt, Mycobacterium tuberculosis H37Rv
caccgaaaccggucagc

SEQ ID NO: 3273561 - RNA, 16 nt, Mycobacterium tuberculosis H37Rv
caccgaaacgccgacc

SEQ ID NO: 3273562 - RNA, 17 nt, Mycobacterium tuberculosis H37Rv
caccgaaacgccgaccu

SEQ ID NO: 3273563 - RNA, 21 nt, Mycobacterium tuberculosis H37Rv
caccgaaagccucucuuccca

SEQ ID NO: 3273564 - RNA, 17 nt, Mycobacterium tuberculosis H37Rv
caccgaaauacccagcg

SEQ ID NO: 3273565 - RNA, 16 nt, Mycobacterium tuberculosis H37Rv
caccgaacagucgcag

SEQ ID NO: 3273566 - RNA, 20 nt, Mycobacterium tuberculosis H37Rv
caccgaacccgccaccgcga

SEQ ID NO: 3273567 - RNA, 15 nt, Mycobacterium tuberculosis H37Rv
caccgaaccgccgcu

SEQ ID NO: 3273568 - RNA, 13 nt, Mycobacterium tuberculosis H37Rv
caccgaacgcgau

SEQ ID NO: 3273569 - RNA, 15 nt, Mycobacterium tuberculosis H37Rv
caccgaacgcggcca

SEQ ID NO: 3273570 - RNA, 21 nt, Mycobacterium tuberculosis H37Rv
caccgaacuugcggaccuggc

SEQ ID NO: 3273571 - RNA, 16 nt, Mycobacterium tuberculosis H37Rv
caccgaauuacgcacc

SEQ ID NO: 3273572 - RNA, 21 nt, Mycobacterium tuberculosis H37Rv
caccgacaagaauggccgccu

SEQ ID NO: 3273573 - RNA, 22 nt, Mycobacterium tuberculosis H37Rv
caccgacaagaauggccgccuu

SEQ ID NO: 3273574 - RNA, 16 nt, Mycobacterium tuberculosis H37Rv
caccgacaccggccgc

SEQ ID NO: 3273575 - RNA, 14 nt, Mycobacterium tuberculosis H37Rv
caccgacaccgugc

SEQ ID NO: 3273576 - RNA, 14 nt, Mycobacterium tuberculosis H37Rv
caccgacagcaccc

SEQ ID NO: 3273577 - RNA, 21 nt, Mycobacterium tuberculosis H37Rv
caccgacagcacccaaugcca

SEQ ID NO: 3273578 - RNA, 16 nt, Mycobacterium tuberculosis H37Rv
caccgacagccccauc

SEQ ID NO: 3273579 - RNA, 22 nt, Mycobacterium tuberculosis H37Rv
caccgacagccccaucaccacc

SEQ ID NO: 3273580 - RNA, 14 nt, Mycobacterium tuberculosis H37Rv
caccgacagcccga

SEQ ID NO: 3273581 - RNA, 20 nt, Mycobacterium tuberculosis H37Rv
caccgacagcccgaacgagg

SEQ ID NO: 3273582 - RNA, 18 nt, Mycobacterium tuberculosis H37Rv
caccgacaucgucaucca

SEQ ID NO: 3273583 - RNA, 21 nt, Mycobacterium tuberculosis H37Rv
caccgacaucgucauccaggg

SEQ ID NO: 3273584 - RNA, 22 nt, Mycobacterium tuberculosis H37Rv
caccgacauguguggcagcccc

SEQ ID NO: 3273585 - RNA, 19 nt, Mycobacterium tuberculosis H37Rv
caccgaccagggccgccgc

SEQ ID NO: 3273586 - RNA, 20 nt, Mycobacterium tuberculosis H37Rv
caccgaccagggccgccgcu

SEQ ID NO: 3273587 - RNA, 21 nt, Mycobacterium tuberculosis H37Rv
caccgaccuggacgcggccaa

SEQ ID NO: 3273588 - RNA, 21 nt, Mycobacterium tuberculosis H37Rv
caccgacgacggcgacggcgc

SEQ ID NO: 3273589 - RNA, 15 nt, Mycobacterium tuberculosis H37Rv
caccgacgccgauac

SEQ ID NO: 3273590 - RNA, 20 nt, Mycobacterium tuberculosis H37Rv
caccgacgcgucggcgacgc

SEQ ID NO: 3273591 - RNA, 18 nt, Mycobacterium tuberculosis H37Rv
caccgacggaugaucagc

SEQ ID NO: 3273592 - RNA, 14 nt, Mycobacterium tuberculosis H37Rv
caccgacgucaggc

SEQ ID NO: 3273593 - RNA, 18 nt, Mycobacterium tuberculosis H37Rv
caccgacgucggcuucac

SEQ ID NO: 3273594 - RNA, 19 nt, Mycobacterium tuberculosis H37Rv
caccgagaucaugccggcg

SEQ ID NO: 3273595 - RNA, 15 nt, Mycobacterium tuberculosis H37Rv
caccgagaucggaca

SEQ ID NO: 3273596 - RNA, 21 nt, Mycobacterium tuberculosis H37Rv
caccgagaugcgcaauagacc

SEQ ID NO: 3273597 - RNA, 15 nt, Mycobacterium tuberculosis H37Rv
caccgagcaucucgu

SEQ ID NO: 3273598 - RNA, 15 nt, Mycobacterium tuberculosis H37Rv
caccgagccacgacc

SEQ ID NO: 3273599 - RNA, 21 nt, Mycobacterium tuberculosis H37Rv
caccgagccguccaagccagc

SEQ ID NO: 3273600 - RNA, 17 nt, Mycobacterium tuberculosis H37Rv
caccgagcgcaacccgu

SEQ ID NO: 3273601 - RNA, 20 nt, Mycobacterium tuberculosis H37Rv
caccgagcgcaaucgaccac

SEQ ID NO: 3273602 - RNA, 14 nt, Mycobacterium tuberculosis H37Rv
caccgagcggugaa

SEQ ID NO: 3273603 - RNA, 13 nt, Mycobacterium tuberculosis H37Rv
caccgagcugagc

SEQ ID NO: 3273604 - RNA, 18 nt, Mycobacterium tuberculosis H37Rv
caccgagcugagcggcca

SEQ ID NO: 3273605 - RNA, 20 nt, Mycobacterium tuberculosis H37Rv
caccgagcuuguccagcggc

SEQ ID NO: 3273606 - RNA, 16 nt, Mycobacterium tuberculosis H37Rv
caccgagggcaaggac

SEQ ID NO: 3273607 - RNA, 18 nt, Mycobacterium tuberculosis H37Rv
caccgaggucgagcgacc

SEQ ID NO: 3273608 - RNA, 22 nt, Mycobacterium tuberculosis H37Rv
caccgaggucgagcgaccccac

SEQ ID NO: 3273609 - RNA, 16 nt, Mycobacterium tuberculosis H37Rv
caccgaggugccgcgc

SEQ ID NO: 3273610 - RNA, 19 nt, Mycobacterium tuberculosis H37Rv
caccgaggugccgcgcagc

SEQ ID NO: 3273611 - RNA, 23 nt, Mycobacterium tuberculosis H37Rv
caccgaggugccgcgcagcugcc

SEQ ID NO: 3273612 - RNA, 14 nt, Mycobacterium tuberculosis H37Rv
caccgagguugcgc

SEQ ID NO: 3273613 - RNA, 21 nt, Mycobacterium tuberculosis H37Rv
caccgaguauuuuucgaccag

SEQ ID NO: 3273614 - RNA, 19 nt, Mycobacterium tuberculosis H37Rv
caccgauacccccggcauu

SEQ ID NO: 3273615 - RNA, 17 nt, Mycobacterium tuberculosis H37Rv
caccgauaccgucagcg

SEQ ID NO: 3273616 - RNA, 22 nt, Mycobacterium tuberculosis H37Rv
caccgauaccgucagcgccgcu

SEQ ID NO: 3273617 - RNA, 15 nt, Mycobacterium tuberculosis H37Rv
caccgaucccgcggc

SEQ ID NO: 3273618 - RNA, 15 nt, Mycobacterium tuberculosis H37Rv
caccgauccggccgc

SEQ ID NO: 3273619 - RNA, 13 nt, Mycobacterium tuberculosis H37Rv
caccgauccugga

SEQ ID NO: 3273620 - RNA, 17 nt, Mycobacterium tuberculosis H37Rv
caccgaucgacugcagc

SEQ ID NO: 3273621 - RNA, 12 nt, Mycobacterium tuberculosis H37Rv
caccgaucggca

SEQ ID NO: 3273622 - RNA, 16 nt, Mycobacterium tuberculosis H37Rv
caccgaucucgaccag

SEQ ID NO: 3273623 - RNA, 14 nt, Mycobacterium tuberculosis H37Rv
caccgaugagccga

SEQ ID NO: 3273624 - RNA, 15 nt, Mycobacterium tuberculosis H37Rv
caccgaugccacauc

SEQ ID NO: 3273625 - RNA, 20 nt, Mycobacterium tuberculosis H37Rv
caccgaugccgaagcccccg

SEQ ID NO: 3273626 - RNA, 15 nt, Mycobacterium tuberculosis H37Rv
caccgaugccuugac

SEQ ID NO: 3273627 - RNA, 19 nt, Mycobacterium tuberculosis H37Rv
caccgaugccuugaccgcg

SEQ ID NO: 3273628 - RNA, 13 nt, Mycobacterium tuberculosis H37Rv
caccgaugcguuc

SEQ ID NO: 3273629 - RNA, 17 nt, Mycobacterium tuberculosis H37Rv
caccgaugcguucgggc

SEQ ID NO: 3273630 - RNA, 17 nt, Mycobacterium tuberculosis H37Rv
caccgauggcgcaccgg

SEQ ID NO: 3273631 - RNA, 22 nt, Mycobacterium tuberculosis H37Rv
caccgauggcgguggugccgcg

SEQ ID NO: 3273632 - RNA, 19 nt, Mycobacterium tuberculosis H37Rv
caccgcaaaguagacgugc

SEQ ID NO: 3273633 - RNA, 18 nt, Mycobacterium tuberculosis H37Rv
caccgcaaccaaagcgac

SEQ ID NO: 3273634 - RNA, 23 nt, Mycobacterium tuberculosis H37Rv
caccgcaaccaaagcgacgagca

SEQ ID NO: 3273635 - RNA, 15 nt, Mycobacterium tuberculosis H37Rv
caccgcaaccacgcc

SEQ ID NO: 3273636 - RNA, 19 nt, Mycobacterium tuberculosis H37Rv
caccgcaacgcuucggcag

SEQ ID NO: 3273637 - RNA, 20 nt, Mycobacterium tuberculosis H37Rv
caccgcaacgcuucggcagc

SEQ ID NO: 3273638 - RNA, 15 nt, Mycobacterium tuberculosis H37Rv
caccgcaagaaucag

SEQ ID NO: 3273639 - RNA, 15 nt, Mycobacterium tuberculosis H37Rv
caccgcacaccugcg

SEQ ID NO: 3273640 - RNA, 18 nt, Mycobacterium tuberculosis H37Rv
caccgcaccggaauacag

SEQ ID NO: 3273641 - RNA, 16 nt, Mycobacterium tuberculosis H37Rv
caccgcagcggguggu

SEQ ID NO: 3273642 - RNA, 18 nt, Mycobacterium tuberculosis H37Rv
caccgcagcggguggugc

SEQ ID NO: 3273643 - RNA, 16 nt, Mycobacterium tuberculosis H37Rv
caccgcauaacgccag

SEQ ID NO: 3273644 - RNA, 20 nt, Mycobacterium tuberculosis H37Rv
caccgcauaacgccaguccc

SEQ ID NO: 3273645 - RNA, 20 nt, Mycobacterium tuberculosis H37Rv
caccgcauuguugaagaaag

SEQ ID NO: 3273646 - RNA, 17 nt, Mycobacterium tuberculosis H37Rv
caccgccaacuccucag

SEQ ID NO: 3273647 - RNA, 16 nt, Mycobacterium tuberculosis H37Rv
caccgccaccacccag

SEQ ID NO: 3273648 - RNA, 15 nt, Mycobacterium tuberculosis H37Rv
caccgccaccacggu

SEQ ID NO: 3273649 - RNA, 18 nt, Mycobacterium tuberculosis H37Rv
caccgccagauaggcacc

SEQ ID NO: 3273650 - RNA, 13 nt, Mycobacterium tuberculosis H37Rv
caccgccagcaga

SEQ ID NO: 3273651 - RNA, 15 nt, Mycobacterium tuberculosis H37Rv
caccgccagccccgc

SEQ ID NO: 3273652 - RNA, 16 nt, Mycobacterium tuberculosis H37Rv
caccgccagcggcaau

SEQ ID NO: 3273653 - RNA, 21 nt, Mycobacterium tuberculosis H37Rv
caccgccaguuccggugacgg

SEQ ID NO: 3273654 - RNA, 17 nt, Mycobacterium tuberculosis H37Rv
caccgccaugaacucga

SEQ ID NO: 3273655 - RNA, 20 nt, Mycobacterium tuberculosis H37Rv
caccgcccccgucggccuug

SEQ ID NO: 3273656 - RNA, 15 nt, Mycobacterium tuberculosis H37Rv
caccgccccgccaac

SEQ ID NO: 3273657 - RNA, 19 nt, Mycobacterium tuberculosis H37Rv
caccgccccgccaaccacu

SEQ ID NO: 3273658 - RNA, 14 nt, Mycobacterium tuberculosis H37Rv
caccgccccgccgc

SEQ ID NO: 3273659 - RNA, 15 nt, Mycobacterium tuberculosis H37Rv
caccgccccgcgccc

SEQ ID NO: 3273660 - RNA, 16 nt, Mycobacterium tuberculosis H37Rv
caccgccccgcgccca

SEQ ID NO: 3273661 - RNA, 18 nt, Mycobacterium tuberculosis H37Rv
caccgccccgcgcccaac

SEQ ID NO: 3273662 - RNA, 22 nt, Mycobacterium tuberculosis H37Rv
caccgccccggcggcggcggcc

SEQ ID NO: 3273663 - RNA, 17 nt, Mycobacterium tuberculosis H37Rv
caccgcccgcaagucgg

SEQ ID NO: 3273664 - RNA, 23 nt, Mycobacterium tuberculosis H37Rv
caccgcccgcaagucggacgggu

SEQ ID NO: 3273665 - RNA, 15 nt, Mycobacterium tuberculosis H37Rv
caccgcccgccgaac

SEQ ID NO: 3273666 - RNA, 14 nt, Mycobacterium tuberculosis H37Rv
caccgcccggcccg

SEQ ID NO: 3273667 - RNA, 15 nt, Mycobacterium tuberculosis H37Rv
caccgcccggcccgg

SEQ ID NO: 3273668 - RNA, 14 nt, Mycobacterium tuberculosis H37Rv
caccgcccggcccu

SEQ ID NO: 3273669 - RNA, 15 nt, Mycobacterium tuberculosis H37Rv
caccgcccuugccgc

SEQ ID NO: 3273670 - RNA, 17 nt, Mycobacterium tuberculosis H37Rv
caccgcccuugccgccg

SEQ ID NO: 3273671 - RNA, 12 nt, Mycobacterium tuberculosis H37Rv
caccgccgacac

SEQ ID NO: 3273672 - RNA, 22 nt, Mycobacterium tuberculosis H37Rv
caccgccgacaggccggccacc

SEQ ID NO: 3273673 - RNA, 12 nt, Mycobacterium tuberculosis H37Rv
caccgccgacau

SEQ ID NO: 3273674 - RNA, 20 nt, Mycobacterium tuberculosis H37Rv
caccgccgacauggcggugc

SEQ ID NO: 3273675 - RNA, 16 nt, Mycobacterium tuberculosis H37Rv
caccgccgaccaggcc

SEQ ID NO: 3273676 - RNA, 17 nt, Mycobacterium tuberculosis H37Rv
caccgccgaccuaguca

SEQ ID NO: 3273677 - RNA, 16 nt, Mycobacterium tuberculosis H37Rv
caccgccgacgcccga

SEQ ID NO: 3273678 - RNA, 13 nt, Mycobacterium tuberculosis H37Rv
caccgccgcacgc

SEQ ID NO: 3273679 - RNA, 13 nt, Mycobacterium tuberculosis H37Rv
caccgccgcccaa

SEQ ID NO: 3273680 - RNA, 22 nt, Mycobacterium tuberculosis H37Rv
caccgccgccgaagcgaugccg

SEQ ID NO: 3273681 - RNA, 17 nt, Mycobacterium tuberculosis H37Rv
caccgccgccgccaccg

SEQ ID NO: 3273682 - RNA, 20 nt, Mycobacterium tuberculosis H37Rv
caccgccgccgccaccggcg

SEQ ID NO: 3273683 - RNA, 13 nt, Mycobacterium tuberculosis H37Rv
caccgccgccgga

SEQ ID NO: 3273684 - RNA, 14 nt, Mycobacterium tuberculosis H37Rv
caccgccgccggag

SEQ ID NO: 3273685 - RNA, 16 nt, Mycobacterium tuberculosis H37Rv
caccgccgccggaggu

SEQ ID NO: 3273686 - RNA, 14 nt, Mycobacterium tuberculosis H37Rv
caccgccgccggca

SEQ ID NO: 3273687 - RNA, 15 nt, Mycobacterium tuberculosis H37Rv
caccgccgccggcac

SEQ ID NO: 3273688 - RNA, 12 nt, Mycobacterium tuberculosis H37Rv
caccgccgccug

SEQ ID NO: 3273689 - RNA, 13 nt, Mycobacterium tuberculosis H37Rv
caccgccgccugc

SEQ ID NO: 3273690 - RNA, 20 nt, Mycobacterium tuberculosis H37Rv
caccgccgccugcccggccc

SEQ ID NO: 3273691 - RNA, 13 nt, Mycobacterium tuberculosis H37Rv
caccgccgcgacc

SEQ ID NO: 3273692 - RNA, 15 nt, Mycobacterium tuberculosis H37Rv
caccgccgcgcgaca

SEQ ID NO: 3273693 - RNA, 12 nt, Mycobacterium tuberculosis H37Rv
caccgccgcggc

SEQ ID NO: 3273694 - RNA, 14 nt, Mycobacterium tuberculosis H37Rv
caccgccgcggccg

SEQ ID NO: 3273695 - RNA, 19 nt, Mycobacterium tuberculosis H37Rv
caccgccgcggccgccguc

SEQ ID NO: 3273696 - RNA, 14 nt, Mycobacterium tuberculosis H37Rv
caccgccgcgucga

SEQ ID NO: 3273697 - RNA, 18 nt, Mycobacterium tuberculosis H37Rv
caccgccgcuaccgcccg

SEQ ID NO: 3273698 - RNA, 23 nt, Mycobacterium tuberculosis H37Rv
caccgccgcuaccgcccgcgcca

SEQ ID NO: 3273699 - RNA, 17 nt, Mycobacterium tuberculosis H37Rv
caccgccgcugccggua

SEQ ID NO: 3273700 - RNA, 17 nt, Mycobacterium tuberculosis H37Rv
caccgccggcaccgccg

SEQ ID NO: 3273701 - RNA, 14 nt, Mycobacterium tuberculosis H37Rv
caccgccggccuug

SEQ ID NO: 3273702 - RNA, 14 nt, Mycobacterium tuberculosis H37Rv
caccgccggcgccc

SEQ ID NO: 3273703 - RNA, 18 nt, Mycobacterium tuberculosis H37Rv
caccgccggcgcccaggc

SEQ ID NO: 3273704 - RNA, 21 nt, Mycobacterium tuberculosis H37Rv
caccgccggcgcccaggccga

SEQ ID NO: 3273705 - RNA, 19 nt, Mycobacterium tuberculosis H37Rv
caccgccggcgccgccguc

SEQ ID NO: 3273706 - RNA, 20 nt, Mycobacterium tuberculosis H37Rv
caccgccgggaugccggccc

SEQ ID NO: 3273707 - RNA, 17 nt, Mycobacterium tuberculosis H37Rv
caccgccggugccgcca

SEQ ID NO: 3273708 - RNA, 19 nt, Mycobacterium tuberculosis H37Rv
caccgccggugccgccauc

SEQ ID NO: 3273709 - RNA, 17 nt, Mycobacterium tuberculosis H37Rv
caccgccggugcggcca

SEQ ID NO: 3273710 - RNA, 18 nt, Mycobacterium tuberculosis H37Rv
caccgccggugcugacga

SEQ ID NO: 3273711 - RNA, 20 nt, Mycobacterium tuberculosis H37Rv
caccgccguuaccgccguua

SEQ ID NO: 3273712 - RNA, 18 nt, Mycobacterium tuberculosis H37Rv
caccgccguugccgaucg

SEQ ID NO: 3273713 - RNA, 17 nt, Mycobacterium tuberculosis H37Rv
caccgccguugccgccg

SEQ ID NO: 3273714 - RNA, 18 nt, Mycobacterium tuberculosis H37Rv
caccgccguugccgccgg

SEQ ID NO: 3273715 - RNA, 24 nt, Mycobacterium tuberculosis H37Rv
caccgccguugccgccggcgccgc

SEQ ID NO: 3273716 - RNA, 20 nt, Mycobacterium tuberculosis H37Rv
caccgccguugggccgcgcc

SEQ ID NO: 3273717 - RNA, 14 nt, Mycobacterium tuberculosis H37Rv
caccgccucacugg

SEQ ID NO: 3273718 - RNA, 23 nt, Mycobacterium tuberculosis H37Rv
caccgccugcgccgcccgcgcca

SEQ ID NO: 3273719 - RNA, 16 nt, Mycobacterium tuberculosis H37Rv
caccgccugcgccuug

SEQ ID NO: 3273720 - RNA, 21 nt, Mycobacterium tuberculosis H37Rv
caccgccuggaucagcgcguu

SEQ ID NO: 3273721 - RNA, 23 nt, Mycobacterium tuberculosis H37Rv
caccgccuguacgagcagaucgc

SEQ ID NO: 3273722 - RNA, 17 nt, Mycobacterium tuberculosis H37Rv
caccgccugugccgccg

SEQ ID NO: 3273723 - RNA, 23 nt, Mycobacterium tuberculosis H37Rv
caccgccugugccgccggcgcca

SEQ ID NO: 3273724 - RNA, 15 nt, Mycobacterium tuberculosis H37Rv
caccgccuuggucac

SEQ ID NO: 3273725 - RNA, 15 nt, Mycobacterium tuberculosis H37Rv
caccgccuuugccgc

SEQ ID NO: 3273726 - RNA, 17 nt, Mycobacterium tuberculosis H37Rv
caccgccuuugccgccg

SEQ ID NO: 3273727 - RNA, 20 nt, Mycobacterium tuberculosis H37Rv
caccgccuuugccgccggca

SEQ ID NO: 3273728 - RNA, 24 nt, Mycobacterium tuberculosis H37Rv
caccgccuuugccgccggcaccgc

SEQ ID NO: 3273729 - RNA, 17 nt, Mycobacterium tuberculosis H37Rv
caccgcgaaagcaccga

SEQ ID NO: 3273730 - RNA, 13 nt, Mycobacterium tuberculosis H37Rv
caccgcgacaccc

SEQ ID NO: 3273731 - RNA, 23 nt, Mycobacterium tuberculosis H37Rv
caccgcgacgacgaggucgguca

SEQ ID NO: 3273732 - RNA, 19 nt, Mycobacterium tuberculosis H37Rv
caccgcgacgagcggccgu

SEQ ID NO: 3273733 - RNA, 13 nt, Mycobacterium tuberculosis H37Rv
caccgcgaucacc

SEQ ID NO: 3273734 - RNA, 15 nt, Mycobacterium tuberculosis H37Rv
caccgcgaucaccac

SEQ ID NO: 3273735 - RNA, 17 nt, Mycobacterium tuberculosis H37Rv
caccgcgaucaccaccg

SEQ ID NO: 3273736 - RNA, 19 nt, Mycobacterium tuberculosis H37Rv
caccgcgaucaccaccgga

SEQ ID NO: 3273737 - RNA, 17 nt, Mycobacterium tuberculosis H37Rv
caccgcgcaacccggac

SEQ ID NO: 3273738 - RNA, 14 nt, Mycobacterium tuberculosis H37Rv
caccgcgcagcgaa

SEQ ID NO: 3273739 - RNA, 16 nt, Mycobacterium tuberculosis H37Rv
caccgcgcaucaucgc

SEQ ID NO: 3273740 - RNA, 20 nt, Mycobacterium tuberculosis H37Rv
caccgcgcaucaucgcccac

SEQ ID NO: 3273741 - RNA, 13 nt, Mycobacterium tuberculosis H37Rv
caccgcgccagcc

SEQ ID NO: 3273742 - RNA, 14 nt, Mycobacterium tuberculosis H37Rv
caccgcgccagccu

SEQ ID NO: 3273743 - RNA, 20 nt, Mycobacterium tuberculosis H37Rv
caccgcgccagccuccacca

SEQ ID NO: 3273744 - RNA, 13 nt, Mycobacterium tuberculosis H37Rv
caccgcgccgaac

SEQ ID NO: 3273745 - RNA, 13 nt, Mycobacterium tuberculosis H37Rv
caccgcgccgagc

SEQ ID NO: 3273746 - RNA, 14 nt, Mycobacterium tuberculosis H37Rv
caccgcgccgagca

SEQ ID NO: 3273747 - RNA, 16 nt, Mycobacterium tuberculosis H37Rv
caccgcgccgagcaga

SEQ ID NO: 3273748 - RNA, 12 nt, Mycobacterium tuberculosis H37Rv
caccgcgccgcg

SEQ ID NO: 3273749 - RNA, 19 nt, Mycobacterium tuberculosis H37Rv
caccgcgccgcgccgcgcc

SEQ ID NO: 3273750 - RNA, 21 nt, Mycobacterium tuberculosis H37Rv
caccgcgccggagaucgucgc

SEQ ID NO: 3273751 - RNA, 23 nt, Mycobacterium tuberculosis H37Rv
caccgcgccggcggaagcggcgg

SEQ ID NO: 3273752 - RNA, 14 nt, Mycobacterium tuberculosis H37Rv
caccgcgcggcgca

SEQ ID NO: 3273753 - RNA, 18 nt, Mycobacterium tuberculosis H37Rv
caccgcgcggcgcagcac

SEQ ID NO: 3273754 - RNA, 17 nt, Mycobacterium tuberculosis H37Rv
caccgcgcuggucagcc

SEQ ID NO: 3273755 - RNA, 19 nt, Mycobacterium tuberculosis H37Rv
caccgcggaccggcgucgg

SEQ ID NO: 3273756 - RNA, 13 nt, Mycobacterium tuberculosis H37Rv
caccgcggcaaga

SEQ ID NO: 3273757 - RNA, 15 nt, Mycobacterium tuberculosis H37Rv
caccgcggccagcac

SEQ ID NO: 3273758 - RNA, 21 nt, Mycobacterium tuberculosis H37Rv
caccgcggccagcaccagcuc

SEQ ID NO: 3273759 - RNA, 23 nt, Mycobacterium tuberculosis H37Rv
caccgcggccagcaccagcucac

SEQ ID NO: 3273760 - RNA, 15 nt, Mycobacterium tuberculosis H37Rv
caccgcggccagcgg

SEQ ID NO: 3273761 - RNA, 14 nt, Mycobacterium tuberculosis H37Rv
caccgcggccgcgg

SEQ ID NO: 3273762 - RNA, 16 nt, Mycobacterium tuberculosis H37Rv
caccgcggccgcggac

SEQ ID NO: 3273763 - RNA, 12 nt, Mycobacterium tuberculosis H37Rv
caccgcggcgau

SEQ ID NO: 3273764 - RNA, 21 nt, Mycobacterium tuberculosis H37Rv
caccgcggcggcgcguggugc

SEQ ID NO: 3273765 - RNA, 14 nt, Mycobacterium tuberculosis H37Rv
caccgcggcgucgc

SEQ ID NO: 3273766 - RNA, 14 nt, Mycobacterium tuberculosis H37Rv
caccgcgggaucgg

SEQ ID NO: 3273767 - RNA, 22 nt, Mycobacterium tuberculosis H37Rv
caccgcgggaucgguggcggca

SEQ ID NO: 3273768 - RNA, 12 nt, Mycobacterium tuberculosis H37Rv
caccgcgggcag

SEQ ID NO: 3273769 - RNA, 13 nt, Mycobacterium tuberculosis H37Rv
caccgcgggcaua

SEQ ID NO: 3273770 - RNA, 15 nt, Mycobacterium tuberculosis H37Rv
caccgcgguagccga

SEQ ID NO: 3273771 - RNA, 13 nt, Mycobacterium tuberculosis H37Rv
caccgcggucagc

SEQ ID NO: 3273772 - RNA, 17 nt, Mycobacterium tuberculosis H37Rv
caccgcgguggcggcga

SEQ ID NO: 3273773 - RNA, 20 nt, Mycobacterium tuberculosis H37Rv
caccgcguaguccaggccgu

SEQ ID NO: 3273774 - RNA, 12 nt, Mycobacterium tuberculosis H37Rv
caccgcgucacc

SEQ ID NO: 3273775 - RNA, 13 nt, Mycobacterium tuberculosis H37Rv
caccgcguccagg

SEQ ID NO: 3273776 - RNA, 13 nt, Mycobacterium tuberculosis H37Rv
caccgcgucggcc

SEQ ID NO: 3273777 - RNA, 16 nt, Mycobacterium tuberculosis H37Rv
caccgcgucggccgaa

SEQ ID NO: 3273778 - RNA, 18 nt, Mycobacterium tuberculosis H37Rv
caccgcgucguagccacg

SEQ ID NO: 3273779 - RNA, 20 nt, Mycobacterium tuberculosis H37Rv
caccgcgucguagccacgca

SEQ ID NO: 3273780 - RNA, 20 nt, Mycobacterium tuberculosis H37Rv
caccgcguugaugaccaggu

SEQ ID NO: 3273781 - RNA, 23 nt, Mycobacterium tuberculosis H37Rv
caccgcguugaugaccgccgccg

SEQ ID NO: 3273782 - RNA, 14 nt, Mycobacterium tuberculosis H37Rv
caccgcguuggcca

SEQ ID NO: 3273783 - RNA, 17 nt, Mycobacterium tuberculosis H37Rv
caccgcguuggccacac

SEQ ID NO: 3273784 - RNA, 23 nt, Mycobacterium tuberculosis H37Rv
caccgcguuucgcgacgucugcc

SEQ ID NO: 3273785 - RNA, 20 nt, Mycobacterium tuberculosis H37Rv
caccgcuacgaccaauagca

SEQ ID NO: 3273786 - RNA, 16 nt, Mycobacterium tuberculosis H37Rv
caccgcugagcccccc

SEQ ID NO: 3273787 - RNA, 17 nt, Mycobacterium tuberculosis H37Rv
caccgcugagccccccg

SEQ ID NO: 3273788 - RNA, 15 nt, Mycobacterium tuberculosis H37Rv
caccgcugccggcac

SEQ ID NO: 3273789 - RNA, 21 nt, Mycobacterium tuberculosis H37Rv
caccgcugccggcacgcaugc

SEQ ID NO: 3273790 - RNA, 17 nt, Mycobacterium tuberculosis H37Rv
caccgcugccggcgccg

SEQ ID NO: 3273791 - RNA, 16 nt, Mycobacterium tuberculosis H37Rv
caccgcugcggcacca

SEQ ID NO: 3273792 - RNA, 14 nt, Mycobacterium tuberculosis H37Rv
caccgcuggaucga

SEQ ID NO: 3273793 - RNA, 20 nt, Mycobacterium tuberculosis H37Rv
caccgcuguugcaucgccgc

SEQ ID NO: 3273794 - RNA, 21 nt, Mycobacterium tuberculosis H37Rv
caccgcuucaggcgccacugc

SEQ ID NO: 3273795 - RNA, 13 nt, Mycobacterium tuberculosis H37Rv
caccgcuugcugg

SEQ ID NO: 3273796 - RNA, 14 nt, Mycobacterium tuberculosis H37Rv
caccgcuugcuggc

SEQ ID NO: 3273797 - RNA, 17 nt, Mycobacterium tuberculosis H37Rv
caccggaacccccagcu

SEQ ID NO: 3273798 - RNA, 14 nt, Mycobacterium tuberculosis H37Rv
caccggaauccccc

SEQ ID NO: 3273799 - RNA, 21 nt, Mycobacterium tuberculosis H37Rv
caccggaauccgggccgccgc

SEQ ID NO: 3273800 - RNA, 23 nt, Mycobacterium tuberculosis H37Rv
caccggacgaaacgaucgcgcca

SEQ ID NO: 3273801 - RNA, 15 nt, Mycobacterium tuberculosis H37Rv
caccggagaacgggu

SEQ ID NO: 3273802 - RNA, 18 nt, Mycobacterium tuberculosis H37Rv
caccggagaacgggucga

SEQ ID NO: 3273803 - RNA, 17 nt, Mycobacterium tuberculosis H37Rv
caccggagcgccgagcu

SEQ ID NO: 3273804 - RNA, 14 nt, Mycobacterium tuberculosis H37Rv
caccggaggccgcc

SEQ ID NO: 3273805 - RNA, 16 nt, Mycobacterium tuberculosis H37Rv
caccggaggccgccgc

SEQ ID NO: 3273806 - RNA, 13 nt, Mycobacterium tuberculosis H37Rv
caccggagucggc

SEQ ID NO: 3273807 - RNA, 16 nt, Mycobacterium tuberculosis H37Rv
caccggagucggcguc

SEQ ID NO: 3273808 - RNA, 14 nt, Mycobacterium tuberculosis H37Rv
caccggauacagcc

SEQ ID NO: 3273809 - RNA, 15 nt, Mycobacterium tuberculosis H37Rv
caccggauagguggu

SEQ ID NO: 3273810 - RNA, 17 nt, Mycobacterium tuberculosis H37Rv
caccggaucgccgucgc

SEQ ID NO: 3273811 - RNA, 23 nt, Mycobacterium tuberculosis H37Rv
caccggaugauguggugugccug

SEQ ID NO: 3273812 - RNA, 14 nt, Mycobacterium tuberculosis H37Rv
caccggcaauaccg

SEQ ID NO: 3273813 - RNA, 14 nt, Mycobacterium tuberculosis H37Rv
caccggcaaucggc

SEQ ID NO: 3273814 - RNA, 23 nt, Mycobacterium tuberculosis H37Rv
caccggcaccacgaucaacucgu

SEQ ID NO: 3273815 - RNA, 21 nt, Mycobacterium tuberculosis H37Rv
caccggcacccccgucgccac

SEQ ID NO: 3273816 - RNA, 22 nt, Mycobacterium tuberculosis H37Rv
caccggcacccccgucgccacc

SEQ ID NO: 3273817 - RNA, 23 nt, Mycobacterium tuberculosis H37Rv
caccggcacccccgucgccaccg

SEQ ID NO: 3273818 - RNA, 19 nt, Mycobacterium tuberculosis H37Rv
caccggcaccgcugccgcu

SEQ ID NO: 3273819 - RNA, 16 nt, Mycobacterium tuberculosis H37Rv
caccggcaccggccgu

SEQ ID NO: 3273820 - RNA, 23 nt, Mycobacterium tuberculosis H37Rv
caccggcacggugaacggcaagg

SEQ ID NO: 3273821 - RNA, 18 nt, Mycobacterium tuberculosis H37Rv
caccggcacugcccagca

SEQ ID NO: 3273822 - RNA, 14 nt, Mycobacterium tuberculosis H37Rv
caccggcaugcgug

SEQ ID NO: 3273823 - RNA, 15 nt, Mycobacterium tuberculosis H37Rv
caccggccaccagcc

SEQ ID NO: 3273824 - RNA, 18 nt, Mycobacterium tuberculosis H37Rv
caccggccaccagcccga

SEQ ID NO: 3273825 - RNA, 19 nt, Mycobacterium tuberculosis H37Rv
caccggccaccagggccac

SEQ ID NO: 3273826 - RNA, 16 nt, Mycobacterium tuberculosis H37Rv
caccggccacucggga

SEQ ID NO: 3273827 - RNA, 12 nt, Mycobacterium tuberculosis H37Rv
caccggccagcg

SEQ ID NO: 3273828 - RNA, 16 nt, Mycobacterium tuberculosis H37Rv
caccggccccaccgac

SEQ ID NO: 3273829 - RNA, 12 nt, Mycobacterium tuberculosis H37Rv
caccggccggcg

SEQ ID NO: 3273830 - RNA, 23 nt, Mycobacterium tuberculosis H37Rv
caccggccgguggguagccagcg

SEQ ID NO: 3273831 - RNA, 17 nt, Mycobacterium tuberculosis H37Rv
caccggccgugccgccg

SEQ ID NO: 3273832 - RNA, 23 nt, Mycobacterium tuberculosis H37Rv
caccggccgugccgccgacacca

SEQ ID NO: 3273833 - RNA, 17 nt, Mycobacterium tuberculosis H37Rv
caccggccugcgcgacc

SEQ ID NO: 3273834 - RNA, 18 nt, Mycobacterium tuberculosis H37Rv
caccggcgagugcugucg

SEQ ID NO: 3273835 - RNA, 15 nt, Mycobacterium tuberculosis H37Rv
caccggcgaucaccg

SEQ ID NO: 3273836 - RNA, 19 nt, Mycobacterium tuberculosis H37Rv
caccggcgaucguguccac

SEQ ID NO: 3273837 - RNA, 13 nt, Mycobacterium tuberculosis H37Rv
caccggcgcaccg

SEQ ID NO: 3273838 - RNA, 19 nt, Mycobacterium tuberculosis H37Rv
caccggcgcaccggagucg

SEQ ID NO: 3273839 - RNA, 12 nt, Mycobacterium tuberculosis H37Rv
caccggcgccca

SEQ ID NO: 3273840 - RNA, 13 nt, Mycobacterium tuberculosis H37Rv
caccggcgccgcc

SEQ ID NO: 3273841 - RNA, 14 nt, Mycobacterium tuberculosis H37Rv
caccggcgccgccc

SEQ ID NO: 3273842 - RNA, 15 nt, Mycobacterium tuberculosis H37Rv
caccggcgccgcccg

SEQ ID NO: 3273843 - RNA, 15 nt, Mycobacterium tuberculosis H37Rv
caccggcgccgccgu

SEQ ID NO: 3273844 - RNA, 17 nt, Mycobacterium tuberculosis H37Rv
caccggcgccgccgucg

SEQ ID NO: 3273845 - RNA, 16 nt, Mycobacterium tuberculosis H37Rv
caccggcgccguguca

SEQ ID NO: 3273846 - RNA, 11 nt, Mycobacterium tuberculosis H37Rv
caccggcgccu

SEQ ID NO: 3273847 - RNA, 24 nt, Mycobacterium tuberculosis H37Rv
caccggcgcgggcacgcccucguc

SEQ ID NO: 3273848 - RNA, 13 nt, Mycobacterium tuberculosis H37Rv
caccggcggcgcc

SEQ ID NO: 3273849 - RNA, 14 nt, Mycobacterium tuberculosis H37Rv
caccggcggcgccg

SEQ ID NO: 3273850 - RNA, 19 nt, Mycobacterium tuberculosis H37Rv
caccggcggucugcagugc

SEQ ID NO: 3273851 - RNA, 22 nt, Mycobacterium tuberculosis H37Rv
caccggcggucugcagugcagc

SEQ ID NO: 3273852 - RNA, 12 nt, Mycobacterium tuberculosis H37Rv
caccggcgucga

SEQ ID NO: 3273853 - RNA, 15 nt, Mycobacterium tuberculosis H37Rv
caccggcgucgacgu

SEQ ID NO: 3273854 - RNA, 13 nt, Mycobacterium tuberculosis H37Rv
caccggcgucgcu

SEQ ID NO: 3273855 - RNA, 21 nt, Mycobacterium tuberculosis H37Rv
caccggcguucaccugcgucg

SEQ ID NO: 3273856 - RNA, 16 nt, Mycobacterium tuberculosis H37Rv
caccggcucccggggg

SEQ ID NO: 3273857 - RNA, 17 nt, Mycobacterium tuberculosis H37Rv
caccggcugaccgaccc

SEQ ID NO: 3273858 - RNA, 12 nt, Mycobacterium tuberculosis H37Rv
caccggcugcaa

SEQ ID NO: 3273859 - RNA, 15 nt, Mycobacterium tuberculosis H37Rv
caccggcugcaacca

SEQ ID NO: 3273860 - RNA, 19 nt, Mycobacterium tuberculosis H37Rv
caccggcugcaaccagcgg

SEQ ID NO: 3273861 - RNA, 17 nt, Mycobacterium tuberculosis H37Rv
caccggcugcugaggag

SEQ ID NO: 3273862 - RNA, 16 nt, Mycobacterium tuberculosis H37Rv
caccggcuggugccaa

SEQ ID NO: 3273863 - RNA, 23 nt, Mycobacterium tuberculosis H37Rv
caccggcuggugccaacugcgcc

SEQ ID NO: 3273864 - RNA, 20 nt, Mycobacterium tuberculosis H37Rv
caccggcuucuccuccagag

SEQ ID NO: 3273865 - RNA, 23 nt, Mycobacterium tuberculosis H37Rv
caccggcuugggccaggcccagc

SEQ ID NO: 3273866 - RNA, 16 nt, Mycobacterium tuberculosis H37Rv
caccggcuuggugaac

SEQ ID NO: 3273867 - RNA, 22 nt, Mycobacterium tuberculosis H37Rv
caccggcuuggugaaccgcgcg

SEQ ID NO: 3273868 - RNA, 14 nt, Mycobacterium tuberculosis H37Rv
caccgggcaccagu

SEQ ID NO: 3273869 - RNA, 20 nt, Mycobacterium tuberculosis H37Rv
caccgggcaccagucgcccc

SEQ ID NO: 3273870 - RNA, 18 nt, Mycobacterium tuberculosis H37Rv
caccgggcccgccguccc

SEQ ID NO: 3273871 - RNA, 23 nt, Mycobacterium tuberculosis H37Rv
caccgggcccgccguccccgccg

SEQ ID NO: 3273872 - RNA, 13 nt, Mycobacterium tuberculosis H37Rv
caccgggcccuug

SEQ ID NO: 3273873 - RNA, 17 nt, Mycobacterium tuberculosis H37Rv
caccgggcccuugcuga

SEQ ID NO: 3273874 - RNA, 14 nt, Mycobacterium tuberculosis H37Rv
caccgggccgacag

SEQ ID NO: 3273875 - RNA, 16 nt, Mycobacterium tuberculosis H37Rv
caccgggcggcggcga

SEQ ID NO: 3273876 - RNA, 17 nt, Mycobacterium tuberculosis H37Rv
caccgggcgucgucggu

SEQ ID NO: 3273877 - RNA, 18 nt, Mycobacterium tuberculosis H37Rv
caccggggaagaucucgg

SEQ ID NO: 3273878 - RNA, 15 nt, Mycobacterium tuberculosis H37Rv
caccggggacgucga

SEQ ID NO: 3273879 - RNA, 15 nt, Mycobacterium tuberculosis H37Rv
caccggggcggccga

SEQ ID NO: 3273880 - RNA, 18 nt, Mycobacterium tuberculosis H37Rv
caccgggguuacucgcag

SEQ ID NO: 3273881 - RNA, 23 nt, Mycobacterium tuberculosis H37Rv
caccgggguuacucgcagcgccg

SEQ ID NO: 3273882 - RNA, 19 nt, Mycobacterium tuberculosis H37Rv
caccggguccaccgcacgg

SEQ ID NO: 3273883 - RNA, 23 nt, Mycobacterium tuberculosis H37Rv
caccggguccggugaacccgauu

SEQ ID NO: 3273884 - RNA, 12 nt, Mycobacterium tuberculosis H37Rv
caccgggugacc

SEQ ID NO: 3273885 - RNA, 18 nt, Mycobacterium tuberculosis H37Rv
caccgggugcgacggcgu

SEQ ID NO: 3273886 - RNA, 19 nt, Mycobacterium tuberculosis H37Rv
caccgggugcgacggcguu

SEQ ID NO: 3273887 - RNA, 21 nt, Mycobacterium tuberculosis H37Rv
caccggguuggaagccgcacc

SEQ ID NO: 3273888 - RNA, 21 nt, Mycobacterium tuberculosis H37Rv
caccgguaacgcgacaagguc

SEQ ID NO: 3273889 - RNA, 13 nt, Mycobacterium tuberculosis H37Rv
caccgguaccgau

SEQ ID NO: 3273890 - RNA, 12 nt, Mycobacterium tuberculosis H37Rv
caccgguaccgc

SEQ ID NO: 3273891 - RNA, 20 nt, Mycobacterium tuberculosis H37Rv
caccgguaccggcgacgaau

SEQ ID NO: 3273892 - RNA, 22 nt, Mycobacterium tuberculosis H37Rv
caccgguauguucggcaaugac

SEQ ID NO: 3273893 - RNA, 23 nt, Mycobacterium tuberculosis H37Rv
caccgguauguucggcaaugacg

SEQ ID NO: 3273894 - RNA, 13 nt, Mycobacterium tuberculosis H37Rv
caccggucaccgc

SEQ ID NO: 3273895 - RNA, 15 nt, Mycobacterium tuberculosis H37Rv
caccggucaccgcgc

SEQ ID NO: 3273896 - RNA, 17 nt, Mycobacterium tuberculosis H37Rv
caccggucaccgcgcag

SEQ ID NO: 3273897 - RNA, 18 nt, Mycobacterium tuberculosis H37Rv
caccggucaccgcgcagc

SEQ ID NO: 3273898 - RNA, 13 nt, Mycobacterium tuberculosis H37Rv
caccggucagcga

SEQ ID NO: 3273899 - RNA, 20 nt, Mycobacterium tuberculosis H37Rv
caccggucgguuaauggguc

SEQ ID NO: 3273900 - RNA, 23 nt, Mycobacterium tuberculosis H37Rv
caccggugauggugaccagcagg

SEQ ID NO: 3273901 - RNA, 16 nt, Mycobacterium tuberculosis H37Rv
caccggugcccaccac

SEQ ID NO: 3273902 - RNA, 18 nt, Mycobacterium tuberculosis H37Rv
caccggugcccaccaccg

SEQ ID NO: 3273903 - RNA, 14 nt, Mycobacterium tuberculosis H37Rv
caccggugccgccc

SEQ ID NO: 3273904 - RNA, 18 nt, Mycobacterium tuberculosis H37Rv
caccggugccgcccgcgc

SEQ ID NO: 3273905 - RNA, 15 nt, Mycobacterium tuberculosis H37Rv
caccggugccgccgu

SEQ ID NO: 3273906 - RNA, 14 nt, Mycobacterium tuberculosis H37Rv
caccggugccggcg

SEQ ID NO: 3273907 - RNA, 18 nt, Mycobacterium tuberculosis H37Rv
caccggugccggcgacgc

SEQ ID NO: 3273908 - RNA, 19 nt, Mycobacterium tuberculosis H37Rv
caccggugccggcgacgcu

SEQ ID NO: 3273909 - RNA, 21 nt, Mycobacterium tuberculosis H37Rv
caccgguucggggggcagguc

SEQ ID NO: 3273910 - RNA, 23 nt, Mycobacterium tuberculosis H37Rv
caccgguucggggggcaggucga

SEQ ID NO: 3273911 - RNA, 16 nt, Mycobacterium tuberculosis H37Rv
caccgguucggugagc

SEQ ID NO: 3273912 - RNA, 16 nt, Mycobacterium tuberculosis H37Rv
caccgguuucgucggu

SEQ ID NO: 3273913 - RNA, 16 nt, Mycobacterium tuberculosis H37Rv
caccgguuugacgucc

SEQ ID NO: 3273914 - RNA, 22 nt, Mycobacterium tuberculosis H37Rv
caccguacgggacgaagaccgg

SEQ ID NO: 3273915 - RNA, 20 nt, Mycobacterium tuberculosis H37Rv
caccguagagcaugccgccc

SEQ ID NO: 3273916 - RNA, 14 nt, Mycobacterium tuberculosis H37Rv
caccguagccagca

SEQ ID NO: 3273917 - RNA, 22 nt, Mycobacterium tuberculosis H37Rv
caccguagccgcugcacguggc

SEQ ID NO: 3273918 - RNA, 14 nt, Mycobacterium tuberculosis H37Rv
caccgucaccgccg

SEQ ID NO: 3273919 - RNA, 17 nt, Mycobacterium tuberculosis H37Rv
caccgucaccgccggca

SEQ ID NO: 3273920 - RNA, 18 nt, Mycobacterium tuberculosis H37Rv
caccgucaccgccgucac

SEQ ID NO: 3273921 - RNA, 19 nt, Mycobacterium tuberculosis H37Rv
caccgucaugccgacgaca

SEQ ID NO: 3273922 - RNA, 16 nt, Mycobacterium tuberculosis H37Rv
caccgucaugccguug

SEQ ID NO: 3273923 - RNA, 20 nt, Mycobacterium tuberculosis H37Rv
caccguccaauagcugacac

SEQ ID NO: 3273924 - RNA, 19 nt, Mycobacterium tuberculosis H37Rv
caccguccaauuggcgucg

SEQ ID NO: 3273925 - RNA, 23 nt, Mycobacterium tuberculosis H37Rv
caccguccagcagcucggggcga

SEQ ID NO: 3273926 - RNA, 18 nt, Mycobacterium tuberculosis H37Rv
caccguccgucggcgcuc

SEQ ID NO: 3273927 - RNA, 20 nt, Mycobacterium tuberculosis H37Rv
caccgucgcauacgcccacu

SEQ ID NO: 3273928 - RNA, 23 nt, Mycobacterium tuberculosis H37Rv
caccgucgcccggguggcgucga

SEQ ID NO: 3273929 - RNA, 17 nt, Mycobacterium tuberculosis H37Rv
caccgucggcagcagcg

SEQ ID NO: 3273930 - RNA, 23 nt, Mycobacterium tuberculosis H37Rv
caccgucgggauggacggcagcc

SEQ ID NO: 3273931 - RNA, 20 nt, Mycobacterium tuberculosis H37Rv
caccgucguacucggcggcc

SEQ ID NO: 3273932 - RNA, 17 nt, Mycobacterium tuberculosis H37Rv
caccgucuccggcgcca

SEQ ID NO: 3273933 - RNA, 16 nt, Mycobacterium tuberculosis H37Rv
caccgucucgccgcgc

SEQ ID NO: 3273934 - RNA, 18 nt, Mycobacterium tuberculosis H37Rv
caccgucugcggaccggc

SEQ ID NO: 3273935 - RNA, 14 nt, Mycobacterium tuberculosis H37Rv
caccgucugcuggc

SEQ ID NO: 3273936 - RNA, 15 nt, Mycobacterium tuberculosis H37Rv
caccgugaccgccgc

SEQ ID NO: 3273937 - RNA, 18 nt, Mycobacterium tuberculosis H37Rv
caccgugaccgccgcgcc

SEQ ID NO: 3273938 - RNA, 13 nt, Mycobacterium tuberculosis H37Rv
caccgugccgacg

SEQ ID NO: 3273939 - RNA, 21 nt, Mycobacterium tuberculosis H37Rv
caccgugccgacgccccgauc

SEQ ID NO: 3273940 - RNA, 14 nt, Mycobacterium tuberculosis H37Rv
caccgugccgggcg

SEQ ID NO: 3273941 - RNA, 15 nt, Mycobacterium tuberculosis H37Rv
caccgugccgggcga

SEQ ID NO: 3273942 - RNA, 17 nt, Mycobacterium tuberculosis H37Rv
caccgugcgccgaaugg

SEQ ID NO: 3273943 - RNA, 18 nt, Mycobacterium tuberculosis H37Rv
caccgugcggaucgcgcu

SEQ ID NO: 3273944 - RNA, 19 nt, Mycobacterium tuberculosis H37Rv
caccgugcggaucgcgcug

SEQ ID NO: 3273945 - RNA, 21 nt, Mycobacterium tuberculosis H37Rv
caccgugcggggggcagcucc

SEQ ID NO: 3273946 - RNA, 18 nt, Mycobacterium tuberculosis H37Rv
caccguggacaccuggcu

SEQ ID NO: 3273947 - RNA, 17 nt, Mycobacterium tuberculosis H37Rv
caccguggaucggcagc

SEQ ID NO: 3273948 - RNA, 13 nt, Mycobacterium tuberculosis H37Rv
caccguggccgca

SEQ ID NO: 3273949 - RNA, 20 nt, Mycobacterium tuberculosis H37Rv
caccgugggcccuucacugu

SEQ ID NO: 3273950 - RNA, 16 nt, Mycobacterium tuberculosis H37Rv
caccgugggcggaacg

SEQ ID NO: 3273951 - RNA, 16 nt, Mycobacterium tuberculosis H37Rv
caccgugguucggcgg

SEQ ID NO: 3273952 - RNA, 19 nt, Mycobacterium tuberculosis H37Rv
caccgugucacgcgaccac

SEQ ID NO: 3273953 - RNA, 12 nt, Mycobacterium tuberculosis H37Rv
caccgugucgac

SEQ ID NO: 3273954 - RNA, 18 nt, Mycobacterium tuberculosis H37Rv
caccgugucgccggcgaa

SEQ ID NO: 3273955 - RNA, 18 nt, Mycobacterium tuberculosis H37Rv
caccguguugcacgcggg

SEQ ID NO: 3273956 - RNA, 16 nt, Mycobacterium tuberculosis H37Rv
caccguuaccgccguc

SEQ ID NO: 3273957 - RNA, 15 nt, Mycobacterium tuberculosis H37Rv
caccguuagccaggu

SEQ ID NO: 3273958 - RNA, 16 nt, Mycobacterium tuberculosis H37Rv
caccguuagccagguc

SEQ ID NO: 3273959 - RNA, 21 nt, Mycobacterium tuberculosis H37Rv
caccguugccgaaccacgcgc

SEQ ID NO: 3273960 - RNA, 14 nt, Mycobacterium tuberculosis H37Rv
caccguugccgccg

SEQ ID NO: 3273961 - RNA, 21 nt, Mycobacterium tuberculosis H37Rv
caccguugccgccgucaccgc

SEQ ID NO: 3273962 - RNA, 12 nt, Mycobacterium tuberculosis H37Rv
caccguugcguu

SEQ ID NO: 3273963 - RNA, 17 nt, Mycobacterium tuberculosis H37Rv
caccguugcguuggcgc

SEQ ID NO: 3273964 - RNA, 22 nt, Mycobacterium tuberculosis H37Rv
caccguuguaugcugcgcgccg

SEQ ID NO: 3273965 - RNA, 18 nt, Mycobacterium tuberculosis H37Rv
caccguuugagcggccac

SEQ ID NO: 3273966 - RNA, 16 nt, Mycobacterium tuberculosis H37Rv
caccguuugcgcaccg

SEQ ID NO: 3273967 - RNA, 17 nt, Mycobacterium tuberculosis H37Rv
caccuaccgagaucacc

SEQ ID NO: 3273968 - RNA, 13 nt, Mycobacterium tuberculosis H37Rv
caccuagucgcgg

SEQ ID NO: 3273969 - RNA, 14 nt, Mycobacterium tuberculosis H37Rv
caccuauggucaac

SEQ ID NO: 3273970 - RNA, 18 nt, Mycobacterium tuberculosis H37Rv
caccucagaaaguccccg

SEQ ID NO: 3273971 - RNA, 16 nt, Mycobacterium tuberculosis H37Rv
caccuccaccgcgccg

SEQ ID NO: 3273972 - RNA, 15 nt, Mycobacterium tuberculosis H37Rv
caccuccagcaccac

SEQ ID NO: 3273973 - RNA, 13 nt, Mycobacterium tuberculosis H37Rv
caccucccacgcc

SEQ ID NO: 3273974 - RNA, 16 nt, Mycobacterium tuberculosis H37Rv
caccucccacgccgcc

SEQ ID NO: 3273975 - RNA, 20 nt, Mycobacterium tuberculosis H37Rv
caccucccagggcucggcgg

SEQ ID NO: 3273976 - RNA, 13 nt, Mycobacterium tuberculosis H37Rv
caccucccgcagc

SEQ ID NO: 3273977 - RNA, 17 nt, Mycobacterium tuberculosis H37Rv
caccucccgcagccggg

SEQ ID NO: 3273978 - RNA, 15 nt, Mycobacterium tuberculosis H37Rv
caccucccgcggcac

SEQ ID NO: 3273979 - RNA, 17 nt, Mycobacterium tuberculosis H37Rv
caccucccgcggcaccu

SEQ ID NO: 3273980 - RNA, 22 nt, Mycobacterium tuberculosis H37Rv
caccuccgaggccgccaucgcc

SEQ ID NO: 3273981 - RNA, 13 nt, Mycobacterium tuberculosis H37Rv
caccuccgccccg

SEQ ID NO: 3273982 - RNA, 17 nt, Mycobacterium tuberculosis H37Rv
caccuccgccggcaccu

SEQ ID NO: 3273983 - RNA, 19 nt, Mycobacterium tuberculosis H37Rv
caccuccgccggcaccucc

SEQ ID NO: 3273984 - RNA, 14 nt, Mycobacterium tuberculosis H37Rv
caccuccggcaccg

SEQ ID NO: 3273985 - RNA, 15 nt, Mycobacterium tuberculosis H37Rv
caccuccggcaccgc

SEQ ID NO: 3273986 - RNA, 22 nt, Mycobacterium tuberculosis H37Rv
caccuccggcaccgcccuugcc

SEQ ID NO: 3273987 - RNA, 16 nt, Mycobacterium tuberculosis H37Rv
caccuccgucagcgcc

SEQ ID NO: 3273988 - RNA, 16 nt, Mycobacterium tuberculosis H37Rv
caccuccucgagcagg

SEQ ID NO: 3273989 - RNA, 23 nt, Mycobacterium tuberculosis H37Rv
caccucgaugaugcgcucggccu

SEQ ID NO: 3273990 - RNA, 12 nt, Mycobacterium tuberculosis H37Rv
caccucgaugcc

SEQ ID NO: 3273991 - RNA, 16 nt, Mycobacterium tuberculosis H37Rv
caccucgaugccgccc

SEQ ID NO: 3273992 - RNA, 17 nt, Mycobacterium tuberculosis H37Rv
caccucgaugccgcccc

SEQ ID NO: 3273993 - RNA, 20 nt, Mycobacterium tuberculosis H37Rv
caccucgaugccgccccgca

SEQ ID NO: 3273994 - RNA, 20 nt, Mycobacterium tuberculosis H37Rv
caccucgaugcggguggcgc

SEQ ID NO: 3273995 - RNA, 21 nt, Mycobacterium tuberculosis H37Rv
caccucgauggcguccaucuc

SEQ ID NO: 3273996 - RNA, 16 nt, Mycobacterium tuberculosis H37Rv
caccucgcacgacacc

SEQ ID NO: 3273997 - RNA, 20 nt, Mycobacterium tuberculosis H37Rv
caccucgcacgacaccucga

SEQ ID NO: 3273998 - RNA, 22 nt, Mycobacterium tuberculosis H37Rv
caccucggccagcuccgccugc

SEQ ID NO: 3273999 - RNA, 22 nt, Mycobacterium tuberculosis H37Rv
caccucggcgaagucacgcacc

SEQ ID NO: 3274000 - RNA, 12 nt, Mycobacterium tuberculosis H37Rv
caccucggcguu

SEQ ID NO: 3274001 - RNA, 16 nt, Mycobacterium tuberculosis H37Rv
caccucgggcgcccgc

SEQ ID NO: 3274002 - RNA, 20 nt, Mycobacterium tuberculosis H37Rv
caccucggguguggucacca

SEQ ID NO: 3274003 - RNA, 23 nt, Mycobacterium tuberculosis H37Rv
caccucggguguggucaccaggc

SEQ ID NO: 3274004 - RNA, 18 nt, Mycobacterium tuberculosis H37Rv
caccucggugaccaggcc

SEQ ID NO: 3274005 - RNA, 20 nt, Mycobacterium tuberculosis H37Rv
caccucggugaccaggccgg

SEQ ID NO: 3274006 - RNA, 13 nt, Mycobacterium tuberculosis H37Rv
caccucgucgaca

SEQ ID NO: 3274007 - RNA, 15 nt, Mycobacterium tuberculosis H37Rv
caccucgugcggcgc

SEQ ID NO: 3274008 - RNA, 20 nt, Mycobacterium tuberculosis H37Rv
caccucuucucggacacgcu

SEQ ID NO: 3274009 - RNA, 23 nt, Mycobacterium tuberculosis H37Rv
caccugacgugcggcgcggcgac

SEQ ID NO: 3274010 - RNA, 20 nt, Mycobacterium tuberculosis H37Rv
caccugacuaccgucaucga

SEQ ID NO: 3274011 - RNA, 13 nt, Mycobacterium tuberculosis H37Rv
caccugcaccgca

SEQ ID NO: 3274012 - RNA, 20 nt, Mycobacterium tuberculosis H37Rv
caccugcacgugacccuggg

SEQ ID NO: 3274013 - RNA, 20 nt, Mycobacterium tuberculosis H37Rv
caccugcagcacgacgugcg

SEQ ID NO: 3274014 - RNA, 16 nt, Mycobacterium tuberculosis H37Rv
caccugcaucgucgcc

SEQ ID NO: 3274015 - RNA, 15 nt, Mycobacterium tuberculosis H37Rv
caccugcaugugugu

SEQ ID NO: 3274016 - RNA, 19 nt, Mycobacterium tuberculosis H37Rv
caccugccgacucaucggc

SEQ ID NO: 3274017 - RNA, 22 nt, Mycobacterium tuberculosis H37Rv
caccugcgaugaugugcgacca

SEQ ID NO: 3274018 - RNA, 14 nt, Mycobacterium tuberculosis H37Rv
caccugcgcgcggc

SEQ ID NO: 3274019 - RNA, 18 nt, Mycobacterium tuberculosis H37Rv
caccugcgcgcggccgcg

SEQ ID NO: 3274020 - RNA, 16 nt, Mycobacterium tuberculosis H37Rv
caccugcgggcccacg

SEQ ID NO: 3274021 - RNA, 20 nt, Mycobacterium tuberculosis H37Rv
caccugcgggcccacgccca

SEQ ID NO: 3274022 - RNA, 17 nt, Mycobacterium tuberculosis H37Rv
caccugcgucggcccgc

SEQ ID NO: 3274023 - RNA, 18 nt, Mycobacterium tuberculosis H37Rv
caccugcucgucggucac

SEQ ID NO: 3274024 - RNA, 14 nt, Mycobacterium tuberculosis H37Rv
caccugcugcaacc

SEQ ID NO: 3274025 - RNA, 17 nt, Mycobacterium tuberculosis H37Rv
caccugcuggaagccgu

SEQ ID NO: 3274026 - RNA, 19 nt, Mycobacterium tuberculosis H37Rv
caccuggcgugucgccgcc

SEQ ID NO: 3274027 - RNA, 20 nt, Mycobacterium tuberculosis H37Rv
caccuggcgugucgccgcca

SEQ ID NO: 3274028 - RNA, 23 nt, Mycobacterium tuberculosis H37Rv
caccuggcgugucgccgccacca

SEQ ID NO: 3274029 - RNA, 22 nt, Mycobacterium tuberculosis H37Rv
caccuggcuggucaggaucgca

SEQ ID NO: 3274030 - RNA, 15 nt, Mycobacterium tuberculosis H37Rv
caccugggccagcag

SEQ ID NO: 3274031 - RNA, 20 nt, Mycobacterium tuberculosis H37Rv
caccugggcgcgcuggcggg

SEQ ID NO: 3274032 - RNA, 16 nt, Mycobacterium tuberculosis H37Rv
caccugggcugccggc

SEQ ID NO: 3274033 - RNA, 21 nt, Mycobacterium tuberculosis H37Rv
caccugggcugccggccagac

SEQ ID NO: 3274034 - RNA, 22 nt, Mycobacterium tuberculosis H37Rv
caccugggucgacgagauccag

SEQ ID NO: 3274035 - RNA, 16 nt, Mycobacterium tuberculosis H37Rv
caccugguccaaucgc

SEQ ID NO: 3274036 - RNA, 23 nt, Mycobacterium tuberculosis H37Rv
caccuggucggccgcaaggcgcc

SEQ ID NO: 3274037 - RNA, 21 nt, Mycobacterium tuberculosis H37Rv
caccuguaguucgaugacuga

SEQ ID NO: 3274038 - RNA, 19 nt, Mycobacterium tuberculosis H37Rv
caccuguccgguggaaucc

SEQ ID NO: 3274039 - RNA, 22 nt, Mycobacterium tuberculosis H37Rv
caccuguccgguggaauccacc

SEQ ID NO: 3274040 - RNA, 20 nt, Mycobacterium tuberculosis H37Rv
caccuguuggcaugccgccc

SEQ ID NO: 3274041 - RNA, 14 nt, Mycobacterium tuberculosis H37Rv
caccuucaccgggu

SEQ ID NO: 3274042 - RNA, 22 nt, Mycobacterium tuberculosis H37Rv
caccuucaccgggugacccgcc

SEQ ID NO: 3274043 - RNA, 12 nt, Mycobacterium tuberculosis H37Rv
caccuuccacga

SEQ ID NO: 3274044 - RNA, 22 nt, Mycobacterium tuberculosis H37Rv
caccuucgacguugcggacggc

SEQ ID NO: 3274045 - RNA, 23 nt, Mycobacterium tuberculosis H37Rv
caccuucgucgcggccgcggccu

SEQ ID NO: 3274046 - RNA, 18 nt, Mycobacterium tuberculosis H37Rv
caccuucugacgcggccg

SEQ ID NO: 3274047 - RNA, 21 nt, Mycobacterium tuberculosis H37Rv
caccuugcccaagaucucgcg

SEQ ID NO: 3274048 - RNA, 13 nt, Mycobacterium tuberculosis H37Rv
caccuugccuagc

SEQ ID NO: 3274049 - RNA, 13 nt, Mycobacterium tuberculosis H37Rv
caccuugcguccg

SEQ ID NO: 3274050 - RNA, 15 nt, Mycobacterium tuberculosis H37Rv
caccuugcugcaguc

SEQ ID NO: 3274051 - RNA, 18 nt, Mycobacterium tuberculosis H37Rv
caccuuggaugcccugcc

SEQ ID NO: 3274052 - RNA, 22 nt, Mycobacterium tuberculosis H37Rv
caccuuggcugggcccgccguc

SEQ ID NO: 3274053 - RNA, 16 nt, Mycobacterium tuberculosis H37Rv
caccuugggcagcuug

SEQ ID NO: 3274054 - RNA, 17 nt, Mycobacterium tuberculosis H37Rv
caccuuguggacccgcc

SEQ ID NO: 3274055 - RNA, 20 nt, Mycobacterium tuberculosis H37Rv
caccuuguggacccgccagg

SEQ ID NO: 3274056 - RNA, 18 nt, Mycobacterium tuberculosis H37Rv
caccuuucuccacauugg

SEQ ID NO: 3274057 - RNA, 14 nt, Mycobacterium tuberculosis H37Rv
cacgaaaccgcagc

SEQ ID NO: 3274058 - RNA, 21 nt, Mycobacterium tuberculosis H37Rv
cacgaaauugggcgauucugc

SEQ ID NO: 3274059 - RNA, 19 nt, Mycobacterium tuberculosis H37Rv
cacgaacaucagaucgccg

SEQ ID NO: 3274060 - RNA, 15 nt, Mycobacterium tuberculosis H37Rv
cacgaacccucagcc

SEQ ID NO: 3274061 - RNA, 20 nt, Mycobacterium tuberculosis H37Rv
cacgaaccgugcugggcauc

SEQ ID NO: 3274062 - RNA, 23 nt, Mycobacterium tuberculosis H37Rv
cacgaacgccugcucgucggcca

SEQ ID NO: 3274063 - RNA, 21 nt, Mycobacterium tuberculosis H37Rv
cacgaagcuggcgugcagcag

SEQ ID NO: 3274064 - RNA, 22 nt, Mycobacterium tuberculosis H37Rv
cacgaagcuggcgugcagcagg

SEQ ID NO: 3274065 - RNA, 17 nt, Mycobacterium tuberculosis H37Rv
cacgaagugacccgaac

SEQ ID NO: 3274066 - RNA, 13 nt, Mycobacterium tuberculosis H37Rv
cacgaauccggcc

SEQ ID NO: 3274067 - RNA, 18 nt, Mycobacterium tuberculosis H37Rv
cacgacaacuucgccgga

SEQ ID NO: 3274068 - RNA, 21 nt, Mycobacterium tuberculosis H37Rv
cacgacagcagaguggugauc

SEQ ID NO: 3274069 - RNA, 15 nt, Mycobacterium tuberculosis H37Rv
cacgacaggucgccc

SEQ ID NO: 3274070 - RNA, 18 nt, Mycobacterium tuberculosis H37Rv
cacgacaugaccgacagg

SEQ ID NO: 3274071 - RNA, 14 nt, Mycobacterium tuberculosis H37Rv
cacgacccagcaug

SEQ ID NO: 3274072 - RNA, 22 nt, Mycobacterium tuberculosis H37Rv
cacgacccgggaaggaaccggg

SEQ ID NO: 3274073 - RNA, 16 nt, Mycobacterium tuberculosis H37Rv
cacgaccgacaccccg

SEQ ID NO: 3274074 - RNA, 15 nt, Mycobacterium tuberculosis H37Rv
cacgaccgccgauac

SEQ ID NO: 3274075 - RNA, 19 nt, Mycobacterium tuberculosis H37Rv
cacgaccgcgcaacaccuc

SEQ ID NO: 3274076 - RNA, 13 nt, Mycobacterium tuberculosis H37Rv
cacgaccucggga

SEQ ID NO: 3274077 - RNA, 16 nt, Mycobacterium tuberculosis H37Rv
cacgaccugcucaucc

SEQ ID NO: 3274078 - RNA, 13 nt, Mycobacterium tuberculosis H37Rv
cacgaccugguua

SEQ ID NO: 3274079 - RNA, 22 nt, Mycobacterium tuberculosis H37Rv
cacgacgaacaccagcgcgccg

SEQ ID NO: 3274080 - RNA, 19 nt, Mycobacterium tuberculosis H37Rv
cacgacgaauccccgacac

SEQ ID NO: 3274081 - RNA, 18 nt, Mycobacterium tuberculosis H37Rv
cacgacgacaaccggcca

SEQ ID NO: 3274082 - RNA, 14 nt, Mycobacterium tuberculosis H37Rv
cacgacgccgagca

SEQ ID NO: 3274083 - RNA, 19 nt, Mycobacterium tuberculosis H37Rv
cacgacgccggccuggccg

SEQ ID NO: 3274084 - RNA, 22 nt, Mycobacterium tuberculosis H37Rv
cacgacgccggccuggccgcca

SEQ ID NO: 3274085 - RNA, 21 nt, Mycobacterium tuberculosis H37Rv
cacgacgccuugucggcgugu

SEQ ID NO: 3274086 - RNA, 17 nt, Mycobacterium tuberculosis H37Rv
cacgacgcgacacgccg

SEQ ID NO: 3274087 - RNA, 13 nt, Mycobacterium tuberculosis H37Rv
cacgacgggccga

SEQ ID NO: 3274088 - RNA, 17 nt, Mycobacterium tuberculosis H37Rv
cacgacgugcaggaaca

SEQ ID NO: 3274089 - RNA, 15 nt, Mycobacterium tuberculosis H37Rv
cacgacucccccggc

SEQ ID NO: 3274090 - RNA, 22 nt, Mycobacterium tuberculosis H37Rv
cacgacugcggcaaacgugauc

SEQ ID NO: 3274091 - RNA, 18 nt, Mycobacterium tuberculosis H37Rv
cacgacuggcgcccagcc

SEQ ID NO: 3274092 - RNA, 21 nt, Mycobacterium tuberculosis H37Rv
cacgacuggcgcccagccgga

SEQ ID NO: 3274093 - RNA, 17 nt, Mycobacterium tuberculosis H37Rv
cacgacugugcgccgca

SEQ ID NO: 3274094 - RNA, 16 nt, Mycobacterium tuberculosis H37Rv
cacgagagcgcugucc

SEQ ID NO: 3274095 - RNA, 17 nt, Mycobacterium tuberculosis H37Rv
cacgagcaacgggcgaa

SEQ ID NO: 3274096 - RNA, 22 nt, Mycobacterium tuberculosis H37Rv
cacgagcacgggacuucgugcc

SEQ ID NO: 3274097 - RNA, 14 nt, Mycobacterium tuberculosis H37Rv
cacgagcagccgau

SEQ ID NO: 3274098 - RNA, 21 nt, Mycobacterium tuberculosis H37Rv
cacgagcaugcuggaccucgc

SEQ ID NO: 3274099 - RNA, 13 nt, Mycobacterium tuberculosis H37Rv
cacgagcguagcg

SEQ ID NO: 3274100 - RNA, 22 nt, Mycobacterium tuberculosis H37Rv
cacgaggacugggugcgcggcc

SEQ ID NO: 3274101 - RNA, 21 nt, Mycobacterium tuberculosis H37Rv
cacgaggcacaaucaccgccg

SEQ ID NO: 3274102 - RNA, 16 nt, Mycobacterium tuberculosis H37Rv
cacgaggcuugcggca

SEQ ID NO: 3274103 - RNA, 19 nt, Mycobacterium tuberculosis H37Rv
cacgaggcuugcggcacaa

SEQ ID NO: 3274104 - RNA, 17 nt, Mycobacterium tuberculosis H37Rv
cacgagguugggccggu

SEQ ID NO: 3274105 - RNA, 20 nt, Mycobacterium tuberculosis H37Rv
cacgaguccgcggaucacca

SEQ ID NO: 3274106 - RNA, 16 nt, Mycobacterium tuberculosis H37Rv
cacgagucgccagacc

SEQ ID NO: 3274107 - RNA, 14 nt, Mycobacterium tuberculosis H37Rv
cacgagugcaagac

SEQ ID NO: 3274108 - RNA, 21 nt, Mycobacterium tuberculosis H37Rv
cacgaucaacucgugcgggca

SEQ ID NO: 3274109 - RNA, 17 nt, Mycobacterium tuberculosis H37Rv
cacgaucacccgcacgu

SEQ ID NO: 3274110 - RNA, 19 nt, Mycobacterium tuberculosis H37Rv
cacgaucacgucgucucgg

SEQ ID NO: 3274111 - RNA, 17 nt, Mycobacterium tuberculosis H37Rv
cacgaucaguugcccca

SEQ ID NO: 3274112 - RNA, 22 nt, Mycobacterium tuberculosis H37Rv
cacgaucaucgggguggccacc

SEQ ID NO: 3274113 - RNA, 23 nt, Mycobacterium tuberculosis H37Rv
cacgaucaucgggguggccacca

SEQ ID NO: 3274114 - RNA, 22 nt, Mycobacterium tuberculosis H37Rv
cacgauccgcgguagcagcagc

SEQ ID NO: 3274115 - RNA, 15 nt, Mycobacterium tuberculosis H37Rv
cacgaucgcccguga

SEQ ID NO: 3274116 - RNA, 14 nt, Mycobacterium tuberculosis H37Rv
cacgaucgcgucgg

SEQ ID NO: 3274117 - RNA, 15 nt, Mycobacterium tuberculosis H37Rv
cacgaucgugccggg

SEQ ID NO: 3274118 - RNA, 16 nt, Mycobacterium tuberculosis H37Rv
cacgaucgugccggga

SEQ ID NO: 3274119 - RNA, 21 nt, Mycobacterium tuberculosis H37Rv
cacgaucgugccgggaccggu

SEQ ID NO: 3274120 - RNA, 19 nt, Mycobacterium tuberculosis H37Rv
cacgaucucguggaucugc

SEQ ID NO: 3274121 - RNA, 22 nt, Mycobacterium tuberculosis H37Rv
cacgaucucguggaucugccuc

SEQ ID NO: 3274122 - RNA, 23 nt, Mycobacterium tuberculosis H37Rv
cacgaucucguggaucugccucu

SEQ ID NO: 3274123 - RNA, 21 nt, Mycobacterium tuberculosis H37Rv
cacgaucugcaggcccaggcu

SEQ ID NO: 3274124 - RNA, 23 nt, Mycobacterium tuberculosis H37Rv
cacgaucugcaggcccaggcugu

SEQ ID NO: 3274125 - RNA, 14 nt, Mycobacterium tuberculosis H37Rv
cacgaugaucccaa

SEQ ID NO: 3274126 - RNA, 23 nt, Mycobacterium tuberculosis H37Rv
cacgaugaucuugccgcggcgca

SEQ ID NO: 3274127 - RNA, 23 nt, Mycobacterium tuberculosis H37Rv
cacgaugcccaagcccucgacgu

SEQ ID NO: 3274128 - RNA, 14 nt, Mycobacterium tuberculosis H37Rv
cacgauggcggcca

SEQ ID NO: 3274129 - RNA, 17 nt, Mycobacterium tuberculosis H37Rv
cacgauguccucgaugc

SEQ ID NO: 3274130 - RNA, 19 nt, Mycobacterium tuberculosis H37Rv
cacgauguccucgaugcgg

SEQ ID NO: 3274131 - RNA, 18 nt, Mycobacterium tuberculosis H37Rv
cacgcaaaguucgucacc

SEQ ID NO: 3274132 - RNA, 18 nt, Mycobacterium tuberculosis H37Rv
cacgcaacaccgccaacu

SEQ ID NO: 3274133 - RNA, 20 nt, Mycobacterium tuberculosis H37Rv
cacgcaacaccgccaacucc

SEQ ID NO: 3274134 - RNA, 19 nt, Mycobacterium tuberculosis H37Rv
cacgcaaccggcggacacc

SEQ ID NO: 3274135 - RNA, 15 nt, Mycobacterium tuberculosis H37Rv
cacgcaaugucggca

SEQ ID NO: 3274136 - RNA, 14 nt, Mycobacterium tuberculosis H37Rv
cacgcacaagccuc

SEQ ID NO: 3274137 - RNA, 13 nt, Mycobacterium tuberculosis H37Rv
cacgcacccggcg

SEQ ID NO: 3274138 - RNA, 14 nt, Mycobacterium tuberculosis H37Rv
cacgcaccgccccg

SEQ ID NO: 3274139 - RNA, 15 nt, Mycobacterium tuberculosis H37Rv
cacgcaccgccccgc

SEQ ID NO: 3274140 - RNA, 20 nt, Mycobacterium tuberculosis H37Rv
cacgcacgcgguucaccacg

SEQ ID NO: 3274141 - RNA, 20 nt, Mycobacterium tuberculosis H37Rv
cacgcacguagacgguguca

SEQ ID NO: 3274142 - RNA, 16 nt, Mycobacterium tuberculosis H37Rv
cacgcacucccgagcc

SEQ ID NO: 3274143 - RNA, 20 nt, Mycobacterium tuberculosis H37Rv
cacgcacucccgagccacaa

SEQ ID NO: 3274144 - RNA, 19 nt, Mycobacterium tuberculosis H37Rv
cacgcacucgucgggguug

SEQ ID NO: 3274145 - RNA, 22 nt, Mycobacterium tuberculosis H37Rv
cacgcacugaugucacccgccc

SEQ ID NO: 3274146 - RNA, 17 nt, Mycobacterium tuberculosis H37Rv
cacgcacugccgcggac

SEQ ID NO: 3274147 - RNA, 12 nt, Mycobacterium tuberculosis H37Rv
cacgcagagcca

SEQ ID NO: 3274148 - RNA, 13 nt, Mycobacterium tuberculosis H37Rv
cacgcagcccguc

SEQ ID NO: 3274149 - RNA, 21 nt, Mycobacterium tuberculosis H37Rv
cacgcagcccgucggcgccga

SEQ ID NO: 3274150 - RNA, 13 nt, Mycobacterium tuberculosis H37Rv
cacgcagccgcgc

SEQ ID NO: 3274151 - RNA, 17 nt, Mycobacterium tuberculosis H37Rv
cacgcaggaaaaccccg

SEQ ID NO: 3274152 - RNA, 18 nt, Mycobacterium tuberculosis H37Rv
cacgcaguucggucagcg

SEQ ID NO: 3274153 - RNA, 21 nt, Mycobacterium tuberculosis H37Rv
cacgcaucgcgaagucgucca

SEQ ID NO: 3274154 - RNA, 13 nt, Mycobacterium tuberculosis H37Rv
cacgcaugggcca

SEQ ID NO: 3274155 - RNA, 17 nt, Mycobacterium tuberculosis H37Rv
cacgcauguuggugauc

SEQ ID NO: 3274156 - RNA, 20 nt, Mycobacterium tuberculosis H37Rv
cacgccaacguugcgccagc

SEQ ID NO: 3274157 - RNA, 14 nt, Mycobacterium tuberculosis H37Rv
cacgccaaguccgc

SEQ ID NO: 3274158 - RNA, 14 nt, Mycobacterium tuberculosis H37Rv
cacgccaccgcaac

SEQ ID NO: 3274159 - RNA, 15 nt, Mycobacterium tuberculosis H37Rv
cacgccaccgcaacu

SEQ ID NO: 3274160 - RNA, 15 nt, Mycobacterium tuberculosis H37Rv
cacgccagcccgucc

SEQ ID NO: 3274161 - RNA, 12 nt, Mycobacterium tuberculosis H37Rv
cacgccagccgu

SEQ ID NO: 3274162 - RNA, 16 nt, Mycobacterium tuberculosis H37Rv
cacgccagccgugccg

SEQ ID NO: 3274163 - RNA, 16 nt, Mycobacterium tuberculosis H37Rv
cacgccagcgcgacca

SEQ ID NO: 3274164 - RNA, 17 nt, Mycobacterium tuberculosis H37Rv
cacgccagcucgccggc

SEQ ID NO: 3274165 - RNA, 18 nt, Mycobacterium tuberculosis H37Rv
cacgccaggugaugccgc

SEQ ID NO: 3274166 - RNA, 18 nt, Mycobacterium tuberculosis H37Rv
cacgccauaccggcuggc

SEQ ID NO: 3274167 - RNA, 19 nt, Mycobacterium tuberculosis H37Rv
cacgccauccacgacaucg

SEQ ID NO: 3274168 - RNA, 19 nt, Mycobacterium tuberculosis H37Rv
cacgccauggaaacccucg

SEQ ID NO: 3274169 - RNA, 18 nt, Mycobacterium tuberculosis H37Rv
cacgcccacagcugacga

SEQ ID NO: 3274170 - RNA, 11 nt, Mycobacterium tuberculosis H37Rv
cacgcccaggc

SEQ ID NO: 3274171 - RNA, 15 nt, Mycobacterium tuberculosis H37Rv
cacgccccgaucggu

SEQ ID NO: 3274172 - RNA, 22 nt, Mycobacterium tuberculosis H37Rv
cacgccccgaucggugacgcgc

SEQ ID NO: 3274173 - RNA, 15 nt, Mycobacterium tuberculosis H37Rv
cacgcccgacgagga

SEQ ID NO: 3274174 - RNA, 15 nt, Mycobacterium tuberculosis H37Rv
cacgcccgacgccag

SEQ ID NO: 3274175 - RNA, 17 nt, Mycobacterium tuberculosis H37Rv
cacgcccgacgccagcu

SEQ ID NO: 3274176 - RNA, 12 nt, Mycobacterium tuberculosis H37Rv
cacgcccgccug

SEQ ID NO: 3274177 - RNA, 13 nt, Mycobacterium tuberculosis H37Rv
cacgcccgcgagc

SEQ ID NO: 3274178 - RNA, 13 nt, Mycobacterium tuberculosis H37Rv
cacgcccggcgug

SEQ ID NO: 3274179 - RNA, 15 nt, Mycobacterium tuberculosis H37Rv
cacgcccucgacgcg

SEQ ID NO: 3274180 - RNA, 19 nt, Mycobacterium tuberculosis H37Rv
cacgcccucgacgcgcucg

SEQ ID NO: 3274181 - RNA, 13 nt, Mycobacterium tuberculosis H37Rv
cacgccgaccaau

SEQ ID NO: 3274182 - RNA, 14 nt, Mycobacterium tuberculosis H37Rv
cacgccgaccagca

SEQ ID NO: 3274183 - RNA, 16 nt, Mycobacterium tuberculosis H37Rv
cacgccgaccagcacc

SEQ ID NO: 3274184 - RNA, 19 nt, Mycobacterium tuberculosis H37Rv
cacgccgaccagcacccgc

SEQ ID NO: 3274185 - RNA, 19 nt, Mycobacterium tuberculosis H37Rv
cacgccgaccaucucaccg

SEQ ID NO: 3274186 - RNA, 22 nt, Mycobacterium tuberculosis H37Rv
cacgccgaugauggacaccagc

SEQ ID NO: 3274187 - RNA, 22 nt, Mycobacterium tuberculosis H37Rv
cacgccgaugcggugcggauca

SEQ ID NO: 3274188 - RNA, 15 nt, Mycobacterium tuberculosis H37Rv
cacgccgauucgccg

SEQ ID NO: 3274189 - RNA, 21 nt, Mycobacterium tuberculosis H37Rv
cacgccgccgacgugaggguc

SEQ ID NO: 3274190 - RNA, 23 nt, Mycobacterium tuberculosis H37Rv
cacgccgccggccgccagcgcac

SEQ ID NO: 3274191 - RNA, 13 nt, Mycobacterium tuberculosis H37Rv
cacgccgccguug

SEQ ID NO: 3274192 - RNA, 13 nt, Mycobacterium tuberculosis H37Rv
cacgccggcaucg

SEQ ID NO: 3274193 - RNA, 20 nt, Mycobacterium tuberculosis H37Rv
cacgccggcaucgucgacgc

SEQ ID NO: 3274194 - RNA, 15 nt, Mycobacterium tuberculosis H37Rv
cacgccggcaugcca

SEQ ID NO: 3274195 - RNA, 14 nt, Mycobacterium tuberculosis H37Rv
cacgccggccagcg

SEQ ID NO: 3274196 - RNA, 15 nt, Mycobacterium tuberculosis H37Rv
cacgccgggcaaggc

SEQ ID NO: 3274197 - RNA, 21 nt, Mycobacterium tuberculosis H37Rv
cacgccgggcaaggccaccgu

SEQ ID NO: 3274198 - RNA, 16 nt, Mycobacterium tuberculosis H37Rv
cacgccguagcgcagc

SEQ ID NO: 3274199 - RNA, 23 nt, Mycobacterium tuberculosis H37Rv
cacgccguagcgcagcgccuccu

SEQ ID NO: 3274200 - RNA, 12 nt, Mycobacterium tuberculosis H37Rv
cacgccgucacc

SEQ ID NO: 3274201 - RNA, 14 nt, Mycobacterium tuberculosis H37Rv
cacgccgucaccgc

SEQ ID NO: 3274202 - RNA, 13 nt, Mycobacterium tuberculosis H37Rv
cacgccgucgaca

SEQ ID NO: 3274203 - RNA, 14 nt, Mycobacterium tuberculosis H37Rv
cacgccucgccgaa

SEQ ID NO: 3274204 - RNA, 20 nt, Mycobacterium tuberculosis H37Rv
cacgccucgccgaagugguc

SEQ ID NO: 3274205 - RNA, 22 nt, Mycobacterium tuberculosis H37Rv
cacgccugccgaaacgccgacc

SEQ ID NO: 3274206 - RNA, 19 nt, Mycobacterium tuberculosis H37Rv
cacgccugcucggagagca

SEQ ID NO: 3274207 - RNA, 21 nt, Mycobacterium tuberculosis H37Rv
cacgccuggcuacgcgcgccc

SEQ ID NO: 3274208 - RNA, 14 nt, Mycobacterium tuberculosis H37Rv
cacgccugggcgac

SEQ ID NO: 3274209 - RNA, 15 nt, Mycobacterium tuberculosis H37Rv
cacgccugggcgacg

SEQ ID NO: 3274210 - RNA, 15 nt, Mycobacterium tuberculosis H37Rv
cacgccuugagccga

SEQ ID NO: 3274211 - RNA, 15 nt, Mycobacterium tuberculosis H37Rv
cacgcgaaugacgau

SEQ ID NO: 3274212 - RNA, 21 nt, Mycobacterium tuberculosis H37Rv
cacgcgaaugacgauccagcc

SEQ ID NO: 3274213 - RNA, 12 nt, Mycobacterium tuberculosis H37Rv
cacgcgaccacc

SEQ ID NO: 3274214 - RNA, 15 nt, Mycobacterium tuberculosis H37Rv
cacgcgaugcacgcc

SEQ ID NO: 3274215 - RNA, 15 nt, Mycobacterium tuberculosis H37Rv
cacgcgauggccauc

SEQ ID NO: 3274216 - RNA, 21 nt, Mycobacterium tuberculosis H37Rv
cacgcgcccgcaccaccggcc

SEQ ID NO: 3274217 - RNA, 15 nt, Mycobacterium tuberculosis H37Rv
cacgcgcggcgucgu

SEQ ID NO: 3274218 - RNA, 23 nt, Mycobacterium tuberculosis H37Rv
cacgcgcguuuagucuccggcgu

SEQ ID NO: 3274219 - RNA, 14 nt, Mycobacterium tuberculosis H37Rv
cacgcgcucaccga

SEQ ID NO: 3274220 - RNA, 22 nt, Mycobacterium tuberculosis H37Rv
cacgcggaaaccaucgccagcc

SEQ ID NO: 3274221 - RNA, 12 nt, Mycobacterium tuberculosis H37Rv
cacgcggcgaug

SEQ ID NO: 3274222 - RNA, 14 nt, Mycobacterium tuberculosis H37Rv
cacgcgggaagugc

SEQ ID NO: 3274223 - RNA, 20 nt, Mycobacterium tuberculosis H37Rv
cacgcgggagguacccccag

SEQ ID NO: 3274224 - RNA, 20 nt, Mycobacterium tuberculosis H37Rv
cacgcgggcacugguggcga

SEQ ID NO: 3274225 - RNA, 18 nt, Mycobacterium tuberculosis H37Rv
cacgcggguugcgcggcu

SEQ ID NO: 3274226 - RNA, 13 nt, Mycobacterium tuberculosis H37Rv
cacgcggucccac

SEQ ID NO: 3274227 - RNA, 14 nt, Mycobacterium tuberculosis H37Rv
cacgcguagcgguc

SEQ ID NO: 3274228 - RNA, 19 nt, Mycobacterium tuberculosis H37Rv
cacgcgucuucggucgcgg

SEQ ID NO: 3274229 - RNA, 18 nt, Mycobacterium tuberculosis H37Rv
cacgcgugacucggccga

SEQ ID NO: 3274230 - RNA, 22 nt, Mycobacterium tuberculosis H37Rv
cacgcguuccauggcccgcucg

SEQ ID NO: 3274231 - RNA, 20 nt, Mycobacterium tuberculosis H37Rv
cacgcguuccuccagcagcg

SEQ ID NO: 3274232 - RNA, 20 nt, Mycobacterium tuberculosis H37Rv
cacgcguuucgaaccgcacg

SEQ ID NO: 3274233 - RNA, 14 nt, Mycobacterium tuberculosis H37Rv
cacgcucacccggc

SEQ ID NO: 3274234 - RNA, 18 nt, Mycobacterium tuberculosis H37Rv
cacgcucaugaccgcucg

SEQ ID NO: 3274235 - RNA, 18 nt, Mycobacterium tuberculosis H37Rv
cacgcuccagcucggcca

SEQ ID NO: 3274236 - RNA, 14 nt, Mycobacterium tuberculosis H37Rv
cacgcucgcgcacc

SEQ ID NO: 3274237 - RNA, 14 nt, Mycobacterium tuberculosis H37Rv
uggugucgcggccg

SEQ ID NO: 3274238 - RNA, 22 nt, Mycobacterium tuberculosis H37Rv
uggugucggaaugggcgccaca

SEQ ID NO: 3274239 - RNA, 17 nt, Mycobacterium tuberculosis H37Rv
uggugugacgaucccca

SEQ ID NO: 3274240 - RNA, 22 nt, Mycobacterium tuberculosis H37Rv
uggugugauacagcgccagggg

SEQ ID NO: 3274241 - RNA, 13 nt, Mycobacterium tuberculosis H37Rv
ugguguggggcgg

SEQ ID NO: 3274242 - RNA, 19 nt, Mycobacterium tuberculosis H37Rv
ugguuacucaccaaccgca

SEQ ID NO: 3274243 - RNA, 17 nt, Mycobacterium tuberculosis H37Rv
ugguuagaggaugguca

SEQ ID NO: 3274244 - RNA, 22 nt, Mycobacterium tuberculosis H37Rv
ugguuagaggauggucagcagc

SEQ ID NO: 3274245 - RNA, 14 nt, Mycobacterium tuberculosis H37Rv
ugguuagguggcug

SEQ ID NO: 3274246 - RNA, 13 nt, Mycobacterium tuberculosis H37Rv
ugguucaaccgga

SEQ ID NO: 3274247 - RNA, 13 nt, Mycobacterium tuberculosis H37Rv
ugguucaccucgg

SEQ ID NO: 3274248 - RNA, 17 nt, Mycobacterium tuberculosis H37Rv
ugguuccggcgugcagc

SEQ ID NO: 3274249 - RNA, 13 nt, Mycobacterium tuberculosis H37Rv
ugguucgcacacc

SEQ ID NO: 3274250 - RNA, 17 nt, Mycobacterium tuberculosis H37Rv
ugguugaaccgguacaa

SEQ ID NO: 3274251 - RNA, 13 nt, Mycobacterium tuberculosis H37Rv
ugguugaccucgg

SEQ ID NO: 3274252 - RNA, 16 nt, Mycobacterium tuberculosis H37Rv
ugguugcguccgccga

SEQ ID NO: 3274253 - RNA, 13 nt, Mycobacterium tuberculosis H37Rv
ugguuggcucgcu

SEQ ID NO: 3274254 - RNA, 16 nt, Mycobacterium tuberculosis H37Rv
ugguugggccagcucc

SEQ ID NO: 3274255 - RNA, 19 nt, Mycobacterium tuberculosis H37Rv
uguacaacgccgucgucgu

SEQ ID NO: 3274256 - RNA, 21 nt, Mycobacterium tuberculosis H37Rv
uguacaggcuguccagcagcg

SEQ ID NO: 3274257 - RNA, 15 nt, Mycobacterium tuberculosis H37Rv
uguaccccagcaucu

SEQ ID NO: 3274258 - RNA, 18 nt, Mycobacterium tuberculosis H37Rv
uguaccccagcgccacca

SEQ ID NO: 3274259 - RNA, 17 nt, Mycobacterium tuberculosis H37Rv
uguacgcaucgccguca

SEQ ID NO: 3274260 - RNA, 16 nt, Mycobacterium tuberculosis H37Rv
uguacugcggugccac

SEQ ID NO: 3274261 - RNA, 15 nt, Mycobacterium tuberculosis H37Rv
uguagacggcggcau

SEQ ID NO: 3274262 - RNA, 14 nt, Mycobacterium tuberculosis H37Rv
uguagacgucgacc

SEQ ID NO: 3274263 - RNA, 18 nt, Mycobacterium tuberculosis H37Rv
uguagagcgcaccgcgaa

SEQ ID NO: 3274264 - RNA, 13 nt, Mycobacterium tuberculosis H37Rv
uguagaucagcaa

SEQ ID NO: 3274265 - RNA, 19 nt, Mycobacterium tuberculosis H37Rv
uguagcagcgccagcagcu

SEQ ID NO: 3274266 - RNA, 20 nt, Mycobacterium tuberculosis H37Rv
uguagccaaccguguaggcc

SEQ ID NO: 3274267 - RNA, 20 nt, Mycobacterium tuberculosis H37Rv
uguagccagcggcugcccau

SEQ ID NO: 3274268 - RNA, 12 nt, Mycobacterium tuberculosis H37Rv
uguagcccagcc

SEQ ID NO: 3274269 - RNA, 12 nt, Mycobacterium tuberculosis H37Rv
uguagcccuccg

SEQ ID NO: 3274270 - RNA, 16 nt, Mycobacterium tuberculosis H37Rv
uguagcucggacccuc

SEQ ID NO: 3274271 - RNA, 21 nt, Mycobacterium tuberculosis H37Rv
uguagcugcgggucucgccga

SEQ ID NO: 3274272 - RNA, 15 nt, Mycobacterium tuberculosis H37Rv
uguaggcuuccagcu

SEQ ID NO: 3274273 - RNA, 14 nt, Mycobacterium tuberculosis H37Rv
uguagggcugcucc

SEQ ID NO: 3274274 - RNA, 15 nt, Mycobacterium tuberculosis H37Rv
uguagggcuuccagg

SEQ ID NO: 3274275 - RNA, 23 nt, Mycobacterium tuberculosis H37Rv
uguaguccucgguggccuucugg

SEQ ID NO: 3274276 - RNA, 18 nt, Mycobacterium tuberculosis H37Rv
uguaugacaggucacggu

SEQ ID NO: 3274277 - RNA, 17 nt, Mycobacterium tuberculosis H37Rv
ugucaaccaagugaccg

SEQ ID NO: 3274278 - RNA, 21 nt, Mycobacterium tuberculosis H37Rv
ugucaaucauguacaccgucg

SEQ ID NO: 3274279 - RNA, 22 nt, Mycobacterium tuberculosis H37Rv
ugucaaugacaccggggcagau

SEQ ID NO: 3274280 - RNA, 13 nt, Mycobacterium tuberculosis H37Rv
ugucaccgccggg

SEQ ID NO: 3274281 - RNA, 18 nt, Mycobacterium tuberculosis H37Rv
ugucaccgccgggaagcc

SEQ ID NO: 3274282 - RNA, 19 nt, Mycobacterium tuberculosis H37Rv
ugucaccgccgggaagccg

SEQ ID NO: 3274283 - RNA, 14 nt, Mycobacterium tuberculosis H37Rv
ugucacgcaccgcg

SEQ ID NO: 3274284 - RNA, 15 nt, Mycobacterium tuberculosis H37Rv
ugucacgcaccgcgg

SEQ ID NO: 3274285 - RNA, 15 nt, Mycobacterium tuberculosis H37Rv
ugucacguaacgccg

SEQ ID NO: 3274286 - RNA, 17 nt, Mycobacterium tuberculosis H37Rv
ugucacuguaccgggcg

SEQ ID NO: 3274287 - RNA, 14 nt, Mycobacterium tuberculosis H37Rv
ugucagcagcccau

SEQ ID NO: 3274288 - RNA, 14 nt, Mycobacterium tuberculosis H37Rv
ugucagccaccggu

SEQ ID NO: 3274289 - RNA, 21 nt, Mycobacterium tuberculosis H37Rv
ugucagcgaacggccaggaca

SEQ ID NO: 3274290 - RNA, 18 nt, Mycobacterium tuberculosis H37Rv
ugucagcggccgcgacgu

SEQ ID NO: 3274291 - RNA, 19 nt, Mycobacterium tuberculosis H37Rv
ugucaggauauuucuaaau

SEQ ID NO: 3274292 - RNA, 15 nt, Mycobacterium tuberculosis H37Rv
ugugaacugucccac

SEQ ID NO: 3274293 - RNA, 19 nt, Mycobacterium tuberculosis H37Rv
ugugaaucgcacgacgcga

SEQ ID NO: 3274294 - RNA, 19 nt, Mycobacterium tuberculosis H37Rv
ugugaaucugacgacgcga

SEQ ID NO: 3274295 - RNA, 12 nt, Mycobacterium tuberculosis H37Rv
ugugacaucggg

SEQ ID NO: 3274296 - RNA, 21 nt, Mycobacterium tuberculosis H37Rv
ugugaccgaacaacagcggca

SEQ ID NO: 3274297 - RNA, 17 nt, Mycobacterium tuberculosis H37Rv
ugugacggcggccacgu

SEQ ID NO: 3274298 - RNA, 21 nt, Mycobacterium tuberculosis H37Rv
ugugagcacaccgacagcacc

SEQ ID NO: 3274299 - RNA, 23 nt, Mycobacterium tuberculosis H37Rv
ugugagccacgcgcaaacucaga

SEQ ID NO: 3274300 - RNA, 11 nt, Mycobacterium tuberculosis H37Rv
ugugagcgcgc

SEQ ID NO: 3274301 - RNA, 23 nt, Mycobacterium tuberculosis H37Rv
ugugagguagucggcgcgucguu

SEQ ID NO: 3274302 - RNA, 13 nt, Mycobacterium tuberculosis H37Rv
ugugaucaccgau

SEQ ID NO: 3274303 - RNA, 19 nt, Mycobacterium tuberculosis H37Rv
ugugcacggcuucggcgag

SEQ ID NO: 3274304 - RNA, 14 nt, Mycobacterium tuberculosis H37Rv
ugugcacggugugc

SEQ ID NO: 3274305 - RNA, 20 nt, Mycobacterium tuberculosis H37Rv
ugugcacggugugcacggcg

SEQ ID NO: 3274306 - RNA, 16 nt, Mycobacterium tuberculosis H37Rv
ugugcaucggcgaccg

SEQ ID NO: 3274307 - RNA, 13 nt, Mycobacterium tuberculosis H37Rv
ugugccaccgcug

SEQ ID NO: 3274308 - RNA, 13 nt, Mycobacterium tuberculosis H37Rv
ugugccacggggc

SEQ ID NO: 3274309 - RNA, 21 nt, Mycobacterium tuberculosis H37Rv
ugugcccaugaugcucgauga

SEQ ID NO: 3274310 - RNA, 22 nt, Mycobacterium tuberculosis H37Rv
ugugcccaugaugcucgaugau

SEQ ID NO: 3274311 - RNA, 21 nt, Mycobacterium tuberculosis H37Rv
ugugcccggcuccuccccggc

SEQ ID NO: 3274312 - RNA, 19 nt, Mycobacterium tuberculosis H37Rv
ugugcccggcucucagcga

SEQ ID NO: 3274313 - RNA, 20 nt, Mycobacterium tuberculosis H37Rv
ugugccgaucggccaacagg

SEQ ID NO: 3274314 - RNA, 11 nt, Mycobacterium tuberculosis H37Rv
ugugccgccgg

SEQ ID NO: 3274315 - RNA, 18 nt, Mycobacterium tuberculosis H37Rv
ugugccgcugcauccgca

SEQ ID NO: 3274316 - RNA, 17 nt, Mycobacterium tuberculosis H37Rv
ugugccguccccggccg

SEQ ID NO: 3274317 - RNA, 14 nt, Mycobacterium tuberculosis H37Rv
ugugccugcgucuc

SEQ ID NO: 3274318 - RNA, 17 nt, Mycobacterium tuberculosis H37Rv
ugugcgauccagggccg

SEQ ID NO: 3274319 - RNA, 21 nt, Mycobacterium tuberculosis H37Rv
ugugcgauccagggccgacgc

SEQ ID NO: 3274320 - RNA, 17 nt, Mycobacterium tuberculosis H37Rv
ugugcgccgcagccugc

SEQ ID NO: 3274321 - RNA, 16 nt, Mycobacterium tuberculosis H37Rv
ugugcggcguuguggc

SEQ ID NO: 3274322 - RNA, 19 nt, Mycobacterium tuberculosis H37Rv
ugugcgggcagguccgcca

SEQ ID NO: 3274323 - RNA, 23 nt, Mycobacterium tuberculosis H37Rv
ugugcgggcggugcacaccgucg

SEQ ID NO: 3274324 - RNA, 20 nt, Mycobacterium tuberculosis H37Rv
ugugcgucguucggagcccu

SEQ ID NO: 3274325 - RNA, 15 nt, Mycobacterium tuberculosis H37Rv
ugugcguugcgcugc

SEQ ID NO: 3274326 - RNA, 13 nt, Mycobacterium tuberculosis H37Rv
ugugcucgccgau

SEQ ID NO: 3274327 - RNA, 13 nt, Mycobacterium tuberculosis H37Rv
ugugcucggccaa

SEQ ID NO: 3274328 - RNA, 16 nt, Mycobacterium tuberculosis H37Rv
ugugcugccaccggcc

SEQ ID NO: 3274329 - RNA, 16 nt, Mycobacterium tuberculosis H37Rv
uguggaauacgcugcu

SEQ ID NO: 3274330 - RNA, 12 nt, Mycobacterium tuberculosis H37Rv
uguggacccgcc

SEQ ID NO: 3274331 - RNA, 18 nt, Mycobacterium tuberculosis H37Rv
uguggacccgccagggca

SEQ ID NO: 3274332 - RNA, 12 nt, Mycobacterium tuberculosis H37Rv
uguggacgcccg

SEQ ID NO: 3274333 - RNA, 22 nt, Mycobacterium tuberculosis H37Rv
uguggacgcccgaguugaagaa

SEQ ID NO: 3274334 - RNA, 18 nt, Mycobacterium tuberculosis H37Rv
uguggacugggccagguc

SEQ ID NO: 3274335 - RNA, 19 nt, Mycobacterium tuberculosis H37Rv
uguggacuucagcaggccc

SEQ ID NO: 3274336 - RNA, 13 nt, Mycobacterium tuberculosis H37Rv
uguggcacccggc

SEQ ID NO: 3274337 - RNA, 18 nt, Mycobacterium tuberculosis H37Rv
uguggcacguggcgaccg

SEQ ID NO: 3274338 - RNA, 17 nt, Mycobacterium tuberculosis H37Rv
uguggccagcaucauca

SEQ ID NO: 3274339 - RNA, 17 nt, Mycobacterium tuberculosis H37Rv
uguggcccaacaccgcc

SEQ ID NO: 3274340 - RNA, 24 nt, Mycobacterium tuberculosis H37Rv
uguggcccacauguccagcguccu

SEQ ID NO: 3274341 - RNA, 13 nt, Mycobacterium tuberculosis H37Rv
uguggcccgucau

SEQ ID NO: 3274342 - RNA, 17 nt, Mycobacterium tuberculosis H37Rv
uguggcggcguccagaa

SEQ ID NO: 3274343 - RNA, 21 nt, Mycobacterium tuberculosis H37Rv
uguggcugaucccggccaggc

SEQ ID NO: 3274344 - RNA, 15 nt, Mycobacterium tuberculosis H37Rv
uguggcuuugacugc

SEQ ID NO: 3274345 - RNA, 21 nt, Mycobacterium tuberculosis H37Rv
ugugggaacuggaccacagcc

SEQ ID NO: 3274346 - RNA, 19 nt, Mycobacterium tuberculosis H37Rv
ugugggugaacaccgaggu

SEQ ID NO: 3274347 - RNA, 16 nt, Mycobacterium tuberculosis H37Rv
ugugggugguuguguc

SEQ ID NO: 3274348 - RNA, 16 nt, Mycobacterium tuberculosis H37Rv
ugugguaccagcccgc

SEQ ID NO: 3274349 - RNA, 15 nt, Mycobacterium tuberculosis H37Rv
uguggucaccaggcc

SEQ ID NO: 3274350 - RNA, 15 nt, Mycobacterium tuberculosis H37Rv
ugugguccaucgcgc

SEQ ID NO: 3274351 - RNA, 18 nt, Mycobacterium tuberculosis H37Rv
uguggucgaguugaagaa

SEQ ID NO: 3274352 - RNA, 18 nt, Mycobacterium tuberculosis H37Rv
uguggucuucaucgccgu

SEQ ID NO: 3274353 - RNA, 15 nt, Mycobacterium tuberculosis H37Rv
uguggugacagagcg

SEQ ID NO: 3274354 - RNA, 16 nt, Mycobacterium tuberculosis H37Rv
uguggugcggcgcgau

SEQ ID NO: 3274355 - RNA, 19 nt, Mycobacterium tuberculosis H37Rv
uguggugugccugcgucuc

SEQ ID NO: 3274356 - RNA, 19 nt, Mycobacterium tuberculosis H37Rv
uguguccgaaggcuugucg

SEQ ID NO: 3274357 - RNA, 18 nt, Mycobacterium tuberculosis H37Rv
uguguccgcucgccgcca

SEQ ID NO: 3274358 - RNA, 18 nt, Mycobacterium tuberculosis H37Rv
uguguccugucgcaccag

SEQ ID NO: 3274359 - RNA, 13 nt, Mycobacterium tuberculosis H37Rv
ugugucggccugg

SEQ ID NO: 3274360 - RNA, 12 nt, Mycobacterium tuberculosis H37Rv
ugugugcagcag

SEQ ID NO: 3274361 - RNA, 16 nt, Mycobacterium tuberculosis H37Rv
ugugugcagcagcauc

SEQ ID NO: 3274362 - RNA, 19 nt, Mycobacterium tuberculosis H37Rv
ugugugcgauccagggccg

SEQ ID NO: 3274363 - RNA, 12 nt, Mycobacterium tuberculosis H37Rv
uguguggcagcc

SEQ ID NO: 3274364 - RNA, 13 nt, Mycobacterium tuberculosis H37Rv
uguguggcagccc

SEQ ID NO: 3274365 - RNA, 17 nt, Mycobacterium tuberculosis H37Rv
uguuaaccgggcacgga

SEQ ID NO: 3274366 - RNA, 19 nt, Mycobacterium tuberculosis H37Rv
uguuaucgaagcccgaguu

SEQ ID NO: 3274367 - RNA, 17 nt, Mycobacterium tuberculosis H37Rv
uguuauuuuuggccaug

SEQ ID NO: 3274368 - RNA, 17 nt, Mycobacterium tuberculosis H37Rv
uguucaaucccuccgcc

SEQ ID NO: 3274369 - RNA, 14 nt, Mycobacterium tuberculosis H37Rv
uguucacgccgccg

SEQ ID NO: 3274370 - RNA, 22 nt, Mycobacterium tuberculosis H37Rv
uguucagcuucgccagguggcc

SEQ ID NO: 3274371 - RNA, 13 nt, Mycobacterium tuberculosis H37Rv
uguucaucaucug

SEQ ID NO: 3274372 - RNA, 15 nt, Mycobacterium tuberculosis H37Rv
uguuccaacacuggg

SEQ ID NO: 3274373 - RNA, 18 nt, Mycobacterium tuberculosis H37Rv
uguuccaacuccugcagc

SEQ ID NO: 3274374 - RNA, 15 nt, Mycobacterium tuberculosis H37Rv
uguuccacaccaggc

SEQ ID NO: 3274375 - RNA, 18 nt, Mycobacterium tuberculosis H37Rv
uguuccagaaggccgcac

SEQ ID NO: 3274376 - RNA, 20 nt, Mycobacterium tuberculosis H37Rv
uguuccagaaggccgcaccg

SEQ ID NO: 3274377 - RNA, 22 nt, Mycobacterium tuberculosis H37Rv
uguuccagcggguggccaucac

SEQ ID NO: 3274378 - RNA, 15 nt, Mycobacterium tuberculosis H37Rv
uguuccgccacccgc

SEQ ID NO: 3274379 - RNA, 19 nt, Mycobacterium tuberculosis H37Rv
uguuccgggugccgcgccg

SEQ ID NO: 3274380 - RNA, 19 nt, Mycobacterium tuberculosis H37Rv
uguuccgugcgggucgucc

SEQ ID NO: 3274381 - RNA, 15 nt, Mycobacterium tuberculosis H37Rv
uguucgacugcagaa

SEQ ID NO: 3274382 - RNA, 23 nt, Mycobacterium tuberculosis H37Rv
uguucgacugcagaaacagccgc

SEQ ID NO: 3274383 - RNA, 17 nt, Mycobacterium tuberculosis H37Rv
uguucgccgacgcgaag

SEQ ID NO: 3274384 - RNA, 21 nt, Mycobacterium tuberculosis H37Rv
uguucggcccuauggguuccu

SEQ ID NO: 3274385 - RNA, 15 nt, Mycobacterium tuberculosis H37Rv
uguucugcacguuga

SEQ ID NO: 3274386 - RNA, 21 nt, Mycobacterium tuberculosis H37Rv
uguucuugagccggacguucu

SEQ ID NO: 3274387 - RNA, 15 nt, Mycobacterium tuberculosis H37Rv
uguucuuggucaccg

SEQ ID NO: 3274388 - RNA, 19 nt, Mycobacterium tuberculosis H37Rv
uuccaucacggaccaggcc

SEQ ID NO: 3274389 - RNA, 15 nt, Mycobacterium tuberculosis H37Rv
uuccaucgcgaccuc

SEQ ID NO: 3274390 - RNA, 19 nt, Mycobacterium tuberculosis H37Rv
uuccauucgcgguccauca

SEQ ID NO: 3274391 - RNA, 12 nt, Mycobacterium tuberculosis H37Rv
uucccaccacca

SEQ ID NO: 3274392 - RNA, 14 nt, Mycobacterium tuberculosis H37Rv
uucccacuggaggu

SEQ ID NO: 3274393 - RNA, 17 nt, Mycobacterium tuberculosis H37Rv
uuccccaccgucgucgu

SEQ ID NO: 3274394 - RNA, 13 nt, Mycobacterium tuberculosis H37Rv
uucccgaaccccg

SEQ ID NO: 3274395 - RNA, 19 nt, Mycobacterium tuberculosis H37Rv
uucccgaguugcccucugg

SEQ ID NO: 3274396 - RNA, 23 nt, Mycobacterium tuberculosis H37Rv
uucccgccauugccgccgucgcc

SEQ ID NO: 3274397 - RNA, 17 nt, Mycobacterium tuberculosis H37Rv
uucccgcggacagcccg

SEQ ID NO: 3274398 - RNA, 18 nt, Mycobacterium tuberculosis H37Rv
uucccggauagacggcga

SEQ ID NO: 3274399 - RNA, 14 nt, Mycobacterium tuberculosis H37Rv
uucccggaugccga

SEQ ID NO: 3274400 - RNA, 13 nt, Mycobacterium tuberculosis H37Rv
uuccgaagcccgg

SEQ ID NO: 3274401 - RNA, 15 nt, Mycobacterium tuberculosis H37Rv
uuccgaggagggccg

SEQ ID NO: 3274402 - RNA, 16 nt, Mycobacterium tuberculosis H37Rv
uuccgauagccgacca

SEQ ID NO: 3274403 - RNA, 22 nt, Mycobacterium tuberculosis H37Rv
uuccgcagucccgaacaauuca

SEQ ID NO: 3274404 - RNA, 21 nt, Mycobacterium tuberculosis H37Rv
uuccgcccagugaacucguga

SEQ ID NO: 3274405 - RNA, 17 nt, Mycobacterium tuberculosis H37Rv
uuccgcgaaggucucga

SEQ ID NO: 3274406 - RNA, 20 nt, Mycobacterium tuberculosis H37Rv
uuccgcgaaucaacaggacc

SEQ ID NO: 3274407 - RNA, 15 nt, Mycobacterium tuberculosis H37Rv
uuccgcggguuugau

SEQ ID NO: 3274408 - RNA, 16 nt, Mycobacterium tuberculosis H37Rv
uuccgcuaccgcacag

SEQ ID NO: 3274409 - RNA, 16 nt, Mycobacterium tuberculosis H37Rv
uuccgcucgagggaug

SEQ ID NO: 3274410 - RNA, 19 nt, Mycobacterium tuberculosis H37Rv
uuccgcucguucgugcagc

SEQ ID NO: 3274411 - RNA, 13 nt, Mycobacterium tuberculosis H37Rv
uuccggcgcggcc

SEQ ID NO: 3274412 - RNA, 22 nt, Mycobacterium tuberculosis H37Rv
uuccgggcgaccaacacgucga

SEQ ID NO: 3274413 - RNA, 22 nt, Mycobacterium tuberculosis H37Rv
uuccguagacggggugagccga

SEQ ID NO: 3274414 - RNA, 15 nt, Mycobacterium tuberculosis H37Rv
uuccguuaggcucca

SEQ ID NO: 3274415 - RNA, 19 nt, Mycobacterium tuberculosis H37Rv
uuccucaaggucggccagg

SEQ ID NO: 3274416 - RNA, 22 nt, Mycobacterium tuberculosis H37Rv
uuccucaaggucggccaggcug

SEQ ID NO: 3274417 - RNA, 11 nt, Mycobacterium tuberculosis H37Rv
uuccucagcgg

SEQ ID NO: 3274418 - RNA, 15 nt, Mycobacterium tuberculosis H37Rv
uuccuccgacgcgau

SEQ ID NO: 3274419 - RNA, 15 nt, Mycobacterium tuberculosis H37Rv
uuccuccggcagcag

SEQ ID NO: 3274420 - RNA, 14 nt, Mycobacterium tuberculosis H37Rv
uuccuccucggcgc

SEQ ID NO: 3274421 - RNA, 16 nt, Mycobacterium tuberculosis H37Rv
uuccucgagccagcuc

SEQ ID NO: 3274422 - RNA, 18 nt, Mycobacterium tuberculosis H37Rv
uuccucgagccagcuccg

SEQ ID NO: 3274423 - RNA, 22 nt, Mycobacterium tuberculosis H37Rv
uuccucggauugcagcgcgaug

SEQ ID NO: 3274424 - RNA, 21 nt, Mycobacterium tuberculosis H37Rv
uuccucugggcuguccuccug

SEQ ID NO: 3274425 - RNA, 18 nt, Mycobacterium tuberculosis H37Rv
uuccugacgccauucauc

SEQ ID NO: 3274426 - RNA, 18 nt, Mycobacterium tuberculosis H37Rv
uuccugccgucucgucgg

SEQ ID NO: 3274427 - RNA, 18 nt, Mycobacterium tuberculosis H37Rv
uuccugcgccgguaacug

SEQ ID NO: 3274428 - RNA, 18 nt, Mycobacterium tuberculosis H37Rv
uuccuggcgggcgccuug

SEQ ID NO: 3274429 - RNA, 21 nt, Mycobacterium tuberculosis H37Rv
uuccuggcgggcgccuugguc

SEQ ID NO: 3274430 - RNA, 18 nt, Mycobacterium tuberculosis H37Rv
uuccuggguugugccgcc

SEQ ID NO: 3274431 - RNA, 15 nt, Mycobacterium tuberculosis H37Rv
uuccugguagucgcc

SEQ ID NO: 3274432 - RNA, 15 nt, Mycobacterium tuberculosis H37Rv
uuccuugccgaucgc

SEQ ID NO: 3274433 - RNA, 15 nt, Mycobacterium tuberculosis H37Rv
uucgaauuggugcgc

SEQ ID NO: 3274434 - RNA, 13 nt, Mycobacterium tuberculosis H37Rv
uucgacaggccac

SEQ ID NO: 3274435 - RNA, 24 nt, Mycobacterium tuberculosis H37Rv
uucgacaggccaccgcagacgccg

SEQ ID NO: 3274436 - RNA, 21 nt, Mycobacterium tuberculosis H37Rv
uucgacggcggccaaggucga

SEQ ID NO: 3274437 - RNA, 18 nt, Mycobacterium tuberculosis H37Rv
uucgacggugccgucugc

SEQ ID NO: 3274438 - RNA, 13 nt, Mycobacterium tuberculosis H37Rv
uucgagcaccgac

SEQ ID NO: 3274439 - RNA, 15 nt, Mycobacterium tuberculosis H37Rv
uucgagcugccaggc

SEQ ID NO: 3274440 - RNA, 14 nt, Mycobacterium tuberculosis H37Rv
uucgagggugaccc

SEQ ID NO: 3274441 - RNA, 14 nt, Mycobacterium tuberculosis H37Rv
uucgagguggcugc

SEQ ID NO: 3274442 - RNA, 21 nt, Mycobacterium tuberculosis H37Rv
uucgaucaacugcagauagga

SEQ ID NO: 3274443 - RNA, 15 nt, Mycobacterium tuberculosis H37Rv
uucgaucagucgugg

SEQ ID NO: 3274444 - RNA, 13 nt, Mycobacterium tuberculosis H37Rv
uucgaugggugca

SEQ ID NO: 3274445 - RNA, 19 nt, Mycobacterium tuberculosis H37Rv
uucgccacgcccgacgcca

SEQ ID NO: 3274446 - RNA, 13 nt, Mycobacterium tuberculosis H37Rv
uucgccagcgccg

SEQ ID NO: 3274447 - RNA, 18 nt, Mycobacterium tuberculosis H37Rv
uucgcccacagcuugccc

SEQ ID NO: 3274448 - RNA, 22 nt, Mycobacterium tuberculosis H37Rv
uucgcccgcccgucuuccagcc

SEQ ID NO: 3274449 - RNA, 22 nt, Mycobacterium tuberculosis H37Rv
uucgcccggcugcgccgggcuc

SEQ ID NO: 3274450 - RNA, 12 nt, Mycobacterium tuberculosis H37Rv
uucgccgagcgu

SEQ ID NO: 3274451 - RNA, 18 nt, Mycobacterium tuberculosis H37Rv
uucgccgaguugaccgcc

SEQ ID NO: 3274452 - RNA, 13 nt, Mycobacterium tuberculosis H37Rv
uucgccgcccgca

SEQ ID NO: 3274453 - RNA, 17 nt, Mycobacterium tuberculosis H37Rv
uucgccgcgcuugcgau

SEQ ID NO: 3274454 - RNA, 23 nt, Mycobacterium tuberculosis H37Rv
uucgccggaucgaaacucagccc

SEQ ID NO: 3274455 - RNA, 15 nt, Mycobacterium tuberculosis H37Rv
uucgccggcuccgca

SEQ ID NO: 3274456 - RNA, 17 nt, Mycobacterium tuberculosis H37Rv
uucgccguugucgucgg

SEQ ID NO: 3274457 - RNA, 19 nt, Mycobacterium tuberculosis H37Rv
uucgcgaagaacgacgcca

SEQ ID NO: 3274458 - RNA, 15 nt, Mycobacterium tuberculosis H37Rv
uucgcgaagcugugc

SEQ ID NO: 3274459 - RNA, 18 nt, Mycobacterium tuberculosis H37Rv
uucgcgacaacucgcgaa

SEQ ID NO: 3274460 - RNA, 22 nt, Mycobacterium tuberculosis H37Rv
uucgcgggacgcgacucggcgg

SEQ ID NO: 3274461 - RNA, 19 nt, Mycobacterium tuberculosis H37Rv
uucgcgguuggcggcgaug

SEQ ID NO: 3274462 - RNA, 13 nt, Mycobacterium tuberculosis H37Rv
uucgcgucgccga

SEQ ID NO: 3274463 - RNA, 17 nt, Mycobacterium tuberculosis H37Rv
uucgcgugccagcgccc

SEQ ID NO: 3274464 - RNA, 22 nt, Mycobacterium tuberculosis H37Rv
uucgcugaccgcuaccagcugg

SEQ ID NO: 3274465 - RNA, 20 nt, Mycobacterium tuberculosis H37Rv
uucggaaaaccgcaccgucc

SEQ ID NO: 3274466 - RNA, 14 nt, Mycobacterium tuberculosis H37Rv
uucggaggugaccu

SEQ ID NO: 3274467 - RNA, 14 nt, Mycobacterium tuberculosis H37Rv
uucggagucacgca

SEQ ID NO: 3274468 - RNA, 18 nt, Mycobacterium tuberculosis H37Rv
uucggaugucccuugacg

SEQ ID NO: 3274469 - RNA, 14 nt, Mycobacterium tuberculosis H37Rv
uucggaugucucgg

SEQ ID NO: 3274470 - RNA, 17 nt, Mycobacterium tuberculosis H37Rv
uucggcaggaaugccgc

SEQ ID NO: 3274471 - RNA, 19 nt, Mycobacterium tuberculosis H37Rv
uucggcaggaaugccgcgg

SEQ ID NO: 3274472 - RNA, 13 nt, Mycobacterium tuberculosis H37Rv
uucggccaccaac

SEQ ID NO: 3274473 - RNA, 14 nt, Mycobacterium tuberculosis H37Rv
uucggccagcgugu

SEQ ID NO: 3274474 - RNA, 17 nt, Mycobacterium tuberculosis H37Rv
uucggcccgaggugccg

SEQ ID NO: 3274475 - RNA, 22 nt, Mycobacterium tuberculosis H37Rv
uucggcccgaggugccggggcc

SEQ ID NO: 3274476 - RNA, 17 nt, Mycobacterium tuberculosis H37Rv
uucggccgaccgggcuc

SEQ ID NO: 3274477 - RNA, 17 nt, Mycobacterium tuberculosis H37Rv
uucggccgagugcacgc

SEQ ID NO: 3274478 - RNA, 13 nt, Mycobacterium tuberculosis H37Rv
uucggcgaccggc

SEQ ID NO: 3274479 - RNA, 23 nt, Mycobacterium tuberculosis H37Rv
uucggcgaggacggcggccagga

SEQ ID NO: 3274480 - RNA, 14 nt, Mycobacterium tuberculosis H37Rv
uucggcgaucgucu

SEQ ID NO: 3274481 - RNA, 17 nt, Mycobacterium tuberculosis H37Rv
uucggcgccggcgucgg

SEQ ID NO: 3274482 - RNA, 17 nt, Mycobacterium tuberculosis H37Rv
uucggcgccucguugcc

SEQ ID NO: 3274483 - RNA, 15 nt, Mycobacterium tuberculosis H37Rv
uucggcgcugaucgc

SEQ ID NO: 3274484 - RNA, 17 nt, Mycobacterium tuberculosis H37Rv
uucggcgcugaucgcgc

SEQ ID NO: 3274485 - RNA, 20 nt, Mycobacterium tuberculosis H37Rv
uugcacaccggcacugccca

SEQ ID NO: 3274486 - RNA, 13 nt, Mycobacterium tuberculosis H37Rv
uugcacagcggca

SEQ ID NO: 3274487 - RNA, 15 nt, Mycobacterium tuberculosis H37Rv
uugcacugcucguug

SEQ ID NO: 3274488 - RNA, 15 nt, Mycobacterium tuberculosis H37Rv
uugcacugcugguug

SEQ ID NO: 3274489 - RNA, 16 nt, Mycobacterium tuberculosis H37Rv
uugcacugcugguuga

SEQ ID NO: 3274490 - RNA, 19 nt, Mycobacterium tuberculosis H37Rv
uugcaggcccgaguuguug

SEQ ID NO: 3274491 - RNA, 21 nt, Mycobacterium tuberculosis H37Rv
uugcaucaaaaacgaacccag

SEQ ID NO: 3274492 - RNA, 13 nt, Mycobacterium tuberculosis H37Rv
uugccaaagccca

SEQ ID NO: 3274493 - RNA, 14 nt, Mycobacterium tuberculosis H37Rv
uugccaaagcccac

SEQ ID NO: 3274494 - RNA, 13 nt, Mycobacterium tuberculosis H37Rv
uugccaaagcccg

SEQ ID NO: 3274495 - RNA, 13 nt, Mycobacterium tuberculosis H37Rv
uugccaacgccca

SEQ ID NO: 3274496 - RNA, 15 nt, Mycobacterium tuberculosis H37Rv
uugccaccagaaaca

SEQ ID NO: 3274497 - RNA, 12 nt, Mycobacterium tuberculosis H37Rv
uugccaccgccg

SEQ ID NO: 3274498 - RNA, 23 nt, Mycobacterium tuberculosis H37Rv
uugccaccgcuguucuuggugac

SEQ ID NO: 3274499 - RNA, 17 nt, Mycobacterium tuberculosis H37Rv
uugccaccgguaccgcc

SEQ ID NO: 3274500 - RNA, 15 nt, Mycobacterium tuberculosis H37Rv
uugccacgccgccgg

SEQ ID NO: 3274501 - RNA, 19 nt, Mycobacterium tuberculosis H37Rv
uugccacuccaggagccga

SEQ ID NO: 3274502 - RNA, 14 nt, Mycobacterium tuberculosis H37Rv
uugccagaucagca

SEQ ID NO: 3274503 - RNA, 15 nt, Mycobacterium tuberculosis H37Rv
uugcccacaaagauc

SEQ ID NO: 3274504 - RNA, 17 nt, Mycobacterium tuberculosis H37Rv
uugcccacaaagauccg

SEQ ID NO: 3274505 - RNA, 13 nt, Mycobacterium tuberculosis H37Rv
uugcccccagggc

SEQ ID NO: 3274506 - RNA, 13 nt, Mycobacterium tuberculosis H37Rv
uugccgaagccgg

SEQ ID NO: 3274507 - RNA, 22 nt, Mycobacterium tuberculosis H37Rv
uugccgaaguuuuggaagcccg

SEQ ID NO: 3274508 - RNA, 17 nt, Mycobacterium tuberculosis H37Rv
uugccgaccgucacuga

SEQ ID NO: 3274509 - RNA, 18 nt, Mycobacterium tuberculosis H37Rv
uugccgaccgucacugau

SEQ ID NO: 3274510 - RNA, 13 nt, Mycobacterium tuberculosis H37Rv
uugccgaucaacc

SEQ ID NO: 3274511 - RNA, 15 nt, Mycobacterium tuberculosis H37Rv
uugccgauccccagg

SEQ ID NO: 3274512 - RNA, 10 nt, Mycobacterium tuberculosis H37Rv
uugccgccga

SEQ ID NO: 3274513 - RNA, 18 nt, Mycobacterium tuberculosis H37Rv
uugccgccgaacagcugg

SEQ ID NO: 3274514 - RNA, 20 nt, Mycobacterium tuberculosis H37Rv
uugccgccgaacgccucugc

SEQ ID NO: 3274515 - RNA, 22 nt, Mycobacterium tuberculosis H37Rv
uugccgccgaacgccucugcga

SEQ ID NO: 3274516 - RNA, 16 nt, Mycobacterium tuberculosis H37Rv
uugccgccgaagccga

SEQ ID NO: 3274517 - RNA, 13 nt, Mycobacterium tuberculosis H37Rv
uugccgccgacgc

SEQ ID NO: 3274518 - RNA, 10 nt, Mycobacterium tuberculosis H37Rv
uugccgccgc

SEQ ID NO: 3274519 - RNA, 19 nt, Mycobacterium tuberculosis H37Rv
uugccgccggugccgccga

SEQ ID NO: 3274520 - RNA, 10 nt, Mycobacterium tuberculosis H37Rv
uugccgccgu

SEQ ID NO: 3274521 - RNA, 13 nt, Mycobacterium tuberculosis H37Rv
uugccgccguccc

SEQ ID NO: 3274522 - RNA, 18 nt, Mycobacterium tuberculosis H37Rv
uugccgccguuaccgccg

SEQ ID NO: 3274523 - RNA, 23 nt, Mycobacterium tuberculosis H37Rv
uugccgccguuaccgccguugcc

SEQ ID NO: 3274524 - RNA, 14 nt, Mycobacterium tuberculosis H37Rv
uugccgccuuggcc

SEQ ID NO: 3274525 - RNA, 23 nt, Mycobacterium tuberculosis H37Rv
uugccggaguugucgacggccac

SEQ ID NO: 3274526 - RNA, 22 nt, Mycobacterium tuberculosis H37Rv
uugccggcgccuuggucgccgc

SEQ ID NO: 3274527 - RNA, 13 nt, Mycobacterium tuberculosis H37Rv
uugccggcguugc

SEQ ID NO: 3274528 - RNA, 19 nt, Mycobacterium tuberculosis H37Rv
uugccggcguugccgccgu

SEQ ID NO: 3274529 - RNA, 17 nt, Mycobacterium tuberculosis H37Rv
uugccggcuucggcgag

SEQ ID NO: 3274530 - RNA, 22 nt, Mycobacterium tuberculosis H37Rv
uugccggcuucggcgagcguac

SEQ ID NO: 3274531 - RNA, 15 nt, Mycobacterium tuberculosis H37Rv
uugccggcuuggccu

SEQ ID NO: 3274532 - RNA, 16 nt, Mycobacterium tuberculosis H37Rv
uugccucccuuuucca

SEQ ID NO: 3274533 - RNA, 21 nt, Mycobacterium tuberculosis H37Rv
uugccuucuuggcgggagccu

SEQ ID NO: 3274534 - RNA, 13 nt, Mycobacterium tuberculosis H37Rv
uugcgcagcagcg

SEQ ID NO: 3274535 - RNA, 14 nt, Mycobacterium tuberculosis H37Rv
uugcgcagccgcag

SEQ ID NO: 3274536 - RNA, 23 nt, Mycobacterium tuberculosis H37Rv
uugcgcccggcacgcucggugaa

SEQ ID NO: 3274537 - RNA, 12 nt, Mycobacterium tuberculosis H37Rv
uugcgccgccaa

SEQ ID NO: 3274538 - RNA, 19 nt, Mycobacterium tuberculosis H37Rv
uugcgccggaugacaccga

SEQ ID NO: 3274539 - RNA, 15 nt, Mycobacterium tuberculosis H37Rv
uugcgcgcugagcuc

SEQ ID NO: 3274540 - RNA, 15 nt, Mycobacterium tuberculosis H37Rv
uugcgcggucucgag

SEQ ID NO: 3274541 - RNA, 13 nt, Mycobacterium tuberculosis H37Rv
uugcgcucauccg

SEQ ID NO: 3274542 - RNA, 19 nt, Mycobacterium tuberculosis H37Rv
uugcgcucguugguucagc

SEQ ID NO: 3274543 - RNA, 12 nt, Mycobacterium tuberculosis H37Rv
uugcgcuuguug

SEQ ID NO: 3274544 - RNA, 21 nt, Mycobacterium tuberculosis H37Rv
uugcggcccgggaggcguugc

SEQ ID NO: 3274545 - RNA, 19 nt, Mycobacterium tuberculosis H37Rv
uugcgggacuagguccgau

SEQ ID NO: 3274546 - RNA, 13 nt, Mycobacterium tuberculosis H37Rv
uugcgggcgugga

SEQ ID NO: 3274547 - RNA, 23 nt, Mycobacterium tuberculosis H37Rv
uugcgggggaguaguggugggcg

SEQ ID NO: 3274548 - RNA, 18 nt, Mycobacterium tuberculosis H37Rv
uugcgguaagccggcgug

SEQ ID NO: 3274549 - RNA, 15 nt, Mycobacterium tuberculosis H37Rv
uugcguccauccgca

SEQ ID NO: 3274550 - RNA, 18 nt, Mycobacterium tuberculosis H37Rv
uugcgucgcgccugcccg

SEQ ID NO: 3274551 - RNA, 18 nt, Mycobacterium tuberculosis H37Rv
uugcgucugcucggcgua

SEQ ID NO: 3274552 - RNA, 13 nt, Mycobacterium tuberculosis H37Rv
uugcucaccagac

SEQ ID NO: 3274553 - RNA, 16 nt, Mycobacterium tuberculosis H37Rv
uugcucagccggcccu

SEQ ID NO: 3274554 - RNA, 15 nt, Mycobacterium tuberculosis H37Rv
uugcucggcgagccu

SEQ ID NO: 3274555 - RNA, 23 nt, Mycobacterium tuberculosis H37Rv
uugcucggugaugcccagcgccg

SEQ ID NO: 3274556 - RNA, 13 nt, Mycobacterium tuberculosis H37Rv
uugcucguucacc

SEQ ID NO: 3274557 - RNA, 22 nt, Mycobacterium tuberculosis H37Rv
uugcugaucagagcguucuuca

SEQ ID NO: 3274558 - RNA, 20 nt, Mycobacterium tuberculosis H37Rv
uugcugcggcuuucagcgcu

SEQ ID NO: 3274559 - RNA, 15 nt, Mycobacterium tuberculosis H37Rv
uugcuugcagggcca

SEQ ID NO: 3274560 - RNA, 23 nt, Mycobacterium tuberculosis H37Rv
uuggaacuuguugacgaacccac

SEQ ID NO: 3274561 - RNA, 18 nt, Mycobacterium tuberculosis H37Rv
uuggaccgagacuugcug

SEQ ID NO: 3274562 - RNA, 15 nt, Mycobacterium tuberculosis H37Rv
uuggacugacgucga

SEQ ID NO: 3274563 - RNA, 20 nt, Mycobacterium tuberculosis H37Rv
uuggagccgccaccgaggcc

SEQ ID NO: 3274564 - RNA, 15 nt, Mycobacterium tuberculosis H37Rv
uuggaucgccaccgg

SEQ ID NO: 3274565 - RNA, 23 nt, Mycobacterium tuberculosis H37Rv
uuggcaaagccgaaaucacugag

SEQ ID NO: 3274566 - RNA, 16 nt, Mycobacterium tuberculosis H37Rv
uuggcaacacagcuga

SEQ ID NO: 3274567 - RNA, 14 nt, Mycobacterium tuberculosis H37Rv
uuggcaagcacgcg

SEQ ID NO: 3274568 - RNA, 22 nt, Mycobacterium tuberculosis H37Rv
uuggcaaugaccccggcguugc

SEQ ID NO: 3274569 - RNA, 12 nt, Mycobacterium tuberculosis H37Rv
uuggcaccagcc

SEQ ID NO: 3274570 - RNA, 14 nt, Mycobacterium tuberculosis H37Rv
uuggcagagccgac

SEQ ID NO: 3274571 - RNA, 15 nt, Mycobacterium tuberculosis H37Rv
uuggcagagccgacu

SEQ ID NO: 3274572 - RNA, 15 nt, Mycobacterium tuberculosis H37Rv
uuggcagcccucugg

SEQ ID NO: 3274573 - RNA, 16 nt, Mycobacterium tuberculosis H37Rv
uuggcagggccagcgg

SEQ ID NO: 3274574 - RNA, 23 nt, Mycobacterium tuberculosis H37Rv
uuggccaaccccauggccagcgc

SEQ ID NO: 3274575 - RNA, 21 nt, Mycobacterium tuberculosis H37Rv
uuggccaauagaagcacgucg

SEQ ID NO: 3274576 - RNA, 17 nt, Mycobacterium tuberculosis H37Rv
uuggccaccaucgccgc

SEQ ID NO: 3274577 - RNA, 20 nt, Mycobacterium tuberculosis H37Rv
uuggccaccaucgccgccgu

SEQ ID NO: 3274578 - RNA, 13 nt, Mycobacterium tuberculosis H37Rv
uuggccaccgccc

SEQ ID NO: 3274579 - RNA, 18 nt, Mycobacterium tuberculosis H37Rv
uuggccacuugcucggcg

SEQ ID NO: 3274580 - RNA, 13 nt, Mycobacterium tuberculosis H37Rv
uuggccagcagcg

SEQ ID NO: 3274581 - RNA, 22 nt, Mycobacterium tuberculosis H37Rv
uuggccaggucggccaccgugg

SEQ ID NO: 3274582 - RNA, 19 nt, Mycobacterium tuberculosis H37Rv
ugccaccucgacgcaccua

SEQ ID NO: 3274583 - RNA, 23 nt, Mycobacterium tuberculosis H37Rv
ugccacgaacugauuuucgugua

SEQ ID NO: 3274584 - RNA, 23 nt, Mycobacterium tuberculosis H37Rv
ugccacgcguuccuccagcagcg

SEQ ID NO: 3274585 - RNA, 21 nt, Mycobacterium tuberculosis H37Rv
ugccacggucauuggguguca

SEQ ID NO: 3274586 - RNA, 22 nt, Mycobacterium tuberculosis H37Rv
ugccacguucgcgggcgucccg

SEQ ID NO: 3274587 - RNA, 17 nt, Mycobacterium tuberculosis H37Rv
ugccacucgaugcuuuc

SEQ ID NO: 3274588 - RNA, 15 nt, Mycobacterium tuberculosis H37Rv
ugccagaacccggac

SEQ ID NO: 3274589 - RNA, 21 nt, Mycobacterium tuberculosis H37Rv
ugccagaacccggacagggug

SEQ ID NO: 3274590 - RNA, 14 nt, Mycobacterium tuberculosis H37Rv
ugccagaccagggc

SEQ ID NO: 3274591 - RNA, 11 nt, Mycobacterium tuberculosis H37Rv
ugccagcacca

SEQ ID NO: 3274592 - RNA, 15 nt, Mycobacterium tuberculosis H37Rv
ugccagcaccacguc

SEQ ID NO: 3274593 - RNA, 16 nt, Mycobacterium tuberculosis H37Rv
ugccagcagcaaucag

SEQ ID NO: 3274594 - RNA, 14 nt, Mycobacterium tuberculosis H37Rv
ugccagcagcagcg

SEQ ID NO: 3274595 - RNA, 22 nt, Mycobacterium tuberculosis H37Rv
ugccagcagcagcgccgcgugg

SEQ ID NO: 3274596 - RNA, 12 nt, Mycobacterium tuberculosis H37Rv
ugccagccgguc

SEQ ID NO: 3274597 - RNA, 23 nt, Mycobacterium tuberculosis H37Rv
ugccagccuuggacgugcgcgcc

SEQ ID NO: 3274598 - RNA, 14 nt, Mycobacterium tuberculosis H37Rv
ugccagcgccgccg

SEQ ID NO: 3274599 - RNA, 11 nt, Mycobacterium tuberculosis H37Rv
ugccagcggca

SEQ ID NO: 3274600 - RNA, 23 nt, Mycobacterium tuberculosis H37Rv
ugccagcggcacacccaucaccg

SEQ ID NO: 3274601 - RNA, 23 nt, Mycobacterium tuberculosis H37Rv
ugccagcggccgggcggccaggc

SEQ ID NO: 3274602 - RNA, 16 nt, Mycobacterium tuberculosis H37Rv
ugccagcuguugcggg

SEQ ID NO: 3274603 - RNA, 16 nt, Mycobacterium tuberculosis H37Rv
ugccaggaccgcgccg

SEQ ID NO: 3274604 - RNA, 18 nt, Mycobacterium tuberculosis H37Rv
ugccaggagcacggguug

SEQ ID NO: 3274605 - RNA, 13 nt, Mycobacterium tuberculosis H37Rv
ugccagggcgggc

SEQ ID NO: 3274606 - RNA, 21 nt, Mycobacterium tuberculosis H37Rv
ugccagggucgaugucgucga

SEQ ID NO: 3274607 - RNA, 20 nt, Mycobacterium tuberculosis H37Rv
ugccagggugcgccgguccu

SEQ ID NO: 3274608 - RNA, 13 nt, Mycobacterium tuberculosis H37Rv
ugccaggucggcg

SEQ ID NO: 3274609 - RNA, 23 nt, Mycobacterium tuberculosis H37Rv
ugccaggucggcgggcgcgggug

SEQ ID NO: 3274610 - RNA, 15 nt, Mycobacterium tuberculosis H37Rv
ugccaggugggugaa

SEQ ID NO: 3274611 - RNA, 16 nt, Mycobacterium tuberculosis H37Rv
ugccaguacucggcca

SEQ ID NO: 3274612 - RNA, 19 nt, Mycobacterium tuberculosis H37Rv
ugccaguagucgccgggcg

SEQ ID NO: 3274613 - RNA, 14 nt, Mycobacterium tuberculosis H37Rv
ugccagucgaucgc

SEQ ID NO: 3274614 - RNA, 19 nt, Mycobacterium tuberculosis H37Rv
ugccagucgaucgcggccc

SEQ ID NO: 3274615 - RNA, 14 nt, Mycobacterium tuberculosis H37Rv
ugccagugauggcg

SEQ ID NO: 3274616 - RNA, 20 nt, Mycobacterium tuberculosis H37Rv
ugccagugauggcgcggucg

SEQ ID NO: 3274617 - RNA, 16 nt, Mycobacterium tuberculosis H37Rv
ugccagugccgcccac

SEQ ID NO: 3274618 - RNA, 23 nt, Mycobacterium tuberculosis H37Rv
ugccagugccgcccaccacacag

SEQ ID NO: 3274619 - RNA, 21 nt, Mycobacterium tuberculosis H37Rv
ugccauacagcaccccgccgg

SEQ ID NO: 3274620 - RNA, 16 nt, Mycobacterium tuberculosis H37Rv
ugccauaggacaggaa

SEQ ID NO: 3274621 - RNA, 22 nt, Mycobacterium tuberculosis H37Rv
ugccaucgcggcguugugaccg

SEQ ID NO: 3274622 - RNA, 14 nt, Mycobacterium tuberculosis H37Rv
ugccaucuccggug

SEQ ID NO: 3274623 - RNA, 24 nt, Mycobacterium tuberculosis H37Rv
ugccauuccagaucaacgcgucgc

SEQ ID NO: 3274624 - RNA, 19 nt, Mycobacterium tuberculosis H37Rv
ugcccaaaaggaagaccuc

SEQ ID NO: 3274625 - RNA, 15 nt, Mycobacterium tuberculosis H37Rv
ugcccaagcagucca

SEQ ID NO: 3274626 - RNA, 12 nt, Mycobacterium tuberculosis H37Rv
ugcccaagcccu

SEQ ID NO: 3274627 - RNA, 14 nt, Mycobacterium tuberculosis H37Rv
ugcccaagcgcguu

SEQ ID NO: 3274628 - RNA, 15 nt, Mycobacterium tuberculosis H37Rv
ugcccaaggccagga

SEQ ID NO: 3274629 - RNA, 21 nt, Mycobacterium tuberculosis H37Rv
ugcccacaaccgcaccaggug

SEQ ID NO: 3274630 - RNA, 14 nt, Mycobacterium tuberculosis H37Rv
ugcccacgaaccgu

SEQ ID NO: 3274631 - RNA, 21 nt, Mycobacterium tuberculosis H37Rv
ugcccacgcacagcaacgccc

SEQ ID NO: 3274632 - RNA, 23 nt, Mycobacterium tuberculosis H37Rv
ugcccacggcgaccacgccgccg

SEQ ID NO: 3274633 - RNA, 13 nt, Mycobacterium tuberculosis H37Rv
ugcccacgggccg

SEQ ID NO: 3274634 - RNA, 16 nt, Mycobacterium tuberculosis H37Rv
ugcccacgggccggcc

SEQ ID NO: 3274635 - RNA, 21 nt, Mycobacterium tuberculosis H37Rv
ugcccacgggccggccgagcg

SEQ ID NO: 3274636 - RNA, 13 nt, Mycobacterium tuberculosis H37Rv
ugcccagcaccac

SEQ ID NO: 3274637 - RNA, 20 nt, Mycobacterium tuberculosis H37Rv
ugcccagcaccaccgcggug

SEQ ID NO: 3274638 - RNA, 12 nt, Mycobacterium tuberculosis H37Rv
ugcccagcaccc

SEQ ID NO: 3274639 - RNA, 19 nt, Mycobacterium tuberculosis H37Rv
ugcccagcagaccaagucc

SEQ ID NO: 3274640 - RNA, 15 nt, Mycobacterium tuberculosis H37Rv
ugcccagcagcgcga

SEQ ID NO: 3274641 - RNA, 15 nt, Mycobacterium tuberculosis H37Rv
ugcccagcgccgaau

SEQ ID NO: 3274642 - RNA, 12 nt, Mycobacterium tuberculosis H37Rv
ugcccagcgugg

SEQ ID NO: 3274643 - RNA, 14 nt, Mycobacterium tuberculosis H37Rv
ugcccaggccaccg

SEQ ID NO: 3274644 - RNA, 18 nt, Mycobacterium tuberculosis H37Rv
ugcccaggccaccggcug

SEQ ID NO: 3274645 - RNA, 18 nt, Mycobacterium tuberculosis H37Rv
ugcccaggcucgcaccgu

SEQ ID NO: 3274646 - RNA, 18 nt, Mycobacterium tuberculosis H37Rv
ugcccaggugcguccagg

SEQ ID NO: 3274647 - RNA, 15 nt, Mycobacterium tuberculosis H37Rv
ugcccauagccaggu

SEQ ID NO: 3274648 - RNA, 13 nt, Mycobacterium tuberculosis H37Rv
ugcccaucggcau

SEQ ID NO: 3274649 - RNA, 16 nt, Mycobacterium tuberculosis H37Rv
ugcccaucggcaugau

SEQ ID NO: 3274650 - RNA, 14 nt, Mycobacterium tuberculosis H37Rv
ugcccaucuccaac

SEQ ID NO: 3274651 - RNA, 17 nt, Mycobacterium tuberculosis H37Rv
ugcccaugauggucacg

SEQ ID NO: 3274652 - RNA, 20 nt, Mycobacterium tuberculosis H37Rv
ugcccaugauggucacggcg

SEQ ID NO: 3274653 - RNA, 18 nt, Mycobacterium tuberculosis H37Rv
ugcccaugcggcaggugc

SEQ ID NO: 3274654 - RNA, 12 nt, Mycobacterium tuberculosis H37Rv
ugccccaagcca

SEQ ID NO: 3274655 - RNA, 17 nt, Mycobacterium tuberculosis H37Rv
ugccccagggcagugcg

SEQ ID NO: 3274656 - RNA, 14 nt, Mycobacterium tuberculosis H37Rv
ugccccaugcgcag

SEQ ID NO: 3274657 - RNA, 14 nt, Mycobacterium tuberculosis H37Rv
ugcccccgccggcc

SEQ ID NO: 3274658 - RNA, 15 nt, Mycobacterium tuberculosis H37Rv
ugcccccgccggccg

SEQ ID NO: 3274659 - RNA, 16 nt, Mycobacterium tuberculosis H37Rv
ugcccccggcgcggcg

SEQ ID NO: 3274660 - RNA, 14 nt, Mycobacterium tuberculosis H37Rv
ugcccccggugccg

SEQ ID NO: 3274661 - RNA, 19 nt, Mycobacterium tuberculosis H37Rv
ugcccccguucuggaaccc

SEQ ID NO: 3274662 - RNA, 21 nt, Mycobacterium tuberculosis H37Rv
ugcccccguugccgcccgucc

SEQ ID NO: 3274663 - RNA, 16 nt, Mycobacterium tuberculosis H37Rv
ugccccgaaccgcgcu

SEQ ID NO: 3274664 - RNA, 20 nt, Mycobacterium tuberculosis H37Rv
ugccccgaccgccguggccg

SEQ ID NO: 3274665 - RNA, 16 nt, Mycobacterium tuberculosis H37Rv
ugccccgagcugccgu

SEQ ID NO: 3274666 - RNA, 16 nt, Mycobacterium tuberculosis H37Rv
ugccccgcagcacucg

SEQ ID NO: 3274667 - RNA, 12 nt, Mycobacterium tuberculosis H37Rv
ugccccgcaucg

SEQ ID NO: 3274668 - RNA, 14 nt, Mycobacterium tuberculosis H37Rv
ugccccgcaucgcc

SEQ ID NO: 3274669 - RNA, 13 nt, Mycobacterium tuberculosis H37Rv
ugccccgccgcca

SEQ ID NO: 3274670 - RNA, 16 nt, Mycobacterium tuberculosis H37Rv
ugccccgccuuggcca

SEQ ID NO: 3274671 - RNA, 21 nt, Mycobacterium tuberculosis H37Rv
ugccccgccuuggccaccauc

SEQ ID NO: 3274672 - RNA, 20 nt, Mycobacterium tuberculosis H37Rv
ugccccgguugaucuugucc

SEQ ID NO: 3274673 - RNA, 21 nt, Mycobacterium tuberculosis H37Rv
ugccccgucguucuccauccg

SEQ ID NO: 3274674 - RNA, 14 nt, Mycobacterium tuberculosis H37Rv
ugccccuccgggcg

SEQ ID NO: 3274675 - RNA, 17 nt, Mycobacterium tuberculosis H37Rv
ugcccgaaccaccaccg

SEQ ID NO: 3274676 - RNA, 21 nt, Mycobacterium tuberculosis H37Rv
ugcccgaaccaccaccggcaa

SEQ ID NO: 3274677 - RNA, 21 nt, Mycobacterium tuberculosis H37Rv
ugcccgaagagcacgucaaca

SEQ ID NO: 3274678 - RNA, 20 nt, Mycobacterium tuberculosis H37Rv
ugcccgacccgccgacgccg

SEQ ID NO: 3274679 - RNA, 16 nt, Mycobacterium tuberculosis H37Rv
ugccgauacagcacau

SEQ ID NO: 3274680 - RNA, 22 nt, Mycobacterium tuberculosis H37Rv
ugccgaucaaccccccgggccc

SEQ ID NO: 3274681 - RNA, 14 nt, Mycobacterium tuberculosis H37Rv
ugccgaucagcagu

SEQ ID NO: 3274682 - RNA, 16 nt, Mycobacterium tuberculosis H37Rv
ugccgaucagcagugg

SEQ ID NO: 3274683 - RNA, 19 nt, Mycobacterium tuberculosis H37Rv
ugccgaucaguccggcguu

SEQ ID NO: 3274684 - RNA, 13 nt, Mycobacterium tuberculosis H37Rv
ugccgauccccag

SEQ ID NO: 3274685 - RNA, 16 nt, Mycobacterium tuberculosis H37Rv
ugccgauccccaggcc

SEQ ID NO: 3274686 - RNA, 13 nt, Mycobacterium tuberculosis H37Rv
ugccgaucccggc

SEQ ID NO: 3274687 - RNA, 23 nt, Mycobacterium tuberculosis H37Rv
ugccgaucccgugguggcgccau

SEQ ID NO: 3274688 - RNA, 14 nt, Mycobacterium tuberculosis H37Rv
ugccgaucgaugcc

SEQ ID NO: 3274689 - RNA, 15 nt, Mycobacterium tuberculosis H37Rv
ugccgaucgaugcca

SEQ ID NO: 3274690 - RNA, 12 nt, Mycobacterium tuberculosis H37Rv
ugccgaucggcc

SEQ ID NO: 3274691 - RNA, 19 nt, Mycobacterium tuberculosis H37Rv
ugccgaucggccaacaggu

SEQ ID NO: 3274692 - RNA, 20 nt, Mycobacterium tuberculosis H37Rv
ugccgaucggccaacagguc

SEQ ID NO: 3274693 - RNA, 23 nt, Mycobacterium tuberculosis H37Rv
ugccgaucugcucgccgagcucg

SEQ ID NO: 3274694 - RNA, 12 nt, Mycobacterium tuberculosis H37Rv
ugccgaugccgg

SEQ ID NO: 3274695 - RNA, 20 nt, Mycobacterium tuberculosis H37Rv
ugccgaugcgacgcagaccg

SEQ ID NO: 3274696 - RNA, 19 nt, Mycobacterium tuberculosis H37Rv
ugccgauggaugggcugcg

SEQ ID NO: 3274697 - RNA, 14 nt, Mycobacterium tuberculosis H37Rv
ugccgcaagccucg

SEQ ID NO: 3274698 - RNA, 18 nt, Mycobacterium tuberculosis H37Rv
ugccgcaccaaggccgcc

SEQ ID NO: 3274699 - RNA, 15 nt, Mycobacterium tuberculosis H37Rv
ugccgcacccagacc

SEQ ID NO: 3274700 - RNA, 14 nt, Mycobacterium tuberculosis H37Rv
ugccgcacccccuc

SEQ ID NO: 3274701 - RNA, 14 nt, Mycobacterium tuberculosis H37Rv
ugccgcacccgguc

SEQ ID NO: 3274702 - RNA, 20 nt, Mycobacterium tuberculosis H37Rv
ugccgcacgauggccgucga

SEQ ID NO: 3274703 - RNA, 13 nt, Mycobacterium tuberculosis H37Rv
ugccgcagcggcg

SEQ ID NO: 3274704 - RNA, 12 nt, Mycobacterium tuberculosis H37Rv
ugccgcagugac

SEQ ID NO: 3274705 - RNA, 13 nt, Mycobacterium tuberculosis H37Rv
ugccgccaaccgc

SEQ ID NO: 3274706 - RNA, 14 nt, Mycobacterium tuberculosis H37Rv
ugccgccaccaccg

SEQ ID NO: 3274707 - RNA, 16 nt, Mycobacterium tuberculosis H37Rv
ugccgccaccaccggc

SEQ ID NO: 3274708 - RNA, 16 nt, Mycobacterium tuberculosis H37Rv
ugccgccaccgccacc

SEQ ID NO: 3274709 - RNA, 13 nt, Mycobacterium tuberculosis H37Rv
ugccgccaccggc

SEQ ID NO: 3274710 - RNA, 16 nt, Mycobacterium tuberculosis H37Rv
ugccgccaccggcguc

SEQ ID NO: 3274711 - RNA, 22 nt, Mycobacterium tuberculosis H37Rv
ugccgccaccggcguccagucc

SEQ ID NO: 3274712 - RNA, 20 nt, Mycobacterium tuberculosis H37Rv
ugccgccaccuuggcugggc

SEQ ID NO: 3274713 - RNA, 17 nt, Mycobacterium tuberculosis H37Rv
ugccgccacgggcggcc

SEQ ID NO: 3274714 - RNA, 20 nt, Mycobacterium tuberculosis H37Rv
ugccgccacgggcggccacc

SEQ ID NO: 3274715 - RNA, 21 nt, Mycobacterium tuberculosis H37Rv
ugccgccagcaacccugcggu

SEQ ID NO: 3274716 - RNA, 19 nt, Mycobacterium tuberculosis H37Rv
ugccgccagccccagcguu

SEQ ID NO: 3274717 - RNA, 14 nt, Mycobacterium tuberculosis H37Rv
ugccgccagcgcca

SEQ ID NO: 3274718 - RNA, 14 nt, Mycobacterium tuberculosis H37Rv
ugccgccaucaccg

SEQ ID NO: 3274719 - RNA, 14 nt, Mycobacterium tuberculosis H37Rv
ugccgccaucgccg

SEQ ID NO: 3274720 - RNA, 20 nt, Mycobacterium tuberculosis H37Rv
ugccgccauggccgccguug

SEQ ID NO: 3274721 - RNA, 19 nt, Mycobacterium tuberculosis H37Rv
ugccgccauuccagccggu

SEQ ID NO: 3274722 - RNA, 20 nt, Mycobacterium tuberculosis H37Rv
ugccgccauugacgccguug

SEQ ID NO: 3274723 - RNA, 17 nt, Mycobacterium tuberculosis H37Rv
ugccgcccacgcugccc

SEQ ID NO: 3274724 - RNA, 18 nt, Mycobacterium tuberculosis H37Rv
ugccgcccacgcugccca

SEQ ID NO: 3274725 - RNA, 19 nt, Mycobacterium tuberculosis H37Rv
ugccgcccacgcugcccac

SEQ ID NO: 3274726 - RNA, 21 nt, Mycobacterium tuberculosis H37Rv
ugccgcccaggagcaccucga

SEQ ID NO: 3274727 - RNA, 14 nt, Mycobacterium tuberculosis H37Rv
ugccgcccaugccg

SEQ ID NO: 3274728 - RNA, 16 nt, Mycobacterium tuberculosis H37Rv
ugccgcccaugccggg

SEQ ID NO: 3274729 - RNA, 20 nt, Mycobacterium tuberculosis H37Rv
ugccgcccccauaacugcgg

SEQ ID NO: 3274730 - RNA, 17 nt, Mycobacterium tuberculosis H37Rv
ugccgccccgcagcugc

SEQ ID NO: 3274731 - RNA, 19 nt, Mycobacterium tuberculosis H37Rv
ugccgccccgcagcugcgu

SEQ ID NO: 3274732 - RNA, 16 nt, Mycobacterium tuberculosis H37Rv
ugccgcccgagccggu

SEQ ID NO: 3274733 - RNA, 17 nt, Mycobacterium tuberculosis H37Rv
ugccgcccgcgccgccg

SEQ ID NO: 3274734 - RNA, 22 nt, Mycobacterium tuberculosis H37Rv
ugccgcccgcgccgccggaccc

SEQ ID NO: 3274735 - RNA, 15 nt, Mycobacterium tuberculosis H37Rv
ugccgcccucaccgc

SEQ ID NO: 3274736 - RNA, 21 nt, Mycobacterium tuberculosis H37Rv
ugccgcccuugauguccgcga

SEQ ID NO: 3274737 - RNA, 15 nt, Mycobacterium tuberculosis H37Rv
ugccgccgaacagcu

SEQ ID NO: 3274738 - RNA, 11 nt, Mycobacterium tuberculosis H37Rv
ugccgccgaag

SEQ ID NO: 3274739 - RNA, 15 nt, Mycobacterium tuberculosis H37Rv
ugccgccgaagccga

SEQ ID NO: 3274740 - RNA, 16 nt, Mycobacterium tuberculosis H37Rv
ugccgccgaagccgac

SEQ ID NO: 3274741 - RNA, 21 nt, Mycobacterium tuberculosis H37Rv
ugccgccgaagccgcgcaucu

SEQ ID NO: 3274742 - RNA, 23 nt, Mycobacterium tuberculosis H37Rv
ugccgccgacaccaccggcgccg

SEQ ID NO: 3274743 - RNA, 17 nt, Mycobacterium tuberculosis H37Rv
ugccgccgacgccgccg

SEQ ID NO: 3274744 - RNA, 12 nt, Mycobacterium tuberculosis H37Rv
ugccgccgacgg

SEQ ID NO: 3274745 - RNA, 16 nt, Mycobacterium tuberculosis H37Rv
ugccgccgagcuggcg

SEQ ID NO: 3274746 - RNA, 17 nt, Mycobacterium tuberculosis H37Rv
ugccgccgagcuggcgc

SEQ ID NO: 3274747 - RNA, 17 nt, Mycobacterium tuberculosis H37Rv
ugccgccgaugucgacg

SEQ ID NO: 3274748 - RNA, 15 nt, Mycobacterium tuberculosis H37Rv
ugccgccgcacaucu

SEQ ID NO: 3274749 - RNA, 17 nt, Mycobacterium tuberculosis H37Rv
ugccgccgcagaugggc

SEQ ID NO: 3274750 - RNA, 19 nt, Mycobacterium tuberculosis H37Rv
ugccgccgccggcggucgc

SEQ ID NO: 3274751 - RNA, 20 nt, Mycobacterium tuberculosis H37Rv
ugccgccgccggcggucgcg

SEQ ID NO: 3274752 - RNA, 14 nt, Mycobacterium tuberculosis H37Rv
ugccgccgccuccg

SEQ ID NO: 3274753 - RNA, 22 nt, Mycobacterium tuberculosis H37Rv
ugccgccgccuccgccgaggcc

SEQ ID NO: 3274754 - RNA, 13 nt, Mycobacterium tuberculosis H37Rv
ugccgccgccugc

SEQ ID NO: 3274755 - RNA, 14 nt, Mycobacterium tuberculosis H37Rv
ugccgccgcggcag

SEQ ID NO: 3274756 - RNA, 14 nt, Mycobacterium tuberculosis H37Rv
ugccgccgcggcca

SEQ ID NO: 3274757 - RNA, 16 nt, Mycobacterium tuberculosis H37Rv
ugccgccgcggccaca

SEQ ID NO: 3274758 - RNA, 19 nt, Mycobacterium tuberculosis H37Rv
ugccgccgcggccacaacc

SEQ ID NO: 3274759 - RNA, 16 nt, Mycobacterium tuberculosis H37Rv
ugccgccgcggccacc

SEQ ID NO: 3274760 - RNA, 11 nt, Mycobacterium tuberculosis H37Rv
ugccgccggag

SEQ ID NO: 3274761 - RNA, 16 nt, Mycobacterium tuberculosis H37Rv
ugccgccggcaccgcc

SEQ ID NO: 3274762 - RNA, 20 nt, Mycobacterium tuberculosis H37Rv
ugccgccggccccgccgcua

SEQ ID NO: 3274763 - RNA, 14 nt, Mycobacterium tuberculosis H37Rv
ugccgccggcgcca

SEQ ID NO: 3274764 - RNA, 16 nt, Mycobacterium tuberculosis H37Rv
ugccgccggcgccacc

SEQ ID NO: 3274765 - RNA, 23 nt, Mycobacterium tuberculosis H37Rv
ugccgccggcgccacccgcgccg

SEQ ID NO: 3274766 - RNA, 14 nt, Mycobacterium tuberculosis H37Rv
ugccgccggcgccg

SEQ ID NO: 3274767 - RNA, 17 nt, Mycobacterium tuberculosis H37Rv
ugccgccggcgccgccg

SEQ ID NO: 3274768 - RNA, 22 nt, Mycobacterium tuberculosis H37Rv
ugccgccgggugcaacggcguu

SEQ ID NO: 3274769 - RNA, 16 nt, Mycobacterium tuberculosis H37Rv
ugccgccggugccacc

SEQ ID NO: 3274770 - RNA, 17 nt, Mycobacterium tuberculosis H37Rv
ugccgccggugccaccc

SEQ ID NO: 3274771 - RNA, 22 nt, Mycobacterium tuberculosis H37Rv
ugccgccggugccgaucagcag

SEQ ID NO: 3274772 - RNA, 17 nt, Mycobacterium tuberculosis H37Rv
ugccgccggugccgcca

SEQ ID NO: 3274773 - RNA, 17 nt, Mycobacterium tuberculosis H37Rv
ugccgccgguggugccg

SEQ ID NO: 3274774 - RNA, 18 nt, Mycobacterium tuberculosis H37Rv
ugccgccgguguugccgu

SEQ ID NO: 3274775 - RNA, 20 nt, Mycobacterium tuberculosis H37Rv
ugccgccgguuccgccggcc

SEQ ID NO: 3274776 - RNA, 18 nt, Mycobacterium tuberculosis H37Rv
ugccgggggcccgaccug

SEQ ID NO: 3274777 - RNA, 20 nt, Mycobacterium tuberculosis H37Rv
ugccgguagcacagcagcaa

SEQ ID NO: 3274778 - RNA, 20 nt, Mycobacterium tuberculosis H37Rv
ugccggucacgucgaucucc

SEQ ID NO: 3274779 - RNA, 18 nt, Mycobacterium tuberculosis H37Rv
ugccggugcaggucgucc

SEQ ID NO: 3274780 - RNA, 13 nt, Mycobacterium tuberculosis H37Rv
ugccggugcgcua

SEQ ID NO: 3274781 - RNA, 12 nt, Mycobacterium tuberculosis H37Rv
ugccggugcuga

SEQ ID NO: 3274782 - RNA, 17 nt, Mycobacterium tuberculosis H37Rv
ugccgguggcgccgccg

SEQ ID NO: 3274783 - RNA, 18 nt, Mycobacterium tuberculosis H37Rv
ugccgguguugccgaagc

SEQ ID NO: 3274784 - RNA, 21 nt, Mycobacterium tuberculosis H37Rv
ugccgguuugggcgcgugccg

SEQ ID NO: 3274785 - RNA, 17 nt, Mycobacterium tuberculosis H37Rv
ugccguaguaaggagcc

SEQ ID NO: 3274786 - RNA, 16 nt, Mycobacterium tuberculosis H37Rv
ugccgucagcugaccg

SEQ ID NO: 3274787 - RNA, 17 nt, Mycobacterium tuberculosis H37Rv
ugccgucagggucagcu

SEQ ID NO: 3274788 - RNA, 15 nt, Mycobacterium tuberculosis H37Rv
ugccguccccggccg

SEQ ID NO: 3274789 - RNA, 16 nt, Mycobacterium tuberculosis H37Rv
ugccguccggcgcugg

SEQ ID NO: 3274790 - RNA, 18 nt, Mycobacterium tuberculosis H37Rv
ugccgucgaguccaggcc

SEQ ID NO: 3274791 - RNA, 23 nt, Mycobacterium tuberculosis H37Rv
ugccgucgcccuuagggucgccg

SEQ ID NO: 3274792 - RNA, 13 nt, Mycobacterium tuberculosis H37Rv
ugccgucgcugac

SEQ ID NO: 3274793 - RNA, 15 nt, Mycobacterium tuberculosis H37Rv
ugccgucgcugcccc

SEQ ID NO: 3274794 - RNA, 22 nt, Mycobacterium tuberculosis H37Rv
ugccgucuuugucacgcaccgc

SEQ ID NO: 3274795 - RNA, 15 nt, Mycobacterium tuberculosis H37Rv
ugccgugccgggcca

SEQ ID NO: 3274796 - RNA, 19 nt, Mycobacterium tuberculosis H37Rv
ugccgugccggugugucca

SEQ ID NO: 3274797 - RNA, 22 nt, Mycobacterium tuberculosis H37Rv
ugccgugccgguguguccagcg

SEQ ID NO: 3274798 - RNA, 15 nt, Mycobacterium tuberculosis H37Rv
ugccgugcggaucac

SEQ ID NO: 3274799 - RNA, 18 nt, Mycobacterium tuberculosis H37Rv
ugccgugcggaucacucc

SEQ ID NO: 3274800 - RNA, 23 nt, Mycobacterium tuberculosis H37Rv
ugccgugcugaacuccgccgcga

SEQ ID NO: 3274801 - RNA, 19 nt, Mycobacterium tuberculosis H37Rv
ugccgugcugggccgacgg

SEQ ID NO: 3274802 - RNA, 16 nt, Mycobacterium tuberculosis H37Rv
ugccguggaagacguc

SEQ ID NO: 3274803 - RNA, 18 nt, Mycobacterium tuberculosis H37Rv
ugccgugguggacgaugc

SEQ ID NO: 3274804 - RNA, 17 nt, Mycobacterium tuberculosis H37Rv
ugccguguucagcaccc

SEQ ID NO: 3274805 - RNA, 13 nt, Mycobacterium tuberculosis H37Rv
ugccguuccggcu

SEQ ID NO: 3274806 - RNA, 16 nt, Mycobacterium tuberculosis H37Rv
ugccguugcccucggc

SEQ ID NO: 3274807 - RNA, 13 nt, Mycobacterium tuberculosis H37Rv
ugccguugcgauc

SEQ ID NO: 3274808 - RNA, 14 nt, Mycobacterium tuberculosis H37Rv
ugccguugcgaucg

SEQ ID NO: 3274809 - RNA, 15 nt, Mycobacterium tuberculosis H37Rv
ugccguugcgaucgc

SEQ ID NO: 3274810 - RNA, 22 nt, Mycobacterium tuberculosis H37Rv
ugccguugcgaucgcgugcggu

SEQ ID NO: 3274811 - RNA, 19 nt, Mycobacterium tuberculosis H37Rv
ugccguuggagccgccacc

SEQ ID NO: 3274812 - RNA, 14 nt, Mycobacterium tuberculosis H37Rv
ugccuaccgggccc

SEQ ID NO: 3274813 - RNA, 17 nt, Mycobacterium tuberculosis H37Rv
ugccuacuugcucgacg

SEQ ID NO: 3274814 - RNA, 18 nt, Mycobacterium tuberculosis H37Rv
ugccuagccgcagccccg

SEQ ID NO: 3274815 - RNA, 14 nt, Mycobacterium tuberculosis H37Rv
ugccucaccgccgc

SEQ ID NO: 3274816 - RNA, 12 nt, Mycobacterium tuberculosis H37Rv
ugccuccaucaa

SEQ ID NO: 3274817 - RNA, 14 nt, Mycobacterium tuberculosis H37Rv
ugccuccgacacca

SEQ ID NO: 3274818 - RNA, 13 nt, Mycobacterium tuberculosis H37Rv
ugccucgaccugg

SEQ ID NO: 3274819 - RNA, 16 nt, Mycobacterium tuberculosis H37Rv
ugccucgauggucucc

SEQ ID NO: 3274820 - RNA, 14 nt, Mycobacterium tuberculosis H37Rv
ugccucggcggccu

SEQ ID NO: 3274821 - RNA, 15 nt, Mycobacterium tuberculosis H37Rv
ugccucucagcacgg

SEQ ID NO: 3274822 - RNA, 18 nt, Mycobacterium tuberculosis H37Rv
ugccucucuccgcgcucg

SEQ ID NO: 3274823 - RNA, 16 nt, Mycobacterium tuberculosis H37Rv
ugccugcuagcagcag

SEQ ID NO: 3274824 - RNA, 14 nt, Mycobacterium tuberculosis H37Rv
ugccugggcggccg

SEQ ID NO: 3274825 - RNA, 18 nt, Mycobacterium tuberculosis H37Rv
ugccuuacacgccuggcu

SEQ ID NO: 3274826 - RNA, 21 nt, Mycobacterium tuberculosis H37Rv
ugccuuacacgccuggcuacg

SEQ ID NO: 3274827 - RNA, 13 nt, Mycobacterium tuberculosis H37Rv
ugccuuagcccgg

SEQ ID NO: 3274828 - RNA, 14 nt, Mycobacterium tuberculosis H37Rv
ugccuuagcccggc

SEQ ID NO: 3274829 - RNA, 21 nt, Mycobacterium tuberculosis H37Rv
ugccuucuuugccggcgccuu

SEQ ID NO: 3274830 - RNA, 23 nt, Mycobacterium tuberculosis H37Rv
ugccuuggccggcuugucgacca

SEQ ID NO: 3274831 - RNA, 16 nt, Mycobacterium tuberculosis H37Rv
ugccuugggaccgcgc

SEQ ID NO: 3274832 - RNA, 16 nt, Mycobacterium tuberculosis H37Rv
ugcgaaaauccgugcc

SEQ ID NO: 3274833 - RNA, 15 nt, Mycobacterium tuberculosis H37Rv
ugcgaaacaucucgg

SEQ ID NO: 3274834 - RNA, 18 nt, Mycobacterium tuberculosis H37Rv
ugcgaaacgaauccgcca

SEQ ID NO: 3274835 - RNA, 19 nt, Mycobacterium tuberculosis H37Rv
ugcgaaacgcuggccacuc

SEQ ID NO: 3274836 - RNA, 14 nt, Mycobacterium tuberculosis H37Rv
ugcgaaaguggugg

SEQ ID NO: 3274837 - RNA, 19 nt, Mycobacterium tuberculosis H37Rv
ugcgaacaaguggccagcg

SEQ ID NO: 3274838 - RNA, 19 nt, Mycobacterium tuberculosis H37Rv
ugcgaacgaauccgcucga

SEQ ID NO: 3274839 - RNA, 20 nt, Mycobacterium tuberculosis H37Rv
ugcgaacucaucgugguaac

SEQ ID NO: 3274840 - RNA, 13 nt, Mycobacterium tuberculosis H37Rv
ugcgaacucggcc

SEQ ID NO: 3274841 - RNA, 18 nt, Mycobacterium tuberculosis H37Rv
ugcgaagaguccuuaaac

SEQ ID NO: 3274842 - RNA, 14 nt, Mycobacterium tuberculosis H37Rv
ugcgaagggcaccg

SEQ ID NO: 3274843 - RNA, 17 nt, Mycobacterium tuberculosis H37Rv
ugcgaaucaucuuggug

SEQ ID NO: 3274844 - RNA, 22 nt, Mycobacterium tuberculosis H37Rv
ugcgacacauagugcggcaccg

SEQ ID NO: 3274845 - RNA, 16 nt, Mycobacterium tuberculosis H37Rv
ugcgacagcacgugcc

SEQ ID NO: 3274846 - RNA, 23 nt, Mycobacterium tuberculosis H37Rv
ugcgacauuggucaccugcugca

SEQ ID NO: 3274847 - RNA, 18 nt, Mycobacterium tuberculosis H37Rv
ugcgaccaagucaugccc

SEQ ID NO: 3274848 - RNA, 20 nt, Mycobacterium tuberculosis H37Rv
ugcgacccgcagaccgccac

SEQ ID NO: 3274849 - RNA, 19 nt, Mycobacterium tuberculosis H37Rv
ugcgacccgucgaacgcgc

SEQ ID NO: 3274850 - RNA, 21 nt, Mycobacterium tuberculosis H37Rv
ugcgaccggcuccggacaccc

SEQ ID NO: 3274851 - RNA, 17 nt, Mycobacterium tuberculosis H37Rv
ugcgacgaaccggauca

SEQ ID NO: 3274852 - RNA, 22 nt, Mycobacterium tuberculosis H37Rv
ugcgacgaaguucucuagcucg

SEQ ID NO: 3274853 - RNA, 14 nt, Mycobacterium tuberculosis H37Rv
ugcgacgauaucgg

SEQ ID NO: 3274854 - RNA, 19 nt, Mycobacterium tuberculosis H37Rv
ugcgacguucuugggaccg

SEQ ID NO: 3274855 - RNA, 16 nt, Mycobacterium tuberculosis H37Rv
ugcgacucugcgucug

SEQ ID NO: 3274856 - RNA, 17 nt, Mycobacterium tuberculosis H37Rv
ugcgacucugcgucugc

SEQ ID NO: 3274857 - RNA, 18 nt, Mycobacterium tuberculosis H37Rv
ugcgacucugcgucugcu

SEQ ID NO: 3274858 - RNA, 15 nt, Mycobacterium tuberculosis H37Rv
ugcgacugugaaucu

SEQ ID NO: 3274859 - RNA, 14 nt, Mycobacterium tuberculosis H37Rv
ugcgagcgacaccg

SEQ ID NO: 3274860 - RNA, 16 nt, Mycobacterium tuberculosis H37Rv
ugcgagcgcagcgcau

SEQ ID NO: 3274861 - RNA, 13 nt, Mycobacterium tuberculosis H37Rv
ugcgagcugcggg

SEQ ID NO: 3274862 - RNA, 19 nt, Mycobacterium tuberculosis H37Rv
ugcgaggcguaaucaagca

SEQ ID NO: 3274863 - RNA, 23 nt, Mycobacterium tuberculosis H37Rv
ugcgaggcguaaucaagcagcgu

SEQ ID NO: 3274864 - RNA, 16 nt, Mycobacterium tuberculosis H37Rv
ugcgagucgucgccaa

SEQ ID NO: 3274865 - RNA, 19 nt, Mycobacterium tuberculosis H37Rv
ugcgagugagcucagcaag

SEQ ID NO: 3274866 - RNA, 13 nt, Mycobacterium tuberculosis H37Rv
ugcgaucaguucg

SEQ ID NO: 3274867 - RNA, 12 nt, Mycobacterium tuberculosis H37Rv
ugcgaucgccgc

SEQ ID NO: 3274868 - RNA, 22 nt, Mycobacterium tuberculosis H37Rv
ugcgaucgccgcgcuggucgga

SEQ ID NO: 3274869 - RNA, 15 nt, Mycobacterium tuberculosis H37Rv
ugcgaucgccgcuaa

SEQ ID NO: 3274870 - RNA, 19 nt, Mycobacterium tuberculosis H37Rv
ugcgaucggcacuuagccc

SEQ ID NO: 3274871 - RNA, 21 nt, Mycobacterium tuberculosis H37Rv
ugcgaucgucaacgacgacga

SEQ ID NO: 3274872 - RNA, 18 nt, Mycobacterium tuberculosis H37Rv
ugcgccgccggcggcggu

SEQ ID NO: 3274873 - RNA, 14 nt, Mycobacterium tuberculosis H37Rv
ugcgccgcgcagcg

SEQ ID NO: 3274874 - RNA, 16 nt, Mycobacterium tuberculosis H37Rv
ugcgccgcgcgcggcg

SEQ ID NO: 3274875 - RNA, 14 nt, Mycobacterium tuberculosis H37Rv
ugcgccggaccagc

SEQ ID NO: 3274876 - RNA, 18 nt, Mycobacterium tuberculosis H37Rv
ugcgccggaccagcuccu

SEQ ID NO: 3274877 - RNA, 18 nt, Mycobacterium tuberculosis H37Rv
ugcgccggaugacaccga

SEQ ID NO: 3274878 - RNA, 14 nt, Mycobacterium tuberculosis H37Rv
ugcgccggcgcugc

SEQ ID NO: 3274879 - RNA, 22 nt, Mycobacterium tuberculosis H37Rv
ugcgccggcguuugggcaucau

SEQ ID NO: 3274880 - RNA, 15 nt, Mycobacterium tuberculosis H37Rv
ugcgccgggcucgcg

SEQ ID NO: 3274881 - RNA, 22 nt, Mycobacterium tuberculosis H37Rv
ugcgccgggcucgcgaucguca

SEQ ID NO: 3274882 - RNA, 18 nt, Mycobacterium tuberculosis H37Rv
ugcgccggggacacagcg

SEQ ID NO: 3274883 - RNA, 21 nt, Mycobacterium tuberculosis H37Rv
ugcgccgggugaggcggugac

SEQ ID NO: 3274884 - RNA, 15 nt, Mycobacterium tuberculosis H37Rv
ugcgccgguccucgu

SEQ ID NO: 3274885 - RNA, 11 nt, Mycobacterium tuberculosis H37Rv
ugcgccgucag

SEQ ID NO: 3274886 - RNA, 16 nt, Mycobacterium tuberculosis H37Rv
ugcgccgucagcccag

SEQ ID NO: 3274887 - RNA, 14 nt, Mycobacterium tuberculosis H37Rv
ugcgccgucgcagc

SEQ ID NO: 3274888 - RNA, 18 nt, Mycobacterium tuberculosis H37Rv
ugcgccgucgcagccagc

SEQ ID NO: 3274889 - RNA, 22 nt, Mycobacterium tuberculosis H37Rv
ugcgccgucggugggugccagc

SEQ ID NO: 3274890 - RNA, 15 nt, Mycobacterium tuberculosis H37Rv
ugcgccuccgggacg

SEQ ID NO: 3274891 - RNA, 13 nt, Mycobacterium tuberculosis H37Rv
ugcgccucggcgg

SEQ ID NO: 3274892 - RNA, 21 nt, Mycobacterium tuberculosis H37Rv
ugcgccuugaagcgguggacg

SEQ ID NO: 3274893 - RNA, 15 nt, Mycobacterium tuberculosis H37Rv
ugcgccuugaccaca

SEQ ID NO: 3274894 - RNA, 13 nt, Mycobacterium tuberculosis H37Rv
ugcgccuuggucg

SEQ ID NO: 3274895 - RNA, 16 nt, Mycobacterium tuberculosis H37Rv
ugcgccuuggucgccg

SEQ ID NO: 3274896 - RNA, 15 nt, Mycobacterium tuberculosis H37Rv
ugcgcgaccacccgc

SEQ ID NO: 3274897 - RNA, 19 nt, Mycobacterium tuberculosis H37Rv
ugcgcgaccacccgccgca

SEQ ID NO: 3274898 - RNA, 16 nt, Mycobacterium tuberculosis H37Rv
ugcgcgaccgaccagc

SEQ ID NO: 3274899 - RNA, 17 nt, Mycobacterium tuberculosis H37Rv
ugcgcgaccgaccagcc

SEQ ID NO: 3274900 - RNA, 18 nt, Mycobacterium tuberculosis H37Rv
ugcgcgacugauccucga

SEQ ID NO: 3274901 - RNA, 15 nt, Mycobacterium tuberculosis H37Rv
ugcgcgaggggccgg

SEQ ID NO: 3274902 - RNA, 22 nt, Mycobacterium tuberculosis H37Rv
ugcgcgaugcccacgcacagca

SEQ ID NO: 3274903 - RNA, 22 nt, Mycobacterium tuberculosis H37Rv
ugcgcgaugcgauucugcgucu

SEQ ID NO: 3274904 - RNA, 23 nt, Mycobacterium tuberculosis H37Rv
ugcgcgaugcgauucugcgucug

SEQ ID NO: 3274905 - RNA, 13 nt, Mycobacterium tuberculosis H37Rv
ugcgcgccagaca

SEQ ID NO: 3274906 - RNA, 17 nt, Mycobacterium tuberculosis H37Rv
ugcgcgcccaccgggcg

SEQ ID NO: 3274907 - RNA, 15 nt, Mycobacterium tuberculosis H37Rv
ugcgcgcccgggcgg

SEQ ID NO: 3274908 - RNA, 21 nt, Mycobacterium tuberculosis H37Rv
ugcgcgccgauaugcgugagc

SEQ ID NO: 3274909 - RNA, 23 nt, Mycobacterium tuberculosis H37Rv
ugcgcgccguucacccugguggu

SEQ ID NO: 3274910 - RNA, 14 nt, Mycobacterium tuberculosis H37Rv
ugcgcgcgcagauc

SEQ ID NO: 3274911 - RNA, 15 nt, Mycobacterium tuberculosis H37Rv
ugcgcgcggccgcgc

SEQ ID NO: 3274912 - RNA, 15 nt, Mycobacterium tuberculosis H37Rv
ugcgcgcguugcggu

SEQ ID NO: 3274913 - RNA, 16 nt, Mycobacterium tuberculosis H37Rv
ugcgcgcugacccgcc

SEQ ID NO: 3274914 - RNA, 13 nt, Mycobacterium tuberculosis H37Rv
ugcgcggcauccc

SEQ ID NO: 3274915 - RNA, 14 nt, Mycobacterium tuberculosis H37Rv
ugcgcggcaucccg

SEQ ID NO: 3274916 - RNA, 15 nt, Mycobacterium tuberculosis H37Rv
ugcgcggcaucccgc

SEQ ID NO: 3274917 - RNA, 14 nt, Mycobacterium tuberculosis H37Rv
ugcgcggcccgcau

SEQ ID NO: 3274918 - RNA, 15 nt, Mycobacterium tuberculosis H37Rv
ugcgcggcccgcauc

SEQ ID NO: 3274919 - RNA, 21 nt, Mycobacterium tuberculosis H37Rv
ugcgcggcccgcaucguugcc

SEQ ID NO: 3274920 - RNA, 17 nt, Mycobacterium tuberculosis H37Rv
ugcgcggcgucgucgau

SEQ ID NO: 3274921 - RNA, 17 nt, Mycobacterium tuberculosis H37Rv
ugcgcggcgugcgcggu

SEQ ID NO: 3274922 - RNA, 19 nt, Mycobacterium tuberculosis H37Rv
ugcgcgggcaucgucgucg

SEQ ID NO: 3274923 - RNA, 20 nt, Mycobacterium tuberculosis H37Rv
ugcgcgggcaucgucgucgc

SEQ ID NO: 3274924 - RNA, 23 nt, Mycobacterium tuberculosis H37Rv
ugcgcgggcgaguagucgacguc

SEQ ID NO: 3274925 - RNA, 20 nt, Mycobacterium tuberculosis H37Rv
ugcgcgggugguucaccucg

SEQ ID NO: 3274926 - RNA, 18 nt, Mycobacterium tuberculosis H37Rv
ugcgcgguagcucgucga

SEQ ID NO: 3274927 - RNA, 18 nt, Mycobacterium tuberculosis H37Rv
ugcgcggucugaccgcgu

SEQ ID NO: 3274928 - RNA, 13 nt, Mycobacterium tuberculosis H37Rv
ugcgcggugaccg

SEQ ID NO: 3274929 - RNA, 19 nt, Mycobacterium tuberculosis H37Rv
ugcgcggugaugguuaccg

SEQ ID NO: 3274930 - RNA, 16 nt, Mycobacterium tuberculosis H37Rv
ugcgcggugccggccg

SEQ ID NO: 3274931 - RNA, 12 nt, Mycobacterium tuberculosis H37Rv
ugcgcggugcgc

SEQ ID NO: 3274932 - RNA, 15 nt, Mycobacterium tuberculosis H37Rv
ugcgcgucagccgca

SEQ ID NO: 3274933 - RNA, 18 nt, Mycobacterium tuberculosis H37Rv
ugcgcgucagccgcaccc

SEQ ID NO: 3274934 - RNA, 16 nt, Mycobacterium tuberculosis H37Rv
ugcgcgucaggccagc

SEQ ID NO: 3274935 - RNA, 19 nt, Mycobacterium tuberculosis H37Rv
ugcgcgucgagcagcacca

SEQ ID NO: 3274936 - RNA, 15 nt, Mycobacterium tuberculosis H37Rv
ugcgcgugcugcgga

SEQ ID NO: 3274937 - RNA, 21 nt, Mycobacterium tuberculosis H37Rv
ugcgcguuacccaucgccaca

SEQ ID NO: 3274938 - RNA, 13 nt, Mycobacterium tuberculosis H37Rv
ugcgcguugaccg

SEQ ID NO: 3274939 - RNA, 16 nt, Mycobacterium tuberculosis H37Rv
ugcgcguuggucauca

SEQ ID NO: 3274940 - RNA, 14 nt, Mycobacterium tuberculosis H37Rv
ugcgcucacugcag

SEQ ID NO: 3274941 - RNA, 15 nt, Mycobacterium tuberculosis H37Rv
ugcgcucacuggcga

SEQ ID NO: 3274942 - RNA, 22 nt, Mycobacterium tuberculosis H37Rv
ugcgcuccaacaacuccagcag

SEQ ID NO: 3274943 - RNA, 20 nt, Mycobacterium tuberculosis H37Rv
ugcgcucguugguucagcuc

SEQ ID NO: 3274944 - RNA, 21 nt, Mycobacterium tuberculosis H37Rv
ugcgcucguugguucagcucg

SEQ ID NO: 3274945 - RNA, 18 nt, Mycobacterium tuberculosis H37Rv
ugcgcugcucacgcagca

SEQ ID NO: 3274946 - RNA, 17 nt, Mycobacterium tuberculosis H37Rv
ugcgcugggugaugagc

SEQ ID NO: 3274947 - RNA, 13 nt, Mycobacterium tuberculosis H37Rv
ugcgcuggucgca

SEQ ID NO: 3274948 - RNA, 21 nt, Mycobacterium tuberculosis H37Rv
ugcgcugguggcggcgacacg

SEQ ID NO: 3274949 - RNA, 17 nt, Mycobacterium tuberculosis H37Rv
ugcgcuguugcuggcgc

SEQ ID NO: 3274950 - RNA, 16 nt, Mycobacterium tuberculosis H37Rv
ugcggaaacccggccg

SEQ ID NO: 3274951 - RNA, 13 nt, Mycobacterium tuberculosis H37Rv
ugcggaaaucgga

SEQ ID NO: 3274952 - RNA, 21 nt, Mycobacterium tuberculosis H37Rv
ugcggaacaccaccaggcugu

SEQ ID NO: 3274953 - RNA, 21 nt, Mycobacterium tuberculosis H37Rv
ugcggaacaccgcccggcccg

SEQ ID NO: 3274954 - RNA, 23 nt, Mycobacterium tuberculosis H37Rv
ugcggaacaccgcccggcccggc

SEQ ID NO: 3274955 - RNA, 14 nt, Mycobacterium tuberculosis H37Rv
ugcggaacggccag

SEQ ID NO: 3274956 - RNA, 22 nt, Mycobacterium tuberculosis H37Rv
ugcggaagaagugcucacaucc

SEQ ID NO: 3274957 - RNA, 16 nt, Mycobacterium tuberculosis H37Rv
ugcggaaucagcaccc

SEQ ID NO: 3274958 - RNA, 16 nt, Mycobacterium tuberculosis H37Rv
ugcggacaucaccggc

SEQ ID NO: 3274959 - RNA, 17 nt, Mycobacterium tuberculosis H37Rv
ugcggacaucaccggca

SEQ ID NO: 3274960 - RNA, 19 nt, Mycobacterium tuberculosis H37Rv
ugcggacgguguacagguc

SEQ ID NO: 3274961 - RNA, 22 nt, Mycobacterium tuberculosis H37Rv
ugcggauacuguucugcuggcu

SEQ ID NO: 3274962 - RNA, 22 nt, Mycobacterium tuberculosis H37Rv
ugcggaucacucccccacacac

SEQ ID NO: 3274963 - RNA, 13 nt, Mycobacterium tuberculosis H37Rv
ugcggauccacca

SEQ ID NO: 3274964 - RNA, 12 nt, Mycobacterium tuberculosis H37Rv
ugcggaucggac

SEQ ID NO: 3274965 - RNA, 18 nt, Mycobacterium tuberculosis H37Rv
ugcggauguccuugcggu

SEQ ID NO: 3274966 - RNA, 17 nt, Mycobacterium tuberculosis H37Rv
ugcggcaacagcggggu

SEQ ID NO: 3274967 - RNA, 23 nt, Mycobacterium tuberculosis H37Rv
ugcggcaacgaggucugcggccg

SEQ ID NO: 3274968 - RNA, 17 nt, Mycobacterium tuberculosis H37Rv
ugcguagcaggucgacg

SEQ ID NO: 3274969 - RNA, 18 nt, Mycobacterium tuberculosis H37Rv
ugcguagcaggucgacgg

SEQ ID NO: 3274970 - RNA, 20 nt, Mycobacterium tuberculosis H37Rv
ugcguagccgugggccacga

SEQ ID NO: 3274971 - RNA, 16 nt, Mycobacterium tuberculosis H37Rv
ugcguaucgacccgcg

SEQ ID NO: 3274972 - RNA, 13 nt, Mycobacterium tuberculosis H37Rv
ugcguaugcccac

SEQ ID NO: 3274973 - RNA, 19 nt, Mycobacterium tuberculosis H37Rv
ugcgucaaguccgagucgg

SEQ ID NO: 3274974 - RNA, 13 nt, Mycobacterium tuberculosis H37Rv
ugcguccagcaaa

SEQ ID NO: 3274975 - RNA, 20 nt, Mycobacterium tuberculosis H37Rv
ugcguccggaaccaaccucg

SEQ ID NO: 3274976 - RNA, 15 nt, Mycobacterium tuberculosis H37Rv
ugcguccggugcugg

SEQ ID NO: 3274977 - RNA, 22 nt, Mycobacterium tuberculosis H37Rv
ugcguccguagcgauucugggc

SEQ ID NO: 3274978 - RNA, 17 nt, Mycobacterium tuberculosis H37Rv
ugcgucgaaauccacaa

SEQ ID NO: 3274979 - RNA, 19 nt, Mycobacterium tuberculosis H37Rv
ugcgucgaugccggugugc

SEQ ID NO: 3274980 - RNA, 17 nt, Mycobacterium tuberculosis H37Rv
ugcgucgaugcgcugcu

SEQ ID NO: 3274981 - RNA, 19 nt, Mycobacterium tuberculosis H37Rv
ugcgucgcacgagccaaca

SEQ ID NO: 3274982 - RNA, 14 nt, Mycobacterium tuberculosis H37Rv
ugcgucggcccggu

SEQ ID NO: 3274983 - RNA, 19 nt, Mycobacterium tuberculosis H37Rv
ugcgucugcucacgcgguc

SEQ ID NO: 3274984 - RNA, 13 nt, Mycobacterium tuberculosis H37Rv
ugcgucugcucgc

SEQ ID NO: 3274985 - RNA, 23 nt, Mycobacterium tuberculosis H37Rv
ugcgucugcucgcgcagccgggu

SEQ ID NO: 3274986 - RNA, 15 nt, Mycobacterium tuberculosis H37Rv
ugcgugaacaagauu

SEQ ID NO: 3274987 - RNA, 15 nt, Mycobacterium tuberculosis H37Rv
ugcgugacccgacau

SEQ ID NO: 3274988 - RNA, 16 nt, Mycobacterium tuberculosis H37Rv
ugcgugaugguugcuc

SEQ ID NO: 3274989 - RNA, 18 nt, Mycobacterium tuberculosis H37Rv
ugcgugcauaggccgcgu

SEQ ID NO: 3274990 - RNA, 20 nt, Mycobacterium tuberculosis H37Rv
ugcgugcccguugguguugc

SEQ ID NO: 3274991 - RNA, 13 nt, Mycobacterium tuberculosis H37Rv
ugcgugccgaccc

SEQ ID NO: 3274992 - RNA, 16 nt, Mycobacterium tuberculosis H37Rv
ugcgugccgacccgcu

SEQ ID NO: 3274993 - RNA, 20 nt, Mycobacterium tuberculosis H37Rv
ugcgugccgacccgcuucgc

SEQ ID NO: 3274994 - RNA, 12 nt, Mycobacterium tuberculosis H37Rv
ugcguggcgaac

SEQ ID NO: 3274995 - RNA, 15 nt, Mycobacterium tuberculosis H37Rv
ugcguggcgggcugc

SEQ ID NO: 3274996 - RNA, 22 nt, Mycobacterium tuberculosis H37Rv
ugcguggcguugguggucugcc

SEQ ID NO: 3274997 - RNA, 19 nt, Mycobacterium tuberculosis H37Rv
ugcguuccaucgccgacgc

SEQ ID NO: 3274998 - RNA, 16 nt, Mycobacterium tuberculosis H37Rv
ugcguuccgaucggca

SEQ ID NO: 3274999 - RNA, 15 nt, Mycobacterium tuberculosis H37Rv
ugcguucgggcucca

SEQ ID NO: 3275000 - RNA, 19 nt, Mycobacterium tuberculosis H37Rv
ugcguucgggcuccagcag

SEQ ID NO: 3275001 - RNA, 18 nt, Mycobacterium tuberculosis H37Rv
ugcguucggugaucucgu

SEQ ID NO: 3275002 - RNA, 14 nt, Mycobacterium tuberculosis H37Rv
ugcguuggaugaag

SEQ ID NO: 3275003 - RNA, 15 nt, Mycobacterium tuberculosis H37Rv
ugcguuggccccagg

SEQ ID NO: 3275004 - RNA, 20 nt, Mycobacterium tuberculosis H37Rv
ugcguuggcgccggccaaca

SEQ ID NO: 3275005 - RNA, 17 nt, Mycobacterium tuberculosis H37Rv
ugcguugggaucccagc

SEQ ID NO: 3275006 - RNA, 21 nt, Mycobacterium tuberculosis H37Rv
ugcguugggaucccagcgcag

SEQ ID NO: 3275007 - RNA, 16 nt, Mycobacterium tuberculosis H37Rv
ugcguuguccaccauc

SEQ ID NO: 3275008 - RNA, 19 nt, Mycobacterium tuberculosis H37Rv
ugcuacacccguagaccuu

SEQ ID NO: 3275009 - RNA, 14 nt, Mycobacterium tuberculosis H37Rv
ugcuagcagcagcc

SEQ ID NO: 3275010 - RNA, 19 nt, Mycobacterium tuberculosis H37Rv
ugcuagcuuggcggccagc

SEQ ID NO: 3275011 - RNA, 21 nt, Mycobacterium tuberculosis H37Rv
ugcuaugcaacaccgcaccgg

SEQ ID NO: 3275012 - RNA, 13 nt, Mycobacterium tuberculosis H37Rv
ugcuauggccgca

SEQ ID NO: 3275013 - RNA, 17 nt, Mycobacterium tuberculosis H37Rv
ugcuauucgccagcgcc

SEQ ID NO: 3275014 - RNA, 19 nt, Mycobacterium tuberculosis H37Rv
ugcucaagcgcgucgucac

SEQ ID NO: 3275015 - RNA, 18 nt, Mycobacterium tuberculosis H37Rv
ugcucacauccggucaga

SEQ ID NO: 3275016 - RNA, 19 nt, Mycobacterium tuberculosis H37Rv
ugcucaccagacgcugcca

SEQ ID NO: 3275017 - RNA, 19 nt, Mycobacterium tuberculosis H37Rv
ugcucacgagcaaaccaga

SEQ ID NO: 3275018 - RNA, 13 nt, Mycobacterium tuberculosis H37Rv
ugcucacgcagca

SEQ ID NO: 3275019 - RNA, 18 nt, Mycobacterium tuberculosis H37Rv
ugcucacgcgggucguua

SEQ ID NO: 3275020 - RNA, 17 nt, Mycobacterium tuberculosis H37Rv
ugcucacgguccggcgg

SEQ ID NO: 3275021 - RNA, 13 nt, Mycobacterium tuberculosis H37Rv
ugcucagccggcc

SEQ ID NO: 3275022 - RNA, 18 nt, Mycobacterium tuberculosis H37Rv
ugcucaucgcgcccgcca

SEQ ID NO: 3275023 - RNA, 13 nt, Mycobacterium tuberculosis H37Rv
ugcuccaccgucg

SEQ ID NO: 3275024 - RNA, 21 nt, Mycobacterium tuberculosis H37Rv
ugcuccaggcgcgccgcaccc

SEQ ID NO: 3275025 - RNA, 14 nt, Mycobacterium tuberculosis H37Rv
ugcuccugguggca

SEQ ID NO: 3275026 - RNA, 17 nt, Mycobacterium tuberculosis H37Rv
ugcuccugguggcagaa

SEQ ID NO: 3275027 - RNA, 15 nt, Mycobacterium tuberculosis H37Rv
ugcuccuugggucgg

SEQ ID NO: 3275028 - RNA, 23 nt, Mycobacterium tuberculosis H37Rv
ugcucgacaaccgcccgccaggc

SEQ ID NO: 3275029 - RNA, 17 nt, Mycobacterium tuberculosis H37Rv
ugcucgacgaggccacg

SEQ ID NO: 3275030 - RNA, 19 nt, Mycobacterium tuberculosis H37Rv
ugcucgacgaucugcagca

SEQ ID NO: 3275031 - RNA, 13 nt, Mycobacterium tuberculosis H37Rv
ugcucgacgcccg

SEQ ID NO: 3275032 - RNA, 18 nt, Mycobacterium tuberculosis H37Rv
ugcucgacgcccgccacc

SEQ ID NO: 3275033 - RNA, 16 nt, Mycobacterium tuberculosis H37Rv
ugcucgagcaccucgg

SEQ ID NO: 3275034 - RNA, 20 nt, Mycobacterium tuberculosis H37Rv
ugcucgagcagaucagcacg

SEQ ID NO: 3275035 - RNA, 18 nt, Mycobacterium tuberculosis H37Rv
ugcucgaucaucgggagc

SEQ ID NO: 3275036 - RNA, 19 nt, Mycobacterium tuberculosis H37Rv
ugcucgaucugucgcgccg

SEQ ID NO: 3275037 - RNA, 23 nt, Mycobacterium tuberculosis H37Rv
ugcucgcaaucguuggccaugcc

SEQ ID NO: 3275038 - RNA, 22 nt, Mycobacterium tuberculosis H37Rv
ugcucgccaggcaagccagcac

SEQ ID NO: 3275039 - RNA, 13 nt, Mycobacterium tuberculosis H37Rv
ugcucgccaggcc

SEQ ID NO: 3275040 - RNA, 14 nt, Mycobacterium tuberculosis H37Rv
ugcucgccaggccu

SEQ ID NO: 3275041 - RNA, 18 nt, Mycobacterium tuberculosis H37Rv
ugcucgccaggccuaggc

SEQ ID NO: 3275042 - RNA, 19 nt, Mycobacterium tuberculosis H37Rv
ugcucgccaggggaacgcu

SEQ ID NO: 3275043 - RNA, 13 nt, Mycobacterium tuberculosis H37Rv
ugcucgccgacca

SEQ ID NO: 3275044 - RNA, 19 nt, Mycobacterium tuberculosis H37Rv
ugcucgccgaccagcuuga

SEQ ID NO: 3275045 - RNA, 21 nt, Mycobacterium tuberculosis H37Rv
ugcucgccggacggagguccu

SEQ ID NO: 3275046 - RNA, 12 nt, Mycobacterium tuberculosis H37Rv
ugcucgccggcc

SEQ ID NO: 3275047 - RNA, 15 nt, Mycobacterium tuberculosis H37Rv
ugcucgccgggcagc

SEQ ID NO: 3275048 - RNA, 23 nt, Mycobacterium tuberculosis H37Rv
ugcucgccguaagcaccagccag

SEQ ID NO: 3275049 - RNA, 16 nt, Mycobacterium tuberculosis H37Rv
ugcucgccguggugga

SEQ ID NO: 3275050 - RNA, 24 nt, Mycobacterium tuberculosis H37Rv
ugcucgcgaggcucgcguggccgc

SEQ ID NO: 3275051 - RNA, 20 nt, Mycobacterium tuberculosis H37Rv
ugcucgcgaucgcagugagc

SEQ ID NO: 3275052 - RNA, 20 nt, Mycobacterium tuberculosis H37Rv
ugcucgcgcaaggcgccgca

SEQ ID NO: 3275053 - RNA, 21 nt, Mycobacterium tuberculosis H37Rv
ugcucgcgcagggaucgcagg

SEQ ID NO: 3275054 - RNA, 14 nt, Mycobacterium tuberculosis H37Rv
ugcucgcgcccgcu

SEQ ID NO: 3275055 - RNA, 14 nt, Mycobacterium tuberculosis H37Rv
ugcucgcgccgcua

SEQ ID NO: 3275056 - RNA, 14 nt, Mycobacterium tuberculosis H37Rv
ugcucgcgcucguu

SEQ ID NO: 3275057 - RNA, 20 nt, Mycobacterium tuberculosis H37Rv
ugcucggaaacagcgaucgc

SEQ ID NO: 3275058 - RNA, 23 nt, Mycobacterium tuberculosis H37Rv
ugcucggaaacagcgaucgccgc

SEQ ID NO: 3275059 - RNA, 19 nt, Mycobacterium tuberculosis H37Rv
ugcucggcaucgagcagcc

SEQ ID NO: 3275060 - RNA, 19 nt, Mycobacterium tuberculosis H37Rv
ugcucgggcgugaucccgc

SEQ ID NO: 3275061 - RNA, 17 nt, Mycobacterium tuberculosis H37Rv
ugcucgggggccgacca

SEQ ID NO: 3275062 - RNA, 15 nt, Mycobacterium tuberculosis H37Rv
ugcucggucucgucg

SEQ ID NO: 3275063 - RNA, 18 nt, Mycobacterium tuberculosis H37Rv
ugcucggucucgucgcgg

SEQ ID NO: 3275064 - RNA, 17 nt, Mycobacterium tuberculosis H37Rv
uggaauggaucucggcg

SEQ ID NO: 3275065 - RNA, 22 nt, Mycobacterium tuberculosis H37Rv
uggacaacagcuuggagaucgc

SEQ ID NO: 3275066 - RNA, 14 nt, Mycobacterium tuberculosis H37Rv
uggacaaccucguc

SEQ ID NO: 3275067 - RNA, 14 nt, Mycobacterium tuberculosis H37Rv
uggacaagcacagc

SEQ ID NO: 3275068 - RNA, 21 nt, Mycobacterium tuberculosis H37Rv
uggacacguuguucaccgacg

SEQ ID NO: 3275069 - RNA, 23 nt, Mycobacterium tuberculosis H37Rv
uggacagaaucgaccgccgcuac

SEQ ID NO: 3275070 - RNA, 18 nt, Mycobacterium tuberculosis H37Rv
uggacaggucaauggucu

SEQ ID NO: 3275071 - RNA, 13 nt, Mycobacterium tuberculosis H37Rv
uggaccaccgccg

SEQ ID NO: 3275072 - RNA, 16 nt, Mycobacterium tuberculosis H37Rv
uggaccaccgccgaag

SEQ ID NO: 3275073 - RNA, 21 nt, Mycobacterium tuberculosis H37Rv
uggaccagcgccccggcgcgu

SEQ ID NO: 3275074 - RNA, 16 nt, Mycobacterium tuberculosis H37Rv
uggaccagcgggcggc

SEQ ID NO: 3275075 - RNA, 17 nt, Mycobacterium tuberculosis H37Rv
uggacccugcgccgcca

SEQ ID NO: 3275076 - RNA, 15 nt, Mycobacterium tuberculosis H37Rv
uggaccgaacgacuc

SEQ ID NO: 3275077 - RNA, 13 nt, Mycobacterium tuberculosis H37Rv
uggaccgccgccg

SEQ ID NO: 3275078 - RNA, 16 nt, Mycobacterium tuberculosis H37Rv
uggaccgccgccgaca

SEQ ID NO: 3275079 - RNA, 16 nt, Mycobacterium tuberculosis H37Rv
uggaccgcggugaccc

SEQ ID NO: 3275080 - RNA, 14 nt, Mycobacterium tuberculosis H37Rv
uggaccggucgaca

SEQ ID NO: 3275081 - RNA, 17 nt, Mycobacterium tuberculosis H37Rv
uggaccguugccgaugg

SEQ ID NO: 3275082 - RNA, 16 nt, Mycobacterium tuberculosis H37Rv
uggacgacccgggccg

SEQ ID NO: 3275083 - RNA, 20 nt, Mycobacterium tuberculosis H37Rv
uggacgcagagucaacagau

SEQ ID NO: 3275084 - RNA, 21 nt, Mycobacterium tuberculosis H37Rv
uggacgcagagucaacagaua

SEQ ID NO: 3275085 - RNA, 21 nt, Mycobacterium tuberculosis H37Rv
uggacgcccgaguugaagaau

SEQ ID NO: 3275086 - RNA, 16 nt, Mycobacterium tuberculosis H37Rv
uggacgcgaugaucau

SEQ ID NO: 3275087 - RNA, 16 nt, Mycobacterium tuberculosis H37Rv
uggacgcgcaugcccc

SEQ ID NO: 3275088 - RNA, 13 nt, Mycobacterium tuberculosis H37Rv
uggacggccaggu

SEQ ID NO: 3275089 - RNA, 23 nt, Mycobacterium tuberculosis H37Rv
uggacgugucaucacggucagcc

SEQ ID NO: 3275090 - RNA, 21 nt, Mycobacterium tuberculosis H37Rv
uggacugagucguaguaggcg

SEQ ID NO: 3275091 - RNA, 20 nt, Mycobacterium tuberculosis H37Rv
uggacuuuauggcuagugcu

SEQ ID NO: 3275092 - RNA, 20 nt, Mycobacterium tuberculosis H37Rv
uggagaaguuagccaccuug

SEQ ID NO: 3275093 - RNA, 11 nt, Mycobacterium tuberculosis H37Rv
uggagauggca

SEQ ID NO: 3275094 - RNA, 21 nt, Mycobacterium tuberculosis H37Rv
uggagaugucggugaucacgg

SEQ ID NO: 3275095 - RNA, 21 nt, Mycobacterium tuberculosis H37Rv
uggagauuggguccagcgagg

SEQ ID NO: 3275096 - RNA, 23 nt, Mycobacterium tuberculosis H37Rv
uggagcgcgccucgcccagcaag

SEQ ID NO: 3275097 - RNA, 21 nt, Mycobacterium tuberculosis H37Rv
uggagcuaugucauagcgcac

SEQ ID NO: 3275098 - RNA, 21 nt, Mycobacterium tuberculosis H37Rv
uggagcucaucgacgagccgc

SEQ ID NO: 3275099 - RNA, 21 nt, Mycobacterium tuberculosis H37Rv
uggagcuuggcccagcguguc

SEQ ID NO: 3275100 - RNA, 13 nt, Mycobacterium tuberculosis H37Rv
uggaggccgccga

SEQ ID NO: 3275101 - RNA, 17 nt, Mycobacterium tuberculosis H37Rv
uggagguucccgaaucu

SEQ ID NO: 3275102 - RNA, 16 nt, Mycobacterium tuberculosis H37Rv
uggaguauccggcaga

SEQ ID NO: 3275103 - RNA, 16 nt, Mycobacterium tuberculosis H37Rv
uggagugaggcugugc

SEQ ID NO: 3275104 - RNA, 19 nt, Mycobacterium tuberculosis H37Rv
uggagugaggcugugcccc

SEQ ID NO: 3275105 - RNA, 22 nt, Mycobacterium tuberculosis H37Rv
uggagugaggcugugccccagg

SEQ ID NO: 3275106 - RNA, 20 nt, Mycobacterium tuberculosis H37Rv
uggaguggugauccagccgu

SEQ ID NO: 3275107 - RNA, 13 nt, Mycobacterium tuberculosis H37Rv
uggaguuggcugc

SEQ ID NO: 3275108 - RNA, 22 nt, Mycobacterium tuberculosis H37Rv
uggauaauccaugacacugggg

SEQ ID NO: 3275109 - RNA, 22 nt, Mycobacterium tuberculosis H37Rv
uggauagcuuuucgcaagucuc

SEQ ID NO: 3275110 - RNA, 16 nt, Mycobacterium tuberculosis H37Rv
uggaucacgucgaugu

SEQ ID NO: 3275111 - RNA, 16 nt, Mycobacterium tuberculosis H37Rv
uggaucagggucauca

SEQ ID NO: 3275112 - RNA, 20 nt, Mycobacterium tuberculosis H37Rv
uggaucauguucggccacca

SEQ ID NO: 3275113 - RNA, 18 nt, Mycobacterium tuberculosis H37Rv
uggauccaaccgugcucu

SEQ ID NO: 3275114 - RNA, 18 nt, Mycobacterium tuberculosis H37Rv
uggaucccacgaguuggc

SEQ ID NO: 3275115 - RNA, 19 nt, Mycobacterium tuberculosis H37Rv
uggauccccugauggaccc

SEQ ID NO: 3275116 - RNA, 15 nt, Mycobacterium tuberculosis H37Rv
uggauccggccacca

SEQ ID NO: 3275117 - RNA, 16 nt, Mycobacterium tuberculosis H37Rv
uggauccggccaccac

SEQ ID NO: 3275118 - RNA, 22 nt, Mycobacterium tuberculosis H37Rv
uggauccgggagucgacggugc

SEQ ID NO: 3275119 - RNA, 17 nt, Mycobacterium tuberculosis H37Rv
uggaucgucgcuguggc

SEQ ID NO: 3275120 - RNA, 19 nt, Mycobacterium tuberculosis H37Rv
uggaucgucgggagcacac

SEQ ID NO: 3275121 - RNA, 19 nt, Mycobacterium tuberculosis H37Rv
uggaucgucucgcgcaccu

SEQ ID NO: 3275122 - RNA, 14 nt, Mycobacterium tuberculosis H37Rv
uggaucugccucuc

SEQ ID NO: 3275123 - RNA, 15 nt, Mycobacterium tuberculosis H37Rv
uggaucuuggccagc

SEQ ID NO: 3275124 - RNA, 19 nt, Mycobacterium tuberculosis H37Rv
uggaucuuggccagcagcg

SEQ ID NO: 3275125 - RNA, 21 nt, Mycobacterium tuberculosis H37Rv
uggaugaccgaaccuggucuu

SEQ ID NO: 3275126 - RNA, 16 nt, Mycobacterium tuberculosis H37Rv
uggaugcccguagacg

SEQ ID NO: 3275127 - RNA, 22 nt, Mycobacterium tuberculosis H37Rv
uggaugcccguagacgccgagc

SEQ ID NO: 3275128 - RNA, 11 nt, Mycobacterium tuberculosis H37Rv
uggauggacca

SEQ ID NO: 3275129 - RNA, 16 nt, Mycobacterium tuberculosis H37Rv
uggauggccgccaggc

SEQ ID NO: 3275130 - RNA, 15 nt, Mycobacterium tuberculosis H37Rv
uggauggcgcccugc

SEQ ID NO: 3275131 - RNA, 16 nt, Mycobacterium tuberculosis H37Rv
uggaugggcugcgcgu

SEQ ID NO: 3275132 - RNA, 17 nt, Mycobacterium tuberculosis H37Rv
uggauucuucagcgcgg

SEQ ID NO: 3275133 - RNA, 19 nt, Mycobacterium tuberculosis H37Rv
uggauuggcgucagcagca

SEQ ID NO: 3275134 - RNA, 14 nt, Mycobacterium tuberculosis H37Rv
uggauuuuggcuga

SEQ ID NO: 3275135 - RNA, 19 nt, Mycobacterium tuberculosis H37Rv
uggcaaagacgcuggccac

SEQ ID NO: 3275136 - RNA, 21 nt, Mycobacterium tuberculosis H37Rv
uggcaaccacguccgcaaccu

SEQ ID NO: 3275137 - RNA, 23 nt, Mycobacterium tuberculosis H37Rv
uggcaaccgaauugaacugagga

SEQ ID NO: 3275138 - RNA, 12 nt, Mycobacterium tuberculosis H37Rv
uggcaaccgcgc

SEQ ID NO: 3275139 - RNA, 21 nt, Mycobacterium tuberculosis H37Rv
uggcaacgccgcgccguucca

SEQ ID NO: 3275140 - RNA, 17 nt, Mycobacterium tuberculosis H37Rv
uggcaacggcaucccgg

SEQ ID NO: 3275141 - RNA, 21 nt, Mycobacterium tuberculosis H37Rv
uggcaagcacggcgucgaugu

SEQ ID NO: 3275142 - RNA, 15 nt, Mycobacterium tuberculosis H37Rv
uggcaagcugucguc

SEQ ID NO: 3275143 - RNA, 17 nt, Mycobacterium tuberculosis H37Rv
uggcaagucaacaccgc

SEQ ID NO: 3275144 - RNA, 22 nt, Mycobacterium tuberculosis H37Rv
uggcaagucaacaccgcggccg

SEQ ID NO: 3275145 - RNA, 22 nt, Mycobacterium tuberculosis H37Rv
uggcaaucccgccaucugccug

SEQ ID NO: 3275146 - RNA, 14 nt, Mycobacterium tuberculosis H37Rv
uggcaccagccggu

SEQ ID NO: 3275147 - RNA, 22 nt, Mycobacterium tuberculosis H37Rv
uggcaccagccggugagcgagc

SEQ ID NO: 3275148 - RNA, 21 nt, Mycobacterium tuberculosis H37Rv
uggcacccgcgucgagugccg

SEQ ID NO: 3275149 - RNA, 14 nt, Mycobacterium tuberculosis H37Rv
uggcaccgccagcc

SEQ ID NO: 3275150 - RNA, 18 nt, Mycobacterium tuberculosis H37Rv
uggcacggccccugccac

SEQ ID NO: 3275151 - RNA, 15 nt, Mycobacterium tuberculosis H37Rv
uggcacgggucguca

SEQ ID NO: 3275152 - RNA, 22 nt, Mycobacterium tuberculosis H37Rv
uggcacgugaaagccgaccagc

SEQ ID NO: 3275153 - RNA, 20 nt, Mycobacterium tuberculosis H37Rv
uggcagaccggugagcaccg

SEQ ID NO: 3275154 - RNA, 12 nt, Mycobacterium tuberculosis H37Rv
uggcagagccgc

SEQ ID NO: 3275155 - RNA, 17 nt, Mycobacterium tuberculosis H37Rv
uggcagagccgccguug

SEQ ID NO: 3275156 - RNA, 14 nt, Mycobacterium tuberculosis H37Rv
uggcagccccagcu

SEQ ID NO: 3275157 - RNA, 22 nt, Mycobacterium tuberculosis H37Rv
uggcagcccguucgaaguucuc

SEQ ID NO: 3275158 - RNA, 13 nt, Mycobacterium tuberculosis H37Rv
uggcagccugcug

SEQ ID NO: 3275159 - RNA, 22 nt, Mycobacterium tuberculosis H37Rv
uggcagcggccuccgggccaug

SEQ ID NO: 3275160 - RNA, 21 nt, Mycobacterium tuberculosis H37Rv
uggcccggacaugcgggcagc

SEQ ID NO: 3275161 - RNA, 22 nt, Mycobacterium tuberculosis H37Rv
uggcccggacaugcgggcagca

SEQ ID NO: 3275162 - RNA, 22 nt, Mycobacterium tuberculosis H37Rv
uggcccggcgaaagcuugggcg

SEQ ID NO: 3275163 - RNA, 12 nt, Mycobacterium tuberculosis H37Rv
uggcccgggccc

SEQ ID NO: 3275164 - RNA, 21 nt, Mycobacterium tuberculosis H37Rv
uggcccgggcccgcgggauca

SEQ ID NO: 3275165 - RNA, 22 nt, Mycobacterium tuberculosis H37Rv
uggcccgggucuccggcgcacc

SEQ ID NO: 3275166 - RNA, 16 nt, Mycobacterium tuberculosis H37Rv
uggccgaaagccaggc

SEQ ID NO: 3275167 - RNA, 21 nt, Mycobacterium tuberculosis H37Rv
uggccgaacagcaggccucca

SEQ ID NO: 3275168 - RNA, 17 nt, Mycobacterium tuberculosis H37Rv
uggccgaacauucccau

SEQ ID NO: 3275169 - RNA, 18 nt, Mycobacterium tuberculosis H37Rv
uggccgacagccaccgcg

SEQ ID NO: 3275170 - RNA, 19 nt, Mycobacterium tuberculosis H37Rv
uggccgacagccaccgcga

SEQ ID NO: 3275171 - RNA, 16 nt, Mycobacterium tuberculosis H37Rv
uggccgagcagggccg

SEQ ID NO: 3275172 - RNA, 17 nt, Mycobacterium tuberculosis H37Rv
uggccgagcagggccgg

SEQ ID NO: 3275173 - RNA, 22 nt, Mycobacterium tuberculosis H37Rv
uggccgaguagauggucgacgg

SEQ ID NO: 3275174 - RNA, 23 nt, Mycobacterium tuberculosis H37Rv
uggccgauguaguccggccaguc

SEQ ID NO: 3275175 - RNA, 19 nt, Mycobacterium tuberculosis H37Rv
uggccgcaaggcguguagc

SEQ ID NO: 3275176 - RNA, 14 nt, Mycobacterium tuberculosis H37Rv
uggccgcagggccu

SEQ ID NO: 3275177 - RNA, 17 nt, Mycobacterium tuberculosis H37Rv
uggccgcaucgacgcuc

SEQ ID NO: 3275178 - RNA, 16 nt, Mycobacterium tuberculosis H37Rv
uggccgcaucgccuca

SEQ ID NO: 3275179 - RNA, 18 nt, Mycobacterium tuberculosis H37Rv
uggccgcauuggcgaccg

SEQ ID NO: 3275180 - RNA, 18 nt, Mycobacterium tuberculosis H37Rv
uggccgccaccgcgacga

SEQ ID NO: 3275181 - RNA, 16 nt, Mycobacterium tuberculosis H37Rv
uggccgccaccuccca

SEQ ID NO: 3275182 - RNA, 21 nt, Mycobacterium tuberculosis H37Rv
uggccgccagauuggcgcugc

SEQ ID NO: 3275183 - RNA, 16 nt, Mycobacterium tuberculosis H37Rv
uggccgcccagaccgc

SEQ ID NO: 3275184 - RNA, 17 nt, Mycobacterium tuberculosis H37Rv
uggccgcccgcugcggc

SEQ ID NO: 3275185 - RNA, 17 nt, Mycobacterium tuberculosis H37Rv
uggccgcccuggccgcc

SEQ ID NO: 3275186 - RNA, 20 nt, Mycobacterium tuberculosis H37Rv
uggccgccgaauccgacguc

SEQ ID NO: 3275187 - RNA, 17 nt, Mycobacterium tuberculosis H37Rv
uggccgccgccaccugu

SEQ ID NO: 3275188 - RNA, 12 nt, Mycobacterium tuberculosis H37Rv
uggccgccgcga

SEQ ID NO: 3275189 - RNA, 19 nt, Mycobacterium tuberculosis H37Rv
uggccgccgcgcaccgcgg

SEQ ID NO: 3275190 - RNA, 18 nt, Mycobacterium tuberculosis H37Rv
uggccgccggcgccgcca

SEQ ID NO: 3275191 - RNA, 19 nt, Mycobacterium tuberculosis H37Rv
uggccgccggcgccgccau

SEQ ID NO: 3275192 - RNA, 16 nt, Mycobacterium tuberculosis H37Rv
uggccgcgagguaccc

SEQ ID NO: 3275193 - RNA, 15 nt, Mycobacterium tuberculosis H37Rv
uggccgcgcaggcuu

SEQ ID NO: 3275194 - RNA, 17 nt, Mycobacterium tuberculosis H37Rv
uggccgcgccucggucu

SEQ ID NO: 3275195 - RNA, 20 nt, Mycobacterium tuberculosis H37Rv
uggccgcgcucaucgcggcg

SEQ ID NO: 3275196 - RNA, 23 nt, Mycobacterium tuberculosis H37Rv
uggccgcucuccaccccgucugc

SEQ ID NO: 3275197 - RNA, 14 nt, Mycobacterium tuberculosis H37Rv
uggccgcugccuuc

SEQ ID NO: 3275198 - RNA, 16 nt, Mycobacterium tuberculosis H37Rv
uggccgcugccuucuu

SEQ ID NO: 3275199 - RNA, 14 nt, Mycobacterium tuberculosis H37Rv
uggccgcugugggc

SEQ ID NO: 3275200 - RNA, 18 nt, Mycobacterium tuberculosis H37Rv
uggccggccagccauggc

SEQ ID NO: 3275201 - RNA, 15 nt, Mycobacterium tuberculosis H37Rv
uggccggccaucgcc

SEQ ID NO: 3275202 - RNA, 16 nt, Mycobacterium tuberculosis H37Rv
uggccggccaucgccc

SEQ ID NO: 3275203 - RNA, 15 nt, Mycobacterium tuberculosis H37Rv
uggccggcgauggcc

SEQ ID NO: 3275204 - RNA, 22 nt, Mycobacterium tuberculosis H37Rv
uggccggcgguaagcccagaca

SEQ ID NO: 3275205 - RNA, 13 nt, Mycobacterium tuberculosis H37Rv
uggccgggaccgc

SEQ ID NO: 3275206 - RNA, 23 nt, Mycobacterium tuberculosis H37Rv
uggccgggaccgccccggccagg

SEQ ID NO: 3275207 - RNA, 15 nt, Mycobacterium tuberculosis H37Rv
uggccgggcacgcga

SEQ ID NO: 3275208 - RNA, 13 nt, Mycobacterium tuberculosis H37Rv
uggccgggcggua

SEQ ID NO: 3275209 - RNA, 18 nt, Mycobacterium tuberculosis H37Rv
uggccgguucaggggugg

SEQ ID NO: 3275210 - RNA, 17 nt, Mycobacterium tuberculosis H37Rv
uggccguauagcgugac

SEQ ID NO: 3275211 - RNA, 13 nt, Mycobacterium tuberculosis H37Rv
uggccgucagcca

SEQ ID NO: 3275212 - RNA, 16 nt, Mycobacterium tuberculosis H37Rv
uggccgucagccaggu

SEQ ID NO: 3275213 - RNA, 22 nt, Mycobacterium tuberculosis H37Rv
uggccgucagccaggugcccaa

SEQ ID NO: 3275214 - RNA, 15 nt, Mycobacterium tuberculosis H37Rv
uggccguccgaccga

SEQ ID NO: 3275215 - RNA, 15 nt, Mycobacterium tuberculosis H37Rv
uggccguccgguccg

SEQ ID NO: 3275216 - RNA, 19 nt, Mycobacterium tuberculosis H37Rv
uggccguggucgagguggg

SEQ ID NO: 3275217 - RNA, 17 nt, Mycobacterium tuberculosis H37Rv
uggccguuuguuuuguc

SEQ ID NO: 3275218 - RNA, 21 nt, Mycobacterium tuberculosis H37Rv
uggccuagccgcggcaccgcc

SEQ ID NO: 3275219 - RNA, 19 nt, Mycobacterium tuberculosis H37Rv
uggccucagccaccgggcg

SEQ ID NO: 3275220 - RNA, 15 nt, Mycobacterium tuberculosis H37Rv
uggccucagcccggc

SEQ ID NO: 3275221 - RNA, 13 nt, Mycobacterium tuberculosis H37Rv
uggccucauccac

SEQ ID NO: 3275222 - RNA, 16 nt, Mycobacterium tuberculosis H37Rv
uggccucauccaccga

SEQ ID NO: 3275223 - RNA, 18 nt, Mycobacterium tuberculosis H37Rv
uggccucccacggcgcgu

SEQ ID NO: 3275224 - RNA, 18 nt, Mycobacterium tuberculosis H37Rv
uggccucccacucaccca

SEQ ID NO: 3275225 - RNA, 13 nt, Mycobacterium tuberculosis H37Rv
uggccucgaaggg

SEQ ID NO: 3275226 - RNA, 14 nt, Mycobacterium tuberculosis H37Rv
uggccucgaagggc

SEQ ID NO: 3275227 - RNA, 19 nt, Mycobacterium tuberculosis H37Rv
uggccucguccagcucggu

SEQ ID NO: 3275228 - RNA, 21 nt, Mycobacterium tuberculosis H37Rv
uggccugauuccacugggccu

SEQ ID NO: 3275229 - RNA, 19 nt, Mycobacterium tuberculosis H37Rv
uggccugcccagcaccacc

SEQ ID NO: 3275230 - RNA, 22 nt, Mycobacterium tuberculosis H37Rv
uggccugucaggcggcggaccc

SEQ ID NO: 3275231 - RNA, 21 nt, Mycobacterium tuberculosis H37Rv
uggccuucugguucggguugg

SEQ ID NO: 3275232 - RNA, 23 nt, Mycobacterium tuberculosis H37Rv
uggccuucugguucggguuggag

SEQ ID NO: 3275233 - RNA, 17 nt, Mycobacterium tuberculosis H37Rv
uggccuugacagcuuuc

SEQ ID NO: 3275234 - RNA, 19 nt, Mycobacterium tuberculosis H37Rv
uggccuuguuguccuucag

SEQ ID NO: 3275235 - RNA, 19 nt, Mycobacterium tuberculosis H37Rv
uggccuuugagcgcggcca

SEQ ID NO: 3275236 - RNA, 17 nt, Mycobacterium tuberculosis H37Rv
uggccuuugccgucgag

SEQ ID NO: 3275237 - RNA, 15 nt, Mycobacterium tuberculosis H37Rv
uggcgaaaucgucga

SEQ ID NO: 3275238 - RNA, 13 nt, Mycobacterium tuberculosis H37Rv
uggcgaacagcac

SEQ ID NO: 3275239 - RNA, 18 nt, Mycobacterium tuberculosis H37Rv
uggcgaaccgucagcgcg

SEQ ID NO: 3275240 - RNA, 18 nt, Mycobacterium tuberculosis H37Rv
uggcgaaccucaccugac

SEQ ID NO: 3275241 - RNA, 20 nt, Mycobacterium tuberculosis H37Rv
uggcgaacugguagcccgga

SEQ ID NO: 3275242 - RNA, 13 nt, Mycobacterium tuberculosis H37Rv
uggcgaagaccgc

SEQ ID NO: 3275243 - RNA, 19 nt, Mycobacterium tuberculosis H37Rv
uggcgaaggacaacagccg

SEQ ID NO: 3275244 - RNA, 16 nt, Mycobacterium tuberculosis H37Rv
uggcgaaggccgcaau

SEQ ID NO: 3275245 - RNA, 15 nt, Mycobacterium tuberculosis H37Rv
uggcgaagucgucga

SEQ ID NO: 3275246 - RNA, 18 nt, Mycobacterium tuberculosis H37Rv
uggcgaagucgucgaggu

SEQ ID NO: 3275247 - RNA, 21 nt, Mycobacterium tuberculosis H37Rv
uggcgaagucgucgaggucac

SEQ ID NO: 3275248 - RNA, 17 nt, Mycobacterium tuberculosis H37Rv
uggcgaaugacggccag

SEQ ID NO: 3275249 - RNA, 19 nt, Mycobacterium tuberculosis H37Rv
uggcgacaucucggucaga

SEQ ID NO: 3275250 - RNA, 22 nt, Mycobacterium tuberculosis H37Rv
uggcgaccaccgcgucgggccg

SEQ ID NO: 3275251 - RNA, 13 nt, Mycobacterium tuberculosis H37Rv
uggcgaccugcgc

SEQ ID NO: 3275252 - RNA, 17 nt, Mycobacterium tuberculosis H37Rv
uggcgacgaacgccguc

SEQ ID NO: 3275253 - RNA, 15 nt, Mycobacterium tuberculosis H37Rv
uggcgacggacuccc

SEQ ID NO: 3275254 - RNA, 19 nt, Mycobacterium tuberculosis H37Rv
uggcgacgucggcggugac

SEQ ID NO: 3275255 - RNA, 21 nt, Mycobacterium tuberculosis H37Rv
uggcgagggcuaccggcgccg

SEQ ID NO: 3275256 - RNA, 16 nt, Mycobacterium tuberculosis H37Rv
uggcgggagccuuggu

SEQ ID NO: 3275257 - RNA, 19 nt, Mycobacterium tuberculosis H37Rv
uggcgggccggaugacgcc

SEQ ID NO: 3275258 - RNA, 22 nt, Mycobacterium tuberculosis H37Rv
uggcgggcgccuuggucgccgc

SEQ ID NO: 3275259 - RNA, 12 nt, Mycobacterium tuberculosis H37Rv
uggcgggcugaa

SEQ ID NO: 3275260 - RNA, 14 nt, Mycobacterium tuberculosis H37Rv
uggcgggcugaucg

SEQ ID NO: 3275261 - RNA, 15 nt, Mycobacterium tuberculosis H37Rv
uggcgggcugaucgc

SEQ ID NO: 3275262 - RNA, 16 nt, Mycobacterium tuberculosis H37Rv
uggcgggcugaucgcc

SEQ ID NO: 3275263 - RNA, 22 nt, Mycobacterium tuberculosis H37Rv
uggcgggugacuucguggccuu

SEQ ID NO: 3275264 - RNA, 16 nt, Mycobacterium tuberculosis H37Rv
uggcgggugcggcgau

SEQ ID NO: 3275265 - RNA, 20 nt, Mycobacterium tuberculosis H37Rv
uggcggguuggguggcaccg

SEQ ID NO: 3275266 - RNA, 22 nt, Mycobacterium tuberculosis H37Rv
uggcggucggcagaccgaccuc

SEQ ID NO: 3275267 - RNA, 17 nt, Mycobacterium tuberculosis H37Rv
uggcggugagccgccag

SEQ ID NO: 3275268 - RNA, 14 nt, Mycobacterium tuberculosis H37Rv
uggcggugcgcagc

SEQ ID NO: 3275269 - RNA, 17 nt, Mycobacterium tuberculosis H37Rv
uggcggugcugcuucaa

SEQ ID NO: 3275270 - RNA, 21 nt, Mycobacterium tuberculosis H37Rv
uggcgguggugccgcggccac

SEQ ID NO: 3275271 - RNA, 23 nt, Mycobacterium tuberculosis H37Rv
uggcgguguaacccggaaccagc

SEQ ID NO: 3275272 - RNA, 17 nt, Mycobacterium tuberculosis H37Rv
uggcgguuccggccggc

SEQ ID NO: 3275273 - RNA, 19 nt, Mycobacterium tuberculosis H37Rv
uggcguaauugucgauguc

SEQ ID NO: 3275274 - RNA, 23 nt, Mycobacterium tuberculosis H37Rv
uggcguagggcuguccgaccucg

SEQ ID NO: 3275275 - RNA, 16 nt, Mycobacterium tuberculosis H37Rv
uggcguauagcaugcc

SEQ ID NO: 3275276 - RNA, 12 nt, Mycobacterium tuberculosis H37Rv
uggcgucaccgc

SEQ ID NO: 3275277 - RNA, 13 nt, Mycobacterium tuberculosis H37Rv
uggcgucaccgcc

SEQ ID NO: 3275278 - RNA, 22 nt, Mycobacterium tuberculosis H37Rv
uggcgucgaaccagucgaagaa

SEQ ID NO: 3275279 - RNA, 22 nt, Mycobacterium tuberculosis H37Rv
uggcgucgacgucgacggcgau

SEQ ID NO: 3275280 - RNA, 13 nt, Mycobacterium tuberculosis H37Rv
uggcgucgauguc

SEQ ID NO: 3275281 - RNA, 22 nt, Mycobacterium tuberculosis H37Rv
uggcgucggugaaugccgucgc

SEQ ID NO: 3275282 - RNA, 12 nt, Mycobacterium tuberculosis H37Rv
uggcgugcagca

SEQ ID NO: 3275283 - RNA, 13 nt, Mycobacterium tuberculosis H37Rv
uggcguguggcuu

SEQ ID NO: 3275284 - RNA, 21 nt, Mycobacterium tuberculosis H37Rv
uggcguugaggacguggacuu

SEQ ID NO: 3275285 - RNA, 14 nt, Mycobacterium tuberculosis H37Rv
uggcguuguugacg

SEQ ID NO: 3275286 - RNA, 21 nt, Mycobacterium tuberculosis H37Rv
uggcguuugaugcgggcggca

SEQ ID NO: 3275287 - RNA, 13 nt, Mycobacterium tuberculosis H37Rv
uggcuacgcccca

SEQ ID NO: 3275288 - RNA, 19 nt, Mycobacterium tuberculosis H37Rv
uggcuacgccccacugccg

SEQ ID NO: 3275289 - RNA, 21 nt, Mycobacterium tuberculosis H37Rv
uggcuacgggccgcgguaccc

SEQ ID NO: 3275290 - RNA, 22 nt, Mycobacterium tuberculosis H37Rv
uggcuaguugggugggugcagc

SEQ ID NO: 3275291 - RNA, 23 nt, Mycobacterium tuberculosis H37Rv
uggcuaguugggugggugcagca

SEQ ID NO: 3275292 - RNA, 21 nt, Mycobacterium tuberculosis H37Rv
uggcuauccaccugcuggggc

SEQ ID NO: 3275293 - RNA, 13 nt, Mycobacterium tuberculosis H37Rv
uggcucacgcucc

SEQ ID NO: 3275294 - RNA, 18 nt, Mycobacterium tuberculosis H37Rv
uggcucccuuuuccaaag

SEQ ID NO: 3275295 - RNA, 18 nt, Mycobacterium tuberculosis H37Rv
uggcuccgaaguccacgc

SEQ ID NO: 3275296 - RNA, 17 nt, Mycobacterium tuberculosis H37Rv
uggcuccggccagggga

SEQ ID NO: 3275297 - RNA, 16 nt, Mycobacterium tuberculosis H37Rv
uggcuccggugaaccg

SEQ ID NO: 3275298 - RNA, 16 nt, Mycobacterium tuberculosis H37Rv
uggcucgaagcuggcg

SEQ ID NO: 3275299 - RNA, 20 nt, Mycobacterium tuberculosis H37Rv
uggcucgcggaugcucguug

SEQ ID NO: 3275300 - RNA, 14 nt, Mycobacterium tuberculosis H37Rv
uggcucggcauccc

SEQ ID NO: 3275301 - RNA, 19 nt, Mycobacterium tuberculosis H37Rv
uggcugaucccggccaggc

SEQ ID NO: 3275302 - RNA, 21 nt, Mycobacterium tuberculosis H37Rv
uggcugcgccgaacaccacac

SEQ ID NO: 3275303 - RNA, 19 nt, Mycobacterium tuberculosis H37Rv
uggcugcuguugguauuag

SEQ ID NO: 3275304 - RNA, 17 nt, Mycobacterium tuberculosis H37Rv
uggcuguccgcgggccg

SEQ ID NO: 3275305 - RNA, 17 nt, Mycobacterium tuberculosis H37Rv
uggcuucgaagcgaucg

SEQ ID NO: 3275306 - RNA, 22 nt, Mycobacterium tuberculosis H37Rv
uggcuucucccgccacugcugg

SEQ ID NO: 3275307 - RNA, 14 nt, Mycobacterium tuberculosis H37Rv
uggcuugcucugcg

SEQ ID NO: 3275308 - RNA, 18 nt, Mycobacterium tuberculosis H37Rv
uggcuugggccagcgcau

SEQ ID NO: 3275309 - RNA, 12 nt, Mycobacterium tuberculosis H37Rv
uggcuuucggua

SEQ ID NO: 3275310 - RNA, 19 nt, Mycobacterium tuberculosis H37Rv
uggcuuuugcgucugcucg

SEQ ID NO: 3275311 - RNA, 15 nt, Mycobacterium tuberculosis H37Rv
ugggaaccaccagca

SEQ ID NO: 3275312 - RNA, 17 nt, Mycobacterium tuberculosis H37Rv
ugggaagugcggugaga

SEQ ID NO: 3275313 - RNA, 21 nt, Mycobacterium tuberculosis H37Rv
ugggaaucagugaagacacca

SEQ ID NO: 3275314 - RNA, 21 nt, Mycobacterium tuberculosis H37Rv
ugggacaaagacgccgucggc

SEQ ID NO: 3275315 - RNA, 21 nt, Mycobacterium tuberculosis H37Rv
ugggacaggacgacuggaagg

SEQ ID NO: 3275316 - RNA, 21 nt, Mycobacterium tuberculosis H37Rv
ugggaccagugcgguggcagg

SEQ ID NO: 3275317 - RNA, 22 nt, Mycobacterium tuberculosis H37Rv
ugggaccgggcguuucccugcc

SEQ ID NO: 3275318 - RNA, 14 nt, Mycobacterium tuberculosis H37Rv
ugggacgcgcggau

SEQ ID NO: 3275319 - RNA, 20 nt, Mycobacterium tuberculosis H37Rv
ugggacgucuccaccgcgau

SEQ ID NO: 3275320 - RNA, 22 nt, Mycobacterium tuberculosis H37Rv
ugggagccaccggcgucgacgu

SEQ ID NO: 3275321 - RNA, 20 nt, Mycobacterium tuberculosis H37Rv
ugggagcuacccgggccagg

SEQ ID NO: 3275322 - RNA, 19 nt, Mycobacterium tuberculosis H37Rv
ugggaggcggcgccagugc

SEQ ID NO: 3275323 - RNA, 24 nt, Mycobacterium tuberculosis H37Rv
ugggauccgguggugggccguggg

SEQ ID NO: 3275324 - RNA, 20 nt, Mycobacterium tuberculosis H37Rv
ugggaugaccuuggccgugc

SEQ ID NO: 3275325 - RNA, 18 nt, Mycobacterium tuberculosis H37Rv
ugggauguucuuggucac

SEQ ID NO: 3275326 - RNA, 21 nt, Mycobacterium tuberculosis H37Rv
ugggcaaacugggcaccggcg

SEQ ID NO: 3275327 - RNA, 19 nt, Mycobacterium tuberculosis H37Rv
ugggcaagcugaccgccag

SEQ ID NO: 3275328 - RNA, 21 nt, Mycobacterium tuberculosis H37Rv
ugggcaauccggucagcgcgg

SEQ ID NO: 3275329 - RNA, 23 nt, Mycobacterium tuberculosis H37Rv
ugggcaauuccgccgagcgcaac

SEQ ID NO: 3275330 - RNA, 13 nt, Mycobacterium tuberculosis H37Rv
ugggcaccggcgg

SEQ ID NO: 3275331 - RNA, 19 nt, Mycobacterium tuberculosis H37Rv
ugggcaccuuggccaggaa

SEQ ID NO: 3275332 - RNA, 19 nt, Mycobacterium tuberculosis H37Rv
ugggcacggagaccgugga

SEQ ID NO: 3275333 - RNA, 20 nt, Mycobacterium tuberculosis H37Rv
ugggcagaaucggugggcgg

SEQ ID NO: 3275334 - RNA, 20 nt, Mycobacterium tuberculosis H37Rv
ugggcagaccgaucggcagg

SEQ ID NO: 3275335 - RNA, 19 nt, Mycobacterium tuberculosis H37Rv
ugggcagccagaucuccag

SEQ ID NO: 3275336 - RNA, 22 nt, Mycobacterium tuberculosis H37Rv
ugggcaucaccgacgcgucggc

SEQ ID NO: 3275337 - RNA, 13 nt, Mycobacterium tuberculosis H37Rv
ugggcaucaccgc

SEQ ID NO: 3275338 - RNA, 14 nt, Mycobacterium tuberculosis H37Rv
ugggcaucaccgcc

SEQ ID NO: 3275339 - RNA, 21 nt, Mycobacterium tuberculosis H37Rv
ugggcauugcggcgcgggugc

SEQ ID NO: 3275340 - RNA, 15 nt, Mycobacterium tuberculosis H37Rv
ugggccagcuccuga

SEQ ID NO: 3275341 - RNA, 15 nt, Mycobacterium tuberculosis H37Rv
ugggccaggcccagc

SEQ ID NO: 3275342 - RNA, 20 nt, Mycobacterium tuberculosis H37Rv
ugggccagugaaaccaccgg

SEQ ID NO: 3275343 - RNA, 23 nt, Mycobacterium tuberculosis H37Rv
ugggccaugcuaggaccaccagc

SEQ ID NO: 3275344 - RNA, 19 nt, Mycobacterium tuberculosis H37Rv
ugggcccagcggccgcgau

SEQ ID NO: 3275345 - RNA, 21 nt, Mycobacterium tuberculosis H37Rv
ugggcccaggagauccaccgg

SEQ ID NO: 3275346 - RNA, 22 nt, Mycobacterium tuberculosis H37Rv
ugggccccgaucccgaggggag

SEQ ID NO: 3275347 - RNA, 15 nt, Mycobacterium tuberculosis H37Rv
ugggccccgccgaug

SEQ ID NO: 3275348 - RNA, 17 nt, Mycobacterium tuberculosis H37Rv
ugggcccgccagcccag

SEQ ID NO: 3275349 - RNA, 19 nt, Mycobacterium tuberculosis H37Rv
ugggcccugcacagcagcg

SEQ ID NO: 3275350 - RNA, 14 nt, Mycobacterium tuberculosis H37Rv
ugggccgacgggac

SEQ ID NO: 3275351 - RNA, 18 nt, Mycobacterium tuberculosis H37Rv
ugggugccggcagcggcg

SEQ ID NO: 3275352 - RNA, 14 nt, Mycobacterium tuberculosis H37Rv
ugggugcgcggccg

SEQ ID NO: 3275353 - RNA, 13 nt, Mycobacterium tuberculosis H37Rv
uggguggcgucgc

SEQ ID NO: 3275354 - RNA, 19 nt, Mycobacterium tuberculosis H37Rv
uggguguugcuggccgcga

SEQ ID NO: 3275355 - RNA, 22 nt, Mycobacterium tuberculosis H37Rv
uggguguugucgucgagcgcgc

SEQ ID NO: 3275356 - RNA, 17 nt, Mycobacterium tuberculosis H37Rv
uggguuccguggaugga

SEQ ID NO: 3275357 - RNA, 19 nt, Mycobacterium tuberculosis H37Rv
uggguugauuggccccggc

SEQ ID NO: 3275358 - RNA, 24 nt, Mycobacterium tuberculosis H37Rv
uggguugcgaacucggccgugugc

SEQ ID NO: 3275359 - RNA, 19 nt, Mycobacterium tuberculosis H37Rv
uggguugugccgcccugga

SEQ ID NO: 3275360 - RNA, 23 nt, Mycobacterium tuberculosis H37Rv
uggguuucaaagcgacagcgcgg

SEQ ID NO: 3275361 - RNA, 21 nt, Mycobacterium tuberculosis H37Rv
ugguaaccagggcagccgggu

SEQ ID NO: 3275362 - RNA, 22 nt, Mycobacterium tuberculosis H37Rv
ugguaaccauauggcccgcgag

SEQ ID NO: 3275363 - RNA, 15 nt, Mycobacterium tuberculosis H37Rv
ugguacccaccaggg

SEQ ID NO: 3275364 - RNA, 16 nt, Mycobacterium tuberculosis H37Rv
ugguacccagcgcggc

SEQ ID NO: 3275365 - RNA, 18 nt, Mycobacterium tuberculosis H37Rv
ugguacccagcgcggcca

SEQ ID NO: 3275366 - RNA, 13 nt, Mycobacterium tuberculosis H37Rv
ugguagccagggc

SEQ ID NO: 3275367 - RNA, 23 nt, Mycobacterium tuberculosis H37Rv
ugguaguccccgaaccgagcgga

SEQ ID NO: 3275368 - RNA, 18 nt, Mycobacterium tuberculosis H37Rv
ugguaugccgcccgcagc

SEQ ID NO: 3275369 - RNA, 19 nt, Mycobacterium tuberculosis H37Rv
ugguauuuguccggcggac

SEQ ID NO: 3275370 - RNA, 13 nt, Mycobacterium tuberculosis H37Rv
uggucaacagcgg

SEQ ID NO: 3275371 - RNA, 15 nt, Mycobacterium tuberculosis H37Rv
uggucaacagcggca

SEQ ID NO: 3275372 - RNA, 17 nt, Mycobacterium tuberculosis H37Rv
uggucaacggccgacuu

SEQ ID NO: 3275373 - RNA, 19 nt, Mycobacterium tuberculosis H37Rv
uggucaagacccgcaucca

SEQ ID NO: 3275374 - RNA, 16 nt, Mycobacterium tuberculosis H37Rv
uggucaagaucagcgg

SEQ ID NO: 3275375 - RNA, 18 nt, Mycobacterium tuberculosis H37Rv
uggucacacccagcgcgc

SEQ ID NO: 3275376 - RNA, 15 nt, Mycobacterium tuberculosis H37Rv
uggucaccaccauca

SEQ ID NO: 3275377 - RNA, 12 nt, Mycobacterium tuberculosis H37Rv
uggucaccagcc

SEQ ID NO: 3275378 - RNA, 14 nt, Mycobacterium tuberculosis H37Rv
uggucaccagccac

SEQ ID NO: 3275379 - RNA, 15 nt, Mycobacterium tuberculosis H37Rv
uggucaccugcugca

SEQ ID NO: 3275380 - RNA, 17 nt, Mycobacterium tuberculosis H37Rv
uggucacggcgucgacu

SEQ ID NO: 3275381 - RNA, 12 nt, Mycobacterium tuberculosis H37Rv
uggucacgguuc

SEQ ID NO: 3275382 - RNA, 15 nt, Mycobacterium tuberculosis H37Rv
uggucagcagcucca

SEQ ID NO: 3275383 - RNA, 13 nt, Mycobacterium tuberculosis H37Rv
uggucagccgcgg

SEQ ID NO: 3275384 - RNA, 13 nt, Mycobacterium tuberculosis H37Rv
uggucagcuggcc

SEQ ID NO: 3275385 - RNA, 16 nt, Mycobacterium tuberculosis H37Rv
uggucagucaccaacc

SEQ ID NO: 3275386 - RNA, 21 nt, Mycobacterium tuberculosis H37Rv
uggucaguccgacaccggcgg

SEQ ID NO: 3275387 - RNA, 19 nt, Mycobacterium tuberculosis H37Rv
uggucagugugaacugucc

SEQ ID NO: 3275388 - RNA, 14 nt, Mycobacterium tuberculosis H37Rv
uggucauccagcca

SEQ ID NO: 3275389 - RNA, 19 nt, Mycobacterium tuberculosis H37Rv
uggucauguucggggcgca

SEQ ID NO: 3275390 - RNA, 17 nt, Mycobacterium tuberculosis H37Rv
ugguccaaccagcacca

SEQ ID NO: 3275391 - RNA, 13 nt, Mycobacterium tuberculosis H37Rv
ugguccaaccggg

SEQ ID NO: 3275392 - RNA, 18 nt, Mycobacterium tuberculosis H37Rv
ugguccaggcccuggcca

SEQ ID NO: 3275393 - RNA, 21 nt, Mycobacterium tuberculosis H37Rv
uggucccgagggcggcagcua

SEQ ID NO: 3275394 - RNA, 19 nt, Mycobacterium tuberculosis H37Rv
uggucccgaugaccuugcc

SEQ ID NO: 3275395 - RNA, 20 nt, Mycobacterium tuberculosis H37Rv
ugguccgggugccggugcgc

SEQ ID NO: 3275396 - RNA, 20 nt, Mycobacterium tuberculosis H37Rv
uggucgaaacgguacgccgc

SEQ ID NO: 3275397 - RNA, 22 nt, Mycobacterium tuberculosis H37Rv
uggucgaaacgguacgccgccg

SEQ ID NO: 3275398 - RNA, 20 nt, Mycobacterium tuberculosis H37Rv
uggucgaagaucgccugggg

SEQ ID NO: 3275399 - RNA, 23 nt, Mycobacterium tuberculosis H37Rv
uggucgaauaguugaccaggccg

SEQ ID NO: 3275400 - RNA, 15 nt, Mycobacterium tuberculosis H37Rv
uggucgacgccgaga

SEQ ID NO: 3275401 - RNA, 20 nt, Mycobacterium tuberculosis H37Rv
uggucgacgucgguguaacc

SEQ ID NO: 3275402 - RNA, 19 nt, Mycobacterium tuberculosis H37Rv
uggucgagcacgcugcugc

SEQ ID NO: 3275403 - RNA, 22 nt, Mycobacterium tuberculosis H37Rv
uggucgagucgaugaccccggu

SEQ ID NO: 3275404 - RNA, 16 nt, Mycobacterium tuberculosis H37Rv
uggucgaguugaagaa

SEQ ID NO: 3275405 - RNA, 16 nt, Mycobacterium tuberculosis H37Rv
uggucgaucagguacu

SEQ ID NO: 3275406 - RNA, 16 nt, Mycobacterium tuberculosis H37Rv
uggucgaugugaucac

SEQ ID NO: 3275407 - RNA, 18 nt, Mycobacterium tuberculosis H37Rv
uggucgcaccgccggccu

SEQ ID NO: 3275408 - RNA, 21 nt, Mycobacterium tuberculosis H37Rv
uggucgcaggauucccagucc

SEQ ID NO: 3275409 - RNA, 14 nt, Mycobacterium tuberculosis H37Rv
uggucgccaugucg

SEQ ID NO: 3275410 - RNA, 13 nt, Mycobacterium tuberculosis H37Rv
uggucgccccgau

SEQ ID NO: 3275411 - RNA, 16 nt, Mycobacterium tuberculosis H37Rv
uggucgccgcggcagc

SEQ ID NO: 3275412 - RNA, 22 nt, Mycobacterium tuberculosis H37Rv
uggucgccggcgucgagccgga

SEQ ID NO: 3275413 - RNA, 14 nt, Mycobacterium tuberculosis H37Rv
uggucgccgggcag

SEQ ID NO: 3275414 - RNA, 18 nt, Mycobacterium tuberculosis H37Rv
uggucgcgaccgaccgca

SEQ ID NO: 3275415 - RNA, 14 nt, Mycobacterium tuberculosis H37Rv
uggucgcgccaccc

SEQ ID NO: 3275416 - RNA, 20 nt, Mycobacterium tuberculosis H37Rv
uggucgcggucccacggccg

SEQ ID NO: 3275417 - RNA, 18 nt, Mycobacterium tuberculosis H37Rv
uggucgcgguggcggcgg

SEQ ID NO: 3275418 - RNA, 17 nt, Mycobacterium tuberculosis H37Rv
uggucggacagcgucuc

SEQ ID NO: 3275419 - RNA, 13 nt, Mycobacterium tuberculosis H37Rv
uggucggccaccc

SEQ ID NO: 3275420 - RNA, 16 nt, Mycobacterium tuberculosis H37Rv
uggucggccaggucga

SEQ ID NO: 3275421 - RNA, 19 nt, Mycobacterium tuberculosis H37Rv
uggucggccaggucgagca

SEQ ID NO: 3275422 - RNA, 13 nt, Mycobacterium tuberculosis H37Rv
uggucggcgacgu

SEQ ID NO: 3275423 - RNA, 20 nt, Mycobacterium tuberculosis H37Rv
uggucggcuacggccagugc

SEQ ID NO: 3275424 - RNA, 14 nt, Mycobacterium tuberculosis H37Rv
uggucggcucguca

SEQ ID NO: 3275425 - RNA, 13 nt, Mycobacterium tuberculosis H37Rv
uggucgggucgca

SEQ ID NO: 3275426 - RNA, 16 nt, Mycobacterium tuberculosis H37Rv
uggucggugacugugc

SEQ ID NO: 3275427 - RNA, 20 nt, Mycobacterium tuberculosis H37Rv
uggucggugccagcaccacg

SEQ ID NO: 3275428 - RNA, 19 nt, Mycobacterium tuberculosis H37Rv
uggucgucauccuggucac

SEQ ID NO: 3275429 - RNA, 20 nt, Mycobacterium tuberculosis H37Rv
uggucgucauccuggucacc

SEQ ID NO: 3275430 - RNA, 24 nt, Mycobacterium tuberculosis H37Rv
uggucgucggaguaccgcgcguug

SEQ ID NO: 3275431 - RNA, 22 nt, Mycobacterium tuberculosis H37Rv
uggucgugggccaccaccucgg

SEQ ID NO: 3275432 - RNA, 17 nt, Mycobacterium tuberculosis H37Rv
uggucuccggcaccgag

SEQ ID NO: 3275433 - RNA, 15 nt, Mycobacterium tuberculosis H37Rv
uggucucgguaggcg

SEQ ID NO: 3275434 - RNA, 12 nt, Mycobacterium tuberculosis H37Rv
uggucugccagc

SEQ ID NO: 3275435 - RNA, 18 nt, Mycobacterium tuberculosis H37Rv
uggugaagccguagacgu

SEQ ID NO: 3275436 - RNA, 16 nt, Mycobacterium tuberculosis H37Rv
uggugaaggcaaacac

SEQ ID NO: 3275437 - RNA, 21 nt, Mycobacterium tuberculosis H37Rv
uggugacccugaugaucgucc

SEQ ID NO: 3275438 - RNA, 16 nt, Mycobacterium tuberculosis H37Rv
uggugacggugaagcc

SEQ ID NO: 3275439 - RNA, 17 nt, Mycobacterium tuberculosis H37Rv
uggugagccucggcgag

SEQ ID NO: 3275440 - RNA, 14 nt, Mycobacterium tuberculosis H37Rv
uggugaggcccccc

SEQ ID NO: 3275441 - RNA, 15 nt, Mycobacterium tuberculosis H37Rv
uggugagguggucag

SEQ ID NO: 3275442 - RNA, 17 nt, Mycobacterium tuberculosis H37Rv
uggugaucacgucggau

SEQ ID NO: 3275443 - RNA, 22 nt, Mycobacterium tuberculosis H37Rv
uggugaucugcugggcaagauc

SEQ ID NO: 3275444 - RNA, 20 nt, Mycobacterium tuberculosis H37Rv
uggugaugccgaugaccgcc

SEQ ID NO: 3275445 - RNA, 21 nt, Mycobacterium tuberculosis H37Rv
uggugaugggggagccgguga

SEQ ID NO: 3275446 - RNA, 23 nt, Mycobacterium tuberculosis H37Rv
uggugcacggcuuuucgacgcug

SEQ ID NO: 3275447 - RNA, 22 nt, Mycobacterium tuberculosis H37Rv
uugggcuuagggcgcccgcccc

SEQ ID NO: 3275448 - RNA, 22 nt, Mycobacterium tuberculosis H37Rv
uuggggcgcgugggcgugcagg

SEQ ID NO: 3275449 - RNA, 20 nt, Mycobacterium tuberculosis H37Rv
uugggggcuucugcgucugc

SEQ ID NO: 3275450 - RNA, 20 nt, Mycobacterium tuberculosis H37Rv
uugggugccguugcgucugc

SEQ ID NO: 3275451 - RNA, 17 nt, Mycobacterium tuberculosis H37Rv
uugggugggugcagcac

SEQ ID NO: 3275452 - RNA, 13 nt, Mycobacterium tuberculosis H37Rv
uuggguuucgaca

SEQ ID NO: 3275453 - RNA, 18 nt, Mycobacterium tuberculosis H37Rv
uuggguuuuguuuggaga

SEQ ID NO: 3275454 - RNA, 15 nt, Mycobacterium tuberculosis H37Rv
uugguagccagggcg

SEQ ID NO: 3275455 - RNA, 22 nt, Mycobacterium tuberculosis H37Rv
uugguagccggccgcuuggccg

SEQ ID NO: 3275456 - RNA, 14 nt, Mycobacterium tuberculosis H37Rv
uugguaguccugcu

SEQ ID NO: 3275457 - RNA, 16 nt, Mycobacterium tuberculosis H37Rv
uugguaguccugcuug

SEQ ID NO: 3275458 - RNA, 18 nt, Mycobacterium tuberculosis H37Rv
uuggucagcguggacgcc

SEQ ID NO: 3275459 - RNA, 17 nt, Mycobacterium tuberculosis H37Rv
uuggucagugugaacug

SEQ ID NO: 3275460 - RNA, 14 nt, Mycobacterium tuberculosis H37Rv
uugguccucggcgg

SEQ ID NO: 3275461 - RNA, 11 nt, Mycobacterium tuberculosis H37Rv
uuggucgccau

SEQ ID NO: 3275462 - RNA, 18 nt, Mycobacterium tuberculosis H37Rv
uuggucgccgcuuucuug

SEQ ID NO: 3275463 - RNA, 13 nt, Mycobacterium tuberculosis H37Rv
uuggucgccggcg

SEQ ID NO: 3275464 - RNA, 14 nt, Mycobacterium tuberculosis H37Rv
uuggucuugaaccc

SEQ ID NO: 3275465 - RNA, 22 nt, Mycobacterium tuberculosis H37Rv
uuggugcggaccugcgccggug

SEQ ID NO: 3275466 - RNA, 22 nt, Mycobacterium tuberculosis H37Rv
uugguggauucgaucaggccuu

SEQ ID NO: 3275467 - RNA, 22 nt, Mycobacterium tuberculosis H37Rv
uugguggcguggcccucggcga

SEQ ID NO: 3275468 - RNA, 13 nt, Mycobacterium tuberculosis H37Rv
uugguggcuggug

SEQ ID NO: 3275469 - RNA, 18 nt, Mycobacterium tuberculosis H37Rv
uuggugggccagcagcaa

SEQ ID NO: 3275470 - RNA, 19 nt, Mycobacterium tuberculosis H37Rv
uugguggucgccacccgac

SEQ ID NO: 3275471 - RNA, 16 nt, Mycobacterium tuberculosis H37Rv
uugguguauucgcgga

SEQ ID NO: 3275472 - RNA, 13 nt, Mycobacterium tuberculosis H37Rv
uugguguccacca

SEQ ID NO: 3275473 - RNA, 17 nt, Mycobacterium tuberculosis H37Rv
uuguagacggcaccccc

SEQ ID NO: 3275474 - RNA, 17 nt, Mycobacterium tuberculosis H37Rv
uuguagcgggcaagaug

SEQ ID NO: 3275475 - RNA, 19 nt, Mycobacterium tuberculosis H37Rv
uugucaggauauuucuaaa

SEQ ID NO: 3275476 - RNA, 16 nt, Mycobacterium tuberculosis H37Rv
uuguccagggugguca

SEQ ID NO: 3275477 - RNA, 17 nt, Mycobacterium tuberculosis H37Rv
uuguccggugguggcga

SEQ ID NO: 3275478 - RNA, 18 nt, Mycobacterium tuberculosis H37Rv
uuguccuaauucggggcc

SEQ ID NO: 3275479 - RNA, 13 nt, Mycobacterium tuberculosis H37Rv
uugucgcagcgca

SEQ ID NO: 3275480 - RNA, 23 nt, Mycobacterium tuberculosis H37Rv
uugucgccggcauacaccgugac

SEQ ID NO: 3275481 - RNA, 13 nt, Mycobacterium tuberculosis H37Rv
uugucgcgcagca

SEQ ID NO: 3275482 - RNA, 19 nt, Mycobacterium tuberculosis H37Rv
uugucggagcuagacccgu

SEQ ID NO: 3275483 - RNA, 11 nt, Mycobacterium tuberculosis H37Rv
uugucggcgau

SEQ ID NO: 3275484 - RNA, 21 nt, Mycobacterium tuberculosis H37Rv
uugucuagcggucgcuugcug

SEQ ID NO: 3275485 - RNA, 15 nt, Mycobacterium tuberculosis H37Rv
uugugccuuagcugc

SEQ ID NO: 3275486 - RNA, 18 nt, Mycobacterium tuberculosis H37Rv
uugugcgggcuccaugcc

SEQ ID NO: 3275487 - RNA, 15 nt, Mycobacterium tuberculosis H37Rv
uuguggcguguggcu

SEQ ID NO: 3275488 - RNA, 16 nt, Mycobacterium tuberculosis H37Rv
uugugggugguccagc

SEQ ID NO: 3275489 - RNA, 19 nt, Mycobacterium tuberculosis H37Rv
uuguggucagcugcugcca

SEQ ID NO: 3275490 - RNA, 17 nt, Mycobacterium tuberculosis H37Rv
uuguggucgaguugaag

SEQ ID NO: 3275491 - RNA, 17 nt, Mycobacterium tuberculosis H37Rv
uuguuccagcgcaucga

SEQ ID NO: 3275492 - RNA, 17 nt, Mycobacterium tuberculosis H37Rv
uuguuccguccccgacg

SEQ ID NO: 3275493 - RNA, 14 nt, Mycobacterium tuberculosis H37Rv
uuguugaagccgau

SEQ ID NO: 3275494 - RNA, 23 nt, Mycobacterium tuberculosis H37Rv
uuguugccgacgaucgacgccgc

SEQ ID NO: 3275495 - RNA, 15 nt, Mycobacterium tuberculosis H37Rv
cggcggguagcucgc

SEQ ID NO: 3275496 - RNA, 19 nt, Mycobacterium tuberculosis H37Rv
cggcggguagcucgcugac

SEQ ID NO: 3275497 - RNA, 15 nt, Mycobacterium tuberculosis H37Rv
cggcgggucaggcca

SEQ ID NO: 3275498 - RNA, 19 nt, Mycobacterium tuberculosis H37Rv
cggcggguccucgcggagc

SEQ ID NO: 3275499 - RNA, 13 nt, Mycobacterium tuberculosis H37Rv
cggcggguggcgc

SEQ ID NO: 3275500 - RNA, 15 nt, Mycobacterium tuberculosis H37Rv
cggcggguggcgcca

SEQ ID NO: 3275501 - RNA, 17 nt, Mycobacterium tuberculosis H37Rv
cggcggguggcgccagu

SEQ ID NO: 3275502 - RNA, 23 nt, Mycobacterium tuberculosis H37Rv
cggcgguaaaugccugcccaccu

SEQ ID NO: 3275503 - RNA, 18 nt, Mycobacterium tuberculosis H37Rv
cggcgguaagggcgggcu

SEQ ID NO: 3275504 - RNA, 21 nt, Mycobacterium tuberculosis H37Rv
cggcgguaccagagcagcuca

SEQ ID NO: 3275505 - RNA, 13 nt, Mycobacterium tuberculosis H37Rv
cggcgguaccgcc

SEQ ID NO: 3275506 - RNA, 15 nt, Mycobacterium tuberculosis H37Rv
cggcgguaccgccgc

SEQ ID NO: 3275507 - RNA, 23 nt, Mycobacterium tuberculosis H37Rv
cggcgguaccggaaucggcggcg

SEQ ID NO: 3275508 - RNA, 20 nt, Mycobacterium tuberculosis H37Rv
cggcgguagccgaccagcgc

SEQ ID NO: 3275509 - RNA, 19 nt, Mycobacterium tuberculosis H37Rv
cggcgguaguacucgcgca

SEQ ID NO: 3275510 - RNA, 21 nt, Mycobacterium tuberculosis H37Rv
cggcgguaguacucgcgcagg

SEQ ID NO: 3275511 - RNA, 19 nt, Mycobacterium tuberculosis H37Rv
cggcgguagucggccagcu

SEQ ID NO: 3275512 - RNA, 21 nt, Mycobacterium tuberculosis H37Rv
cggcgguaugccacaggcugc

SEQ ID NO: 3275513 - RNA, 23 nt, Mycobacterium tuberculosis H37Rv
cggcgguaugccacaggcugcca

SEQ ID NO: 3275514 - RNA, 15 nt, Mycobacterium tuberculosis H37Rv
cggcggucagcagcg

SEQ ID NO: 3275515 - RNA, 17 nt, Mycobacterium tuberculosis H37Rv
cggcgguccgcgcgacc

SEQ ID NO: 3275516 - RNA, 18 nt, Mycobacterium tuberculosis H37Rv
cggcgguccgcgcgacca

SEQ ID NO: 3275517 - RNA, 13 nt, Mycobacterium tuberculosis H37Rv
cggcggucgagcu

SEQ ID NO: 3275518 - RNA, 13 nt, Mycobacterium tuberculosis H37Rv
cggcggucgccag

SEQ ID NO: 3275519 - RNA, 21 nt, Mycobacterium tuberculosis H37Rv
cggcggucgccagucgauucg

SEQ ID NO: 3275520 - RNA, 18 nt, Mycobacterium tuberculosis H37Rv
cggcggucggcugggcga

SEQ ID NO: 3275521 - RNA, 23 nt, Mycobacterium tuberculosis H37Rv
cggcggucucacguugugagcca

SEQ ID NO: 3275522 - RNA, 21 nt, Mycobacterium tuberculosis H37Rv
cggcggucucgucaaccugcg

SEQ ID NO: 3275523 - RNA, 21 nt, Mycobacterium tuberculosis H37Rv
cggcggucugagacucgucga

SEQ ID NO: 3275524 - RNA, 17 nt, Mycobacterium tuberculosis H37Rv
cggcggucugcagugca

SEQ ID NO: 3275525 - RNA, 23 nt, Mycobacterium tuberculosis H37Rv
cggcggucugcagugcagcgauc

SEQ ID NO: 3275526 - RNA, 16 nt, Mycobacterium tuberculosis H37Rv
cggcggucuuggcgcg

SEQ ID NO: 3275527 - RNA, 20 nt, Mycobacterium tuberculosis H37Rv
cggcggucuuggcgcgccca

SEQ ID NO: 3275528 - RNA, 20 nt, Mycobacterium tuberculosis H37Rv
cggcggugaaaucgcacagc

SEQ ID NO: 3275529 - RNA, 20 nt, Mycobacterium tuberculosis H37Rv
cggcggugaacgacgggucg

SEQ ID NO: 3275530 - RNA, 22 nt, Mycobacterium tuberculosis H37Rv
cggcggugcagaucggcucacc

SEQ ID NO: 3275531 - RNA, 14 nt, Mycobacterium tuberculosis H37Rv
cggcggugcagcag

SEQ ID NO: 3275532 - RNA, 22 nt, Mycobacterium tuberculosis H37Rv
cggcggugcagcagggcgcgca

SEQ ID NO: 3275533 - RNA, 21 nt, Mycobacterium tuberculosis H37Rv
cggcggugccacgaucggcgg

SEQ ID NO: 3275534 - RNA, 22 nt, Mycobacterium tuberculosis H37Rv
cggcggugccacgaucggcggg

SEQ ID NO: 3275535 - RNA, 15 nt, Mycobacterium tuberculosis H37Rv
cggcggugcccagca

SEQ ID NO: 3275536 - RNA, 21 nt, Mycobacterium tuberculosis H37Rv
cggcggugcccagcagcgcga

SEQ ID NO: 3275537 - RNA, 18 nt, Mycobacterium tuberculosis H37Rv
cggcggugccgacggugg

SEQ ID NO: 3275538 - RNA, 21 nt, Mycobacterium tuberculosis H37Rv
cggcggugccgcggcuaggcc

SEQ ID NO: 3275539 - RNA, 17 nt, Mycobacterium tuberculosis H37Rv
cggcggugcgcugauga

SEQ ID NO: 3275540 - RNA, 14 nt, Mycobacterium tuberculosis H37Rv
cggcgguggccagc

SEQ ID NO: 3275541 - RNA, 15 nt, Mycobacterium tuberculosis H37Rv
cggcgguggccagcg

SEQ ID NO: 3275542 - RNA, 16 nt, Mycobacterium tuberculosis H37Rv
cggcgguggcguuacg

SEQ ID NO: 3275543 - RNA, 22 nt, Mycobacterium tuberculosis H37Rv
cggcgguggcguuacgggcgau

SEQ ID NO: 3275544 - RNA, 14 nt, Mycobacterium tuberculosis H37Rv
cggcggugggucgu

SEQ ID NO: 3275545 - RNA, 18 nt, Mycobacterium tuberculosis H37Rv
cggcggugguaccggcgc

SEQ ID NO: 3275546 - RNA, 14 nt, Mycobacterium tuberculosis H37Rv
cggcggugucgacc

SEQ ID NO: 3275547 - RNA, 14 nt, Mycobacterium tuberculosis H37Rv
cggcggugugcgca

SEQ ID NO: 3275548 - RNA, 17 nt, Mycobacterium tuberculosis H37Rv
cggcggugugcgcaugg

SEQ ID NO: 3275549 - RNA, 23 nt, Mycobacterium tuberculosis H37Rv
cggcgguguuggcgccagccccg

SEQ ID NO: 3275550 - RNA, 23 nt, Mycobacterium tuberculosis H37Rv
cggcgguuaucgucgggucaccc

SEQ ID NO: 3275551 - RNA, 23 nt, Mycobacterium tuberculosis H37Rv
cggcgguuccauacagccgccga

SEQ ID NO: 3275552 - RNA, 22 nt, Mycobacterium tuberculosis H37Rv
cggcgguugccccgaccgccgu

SEQ ID NO: 3275553 - RNA, 19 nt, Mycobacterium tuberculosis H37Rv
cggcgguuggugcagcgug

SEQ ID NO: 3275554 - RNA, 16 nt, Mycobacterium tuberculosis H37Rv
cggcguaaccggcagc

SEQ ID NO: 3275555 - RNA, 17 nt, Mycobacterium tuberculosis H37Rv
cggcguacaaaccgucg

SEQ ID NO: 3275556 - RNA, 18 nt, Mycobacterium tuberculosis H37Rv
cggcguacaaaccgucgg

SEQ ID NO: 3275557 - RNA, 20 nt, Mycobacterium tuberculosis H37Rv
cggcguacaaaccgucgggg

SEQ ID NO: 3275558 - RNA, 20 nt, Mycobacterium tuberculosis H37Rv
cggcguacagcgccugggug

SEQ ID NO: 3275559 - RNA, 24 nt, Mycobacterium tuberculosis H37Rv
cggcguacccguuaugcgccgccc

SEQ ID NO: 3275560 - RNA, 15 nt, Mycobacterium tuberculosis H37Rv
cggcguacgccggac

SEQ ID NO: 3275561 - RNA, 18 nt, Mycobacterium tuberculosis H37Rv
cggcguacucgugcaccg

SEQ ID NO: 3275562 - RNA, 21 nt, Mycobacterium tuberculosis H37Rv
cggcguacucgugcaccgucg

SEQ ID NO: 3275563 - RNA, 22 nt, Mycobacterium tuberculosis H37Rv
cggcguacucgugcaccgucgg

SEQ ID NO: 3275564 - RNA, 22 nt, Mycobacterium tuberculosis H37Rv
cggcguacuucgacagcggcga

SEQ ID NO: 3275565 - RNA, 14 nt, Mycobacterium tuberculosis H37Rv
cggcguagacgucc

SEQ ID NO: 3275566 - RNA, 21 nt, Mycobacterium tuberculosis H37Rv
cggcguagaucaucagcgacu

SEQ ID NO: 3275567 - RNA, 22 nt, Mycobacterium tuberculosis H37Rv
cggcguagaugcgcccggcgug

SEQ ID NO: 3275568 - RNA, 18 nt, Mycobacterium tuberculosis H37Rv
cggcguagcgagcgggug

SEQ ID NO: 3275569 - RNA, 16 nt, Mycobacterium tuberculosis H37Rv
cggcguaggcaggauc

SEQ ID NO: 3275570 - RNA, 15 nt, Mycobacterium tuberculosis H37Rv
cggcguaggcgaugg

SEQ ID NO: 3275571 - RNA, 18 nt, Mycobacterium tuberculosis H37Rv
cggcguaggcggucagau

SEQ ID NO: 3275572 - RNA, 16 nt, Mycobacterium tuberculosis H37Rv
cggcguauugcaccgc

SEQ ID NO: 3275573 - RNA, 20 nt, Mycobacterium tuberculosis H37Rv
cggcguauugcaccgccagg

SEQ ID NO: 3275574 - RNA, 22 nt, Mycobacterium tuberculosis H37Rv
cggcgucaaaggccuugacgua

SEQ ID NO: 3275575 - RNA, 18 nt, Mycobacterium tuberculosis H37Rv
cggcgucaaauccagcga

SEQ ID NO: 3275576 - RNA, 19 nt, Mycobacterium tuberculosis H37Rv
cggcgucacggcgugacca

SEQ ID NO: 3275577 - RNA, 20 nt, Mycobacterium tuberculosis H37Rv
cggcgucacggcgugaccac

SEQ ID NO: 3275578 - RNA, 15 nt, Mycobacterium tuberculosis H37Rv
cggcgucagccccga

SEQ ID NO: 3275579 - RNA, 20 nt, Mycobacterium tuberculosis H37Rv
cggcgucaggcacaacgcga

SEQ ID NO: 3275580 - RNA, 20 nt, Mycobacterium tuberculosis H37Rv
cggcguccaagaacggaugc

SEQ ID NO: 3275581 - RNA, 15 nt, Mycobacterium tuberculosis H37Rv
cggcguccagcagcg

SEQ ID NO: 3275582 - RNA, 16 nt, Mycobacterium tuberculosis H37Rv
cggcguccaggcagcg

SEQ ID NO: 3275583 - RNA, 21 nt, Mycobacterium tuberculosis H37Rv
cggcguccagggcgccacuga

SEQ ID NO: 3275584 - RNA, 13 nt, Mycobacterium tuberculosis H37Rv
cggcguccgaccg

SEQ ID NO: 3275585 - RNA, 21 nt, Mycobacterium tuberculosis H37Rv
cggcguccgggaucuccccaa

SEQ ID NO: 3275586 - RNA, 17 nt, Mycobacterium tuberculosis H37Rv
cggcguccuugcgcagc

SEQ ID NO: 3275587 - RNA, 21 nt, Mycobacterium tuberculosis H37Rv
cggcguccuugcgcagcacca

SEQ ID NO: 3275588 - RNA, 14 nt, Mycobacterium tuberculosis H37Rv
cggcgucgaagcac

SEQ ID NO: 3275589 - RNA, 19 nt, Mycobacterium tuberculosis H37Rv
cggcgucgaagugggugaa

SEQ ID NO: 3275590 - RNA, 16 nt, Mycobacterium tuberculosis H37Rv
cggcuaccgcgcuccc

SEQ ID NO: 3275591 - RNA, 19 nt, Mycobacterium tuberculosis H37Rv
cggcuaccgcgcucccggc

SEQ ID NO: 3275592 - RNA, 20 nt, Mycobacterium tuberculosis H37Rv
cggcuaccgcgcucccggcg

SEQ ID NO: 3275593 - RNA, 21 nt, Mycobacterium tuberculosis H37Rv
cggcuaccgcgcucccggcgu

SEQ ID NO: 3275594 - RNA, 15 nt, Mycobacterium tuberculosis H37Rv
cggcuaccggcgugu

SEQ ID NO: 3275595 - RNA, 15 nt, Mycobacterium tuberculosis H37Rv
cggcuacggcugccc

SEQ ID NO: 3275596 - RNA, 16 nt, Mycobacterium tuberculosis H37Rv
cggcuagcaacggguc

SEQ ID NO: 3275597 - RNA, 13 nt, Mycobacterium tuberculosis H37Rv
cggcuagcucucg

SEQ ID NO: 3275598 - RNA, 19 nt, Mycobacterium tuberculosis H37Rv
cggcuaggccaagccgcgg

SEQ ID NO: 3275599 - RNA, 17 nt, Mycobacterium tuberculosis H37Rv
cggcuaggccagcacgg

SEQ ID NO: 3275600 - RNA, 15 nt, Mycobacterium tuberculosis H37Rv
cggcuaggccggccg

SEQ ID NO: 3275601 - RNA, 16 nt, Mycobacterium tuberculosis H37Rv
cggcuaggccggccgg

SEQ ID NO: 3275602 - RNA, 21 nt, Mycobacterium tuberculosis H37Rv
cggcuagggcagcagcccggg

SEQ ID NO: 3275603 - RNA, 19 nt, Mycobacterium tuberculosis H37Rv
cggcuagggcccuggcggc

SEQ ID NO: 3275604 - RNA, 19 nt, Mycobacterium tuberculosis H37Rv
cggcuaggucagcgggcuu

SEQ ID NO: 3275605 - RNA, 14 nt, Mycobacterium tuberculosis H37Rv
cggcuagucaaguc

SEQ ID NO: 3275606 - RNA, 24 nt, Mycobacterium tuberculosis H37Rv
cggcuagucaagucuggcugagca

SEQ ID NO: 3275607 - RNA, 16 nt, Mycobacterium tuberculosis H37Rv
cggcuagugcauuguc

SEQ ID NO: 3275608 - RNA, 20 nt, Mycobacterium tuberculosis H37Rv
cggcuauaucccgccccggg

SEQ ID NO: 3275609 - RNA, 17 nt, Mycobacterium tuberculosis H37Rv
cggcuaucgcuagccgg

SEQ ID NO: 3275610 - RNA, 19 nt, Mycobacterium tuberculosis H37Rv
cggcuaucgcuagccggcu

SEQ ID NO: 3275611 - RNA, 22 nt, Mycobacterium tuberculosis H37Rv
cggcucaacaccgaguuccucu

SEQ ID NO: 3275612 - RNA, 23 nt, Mycobacterium tuberculosis H37Rv
cggcucaaggacgcaccgccagu

SEQ ID NO: 3275613 - RNA, 15 nt, Mycobacterium tuberculosis H37Rv
cggcucaaucuccuc

SEQ ID NO: 3275614 - RNA, 18 nt, Mycobacterium tuberculosis H37Rv
cggcucaaucuccuccgc

SEQ ID NO: 3275615 - RNA, 15 nt, Mycobacterium tuberculosis H37Rv
cggcucacagcacag

SEQ ID NO: 3275616 - RNA, 22 nt, Mycobacterium tuberculosis H37Rv
cggcucacagcacagcgcagcc

SEQ ID NO: 3275617 - RNA, 13 nt, Mycobacterium tuberculosis H37Rv
cggcucaccgaac

SEQ ID NO: 3275618 - RNA, 16 nt, Mycobacterium tuberculosis H37Rv
cggcucaccgaacgcg

SEQ ID NO: 3275619 - RNA, 14 nt, Mycobacterium tuberculosis H37Rv
cggcucaccgcgca

SEQ ID NO: 3275620 - RNA, 16 nt, Mycobacterium tuberculosis H37Rv
cggcucaccgcgcauc

SEQ ID NO: 3275621 - RNA, 21 nt, Mycobacterium tuberculosis H37Rv
cggcucaccgcgcaucaucgc

SEQ ID NO: 3275622 - RNA, 15 nt, Mycobacterium tuberculosis H37Rv
cggcucaucgcagcc

SEQ ID NO: 3275623 - RNA, 18 nt, Mycobacterium tuberculosis H37Rv
cggcuccaacgauggaac

SEQ ID NO: 3275624 - RNA, 13 nt, Mycobacterium tuberculosis H37Rv
cggcuccacccac

SEQ ID NO: 3275625 - RNA, 20 nt, Mycobacterium tuberculosis H37Rv
cggcuccacccccacgcugc

SEQ ID NO: 3275626 - RNA, 16 nt, Mycobacterium tuberculosis H37Rv
cggcuccaccgggccc

SEQ ID NO: 3275627 - RNA, 14 nt, Mycobacterium tuberculosis H37Rv
cggcuccagcaccg

SEQ ID NO: 3275628 - RNA, 17 nt, Mycobacterium tuberculosis H37Rv
cggcuccagcaugggcg

SEQ ID NO: 3275629 - RNA, 20 nt, Mycobacterium tuberculosis H37Rv
cggcuccagguccacaucca

SEQ ID NO: 3275630 - RNA, 22 nt, Mycobacterium tuberculosis H37Rv
cggcuccagguccacauccagg

SEQ ID NO: 3275631 - RNA, 19 nt, Mycobacterium tuberculosis H37Rv
cggcucccauggcgcgagc

SEQ ID NO: 3275632 - RNA, 20 nt, Mycobacterium tuberculosis H37Rv
cggcucccauggcgcgagca

SEQ ID NO: 3275633 - RNA, 17 nt, Mycobacterium tuberculosis H37Rv
cggcuccgauuccgaac

SEQ ID NO: 3275634 - RNA, 23 nt, Mycobacterium tuberculosis H37Rv
cggcuccgccacuggcgccggug

SEQ ID NO: 3275635 - RNA, 13 nt, Mycobacterium tuberculosis H37Rv
cggcuccgccagc

SEQ ID NO: 3275636 - RNA, 19 nt, Mycobacterium tuberculosis H37Rv
cggcuccgccagcgccgcc

SEQ ID NO: 3275637 - RNA, 16 nt, Mycobacterium tuberculosis H37Rv
cggcuccgcccggcgu

SEQ ID NO: 3275638 - RNA, 14 nt, Mycobacterium tuberculosis H37Rv
cggcuccgccguug

SEQ ID NO: 3275639 - RNA, 22 nt, Mycobacterium tuberculosis H37Rv
cggcuccggacaccccgcacgg

SEQ ID NO: 3275640 - RNA, 16 nt, Mycobacterium tuberculosis H37Rv
cggcuccuccccggcc

SEQ ID NO: 3275641 - RNA, 20 nt, Mycobacterium tuberculosis H37Rv
cggcuccuccccggcccgcu

SEQ ID NO: 3275642 - RNA, 21 nt, Mycobacterium tuberculosis H37Rv
cggcuccuccgguaucggcga

SEQ ID NO: 3275643 - RNA, 22 nt, Mycobacterium tuberculosis H37Rv
cggcucgagucgcagcacgggu

SEQ ID NO: 3275644 - RNA, 15 nt, Mycobacterium tuberculosis H37Rv
cggcucgccaccucg

SEQ ID NO: 3275645 - RNA, 23 nt, Mycobacterium tuberculosis H37Rv
cggcucgccggcgcgcaccccgg

SEQ ID NO: 3275646 - RNA, 14 nt, Mycobacterium tuberculosis H37Rv
cggcucgcgcggga

SEQ ID NO: 3275647 - RNA, 23 nt, Mycobacterium tuberculosis H37Rv
cggcucgcgcgggaaguccgucg

SEQ ID NO: 3275648 - RNA, 19 nt, Mycobacterium tuberculosis H37Rv
cggcucggaaaccgccccg

SEQ ID NO: 3275649 - RNA, 18 nt, Mycobacterium tuberculosis H37Rv
cggcucggcaggugacca

SEQ ID NO: 3275650 - RNA, 20 nt, Mycobacterium tuberculosis H37Rv
cggcucggcgggggaccccg

SEQ ID NO: 3275651 - RNA, 22 nt, Mycobacterium tuberculosis H37Rv
cggcucggcgggggaccccgcc

SEQ ID NO: 3275652 - RNA, 20 nt, Mycobacterium tuberculosis H37Rv
cggcucgggaacuucgccga

SEQ ID NO: 3275653 - RNA, 22 nt, Mycobacterium tuberculosis H37Rv
cggcucgggaacuucgccgaag

SEQ ID NO: 3275654 - RNA, 19 nt, Mycobacterium tuberculosis H37Rv
cggcucggguaccggcggc

SEQ ID NO: 3275655 - RNA, 15 nt, Mycobacterium tuberculosis H37Rv
cggcucgggugcgcc

SEQ ID NO: 3275656 - RNA, 19 nt, Mycobacterium tuberculosis H37Rv
cggcucgggugcgcccggc

SEQ ID NO: 3275657 - RNA, 12 nt, Mycobacterium tuberculosis H37Rv
cggcucggugcg

SEQ ID NO: 3275658 - RNA, 15 nt, Mycobacterium tuberculosis H37Rv
cggcucgucaaacga

SEQ ID NO: 3275659 - RNA, 15 nt, Mycobacterium tuberculosis H37Rv
cggcucgucagguuc

SEQ ID NO: 3275660 - RNA, 13 nt, Mycobacterium tuberculosis H37Rv
cggcucguccggg

SEQ ID NO: 3275661 - RNA, 21 nt, Mycobacterium tuberculosis H37Rv
cggcucgucgaacauggcacg

SEQ ID NO: 3275662 - RNA, 20 nt, Mycobacterium tuberculosis H37Rv
cggcucgucgaugucgacgu

SEQ ID NO: 3275663 - RNA, 20 nt, Mycobacterium tuberculosis H37Rv
cggcucuagaucgccgagcg

SEQ ID NO: 3275664 - RNA, 17 nt, Mycobacterium tuberculosis H37Rv
cggcucuauccggcgca

SEQ ID NO: 3275665 - RNA, 17 nt, Mycobacterium tuberculosis H37Rv
cggcucucuucgcgcgc

SEQ ID NO: 3275666 - RNA, 22 nt, Mycobacterium tuberculosis H37Rv
cggcucucuucgcgcgcugggc

SEQ ID NO: 3275667 - RNA, 16 nt, Mycobacterium tuberculosis H37Rv
cggcugaauucggcga

SEQ ID NO: 3275668 - RNA, 13 nt, Mycobacterium tuberculosis H37Rv
cggcugaccgacc

SEQ ID NO: 3275669 - RNA, 20 nt, Mycobacterium tuberculosis H37Rv
cggcugaccggggucggccu

SEQ ID NO: 3275670 - RNA, 21 nt, Mycobacterium tuberculosis H37Rv
cggcugaccggggucggccug

SEQ ID NO: 3275671 - RNA, 13 nt, Mycobacterium tuberculosis H37Rv
cggcugaccuccc

SEQ ID NO: 3275672 - RNA, 14 nt, Mycobacterium tuberculosis H37Rv
cggcugaccuccca

SEQ ID NO: 3275673 - RNA, 21 nt, Mycobacterium tuberculosis H37Rv
cggcugaccucccacccccgg

SEQ ID NO: 3275674 - RNA, 21 nt, Mycobacterium tuberculosis H37Rv
cggcugaccuucucacgcacc

SEQ ID NO: 3275675 - RNA, 22 nt, Mycobacterium tuberculosis H37Rv
cggcugaccuucucacgcacca

SEQ ID NO: 3275676 - RNA, 16 nt, Mycobacterium tuberculosis H37Rv
cggcugagacgguguu

SEQ ID NO: 3275677 - RNA, 20 nt, Mycobacterium tuberculosis H37Rv
cggcugauucgagccacaug

SEQ ID NO: 3275678 - RNA, 23 nt, Mycobacterium tuberculosis H37Rv
cggcugauuggcccaccgccguu

SEQ ID NO: 3275679 - RNA, 20 nt, Mycobacterium tuberculosis H37Rv
cggcugcaaccagcggcaca

SEQ ID NO: 3275680 - RNA, 19 nt, Mycobacterium tuberculosis H37Rv
cggcugcacgcugcggguc

SEQ ID NO: 3275681 - RNA, 16 nt, Mycobacterium tuberculosis H37Rv
cggcugcauccuccuc

SEQ ID NO: 3275682 - RNA, 14 nt, Mycobacterium tuberculosis H37Rv
cggcugccacacag

SEQ ID NO: 3275683 - RNA, 18 nt, Mycobacterium tuberculosis H37Rv
cggcugccagcgccgccg

SEQ ID NO: 3275684 - RNA, 15 nt, Mycobacterium tuberculosis H37Rv
cggcugcccacccca

SEQ ID NO: 3275685 - RNA, 19 nt, Mycobacterium tuberculosis H37Rv
cggcugcccguucugccca

SEQ ID NO: 3275686 - RNA, 21 nt, Mycobacterium tuberculosis H37Rv
cgggaagccgcaucuggcugu

SEQ ID NO: 3275687 - RNA, 15 nt, Mycobacterium tuberculosis H37Rv
cgggaaggaaccggg

SEQ ID NO: 3275688 - RNA, 18 nt, Mycobacterium tuberculosis H37Rv
cgggaaggaaccgggcaa

SEQ ID NO: 3275689 - RNA, 23 nt, Mycobacterium tuberculosis H37Rv
cgggaaggaaccgggcaaaucaa

SEQ ID NO: 3275690 - RNA, 16 nt, Mycobacterium tuberculosis H37Rv
cgggaaggcauugccc

SEQ ID NO: 3275691 - RNA, 20 nt, Mycobacterium tuberculosis H37Rv
cgggaagucgcugaagccgu

SEQ ID NO: 3275692 - RNA, 12 nt, Mycobacterium tuberculosis H37Rv
cgggaagucggg

SEQ ID NO: 3275693 - RNA, 23 nt, Mycobacterium tuberculosis H37Rv
cgggaagugauguggcugagcag

SEQ ID NO: 3275694 - RNA, 14 nt, Mycobacterium tuberculosis H37Rv
cgggaagugcaccc

SEQ ID NO: 3275695 - RNA, 17 nt, Mycobacterium tuberculosis H37Rv
cgggaagugcacccggu

SEQ ID NO: 3275696 - RNA, 19 nt, Mycobacterium tuberculosis H37Rv
cgggaauccggugaugacc

SEQ ID NO: 3275697 - RNA, 21 nt, Mycobacterium tuberculosis H37Rv
cgggaaucgcucgcgccaggu

SEQ ID NO: 3275698 - RNA, 14 nt, Mycobacterium tuberculosis H37Rv
cgggaaugaccuug

SEQ ID NO: 3275699 - RNA, 15 nt, Mycobacterium tuberculosis H37Rv
cgggaauggacaggu

SEQ ID NO: 3275700 - RNA, 15 nt, Mycobacterium tuberculosis H37Rv
cgggaauggcgacca

SEQ ID NO: 3275701 - RNA, 19 nt, Mycobacterium tuberculosis H37Rv
cgggaauuucgucggccau

SEQ ID NO: 3275702 - RNA, 19 nt, Mycobacterium tuberculosis H37Rv
cgggacaaaaucagcagcc

SEQ ID NO: 3275703 - RNA, 12 nt, Mycobacterium tuberculosis H37Rv
cgggacaaccgc

SEQ ID NO: 3275704 - RNA, 19 nt, Mycobacterium tuberculosis H37Rv
cgggacaaguucgguagcg

SEQ ID NO: 3275705 - RNA, 14 nt, Mycobacterium tuberculosis H37Rv
cgggacaccaccgc

SEQ ID NO: 3275706 - RNA, 18 nt, Mycobacterium tuberculosis H37Rv
cgggacacgucgcgccag

SEQ ID NO: 3275707 - RNA, 17 nt, Mycobacterium tuberculosis H37Rv
cgggaccauagucgccg

SEQ ID NO: 3275708 - RNA, 16 nt, Mycobacterium tuberculosis H37Rv
cgggacccgggugguc

SEQ ID NO: 3275709 - RNA, 20 nt, Mycobacterium tuberculosis H37Rv
cgggacccgugagcucgucg

SEQ ID NO: 3275710 - RNA, 17 nt, Mycobacterium tuberculosis H37Rv
cgggaccggggacgcgc

SEQ ID NO: 3275711 - RNA, 21 nt, Mycobacterium tuberculosis H37Rv
cgggaccgugacguaucgccg

SEQ ID NO: 3275712 - RNA, 17 nt, Mycobacterium tuberculosis H37Rv
cgggaccuucgagccgc

SEQ ID NO: 3275713 - RNA, 20 nt, Mycobacterium tuberculosis H37Rv
cgggacgaaaaaaucgugcg

SEQ ID NO: 3275714 - RNA, 19 nt, Mycobacterium tuberculosis H37Rv
cgggacgaaucccgcgccc

SEQ ID NO: 3275715 - RNA, 14 nt, Mycobacterium tuberculosis H37Rv
cgggacgauaccgg

SEQ ID NO: 3275716 - RNA, 22 nt, Mycobacterium tuberculosis H37Rv
cgggacgcaugcgugacccgac

SEQ ID NO: 3275717 - RNA, 13 nt, Mycobacterium tuberculosis H37Rv
cgggacgccgccc

SEQ ID NO: 3275718 - RNA, 23 nt, Mycobacterium tuberculosis H37Rv
cgggacgccgcccccguggggug

SEQ ID NO: 3275719 - RNA, 21 nt, Mycobacterium tuberculosis H37Rv
cgggacgccuugaucggcgag

SEQ ID NO: 3275720 - RNA, 18 nt, Mycobacterium tuberculosis H37Rv
cgggacgcgacucggcgg

SEQ ID NO: 3275721 - RNA, 17 nt, Mycobacterium tuberculosis H37Rv
cgggacggccgccgccg

SEQ ID NO: 3275722 - RNA, 15 nt, Mycobacterium tuberculosis H37Rv
cgggacgucaccguu

SEQ ID NO: 3275723 - RNA, 15 nt, Mycobacterium tuberculosis H37Rv
cgggacgucgccgca

SEQ ID NO: 3275724 - RNA, 12 nt, Mycobacterium tuberculosis H37Rv
cgggacgucguc

SEQ ID NO: 3275725 - RNA, 17 nt, Mycobacterium tuberculosis H37Rv
cgggacguuguccaccg

SEQ ID NO: 3275726 - RNA, 19 nt, Mycobacterium tuberculosis H37Rv
cgggacguuguccaccgcc

SEQ ID NO: 3275727 - RNA, 17 nt, Mycobacterium tuberculosis H37Rv
cgggacugacccugauc

SEQ ID NO: 3275728 - RNA, 15 nt, Mycobacterium tuberculosis H37Rv
cgggacugcagcgcg

SEQ ID NO: 3275729 - RNA, 15 nt, Mycobacterium tuberculosis H37Rv
cgggacuucccgcga

SEQ ID NO: 3275730 - RNA, 19 nt, Mycobacterium tuberculosis H37Rv
cgggagaacgugccgaguu

SEQ ID NO: 3275731 - RNA, 19 nt, Mycobacterium tuberculosis H37Rv
cgggagacgcugcgcgcca

SEQ ID NO: 3275732 - RNA, 14 nt, Mycobacterium tuberculosis H37Rv
cgggagaucgucgc

SEQ ID NO: 3275733 - RNA, 15 nt, Mycobacterium tuberculosis H37Rv
cgggagcaccgacca

SEQ ID NO: 3275734 - RNA, 18 nt, Mycobacterium tuberculosis H37Rv
cgggagcagcacucgggu

SEQ ID NO: 3275735 - RNA, 15 nt, Mycobacterium tuberculosis H37Rv
cgggagccgcacccg

SEQ ID NO: 3275736 - RNA, 15 nt, Mycobacterium tuberculosis H37Rv
cgggagcgacgucgg

SEQ ID NO: 3275737 - RNA, 18 nt, Mycobacterium tuberculosis H37Rv
cgggagcgacgucgguga

SEQ ID NO: 3275738 - RNA, 14 nt, Mycobacterium tuberculosis H37Rv
cgggagcggcugcg

SEQ ID NO: 3275739 - RNA, 18 nt, Mycobacterium tuberculosis H37Rv
cgggagcggcugcggcaa

SEQ ID NO: 3275740 - RNA, 20 nt, Mycobacterium tuberculosis H37Rv
cgggagcugccgggaggggu

SEQ ID NO: 3275741 - RNA, 13 nt, Mycobacterium tuberculosis H37Rv
cgggaggccaccg

SEQ ID NO: 3275742 - RNA, 14 nt, Mycobacterium tuberculosis H37Rv
cgggaggccaccgc

SEQ ID NO: 3275743 - RNA, 16 nt, Mycobacterium tuberculosis H37Rv
cgggaggccaccgcga

SEQ ID NO: 3275744 - RNA, 17 nt, Mycobacterium tuberculosis H37Rv
cgggaggccaccgcgaa

SEQ ID NO: 3275745 - RNA, 21 nt, Mycobacterium tuberculosis H37Rv
cgggaggccggcuaccgcgcu

SEQ ID NO: 3275746 - RNA, 20 nt, Mycobacterium tuberculosis H37Rv
cgggaguccgguagcugugg

SEQ ID NO: 3275747 - RNA, 13 nt, Mycobacterium tuberculosis H37Rv
cgggagucgacgg

SEQ ID NO: 3275748 - RNA, 19 nt, Mycobacterium tuberculosis H37Rv
cgggagucgguaucggcag

SEQ ID NO: 3275749 - RNA, 17 nt, Mycobacterium tuberculosis H37Rv
cgggagucgucgagcug

SEQ ID NO: 3275750 - RNA, 15 nt, Mycobacterium tuberculosis H37Rv
cgggaguguguccga

SEQ ID NO: 3275751 - RNA, 14 nt, Mycobacterium tuberculosis H37Rv
cgggauaacccagc

SEQ ID NO: 3275752 - RNA, 19 nt, Mycobacterium tuberculosis H37Rv
cgggauaccgcucagggug

SEQ ID NO: 3275753 - RNA, 14 nt, Mycobacterium tuberculosis H37Rv
cgggauaucgucga

SEQ ID NO: 3275754 - RNA, 17 nt, Mycobacterium tuberculosis H37Rv
cgggauaucgucgacgc

SEQ ID NO: 3275755 - RNA, 19 nt, Mycobacterium tuberculosis H37Rv
cgggauaucgucgacgccc

SEQ ID NO: 3275756 - RNA, 19 nt, Mycobacterium tuberculosis H37Rv
cgggauccacccagugcca

SEQ ID NO: 3275757 - RNA, 14 nt, Mycobacterium tuberculosis H37Rv
cgggauccaggccc

SEQ ID NO: 3275758 - RNA, 17 nt, Mycobacterium tuberculosis H37Rv
cgggauccaggcccagc

SEQ ID NO: 3275759 - RNA, 15 nt, Mycobacterium tuberculosis H37Rv
cgggaucgacccgcc

SEQ ID NO: 3275760 - RNA, 22 nt, Mycobacterium tuberculosis H37Rv
cgggaucgcccaggcgcgacgu

SEQ ID NO: 3275761 - RNA, 20 nt, Mycobacterium tuberculosis H37Rv
cgggaucgccgagaccgcgu

SEQ ID NO: 3275762 - RNA, 18 nt, Mycobacterium tuberculosis H37Rv
cgggaucgccguccagca

SEQ ID NO: 3275763 - RNA, 15 nt, Mycobacterium tuberculosis H37Rv
cgggaucgcugccag

SEQ ID NO: 3275764 - RNA, 12 nt, Mycobacterium tuberculosis H37Rv
cgggaucggccg

SEQ ID NO: 3275765 - RNA, 15 nt, Mycobacterium tuberculosis H37Rv
cgggaucugcgccgc

SEQ ID NO: 3275766 - RNA, 17 nt, Mycobacterium tuberculosis H37Rv
cgggaucugcgccgcgc

SEQ ID NO: 3275767 - RNA, 18 nt, Mycobacterium tuberculosis H37Rv
cgggaucugcgccgcgcg

SEQ ID NO: 3275768 - RNA, 15 nt, Mycobacterium tuberculosis H37Rv
cgggaugccggcgaa

SEQ ID NO: 3275769 - RNA, 20 nt, Mycobacterium tuberculosis H37Rv
cgggaugcucgauccacugc

SEQ ID NO: 3275770 - RNA, 17 nt, Mycobacterium tuberculosis H37Rv
cgggaugugcggcugca

SEQ ID NO: 3275771 - RNA, 19 nt, Mycobacterium tuberculosis H37Rv
cgggaugugcggcugcacc

SEQ ID NO: 3275772 - RNA, 21 nt, Mycobacterium tuberculosis H37Rv
cgggaugugcggcugcaccgg

SEQ ID NO: 3275773 - RNA, 21 nt, Mycobacterium tuberculosis H37Rv
cgggauugccgccaccuuggc

SEQ ID NO: 3275774 - RNA, 19 nt, Mycobacterium tuberculosis H37Rv
cgggauuggaggcgggcgu

SEQ ID NO: 3275775 - RNA, 15 nt, Mycobacterium tuberculosis H37Rv
cgggcaaaucaagca

SEQ ID NO: 3275776 - RNA, 17 nt, Mycobacterium tuberculosis H37Rv
cgggcaaaucaagcaca

SEQ ID NO: 3275777 - RNA, 18 nt, Mycobacterium tuberculosis H37Rv
cgggcaaaucaagcacag

SEQ ID NO: 3275778 - RNA, 13 nt, Mycobacterium tuberculosis H37Rv
cgggcaacacgau

SEQ ID NO: 3275779 - RNA, 20 nt, Mycobacterium tuberculosis H37Rv
cgggcaacacgauaucgggc

SEQ ID NO: 3275780 - RNA, 15 nt, Mycobacterium tuberculosis H37Rv
cgggcaaccagcagc

SEQ ID NO: 3275781 - RNA, 19 nt, Mycobacterium tuberculosis H37Rv
cgggcaaccagcagcaggu

SEQ ID NO: 3275782 - RNA, 18 nt, Mycobacterium tuberculosis H37Rv
cgggcccgccguccccgc

SEQ ID NO: 3275783 - RNA, 19 nt, Mycobacterium tuberculosis H37Rv
cgggcccgccguccccgcc

SEQ ID NO: 3275784 - RNA, 14 nt, Mycobacterium tuberculosis H37Rv
cgggcccgcgcggc

SEQ ID NO: 3275785 - RNA, 21 nt, Mycobacterium tuberculosis H37Rv
cgggcccgcugggcuuggggc

SEQ ID NO: 3275786 - RNA, 15 nt, Mycobacterium tuberculosis H37Rv
cgggcccggacaagg

SEQ ID NO: 3275787 - RNA, 20 nt, Mycobacterium tuberculosis H37Rv
cgggcccguagccgagcuug

SEQ ID NO: 3275788 - RNA, 17 nt, Mycobacterium tuberculosis H37Rv
cgggcccgucgucgucg

SEQ ID NO: 3275789 - RNA, 18 nt, Mycobacterium tuberculosis H37Rv
cgggcccgucgucgucga

SEQ ID NO: 3275790 - RNA, 22 nt, Mycobacterium tuberculosis H37Rv
cgggcccguucucgcggccgau

SEQ ID NO: 3275791 - RNA, 20 nt, Mycobacterium tuberculosis H37Rv
cgggcccuccacugcgagcg

SEQ ID NO: 3275792 - RNA, 13 nt, Mycobacterium tuberculosis H37Rv
cgggcccuccggc

SEQ ID NO: 3275793 - RNA, 22 nt, Mycobacterium tuberculosis H37Rv
cgggcccucuaugcgggcagcg

SEQ ID NO: 3275794 - RNA, 18 nt, Mycobacterium tuberculosis H37Rv
cgggcccuuccuggccga

SEQ ID NO: 3275795 - RNA, 17 nt, Mycobacterium tuberculosis H37Rv
cgggccgaacacaccgg

SEQ ID NO: 3275796 - RNA, 23 nt, Mycobacterium tuberculosis H37Rv
cgggccgaacacaccgggcgggc

SEQ ID NO: 3275797 - RNA, 17 nt, Mycobacterium tuberculosis H37Rv
cgggccgaagccccgau

SEQ ID NO: 3275798 - RNA, 17 nt, Mycobacterium tuberculosis H37Rv
cgggccgaagcgcgcgc

SEQ ID NO: 3275799 - RNA, 18 nt, Mycobacterium tuberculosis H37Rv
cgggccgaauaccacacc

SEQ ID NO: 3275800 - RNA, 19 nt, Mycobacterium tuberculosis H37Rv
cgggccgaauaccacaccg

SEQ ID NO: 3275801 - RNA, 16 nt, Mycobacterium tuberculosis H37Rv
cgggccgacagcacgc

SEQ ID NO: 3275802 - RNA, 21 nt, Mycobacterium tuberculosis H37Rv
cgggccgacagcacgccaggc

SEQ ID NO: 3275803 - RNA, 23 nt, Mycobacterium tuberculosis H37Rv
cgggccgaccagagcuucgccgc

SEQ ID NO: 3275804 - RNA, 16 nt, Mycobacterium tuberculosis H37Rv
cgggccgacgcaggug

SEQ ID NO: 3275805 - RNA, 23 nt, Mycobacterium tuberculosis H37Rv
cgggccgagaucacgccgggcga

SEQ ID NO: 3275806 - RNA, 14 nt, Mycobacterium tuberculosis H37Rv
cgggccgagcgcac

SEQ ID NO: 3275807 - RNA, 14 nt, Mycobacterium tuberculosis H37Rv
cgggccgaucaccc

SEQ ID NO: 3275808 - RNA, 20 nt, Mycobacterium tuberculosis H37Rv
cgggccgaucucuccggcgg

SEQ ID NO: 3275809 - RNA, 16 nt, Mycobacterium tuberculosis H37Rv
cgggccgcaucgucgc

SEQ ID NO: 3275810 - RNA, 16 nt, Mycobacterium tuberculosis H37Rv
cgggccgccagggccc

SEQ ID NO: 3275811 - RNA, 14 nt, Mycobacterium tuberculosis H37Rv
cgggccgccgagcu

SEQ ID NO: 3275812 - RNA, 19 nt, Mycobacterium tuberculosis H37Rv
cgggccgccgagcucgguc

SEQ ID NO: 3275813 - RNA, 13 nt, Mycobacterium tuberculosis H37Rv
cgggccgccgccc

SEQ ID NO: 3275814 - RNA, 14 nt, Mycobacterium tuberculosis H37Rv
cgggccgccgcccc

SEQ ID NO: 3275815 - RNA, 19 nt, Mycobacterium tuberculosis H37Rv
cgggccgccgcgauggccc

SEQ ID NO: 3275816 - RNA, 14 nt, Mycobacterium tuberculosis H37Rv
cgggccgccuggag

SEQ ID NO: 3275817 - RNA, 20 nt, Mycobacterium tuberculosis H37Rv
cgggccgccuggagcugugg

SEQ ID NO: 3275818 - RNA, 13 nt, Mycobacterium tuberculosis H37Rv
cgggccgcgcggc

SEQ ID NO: 3275819 - RNA, 16 nt, Mycobacterium tuberculosis H37Rv
cgggccgcgcgggccg

SEQ ID NO: 3275820 - RNA, 14 nt, Mycobacterium tuberculosis H37Rv
cgggccgcggcggc

SEQ ID NO: 3275821 - RNA, 19 nt, Mycobacterium tuberculosis H37Rv
cgggccgcgucgaacuggg

SEQ ID NO: 3275822 - RNA, 21 nt, Mycobacterium tuberculosis H37Rv
cgggccggaugacgcccaggg

SEQ ID NO: 3275823 - RNA, 16 nt, Mycobacterium tuberculosis H37Rv
cgggccggcaucgucg

SEQ ID NO: 3275824 - RNA, 17 nt, Mycobacterium tuberculosis H37Rv
cgggccggcaucgucgg

SEQ ID NO: 3275825 - RNA, 15 nt, Mycobacterium tuberculosis H37Rv
cgggccggccgagcg

SEQ ID NO: 3275826 - RNA, 16 nt, Mycobacterium tuberculosis H37Rv
cgggccggccgccgcg

SEQ ID NO: 3275827 - RNA, 16 nt, Mycobacterium tuberculosis H37Rv
cgggccgggcgguguc

SEQ ID NO: 3275828 - RNA, 23 nt, Mycobacterium tuberculosis H37Rv
cgggccgguggaaaagccacggc

SEQ ID NO: 3275829 - RNA, 18 nt, Mycobacterium tuberculosis H37Rv
cgggccguacacaccgag

SEQ ID NO: 3275830 - RNA, 15 nt, Mycobacterium tuberculosis H37Rv
cgggccgucaaucgc

SEQ ID NO: 3275831 - RNA, 20 nt, Mycobacterium tuberculosis H37Rv
cgggccguccggcgccugcu

SEQ ID NO: 3275832 - RNA, 21 nt, Mycobacterium tuberculosis H37Rv
cgggccguccggcgccugcug

SEQ ID NO: 3275833 - RNA, 15 nt, Mycobacterium tuberculosis H37Rv
cgggccguccuccca

SEQ ID NO: 3275834 - RNA, 14 nt, Mycobacterium tuberculosis H37Rv
cgggccgugacccu

SEQ ID NO: 3275835 - RNA, 18 nt, Mycobacterium tuberculosis H37Rv
cgggccguguccgccgga

SEQ ID NO: 3275836 - RNA, 16 nt, Mycobacterium tuberculosis H37Rv
cgggccuccugcuggc

SEQ ID NO: 3275837 - RNA, 17 nt, Mycobacterium tuberculosis H37Rv
cgggccuccugcuggcc

SEQ ID NO: 3275838 - RNA, 13 nt, Mycobacterium tuberculosis H37Rv
cgggccucggcga

SEQ ID NO: 3275839 - RNA, 14 nt, Mycobacterium tuberculosis H37Rv
cgggccucggcgcc

SEQ ID NO: 3275840 - RNA, 19 nt, Mycobacterium tuberculosis H37Rv
cgggccucggcgccgucgg

SEQ ID NO: 3275841 - RNA, 18 nt, Mycobacterium tuberculosis H37Rv
cgggccugcaccacggcg

SEQ ID NO: 3275842 - RNA, 12 nt, Mycobacterium tuberculosis H37Rv
cgggccugcacg

SEQ ID NO: 3275843 - RNA, 14 nt, Mycobacterium tuberculosis H37Rv
cgggccugcacgcc

SEQ ID NO: 3275844 - RNA, 22 nt, Mycobacterium tuberculosis H37Rv
cgggccugcgcgauccgcgcgc

SEQ ID NO: 3275845 - RNA, 17 nt, Mycobacterium tuberculosis H37Rv
cgggccuucagcucacc

SEQ ID NO: 3275846 - RNA, 18 nt, Mycobacterium tuberculosis H37Rv
cgggccuucagcucacca

SEQ ID NO: 3275847 - RNA, 18 nt, Mycobacterium tuberculosis H37Rv
cgggccuugcgcgcgcag

SEQ ID NO: 3275848 - RNA, 20 nt, Mycobacterium tuberculosis H37Rv
cgggccuuguucuuggccac

SEQ ID NO: 3275849 - RNA, 22 nt, Mycobacterium tuberculosis H37Rv
cgggccuuguucuuggccaccc

SEQ ID NO: 3275850 - RNA, 14 nt, Mycobacterium tuberculosis H37Rv
cgggcgaaccgcuc

SEQ ID NO: 3275851 - RNA, 18 nt, Mycobacterium tuberculosis H37Rv
cgggcgaauccggcgggu

SEQ ID NO: 3275852 - RNA, 15 nt, Mycobacterium tuberculosis H37Rv
cgggcgaccaacacg

SEQ ID NO: 3275853 - RNA, 22 nt, Mycobacterium tuberculosis H37Rv
cgggcgaccaacacgucgagca

SEQ ID NO: 3275854 - RNA, 14 nt, Mycobacterium tuberculosis H37Rv
cgggcgaccaccac

SEQ ID NO: 3275855 - RNA, 16 nt, Mycobacterium tuberculosis H37Rv
cgggcgaccaccaccg

SEQ ID NO: 3275856 - RNA, 17 nt, Mycobacterium tuberculosis H37Rv
cgggcgaccaccaccgc

SEQ ID NO: 3275857 - RNA, 18 nt, Mycobacterium tuberculosis H37Rv
cgggcgaccaccaccgcc

SEQ ID NO: 3275858 - RNA, 23 nt, Mycobacterium tuberculosis H37Rv
cgggcgaccaccaccgccgccga

SEQ ID NO: 3275859 - RNA, 14 nt, Mycobacterium tuberculosis H37Rv
cgggcgaccaccgc

SEQ ID NO: 3275860 - RNA, 13 nt, Mycobacterium tuberculosis H37Rv
cgggcgacccguu

SEQ ID NO: 3275861 - RNA, 20 nt, Mycobacterium tuberculosis H37Rv
cgggcgaccuccggaaucgc

SEQ ID NO: 3275862 - RNA, 21 nt, Mycobacterium tuberculosis H37Rv
cgggcgaccuccggaaucgcc

SEQ ID NO: 3275863 - RNA, 12 nt, Mycobacterium tuberculosis H37Rv
cgggcgaccugc

SEQ ID NO: 3275864 - RNA, 22 nt, Mycobacterium tuberculosis H37Rv
cgggcgagaacccacgcaugca

SEQ ID NO: 3275865 - RNA, 22 nt, Mycobacterium tuberculosis H37Rv
cgggcgagcgcggccugcacca

SEQ ID NO: 3275866 - RNA, 20 nt, Mycobacterium tuberculosis H37Rv
cgggcgagcucgucgagcgc

SEQ ID NO: 3275867 - RNA, 20 nt, Mycobacterium tuberculosis H37Rv
cgggcgaguacaggcgcagc

SEQ ID NO: 3275868 - RNA, 21 nt, Mycobacterium tuberculosis H37Rv
cgggcgaguacaggcgcagcg

SEQ ID NO: 3275869 - RNA, 21 nt, Mycobacterium tuberculosis H37Rv
cgggcgaguagucgacgucga

SEQ ID NO: 3275870 - RNA, 16 nt, Mycobacterium tuberculosis H37Rv
cgggcgagugucagca

SEQ ID NO: 3275871 - RNA, 20 nt, Mycobacterium tuberculosis H37Rv
cgggcgagugucagcagaug

SEQ ID NO: 3275872 - RNA, 21 nt, Mycobacterium tuberculosis H37Rv
cgggcgaucaaagccagcacc

SEQ ID NO: 3275873 - RNA, 15 nt, Mycobacterium tuberculosis H37Rv
cgggcgaucgccugg

SEQ ID NO: 3275874 - RNA, 18 nt, Mycobacterium tuberculosis H37Rv
cgggcgaucgccugggcu

SEQ ID NO: 3275875 - RNA, 13 nt, Mycobacterium tuberculosis H37Rv
cgggcgaucucga

SEQ ID NO: 3275876 - RNA, 21 nt, Mycobacterium tuberculosis H37Rv
cgggcgaugcgggccgccagg

SEQ ID NO: 3275877 - RNA, 14 nt, Mycobacterium tuberculosis H37Rv
cgggcgaugcuggg

SEQ ID NO: 3275878 - RNA, 22 nt, Mycobacterium tuberculosis H37Rv
cgggcucgcauguucuccacgc

SEQ ID NO: 3275879 - RNA, 17 nt, Mycobacterium tuberculosis H37Rv
cgggcucgcgaucguca

SEQ ID NO: 3275880 - RNA, 15 nt, Mycobacterium tuberculosis H37Rv
cgggcucgcugcacc

SEQ ID NO: 3275881 - RNA, 15 nt, Mycobacterium tuberculosis H37Rv
cgggcucgcuucagg

SEQ ID NO: 3275882 - RNA, 20 nt, Mycobacterium tuberculosis H37Rv
cgggcucgcuucaggcaccg

SEQ ID NO: 3275883 - RNA, 15 nt, Mycobacterium tuberculosis H37Rv
cgggcucggagauga

SEQ ID NO: 3275884 - RNA, 12 nt, Mycobacterium tuberculosis H37Rv
cgggcucggcag

SEQ ID NO: 3275885 - RNA, 20 nt, Mycobacterium tuberculosis H37Rv
cgggcucggcgucgccgcca

SEQ ID NO: 3275886 - RNA, 23 nt, Mycobacterium tuberculosis H37Rv
cgggcucggucccgcuacaccug

SEQ ID NO: 3275887 - RNA, 15 nt, Mycobacterium tuberculosis H37Rv
cgggcucguccagca

SEQ ID NO: 3275888 - RNA, 15 nt, Mycobacterium tuberculosis H37Rv
cgggcucucggcguc

SEQ ID NO: 3275889 - RNA, 17 nt, Mycobacterium tuberculosis H37Rv
cgggcucucggcgucga

SEQ ID NO: 3275890 - RNA, 21 nt, Mycobacterium tuberculosis H37Rv
cgggcucugcugccagccgaa

SEQ ID NO: 3275891 - RNA, 19 nt, Mycobacterium tuberculosis H37Rv
cgggcugacgaucuccacc

SEQ ID NO: 3275892 - RNA, 20 nt, Mycobacterium tuberculosis H37Rv
cgggcugaucgcccggcgcg

SEQ ID NO: 3275893 - RNA, 10 nt, Mycobacterium tuberculosis H37Rv
cgggcugcag

SEQ ID NO: 3275894 - RNA, 18 nt, Mycobacterium tuberculosis H37Rv
cgggcugcagugacucga

SEQ ID NO: 3275895 - RNA, 22 nt, Mycobacterium tuberculosis H37Rv
cgggcugccacggccuucagcg

SEQ ID NO: 3275896 - RNA, 13 nt, Mycobacterium tuberculosis H37Rv
cgggcugccgcau

SEQ ID NO: 3275897 - RNA, 16 nt, Mycobacterium tuberculosis H37Rv
cgggcugccgcaugcg

SEQ ID NO: 3275898 - RNA, 13 nt, Mycobacterium tuberculosis H37Rv
cgggcugccgccc

SEQ ID NO: 3275899 - RNA, 15 nt, Mycobacterium tuberculosis H37Rv
cgggcuggccgacuc

SEQ ID NO: 3275900 - RNA, 17 nt, Mycobacterium tuberculosis H37Rv
cgggcuggccgacucga

SEQ ID NO: 3275901 - RNA, 13 nt, Mycobacterium tuberculosis H37Rv
cgggcuguaggcg

SEQ ID NO: 3275902 - RNA, 20 nt, Mycobacterium tuberculosis H37Rv
cgggcugugaacagcgcguc

SEQ ID NO: 3275903 - RNA, 21 nt, Mycobacterium tuberculosis H37Rv
cgggcugugaacagcgcgucg

SEQ ID NO: 3275904 - RNA, 22 nt, Mycobacterium tuberculosis H37Rv
cgggcugugaacagcgcgucgg

SEQ ID NO: 3275905 - RNA, 16 nt, Mycobacterium tuberculosis H37Rv
cgggcugugauccgac

SEQ ID NO: 3275906 - RNA, 17 nt, Mycobacterium tuberculosis H37Rv
cgggcuuaugcacgacg

SEQ ID NO: 3275907 - RNA, 13 nt, Mycobacterium tuberculosis H37Rv
cgggcuucggcca

SEQ ID NO: 3275908 - RNA, 19 nt, Mycobacterium tuberculosis H37Rv
cgggcuugagcgccgaugu

SEQ ID NO: 3275909 - RNA, 21 nt, Mycobacterium tuberculosis H37Rv
cgggcuugccgucuucgccgc

SEQ ID NO: 3275910 - RNA, 15 nt, Mycobacterium tuberculosis H37Rv
cgggcuugcgcagca

SEQ ID NO: 3275911 - RNA, 17 nt, Mycobacterium tuberculosis H37Rv
cgggcuugcgcagcagc

SEQ ID NO: 3275912 - RNA, 22 nt, Mycobacterium tuberculosis H37Rv
cggggaaaccggccagccgacg

SEQ ID NO: 3275913 - RNA, 11 nt, Mycobacterium tuberculosis H37Rv
cggggaacacc

SEQ ID NO: 3275914 - RNA, 19 nt, Mycobacterium tuberculosis H37Rv
cggggaaccguccaagccg

SEQ ID NO: 3275915 - RNA, 13 nt, Mycobacterium tuberculosis H37Rv
cggggaccgcggu

SEQ ID NO: 3275916 - RNA, 21 nt, Mycobacterium tuberculosis H37Rv
cggggacgccgcggcgccggu

SEQ ID NO: 3275917 - RNA, 17 nt, Mycobacterium tuberculosis H37Rv
cggggacgcgccccagu

SEQ ID NO: 3275918 - RNA, 16 nt, Mycobacterium tuberculosis H37Rv
cggggacucauggccg

SEQ ID NO: 3275919 - RNA, 17 nt, Mycobacterium tuberculosis H37Rv
cggggaguuccaaaucg

SEQ ID NO: 3275920 - RNA, 23 nt, Mycobacterium tuberculosis H37Rv
cggggaguuccaaaucgguggca

SEQ ID NO: 3275921 - RNA, 20 nt, Mycobacterium tuberculosis H37Rv
cggggauaucacgacgccga

SEQ ID NO: 3275922 - RNA, 14 nt, Mycobacterium tuberculosis H37Rv
cggggaucagcguc

SEQ ID NO: 3275923 - RNA, 17 nt, Mycobacterium tuberculosis H37Rv
cggggauccgaccugcu

SEQ ID NO: 3275924 - RNA, 21 nt, Mycobacterium tuberculosis H37Rv
cggggaucgcaagccguugca

SEQ ID NO: 3275925 - RNA, 20 nt, Mycobacterium tuberculosis H37Rv
cggggaugccgaaccgcugc

SEQ ID NO: 3275926 - RNA, 21 nt, Mycobacterium tuberculosis H37Rv
cggggauguccgcggccacca

SEQ ID NO: 3275927 - RNA, 15 nt, Mycobacterium tuberculosis H37Rv
cggggaugucgaccg

SEQ ID NO: 3275928 - RNA, 19 nt, Mycobacterium tuberculosis H37Rv
cggggcaaaggagccguug

SEQ ID NO: 3275929 - RNA, 18 nt, Mycobacterium tuberculosis H37Rv
cggggcaccacgccagcc

SEQ ID NO: 3275930 - RNA, 13 nt, Mycobacterium tuberculosis H37Rv
cggggccacccgc

SEQ ID NO: 3275931 - RNA, 15 nt, Mycobacterium tuberculosis H37Rv
cggggccacccgcag

SEQ ID NO: 3275932 - RNA, 13 nt, Mycobacterium tuberculosis H37Rv
cggggcccacacg

SEQ ID NO: 3275933 - RNA, 21 nt, Mycobacterium tuberculosis H37Rv
cggggccccgcggcgccgcca

SEQ ID NO: 3275934 - RNA, 21 nt, Mycobacterium tuberculosis H37Rv
cggggcccggacaggcucacg

SEQ ID NO: 3275935 - RNA, 22 nt, Mycobacterium tuberculosis H37Rv
cggggccgcacuguugcguagc

SEQ ID NO: 3275936 - RNA, 16 nt, Mycobacterium tuberculosis H37Rv
cggggccgccgaugcc

SEQ ID NO: 3275937 - RNA, 21 nt, Mycobacterium tuberculosis H37Rv
cggggccgccgaugccaccgc

SEQ ID NO: 3275938 - RNA, 15 nt, Mycobacterium tuberculosis H37Rv
cggggccgccgcggc

SEQ ID NO: 3275939 - RNA, 20 nt, Mycobacterium tuberculosis H37Rv
cggggccgccgcggccggcg

SEQ ID NO: 3275940 - RNA, 12 nt, Mycobacterium tuberculosis H37Rv
cggggccgccgu

SEQ ID NO: 3275941 - RNA, 14 nt, Mycobacterium tuberculosis H37Rv
cggggccgccgucg

SEQ ID NO: 3275942 - RNA, 23 nt, Mycobacterium tuberculosis H37Rv
cggggccgccgucgccuccgcua

SEQ ID NO: 3275943 - RNA, 14 nt, Mycobacterium tuberculosis H37Rv
cggggccgucggca

SEQ ID NO: 3275944 - RNA, 15 nt, Mycobacterium tuberculosis H37Rv
cggggccgucgucgg

SEQ ID NO: 3275945 - RNA, 21 nt, Mycobacterium tuberculosis H37Rv
cggggccgucgucggucaccg

SEQ ID NO: 3275946 - RNA, 14 nt, Mycobacterium tuberculosis H37Rv
cggggccgucucgc

SEQ ID NO: 3275947 - RNA, 18 nt, Mycobacterium tuberculosis H37Rv
cggggccgucucgccgug

SEQ ID NO: 3275948 - RNA, 16 nt, Mycobacterium tuberculosis H37Rv
cggggccucgcgagaa

SEQ ID NO: 3275949 - RNA, 15 nt, Mycobacterium tuberculosis H37Rv
cggggcgauccccag

SEQ ID NO: 3275950 - RNA, 23 nt, Mycobacterium tuberculosis H37Rv
cggggcgcaccgcggaccggcgu

SEQ ID NO: 3275951 - RNA, 13 nt, Mycobacterium tuberculosis H37Rv
cggggcgcccggc

SEQ ID NO: 3275952 - RNA, 14 nt, Mycobacterium tuberculosis H37Rv
cggggcgcgguacc

SEQ ID NO: 3275953 - RNA, 13 nt, Mycobacterium tuberculosis H37Rv
cggggcgcucgcg

SEQ ID NO: 3275954 - RNA, 15 nt, Mycobacterium tuberculosis H37Rv
cggggcgcucgcgcg

SEQ ID NO: 3275955 - RNA, 22 nt, Mycobacterium tuberculosis H37Rv
cggggcggcauuggcggugccg

SEQ ID NO: 3275956 - RNA, 14 nt, Mycobacterium tuberculosis H37Rv
cggggcggcggugg

SEQ ID NO: 3275957 - RNA, 20 nt, Mycobacterium tuberculosis H37Rv
cggggcgucguaaacgucgg

SEQ ID NO: 3275958 - RNA, 20 nt, Mycobacterium tuberculosis H37Rv
cggggcuaguugagcgcugc

SEQ ID NO: 3275959 - RNA, 16 nt, Mycobacterium tuberculosis H37Rv
cggggcucucgagucc

SEQ ID NO: 3275960 - RNA, 22 nt, Mycobacterium tuberculosis H37Rv
cggggcucucgaguccaggcag

SEQ ID NO: 3275961 - RNA, 11 nt, Mycobacterium tuberculosis H37Rv
cggggcugccc

SEQ ID NO: 3275962 - RNA, 17 nt, Mycobacterium tuberculosis H37Rv
cggggcugccgccguug

SEQ ID NO: 3275963 - RNA, 23 nt, Mycobacterium tuberculosis H37Rv
cggggcugggcgccaugcgccaa

SEQ ID NO: 3275964 - RNA, 12 nt, Mycobacterium tuberculosis H37Rv
cggggcuggggg

SEQ ID NO: 3275965 - RNA, 20 nt, Mycobacterium tuberculosis H37Rv
cggggcugggggccggcagc

SEQ ID NO: 3275966 - RNA, 21 nt, Mycobacterium tuberculosis H37Rv
cggggcugggggccggcagcg

SEQ ID NO: 3275967 - RNA, 15 nt, Mycobacterium tuberculosis H37Rv
cggggcugucggcga

SEQ ID NO: 3275968 - RNA, 23 nt, Mycobacterium tuberculosis H37Rv
cggggcuucaucuggcgccguua

SEQ ID NO: 3275969 - RNA, 16 nt, Mycobacterium tuberculosis H37Rv
cgggggaagcgcgucc

SEQ ID NO: 3275970 - RNA, 12 nt, Mycobacterium tuberculosis H37Rv
cgggggacgggu

SEQ ID NO: 3275971 - RNA, 21 nt, Mycobacterium tuberculosis H37Rv
cgggggcaccguuaccgccgu

SEQ ID NO: 3275972 - RNA, 23 nt, Mycobacterium tuberculosis H37Rv
cgggggcaccguuaccgccgucg

SEQ ID NO: 3275973 - RNA, 15 nt, Mycobacterium tuberculosis H37Rv
cgggggcagcgccuc

SEQ ID NO: 3275974 - RNA, 15 nt, Mycobacterium tuberculosis H37Rv
cggguccgccgggcc

SEQ ID NO: 3275975 - RNA, 16 nt, Mycobacterium tuberculosis H37Rv
cggguccgccgggccc

SEQ ID NO: 3275976 - RNA, 20 nt, Mycobacterium tuberculosis H37Rv
cggguccgccgggccccggg

SEQ ID NO: 3275977 - RNA, 13 nt, Mycobacterium tuberculosis H37Rv
cggguccggugaa

SEQ ID NO: 3275978 - RNA, 19 nt, Mycobacterium tuberculosis H37Rv
cggguccggugaacccgau

SEQ ID NO: 3275979 - RNA, 18 nt, Mycobacterium tuberculosis H37Rv
cggguccuauccgggccc

SEQ ID NO: 3275980 - RNA, 16 nt, Mycobacterium tuberculosis H37Rv
cggguccucgcggagc

SEQ ID NO: 3275981 - RNA, 21 nt, Mycobacterium tuberculosis H37Rv
cggguccucgcggagccgucg

SEQ ID NO: 3275982 - RNA, 20 nt, Mycobacterium tuberculosis H37Rv
cggguccuggaucagccagu

SEQ ID NO: 3275983 - RNA, 14 nt, Mycobacterium tuberculosis H37Rv
cgggucgaccccgg

SEQ ID NO: 3275984 - RNA, 20 nt, Mycobacterium tuberculosis H37Rv
cgggucgacgacgucgcgca

SEQ ID NO: 3275985 - RNA, 20 nt, Mycobacterium tuberculosis H37Rv
cgggucgacguuaccgaccg

SEQ ID NO: 3275986 - RNA, 14 nt, Mycobacterium tuberculosis H37Rv
cgggucgagccgga

SEQ ID NO: 3275987 - RNA, 20 nt, Mycobacterium tuberculosis H37Rv
cgggucgagccggacccggu

SEQ ID NO: 3275988 - RNA, 22 nt, Mycobacterium tuberculosis H37Rv
cgggucgaucaccgacaccgug

SEQ ID NO: 3275989 - RNA, 13 nt, Mycobacterium tuberculosis H37Rv
cgggucgaugacg

SEQ ID NO: 3275990 - RNA, 16 nt, Mycobacterium tuberculosis H37Rv
cgggucgaugucggca

SEQ ID NO: 3275991 - RNA, 17 nt, Mycobacterium tuberculosis H37Rv
cgggucgauuucgccgg

SEQ ID NO: 3275992 - RNA, 20 nt, Mycobacterium tuberculosis H37Rv
cgggucgcaaccgccgccau

SEQ ID NO: 3275993 - RNA, 17 nt, Mycobacterium tuberculosis H37Rv
cgggucgcaccccggcg

SEQ ID NO: 3275994 - RNA, 13 nt, Mycobacterium tuberculosis H37Rv
cgggucgccgcca

SEQ ID NO: 3275995 - RNA, 14 nt, Mycobacterium tuberculosis H37Rv
cgggucgcgggugc

SEQ ID NO: 3275996 - RNA, 15 nt, Mycobacterium tuberculosis H37Rv
cgggucggcacgacc

SEQ ID NO: 3275997 - RNA, 19 nt, Mycobacterium tuberculosis H37Rv
cgggucggcacgacccggg

SEQ ID NO: 3275998 - RNA, 12 nt, Mycobacterium tuberculosis H37Rv
cgggucggcaga

SEQ ID NO: 3275999 - RNA, 12 nt, Mycobacterium tuberculosis H37Rv
cgggucggccau

SEQ ID NO: 3276000 - RNA, 18 nt, Mycobacterium tuberculosis H37Rv
cgggucggcgaccgcgcu

SEQ ID NO: 3276001 - RNA, 12 nt, Mycobacterium tuberculosis H37Rv
cgggucggcgcc

SEQ ID NO: 3276002 - RNA, 17 nt, Mycobacterium tuberculosis H37Rv
cgggucggcgccgagca

SEQ ID NO: 3276003 - RNA, 12 nt, Mycobacterium tuberculosis H37Rv
cgggucggcgcu

SEQ ID NO: 3276004 - RNA, 20 nt, Mycobacterium tuberculosis H37Rv
cgggucggcggugccgugug

SEQ ID NO: 3276005 - RNA, 24 nt, Mycobacterium tuberculosis H37Rv
cgggucgguccacuucagaucggc

SEQ ID NO: 3276006 - RNA, 19 nt, Mycobacterium tuberculosis H37Rv
cgggucgguuuccuccggc

SEQ ID NO: 3276007 - RNA, 20 nt, Mycobacterium tuberculosis H37Rv
cgggucgguuuccuccggca

SEQ ID NO: 3276008 - RNA, 22 nt, Mycobacterium tuberculosis H37Rv
cgggucgguuuccuccggcagc

SEQ ID NO: 3276009 - RNA, 16 nt, Mycobacterium tuberculosis H37Rv
cgggucgucauacagc

SEQ ID NO: 3276010 - RNA, 17 nt, Mycobacterium tuberculosis H37Rv
cgggucguccggcggca

SEQ ID NO: 3276011 - RNA, 20 nt, Mycobacterium tuberculosis H37Rv
cgggucgucggcgucggugg

SEQ ID NO: 3276012 - RNA, 16 nt, Mycobacterium tuberculosis H37Rv
cgggucgugccccggc

SEQ ID NO: 3276013 - RNA, 23 nt, Mycobacterium tuberculosis H37Rv
cgggucgugcgacaacacgaccu

SEQ ID NO: 3276014 - RNA, 14 nt, Mycobacterium tuberculosis H37Rv
cgggucguucgggu

SEQ ID NO: 3276015 - RNA, 19 nt, Mycobacterium tuberculosis H37Rv
cgggucguucgggugagca

SEQ ID NO: 3276016 - RNA, 20 nt, Mycobacterium tuberculosis H37Rv
cgggucguucuccgcgccgc

SEQ ID NO: 3276017 - RNA, 22 nt, Mycobacterium tuberculosis H37Rv
cgggucuacagcguugccaggu

SEQ ID NO: 3276018 - RNA, 15 nt, Mycobacterium tuberculosis H37Rv
cgggucuccggcgca

SEQ ID NO: 3276019 - RNA, 14 nt, Mycobacterium tuberculosis H37Rv
cgggucucgcgagc

SEQ ID NO: 3276020 - RNA, 13 nt, Mycobacterium tuberculosis H37Rv
cgggucugcgguc

SEQ ID NO: 3276021 - RNA, 16 nt, Mycobacterium tuberculosis H37Rv
cgggucugggugguga

SEQ ID NO: 3276022 - RNA, 21 nt, Mycobacterium tuberculosis H37Rv
cgggugaaacgauggcgauga

SEQ ID NO: 3276023 - RNA, 18 nt, Mycobacterium tuberculosis H37Rv
cgggugaaggaugcggcc

SEQ ID NO: 3276024 - RNA, 19 nt, Mycobacterium tuberculosis H37Rv
cgggugaaggaugcggccc

SEQ ID NO: 3276025 - RNA, 14 nt, Mycobacterium tuberculosis H37Rv
cgggugaccaggcg

SEQ ID NO: 3276026 - RNA, 23 nt, Mycobacterium tuberculosis H37Rv
cgggugaccaggcggcgcggguc

SEQ ID NO: 3276027 - RNA, 14 nt, Mycobacterium tuberculosis H37Rv
cgggugacccgcca

SEQ ID NO: 3276028 - RNA, 15 nt, Mycobacterium tuberculosis H37Rv
cgggugagauccgau

SEQ ID NO: 3276029 - RNA, 13 nt, Mycobacterium tuberculosis H37Rv
cgggugagcaccc

SEQ ID NO: 3276030 - RNA, 15 nt, Mycobacterium tuberculosis H37Rv
cgggugagcacccag

SEQ ID NO: 3276031 - RNA, 16 nt, Mycobacterium tuberculosis H37Rv
cgggugagcacccagc

SEQ ID NO: 3276032 - RNA, 16 nt, Mycobacterium tuberculosis H37Rv
cgggugaguucggcgu

SEQ ID NO: 3276033 - RNA, 18 nt, Mycobacterium tuberculosis H37Rv
cgggugaugacgccgucg

SEQ ID NO: 3276034 - RNA, 22 nt, Mycobacterium tuberculosis H37Rv
cgggugaugacgccgucggcgc

SEQ ID NO: 3276035 - RNA, 15 nt, Mycobacterium tuberculosis H37Rv
cgggugaugcaguga

SEQ ID NO: 3276036 - RNA, 22 nt, Mycobacterium tuberculosis H37Rv
cgggugauggaugggucgaccg

SEQ ID NO: 3276037 - RNA, 20 nt, Mycobacterium tuberculosis H37Rv
cgggugcagaucgccccagc

SEQ ID NO: 3276038 - RNA, 23 nt, Mycobacterium tuberculosis H37Rv
cgggugcagcacggcgccgccac

SEQ ID NO: 3276039 - RNA, 15 nt, Mycobacterium tuberculosis H37Rv
cgggugcagccagau

SEQ ID NO: 3276040 - RNA, 17 nt, Mycobacterium tuberculosis H37Rv
cgggugccgacucggcc

SEQ ID NO: 3276041 - RNA, 13 nt, Mycobacterium tuberculosis H37Rv
cgggugccgagcu

SEQ ID NO: 3276042 - RNA, 17 nt, Mycobacterium tuberculosis H37Rv
cgggugcgacaucgguc

SEQ ID NO: 3276043 - RNA, 17 nt, Mycobacterium tuberculosis H37Rv
cgggugcgcacccgggu

SEQ ID NO: 3276044 - RNA, 22 nt, Mycobacterium tuberculosis H37Rv
cgggugcgccacaaccguugcu

SEQ ID NO: 3276045 - RNA, 18 nt, Mycobacterium tuberculosis H37Rv
cgggugcgccggcguuug

SEQ ID NO: 3276046 - RNA, 14 nt, Mycobacterium tuberculosis H37Rv
cgggugcgccguug

SEQ ID NO: 3276047 - RNA, 21 nt, Mycobacterium tuberculosis H37Rv
cgggugcgccguugccgccgu

SEQ ID NO: 3276048 - RNA, 16 nt, Mycobacterium tuberculosis H37Rv
cgggugcgcugcagcg

SEQ ID NO: 3276049 - RNA, 17 nt, Mycobacterium tuberculosis H37Rv
cgggugcgcugcgauca

SEQ ID NO: 3276050 - RNA, 16 nt, Mycobacterium tuberculosis H37Rv
cgggugcggacaccga

SEQ ID NO: 3276051 - RNA, 13 nt, Mycobacterium tuberculosis H37Rv
cgggugcgucgau

SEQ ID NO: 3276052 - RNA, 18 nt, Mycobacterium tuberculosis H37Rv
cgggugcuacuggguggg

SEQ ID NO: 3276053 - RNA, 19 nt, Mycobacterium tuberculosis H37Rv
cgggugcuacugggugggu

SEQ ID NO: 3276054 - RNA, 16 nt, Mycobacterium tuberculosis H37Rv
cgggugcugauggguc

SEQ ID NO: 3276055 - RNA, 22 nt, Mycobacterium tuberculosis H37Rv
cgggugcugaugggucaggccg

SEQ ID NO: 3276056 - RNA, 23 nt, Mycobacterium tuberculosis H37Rv
cgggugcugaugggucaggccga

SEQ ID NO: 3276057 - RNA, 19 nt, Mycobacterium tuberculosis H37Rv
cggguggccacgcccaggc

SEQ ID NO: 3276058 - RNA, 20 nt, Mycobacterium tuberculosis H37Rv
cggguggccaucaccgcgcu

SEQ ID NO: 3276059 - RNA, 23 nt, Mycobacterium tuberculosis H37Rv
cggguggcgccaggucggcgggc

SEQ ID NO: 3276060 - RNA, 23 nt, Mycobacterium tuberculosis H37Rv
cggguggcgccaguucggcgggc

SEQ ID NO: 3276061 - RNA, 15 nt, Mycobacterium tuberculosis H37Rv
cggguggcgccggug

SEQ ID NO: 3276062 - RNA, 15 nt, Mycobacterium tuberculosis H37Rv
cggguggcgucaccg

SEQ ID NO: 3276063 - RNA, 12 nt, Mycobacterium tuberculosis H37Rv
cggguggcgucg

SEQ ID NO: 3276064 - RNA, 17 nt, Mycobacterium tuberculosis H37Rv
cggguggcuuccggggu

SEQ ID NO: 3276065 - RNA, 16 nt, Mycobacterium tuberculosis H37Rv
cgggugggagcagccg

SEQ ID NO: 3276066 - RNA, 19 nt, Mycobacterium tuberculosis H37Rv
cgggugggagcagccgaac

SEQ ID NO: 3276067 - RNA, 17 nt, Mycobacterium tuberculosis H37Rv
cgggugggcacaccggu

SEQ ID NO: 3276068 - RNA, 14 nt, Mycobacterium tuberculosis H37Rv
cgggugggccagug

SEQ ID NO: 3276069 - RNA, 22 nt, Mycobacterium tuberculosis H37Rv
cggguggucgaugugaucaccg

SEQ ID NO: 3276070 - RNA, 18 nt, Mycobacterium tuberculosis H37Rv
cgguaucgaaagccaacu

SEQ ID NO: 3276071 - RNA, 12 nt, Mycobacterium tuberculosis H37Rv
cgguaucgccaa

SEQ ID NO: 3276072 - RNA, 16 nt, Mycobacterium tuberculosis H37Rv
cgguaucggcagaugg

SEQ ID NO: 3276073 - RNA, 17 nt, Mycobacterium tuberculosis H37Rv
cgguaucggcagauggu

SEQ ID NO: 3276074 - RNA, 17 nt, Mycobacterium tuberculosis H37Rv
cgguaucggugcugguc

SEQ ID NO: 3276075 - RNA, 21 nt, Mycobacterium tuberculosis H37Rv
cgguaugcgcguccccagcgc

SEQ ID NO: 3276076 - RNA, 18 nt, Mycobacterium tuberculosis H37Rv
cgguauucccgcuuggcg

SEQ ID NO: 3276077 - RNA, 15 nt, Mycobacterium tuberculosis H37Rv
cggucaaacgcgcgc

SEQ ID NO: 3276078 - RNA, 19 nt, Mycobacterium tuberculosis H37Rv
cggucaaacgcgcgcgcca

SEQ ID NO: 3276079 - RNA, 20 nt, Mycobacterium tuberculosis H37Rv
cggucaaagaugucgcuggg

SEQ ID NO: 3276080 - RNA, 16 nt, Mycobacterium tuberculosis H37Rv
cggucaacgcugacgu

SEQ ID NO: 3276081 - RNA, 13 nt, Mycobacterium tuberculosis H37Rv
cggucaacucgaa

SEQ ID NO: 3276082 - RNA, 24 nt, Mycobacterium tuberculosis H37Rv
cggucaagccggcgcccgccgcga

SEQ ID NO: 3276083 - RNA, 18 nt, Mycobacterium tuberculosis H37Rv
cggucaaggugcgccgcc

SEQ ID NO: 3276084 - RNA, 21 nt, Mycobacterium tuberculosis H37Rv
cggucaaucccggccaggggc

SEQ ID NO: 3276085 - RNA, 22 nt, Mycobacterium tuberculosis H37Rv
cggucaauucggugcgcuggcg

SEQ ID NO: 3276086 - RNA, 15 nt, Mycobacterium tuberculosis H37Rv
cggucacacgccagc

SEQ ID NO: 3276087 - RNA, 16 nt, Mycobacterium tuberculosis H37Rv
cggucacacgccagcc

SEQ ID NO: 3276088 - RNA, 19 nt, Mycobacterium tuberculosis H37Rv
cggucacacgccagccggu

SEQ ID NO: 3276089 - RNA, 14 nt, Mycobacterium tuberculosis H37Rv
cggucaccaccgug

SEQ ID NO: 3276090 - RNA, 23 nt, Mycobacterium tuberculosis H37Rv
cggucaccacggcggcggcguag

SEQ ID NO: 3276091 - RNA, 23 nt, Mycobacterium tuberculosis H37Rv
cggucaccauggcgccgcgccga

SEQ ID NO: 3276092 - RNA, 14 nt, Mycobacterium tuberculosis H37Rv
cggucacccgugcu

SEQ ID NO: 3276093 - RNA, 21 nt, Mycobacterium tuberculosis H37Rv
cggucaccgacaauucaacac

SEQ ID NO: 3276094 - RNA, 15 nt, Mycobacterium tuberculosis H37Rv
cggucaccgcgcagc

SEQ ID NO: 3276095 - RNA, 17 nt, Mycobacterium tuberculosis H37Rv
cggucaccgcggcaugu

SEQ ID NO: 3276096 - RNA, 18 nt, Mycobacterium tuberculosis H37Rv
cggucaccgcgucaccgg

SEQ ID NO: 3276097 - RNA, 15 nt, Mycobacterium tuberculosis H37Rv
cggucaccucgaugc

SEQ ID NO: 3276098 - RNA, 16 nt, Mycobacterium tuberculosis H37Rv
cggucacgaucacgau

SEQ ID NO: 3276099 - RNA, 13 nt, Mycobacterium tuberculosis H37Rv
cggucacgcguuc

SEQ ID NO: 3276100 - RNA, 13 nt, Mycobacterium tuberculosis H37Rv
cggucacgcugug

SEQ ID NO: 3276101 - RNA, 20 nt, Mycobacterium tuberculosis H37Rv
cggucacgcugugcgguauc

SEQ ID NO: 3276102 - RNA, 15 nt, Mycobacterium tuberculosis H37Rv
cggucacucuggcga

SEQ ID NO: 3276103 - RNA, 15 nt, Mycobacterium tuberculosis H37Rv
cggucagagccgucg

SEQ ID NO: 3276104 - RNA, 18 nt, Mycobacterium tuberculosis H37Rv
cggucagaugcgccgcug

SEQ ID NO: 3276105 - RNA, 21 nt, Mycobacterium tuberculosis H37Rv
cggucagaugcgccgcugguc

SEQ ID NO: 3276106 - RNA, 15 nt, Mycobacterium tuberculosis H37Rv
cggucagauggccac

SEQ ID NO: 3276107 - RNA, 23 nt, Mycobacterium tuberculosis H37Rv
cggucagauguuguacggcccgc

SEQ ID NO: 3276108 - RNA, 22 nt, Mycobacterium tuberculosis H37Rv
cggucagcacgcugaccacaac

SEQ ID NO: 3276109 - RNA, 17 nt, Mycobacterium tuberculosis H37Rv
cggucagccauguccgc

SEQ ID NO: 3276110 - RNA, 16 nt, Mycobacterium tuberculosis H37Rv
cggucagccgcggggc

SEQ ID NO: 3276111 - RNA, 12 nt, Mycobacterium tuberculosis H37Rv
cggucagccgga

SEQ ID NO: 3276112 - RNA, 17 nt, Mycobacterium tuberculosis H37Rv
cggucagcgcgcggcuc

SEQ ID NO: 3276113 - RNA, 15 nt, Mycobacterium tuberculosis H37Rv
cggucagcgcggcgc

SEQ ID NO: 3276114 - RNA, 22 nt, Mycobacterium tuberculosis H37Rv
cggucagcgcggcgcacaaccc

SEQ ID NO: 3276115 - RNA, 18 nt, Mycobacterium tuberculosis H37Rv
cggucagcggauccaggc

SEQ ID NO: 3276116 - RNA, 17 nt, Mycobacterium tuberculosis H37Rv
cggucagcggccaaccc

SEQ ID NO: 3276117 - RNA, 19 nt, Mycobacterium tuberculosis H37Rv
cggucagcggccaacccau

SEQ ID NO: 3276118 - RNA, 17 nt, Mycobacterium tuberculosis H37Rv
cggucagcggcugggcg

SEQ ID NO: 3276119 - RNA, 22 nt, Mycobacterium tuberculosis H37Rv
cggucagcgggcacgccgccga

SEQ ID NO: 3276120 - RNA, 22 nt, Mycobacterium tuberculosis H37Rv
cggucagcgucaggugcgcgac

SEQ ID NO: 3276121 - RNA, 19 nt, Mycobacterium tuberculosis H37Rv
cggucagcucgcugacggc

SEQ ID NO: 3276122 - RNA, 19 nt, Mycobacterium tuberculosis H37Rv
cggucagcucggcagcauc

SEQ ID NO: 3276123 - RNA, 23 nt, Mycobacterium tuberculosis H37Rv
cggucaggaacaaguagccgucg

SEQ ID NO: 3276124 - RNA, 13 nt, Mycobacterium tuberculosis H37Rv
cggucaggauggg

SEQ ID NO: 3276125 - RNA, 18 nt, Mycobacterium tuberculosis H37Rv
cggucaggcaguccaccg

SEQ ID NO: 3276126 - RNA, 20 nt, Mycobacterium tuberculosis H37Rv
cggucaggccgccgcggcga

SEQ ID NO: 3276127 - RNA, 21 nt, Mycobacterium tuberculosis H37Rv
cggucaggcucauccgccggg

SEQ ID NO: 3276128 - RNA, 18 nt, Mycobacterium tuberculosis H37Rv
cggucaguauggcgacga

SEQ ID NO: 3276129 - RNA, 16 nt, Mycobacterium tuberculosis H37Rv
cggucagugggacggg

SEQ ID NO: 3276130 - RNA, 23 nt, Mycobacterium tuberculosis H37Rv
cggucagugggacgggcgcgucc

SEQ ID NO: 3276131 - RNA, 21 nt, Mycobacterium tuberculosis H37Rv
cggucaucccaagcguccgcu

SEQ ID NO: 3276132 - RNA, 18 nt, Mycobacterium tuberculosis H37Rv
cggucaucccuuucgcgc

SEQ ID NO: 3276133 - RNA, 17 nt, Mycobacterium tuberculosis H37Rv
cggucauccggccgucg

SEQ ID NO: 3276134 - RNA, 22 nt, Mycobacterium tuberculosis H37Rv
cggucauccgggcgaccaccac

SEQ ID NO: 3276135 - RNA, 13 nt, Mycobacterium tuberculosis H37Rv
cggucaucgccga

SEQ ID NO: 3276136 - RNA, 19 nt, Mycobacterium tuberculosis H37Rv
cggucaucggccgucucgg

SEQ ID NO: 3276137 - RNA, 13 nt, Mycobacterium tuberculosis H37Rv
cggucauggcgac

SEQ ID NO: 3276138 - RNA, 16 nt, Mycobacterium tuberculosis H37Rv
cggucauggcgacggu

SEQ ID NO: 3276139 - RNA, 15 nt, Mycobacterium tuberculosis H37Rv
cggucauggucagca

SEQ ID NO: 3276140 - RNA, 18 nt, Mycobacterium tuberculosis H37Rv
cgguccaaaacaccgcca

SEQ ID NO: 3276141 - RNA, 22 nt, Mycobacterium tuberculosis H37Rv
cgguccaaaacaccgccagcuc

SEQ ID NO: 3276142 - RNA, 17 nt, Mycobacterium tuberculosis H37Rv
cgguccaacagcgccag

SEQ ID NO: 3276143 - RNA, 22 nt, Mycobacterium tuberculosis H37Rv
cgguccaccgaccuaccgucga

SEQ ID NO: 3276144 - RNA, 19 nt, Mycobacterium tuberculosis H37Rv
cgguccaccgccucacugg

SEQ ID NO: 3276145 - RNA, 13 nt, Mycobacterium tuberculosis H37Rv
cgguccaccggcc

SEQ ID NO: 3276146 - RNA, 14 nt, Mycobacterium tuberculosis H37Rv
cgguccaccggccc

SEQ ID NO: 3276147 - RNA, 16 nt, Mycobacterium tuberculosis H37Rv
cgguccacgacgucga

SEQ ID NO: 3276148 - RNA, 19 nt, Mycobacterium tuberculosis H37Rv
cgguccacgacgucgagcg

SEQ ID NO: 3276149 - RNA, 22 nt, Mycobacterium tuberculosis H37Rv
cgguccacgggccgggcggugu

SEQ ID NO: 3276150 - RNA, 22 nt, Mycobacterium tuberculosis H37Rv
cgguccacugucagcgauccuc

SEQ ID NO: 3276151 - RNA, 17 nt, Mycobacterium tuberculosis H37Rv
cgguccagacaucagug

SEQ ID NO: 3276152 - RNA, 15 nt, Mycobacterium tuberculosis H37Rv
cgguccagacccagc

SEQ ID NO: 3276153 - RNA, 23 nt, Mycobacterium tuberculosis H37Rv
cgguccagcagcucggccgaggc

SEQ ID NO: 3276154 - RNA, 21 nt, Mycobacterium tuberculosis H37Rv
cgguccagccaacgggaacaa

SEQ ID NO: 3276155 - RNA, 18 nt, Mycobacterium tuberculosis H37Rv
cgguccagccaccgccgc

SEQ ID NO: 3276156 - RNA, 22 nt, Mycobacterium tuberculosis H37Rv
cgguccagcccagcgcgcgcaa

SEQ ID NO: 3276157 - RNA, 23 nt, Mycobacterium tuberculosis H37Rv
cgguccagccccaucgcuggucg

SEQ ID NO: 3276158 - RNA, 13 nt, Mycobacterium tuberculosis H37Rv
cgguccagcgucg

SEQ ID NO: 3276159 - RNA, 13 nt, Mycobacterium tuberculosis H37Rv
cgguccagggccu

SEQ ID NO: 3276160 - RNA, 15 nt, Mycobacterium tuberculosis H37Rv
cgguccagggccugu

SEQ ID NO: 3276161 - RNA, 13 nt, Mycobacterium tuberculosis H37Rv
cgguccaucccga

SEQ ID NO: 3276162 - RNA, 17 nt, Mycobacterium tuberculosis H37Rv
cgguccauggacggcca

SEQ ID NO: 3276163 - RNA, 20 nt, Mycobacterium tuberculosis H37Rv
cgguccauggacggccaggu

SEQ ID NO: 3276164 - RNA, 13 nt, Mycobacterium tuberculosis H37Rv
cgguccauucguc

SEQ ID NO: 3276165 - RNA, 19 nt, Mycobacterium tuberculosis H37Rv
cgguccauucguccgcggu

SEQ ID NO: 3276166 - RNA, 23 nt, Mycobacterium tuberculosis H37Rv
cggucgugccggggcugccgaac

SEQ ID NO: 3276167 - RNA, 17 nt, Mycobacterium tuberculosis H37Rv
cggucguuggucggggu

SEQ ID NO: 3276168 - RNA, 18 nt, Mycobacterium tuberculosis H37Rv
cggucguuggugcagacc

SEQ ID NO: 3276169 - RNA, 15 nt, Mycobacterium tuberculosis H37Rv
cggucuagcugggua

SEQ ID NO: 3276170 - RNA, 17 nt, Mycobacterium tuberculosis H37Rv
cggucucagugcucgcc

SEQ ID NO: 3276171 - RNA, 18 nt, Mycobacterium tuberculosis H37Rv
cggucucaugcacccggu

SEQ ID NO: 3276172 - RNA, 21 nt, Mycobacterium tuberculosis H37Rv
cggucuccgcccgcgggcccc

SEQ ID NO: 3276173 - RNA, 15 nt, Mycobacterium tuberculosis H37Rv
cggucuccgcugaug

SEQ ID NO: 3276174 - RNA, 23 nt, Mycobacterium tuberculosis H37Rv
cggucucggaaacggaccuccuc

SEQ ID NO: 3276175 - RNA, 19 nt, Mycobacterium tuberculosis H37Rv
cggucucguaaccaggcua

SEQ ID NO: 3276176 - RNA, 16 nt, Mycobacterium tuberculosis H37Rv
cggucucgucgcgggu

SEQ ID NO: 3276177 - RNA, 22 nt, Mycobacterium tuberculosis H37Rv
cggucucgucgcggguccaggc

SEQ ID NO: 3276178 - RNA, 20 nt, Mycobacterium tuberculosis H37Rv
cggucugaccgcgucggcgu

SEQ ID NO: 3276179 - RNA, 13 nt, Mycobacterium tuberculosis H37Rv
cggucugcaugcg

SEQ ID NO: 3276180 - RNA, 17 nt, Mycobacterium tuberculosis H37Rv
cggucugcuccaggcgc

SEQ ID NO: 3276181 - RNA, 15 nt, Mycobacterium tuberculosis H37Rv
cggucuggacaucgg

SEQ ID NO: 3276182 - RNA, 14 nt, Mycobacterium tuberculosis H37Rv
cggucuggcgauga

SEQ ID NO: 3276183 - RNA, 19 nt, Mycobacterium tuberculosis H37Rv
cggucugguugggccagcu

SEQ ID NO: 3276184 - RNA, 18 nt, Mycobacterium tuberculosis H37Rv
cggucuuacggucggcuc

SEQ ID NO: 3276185 - RNA, 18 nt, Mycobacterium tuberculosis H37Rv
cggucuugggcgcgggug

SEQ ID NO: 3276186 - RNA, 17 nt, Mycobacterium tuberculosis H37Rv
cggucuuugagccggua

SEQ ID NO: 3276187 - RNA, 19 nt, Mycobacterium tuberculosis H37Rv
cggucuuuguccgucgcgu

SEQ ID NO: 3276188 - RNA, 17 nt, Mycobacterium tuberculosis H37Rv
cggugaaaaaggcgacu

SEQ ID NO: 3276189 - RNA, 21 nt, Mycobacterium tuberculosis H37Rv
cggugaaaccggccuucucgc

SEQ ID NO: 3276190 - RNA, 19 nt, Mycobacterium tuberculosis H37Rv
cggugaaaucgcacagcgc

SEQ ID NO: 3276191 - RNA, 18 nt, Mycobacterium tuberculosis H37Rv
cggugaaaugacggcuga

SEQ ID NO: 3276192 - RNA, 18 nt, Mycobacterium tuberculosis H37Rv
cggugaacaaaugccggu

SEQ ID NO: 3276193 - RNA, 15 nt, Mycobacterium tuberculosis H37Rv
cggugaacaccgcca

SEQ ID NO: 3276194 - RNA, 14 nt, Mycobacterium tuberculosis H37Rv
cggugaaccaacgc

SEQ ID NO: 3276195 - RNA, 19 nt, Mycobacterium tuberculosis H37Rv
cggugaaccgggacagcag

SEQ ID NO: 3276196 - RNA, 15 nt, Mycobacterium tuberculosis H37Rv
cggugaacgccgccc

SEQ ID NO: 3276197 - RNA, 17 nt, Mycobacterium tuberculosis H37Rv
cggugaacgccgccccg

SEQ ID NO: 3276198 - RNA, 16 nt, Mycobacterium tuberculosis H37Rv
cggugaacggcaaggu

SEQ ID NO: 3276199 - RNA, 17 nt, Mycobacterium tuberculosis H37Rv
cggugaacgguagcacu

SEQ ID NO: 3276200 - RNA, 17 nt, Mycobacterium tuberculosis H37Rv
cggugaacuucuccacc

SEQ ID NO: 3276201 - RNA, 21 nt, Mycobacterium tuberculosis H37Rv
cggugaacuucuccaccagcg

SEQ ID NO: 3276202 - RNA, 20 nt, Mycobacterium tuberculosis H37Rv
cggugaagaaguucggguag

SEQ ID NO: 3276203 - RNA, 19 nt, Mycobacterium tuberculosis H37Rv
cggugaaggucaccgucga

SEQ ID NO: 3276204 - RNA, 21 nt, Mycobacterium tuberculosis H37Rv
cggugaaggucaccgucgagu

SEQ ID NO: 3276205 - RNA, 22 nt, Mycobacterium tuberculosis H37Rv
cggugaaggucaccgucgaguc

SEQ ID NO: 3276206 - RNA, 20 nt, Mycobacterium tuberculosis H37Rv
cggugaaguagugcucgcag

SEQ ID NO: 3276207 - RNA, 22 nt, Mycobacterium tuberculosis H37Rv
cggugaaguccuccacgcuggc

SEQ ID NO: 3276208 - RNA, 17 nt, Mycobacterium tuberculosis H37Rv
cggugaaucgucugacg

SEQ ID NO: 3276209 - RNA, 13 nt, Mycobacterium tuberculosis H37Rv
cggugaaugccgu

SEQ ID NO: 3276210 - RNA, 18 nt, Mycobacterium tuberculosis H37Rv
cggugaauucacgaugcu

SEQ ID NO: 3276211 - RNA, 20 nt, Mycobacterium tuberculosis H37Rv
cggugacaagcggcccgcug

SEQ ID NO: 3276212 - RNA, 21 nt, Mycobacterium tuberculosis H37Rv
cggugacaagcggcccgcugu

SEQ ID NO: 3276213 - RNA, 22 nt, Mycobacterium tuberculosis H37Rv
cggugacauagacguugccgga

SEQ ID NO: 3276214 - RNA, 12 nt, Mycobacterium tuberculosis H37Rv
cggugacccgcu

SEQ ID NO: 3276215 - RNA, 12 nt, Mycobacterium tuberculosis H37Rv
cggugaccgggu

SEQ ID NO: 3276216 - RNA, 19 nt, Mycobacterium tuberculosis H37Rv
cggugaccucaccaaccgc

SEQ ID NO: 3276217 - RNA, 22 nt, Mycobacterium tuberculosis H37Rv
cggugaccuucgcuauggcggc

SEQ ID NO: 3276218 - RNA, 19 nt, Mycobacterium tuberculosis H37Rv
cggugacgaaacagagcgu

SEQ ID NO: 3276219 - RNA, 14 nt, Mycobacterium tuberculosis H37Rv
cggugacgaagagc

SEQ ID NO: 3276220 - RNA, 20 nt, Mycobacterium tuberculosis H37Rv
cggugacgaagagcaccgcg

SEQ ID NO: 3276221 - RNA, 15 nt, Mycobacterium tuberculosis H37Rv
cggugacgaccauac

SEQ ID NO: 3276222 - RNA, 16 nt, Mycobacterium tuberculosis H37Rv
cggugacgaugaccgc

SEQ ID NO: 3276223 - RNA, 17 nt, Mycobacterium tuberculosis H37Rv
cggugacgaugaccgcg

SEQ ID NO: 3276224 - RNA, 14 nt, Mycobacterium tuberculosis H37Rv
cggugacgccagcc

SEQ ID NO: 3276225 - RNA, 17 nt, Mycobacterium tuberculosis H37Rv
cggugacgccagccugg

SEQ ID NO: 3276226 - RNA, 13 nt, Mycobacterium tuberculosis H37Rv
cggugacgccguc

SEQ ID NO: 3276227 - RNA, 20 nt, Mycobacterium tuberculosis H37Rv
cggugacgggaucgucggca

SEQ ID NO: 3276228 - RNA, 17 nt, Mycobacterium tuberculosis H37Rv
cggugacggggcugacc

SEQ ID NO: 3276229 - RNA, 19 nt, Mycobacterium tuberculosis H37Rv
cggugacgggguugaccgc

SEQ ID NO: 3276230 - RNA, 21 nt, Mycobacterium tuberculosis H37Rv
cggugacgggguugaccgcca

SEQ ID NO: 3276231 - RNA, 13 nt, Mycobacterium tuberculosis H37Rv
cggugacgguguu

SEQ ID NO: 3276232 - RNA, 22 nt, Mycobacterium tuberculosis H37Rv
cggugacgucgccgggcggcgg

SEQ ID NO: 3276233 - RNA, 19 nt, Mycobacterium tuberculosis H37Rv
cggugacguuggcaggcag

SEQ ID NO: 3276234 - RNA, 19 nt, Mycobacterium tuberculosis H37Rv
cggugacucggccuccgcc

SEQ ID NO: 3276235 - RNA, 16 nt, Mycobacterium tuberculosis H37Rv
cggugagaagaagccc

SEQ ID NO: 3276236 - RNA, 12 nt, Mycobacterium tuberculosis H37Rv
cggugagaucgg

SEQ ID NO: 3276237 - RNA, 12 nt, Mycobacterium tuberculosis H37Rv
cggugagcaccg

SEQ ID NO: 3276238 - RNA, 21 nt, Mycobacterium tuberculosis H37Rv
cggugagcagcucggugacaa

SEQ ID NO: 3276239 - RNA, 15 nt, Mycobacterium tuberculosis H37Rv
cggugagcagggcgg

SEQ ID NO: 3276240 - RNA, 14 nt, Mycobacterium tuberculosis H37Rv
cggugagccgggcg

SEQ ID NO: 3276241 - RNA, 20 nt, Mycobacterium tuberculosis H37Rv
cggugagccgugccgccagc

SEQ ID NO: 3276242 - RNA, 13 nt, Mycobacterium tuberculosis H37Rv
cggugagcgagcg

SEQ ID NO: 3276243 - RNA, 18 nt, Mycobacterium tuberculosis H37Rv
cggugagcgagcgcgcgu

SEQ ID NO: 3276244 - RNA, 20 nt, Mycobacterium tuberculosis H37Rv
cggugagcgagcgcgcguag

SEQ ID NO: 3276245 - RNA, 21 nt, Mycobacterium tuberculosis H37Rv
cggugagcucuucggacacag

SEQ ID NO: 3276246 - RNA, 21 nt, Mycobacterium tuberculosis H37Rv
cggugagcugcacgccgauac

SEQ ID NO: 3276247 - RNA, 17 nt, Mycobacterium tuberculosis H37Rv
cggugaggaagcggccg

SEQ ID NO: 3276248 - RNA, 13 nt, Mycobacterium tuberculosis H37Rv
cggugaggcagcg

SEQ ID NO: 3276249 - RNA, 23 nt, Mycobacterium tuberculosis H37Rv
cggugagggguugcggucgacgu

SEQ ID NO: 3276250 - RNA, 16 nt, Mycobacterium tuberculosis H37Rv
cggugaggucgaugcc

SEQ ID NO: 3276251 - RNA, 16 nt, Mycobacterium tuberculosis H37Rv
cggugaggucgguguu

SEQ ID NO: 3276252 - RNA, 16 nt, Mycobacterium tuberculosis H37Rv
cggugaguccgcugag

SEQ ID NO: 3276253 - RNA, 17 nt, Mycobacterium tuberculosis H37Rv
cggugagugaaucgcgg

SEQ ID NO: 3276254 - RNA, 16 nt, Mycobacterium tuberculosis H37Rv
cggugaucaccaugau

SEQ ID NO: 3276255 - RNA, 17 nt, Mycobacterium tuberculosis H37Rv
cggugaucaccaugauc

SEQ ID NO: 3276256 - RNA, 18 nt, Mycobacterium tuberculosis H37Rv
cggugaucaccgcggcgg

SEQ ID NO: 3276257 - RNA, 21 nt, Mycobacterium tuberculosis H37Rv
cggugaucacggucggcgggu

SEQ ID NO: 3276258 - RNA, 21 nt, Mycobacterium tuberculosis H37Rv
cggugaucagguaagcgaacg

SEQ ID NO: 3276259 - RNA, 17 nt, Mycobacterium tuberculosis H37Rv
cggugauccaacuggcc

SEQ ID NO: 3276260 - RNA, 14 nt, Mycobacterium tuberculosis H37Rv
cggugaucccacga

SEQ ID NO: 3276261 - RNA, 13 nt, Mycobacterium tuberculosis H37Rv
cggugaucgaggu

SEQ ID NO: 3276262 - RNA, 15 nt, Mycobacterium tuberculosis H37Rv
cggugcgauaccgac

SEQ ID NO: 3276263 - RNA, 20 nt, Mycobacterium tuberculosis H37Rv
cggugcgaucccacccucgg

SEQ ID NO: 3276264 - RNA, 23 nt, Mycobacterium tuberculosis H37Rv
cggugcgauccugaccagccagg

SEQ ID NO: 3276265 - RNA, 20 nt, Mycobacterium tuberculosis H37Rv
cggugcgauuccgcgucugc

SEQ ID NO: 3276266 - RNA, 21 nt, Mycobacterium tuberculosis H37Rv
cggugcgauuccgcgucugcu

SEQ ID NO: 3276267 - RNA, 12 nt, Mycobacterium tuberculosis H37Rv
cggugcgcacca

SEQ ID NO: 3276268 - RNA, 16 nt, Mycobacterium tuberculosis H37Rv
cggugcgcaccaccga

SEQ ID NO: 3276269 - RNA, 15 nt, Mycobacterium tuberculosis H37Rv
cggugcgcagcugcg

SEQ ID NO: 3276270 - RNA, 22 nt, Mycobacterium tuberculosis H37Rv
cggugcgcagguacgccucgac

SEQ ID NO: 3276271 - RNA, 23 nt, Mycobacterium tuberculosis H37Rv
cggugcgccacgaccgcggcggc

SEQ ID NO: 3276272 - RNA, 19 nt, Mycobacterium tuberculosis H37Rv
cggugcgccagaucaccgu

SEQ ID NO: 3276273 - RNA, 22 nt, Mycobacterium tuberculosis H37Rv
cggugcgccagaucaccgucga

SEQ ID NO: 3276274 - RNA, 13 nt, Mycobacterium tuberculosis H37Rv
cggugcgcgcaga

SEQ ID NO: 3276275 - RNA, 14 nt, Mycobacterium tuberculosis H37Rv
cggugcgcgcagac

SEQ ID NO: 3276276 - RNA, 19 nt, Mycobacterium tuberculosis H37Rv
cggugcgcuggaucuucga

SEQ ID NO: 3276277 - RNA, 16 nt, Mycobacterium tuberculosis H37Rv
cggugcgcuggcggcg

SEQ ID NO: 3276278 - RNA, 14 nt, Mycobacterium tuberculosis H37Rv
cggugcggaacacc

SEQ ID NO: 3276279 - RNA, 16 nt, Mycobacterium tuberculosis H37Rv
cggugcggaacaccgc

SEQ ID NO: 3276280 - RNA, 21 nt, Mycobacterium tuberculosis H37Rv
cggugcggaacaccgcccggc

SEQ ID NO: 3276281 - RNA, 16 nt, Mycobacterium tuberculosis H37Rv
cggugcggaacacgau

SEQ ID NO: 3276282 - RNA, 15 nt, Mycobacterium tuberculosis H37Rv
cggugcggcaacagc

SEQ ID NO: 3276283 - RNA, 18 nt, Mycobacterium tuberculosis H37Rv
cggugcggcagauacucg

SEQ ID NO: 3276284 - RNA, 21 nt, Mycobacterium tuberculosis H37Rv
cggugcggccaaugacgucgg

SEQ ID NO: 3276285 - RNA, 23 nt, Mycobacterium tuberculosis H37Rv
cggugcggucagauucggcgaug

SEQ ID NO: 3276286 - RNA, 14 nt, Mycobacterium tuberculosis H37Rv
cggugcggugcaca

SEQ ID NO: 3276287 - RNA, 17 nt, Mycobacterium tuberculosis H37Rv
cggugcgguggugcgca

SEQ ID NO: 3276288 - RNA, 23 nt, Mycobacterium tuberculosis H37Rv
cggugcgguuucaccgacgacgc

SEQ ID NO: 3276289 - RNA, 16 nt, Mycobacterium tuberculosis H37Rv
cggugcgucagcuggu

SEQ ID NO: 3276290 - RNA, 14 nt, Mycobacterium tuberculosis H37Rv
cggugcguccggug

SEQ ID NO: 3276291 - RNA, 20 nt, Mycobacterium tuberculosis H37Rv
cggugcguccggugcugguc

SEQ ID NO: 3276292 - RNA, 14 nt, Mycobacterium tuberculosis H37Rv
cggugcuaaccgac

SEQ ID NO: 3276293 - RNA, 16 nt, Mycobacterium tuberculosis H37Rv
cggugcuaccggcuug

SEQ ID NO: 3276294 - RNA, 18 nt, Mycobacterium tuberculosis H37Rv
cggugcucaagcgcgucg

SEQ ID NO: 3276295 - RNA, 13 nt, Mycobacterium tuberculosis H37Rv
cggugcuccucgg

SEQ ID NO: 3276296 - RNA, 22 nt, Mycobacterium tuberculosis H37Rv
cggugcuccucggcaggccgac

SEQ ID NO: 3276297 - RNA, 18 nt, Mycobacterium tuberculosis H37Rv
cggugcucuucggcacca

SEQ ID NO: 3276298 - RNA, 16 nt, Mycobacterium tuberculosis H37Rv
cggugcugaccccgcc

SEQ ID NO: 3276299 - RNA, 15 nt, Mycobacterium tuberculosis H37Rv
cggugcugcgccgau

SEQ ID NO: 3276300 - RNA, 17 nt, Mycobacterium tuberculosis H37Rv
cggugcugcgccgauac

SEQ ID NO: 3276301 - RNA, 14 nt, Mycobacterium tuberculosis H37Rv
cggugcugcgggaa

SEQ ID NO: 3276302 - RNA, 16 nt, Mycobacterium tuberculosis H37Rv
cggugcugguccaggc

SEQ ID NO: 3276303 - RNA, 17 nt, Mycobacterium tuberculosis H37Rv
cggugcuguugcgcggu

SEQ ID NO: 3276304 - RNA, 13 nt, Mycobacterium tuberculosis H37Rv
cgguggacgagcc

SEQ ID NO: 3276305 - RNA, 16 nt, Mycobacterium tuberculosis H37Rv
cgguggacgauacgcg

SEQ ID NO: 3276306 - RNA, 19 nt, Mycobacterium tuberculosis H37Rv
cgguggacggcaggcggcc

SEQ ID NO: 3276307 - RNA, 18 nt, Mycobacterium tuberculosis H37Rv
cgguggagcgcgggaugu

SEQ ID NO: 3276308 - RNA, 20 nt, Mycobacterium tuberculosis H37Rv
cgguggaggcguagucggcg

SEQ ID NO: 3276309 - RNA, 12 nt, Mycobacterium tuberculosis H37Rv
cgguggcaccau

SEQ ID NO: 3276310 - RNA, 14 nt, Mycobacterium tuberculosis H37Rv
cgguggcacgcuga

SEQ ID NO: 3276311 - RNA, 15 nt, Mycobacterium tuberculosis H37Rv
cgguggcacggcccc

SEQ ID NO: 3276312 - RNA, 16 nt, Mycobacterium tuberculosis H37Rv
cgguggcagagccgcc

SEQ ID NO: 3276313 - RNA, 13 nt, Mycobacterium tuberculosis H37Rv
cgguggcagcaca

SEQ ID NO: 3276314 - RNA, 17 nt, Mycobacterium tuberculosis H37Rv
cgguggcagccugcugc

SEQ ID NO: 3276315 - RNA, 20 nt, Mycobacterium tuberculosis H37Rv
cgguggccaacaccgccagc

SEQ ID NO: 3276316 - RNA, 21 nt, Mycobacterium tuberculosis H37Rv
cgguggccaacaccgccagca

SEQ ID NO: 3276317 - RNA, 14 nt, Mycobacterium tuberculosis H37Rv
cgguggccagaucg

SEQ ID NO: 3276318 - RNA, 13 nt, Mycobacterium tuberculosis H37Rv
cgguggccccgau

SEQ ID NO: 3276319 - RNA, 18 nt, Mycobacterium tuberculosis H37Rv
cgguggcccgccggcagu

SEQ ID NO: 3276320 - RNA, 20 nt, Mycobacterium tuberculosis H37Rv
cgguggccgacaagucaaga

SEQ ID NO: 3276321 - RNA, 14 nt, Mycobacterium tuberculosis H37Rv
cgguggccgcacga

SEQ ID NO: 3276322 - RNA, 14 nt, Mycobacterium tuberculosis H37Rv
cgguggccgcaucg

SEQ ID NO: 3276323 - RNA, 17 nt, Mycobacterium tuberculosis H37Rv
cgguggccgcgcugguc

SEQ ID NO: 3276324 - RNA, 17 nt, Mycobacterium tuberculosis H37Rv
cgguggccggcaacggc

SEQ ID NO: 3276325 - RNA, 14 nt, Mycobacterium tuberculosis H37Rv
cgguggccgucggg

SEQ ID NO: 3276326 - RNA, 15 nt, Mycobacterium tuberculosis H37Rv
cgguggccgucgggu

SEQ ID NO: 3276327 - RNA, 16 nt, Mycobacterium tuberculosis H37Rv
cgguggccucccacgg

SEQ ID NO: 3276328 - RNA, 19 nt, Mycobacterium tuberculosis H37Rv
cgguggcgccgccgccaau

SEQ ID NO: 3276329 - RNA, 18 nt, Mycobacterium tuberculosis H37Rv
cgguggcgccggggccgc

SEQ ID NO: 3276330 - RNA, 21 nt, Mycobacterium tuberculosis H37Rv
cgguggcgccggggccgccga

SEQ ID NO: 3276331 - RNA, 17 nt, Mycobacterium tuberculosis H37Rv
cgguggcgccggggcgc

SEQ ID NO: 3276332 - RNA, 15 nt, Mycobacterium tuberculosis H37Rv
cgguggcgcggugcc

SEQ ID NO: 3276333 - RNA, 18 nt, Mycobacterium tuberculosis H37Rv
cgguggcggacggcguuu

SEQ ID NO: 3276334 - RNA, 14 nt, Mycobacterium tuberculosis H37Rv
cgguggcggcagca

SEQ ID NO: 3276335 - RNA, 16 nt, Mycobacterium tuberculosis H37Rv
cgguggcggccuccga

SEQ ID NO: 3276336 - RNA, 19 nt, Mycobacterium tuberculosis H37Rv
cgguggcgucgucggcggg

SEQ ID NO: 3276337 - RNA, 15 nt, Mycobacterium tuberculosis H37Rv
cgguggcguggucuc

SEQ ID NO: 3276338 - RNA, 12 nt, Mycobacterium tuberculosis H37Rv
cgguggcuacgc

SEQ ID NO: 3276339 - RNA, 18 nt, Mycobacterium tuberculosis H37Rv
cgguggcuacgccccacu

SEQ ID NO: 3276340 - RNA, 19 nt, Mycobacterium tuberculosis H37Rv
cgguggcucuguagcgucg

SEQ ID NO: 3276341 - RNA, 16 nt, Mycobacterium tuberculosis H37Rv
cgguggcugaucaccg

SEQ ID NO: 3276342 - RNA, 21 nt, Mycobacterium tuberculosis H37Rv
cggugggcgccgacaccggcu

SEQ ID NO: 3276343 - RNA, 13 nt, Mycobacterium tuberculosis H37Rv
cggugggcgggca

SEQ ID NO: 3276344 - RNA, 13 nt, Mycobacterium tuberculosis H37Rv
cggugggcgucau

SEQ ID NO: 3276345 - RNA, 21 nt, Mycobacterium tuberculosis H37Rv
cggugggcuugccgcgcacca

SEQ ID NO: 3276346 - RNA, 18 nt, Mycobacterium tuberculosis H37Rv
cgguggggacccgcucca

SEQ ID NO: 3276347 - RNA, 13 nt, Mycobacterium tuberculosis H37Rv
cgguggggcccuc

SEQ ID NO: 3276348 - RNA, 14 nt, Mycobacterium tuberculosis H37Rv
cggugggggcggcg

SEQ ID NO: 3276349 - RNA, 15 nt, Mycobacterium tuberculosis H37Rv
cgguggggucgacgc

SEQ ID NO: 3276350 - RNA, 16 nt, Mycobacterium tuberculosis H37Rv
cgguggggucgacgca

SEQ ID NO: 3276351 - RNA, 20 nt, Mycobacterium tuberculosis H37Rv
cggugggguuggcuccggug

SEQ ID NO: 3276352 - RNA, 21 nt, Mycobacterium tuberculosis H37Rv
cggugggucugcucagcgcgg

SEQ ID NO: 3276353 - RNA, 15 nt, Mycobacterium tuberculosis H37Rv
cggugggugccagcc

SEQ ID NO: 3276354 - RNA, 17 nt, Mycobacterium tuberculosis H37Rv
cggugggugccagccgg

SEQ ID NO: 3276355 - RNA, 20 nt, Mycobacterium tuberculosis H37Rv
cggugguaauacgucccgag

SEQ ID NO: 3276356 - RNA, 14 nt, Mycobacterium tuberculosis H37Rv
cggugguagcgacg

SEQ ID NO: 3276357 - RNA, 19 nt, Mycobacterium tuberculosis H37Rv
cggugguaggacgccagca

SEQ ID NO: 3276358 - RNA, 12 nt, Mycobacterium tuberculosis H37Rv
cgguggucagca

SEQ ID NO: 3276359 - RNA, 15 nt, Mycobacterium tuberculosis H37Rv
cgguugaccggucga

SEQ ID NO: 3276360 - RNA, 18 nt, Mycobacterium tuberculosis H37Rv
cgguugacgggcucggca

SEQ ID NO: 3276361 - RNA, 19 nt, Mycobacterium tuberculosis H37Rv
cgguugaucgccggccugc

SEQ ID NO: 3276362 - RNA, 17 nt, Mycobacterium tuberculosis H37Rv
cgguugaucuccucgau

SEQ ID NO: 3276363 - RNA, 21 nt, Mycobacterium tuberculosis H37Rv
cgguugaugaucuuggugaag

SEQ ID NO: 3276364 - RNA, 18 nt, Mycobacterium tuberculosis H37Rv
cgguugaugguccgccag

SEQ ID NO: 3276365 - RNA, 17 nt, Mycobacterium tuberculosis H37Rv
cgguugcauaccgccgg

SEQ ID NO: 3276366 - RNA, 22 nt, Mycobacterium tuberculosis H37Rv
cgguugcauccauccugccuua

SEQ ID NO: 3276367 - RNA, 17 nt, Mycobacterium tuberculosis H37Rv
cgguugccacgccgccg

SEQ ID NO: 3276368 - RNA, 13 nt, Mycobacterium tuberculosis H37Rv
cgguugccccggc

SEQ ID NO: 3276369 - RNA, 14 nt, Mycobacterium tuberculosis H37Rv
cgguugccggcggc

SEQ ID NO: 3276370 - RNA, 20 nt, Mycobacterium tuberculosis H37Rv
cgguugcggucaucggcgcc

SEQ ID NO: 3276371 - RNA, 21 nt, Mycobacterium tuberculosis H37Rv
cgguugcggucaucggcgcca

SEQ ID NO: 3276372 - RNA, 22 nt, Mycobacterium tuberculosis H37Rv
cgguuggagguaauccggcugc

SEQ ID NO: 3276373 - RNA, 13 nt, Mycobacterium tuberculosis H37Rv
cgguuggccacca

SEQ ID NO: 3276374 - RNA, 16 nt, Mycobacterium tuberculosis H37Rv
cgguuggccagccaca

SEQ ID NO: 3276375 - RNA, 15 nt, Mycobacterium tuberculosis H37Rv
cgguugguccgccgu

SEQ ID NO: 3276376 - RNA, 21 nt, Mycobacterium tuberculosis H37Rv
cgguugguccgccgucgacca

SEQ ID NO: 3276377 - RNA, 21 nt, Mycobacterium tuberculosis H37Rv
cgguuguagaccucuucggag

SEQ ID NO: 3276378 - RNA, 14 nt, Mycobacterium tuberculosis H37Rv
cgguuguccuccga

SEQ ID NO: 3276379 - RNA, 17 nt, Mycobacterium tuberculosis H37Rv
cgguuuccuccggcagc

SEQ ID NO: 3276380 - RNA, 15 nt, Mycobacterium tuberculosis H37Rv
cgguuucgaccacca

SEQ ID NO: 3276381 - RNA, 16 nt, Mycobacterium tuberculosis H37Rv
cgguuugcacgcacca

SEQ ID NO: 3276382 - RNA, 18 nt, Mycobacterium tuberculosis H37Rv
cgguuugcacgcaccaca

SEQ ID NO: 3276383 - RNA, 23 nt, Mycobacterium tuberculosis H37Rv
cgguuugccagugauggcgcggu

SEQ ID NO: 3276384 - RNA, 16 nt, Mycobacterium tuberculosis H37Rv
cgguuugcguccuggu

SEQ ID NO: 3276385 - RNA, 17 nt, Mycobacterium tuberculosis H37Rv
cgguuuggaucacccgc

SEQ ID NO: 3276386 - RNA, 20 nt, Mycobacterium tuberculosis H37Rv
cgguuuggaucacccgccgc

SEQ ID NO: 3276387 - RNA, 19 nt, Mycobacterium tuberculosis H37Rv
cgguuuuggucgcgaugac

SEQ ID NO: 3276388 - RNA, 22 nt, Mycobacterium tuberculosis H37Rv
cguaaaccgauaucgcugcgga

SEQ ID NO: 3276389 - RNA, 17 nt, Mycobacterium tuberculosis H37Rv
cguaaagggcgucguag

SEQ ID NO: 3276390 - RNA, 13 nt, Mycobacterium tuberculosis H37Rv
cguaacagccggc

SEQ ID NO: 3276391 - RNA, 14 nt, Mycobacterium tuberculosis H37Rv
cguaaccggcagcg

SEQ ID NO: 3276392 - RNA, 21 nt, Mycobacterium tuberculosis H37Rv
cguaaccuggggugaacucca

SEQ ID NO: 3276393 - RNA, 23 nt, Mycobacterium tuberculosis H37Rv
cguaacgccaagcucggcccagc

SEQ ID NO: 3276394 - RNA, 15 nt, Mycobacterium tuberculosis H37Rv
cguaacgccgcucau

SEQ ID NO: 3276395 - RNA, 21 nt, Mycobacterium tuberculosis H37Rv
cguaaggccggagucgacgac

SEQ ID NO: 3276396 - RNA, 16 nt, Mycobacterium tuberculosis H37Rv
cguaauagcugcgucc

SEQ ID NO: 3276397 - RNA, 13 nt, Mycobacterium tuberculosis H37Rv
cguaauuccccag

SEQ ID NO: 3276398 - RNA, 22 nt, Mycobacterium tuberculosis H37Rv
cguaauuccccaggugugugcc

SEQ ID NO: 3276399 - RNA, 14 nt, Mycobacterium tuberculosis H37Rv
cguacaacagcgcg

SEQ ID NO: 3276400 - RNA, 13 nt, Mycobacterium tuberculosis H37Rv
cguacaacgccgg

SEQ ID NO: 3276401 - RNA, 15 nt, Mycobacterium tuberculosis H37Rv
cguacacaccgagca

SEQ ID NO: 3276402 - RNA, 14 nt, Mycobacterium tuberculosis H37Rv
cguacagcgccugg

SEQ ID NO: 3276403 - RNA, 16 nt, Mycobacterium tuberculosis H37Rv
cguacaggccggccac

SEQ ID NO: 3276404 - RNA, 16 nt, Mycobacterium tuberculosis H37Rv
cguacagugucugcca

SEQ ID NO: 3276405 - RNA, 17 nt, Mycobacterium tuberculosis H37Rv
cguacaucagcgcgaac

SEQ ID NO: 3276406 - RNA, 15 nt, Mycobacterium tuberculosis H37Rv
cguaccagcuggcca

SEQ ID NO: 3276407 - RNA, 21 nt, Mycobacterium tuberculosis H37Rv
cguacccguuaugcgccgccc

SEQ ID NO: 3276408 - RNA, 12 nt, Mycobacterium tuberculosis H37Rv
cguaccgacagg

SEQ ID NO: 3276409 - RNA, 16 nt, Mycobacterium tuberculosis H37Rv
cguaccgauuccaugc

SEQ ID NO: 3276410 - RNA, 11 nt, Mycobacterium tuberculosis H37Rv
cguaccgcgcg

SEQ ID NO: 3276411 - RNA, 14 nt, Mycobacterium tuberculosis H37Rv
cguaccggccuuca

SEQ ID NO: 3276412 - RNA, 16 nt, Mycobacterium tuberculosis H37Rv
cguacgacagucgcag

SEQ ID NO: 3276413 - RNA, 16 nt, Mycobacterium tuberculosis H37Rv
cguacgcacgcagccc

SEQ ID NO: 3276414 - RNA, 16 nt, Mycobacterium tuberculosis H37Rv
cguacgccggacccgg

SEQ ID NO: 3276415 - RNA, 15 nt, Mycobacterium tuberculosis H37Rv
cguacgccggcggug

SEQ ID NO: 3276416 - RNA, 15 nt, Mycobacterium tuberculosis H37Rv
cguacggggucgccg

SEQ ID NO: 3276417 - RNA, 20 nt, Mycobacterium tuberculosis H37Rv
cguacgggucggcgacgaac

SEQ ID NO: 3276418 - RNA, 15 nt, Mycobacterium tuberculosis H37Rv
cguacucggcgcgca

SEQ ID NO: 3276419 - RNA, 18 nt, Mycobacterium tuberculosis H37Rv
cguacucggcgcgcagcg

SEQ ID NO: 3276420 - RNA, 18 nt, Mycobacterium tuberculosis H37Rv
cguacucggcggccacca

SEQ ID NO: 3276421 - RNA, 13 nt, Mycobacterium tuberculosis H37Rv
cguacugaucuuc

SEQ ID NO: 3276422 - RNA, 14 nt, Mycobacterium tuberculosis H37Rv
cguacugaucuucg

SEQ ID NO: 3276423 - RNA, 15 nt, Mycobacterium tuberculosis H37Rv
cguacugcuugaugg

SEQ ID NO: 3276424 - RNA, 14 nt, Mycobacterium tuberculosis H37Rv
cguacuugccaccc

SEQ ID NO: 3276425 - RNA, 22 nt, Mycobacterium tuberculosis H37Rv
cguagaaccggggugaggcuuc

SEQ ID NO: 3276426 - RNA, 16 nt, Mycobacterium tuberculosis H37Rv
cguagaaucggcucag

SEQ ID NO: 3276427 - RNA, 22 nt, Mycobacterium tuberculosis H37Rv
cguagaaugcgccgucgguggg

SEQ ID NO: 3276428 - RNA, 13 nt, Mycobacterium tuberculosis H37Rv
cguagaccagcag

SEQ ID NO: 3276429 - RNA, 19 nt, Mycobacterium tuberculosis H37Rv
cguagaccagcaggcccug

SEQ ID NO: 3276430 - RNA, 13 nt, Mycobacterium tuberculosis H37Rv
cguagaccaggcc

SEQ ID NO: 3276431 - RNA, 20 nt, Mycobacterium tuberculosis H37Rv
cguagaccaggcccagguca

SEQ ID NO: 3276432 - RNA, 21 nt, Mycobacterium tuberculosis H37Rv
cguagaccaggcccaggucaa

SEQ ID NO: 3276433 - RNA, 14 nt, Mycobacterium tuberculosis H37Rv
cguagacccacagu

SEQ ID NO: 3276434 - RNA, 22 nt, Mycobacterium tuberculosis H37Rv
cguagaccuucgaguagggcca

SEQ ID NO: 3276435 - RNA, 23 nt, Mycobacterium tuberculosis H37Rv
cguagacgacaucgucaucagcg

SEQ ID NO: 3276436 - RNA, 18 nt, Mycobacterium tuberculosis H37Rv
cguagacgacgucggccg

SEQ ID NO: 3276437 - RNA, 20 nt, Mycobacterium tuberculosis H37Rv
cguagacguccgcggucgca

SEQ ID NO: 3276438 - RNA, 15 nt, Mycobacterium tuberculosis H37Rv
cguagagcagcagcg

SEQ ID NO: 3276439 - RNA, 17 nt, Mycobacterium tuberculosis H37Rv
cguagagccgcucggcg

SEQ ID NO: 3276440 - RNA, 15 nt, Mycobacterium tuberculosis H37Rv
cguagaggacugcgg

SEQ ID NO: 3276441 - RNA, 21 nt, Mycobacterium tuberculosis H37Rv
cguagagucguuuggcgccgc

SEQ ID NO: 3276442 - RNA, 22 nt, Mycobacterium tuberculosis H37Rv
cguagagucguuuggcgccgcc

SEQ ID NO: 3276443 - RNA, 23 nt, Mycobacterium tuberculosis H37Rv
cguagagucguuuggcgccgccg

SEQ ID NO: 3276444 - RNA, 19 nt, Mycobacterium tuberculosis H37Rv
cguagaucaucuggcuggu

SEQ ID NO: 3276445 - RNA, 23 nt, Mycobacterium tuberculosis H37Rv
cguagaugguggucaccaccauc

SEQ ID NO: 3276446 - RNA, 23 nt, Mycobacterium tuberculosis H37Rv
cguagauggugguggcccggcug

SEQ ID NO: 3276447 - RNA, 15 nt, Mycobacterium tuberculosis H37Rv
cguagcaacccagga

SEQ ID NO: 3276448 - RNA, 15 nt, Mycobacterium tuberculosis H37Rv
cguagcaccacaucg

SEQ ID NO: 3276449 - RNA, 17 nt, Mycobacterium tuberculosis H37Rv
cguagcaccacaucggu

SEQ ID NO: 3276450 - RNA, 16 nt, Mycobacterium tuberculosis H37Rv
cguagcaccggucccu

SEQ ID NO: 3276451 - RNA, 15 nt, Mycobacterium tuberculosis H37Rv
cguagcaggucgacg

SEQ ID NO: 3276452 - RNA, 16 nt, Mycobacterium tuberculosis H37Rv
cguagcaggucgacgg

SEQ ID NO: 3276453 - RNA, 19 nt, Mycobacterium tuberculosis H37Rv
cguagcagguguaggugcc

SEQ ID NO: 3276454 - RNA, 15 nt, Mycobacterium tuberculosis H37Rv
cguagcaucgggcga

SEQ ID NO: 3276455 - RNA, 21 nt, Mycobacterium tuberculosis H37Rv
cgucaccgccgucaccgccau

SEQ ID NO: 3276456 - RNA, 14 nt, Mycobacterium tuberculosis H37Rv
cgucaccgccguug

SEQ ID NO: 3276457 - RNA, 17 nt, Mycobacterium tuberculosis H37Rv
cgucaccgccguugccg

SEQ ID NO: 3276458 - RNA, 22 nt, Mycobacterium tuberculosis H37Rv
cgucaccgccguugccgccggc

SEQ ID NO: 3276459 - RNA, 15 nt, Mycobacterium tuberculosis H37Rv
cgucaccgcgacccc

SEQ ID NO: 3276460 - RNA, 12 nt, Mycobacterium tuberculosis H37Rv
cgucaccgcgcg

SEQ ID NO: 3276461 - RNA, 13 nt, Mycobacterium tuberculosis H37Rv
cgucaccgcgggu

SEQ ID NO: 3276462 - RNA, 13 nt, Mycobacterium tuberculosis H37Rv
cgucaccgcugag

SEQ ID NO: 3276463 - RNA, 16 nt, Mycobacterium tuberculosis H37Rv
cgucaccggaaucccc

SEQ ID NO: 3276464 - RNA, 16 nt, Mycobacterium tuberculosis H37Rv
cgucaccggaggccgc

SEQ ID NO: 3276465 - RNA, 23 nt, Mycobacterium tuberculosis H37Rv
cgucaccguacgggacgaagacc

SEQ ID NO: 3276466 - RNA, 17 nt, Mycobacterium tuberculosis H37Rv
cgucaccguguugcacg

SEQ ID NO: 3276467 - RNA, 22 nt, Mycobacterium tuberculosis H37Rv
cgucaccguuguucccauagcc

SEQ ID NO: 3276468 - RNA, 16 nt, Mycobacterium tuberculosis H37Rv
cgucacgcaaccggcg

SEQ ID NO: 3276469 - RNA, 18 nt, Mycobacterium tuberculosis H37Rv
cgucacgcaaccggcgga

SEQ ID NO: 3276470 - RNA, 14 nt, Mycobacterium tuberculosis H37Rv
cgucacgccaccgc

SEQ ID NO: 3276471 - RNA, 16 nt, Mycobacterium tuberculosis H37Rv
cgucacgccaccgcaa

SEQ ID NO: 3276472 - RNA, 17 nt, Mycobacterium tuberculosis H37Rv
cgucacgcgcggcggcg

SEQ ID NO: 3276473 - RNA, 23 nt, Mycobacterium tuberculosis H37Rv
cgucacgcggaaaccaucgccag

SEQ ID NO: 3276474 - RNA, 12 nt, Mycobacterium tuberculosis H37Rv
cgucacgcgggu

SEQ ID NO: 3276475 - RNA, 23 nt, Mycobacterium tuberculosis H37Rv
cgucacggaggccuccacauacg

SEQ ID NO: 3276476 - RNA, 17 nt, Mycobacterium tuberculosis H37Rv
cgucacgggguccgaug

SEQ ID NO: 3276477 - RNA, 22 nt, Mycobacterium tuberculosis H37Rv
cgucacgguggacgauacgcgc

SEQ ID NO: 3276478 - RNA, 14 nt, Mycobacterium tuberculosis H37Rv
cgucacguaauucc

SEQ ID NO: 3276479 - RNA, 18 nt, Mycobacterium tuberculosis H37Rv
cgucacguaauuccccag

SEQ ID NO: 3276480 - RNA, 19 nt, Mycobacterium tuberculosis H37Rv
cgucacguaauuccccagg

SEQ ID NO: 3276481 - RNA, 20 nt, Mycobacterium tuberculosis H37Rv
cgucacguaauuccccaggu

SEQ ID NO: 3276482 - RNA, 13 nt, Mycobacterium tuberculosis H37Rv
cgucacgucgacg

SEQ ID NO: 3276483 - RNA, 15 nt, Mycobacterium tuberculosis H37Rv
cgucacgucgacggc

SEQ ID NO: 3276484 - RNA, 20 nt, Mycobacterium tuberculosis H37Rv
cgucacguggucggccaccc

SEQ ID NO: 3276485 - RNA, 16 nt, Mycobacterium tuberculosis H37Rv
cgucacguucggcgca

SEQ ID NO: 3276486 - RNA, 14 nt, Mycobacterium tuberculosis H37Rv
cgucacucccgaca

SEQ ID NO: 3276487 - RNA, 17 nt, Mycobacterium tuberculosis H37Rv
cgucacucccuggccgc

SEQ ID NO: 3276488 - RNA, 14 nt, Mycobacterium tuberculosis H37Rv
cgucacugaugggc

SEQ ID NO: 3276489 - RNA, 22 nt, Mycobacterium tuberculosis H37Rv
cgucacugcgaaaaaucaugcc

SEQ ID NO: 3276490 - RNA, 15 nt, Mycobacterium tuberculosis H37Rv
cgucacuucccggau

SEQ ID NO: 3276491 - RNA, 23 nt, Mycobacterium tuberculosis H37Rv
cgucacuucccggauagacggcg

SEQ ID NO: 3276492 - RNA, 14 nt, Mycobacterium tuberculosis H37Rv
cgucagaacaccgg

SEQ ID NO: 3276493 - RNA, 16 nt, Mycobacterium tuberculosis H37Rv
cgucagauccggccgu

SEQ ID NO: 3276494 - RNA, 21 nt, Mycobacterium tuberculosis H37Rv
cgucagcaccccgccgccugc

SEQ ID NO: 3276495 - RNA, 22 nt, Mycobacterium tuberculosis H37Rv
cgucagcaugggaauccgcugu

SEQ ID NO: 3276496 - RNA, 16 nt, Mycobacterium tuberculosis H37Rv
cgucagccaccgcaug

SEQ ID NO: 3276497 - RNA, 13 nt, Mycobacterium tuberculosis H37Rv
cgucagcccaggu

SEQ ID NO: 3276498 - RNA, 16 nt, Mycobacterium tuberculosis H37Rv
cgucagcccgacguug

SEQ ID NO: 3276499 - RNA, 14 nt, Mycobacterium tuberculosis H37Rv
cgucagccguucgg

SEQ ID NO: 3276500 - RNA, 22 nt, Mycobacterium tuberculosis H37Rv
cgucagccguucggcuaagccu

SEQ ID NO: 3276501 - RNA, 12 nt, Mycobacterium tuberculosis H37Rv
cgucagcgccgc

SEQ ID NO: 3276502 - RNA, 13 nt, Mycobacterium tuberculosis H37Rv
cgucagcgccgcc

SEQ ID NO: 3276503 - RNA, 14 nt, Mycobacterium tuberculosis H37Rv
cgucagcgccgccg

SEQ ID NO: 3276504 - RNA, 15 nt, Mycobacterium tuberculosis H37Rv
cgucagcgccgcuga

SEQ ID NO: 3276505 - RNA, 18 nt, Mycobacterium tuberculosis H37Rv
cgucagcgcgaccgucag

SEQ ID NO: 3276506 - RNA, 14 nt, Mycobacterium tuberculosis H37Rv
cgucagcgcgccgu

SEQ ID NO: 3276507 - RNA, 14 nt, Mycobacterium tuberculosis H37Rv
cgucagcggcggcc

SEQ ID NO: 3276508 - RNA, 16 nt, Mycobacterium tuberculosis H37Rv
cgucagcgggcagcag

SEQ ID NO: 3276509 - RNA, 13 nt, Mycobacterium tuberculosis H37Rv
cgucagcgucuga

SEQ ID NO: 3276510 - RNA, 14 nt, Mycobacterium tuberculosis H37Rv
cgucagcucaccac

SEQ ID NO: 3276511 - RNA, 22 nt, Mycobacterium tuberculosis H37Rv
cgucagcuguuugccggcuuug

SEQ ID NO: 3276512 - RNA, 15 nt, Mycobacterium tuberculosis H37Rv
cgucaggaaccaccc

SEQ ID NO: 3276513 - RNA, 20 nt, Mycobacterium tuberculosis H37Rv
cgucaggcacaacgcgacgc

SEQ ID NO: 3276514 - RNA, 22 nt, Mycobacterium tuberculosis H37Rv
cgucaggcagcuccgccgccga

SEQ ID NO: 3276515 - RNA, 15 nt, Mycobacterium tuberculosis H37Rv
cgucaggugcgcgac

SEQ ID NO: 3276516 - RNA, 19 nt, Mycobacterium tuberculosis H37Rv
cgucagguuccgcgacaac

SEQ ID NO: 3276517 - RNA, 17 nt, Mycobacterium tuberculosis H37Rv
cgucaguccucaucgag

SEQ ID NO: 3276518 - RNA, 19 nt, Mycobacterium tuberculosis H37Rv
cgucaguccucaucgagcg

SEQ ID NO: 3276519 - RNA, 20 nt, Mycobacterium tuberculosis H37Rv
cgucagugccccgcagcacu

SEQ ID NO: 3276520 - RNA, 16 nt, Mycobacterium tuberculosis H37Rv
cgucaguucggugugc

SEQ ID NO: 3276521 - RNA, 13 nt, Mycobacterium tuberculosis H37Rv
cgucaguugagaa

SEQ ID NO: 3276522 - RNA, 22 nt, Mycobacterium tuberculosis H37Rv
cgucauaagacggauuguccgg

SEQ ID NO: 3276523 - RNA, 17 nt, Mycobacterium tuberculosis H37Rv
cgucauacucgacaccg

SEQ ID NO: 3276524 - RNA, 13 nt, Mycobacterium tuberculosis H37Rv
cgucaucaggucg

SEQ ID NO: 3276525 - RNA, 12 nt, Mycobacterium tuberculosis H37Rv
cgucauccaccg

SEQ ID NO: 3276526 - RNA, 22 nt, Mycobacterium tuberculosis H37Rv
cgucaucccgauguaccccagc

SEQ ID NO: 3276527 - RNA, 16 nt, Mycobacterium tuberculosis H37Rv
cgucauccuggucacc

SEQ ID NO: 3276528 - RNA, 17 nt, Mycobacterium tuberculosis H37Rv
cgucauccuggucacca

SEQ ID NO: 3276529 - RNA, 19 nt, Mycobacterium tuberculosis H37Rv
cgucauccuggucaccagc

SEQ ID NO: 3276530 - RNA, 17 nt, Mycobacterium tuberculosis H37Rv
cgucaucgacgagcgau

SEQ ID NO: 3276531 - RNA, 11 nt, Mycobacterium tuberculosis H37Rv
cgucaucgacu

SEQ ID NO: 3276532 - RNA, 17 nt, Mycobacterium tuberculosis H37Rv
cgucaucgccggguagc

SEQ ID NO: 3276533 - RNA, 14 nt, Mycobacterium tuberculosis H37Rv
cgucaucgcggugu

SEQ ID NO: 3276534 - RNA, 19 nt, Mycobacterium tuberculosis H37Rv
cgucaucgcguagugaugg

SEQ ID NO: 3276535 - RNA, 21 nt, Mycobacterium tuberculosis H37Rv
cgucaucggcuggccgcgccu

SEQ ID NO: 3276536 - RNA, 15 nt, Mycobacterium tuberculosis H37Rv
cgucaucggggccug

SEQ ID NO: 3276537 - RNA, 18 nt, Mycobacterium tuberculosis H37Rv
cgucaucgucggcggauu

SEQ ID NO: 3276538 - RNA, 23 nt, Mycobacterium tuberculosis H37Rv
cgucaucgucggcggauucacgc

SEQ ID NO: 3276539 - RNA, 22 nt, Mycobacterium tuberculosis H37Rv
cgucaucugguggaccuccgga

SEQ ID NO: 3276540 - RNA, 23 nt, Mycobacterium tuberculosis H37Rv
cgucaugaagccguugccgccac

SEQ ID NO: 3276541 - RNA, 18 nt, Mycobacterium tuberculosis H37Rv
cgucaugcccaucuccaa

SEQ ID NO: 3276542 - RNA, 20 nt, Mycobacterium tuberculosis H37Rv
cgucauggcccgaucgaccg

SEQ ID NO: 3276543 - RNA, 12 nt, Mycobacterium tuberculosis H37Rv
cguccaacccag

SEQ ID NO: 3276544 - RNA, 17 nt, Mycobacterium tuberculosis H37Rv
cguccaagccagcguug

SEQ ID NO: 3276545 - RNA, 20 nt, Mycobacterium tuberculosis H37Rv
cguccaagccguagaccagg

SEQ ID NO: 3276546 - RNA, 23 nt, Mycobacterium tuberculosis H37Rv
cguccaccacaccugcggcugcu

SEQ ID NO: 3276547 - RNA, 12 nt, Mycobacterium tuberculosis H37Rv
cguccaccagcc

SEQ ID NO: 3276548 - RNA, 21 nt, Mycobacterium tuberculosis H37Rv
cguccacccacgaucagcagc

SEQ ID NO: 3276549 - RNA, 13 nt, Mycobacterium tuberculosis H37Rv
cguccaccgacgu

SEQ ID NO: 3276550 - RNA, 24 nt, Mycobacterium tuberculosis H37Rv
cguccaccgacguggccagcccgc

SEQ ID NO: 3276551 - RNA, 15 nt, Mycobacterium tuberculosis H37Rv
cguccuuuccaggag

SEQ ID NO: 3276552 - RNA, 20 nt, Mycobacterium tuberculosis H37Rv
cgucgaaaaaucgaucgugu

SEQ ID NO: 3276553 - RNA, 23 nt, Mycobacterium tuberculosis H37Rv
cgucgaaccagaggucacgcagc

SEQ ID NO: 3276554 - RNA, 17 nt, Mycobacterium tuberculosis H37Rv
cgucgaaccagucgaag

SEQ ID NO: 3276555 - RNA, 17 nt, Mycobacterium tuberculosis H37Rv
cgucgaacgguagcacg

SEQ ID NO: 3276556 - RNA, 18 nt, Mycobacterium tuberculosis H37Rv
cgucgaacuuugucgcgc

SEQ ID NO: 3276557 - RNA, 22 nt, Mycobacterium tuberculosis H37Rv
cgucgaacuuugucgcgcugcu

SEQ ID NO: 3276558 - RNA, 22 nt, Mycobacterium tuberculosis H37Rv
cgucgaagaccucaacccccuu

SEQ ID NO: 3276559 - RNA, 18 nt, Mycobacterium tuberculosis H37Rv
cgucgaagacgaacgugu

SEQ ID NO: 3276560 - RNA, 13 nt, Mycobacterium tuberculosis H37Rv
cgucgaagacggc

SEQ ID NO: 3276561 - RNA, 14 nt, Mycobacterium tuberculosis H37Rv
cgucgaagcgaaca

SEQ ID NO: 3276562 - RNA, 18 nt, Mycobacterium tuberculosis H37Rv
cgucgaagggaucacgac

SEQ ID NO: 3276563 - RNA, 19 nt, Mycobacterium tuberculosis H37Rv
cgucgaaggugaccaggcg

SEQ ID NO: 3276564 - RNA, 17 nt, Mycobacterium tuberculosis H37Rv
cgucgaaguagccgacg

SEQ ID NO: 3276565 - RNA, 21 nt, Mycobacterium tuberculosis H37Rv
cgucgaaguuggcgaagcccg

SEQ ID NO: 3276566 - RNA, 19 nt, Mycobacterium tuberculosis H37Rv
cgucgacaacgaucgcgcg

SEQ ID NO: 3276567 - RNA, 22 nt, Mycobacterium tuberculosis H37Rv
cgucgacaacgaucgcgcgagc

SEQ ID NO: 3276568 - RNA, 13 nt, Mycobacterium tuberculosis H37Rv
cgucgacaccgag

SEQ ID NO: 3276569 - RNA, 13 nt, Mycobacterium tuberculosis H37Rv
cgucgacacggug

SEQ ID NO: 3276570 - RNA, 14 nt, Mycobacterium tuberculosis H37Rv
cgucgacacgguga

SEQ ID NO: 3276571 - RNA, 16 nt, Mycobacterium tuberculosis H37Rv
cgucgacacggugauc

SEQ ID NO: 3276572 - RNA, 22 nt, Mycobacterium tuberculosis H37Rv
cgucgacagcgucucgccggga

SEQ ID NO: 3276573 - RNA, 15 nt, Mycobacterium tuberculosis H37Rv
cgucgacaucgguga

SEQ ID NO: 3276574 - RNA, 22 nt, Mycobacterium tuberculosis H37Rv
cgucgaccacaggcaucggagg

SEQ ID NO: 3276575 - RNA, 21 nt, Mycobacterium tuberculosis H37Rv
cgucgaccacgacguucgacg

SEQ ID NO: 3276576 - RNA, 13 nt, Mycobacterium tuberculosis H37Rv
cgucgaccaggcc

SEQ ID NO: 3276577 - RNA, 21 nt, Mycobacterium tuberculosis H37Rv
cgucgacccccugccacagcg

SEQ ID NO: 3276578 - RNA, 22 nt, Mycobacterium tuberculosis H37Rv
cgucgacccccugccacagcga

SEQ ID NO: 3276579 - RNA, 12 nt, Mycobacterium tuberculosis H37Rv
cgucgaccgaac

SEQ ID NO: 3276580 - RNA, 22 nt, Mycobacterium tuberculosis H37Rv
cgucgaccgaacccgacgucgc

SEQ ID NO: 3276581 - RNA, 15 nt, Mycobacterium tuberculosis H37Rv
cgucgaccgcggccc

SEQ ID NO: 3276582 - RNA, 14 nt, Mycobacterium tuberculosis H37Rv
cgucgaccggcggg

SEQ ID NO: 3276583 - RNA, 15 nt, Mycobacterium tuberculosis H37Rv
cgucgaccggcggga

SEQ ID NO: 3276584 - RNA, 18 nt, Mycobacterium tuberculosis H37Rv
cgucgaccgugucaccgc

SEQ ID NO: 3276585 - RNA, 21 nt, Mycobacterium tuberculosis H37Rv
cgucgaccgugucaccgccgg

SEQ ID NO: 3276586 - RNA, 13 nt, Mycobacterium tuberculosis H37Rv
cgucgacgaucag

SEQ ID NO: 3276587 - RNA, 14 nt, Mycobacterium tuberculosis H37Rv
cgucgacgaucagc

SEQ ID NO: 3276588 - RNA, 20 nt, Mycobacterium tuberculosis H37Rv
cgucgacgcccauggcgucg

SEQ ID NO: 3276589 - RNA, 16 nt, Mycobacterium tuberculosis H37Rv
cgucgacgccggccag

SEQ ID NO: 3276590 - RNA, 20 nt, Mycobacterium tuberculosis H37Rv
cgucgacgcgggagucaucg

SEQ ID NO: 3276591 - RNA, 22 nt, Mycobacterium tuberculosis H37Rv
cgucgacgcgggagucaucgcg

SEQ ID NO: 3276592 - RNA, 19 nt, Mycobacterium tuberculosis H37Rv
cgucgacgcgguccucgag

SEQ ID NO: 3276593 - RNA, 21 nt, Mycobacterium tuberculosis H37Rv
cgucgacggccuggggcagcc

SEQ ID NO: 3276594 - RNA, 16 nt, Mycobacterium tuberculosis H37Rv
cgucgacggucuggcc

SEQ ID NO: 3276595 - RNA, 16 nt, Mycobacterium tuberculosis H37Rv
cgucgacgucgacggc

SEQ ID NO: 3276596 - RNA, 17 nt, Mycobacterium tuberculosis H37Rv
cgucgacgucguagacc

SEQ ID NO: 3276597 - RNA, 13 nt, Mycobacterium tuberculosis H37Rv
cgucgacucggcg

SEQ ID NO: 3276598 - RNA, 16 nt, Mycobacterium tuberculosis H37Rv
cgucgacuucagcggc

SEQ ID NO: 3276599 - RNA, 18 nt, Mycobacterium tuberculosis H37Rv
cgucgacuucagcggccg

SEQ ID NO: 3276600 - RNA, 22 nt, Mycobacterium tuberculosis H37Rv
cgucgagcaacgugacccggau

SEQ ID NO: 3276601 - RNA, 18 nt, Mycobacterium tuberculosis H37Rv
cgucgagcaccacccggg

SEQ ID NO: 3276602 - RNA, 14 nt, Mycobacterium tuberculosis H37Rv
cgucgagcaccucc

SEQ ID NO: 3276603 - RNA, 15 nt, Mycobacterium tuberculosis H37Rv
cgucgagcaccuugg

SEQ ID NO: 3276604 - RNA, 18 nt, Mycobacterium tuberculosis H37Rv
cgucgagcacguccucga

SEQ ID NO: 3276605 - RNA, 15 nt, Mycobacterium tuberculosis H37Rv
cgucgagcagccgcg

SEQ ID NO: 3276606 - RNA, 15 nt, Mycobacterium tuberculosis H37Rv
cgucgagcagcgcca

SEQ ID NO: 3276607 - RNA, 14 nt, Mycobacterium tuberculosis H37Rv
cgucgagccgccag

SEQ ID NO: 3276608 - RNA, 12 nt, Mycobacterium tuberculosis H37Rv
cgucgagcgcgg

SEQ ID NO: 3276609 - RNA, 15 nt, Mycobacterium tuberculosis H37Rv
cgucgagcgcggugc

SEQ ID NO: 3276610 - RNA, 19 nt, Mycobacterium tuberculosis H37Rv
cgucgagcgcggugccgcc

SEQ ID NO: 3276611 - RNA, 19 nt, Mycobacterium tuberculosis H37Rv
cgucgagcgcgucggucac

SEQ ID NO: 3276612 - RNA, 14 nt, Mycobacterium tuberculosis H37Rv
cgucgagcgcuccc

SEQ ID NO: 3276613 - RNA, 14 nt, Mycobacterium tuberculosis H37Rv
cgucgagcgucugc

SEQ ID NO: 3276614 - RNA, 22 nt, Mycobacterium tuberculosis H37Rv
cgucgagcucguccucgucuuc

SEQ ID NO: 3276615 - RNA, 20 nt, Mycobacterium tuberculosis H37Rv
cgucgaggaagaucaccucc

SEQ ID NO: 3276616 - RNA, 23 nt, Mycobacterium tuberculosis H37Rv
cgucgaggcacgagccaucgucg

SEQ ID NO: 3276617 - RNA, 16 nt, Mycobacterium tuberculosis H37Rv
cgucgaggcugaccgu

SEQ ID NO: 3276618 - RNA, 18 nt, Mycobacterium tuberculosis H37Rv
cgucgaggcugaccgugg

SEQ ID NO: 3276619 - RNA, 21 nt, Mycobacterium tuberculosis H37Rv
cgucgaggcugaccguggcgc

SEQ ID NO: 3276620 - RNA, 17 nt, Mycobacterium tuberculosis H37Rv
cgucgagggagcgccgc

SEQ ID NO: 3276621 - RNA, 18 nt, Mycobacterium tuberculosis H37Rv
cgucgagggagcgccgca

SEQ ID NO: 3276622 - RNA, 16 nt, Mycobacterium tuberculosis H37Rv
cgucgaggucagcucc

SEQ ID NO: 3276623 - RNA, 16 nt, Mycobacterium tuberculosis H37Rv
cgucgagguccucgag

SEQ ID NO: 3276624 - RNA, 19 nt, Mycobacterium tuberculosis H37Rv
cgucgagguccucgucguc

SEQ ID NO: 3276625 - RNA, 22 nt, Mycobacterium tuberculosis H37Rv
cgucgagguggcgcacaucgcg

SEQ ID NO: 3276626 - RNA, 23 nt, Mycobacterium tuberculosis H37Rv
cgucgagguggcgcacaucgcga

SEQ ID NO: 3276627 - RNA, 24 nt, Mycobacterium tuberculosis H37Rv
cgucgaguagguaacgcgcacgcu

SEQ ID NO: 3276628 - RNA, 16 nt, Mycobacterium tuberculosis H37Rv
cgucgaguagugcagg

SEQ ID NO: 3276629 - RNA, 22 nt, Mycobacterium tuberculosis H37Rv
cgucgaguagugcaggugcccg

SEQ ID NO: 3276630 - RNA, 22 nt, Mycobacterium tuberculosis H37Rv
cgucgaguccaggccggcagcu

SEQ ID NO: 3276631 - RNA, 15 nt, Mycobacterium tuberculosis H37Rv
cgucgagucgacaag

SEQ ID NO: 3276632 - RNA, 14 nt, Mycobacterium tuberculosis H37Rv
cgucgagucgccga

SEQ ID NO: 3276633 - RNA, 18 nt, Mycobacterium tuberculosis H37Rv
cgucgaucacgucgucag

SEQ ID NO: 3276634 - RNA, 18 nt, Mycobacterium tuberculosis H37Rv
cgucgaucagaacgugac

SEQ ID NO: 3276635 - RNA, 22 nt, Mycobacterium tuberculosis H37Rv
cgucgaucagaacgugacgguc

SEQ ID NO: 3276636 - RNA, 14 nt, Mycobacterium tuberculosis H37Rv
cgucgaucagcggc

SEQ ID NO: 3276637 - RNA, 18 nt, Mycobacterium tuberculosis H37Rv
cgucgaucccggucggug

SEQ ID NO: 3276638 - RNA, 16 nt, Mycobacterium tuberculosis H37Rv
cgucgaucgacucaca

SEQ ID NO: 3276639 - RNA, 21 nt, Mycobacterium tuberculosis H37Rv
cgucgaucucgaucgacccgg

SEQ ID NO: 3276640 - RNA, 17 nt, Mycobacterium tuberculosis H37Rv
cgucgaucuugccgcgc

SEQ ID NO: 3276641 - RNA, 21 nt, Mycobacterium tuberculosis H37Rv
cgucgaucuugccgcgccgga

SEQ ID NO: 3276642 - RNA, 21 nt, Mycobacterium tuberculosis H37Rv
cgucgaugagguucaucgccg

SEQ ID NO: 3276643 - RNA, 14 nt, Mycobacterium tuberculosis H37Rv
cgucgaugaucugc

SEQ ID NO: 3276644 - RNA, 14 nt, Mycobacterium tuberculosis H37Rv
cgucgaugccggcu

SEQ ID NO: 3276645 - RNA, 21 nt, Mycobacterium tuberculosis H37Rv
cgucgaugccggcugccgcac

SEQ ID NO: 3276646 - RNA, 15 nt, Mycobacterium tuberculosis H37Rv
cgucgaugcgcugcu

SEQ ID NO: 3276647 - RNA, 21 nt, Mycobacterium tuberculosis H37Rv
cgucgcuuggaucgucgcugu

SEQ ID NO: 3276648 - RNA, 21 nt, Mycobacterium tuberculosis H37Rv
cgucggaauacaacagcuggg

SEQ ID NO: 3276649 - RNA, 13 nt, Mycobacterium tuberculosis H37Rv
cgucggacaccgc

SEQ ID NO: 3276650 - RNA, 17 nt, Mycobacterium tuberculosis H37Rv
cgucggacauaccgcga

SEQ ID NO: 3276651 - RNA, 17 nt, Mycobacterium tuberculosis H37Rv
cgucggagccggccacc

SEQ ID NO: 3276652 - RNA, 23 nt, Mycobacterium tuberculosis H37Rv
cgucggagccggccaccucggug

SEQ ID NO: 3276653 - RNA, 17 nt, Mycobacterium tuberculosis H37Rv
cgucggaguaccgcgcg

SEQ ID NO: 3276654 - RNA, 20 nt, Mycobacterium tuberculosis H37Rv
cgucggaguaccgcgcguug

SEQ ID NO: 3276655 - RNA, 21 nt, Mycobacterium tuberculosis H37Rv
cgucggauccgcccgccuuca

SEQ ID NO: 3276656 - RNA, 16 nt, Mycobacterium tuberculosis H37Rv
cgucggcaacgcuggc

SEQ ID NO: 3276657 - RNA, 14 nt, Mycobacterium tuberculosis H37Rv
cgucggcaccagca

SEQ ID NO: 3276658 - RNA, 22 nt, Mycobacterium tuberculosis H37Rv
cgucggcaccgguuuucgccgg

SEQ ID NO: 3276659 - RNA, 14 nt, Mycobacterium tuberculosis H37Rv
cgucggcagcagcg

SEQ ID NO: 3276660 - RNA, 22 nt, Mycobacterium tuberculosis H37Rv
cgucggcaggcagcucggcaac

SEQ ID NO: 3276661 - RNA, 14 nt, Mycobacterium tuberculosis H37Rv
cgucggcaucggcg

SEQ ID NO: 3276662 - RNA, 16 nt, Mycobacterium tuberculosis H37Rv
cgucggcauugcgcag

SEQ ID NO: 3276663 - RNA, 20 nt, Mycobacterium tuberculosis H37Rv
cgucggcauugcgcaggaug

SEQ ID NO: 3276664 - RNA, 24 nt, Mycobacterium tuberculosis H37Rv
cgucggccacccgguccaccgacc

SEQ ID NO: 3276665 - RNA, 20 nt, Mycobacterium tuberculosis H37Rv
cgucggccaccgccugagcg

SEQ ID NO: 3276666 - RNA, 17 nt, Mycobacterium tuberculosis H37Rv
cgucggccagcagauca

SEQ ID NO: 3276667 - RNA, 20 nt, Mycobacterium tuberculosis H37Rv
cgucggccagcagaucaggu

SEQ ID NO: 3276668 - RNA, 14 nt, Mycobacterium tuberculosis H37Rv
cgucggccagcagc

SEQ ID NO: 3276669 - RNA, 17 nt, Mycobacterium tuberculosis H37Rv
cgucggccagcagcaau

SEQ ID NO: 3276670 - RNA, 14 nt, Mycobacterium tuberculosis H37Rv
cgucggccaggauc

SEQ ID NO: 3276671 - RNA, 20 nt, Mycobacterium tuberculosis H37Rv
cgucggccaggaucaaccgg

SEQ ID NO: 3276672 - RNA, 17 nt, Mycobacterium tuberculosis H37Rv
cgucggccagugcgcgc

SEQ ID NO: 3276673 - RNA, 22 nt, Mycobacterium tuberculosis H37Rv
cgucggccaugguguucggcag

SEQ ID NO: 3276674 - RNA, 20 nt, Mycobacterium tuberculosis H37Rv
cgucggccgacaccgccacc

SEQ ID NO: 3276675 - RNA, 21 nt, Mycobacterium tuberculosis H37Rv
cgucggccgacaccgccacca

SEQ ID NO: 3276676 - RNA, 23 nt, Mycobacterium tuberculosis H37Rv
cgucggccgagucgauugccacc

SEQ ID NO: 3276677 - RNA, 16 nt, Mycobacterium tuberculosis H37Rv
cgucggccgcgcugcu

SEQ ID NO: 3276678 - RNA, 14 nt, Mycobacterium tuberculosis H37Rv
cgucggccggcacc

SEQ ID NO: 3276679 - RNA, 12 nt, Mycobacterium tuberculosis H37Rv
cgucggccugga

SEQ ID NO: 3276680 - RNA, 14 nt, Mycobacterium tuberculosis H37Rv
cgucggcgaaggug

SEQ ID NO: 3276681 - RNA, 21 nt, Mycobacterium tuberculosis H37Rv
cgucggcgaauccgccgccua

SEQ ID NO: 3276682 - RNA, 14 nt, Mycobacterium tuberculosis H37Rv
cgucggcgaccagg

SEQ ID NO: 3276683 - RNA, 20 nt, Mycobacterium tuberculosis H37Rv
cgucggcgagcagacgccgc

SEQ ID NO: 3276684 - RNA, 18 nt, Mycobacterium tuberculosis H37Rv
cgucggcgauggccagca

SEQ ID NO: 3276685 - RNA, 14 nt, Mycobacterium tuberculosis H37Rv
cgucggcgccgaac

SEQ ID NO: 3276686 - RNA, 17 nt, Mycobacterium tuberculosis H37Rv
cgucggcgccggcggcc

SEQ ID NO: 3276687 - RNA, 13 nt, Mycobacterium tuberculosis H37Rv
cgucggcgcggcc

SEQ ID NO: 3276688 - RNA, 13 nt, Mycobacterium tuberculosis H37Rv
cgucggcgcggcu

SEQ ID NO: 3276689 - RNA, 23 nt, Mycobacterium tuberculosis H37Rv
cgucggcggauucacgcacaagc

SEQ ID NO: 3276690 - RNA, 21 nt, Mycobacterium tuberculosis H37Rv
cgucggcggcgaacagcccca

SEQ ID NO: 3276691 - RNA, 22 nt, Mycobacterium tuberculosis H37Rv
cgucggcggcgaacagccccag

SEQ ID NO: 3276692 - RNA, 17 nt, Mycobacterium tuberculosis H37Rv
cgucggcgggcugcagu

SEQ ID NO: 3276693 - RNA, 18 nt, Mycobacterium tuberculosis H37Rv
cgucggcguacagcgccu

SEQ ID NO: 3276694 - RNA, 17 nt, Mycobacterium tuberculosis H37Rv
cgucggcguagacguag

SEQ ID NO: 3276695 - RNA, 12 nt, Mycobacterium tuberculosis H37Rv
cgucggcuagcu

SEQ ID NO: 3276696 - RNA, 15 nt, Mycobacterium tuberculosis H37Rv
cgucggcuccagguc

SEQ ID NO: 3276697 - RNA, 14 nt, Mycobacterium tuberculosis H37Rv
cgucggcucgucgc

SEQ ID NO: 3276698 - RNA, 23 nt, Mycobacterium tuberculosis H37Rv
cgucggcugccgcaaacgcggcg

SEQ ID NO: 3276699 - RNA, 17 nt, Mycobacterium tuberculosis H37Rv
cgucggcuucaccuuua

SEQ ID NO: 3276700 - RNA, 19 nt, Mycobacterium tuberculosis H37Rv
cgucgggaacuucuccgag

SEQ ID NO: 3276701 - RNA, 14 nt, Mycobacterium tuberculosis H37Rv
cgucgggacgccgc

SEQ ID NO: 3276702 - RNA, 17 nt, Mycobacterium tuberculosis H37Rv
cgucgggcacaccgacg

SEQ ID NO: 3276703 - RNA, 21 nt, Mycobacterium tuberculosis H37Rv
cgucgggcacaccgacgccgc

SEQ ID NO: 3276704 - RNA, 12 nt, Mycobacterium tuberculosis H37Rv
cgucgggcaccg

SEQ ID NO: 3276705 - RNA, 21 nt, Mycobacterium tuberculosis H37Rv
cgucgggcgucccggcgguca

SEQ ID NO: 3276706 - RNA, 20 nt, Mycobacterium tuberculosis H37Rv
cgucgggguugauguagagc

SEQ ID NO: 3276707 - RNA, 13 nt, Mycobacterium tuberculosis H37Rv
cgucggguagauc

SEQ ID NO: 3276708 - RNA, 18 nt, Mycobacterium tuberculosis H37Rv
cgucggguaggccgccgu

SEQ ID NO: 3276709 - RNA, 19 nt, Mycobacterium tuberculosis H37Rv
cgucgggucaaugcuggca

SEQ ID NO: 3276710 - RNA, 17 nt, Mycobacterium tuberculosis H37Rv
cgucggguccgcggccc

SEQ ID NO: 3276711 - RNA, 21 nt, Mycobacterium tuberculosis H37Rv
cgucggguuccuccucggcag

SEQ ID NO: 3276712 - RNA, 16 nt, Mycobacterium tuberculosis H37Rv
cgucggguugcgacga

SEQ ID NO: 3276713 - RNA, 21 nt, Mycobacterium tuberculosis H37Rv
cgucgguaagcgccaaggcga

SEQ ID NO: 3276714 - RNA, 22 nt, Mycobacterium tuberculosis H37Rv
cgucgguaagcgccaaggcgau

SEQ ID NO: 3276715 - RNA, 21 nt, Mycobacterium tuberculosis H37Rv
cgucggucaugucggccaccg

SEQ ID NO: 3276716 - RNA, 20 nt, Mycobacterium tuberculosis H37Rv
cgucggucucaugcacccgg

SEQ ID NO: 3276717 - RNA, 13 nt, Mycobacterium tuberculosis H37Rv
cgucggugagcgc

SEQ ID NO: 3276718 - RNA, 21 nt, Mycobacterium tuberculosis H37Rv
cgucggugagcugcgccagaa

SEQ ID NO: 3276719 - RNA, 22 nt, Mycobacterium tuberculosis H37Rv
cgucggugagcugcgccagaau

SEQ ID NO: 3276720 - RNA, 19 nt, Mycobacterium tuberculosis H37Rv
cgucggugcaauuucagcc

SEQ ID NO: 3276721 - RNA, 16 nt, Mycobacterium tuberculosis H37Rv
cgucggugccaccacg

SEQ ID NO: 3276722 - RNA, 15 nt, Mycobacterium tuberculosis H37Rv
cgucggugccgccgc

SEQ ID NO: 3276723 - RNA, 22 nt, Mycobacterium tuberculosis H37Rv
cgucggugccgccgccggcgcc

SEQ ID NO: 3276724 - RNA, 13 nt, Mycobacterium tuberculosis H37Rv
cgucggugccgcu

SEQ ID NO: 3276725 - RNA, 18 nt, Mycobacterium tuberculosis H37Rv
cgucggugcgccacgacc

SEQ ID NO: 3276726 - RNA, 18 nt, Mycobacterium tuberculosis H37Rv
cgucggugcgcgcggcga

SEQ ID NO: 3276727 - RNA, 18 nt, Mycobacterium tuberculosis H37Rv
cgucgguggcagcggugg

SEQ ID NO: 3276728 - RNA, 17 nt, Mycobacterium tuberculosis H37Rv
cgucgguguccucggug

SEQ ID NO: 3276729 - RNA, 16 nt, Mycobacterium tuberculosis H37Rv
cgucgguugccacgcc

SEQ ID NO: 3276730 - RNA, 16 nt, Mycobacterium tuberculosis H37Rv
cgucguacaugggcag

SEQ ID NO: 3276731 - RNA, 20 nt, Mycobacterium tuberculosis H37Rv
cgucguaccguucgggccgu

SEQ ID NO: 3276732 - RNA, 23 nt, Mycobacterium tuberculosis H37Rv
cgucguacggcucauaaaugggu

SEQ ID NO: 3276733 - RNA, 19 nt, Mycobacterium tuberculosis H37Rv
cgucguagcuggcgaucug

SEQ ID NO: 3276734 - RNA, 15 nt, Mycobacterium tuberculosis H37Rv
cgucguaguccaggc

SEQ ID NO: 3276735 - RNA, 16 nt, Mycobacterium tuberculosis H37Rv
cgucguaguuggugaa
